United States Patent 7,709,616 (MICRORNAS AND USES THEREOF) - sequence listing, part 19

SEQ ID NO: 573537 - RNA, 64 nt, hsa; identical to SEQ ID NO: 117047

SEQ ID NO: 573538 - RNA, 64 nt, hsa; identical to SEQ ID NO: 117048

SEQ ID NO: 573539 - RNA, 64 nt, hsa; identical to SEQ ID NO: 117049

SEQ ID NO: 573540 - RNA, 64 nt, hsa
ugauuguaugaaguuuuaaaaaaaacuacagcagccaaagaaacuauauauauauauauauaua

SEQ ID NO: 573541 - RNA, 64 nt, hsa
uauuuucagaucucucaaaaaucacaucauuugaccaaagaauaauuuaagacacauagaacag

SEQ ID NO: 573542 - RNA, 64 nt, hsa
cugggaauaucauagaguaacaagugcuggucagccaaagaaacauucacugcuggugaaccaa

SEQ ID NO: 573543 - RNA, 64 nt, hsa
uuuacauaugaagguuuaaaaauacaucauguggccaaagaaugagaaaggacagaauuaacca

SEQ ID NO: 573544 - RNA, 64 nt, hsa
aauauuacuuaaaaaguagaacagucaaugcaugccaaagaaccauaaacuagcagaggacauu

SEQ ID NO: 573545 - RNA, 64 nt, hsa
ucucucuccccuucucauacacaugccucccccaccaaagaauauaauguaaauuaaauccacu

SEQ ID NO: 573546 - RNA, 64 nt, hsa
caaaagcuaaaauaguucacuccucaacugagacccaaagaauuauagauauuuuucaugauga

SEQ ID NO: 573547 - RNA, 64 nt, hsa
uuuauuuuuccucauuucucaugggcaacagaggccaaagaaacgaagcaagacaaacagcaaa

SEQ ID NO: 573548 - RNA, 64 nt, hsa
uguaccuccuccaugucugucugcguguuuuccaccaaagaaugcaaagcagacuuccaggugu

SEQ ID NO: 573549 - RNA, 64 nt, hsa
cuuuucagcuuauuaaguagcucuuugguaaacaccaaagaaguuucugauagugucugcacaa

SEQ ID NO: 573550 - RNA, 64 nt, hsa
aaccaacauuuggugaggaauuagcaauuucuugccaaagaaaauugauucugcccaauuauuu

SEQ ID NO: 573551 - RNA, 64 nt, hsa
gaagggcacauuuaucuaggggcauuucagguuuccaaagaaaggaauguaugccugggaaaga

SEQ ID NO: 573552 - RNA, 64 nt, hsa
aaagccuuuauugacuaauugauuuaaccucaguccaaagaacagucucuauacuugcccucau

SEQ ID NO: 573553 - RNA, 64 nt, hsa
aaggguggaggguaaucucuacuuuccuauacugccaaagaaugugaggaagaaaugggacucu

SEQ ID NO: 573554 - RNA, 64 nt, hsa
uguugccagcuaugccuuugagaaccucgggaucccaaagaaugaggggaauuucuucagaaag

SEQ ID NO: 573555 - RNA, 64 nt, hsa
uguaacuuaaauuccaaacuaugacuacuacauuccaaagaaacaguugaauuaaacauuuuca

SEQ ID NO: 573556 - RNA, 64 nt, hsa
agcaaauaucuuaccaggcagccuaugaauuaacccaaagaagcuuugguugguuuugguggau

SEQ ID NO: 573557 - RNA, 64 nt, hsa
augaagcuugugaguagagcaaacaaacguuuuuccaaagaauucacagugcuccuuugcaauu

SEQ ID NO: 573558 - RNA, 64 nt, hsa
guuaguaaucccucacuuuaauaccucuuaggaaccaaagaaugccucuacaagcaaaaagaua

SEQ ID NO: 573559 - RNA, 64 nt, hsa
ugccccagcuggggaaaucaaaagggccaaagaaccaaagaagaaaguccacccuugguuccua

SEQ ID NO: 573560 - RNA, 64 nt, hsa
ccuuacccugccccagcuggggaaaucaaaagggccaaagaaccaaagaagaaaguccacccuu

SEQ ID NO: 573561 - RNA, 64 nt, hsa
caaauucuguaauuucacucaacgauuaagucuaccaaagaacacacugcauguaaaagaugua

SEQ ID NO: 573562 - RNA, 64 nt, hsa
aauuacaugauuaugauacuaaucuuuuaaguauccaaagaauauuaaaauacuucaauccugg

SEQ ID NO: 573563 - RNA, 64 nt, hsa
aagaaauauuaauaccacauggggagaaccccaaccaaagaaaucugaaauauauaguaaaugc

SEQ ID NO: 573564 - RNA, 64 nt, hsa
uaaagcaaaaagcaggccacaaccuuaaccaacaccaaagaaacauccaagcaauaaaguggaa

SEQ ID NO: 573565 - RNA, 64 nt, hsa
auuuuguaaugugguuuaacauccuuguuguuugccaaagaaauuucauuuggcugugaauauu

SEQ ID NO: 573566 - RNA, 64 nt, hsa
cucuguuucugcaggggaugauauuggugaguugccaaagaagcaauacagcauaucugcuuuu

SEQ ID NO: 573567 - RNA, 64 nt, hsa
agaauuucugaugauuuggguucuuuuccauaguccaaagaaacagaucagcucuucagguauc

SEQ ID NO: 573568 - RNA, 64 nt, hsa
ggucccagaacaaggaagucacuuuucaguggauccaaagaaucuacuccuuaaaccuggagaa

SEQ ID NO: 573569 - RNA, 64 nt, hsa
uuccucuaaagaugucuuuauguuuccuucauucccaaagaauauuuuuguggaauauaagauu

SEQ ID NO: 573570 - RNA, 64 nt, hsa
guacaccuucuguuucuuugcuuauuuuuuaacgccaaagaaagacucucagagaauagacaac

SEQ ID NO: 573571 - RNA, 64 nt, hsa
aggguauaaaugcauguuccugaggugcccucccccaaagaauguaccugcacucaaaccagga

SEQ ID NO: 573572 - RNA, 64 nt, hsa
ccccgaucccgccagaacggccuuuugcuuccagccaaagaacaccgccaacacgcacaccucc

SEQ ID NO: 573573 - RNA, 64 nt, hsa
aaauggagaguagugagcaaaacaucagauuucaccaaagaaccaaagugacuccacaauuggg

SEQ ID NO: 573574 - RNA, 64 nt, hsa
ggggaaacugcacuuagacugacagaauugaacaccaaagaauuugcuggcuuccaaauugggc

SEQ ID NO: 573575 - RNA, 64 nt, hsa
uagaggggguggggagguaaauuccucugacuugccaaagaaaaagaagggaaccacaguggau

SEQ ID NO: 573576 - RNA, 64 nt, hsa
uggcauuccugaauaauuuccaaauguuuuuaauccaaagaaaaagguuuaaagcuuauuuccc

SEQ ID NO: 573577 - RNA, 64 nt, hsa; identical to SEQ ID NO: 208972

SEQ ID NO: 573578 - RNA, 64 nt, hsa; identical to SEQ ID NO: 208973

SEQ ID NO: 573579 - RNA, 64 nt, hsa; identical to SEQ ID NO: 208974

SEQ ID NO: 573580 - RNA, 64 nt, hsa; identical to SEQ ID NO: 208975

SEQ ID NO: 573581 - RNA, 64 nt, hsa; identical to SEQ ID NO: 208976

SEQ ID NO: 573582 - RNA, 64 nt, hsa; identical to SEQ ID NO: 208977

SEQ ID NO: 573583 - RNA, 64 nt, hsa; identical to SEQ ID NO: 208978

SEQ ID NO: 573584 - RNA, 64 nt, hsa; identical to SEQ ID NO: 208979

SEQ ID NO: 573585 - RNA, 64 nt, hsa; identical to SEQ ID NO: 208980

SEQ ID NO: 573586 - RNA, 64 nt, hsa; identical to SEQ ID NO: 208981

SEQ ID NO: 573587 - RNA, 64 nt, hsa; identical to SEQ ID NO: 208982

SEQ ID NO: 573588 - RNA, 64 nt, hsa; identical to SEQ ID NO: 208983

SEQ ID NO: 573589 - RNA, 64 nt, hsa; identical to SEQ ID NO: 208984

SEQ ID NO: 573590 - RNA, 64 nt, hsa; identical to SEQ ID NO: 208985

SEQ ID NO: 573591 - RNA, 64 nt, hsa; identical to SEQ ID NO: 208986

SEQ ID NO: 573592 - RNA, 64 nt, hsa; identical to SEQ ID NO: 208987

SEQ ID NO: 573593 - RNA, 64 nt, hsa; identical to SEQ ID NO: 208988

SEQ ID NO: 573594 - RNA, 64 nt, hsa; identical to SEQ ID NO: 208989

SEQ ID NO: 573595 - RNA, 64 nt, hsa; identical to SEQ ID NO: 208990

SEQ ID NO: 573596 - RNA, 64 nt, hsa; identical to SEQ ID NO: 208991

SEQ ID NO: 573597 - RNA, 64 nt, hsa; identical to SEQ ID NO: 208992

SEQ ID NO: 573598 - RNA, 64 nt, hsa; identical to SEQ ID NO: 208993

SEQ ID NO: 573599 - RNA, 64 nt, hsa; identical to SEQ ID NO: 208994

SEQ ID NO: 573600 - RNA, 64 nt, hsa; identical to SEQ ID NO: 208995

SEQ ID NO: 573601 - RNA, 64 nt, hsa; identical to SEQ ID NO: 208996

SEQ ID NO: 573602 - RNA, 64 nt, hsa; identical to SEQ ID NO: 208997

SEQ ID NO: 573603 - RNA, 64 nt, hsa; identical to SEQ ID NO: 208998

SEQ ID NO: 573604 - RNA, 64 nt, hsa; identical to SEQ ID NO: 208999

SEQ ID NO: 573605 - RNA, 64 nt, hsa; identical to SEQ ID NO: 209000

SEQ ID NO: 573606 - RNA, 64 nt, hsa; identical to SEQ ID NO: 209001

SEQ ID NO: 573607 - RNA, 64 nt, hsa; identical to SEQ ID NO: 209002

SEQ ID NO: 573608 - RNA, 64 nt, hsa; identical to SEQ ID NO: 209003

SEQ ID NO: 573609 - RNA, 64 nt, hsa; identical to SEQ ID NO: 209004

SEQ ID NO: 573610 - RNA, 64 nt, hsa; identical to SEQ ID NO: 209005

SEQ ID NO: 573611 - RNA, 64 nt, hsa; identical to SEQ ID NO: 209006

SEQ ID NO: 573612 - RNA, 64 nt, hsa; identical to SEQ ID NO: 209007

SEQ ID NO: 573613 - RNA, 64 nt, hsa; identical to SEQ ID NO: 209008

SEQ ID NO: 573614 - RNA, 64 nt, hsa; identical to SEQ ID NO: 209009

SEQ ID NO: 573615 - RNA, 64 nt, hsa; identical to SEQ ID NO: 209010

SEQ ID NO: 573616 - RNA, 64 nt, hsa; identical to SEQ ID NO: 209011

SEQ ID NO: 573617 - RNA, 64 nt, hsa; identical to SEQ ID NO: 209012

SEQ ID NO: 573618 - RNA, 64 nt, hsa; identical to SEQ ID NO: 209013

SEQ ID NO: 573619 - RNA, 64 nt, hsa; identical to SEQ ID NO: 209014

SEQ ID NO: 573620 - RNA, 64 nt, hsa; identical to SEQ ID NO: 209015

SEQ ID NO: 573621 - RNA, 64 nt, hsa; identical to SEQ ID NO: 209016

SEQ ID NO: 573622 - RNA, 64 nt, hsa; identical to SEQ ID NO: 209017

SEQ ID NO: 573623 - RNA, 64 nt, hsa; identical to SEQ ID NO: 209018

SEQ ID NO: 573624 - RNA, 64 nt, hsa; identical to SEQ ID NO: 209019

SEQ ID NO: 573625 - RNA, 64 nt, hsa; identical to SEQ ID NO: 209020

SEQ ID NO: 573626 - RNA, 64 nt, hsa; identical to SEQ ID NO: 209021

SEQ ID NO: 573627 - RNA, 61 nt, hsa
cauugguggcagaugugagcgacaucaggcgcuuccucagugcauuucacgagccacaggu

SEQ ID NO: 573628 - RNA, 61 nt, hsa
aaccuccgccucucagguucaagugguucuccuuccucagccucccaaguagcugggauua

SEQ ID NO: 573629 - RNA, 61 nt, hsa
uuaguuuuuaaaauauuccguggucaaaauucuuccucacuauaauugguauuuacuuuua

SEQ ID NO: 573630 - RNA, 61 nt, hsa
aggagggaacagaccauggaaauuuaaacgacuuccucacggucacagaacuaguuuuuua

SEQ ID NO: 573631 - RNA, 61 nt, hsa
caggcaacgagugggccacaucucacuucugcuuccucaucucagcccacucugaaaaugu

SEQ ID NO: 573632 - RNA, 61 nt, hsa
uccucccccagcuccagggcuccuggauguccuuccucaacucccuccaccccuagacaau

SEQ ID NO: 573633 - RNA, 61 nt, hsa
ucccuucccuccuccuuccucauccuucugucuuccucaauucuccgucucuuuuuuuuca

SEQ ID NO: 573634 - RNA, 61 nt, hsa
guuaaccuuccaccuccucccuucccuccuccuuccucauccuucugucuuccucaauucu

SEQ ID NO: 573635 - RNA, 61 nt, hsa
uugagcugccaaagaagggucacaaaguguucuuccucauggaagaagugccucgggguug

SEQ ID NO: 573636 - RNA, 61 nt, hsa
uggugcaucucagaugcacuugacuucaagccuuccucaaccaaacugguccauuagauuc

SEQ ID NO: 573637 - RNA, 61 nt, hsa
cuccagccaccccuaccccagucacucgccccuuccucaucucuggaauuuggccaggcag

SEQ ID NO: 573638 - RNA, 61 nt, hsa
gcucaaccaguauuuauuucccuaaacgacccuuccucacauucccuucccuccaccucuc

SEQ ID NO: 573639 - RNA, 61 nt, hsa
uauuuccguguucuuaccuagccuccccccacuuccucaaaacaaacaagagauggcaaag

SEQ ID NO: 573640 - RNA, 61 nt, hsa
aagaugaaaagacaacaaaaguaucuucauacuuccucauccccucauugcaacaaaaccu

SEQ ID NO: 573641 - RNA, 61 nt, hsa
uagacuugaaaugucuccacauuuuggaggacuuccucagcccuuuucauugagggaaaau

SEQ ID NO: 573642 - RNA, 61 nt, hsa
uuugugaaaauagaguuuugguaaucacuuucuuccucaaaauaaguccuucuguuaauuu

SEQ ID NO: 573643 - RNA, 61 nt, hsa
guuugcuauuuuuguuuaacuuauuuuguagcuuccucacugguuuguguugcuaagcaaa

SEQ ID NO: 573644 - RNA, 61 nt, hsa
auauuuuccugacagacuugaaaacuaggaucuuccucagaugucuguaaauaacucuggu

SEQ ID NO: 573645 - RNA, 61 nt, hsa
gccagauuccgaaacucccauucuccaaugacuuccucaaccaauggguggccuugugacu

SEQ ID NO: 573646 - RNA, 61 nt, hsa
ucaaaguaguuccuauaggggcauugaggagcuuccucauucugggaaaacugagaaaacc

SEQ ID NO: 573647 - RNA, 61 nt, hsa
ucccaccucaccugagagccauugaauuugccuuccucaugaauuaaaaccucccccaagc

SEQ ID NO: 573648 - RNA, 61 nt, hsa
ccucaugaauuaaaaccucccccaagcagagcuuccucagagaaagugguucuaugaugac

SEQ ID NO: 573649 - RNA, 61 nt, hsa
ccccaagugaguggaagugacaugaugcagucuuccucauggggcaccugaaagaaauuag

SEQ ID NO: 573650 - RNA, 56 nt, hsa; identical to SEQ ID NO: 217988

SEQ ID NO: 573651 - RNA, 61 nt, hsa
cccuacagauuugcaggcugggaaggcuagacuuccucagcccgagggcugcccuuccaaa

SEQ ID NO: 573652 - RNA, 61 nt, hsa
gaggucugagcagggccuggccuuuccuccucuuccucacccucauccuuugggaggcuga

SEQ ID NO: 573653 - RNA, 61 nt, hsa
aaagagaggaaccaauaccuucaaggcucuucuuccucaccgagcaugcuucccuaggauc

SEQ ID NO: 573654 - RNA, 61 nt, hsa
agugacaaagccucugaaagaugcaucaucucuuccucacacccauuuagugggggauggg

SEQ ID NO: 573655 - RNA, 61 nt, hsa
gaauauauuaaauccacaaacacacuauauacuuccucaccacugacuauuuuaucaaauu

SEQ ID NO: 573656 - RNA, 61 nt, hsa
cccuuuauagugugaaaugaaaaauuagucacuuccucacauggaaggcagcuuuucagaa

SEQ ID NO: 573657 - RNA, 61 nt, hsa
agauaaucugaagcucacaaagaugaagugacuuccucaaaaucacaugguucaggacaga

SEQ ID NO: 573658 - RNA, 61 nt, hsa
gaagaucuguccugcaccaucugccuaauuccuuccucacagucuguagccaucugauauc

SEQ ID NO: 573659 - RNA, 61 nt, hsa
agaacagucucguagcugcaguucagcugugcuuccucagccuacuaucauaggcuuccuc

SEQ ID NO: 573660 - RNA, 61 nt, hsa
cagcugugcuuccucagccuacuaucauaggcuuccucagcccucugucauauggcuguuu

SEQ ID NO: 573661 - RNA, 61 nt, hsa
aaggguagcaaaggccaaugucuucuagcugcuuccucaaccccuguccccuggagaccag

SEQ ID NO: 573662 - RNA, 61 nt, hsa
cuuuaauggguauaauuuccuggcugccucccuuccucagcccauuagguuaaacaccaaa

SEQ ID NO: 573663 - RNA, 61 nt, hsa
aagaugaaaagacaacaaaaauaucuucauacuuccucauccccucauuggaacaaaaccu

SEQ ID NO: 573664 - RNA, 61 nt, hsa
uauuacccuauucuuaccuagccucccccgacuuccucaaaacaaacaagagauggcaaag

SEQ ID NO: 573665 - RNA, 61 nt, hsa
gagauuuuaaagacguucccuuuuguauucucuuccucauccaccgccacugggccuguca

SEQ ID NO: 573666 - RNA, 61 nt, hsa
gccuggccagcaccccacacuggagccaucucuuccucauauuucagcagugcagccgggg

SEQ ID NO: 573667 - RNA, 61 nt, hsa
cgacgacugcaaaguguaugcacaccgcaugcuuccucauccacauagugccagcagcagu

SEQ ID NO: 573668 - RNA, 61 nt, hsa
guuucuuagcuuggggagaugauggacuuagcuuccucaagauaaauuucuaguuuauuaa

SEQ ID NO: 573669 - RNA, 61 nt, hsa
ucauuauaaucuguauugacuuaaaaaguuucuuccucaugaugcuaauaguuuuuuguau

SEQ ID NO: 573670 - RNA, 61 nt, hsa
aaggucagugaagucuaucaaucauucuccccuuccucaucagcaaugguagauagaaaug

SEQ ID NO: 573671 - RNA, 61 nt, hsa
agugggaagugugaaggugaccgugaacauccuuccucaucgggucuguccccgucauuuc

SEQ ID NO: 573672 - RNA, 61 nt, hsa
ccaccguuguguccgagcccgcccuccccugcuuccucagcgggaccccuucaucuguugg

SEQ ID NO: 573673 - RNA, 61 nt, hsa
cuccaccccugcagccuccuggcccgcucaccuuccucaccccuccucugacccacccaug

SEQ ID NO: 573674 - RNA, 61 nt, hsa
uucaacaguggcuuuuucuuagauaaucgugcuuccucagcgcccgucggguuguggcauc

SEQ ID NO: 573675 - RNA, 61 nt, hsa
cacuguguuuccucugcacuguucccuuccacuuccucauccucuuugugacauggaaguu

SEQ ID NO: 573676 - RNA, 61 nt, hsa
uagauauaaaaaugauugugcccuaaccaaacuuccucagauugugcacuguuuguuuaaa

SEQ ID NO: 573677 - RNA, 61 nt, hsa
caggggugagccaccgcacccagcccucucucuuccucaaugcacucugcuucuuccguuc

SEQ ID NO: 573678 - RNA, 61 nt, hsa
cucaggagcuccaaccccggacggcagaugccuuccucagucucgagccucagucucccgu

SEQ ID NO: 573679 - RNA, 61 nt, hsa
acugaccaucucucacuguccuccccaccuucuuccucacucacacauuuuuuguacaucu

SEQ ID NO: 573680 - RNA, 61 nt, hsa
uagccggggcagacacccagcuggcuggguccuuccucagccuugccuccuccugucccca

SEQ ID NO: 573681 - RNA, 61 nt, hsa
uaaaauucuuauuuaaccuuccucccuucaucuuccucacccuuuuuacaguggaagaaag

SEQ ID NO: 573682 - RNA, 61 nt, hsa
cuuuuccaauccuaguugucuaccuucuuuucuuccucauuuccuucuuuuauuccucccc

SEQ ID NO: 573683 - RNA, 64 nt, hsa
aaccuucauaaagcaggucagcguggccugauugucccaggaccugaagggagcaaggauggcc

SEQ ID NO: 573684 - RNA, 64 nt, hsa
ucagcuugggaaugauggcugccaacucccaaucucccaggaaggcagggggcagaaucuuuuu

SEQ ID NO: 573685 - RNA, 64 nt, hsa
gacuccccuuucccuucccaaagaggauaggaccucccaggaugcuucccagccucuccucagu

SEQ ID NO: 573686 - RNA, 64 nt, hsa
caaagggugugccucguccugcccgcacugccucucccaggaacuggaaaagcccuguccggug

SEQ ID NO: 573687 - RNA, 64 nt, hsa
acaguguuucaagagacccuaaaaaaccugccugucccaggacccuaugguaaugaacaccaaa

SEQ ID NO: 573688 - RNA, 64 nt, hsa
cuccugcuucccuuaccagucgugcaccgcugacucccaggaagucuuuccugaagucugacca

SEQ ID NO: 573689 - RNA, 64 nt, hsa
uuuauccagcaaugccucaaggauguugcauugcucccaggaacuggcuauuagguaugucuug

SEQ ID NO: 573690 - RNA, 64 nt, hsa
ccaccucccaaccugaugaccucucuggcuggccucccaggaggagggacacuccagccccccu

SEQ ID NO: 573691 - RNA, 64 nt, hsa
ggggaaagaugagcuuuucuaggcuacaauuuucucccaggaagcuuugauuuuuaccguuucu

SEQ ID NO: 573692 - RNA, 64 nt, hsa
cgugugacgggggaaagccaaggucuggagaagcucccaggaacaaucgauggccuugcagcac

SEQ ID NO: 573693 - RNA, 64 nt, hsa
uguccaggccaggcacaguggcucacaccuguaaucccaggacuucgggaggcugaggcuggag

SEQ ID NO: 573694 - RNA, 64 nt, hsa
guccaagaggaguaaaggucaugacagaauuuacucccaggacaaucuaaguucugccacaagu

SEQ ID NO: 573695 - RNA, 64 nt, hsa
ggaccugccccugaccaaugauacccacaccuccucccaggaagacugcccaggccuuuguuag

SEQ ID NO: 573696 - RNA, 64 nt, hsa
cccccugccugauccccugcuggcugggggcagcucccaggauauccugccuuccaacuguuuc

SEQ ID NO: 573697 - RNA, 64 nt, hsa
ccugcuaggccccaguucuuccuccuucccccuuucccaggaaaggccagcccaguccauggcc

SEQ ID NO: 573698 - RNA, 64 nt, hsa
uggcugccaggggccugcagggucugggugggucucccaggagaggaauacugagugggagauc

SEQ ID NO: 573699 - RNA, 64 nt, hsa
uugcccugcuaggaauuagaagacagacaccaugucccaggacaguguuacuucuucugcauga

SEQ ID NO: 573700 - RNA, 64 nt, hsa
gaaugcugauucagagugcaccucuuugacuaggucccaggauccccuugucccuggaguaggg

SEQ ID NO: 573701 - RNA, 64 nt, hsa
gcccagagaugcccugggcucagaucuguaauucucccaggagcugugauagagcaggccacac

SEQ ID NO: 573702 - RNA, 64 nt, hsa
cagcucccacaaggguuccaggaauuccugguguucccaggacaccagacugcaauaacuggag

SEQ ID NO: 573703 - RNA, 64 nt, hsa
aguuccuggcccguggauguuaaagcugcucgauucccaggaucucggcugccuuuuccucuau

SEQ ID NO: 573704 - RNA, 64 nt, hsa
cccagccagacacucauucccauugaccaucuggucccaggagcucaggaggaggaccccaggg

SEQ ID NO: 573705 - RNA, 64 nt, hsa
uagcgucucugcacgugaccucugacaaagcccaucccaggagacggggugaagcuauucccca

SEQ ID NO: 573706 - RNA, 64 nt, hsa
agucuugcaagacccagggagaacccacugcuuuucccaggaggcuccaggauuaggaaaugug

SEQ ID NO: 573707 - RNA, 64 nt, hsa
ucccaccugccugggcgaaucuccuccaaggaagucccaggaggauggggaccaggaaggcugu

SEQ ID NO: 573708 - RNA, 64 nt, hsa
ugagggcugagucugguucccuaggggacccucaucccaggaacaacauuccagccccacccuc

SEQ ID NO: 573709 - RNA, 64 nt, hsa
cacuuugggaagccaaggugggcugaucacuugaucccaggaguuugagaccagccugggcacc

SEQ ID NO: 573710 - RNA, 64 nt, hsa
caacuauuggggaggcuaagguaggaucacuugaucccaggaggcggagguugcagugaguugc

SEQ ID NO: 573711 - RNA, 64 nt, hsa
gcuaauaagagguugggugaaagagugcaucuccucccaggauuccacaacaaaauucuuaucu

SEQ ID NO: 573712 - RNA, 64 nt, hsa
cucauucucaugccuguagguuuccauugcucugucccaggacacuugcgugccagagacgcca

SEQ ID NO: 573713 - RNA, 64 nt, hsa
cuggaucuuccccccacuccucacaccucacaugucccaggagcugccuucauucaggcgggua

SEQ ID NO: 573714 - RNA, 64 nt, hsa
caugcugguggccuucugaaucacugcauggaugucccaggaggcagcucuccccacacagcag

SEQ ID NO: 573715 - RNA, 64 nt, hsa
ugcauuuucuaagugggacauucaaaaaacucucucccaggaccucggaugaccauacucagac

SEQ ID NO: 573716 - RNA, 64 nt, hsa
uauagcaacucauuggugguagccaucaagcacuucccaggaucugcuccaacagaauauugcu

SEQ ID NO: 573717 - RNA, 64 nt, hsa
cuacuugggaggcugaggcaggagaaucgcuugaucccaggaaggcagagguggcagugagcug

SEQ ID NO: 573718 - RNA, 64 nt, hsa
ucugguagauagauagcauguaagggggugguugucccaggaggcagcugcugacagguuugcu

SEQ ID NO: 573719 - RNA, 64 nt, hsa
cguccagcccggggcagucugacugucggugcccucccaggaacggggaaggccuccgucugug

SEQ ID NO: 573720 - RNA, 64 nt, hsa
agaaaccuacaaaaugucaaaccagcuucccgacucccaggagcucaagccaagcccagaggca

SEQ ID NO: 573721 - RNA, 64 nt, hsa
uuuugcagcaguguaauaaagucaauuaaaaacuucccaggauuucuuuggacccaggaaacag

SEQ ID NO: 573722 - RNA, 64 nt, hsa
uguggguccuuucugugcacuaugaacgcuucuuucccaggacagaaaauguguagucuaccuu

SEQ ID NO: 573723 - RNA, 63 nt, hsa
cuccuccuggacuccccucccugccgaacacacaucccaggagucugggaaggagggacuguu

SEQ ID NO: 573724 - RNA, 64 nt, hsa
gugggcugucacugcuugagggagaauccucccuucccaggaggugcagacuucuuaaaaggag

SEQ ID NO: 573725 - RNA, 64 nt, hsa
ugugugcacacaugcagaggugagacccgcaggcucccaggaccagcagccacaagggcagggc

SEQ ID NO: 573726 - RNA, 64 nt, hsa
accaauuucccagggacuccaggguccugaggccucccaggagggccuugggggugaugacccc

SEQ ID NO: 573727 - RNA, 64 nt, hsa
aggguggggggagggcaccggagccuugccaccaucccaggacuuugggcaagucacccgcacu

SEQ ID NO: 573728 - RNA, 64 nt, hsa
aggggaggacccugagggcucagccagggaggggucccaggacucaacugggccccguuucuag

SEQ ID NO: 573729 - RNA, 64 nt, hsa
acuacuuucuuaauaucacuuuggucuccauuuuucccaggacaggaaauaugucccccccuaa

SEQ ID NO: 573730 - RNA, 64 nt, hsa
gccacuccaaucacccuacaagaugccaaggaggucccaggaaguccagcuccuuaaacugacg

SEQ ID NO: 573731 - RNA, 64 nt, hsa
ucauuuuuuuggucacccuuuaaguguccuucucucccaggaugagugaggagcugugcugaug

SEQ ID NO: 573732 - RNA, 64 nt, hsa
aguuggaggggugggcuucucuagcccugcccccucccaggagcccagccccucuggccaggac

SEQ ID NO: 573733 - RNA, 64 nt, hsa
ccuuagccgucugagugagcuguguaugaacaagucccaggaguuccaagagucuagagugguu

SEQ ID NO: 573734 - RNA, 64 nt, hsa
ucugggcgguggcuucacuccugagucugcaaaaucccaggaaacuugggucuugcugcccauc

SEQ ID NO: 573735 - RNA, 64 nt, hsa
ugaccacggccccaagcccagggcuggaggcaggucccaggacgcgccgcucccucaugcugcc

SEQ ID NO: 573736 - RNA, 64 nt, hsa
ugaccgcggccccgagccuggggcuggacgcaggucccaggacgugcugcucccuugugugagu

SEQ ID NO: 573737 - RNA, 64 nt, hsa
ugaccgcggccccgagccuggggcuggacgcaggucccaggacaugcugcucccuugugugagu

SEQ ID NO: 573738 - RNA, 64 nt, hsa
uggccugggccuccucacaacauggugucuggauucccaggaugagcaucccaggaucgcaaga

SEQ ID NO: 573739 - RNA, 64 nt, hsa
ucacaacauggugucuggauucccaggaugagcaucccaggaucgcaagagccauguagaagcu

SEQ ID NO: 573740 - RNA, 64 nt, hsa
cagcuuuagcuuucuccaccagauaaccagcuaaucccaggaauuugcugccccccaccagugg

SEQ ID NO: 573741 - RNA, 64 nt, hsa
agcauuuuuccccucugugcuggauacagacuucucccaggauccucucuuugggagcgaagcc

SEQ ID NO: 573742 - RNA, 64 nt, hsa
ugucagcuucggaagcaucucucgaggacucuggucccaggaugucucccaggacaagccaguc

SEQ ID NO: 573743 - RNA, 64 nt, hsa
aagcaucucucgaggacucuggucccaggaugucucccaggacaagccagucugccucuuccuc

SEQ ID NO: 573744 - RNA, 64 nt, hsa
ggcuuggaagggacuucucccgcaccccacucugucccaggacauagggcagggggccucacug

SEQ ID NO: 573745 - RNA, 64 nt, hsa
gcaggacccuuggcaggcaagccccucccuucacucccaggaccuaccuucugcuaguaaagga

SEQ ID NO: 573746 - RNA, 64 nt, hsa
accaggcgcccagcccugcggaggaggccggggcucccaggaagcggacgcccgguccccacac

SEQ ID NO: 573747 - RNA, 64 nt, hsa
guagugacauuggugagacaacagcccuaacacuucccaggaacugaagugccucaugugauug

SEQ ID NO: 573748 - RNA, 64 nt, hsa
cugugaauggcuguucuccccucacugcugagucucccaggacccccuuuggagaugcccaugg

SEQ ID NO: 573749 - RNA, 64 nt, hsa
gggagcuggacuucagggagccugagugaugcuuucccaggagcagggcagcuggcuggaccag

SEQ ID NO: 573750 - RNA, 64 nt, hsa
gaggacaccgggaggcuguuagggggucacugaaucccaggagccaaccucccccuuugcaggg

SEQ ID NO: 573751 - RNA, 64 nt, hsa
ggaaagcuuugagaguuuauguuuacucuuugagucccaggagaagccuggcacccucuuugca

SEQ ID NO: 573752 - RNA, 64 nt, hsa
gcgauggugccuggucucugaguaagaugccaggucccaggaacucaggcuucaggugagaagg

SEQ ID NO: 573753 - RNA, 64 nt, hsa
cuuaagaaggucgccuaagccuaagagaagacagucccaggagaagcuggccgggaccagccag

SEQ ID NO: 573754 - RNA, 64 nt, hsa
agguugcucuagauugagagaagagacaaacaccucccaggagacaguucaagaaagcuucaaa

SEQ ID NO: 573755 - RNA, 64 nt, hsa
ccccacuuauuccccauucuuccuaguuuucuccucccaggaacugggccaacucaccugaguc

SEQ ID NO: 573756 - RNA, 64 nt, hsa
ccagcaggugccucgauucccugcccuugugaccucccaggaaacagaacugaucugggacacu

SEQ ID NO: 573757 - RNA, 64 nt, hsa
gauucucuaaggagcacgaaagggggaaugccccucccaggaguuuaugggagaagggacuggg

SEQ ID NO: 573758 - RNA, 64 nt, hsa
uccuccacuacaaccuccaugaccuugagacgcaucccaggaggugacgaggcaggggcuccag

SEQ ID NO: 573759 - RNA, 64 nt, hsa
aggggcugcaccuucccccaggaaugacccucuaucccaggaccugagaagggccugcucaccc

SEQ ID NO: 573760 - RNA, 64 nt, hsa
ggucucuuuguugcuauguuuuuuuguuugaaguucccaggaauauuugagggguuccggugau

SEQ ID NO: 573761 - RNA, 64 nt, hsa
aaagggugucugaugugggguggggcuggcauccucccaggaagguucuaggugggaccccguc

SEQ ID NO: 573762 - RNA, 64 nt, hsa
cagaaugcuuuuaaauuuuccagggccuuucuccucccaggaucugggaaagcuugggaaccac

SEQ ID NO: 573763 - RNA, 64 nt, hsa
aacaggagaaucugggcccuaggagcccuguaacucccaggagagaccacugaaaauacuggag

SEQ ID NO: 573764 - RNA, 64 nt, hsa
acucaaagaaggccguguuuccaacauccucucaucccaggacauuuggggcaagugaguuagg

SEQ ID NO: 573765 - RNA, 64 nt, hsa
gaucugaacuggaagcagagguugagauucugccucccaggagagggauuuaccugcccccuag

SEQ ID NO: 573766 - RNA, 64 nt, hsa
gagggggcuuucuccccuuuugcuugagcaggguucccaggagggagaaagagaagacaagagc

SEQ ID NO: 573767 - RNA, 64 nt, hsa
gggagggugcugggccugacauggcuauauacccucccaggaguaaaagccaagcaagagguug

SEQ ID NO: 573768 - RNA, 64 nt, hsa; identical to SEQ ID NO: 260343

SEQ ID NO: 573769 - RNA, 64 nt, hsa; identical to SEQ ID NO: 260344

SEQ ID NO: 573770 - RNA, 64 nt, hsa; identical to SEQ ID NO: 260345

SEQ ID NO: 573771 - RNA, 64 nt, hsa; identical to SEQ ID NO: 260346

SEQ ID NO: 573772 - RNA, 64 nt, hsa; identical to SEQ ID NO: 260347

SEQ ID NO: 573773 - RNA, 64 nt, hsa; identical to SEQ ID NO: 260348

SEQ ID NO: 573774 - RNA, 64 nt, hsa; identical to SEQ ID NO: 260349

SEQ ID NO: 573775 - RNA, 64 nt, hsa; identical to SEQ ID NO: 260350

SEQ ID NO: 573776 - RNA, 57 nt, hsa; identical to SEQ ID NO: 260351

SEQ ID NO: 573777 - RNA, 64 nt, hsa; identical to SEQ ID NO: 260352

SEQ ID NO: 573778 - RNA, 64 nt, hsa; identical to SEQ ID NO: 260353

SEQ ID NO: 573779 - RNA, 64 nt, hsa; identical to SEQ ID NO: 260354

SEQ ID NO: 573780 - RNA, 64 nt, hsa; identical to SEQ ID NO: 260355

SEQ ID NO: 573781 - RNA, 64 nt, hsa; identical to SEQ ID NO: 260356

SEQ ID NO: 573782 - RNA, 64 nt, hsa; identical to SEQ ID NO: 260357

SEQ ID NO: 573783 - RNA, 64 nt, hsa; identical to SEQ ID NO: 260358

SEQ ID NO: 573784 - RNA, 64 nt, hsa; identical to SEQ ID NO: 260359

SEQ ID NO: 573785 - RNA, 64 nt, hsa; identical to SEQ ID NO: 260360

SEQ ID NO: 573786 - RNA, 64 nt, hsa; identical to SEQ ID NO: 260361

SEQ ID NO: 573787 - RNA, 64 nt, hsa; identical to SEQ ID NO: 260362

SEQ ID NO: 573788 - RNA, 64 nt, hsa; identical to SEQ ID NO: 260363

SEQ ID NO: 573789 - RNA, 64 nt, hsa; identical to SEQ ID NO: 260364

SEQ ID NO: 573790 - RNA, 64 nt, hsa; identical to SEQ ID NO: 260365

SEQ ID NO: 573791 - RNA, 64 nt, hsa; identical to SEQ ID NO: 260366

SEQ ID NO: 573792 - RNA, 64 nt, hsa; identical to SEQ ID NO: 260367

SEQ ID NO: 573793 - RNA, 64 nt, hsa; identical to SEQ ID NO: 260368

SEQ ID NO: 573794 - RNA, 64 nt, hsa; identical to SEQ ID NO: 260369

SEQ ID NO: 573795 - RNA, 64 nt, hsa; identical to SEQ ID NO: 260370

SEQ ID NO: 573796 - RNA, 64 nt, hsa; identical to SEQ ID NO: 260371

SEQ ID NO: 573797 - RNA, 64 nt, hsa; identical to SEQ ID NO: 260372

SEQ ID NO: 573798 - RNA, 64 nt, hsa; identical to SEQ ID NO: 260373

SEQ ID NO: 573799 - RNA, 64 nt, hsa; identical to SEQ ID NO: 260374

SEQ ID NO: 573800 - RNA, 64 nt, hsa; identical to SEQ ID NO: 260375

SEQ ID NO: 573801 - RNA, 64 nt, hsa; identical to SEQ ID NO: 260376

SEQ ID NO: 573802 - RNA, 64 nt, hsa; identical to SEQ ID NO: 260377

SEQ ID NO: 573803 - RNA, 64 nt, hsa; identical to SEQ ID NO: 260378

SEQ ID NO: 573804 - RNA, 64 nt, hsa; identical to SEQ ID NO: 260379

SEQ ID NO: 573805 - RNA, 64 nt, hsa; identical to SEQ ID NO: 260380

SEQ ID NO: 573806 - RNA, 64 nt, hsa; identical to SEQ ID NO: 260381

SEQ ID NO: 573807 - RNA, 64 nt, hsa; identical to SEQ ID NO: 260382

SEQ ID NO: 573808 - RNA, 64 nt, hsa; identical to SEQ ID NO: 260383

SEQ ID NO: 573809 - RNA, 64 nt, hsa; identical to SEQ ID NO: 260384

SEQ ID NO: 573810 - RNA, 64 nt, hsa; identical to SEQ ID NO: 260385

SEQ ID NO: 573811 - RNA, 64 nt, hsa; identical to SEQ ID NO: 260386

SEQ ID NO: 573812 - RNA, 64 nt, hsa; identical to SEQ ID NO: 260387

SEQ ID NO: 573813 - RNA, 64 nt, hsa; identical to SEQ ID NO: 260388

SEQ ID NO: 573814 - RNA, 64 nt, hsa; identical to SEQ ID NO: 260389

SEQ ID NO: 573815 - RNA, 64 nt, hsa; identical to SEQ ID NO: 260390

SEQ ID NO: 573816 - RNA, 64 nt, hsa; identical to SEQ ID NO: 260391

SEQ ID NO: 573817 - RNA, 64 nt, hsa; identical to SEQ ID NO: 260392

SEQ ID NO: 573818 - RNA, 64 nt, hsa; identical to SEQ ID NO: 260393

SEQ ID NO: 573819 - RNA, 64 nt, hsa; identical to SEQ ID NO: 260394

SEQ ID NO: 573820 - RNA, 64 nt, hsa; identical to SEQ ID NO: 260395

SEQ ID NO: 573821 - RNA, 64 nt, hsa; identical to SEQ ID NO: 260396

SEQ ID NO: 573822 - RNA, 64 nt, hsa; identical to SEQ ID NO: 260397

SEQ ID NO: 573823 - RNA, 64 nt, hsa; identical to SEQ ID NO: 260398

SEQ ID NO: 573824 - RNA, 64 nt, hsa; identical to SEQ ID NO: 260399

SEQ ID NO: 573825 - RNA, 64 nt, hsa; identical to SEQ ID NO: 260400

SEQ ID NO: 573826 - RNA, 64 nt, hsa; identical to SEQ ID NO: 260401

SEQ ID NO: 573827 - RNA, 64 nt, hsa; identical to SEQ ID NO: 260402

SEQ ID NO: 573828 - RNA, 64 nt, hsa; identical to SEQ ID NO: 260403

SEQ ID NO: 573829 - RNA, 64 nt, hsa; identical to SEQ ID NO: 260404

SEQ ID NO: 573830 - RNA, 64 nt, hsa; identical to SEQ ID NO: 260405

SEQ ID NO: 573831 - RNA, 64 nt, hsa; identical to SEQ ID NO: 260406

SEQ ID NO: 573832 - RNA, 64 nt, hsa; identical to SEQ ID NO: 260407

SEQ ID NO: 573833 - RNA, 64 nt, hsa; identical to SEQ ID NO: 260408

SEQ ID NO: 573834 - RNA, 64 nt, hsa; identical to SEQ ID NO: 260409

SEQ ID NO: 573835 - RNA, 64 nt, hsa; identical to SEQ ID NO: 260410

SEQ ID NO: 573836 - RNA, 64 nt, hsa; identical to SEQ ID NO: 260411

SEQ ID NO: 573837 - RNA, 64 nt, hsa; identical to SEQ ID NO: 260412

SEQ ID NO: 573838 - RNA, 64 nt, hsa; identical to SEQ ID NO: 260413

SEQ ID NO: 573839 - RNA, 64 nt, hsa; identical to SEQ ID NO: 260414

SEQ ID NO: 573840 - RNA, 64 nt, hsa; identical to SEQ ID NO: 260415

SEQ ID NO: 573841 - RNA, 64 nt, hsa; identical to SEQ ID NO: 260416

SEQ ID NO: 573842 - RNA, 64 nt, hsa; identical to SEQ ID NO: 260417

SEQ ID NO: 573843 - RNA, 64 nt, hsa; identical to SEQ ID NO: 260418

SEQ ID NO: 573844 - RNA, 64 nt, hsa; identical to SEQ ID NO: 260419

SEQ ID NO: 573845 - RNA, 64 nt, hsa; identical to SEQ ID NO: 260420

SEQ ID NO: 573846 - RNA, 64 nt, hsa; identical to SEQ ID NO: 260421

SEQ ID NO: 573847 - RNA, 64 nt, hsa; identical to SEQ ID NO: 260422

SEQ ID NO: 573848 - RNA, 64 nt, hsa; identical to SEQ ID NO: 260423

SEQ ID NO: 573849 - RNA, 64 nt, hsa; identical to SEQ ID NO: 260424

SEQ ID NO: 573850 - RNA, 64 nt, hsa; identical to SEQ ID NO: 260425

SEQ ID NO: 573851 - RNA, 64 nt, hsa; identical to SEQ ID NO: 260426

SEQ ID NO: 573852 - RNA, 64 nt, hsa; identical to SEQ ID NO: 260427

SEQ ID NO: 573853 - RNA, 64 nt, hsa; identical to SEQ ID NO: 260428

SEQ ID NO: 573854 - RNA, 64 nt, hsa; identical to SEQ ID NO: 260429

SEQ ID NO: 573855 - RNA, 64 nt, hsa; identical to SEQ ID NO: 260430

SEQ ID NO: 573856 - RNA, 64 nt, hsa; identical to SEQ ID NO: 260431

SEQ ID NO: 573857 - RNA, 64 nt, hsa; identical to SEQ ID NO: 260432

SEQ ID NO: 573858 - RNA, 64 nt, hsa; identical to SEQ ID NO: 260433

SEQ ID NO: 573859 - RNA, 64 nt, hsa; identical to SEQ ID NO: 260434

SEQ ID NO: 573860 - RNA, 64 nt, hsa; identical to SEQ ID NO: 260435

SEQ ID NO: 573861 - RNA, 64 nt, hsa; identical to SEQ ID NO: 260436

SEQ ID NO: 573862 - RNA, 64 nt, hsa; identical to SEQ ID NO: 260437

SEQ ID NO: 573863 - RNA, 64 nt, hsa; identical to SEQ ID NO: 260438

SEQ ID NO: 573864 - RNA, 64 nt, hsa; identical to SEQ ID NO: 260439

SEQ ID NO: 573865 - RNA, 64 nt, hsa; identical to SEQ ID NO: 260440

SEQ ID NO: 573866 - RNA, 64 nt, hsa; identical to SEQ ID NO: 260441

SEQ ID NO: 573867 - RNA, 64 nt, hsa; identical to SEQ ID NO: 260442

SEQ ID NO: 573868 - RNA, 64 nt, hsa; identical to SEQ ID NO: 260443

SEQ ID NO: 573869 - RNA, 64 nt, hsa; identical to SEQ ID NO: 260444

SEQ ID NO: 573870 - RNA, 64 nt, hsa; identical to SEQ ID NO: 260445

SEQ ID NO: 573871 - RNA, 64 nt, hsa; identical to SEQ ID NO: 260446

SEQ ID NO: 573872 - RNA, 64 nt, hsa; identical to SEQ ID NO: 260447

SEQ ID NO: 573873 - RNA, 64 nt, hsa; identical to SEQ ID NO: 260448

SEQ ID NO: 573874 - RNA, 64 nt, hsa; identical to SEQ ID NO: 260449

SEQ ID NO: 573875 - RNA, 64 nt, hsa; identical to SEQ ID NO: 260450

SEQ ID NO: 573876 - RNA, 64 nt, hsa; identical to SEQ ID NO: 260451

SEQ ID NO: 573877 - RNA, 64 nt, hsa; identical to SEQ ID NO: 260452

SEQ ID NO: 573878 - RNA, 64 nt, hsa; identical to SEQ ID NO: 260453

SEQ ID NO: 573879 - RNA, 64 nt, hsa; identical to SEQ ID NO: 260454

SEQ ID NO: 573880 - RNA, 64 nt, hsa; identical to SEQ ID NO: 260455

SEQ ID NO: 573881 - RNA, 64 nt, hsa; identical to SEQ ID NO: 260456

SEQ ID NO: 573882 - RNA, 64 nt, hsa; identical to SEQ ID NO: 260457

SEQ ID NO: 573883 - RNA, 64 nt, hsa; identical to SEQ ID NO: 260458

SEQ ID NO: 573884 - RNA, 64 nt, hsa; identical to SEQ ID NO: 260459

SEQ ID NO: 573885 - RNA, 64 nt, hsa; identical to SEQ ID NO: 260460

SEQ ID NO: 573886 - RNA, 64 nt, hsa; identical to SEQ ID NO: 260461

SEQ ID NO: 573887 - RNA, 64 nt, hsa; identical to SEQ ID NO: 260462

SEQ ID NO: 573888 - RNA, 64 nt, hsa; identical to SEQ ID NO: 260463

SEQ ID NO: 573889 - RNA, 64 nt, hsa; identical to SEQ ID NO: 260464

SEQ ID NO: 573890 - RNA, 64 nt, hsa; identical to SEQ ID NO: 260465

SEQ ID NO: 573891 - RNA, 64 nt, hsa; identical to SEQ ID NO: 260466

SEQ ID NO: 573892 - RNA, 64 nt, hsa; identical to SEQ ID NO: 260467

SEQ ID NO: 573893 - RNA, 64 nt, hsa; identical to SEQ ID NO: 260468

SEQ ID NO: 573894 - RNA, 64 nt, hsa; identical to SEQ ID NO: 260469

SEQ ID NO: 573895 - RNA, 56 nt, hsa; identical to SEQ ID NO: 260470

SEQ ID NO: 573896 - RNA, 64 nt, hsa; identical to SEQ ID NO: 260471

SEQ ID NO: 573897 - RNA, 64 nt, hsa; identical to SEQ ID NO: 260472

SEQ ID NO: 573898 - RNA, 64 nt, hsa; identical to SEQ ID NO: 260473

SEQ ID NO: 573899 - RNA, 64 nt, hsa; identical to SEQ ID NO: 260474

SEQ ID NO: 573900 - RNA, 64 nt, hsa; identical to SEQ ID NO: 260475

SEQ ID NO: 573901 - RNA, 64 nt, hsa; identical to SEQ ID NO: 260476

SEQ ID NO: 573902 - RNA, 64 nt, hsa; identical to SEQ ID NO: 260477

SEQ ID NO: 573903 - RNA, 64 nt, hsa; identical to SEQ ID NO: 260478

SEQ ID NO: 573904 - RNA, 64 nt, hsa; identical to SEQ ID NO: 260479

SEQ ID NO: 573905 - RNA, 64 nt, hsa; identical to SEQ ID NO: 260480

SEQ ID NO: 573906 - RNA, 64 nt, hsa; identical to SEQ ID NO: 260481

SEQ ID NO: 573907 - RNA, 64 nt, hsa; identical to SEQ ID NO: 260482

SEQ ID NO: 573908 - RNA, 64 nt, hsa; identical to SEQ ID NO: 260483

SEQ ID NO: 573909 - RNA, 64 nt, hsa; identical to SEQ ID NO: 260484

SEQ ID NO: 573910 - RNA, 64 nt, hsa; identical to SEQ ID NO: 260485

SEQ ID NO: 573911 - RNA, 64 nt, hsa; identical to SEQ ID NO: 260486

SEQ ID NO: 573912 - RNA, 64 nt, hsa; identical to SEQ ID NO: 260487

SEQ ID NO: 573913 - RNA, 64 nt, hsa; identical to SEQ ID NO: 260488

SEQ ID NO: 573914 - RNA, 64 nt, hsa; identical to SEQ ID NO: 260489

SEQ ID NO: 573915 - RNA, 64 nt, hsa; identical to SEQ ID NO: 260490

SEQ ID NO: 573916 - RNA, 64 nt, hsa; identical to SEQ ID NO: 260491

SEQ ID NO: 573917 - RNA, 64 nt, hsa; identical to SEQ ID NO: 260492

SEQ ID NO: 573918 - RNA, 64 nt, hsa; identical to SEQ ID NO: 260493

SEQ ID NO: 573919 - RNA, 64 nt, hsa; identical to SEQ ID NO: 260494

SEQ ID NO: 573920 - RNA, 64 nt, hsa; identical to SEQ ID NO: 260495

SEQ ID NO: 573921 - RNA, 64 nt, hsa; identical to SEQ ID NO: 260496

SEQ ID NO: 573922 - RNA, 64 nt, hsa; identical to SEQ ID NO: 260497

SEQ ID NO: 573923 - RNA, 64 nt, hsa; identical to SEQ ID NO: 260498

SEQ ID NO: 573924 - RNA, 64 nt, hsa; identical to SEQ ID NO: 260499

SEQ ID NO: 573925 - RNA, 64 nt, hsa; identical to SEQ ID NO: 260500

SEQ ID NO: 573926 - RNA, 64 nt, hsa; identical to SEQ ID NO: 260501

SEQ ID NO: 573927 - RNA, 64 nt, hsa; identical to SEQ ID NO: 260502

SEQ ID NO: 573928 - RNA, 64 nt, hsa; identical to SEQ ID NO: 260503

SEQ ID NO: 573929 - RNA, 64 nt, hsa; identical to SEQ ID NO: 260504

SEQ ID NO: 573930 - RNA, 64 nt, hsa; identical to SEQ ID NO: 260505

SEQ ID NO: 573931 - RNA, 64 nt, hsa; identical to SEQ ID NO: 260506

SEQ ID NO: 573932 - RNA, 64 nt, hsa; identical to SEQ ID NO: 260507

SEQ ID NO: 573933 - RNA, 64 nt, hsa; identical to SEQ ID NO: 260508

SEQ ID NO: 573934 - RNA, 64 nt, hsa; identical to SEQ ID NO: 260509

SEQ ID NO: 573935 - RNA, 64 nt, hsa; identical to SEQ ID NO: 260510

SEQ ID NO: 573936 - RNA, 64 nt, hsa; identical to SEQ ID NO: 260511

SEQ ID NO: 573937 - RNA, 64 nt, hsa; identical to SEQ ID NO: 260512

SEQ ID NO: 573938 - RNA, 64 nt, hsa; identical to SEQ ID NO: 260513

SEQ ID NO: 573939 - RNA, 64 nt, hsa; identical to SEQ ID NO: 260514

SEQ ID NO: 573940 - RNA, 64 nt, hsa; identical to SEQ ID NO: 260515

SEQ ID NO: 573941 - RNA, 64 nt, hsa; identical to SEQ ID NO: 260516

SEQ ID NO: 573942 - RNA, 64 nt, hsa; identical to SEQ ID NO: 260517

SEQ ID NO: 573943 - RNA, 64 nt, hsa; identical to SEQ ID NO: 260518

SEQ ID NO: 573944 - RNA, 64 nt, hsa; identical to SEQ ID NO: 260519

SEQ ID NO: 573945 - RNA, 64 nt, hsa; identical to SEQ ID NO: 260520

SEQ ID NO: 573946 - RNA, 64 nt, hsa; identical to SEQ ID NO: 260521

SEQ ID NO: 573947 - RNA, 64 nt, hsa; identical to SEQ ID NO: 260522

SEQ ID NO: 573948 - RNA, 64 nt, hsa; identical to SEQ ID NO: 260523

SEQ ID NO: 573949 - RNA, 64 nt, hsa; identical to SEQ ID NO: 260524

SEQ ID NO: 573950 - RNA, 64 nt, hsa; identical to SEQ ID NO: 260525

SEQ ID NO: 573951 - RNA, 64 nt, hsa; identical to SEQ ID NO: 260526

SEQ ID NO: 573952 - RNA, 64 nt, hsa; identical to SEQ ID NO: 260527

SEQ ID NO: 573953 - RNA, 64 nt, hsa; identical to SEQ ID NO: 260528

SEQ ID NO: 573954 - RNA, 64 nt, hsa; identical to SEQ ID NO: 260529

SEQ ID NO: 573955 - RNA, 64 nt, hsa; identical to SEQ ID NO: 260530

SEQ ID NO: 573956 - RNA, 64 nt, hsa; identical to SEQ ID NO: 260531

SEQ ID NO: 573957 - RNA, 64 nt, hsa; identical to SEQ ID NO: 260532

SEQ ID NO: 573958 - RNA, 64 nt, hsa; identical to SEQ ID NO: 260533

SEQ ID NO: 573959 - RNA, 64 nt, hsa; identical to SEQ ID NO: 260534

SEQ ID NO: 573960 - RNA, 64 nt, hsa; identical to SEQ ID NO: 260535

SEQ ID NO: 573961 - RNA, 64 nt, hsa; identical to SEQ ID NO: 260536

SEQ ID NO: 573962 - RNA, 64 nt, hsa; identical to SEQ ID NO: 260537

SEQ ID NO: 573963 - RNA, 64 nt, hsa; identical to SEQ ID NO: 260538

SEQ ID NO: 573964 - RNA, 64 nt, hsa; identical to SEQ ID NO: 260539

SEQ ID NO: 573965 - RNA, 64 nt, hsa; identical to SEQ ID NO: 260540

SEQ ID NO: 573966 - RNA, 64 nt, hsa; identical to SEQ ID NO: 260541

SEQ ID NO: 573967 - RNA, 64 nt, hsa; identical to SEQ ID NO: 260542

SEQ ID NO: 573968 - RNA, 64 nt, hsa
auuuuaagcaucaaaugcaaucaucuaaaauauaaaggucaaucauuuauaauagaaacaccuu

SEQ ID NO: 573969 - RNA, 64 nt, hsa
cauaguaaaguuugcuuucauaacugcagcaaaaaaggucaacuugccaagucacugcugccau

SEQ ID NO: 573970 - RNA, 64 nt, hsa
aaugaaugauaaauuaagagaaaaaaauaucaggaaggucaauauaugccuaacauuucuaaac

SEQ ID NO: 573971 - RNA, 64 nt, hsa
uccacagguuguaagcuaggucuagcugacugcaaaggucaaguucucuuuacuccgucaccau

SEQ ID NO: 573972 - RNA, 64 nt, hsa
ucaaaacgagggcugauggaggaaaaaggucaauaaggucaagggaaaaccccgucucuauacc

SEQ ID NO: 573973 - RNA, 64 nt, hsa
uucuccauaucaaaacgagggcugauggaggaaaaaggucaauaaggucaagggaaaaccccgu

SEQ ID NO: 573974 - RNA, 64 nt, hsa
uuuuaaaaauaaugauuuuuaccaggaaucuauuaaggucaauauuaauaacacugaaacagga

SEQ ID NO: 573975 - RNA, 64 nt, hsa
ucaaagugaaucauuuaguugacucuauaauucuaaggucaaaauggaacuugauaguuuuuua

SEQ ID NO: 573976 - RNA, 64 nt, hsa
aaaguacuagucuaguaaaauuuauucuuguuagaaggucaacaaaauaucuguuuagcuuuua

SEQ ID NO: 573977 - RNA, 64 nt, hsa
gcguuuuguuggcugggcuucuggaggcacuggcaaggucaaacugcauuucuuuaagaacagu

SEQ ID NO: 573978 - RNA, 64 nt, hsa
gagcagguuuccacugugggcgguuggcacucugccaucugaguccucugccuaaagcauuccu

SEQ ID NO: 573979 - RNA, 64 nt, hsa
ggcaagcaaaccugggguauuuauccacugacuuccaucugacacugguugaggaccacugcca

SEQ ID NO: 573980 - RNA, 64 nt, hsa
aguuaaaguauggcccgaccauuuaagaaaacaaccaucugagacacgcaggaaauugugagca

SEQ ID NO: 573981 - RNA, 64 nt, hsa
gcaacuuugauuuauagaaggaaaauggaaacccccaucugaguauuuugggaggagcccccag

SEQ ID NO: 573982 - RNA, 64 nt, hsa
caaggguuuuuuuuguuuguuuguuucaaauaagccaucugauuguggugacuggggcccaugu

SEQ ID NO: 573983 - RNA, 64 nt, hsa
uucuccugauugacccgacuccacuccaggaaggccaucugacccugugacaggcauagcucau

SEQ ID NO: 573984 - RNA, 64 nt, hsa
uccauuuuauaaaacacaagguuucaauuugagcccaucugagccuuaaagauccauucugaau

SEQ ID NO: 573985 - RNA, 64 nt, hsa
ccuucaauguaugacuccugggagaaucaaggguccaucugagccucugaguaaagaucccaau

SEQ ID NO: 573986 - RNA, 64 nt, hsa
uccacaugcuuuucuuuuucuaauaaaccaggguccaucugaccccagcgcuaauucaggcucc

SEQ ID NO: 573987 - RNA, 64 nt, hsa
guucagcagugacguagcaucugaaucccuagacccaucugaugaagaggcaucuucgagccca

SEQ ID NO: 573988 - RNA, 64 nt, hsa
aagguggggauuucugaguucuaagaccaagucuccaucugagacucccaaauugcuccccacc

SEQ ID NO: 573989 - RNA, 64 nt, hsa
agggcguccuaacgccuccauggccucaguuuccccaucugaagaauggguacaggaaaggauu

SEQ ID NO: 573990 - RNA, 64 nt, hsa
ccugagccagcuuuauauuucaaccauggcuggcccaucugagagcaucuccccacucucgcca

SEQ ID NO: 573991 - RNA, 64 nt, hsa
cauuuucucuuauuuuguuuucucuggaucuuuuccaucugaggguacaggaaguaccaggacc

SEQ ID NO: 573992 - RNA, 64 nt, hsa
guuacaggcacuaaaguuaguaaagaaaaguuuaccaucugaaaaagcuggauuuucuuuaaga

SEQ ID NO: 573993 - RNA, 64 nt, hsa
aacuuacuugcauaccaaguugauacuugaauaaccaucugaaagugguacuugaucauuuuua

SEQ ID NO: 573994 - RNA, 64 nt, hsa
guaacuguagucaucuuaaauuucaaaccauuuaccaucugaaaguuuugauuugaauguaaaa

SEQ ID NO: 573995 - RNA, 64 nt, hsa
aaucauagcugucugaccucuacggaccucacauccaucugaggcuucauggacaaagauucuc

SEQ ID NO: 573996 - RNA, 64 nt, hsa
gagguuagaauagagggcagaguaaaaggaagcuccaucugagcaaguacaccaaaugaucuca

SEQ ID NO: 573997 - RNA, 62 nt, hsa
uaaucagauaggccggucucagacauuaauccuaccaucugauauuuuuggugaaggaaaaa

SEQ ID NO: 573998 - RNA, 64 nt, hsa; identical to SEQ ID NO: 532503

SEQ ID NO: 573999 - RNA, 64 nt, hsa; identical to SEQ ID NO: 532504

SEQ ID NO: 574000 - RNA, 64 nt, hsa; identical to SEQ ID NO: 532505

SEQ ID NO: 574001 - RNA, 64 nt, hsa; identical to SEQ ID NO: 532506

SEQ ID NO: 574002 - RNA, 64 nt, hsa; identical to SEQ ID NO: 532507

SEQ ID NO: 574003 - RNA, 64 nt, hsa; identical to SEQ ID NO: 532508

SEQ ID NO: 574004 - RNA, 64 nt, hsa; identical to SEQ ID NO: 532509

SEQ ID NO: 574005 - RNA, 64 nt, hsa; identical to SEQ ID NO: 532510

SEQ ID NO: 574006 - RNA, 64 nt, hsa; identical to SEQ ID NO: 532511

SEQ ID NO: 574007 - RNA, 54 nt, hsa; identical to SEQ ID NO: 532512

SEQ ID NO: 574008 - RNA, 61 nt, hsa; identical to SEQ ID NO: 532513

SEQ ID NO: 574009 - RNA, 64 nt, hsa; identical to SEQ ID NO: 532514

SEQ ID NO: 574010 - RNA, 64 nt, hsa; identical to SEQ ID NO: 532515

SEQ ID NO: 574011 - RNA, 64 nt, hsa; identical to SEQ ID NO: 532516

SEQ ID NO: 574012 - RNA, 64 nt, hsa
gcuacaagugacgaggaagguucuguuuugaguauagccagagaaaacaaggauggagaaaaau

SEQ ID NO: 574013 - RNA, 64 nt, hsa
gguacaagugacgaggaagauucuguuuuggguauagccagagaaaacaaggauggagaaaaau

SEQ ID NO: 574014 - RNA, 64 nt, hsa
gcuacaagugaugagaaagauucuguuuugaauauagccagaggaaaaaaggauggagaaaaaa

SEQ ID NO: 574015 - RNA, 64 nt, hsa
agccuccccgacccacuaccuggagauagccagauagccagaugcccugcuccuggccaccuuu

SEQ ID NO: 574016 - RNA, 64 nt, hsa
agucucagagccuccccgacccacuaccuggagauagccagauagccagaugcccugcuccugg

SEQ ID NO: 574017 - RNA, 64 nt, hsa; identical to SEQ ID NO: 243769

SEQ ID NO: 574018 - RNA, 64 nt, hsa; identical to SEQ ID NO: 243770

SEQ ID NO: 574019 - RNA, 64 nt, hsa; identical to SEQ ID NO: 243771

SEQ ID NO: 574020 - RNA, 64 nt, hsa; identical to SEQ ID NO: 243772

SEQ ID NO: 574021 - RNA, 64 nt, hsa; identical to SEQ ID NO: 243773

SEQ ID NO: 574022 - RNA, 64 nt, hsa; identical to SEQ ID NO: 243774

SEQ ID NO: 574023 - RNA, 64 nt, hsa; identical to SEQ ID NO: 243775

SEQ ID NO: 574024 - RNA, 64 nt, hsa; identical to SEQ ID NO: 243776

SEQ ID NO: 574025 - RNA, 64 nt, hsa; identical to SEQ ID NO: 243777

SEQ ID NO: 574026 - RNA, 64 nt, hsa; identical to SEQ ID NO: 243778

SEQ ID NO: 574027 - RNA, 64 nt, hsa; identical to SEQ ID NO: 243779

SEQ ID NO: 574028 - RNA, 64 nt, hsa; identical to SEQ ID NO: 243780

SEQ ID NO: 574029 - RNA, 64 nt, hsa; identical to SEQ ID NO: 243781

SEQ ID NO: 574030 - RNA, 64 nt, hsa; identical to SEQ ID NO: 243782

SEQ ID NO: 574031 - RNA, 64 nt, hsa; identical to SEQ ID NO: 243783

SEQ ID NO: 574032 - RNA, 64 nt, hsa; identical to SEQ ID NO: 243784

SEQ ID NO: 574033 - RNA, 64 nt, hsa; identical to SEQ ID NO: 243785

SEQ ID NO: 574034 - RNA, 64 nt, hsa; identical to SEQ ID NO: 243786

SEQ ID NO: 574035 - RNA, 64 nt, hsa; identical to SEQ ID NO: 243787

SEQ ID NO: 574036 - RNA, 64 nt, hsa; identical to SEQ ID NO: 243788

SEQ ID NO: 574037 - RNA, 64 nt, hsa; identical to SEQ ID NO: 243789

SEQ ID NO: 574038 - RNA, 64 nt, hsa; identical to SEQ ID NO: 243790

SEQ ID NO: 574039 - RNA, 64 nt, hsa; identical to SEQ ID NO: 243791

SEQ ID NO: 574040 - RNA, 64 nt, hsa; identical to SEQ ID NO: 243792

SEQ ID NO: 574041 - RNA, 64 nt, hsa; identical to SEQ ID NO: 243793

SEQ ID NO: 574042 - RNA, 64 nt, hsa; identical to SEQ ID NO: 243794

SEQ ID NO: 574043 - RNA, 64 nt, hsa; identical to SEQ ID NO: 243795

SEQ ID NO: 574044 - RNA, 64 nt, hsa; identical to SEQ ID NO: 243796

SEQ ID NO: 574045 - RNA, 64 nt, hsa; identical to SEQ ID NO: 243797

SEQ ID NO: 574046 - RNA, 64 nt, hsa; identical to SEQ ID NO: 243798

SEQ ID NO: 574047 - RNA, 64 nt, hsa; identical to SEQ ID NO: 243799

SEQ ID NO: 574048 - RNA, 64 nt, hsa; identical to SEQ ID NO: 243800

SEQ ID NO: 574049 - RNA, 64 nt, hsa; identical to SEQ ID NO: 243801

SEQ ID NO: 574050 - RNA, 64 nt, hsa; identical to SEQ ID NO: 243802

SEQ ID NO: 574051 - RNA, 64 nt, hsa; identical to SEQ ID NO: 243803

SEQ ID NO: 574052 - RNA, 64 nt, hsa; identical to SEQ ID NO: 243804

SEQ ID NO: 574053 - RNA, 64 nt, hsa; identical to SEQ ID NO: 243805

SEQ ID NO: 574054 - RNA, 64 nt, hsa; identical to SEQ ID NO: 243806

SEQ ID NO: 574055 - RNA, 64 nt, hsa; identical to SEQ ID NO: 243807

SEQ ID NO: 574056 - RNA, 64 nt, hsa; identical to SEQ ID NO: 243808

SEQ ID NO: 574057 - RNA, 64 nt, hsa; identical to SEQ ID NO: 243809

SEQ ID NO: 574058 - RNA, 64 nt, hsa; identical to SEQ ID NO: 243810

SEQ ID NO: 574059 - RNA, 64 nt, hsa; identical to SEQ ID NO: 243811

SEQ ID NO: 574060 - RNA, 64 nt, hsa; identical to SEQ ID NO: 243812

SEQ ID NO: 574061 - RNA, 64 nt, hsa; identical to SEQ ID NO: 243813

SEQ ID NO: 574062 - RNA, 64 nt, hsa; identical to SEQ ID NO: 243814

SEQ ID NO: 574063 - RNA, 64 nt, hsa; identical to SEQ ID NO: 243815

SEQ ID NO: 574064 - RNA, 64 nt, hsa; identical to SEQ ID NO: 243816

SEQ ID NO: 574065 - RNA, 64 nt, hsa; identical to SEQ ID NO: 243817

SEQ ID NO: 574066 - RNA, 64 nt, hsa; identical to SEQ ID NO: 243818

SEQ ID NO: 574067 - RNA, 64 nt, hsa; identical to SEQ ID NO: 243819

SEQ ID NO: 574068 - RNA, 64 nt, hsa; identical to SEQ ID NO: 243820

SEQ ID NO: 574069 - RNA, 64 nt, hsa; identical to SEQ ID NO: 243821

SEQ ID NO: 574070 - RNA, 64 nt, hsa; identical to SEQ ID NO: 243822

SEQ ID NO: 574071 - RNA, 64 nt, hsa; identical to SEQ ID NO: 243823

SEQ ID NO: 574072 - RNA, 64 nt, hsa; identical to SEQ ID NO: 243824

SEQ ID NO: 574073 - RNA, 64 nt, hsa; identical to SEQ ID NO: 243825

SEQ ID NO: 574074 - RNA, 64 nt, hsa; identical to SEQ ID NO: 131680

SEQ ID NO: 574075 - RNA, 64 nt, hsa; identical to SEQ ID NO: 131681

SEQ ID NO: 574076 - RNA, 64 nt, hsa; identical to SEQ ID NO: 131682

SEQ ID NO: 574077 - RNA, 64 nt, hsa; identical to SEQ ID NO: 131683

SEQ ID NO: 574078 - RNA, 64 nt, hsa; identical to SEQ ID NO: 131684

SEQ ID NO: 574079 - RNA, 64 nt, hsa; identical to SEQ ID NO: 131685

SEQ ID NO: 574080 - RNA, 64 nt, hsa; identical to SEQ ID NO: 131686

SEQ ID NO: 574081 - RNA, 64 nt, hsa; identical to SEQ ID NO: 131687

SEQ ID NO: 574082 - RNA, 64 nt, hsa; identical to SEQ ID NO: 61201

SEQ ID NO: 574083 - RNA, 64 nt, hsa; identical to SEQ ID NO: 61202

SEQ ID NO: 574084 - RNA, 64 nt, hsa; identical to SEQ ID NO: 61203

SEQ ID NO: 574085 - RNA, 64 nt, hsa; identical to SEQ ID NO: 61204

SEQ ID NO: 574086 - RNA, 64 nt, hsa; identical to SEQ ID NO: 61205

SEQ ID NO: 574087 - RNA, 64 nt, hsa; identical to SEQ ID NO: 61206

SEQ ID NO: 574088 - RNA, 64 nt, hsa; identical to SEQ ID NO: 61207

SEQ ID NO: 574089 - RNA, 64 nt, hsa; identical to SEQ ID NO: 61208

SEQ ID NO: 574090 - RNA, 64 nt, hsa; identical to SEQ ID NO: 61209

SEQ ID NO: 574091 - RNA, 64 nt, hsa; identical to SEQ ID NO: 61210

SEQ ID NO: 574092 - RNA, 64 nt, hsa; identical to SEQ ID NO: 61211

SEQ ID NO: 574093 - RNA, 64 nt, hsa; identical to SEQ ID NO: 61212

SEQ ID NO: 574094 - RNA, 64 nt, hsa; identical to SEQ ID NO: 61213

SEQ ID NO: 574095 - RNA, 64 nt, hsa; identical to SEQ ID NO: 61214

SEQ ID NO: 574096 - RNA, 64 nt, hsa; identical to SEQ ID NO: 61215

SEQ ID NO: 574097 - RNA, 64 nt, hsa; identical to SEQ ID NO: 61216

SEQ ID NO: 574098 - RNA, 64 nt, hsa; identical to SEQ ID NO: 61217

SEQ ID NO: 574099 - RNA, 64 nt, hsa; identical to SEQ ID NO: 61218

SEQ ID NO: 574100 - RNA, 64 nt, hsa; identical to SEQ ID NO: 61219

SEQ ID NO: 574101 - RNA, 64 nt, hsa; identical to SEQ ID NO: 61220

SEQ ID NO: 574102 - RNA, 64 nt, hsa; identical to SEQ ID NO: 61221

SEQ ID NO: 574103 - RNA, 64 nt, hsa; identical to SEQ ID NO: 61222

SEQ ID NO: 574104 - RNA, 64 nt, hsa; identical to SEQ ID NO: 61223

SEQ ID NO: 574105 - RNA, 64 nt, hsa; identical to SEQ ID NO: 61224

SEQ ID NO: 574106 - RNA, 64 nt, hsa; identical to SEQ ID NO: 61225

SEQ ID NO: 574107 - RNA, 64 nt, hsa; identical to SEQ ID NO: 61226

SEQ ID NO: 574108 - RNA, 64 nt, hsa; identical to SEQ ID NO: 61227

SEQ ID NO: 574109 - RNA, 64 nt, hsa; identical to SEQ ID NO: 61228

SEQ ID NO: 574110 - RNA, 64 nt, hsa; identical to SEQ ID NO: 61229

SEQ ID NO: 574111 - RNA, 64 nt, hsa; identical to SEQ ID NO: 61230

SEQ ID NO: 574112 - RNA, 64 nt, hsa; identical to SEQ ID NO: 61231

SEQ ID NO: 574113 - RNA, 64 nt, hsa; identical to SEQ ID NO: 61232

SEQ ID NO: 574114 - RNA, 64 nt, hsa; identical to SEQ ID NO: 61233

SEQ ID NO: 574115 - RNA, 64 nt, hsa; identical to SEQ ID NO: 61234

SEQ ID NO: 574116 - RNA, 64 nt, hsa; identical to SEQ ID NO: 61235

SEQ ID NO: 574117 - RNA, 64 nt, hsa; identical to SEQ ID NO: 61236

SEQ ID NO: 574118 - RNA, 64 nt, hsa; identical to SEQ ID NO: 61237

SEQ ID NO: 574119 - RNA, 64 nt, hsa; identical to SEQ ID NO: 61238

SEQ ID NO: 574120 - RNA, 59 nt, hsa; identical to SEQ ID NO: 61239

SEQ ID NO: 574121 - RNA, 64 nt, hsa; identical to SEQ ID NO: 61240

SEQ ID NO: 574122 - RNA, 64 nt, hsa; identical to SEQ ID NO: 61241

SEQ ID NO: 574123 - RNA, 64 nt, hsa; identical to SEQ ID NO: 61242

SEQ ID NO: 574124 - RNA, 64 nt, hsa; identical to SEQ ID NO: 61243

SEQ ID NO: 574125 - RNA, 64 nt, hsa; identical to SEQ ID NO: 61244

SEQ ID NO: 574126 - RNA, 64 nt, hsa; identical to SEQ ID NO: 61245

SEQ ID NO: 574127 - RNA, 64 nt, hsa; identical to SEQ ID NO: 61246

SEQ ID NO: 574128 - RNA, 64 nt, hsa; identical to SEQ ID NO: 61247

SEQ ID NO: 574129 - RNA, 64 nt, hsa; identical to SEQ ID NO: 61248

SEQ ID NO: 574130 - RNA, 64 nt, hsa; identical to SEQ ID NO: 61249

SEQ ID NO: 574131 - RNA, 64 nt, hsa; identical to SEQ ID NO: 38988

SEQ ID NO: 574132 - RNA, 64 nt, hsa; identical to SEQ ID NO: 38989

SEQ ID NO: 574133 - RNA, 64 nt, hsa; identical to SEQ ID NO: 38990

SEQ ID NO: 574134 - RNA, 64 nt, hsa; identical to SEQ ID NO: 38991

SEQ ID NO: 574135 - RNA, 64 nt, hsa; identical to SEQ ID NO: 38992

SEQ ID NO: 574136 - RNA, 64 nt, hsa; identical to SEQ ID NO: 38993

SEQ ID NO: 574137 - RNA, 64 nt, hsa; identical to SEQ ID NO: 38994

SEQ ID NO: 574138 - RNA, 64 nt, hsa; identical to SEQ ID NO: 38995

SEQ ID NO: 574139 - RNA, 64 nt, hsa; identical to SEQ ID NO: 38996

SEQ ID NO: 574140 - RNA, 64 nt, hsa; identical to SEQ ID NO: 38997

SEQ ID NO: 574141 - RNA, 64 nt, hsa; identical to SEQ ID NO: 38998

SEQ ID NO: 574142 - RNA, 64 nt, hsa; identical to SEQ ID NO: 38999

SEQ ID NO: 574143 - RNA, 64 nt, hsa; identical to SEQ ID NO: 39000

SEQ ID NO: 574144 - RNA, 64 nt, hsa; identical to SEQ ID NO: 39001

SEQ ID NO: 574145 - RNA, 64 nt, hsa; identical to SEQ ID NO: 39002

SEQ ID NO: 574146 - RNA, 64 nt, hsa; identical to SEQ ID NO: 39003

SEQ ID NO: 574147 - RNA, 64 nt, hsa; identical to SEQ ID NO: 39004

SEQ ID NO: 574148 - RNA, 64 nt, hsa; identical to SEQ ID NO: 39005

SEQ ID NO: 574149 - RNA, 64 nt, hsa; identical to SEQ ID NO: 39006

SEQ ID NO: 574150 - RNA, 64 nt, hsa; identical to SEQ ID NO: 39007

SEQ ID NO: 574151 - RNA, 64 nt, hsa; identical to SEQ ID NO: 39008

SEQ ID NO: 574152 - RNA, 64 nt, hsa; identical to SEQ ID NO: 39009

SEQ ID NO: 574153 - RNA, 64 nt, hsa; identical to SEQ ID NO: 39010

SEQ ID NO: 574154 - RNA, 64 nt, hsa; identical to SEQ ID NO: 39011

SEQ ID NO: 574155 - RNA, 64 nt, hsa; identical to SEQ ID NO: 39012

SEQ ID NO: 574156 - RNA, 64 nt, hsa; identical to SEQ ID NO: 39013

SEQ ID NO: 574157 - RNA, 64 nt, hsa; identical to SEQ ID NO: 39014

SEQ ID NO: 574158 - RNA, 64 nt, hsa; identical to SEQ ID NO: 39015

SEQ ID NO: 574159 - RNA, 64 nt, hsa; identical to SEQ ID NO: 39016

SEQ ID NO: 574160 - RNA, 64 nt, hsa; identical to SEQ ID NO: 39017

SEQ ID NO: 574161 - RNA, 64 nt, hsa; identical to SEQ ID NO: 39018

SEQ ID NO: 574162 - RNA, 64 nt, hsa; identical to SEQ ID NO: 39019

SEQ ID NO: 574163 - RNA, 64 nt, hsa; identical to SEQ ID NO: 39020

SEQ ID NO: 574164 - RNA, 64 nt, hsa; identical to SEQ ID NO: 39021

SEQ ID NO: 574165 - RNA, 64 nt, hsa; identical to SEQ ID NO: 39022

SEQ ID NO: 574166 - RNA, 64 nt, hsa; identical to SEQ ID NO: 39023

SEQ ID NO: 574167 - RNA, 64 nt, hsa; identical to SEQ ID NO: 39024

SEQ ID NO: 574168 - RNA, 64 nt, hsa; identical to SEQ ID NO: 39025

SEQ ID NO: 574169 - RNA, 64 nt, hsa; identical to SEQ ID NO: 39026

SEQ ID NO: 574170 - RNA, 64 nt, hsa; identical to SEQ ID NO: 39027

SEQ ID NO: 574171 - RNA, 64 nt, hsa; identical to SEQ ID NO: 39028

SEQ ID NO: 574172 - RNA, 64 nt, hsa; identical to SEQ ID NO: 39029

SEQ ID NO: 574173 - RNA, 64 nt, hsa; identical to SEQ ID NO: 39030

SEQ ID NO: 574174 - RNA, 64 nt, hsa; identical to SEQ ID NO: 39031

SEQ ID NO: 574175 - RNA, 64 nt, hsa; identical to SEQ ID NO: 39032

SEQ ID NO: 574176 - RNA, 64 nt, hsa; identical to SEQ ID NO: 39033

SEQ ID NO: 574177 - RNA, 64 nt, hsa; identical to SEQ ID NO: 39034

SEQ ID NO: 574178 - RNA, 64 nt, hsa; identical to SEQ ID NO: 39035

SEQ ID NO: 574179 - RNA, 64 nt, hsa; identical to SEQ ID NO: 39036

SEQ ID NO: 574180 - RNA, 64 nt, hsa; identical to SEQ ID NO: 39037

SEQ ID NO: 574181 - RNA, 64 nt, hsa; identical to SEQ ID NO: 39038

SEQ ID NO: 574182 - RNA, 64 nt, hsa; identical to SEQ ID NO: 39039

SEQ ID NO: 574183 - RNA, 64 nt, hsa; identical to SEQ ID NO: 39040

SEQ ID NO: 574184 - RNA, 64 nt, hsa; identical to SEQ ID NO: 39041

SEQ ID NO: 574185 - RNA, 64 nt, hsa; identical to SEQ ID NO: 39042

SEQ ID NO: 574186 - RNA, 64 nt, hsa; identical to SEQ ID NO: 39043

SEQ ID NO: 574187 - RNA, 64 nt, hsa; identical to SEQ ID NO: 39044

SEQ ID NO: 574188 - RNA, 64 nt, hsa; identical to SEQ ID NO: 39045

SEQ ID NO: 574189 - RNA, 64 nt, hsa; identical to SEQ ID NO: 279869

SEQ ID NO: 574190 - RNA, 64 nt, hsa; identical to SEQ ID NO: 279870

SEQ ID NO: 574191 - RNA, 64 nt, hsa; identical to SEQ ID NO: 279871

SEQ ID NO: 574192 - RNA, 64 nt, hsa; identical to SEQ ID NO: 279871

SEQ ID NO: 574193 - RNA, 64 nt, hsa; identical to SEQ ID NO: 279873

SEQ ID NO: 574194 - RNA, 64 nt, hsa; identical to SEQ ID NO: 279874

SEQ ID NO: 574195 - RNA, 64 nt, hsa; identical to SEQ ID NO: 279875

SEQ ID NO: 574196 - RNA, 64 nt, hsa; identical to SEQ ID NO: 279876

SEQ ID NO: 574197 - RNA, 64 nt, hsa; identical to SEQ ID NO: 279877

SEQ ID NO: 574198 - RNA, 64 nt, hsa; identical to SEQ ID NO: 279878

SEQ ID NO: 574199 - RNA, 64 nt, hsa; identical to SEQ ID NO: 279879

SEQ ID NO: 574200 - RNA, 64 nt, hsa; identical to SEQ ID NO: 279880

SEQ ID NO: 574201 - RNA, 64 nt, hsa; identical to SEQ ID NO: 279881

SEQ ID NO: 574202 - RNA, 64 nt, hsa; identical to SEQ ID NO: 279882

SEQ ID NO: 574203 - RNA, 64 nt, hsa; identical to SEQ ID NO: 279883

SEQ ID NO: 574204 - RNA, 64 nt, hsa; identical to SEQ ID NO: 279884

SEQ ID NO: 574205 - RNA, 64 nt, hsa; identical to SEQ ID NO: 279885

SEQ ID NO: 574206 - RNA, 64 nt, hsa; identical to SEQ ID NO: 279886

SEQ ID NO: 574207 - RNA, 64 nt, hsa; identical to SEQ ID NO: 279887

SEQ ID NO: 574208 - RNA, 64 nt, hsa; identical to SEQ ID NO: 279888

SEQ ID NO: 574209 - RNA, 64 nt, hsa; identical to SEQ ID NO: 279889

SEQ ID NO: 574210 - RNA, 64 nt, hsa; identical to SEQ ID NO: 279890

SEQ ID NO: 574211 - RNA, 64 nt, hsa; identical to SEQ ID NO: 279891

SEQ ID NO: 574212 - RNA, 64 nt, hsa; identical to SEQ ID NO: 279892

SEQ ID NO: 574213 - RNA, 64 nt, hsa; identical to SEQ ID NO: 279893

SEQ ID NO: 574214 - RNA, 64 nt, hsa; identical to SEQ ID NO: 279894

SEQ ID NO: 574215 - RNA, 64 nt, hsa; identical to SEQ ID NO: 279895

SEQ ID NO: 574216 - RNA, 64 nt, hsa; identical to SEQ ID NO: 279896

SEQ ID NO: 574217 - RNA, 64 nt, hsa; identical to SEQ ID NO: 279897

SEQ ID NO: 574218 - RNA, 64 nt, hsa; identical to SEQ ID NO: 279898

SEQ ID NO: 574219 - RNA, 64 nt, hsa; identical to SEQ ID NO: 279898

SEQ ID NO: 574220 - RNA, 64 nt, hsa; identical to SEQ ID NO: 83612

SEQ ID NO: 574221 - RNA, 64 nt, hsa; identical to SEQ ID NO: 83613

SEQ ID NO: 574222 - RNA, 64 nt, hsa; identical to SEQ ID NO: 83614

SEQ ID NO: 574223 - RNA, 64 nt, hsa; identical to SEQ ID NO: 83615

SEQ ID NO: 574224 - RNA, 64 nt, hsa; identical to SEQ ID NO: 83616

SEQ ID NO: 574225 - RNA, 64 nt, hsa; identical to SEQ ID NO: 83617

SEQ ID NO: 574226 - RNA, 64 nt, hsa; identical to SEQ ID NO: 83618

SEQ ID NO: 574227 - RNA, 64 nt, hsa; identical to SEQ ID NO: 83619

SEQ ID NO: 574228 - RNA, 64 nt, hsa; identical to SEQ ID NO: 83620

SEQ ID NO: 574229 - RNA, 64 nt, hsa; identical to SEQ ID NO: 83621

SEQ ID NO: 574230 - RNA, 64 nt, hsa; identical to SEQ ID NO: 83622

SEQ ID NO: 574231 - RNA, 64 nt, hsa; identical to SEQ ID NO: 83623

SEQ ID NO: 574232 - RNA, 64 nt, hsa; identical to SEQ ID NO: 83624

SEQ ID NO: 574233 - RNA, 64 nt, hsa; identical to SEQ ID NO: 83625

SEQ ID NO: 574234 - RNA, 64 nt, hsa; identical to SEQ ID NO: 83626

SEQ ID NO: 574235 - RNA, 64 nt, hsa; identical to SEQ ID NO: 83627

SEQ ID NO: 574236 - RNA, 64 nt, hsa; identical to SEQ ID NO: 83628

SEQ ID NO: 574237 - RNA, 64 nt, hsa; identical to SEQ ID NO: 83629

SEQ ID NO: 574238 - RNA, 64 nt, hsa; identical to SEQ ID NO: 83630

SEQ ID NO: 574239 - RNA, 64 nt, hsa; identical to SEQ ID NO: 83631

SEQ ID NO: 574240 - RNA, 64 nt, hsa; identical to SEQ ID NO: 83632

SEQ ID NO: 574241 - RNA, 60 nt, hsa; identical to SEQ ID NO: 83633

SEQ ID NO: 574242 - RNA, 64 nt, hsa; identical to SEQ ID NO: 83634

SEQ ID NO: 574243 - RNA, 64 nt, hsa; identical to SEQ ID NO: 83635

SEQ ID NO: 574244 - RNA, 64 nt, hsa; identical to SEQ ID NO: 83636

SEQ ID NO: 574245 - RNA, 64 nt, hsa; identical to SEQ ID NO: 83637

SEQ ID NO: 574246 - RNA, 64 nt, hsa; identical to SEQ ID NO: 83638

SEQ ID NO: 574247 - RNA, 64 nt, hsa; identical to SEQ ID NO: 83639

SEQ ID NO: 574248 - RNA, 64 nt, hsa; identical to SEQ ID NO: 83640

SEQ ID NO: 574249 - RNA, 64 nt, hsa; identical to SEQ ID NO: 83641

SEQ ID NO: 574250 - RNA, 64 nt, hsa; identical to SEQ ID NO: 83642

SEQ ID NO: 574251 - RNA, 64 nt, hsa; identical to SEQ ID NO: 83643

SEQ ID NO: 574252 - RNA, 64 nt, hsa; identical to SEQ ID NO: 83644

SEQ ID NO: 574253 - RNA, 64 nt, hsa; identical to SEQ ID NO: 83645

SEQ ID NO: 574254 - RNA, 64 nt, hsa; identical to SEQ ID NO: 83646

SEQ ID NO: 574255 - RNA, 64 nt, hsa; identical to SEQ ID NO: 83647

SEQ ID NO: 574256 - RNA, 64 nt, hsa; identical to SEQ ID NO: 83648

SEQ ID NO: 574257 - RNA, 64 nt, hsa; identical to SEQ ID NO: 83649

SEQ ID NO: 574258 - RNA, 64 nt, hsa; identical to SEQ ID NO: 83650

SEQ ID NO: 574259 - RNA, 54 nt, hsa; identical to SEQ ID NO: 83651

SEQ ID NO: 574260 - RNA, 64 nt, hsa; identical to SEQ ID NO: 83652

SEQ ID NO: 574261 - RNA, 64 nt, hsa; identical to SEQ ID NO: 83653

SEQ ID NO: 574262 - RNA, 64 nt, hsa; identical to SEQ ID NO: 83654

SEQ ID NO: 574263 - RNA, 64 nt, hsa; identical to SEQ ID NO: 83655

SEQ ID NO: 574264 - RNA, 64 nt, hsa; identical to SEQ ID NO: 83656

SEQ ID NO: 574265 - RNA, 64 nt, hsa; identical to SEQ ID NO: 83657

SEQ ID NO: 574266 - RNA, 59 nt, hsa; identical to SEQ ID NO: 83658

SEQ ID NO: 574267 - RNA, 64 nt, hsa; identical to SEQ ID NO: 83659

SEQ ID NO: 574268 - RNA, 64 nt, hsa; identical to SEQ ID NO: 83660

SEQ ID NO: 574269 - RNA, 64 nt, hsa; identical to SEQ ID NO: 83661

SEQ ID NO: 574270 - RNA, 64 nt, hsa; identical to SEQ ID NO: 83662

SEQ ID NO: 574271 - RNA, 64 nt, hsa; identical to SEQ ID NO: 83663

SEQ ID NO: 574272 - RNA, 64 nt, hsa; identical to SEQ ID NO: 83664

SEQ ID NO: 574273 - RNA, 64 nt, hsa; identical to SEQ ID NO: 83665

SEQ ID NO: 574274 - RNA, 64 nt, hsa; identical to SEQ ID NO: 83666

SEQ ID NO: 574275 - RNA, 64 nt, hsa; identical to SEQ ID NO: 83667

SEQ ID NO: 574276 - RNA, 64 nt, hsa; identical to SEQ ID NO: 83668

SEQ ID NO: 574277 - RNA, 66 nt, hsa
aguucuugccuuggcugcaguuuuuuuccuucaagaaugcaguacuaacauuuauuugaguggagu

SEQ ID NO: 574278 - RNA, 66 nt, hsa
caacaagaugagcuaaucgaaaagcccaugucuccuaugcaguacgcacgaucuggucugggaaca

SEQ ID NO: 574279 - RNA, 66 nt, hsa
cuucuaucacccuacauuccagcaucuuaccuucauaugcaguaaaagaaagaaagaaaaaaaaag

SEQ ID NO: 574280 - RNA, 66 nt, hsa
auccuuuuuuguuccuuuuuccugcugccauacuguaugcaguacugcaagcuaauaacguugguu

SEQ ID NO: 574281 - RNA, 66 nt, hsa
aaaguuugggggugcaauauaagaaguuuauauaauaugcaguacauuauccaaaagagaagguag

SEQ ID NO: 574282 - RNA, 66 nt, hsa
aauaugcaguacauuauccaaaagagaagguaguuaaugcaguagaaaguagugguaauaauuccu

SEQ ID NO: 574283 - RNA, 66 nt, hsa
uauuuucuacagauuuugaaaaauguaauaauauuaaugcaguauugcaacaggggugcaauuuaa

SEQ ID NO: 574284 - RNA, 66 nt, hsa
ucuuuuuuaaaguuuuuuuuuaaaauauugauuugaaugcaguaggcuuuuuuguauaaaauuauu

SEQ ID NO: 574285 - RNA, 66 nt, hsa
acaucagagaguucauacuaaaauauauuuuugcagaugcaguaaauaugaaaaauauuuaauccc

SEQ ID NO: 574286 - RNA, 66 nt, hsa
auuaucauuuuguugauugugcuuuuauguaauaaaaugcaguacuuuaaaacauuuagauugugu

SEQ ID NO: 574287 - RNA, 66 nt, hsa
cuuauuuaaaauuuaaauaaggaauacauuuucaaaaugcaguaaucaaaaugugaucuaguguaa

SEQ ID NO: 574288 - RNA, 66 nt, hsa
auauaaguucucuuugcguaggccacuggguuucucaugcaguaagcuuuauaaaaacucauuugc

SEQ ID NO: 574289 - RNA, 66 nt, hsa
uacguuauuuuacuauuuguacuuuuauguaauaaaaugcaguacauuuuuaaauuuucagaugau

SEQ ID NO: 574290 - RNA, 66 nt, hsa
acaccagaggguucauacugagauauauuuuugcagaugcaguauauauuuaaaacauuuaaucca

SEQ ID NO: 574291 - RNA, 66 nt, hsa
auucguaauaauuuagugauggaauuuuuuaauaacaugcaguauauaaaugugcagauuuuaugc

SEQ ID NO: 574292 - RNA, 66 nt, hsa
ugugggguuagcagaucgaauaacuugaaauagaccaugcaguauuccuagcacucaauguaauca

SEQ ID NO: 574293 - RNA, 66 nt, hsa
uacagacaagagagccacaguagagaggcuuguuuaaugcaguaccauuggagaguuaacagaaua

SEQ ID NO: 574294 - RNA, 64 nt, hsa; identical to SEQ ID NO: 163552

SEQ ID NO: 574295 - RNA, 64 nt, hsa; identical to SEQ ID NO: 163553

SEQ ID NO: 574296 - RNA, 64 nt, hsa; identical to SEQ ID NO: 163554

SEQ ID NO: 574297 - RNA, 64 nt, hsa; identical to SEQ ID NO: 163555

SEQ ID NO: 574298 - RNA, 64 nt, hsa; identical to SEQ ID NO: 163556

SEQ ID NO: 574299 - RNA, 64 nt, hsa; identical to SEQ ID NO: 163557

SEQ ID NO: 574300 - RNA, 64 nt, hsa; identical to SEQ ID NO: 163558

SEQ ID NO: 574301 - RNA, 64 nt, hsa; identical to SEQ ID NO: 163559

SEQ ID NO: 574302 - RNA, 64 nt, hsa; identical to SEQ ID NO: 163560

SEQ ID NO: 574303 - RNA, 64 nt, hsa; identical to SEQ ID NO: 163561

SEQ ID NO: 574304 - RNA, 64 nt, hsa; identical to SEQ ID NO: 163562

SEQ ID NO: 574305 - RNA, 64 nt, hsa; identical to SEQ ID NO: 163563

SEQ ID NO: 574306 - RNA, 64 nt, hsa; identical to SEQ ID NO: 163564

SEQ ID NO: 574307 - RNA, 64 nt, hsa; identical to SEQ ID NO: 163565

SEQ ID NO: 574308 - RNA, 64 nt, hsa; identical to SEQ ID NO: 163566

SEQ ID NO: 574309 - RNA, 64 nt, hsa; identical to SEQ ID NO: 163567

SEQ ID NO: 574310 - RNA, 64 nt, hsa; identical to SEQ ID NO: 163568

SEQ ID NO: 574311 - RNA, 64 nt, hsa; identical to SEQ ID NO: 163569

SEQ ID NO: 574312 - RNA, 64 nt, hsa; identical to SEQ ID NO: 163570

SEQ ID NO: 574313 - RNA, 64 nt, hsa; identical to SEQ ID NO: 163571

SEQ ID NO: 574314 - RNA, 64 nt, hsa; identical to SEQ ID NO: 163572

SEQ ID NO: 574315 - RNA, 64 nt, hsa; identical to SEQ ID NO: 163573

SEQ ID NO: 574316 - RNA, 64 nt, hsa; identical to SEQ ID NO: 163574

SEQ ID NO: 574317 - RNA, 64 nt, hsa; identical to SEQ ID NO: 163575

SEQ ID NO: 574318 - RNA, 64 nt, hsa; identical to SEQ ID NO: 163576

SEQ ID NO: 574319 - RNA, 64 nt, hsa; identical to SEQ ID NO: 163577

SEQ ID NO: 574320 - RNA, 64 nt, hsa
uuuugaguuuguuuuagcuaaaaagaaggaauacacacaggaauaaugaccccaaaaaugcuua

SEQ ID NO: 574321 - RNA, 64 nt, hsa
aaugaccccaaaaaugcuuagauaaggccccuauacacaggaccugacauuuagcucaaugaug

SEQ ID NO: 574322 - RNA, 64 nt, hsa
cucuguuggggagagaggaagagugugugugucuacacaggauaaacccaauacauauuguacu

SEQ ID NO: 574323 - RNA, 64 nt, hsa
aaugggccaccuccccacaacagaauucugcccaacacaggagauuucuauaguuauuguuuuc

SEQ ID NO: 574324 - RNA, 64 nt, hsa
caguccucucugggccgcagcggacccagcuggaacacaggaaguuggagcaguaggugcuccu

SEQ ID NO: 574325 - RNA, 64 nt, hsa
uaugucucuuucaacucuaguuuuugagguggggacacaggagguccagugggacacagccacu

SEQ ID NO: 574326 - RNA, 64 nt, hsa
auauuugcuacacaguacccagagcagccuaucuacacaggacauuaauaaugguguacuuuaa

SEQ ID NO: 574327 - RNA, 64 nt, hsa
cugcaaguggaggaacgagagcuggggagcccauacacaggaccugaagcccuaaagaaaggcc

SEQ ID NO: 574328 - RNA, 64 nt, hsa
ucuuccuaagaggcagcauggugugguagaaagaacacaggacaagggagagagagccaaacag

SEQ ID NO: 574329 - RNA, 64 nt, hsa
uauuuuguaucuacuuaaguuugucacugugacaacacaggaaaaguugguuuucaggugagau

SEQ ID NO: 574330 - RNA, 64 nt, hsa
uugggggaaaauagguaaacauagcuucuagcuaacacaggagaccuauucuuagccuuuacua

SEQ ID NO: 574331 - RNA, 64 nt, hsa
ucuguucccugcucccucgcuggcaagccccaccacacaggagugaggccaggggcuaggaguu

SEQ ID NO: 574332 - RNA, 64 nt, hsa
ucccuggcucccugucccugggcucagcacgaccacacaggacacccagccagggaauucugaa

SEQ ID NO: 574333 - RNA, 64 nt, hsa
uucaucucauccugugggauucugcaaucauaaaacacaggaaaggggaauucugugauggcaa

SEQ ID NO: 574334 - RNA, 64 nt, hsa
aggauggauagaaaaaaagcacuuacauuggggcacacaggaaaucccagugucuagcaauggu

SEQ ID NO: 574335 - RNA, 64 nt, hsa
gcaccagaaccugucucgggcugacggggguggcacacaggacacggguggaucccaacaggca

SEQ ID NO: 574336 - RNA, 64 nt, hsa
gcucacucauagccauguccacaugggggcuugcacacaggaucacucacauauguacauguac

SEQ ID NO: 574337 - RNA, 64 nt, hsa
accuuuacuuuacagcuucccuuuauaauuuguuacacaggaauaguuaaaugcauuuguuugu

SEQ ID NO: 574338 - RNA, 64 nt, hsa
cagaggacugccuaguagcaaagguuauuccuggacacaggaaagacgggcauuacagggacca

SEQ ID NO: 574339 - RNA, 64 nt, hsa
acugauugggaggugcguguucagcagaaccugcacacaggacagcgggaaaaaucgaugagcg

SEQ ID NO: 574340 - RNA, 64 nt, hsa
cagguaggacagcugcuccccaagccuccugaggacacaggaagagacggaaggagcaccuuga

SEQ ID NO: 574341 - RNA, 64 nt, hsa
ugccuggugugaaaugaucuauggccuguuucuuacacaggaagcccccugaaccuccuguaca

SEQ ID NO: 574342 - RNA, 64 nt, hsa
guccccgacugugccacgugguaggacacauaggacacaggaauuccuggguccuugcccauga

SEQ ID NO: 574343 - RNA, 64 nt, hsa
uggguccuugcccaugacugugccaugugguaggacacaggacacaggaauuccuggaaagugg

SEQ ID NO: 574344 - RNA, 64 nt, hsa
uugcccaugacugugccaugugguaggacacaggacacaggaauuccuggaaagugguggcuuc

SEQ ID NO: 574345 - RNA, 64 nt, hsa
ggaaaaggcuccagugagcgcgccugcuuuagagacacaggaugauucagaccggaaacagacc

SEQ ID NO: 574346 - RNA, 64 nt, hsa
gagaagccuucaggguacauucagcucuuaacaaacacaggaggacuuaauggcagcuuggcau

SEQ ID NO: 574347 - RNA, 64 nt, hsa
aagacaucagagaugcugcuaagucggcuccagcacacaggagccccccacaacgaagaguuag

SEQ ID NO: 574348 - RNA, 64 nt, hsa
cuacucuggaggcugaggcaggggaauggcucgaacacaggagacggagauugcagugagcuga

SEQ ID NO: 574349 - RNA, 64 nt, hsa
uauugccacucguuucaaacccacaaaauuucucacacaggacacaaaccauaugauuguaagg

SEQ ID NO: 574350 - RNA, 64 nt, hsa
cuggcccccacccaccuuccuugcgaccaccaacacacaggaacucugugugagagagagggcg

SEQ ID NO: 574351 - RNA, 64 nt, hsa
aggccugguggagggggaggggagaagccaagggacacaggagaccacccccgagcuugccuca

SEQ ID NO: 574352 - RNA, 64 nt, hsa
uucucaguguccuaacagcccugcuugggccauaacacaggagaccugcucccuaucugcgcac

SEQ ID NO: 574353 - RNA, 64 nt, hsa
cugagucuuagcaauggacaauuccaauaccuccacacaggacacuagaguaagaaaccuucac

SEQ ID NO: 574354 - RNA, 64 nt, hsa
aaauggcaguauccuaagaguuaaggcacaucaaacacaggagucgagagagugcaguucaggg

SEQ ID NO: 574355 - RNA, 64 nt, hsa
gggggggguggggggacuuaucccuggccuuaggacacaggacaaaucuauuuuggauagaaau

SEQ ID NO: 574356 - RNA, 64 nt, hsa
gauuacaugagaugccuuaggcuaaggcccuggcacacaggaacacaugugcuacaaaggagcu

SEQ ID NO: 574357 - RNA, 64 nt, hsa
agacuguuuuuagguuuugcuauuacaaaauacuacacaggagcaucacuaugccugugugaaa

SEQ ID NO: 574358 - RNA, 64 nt, hsa
gacugcugaaggaaccccauggaugaggugcaggcuacuucacucuuuuuuuuucuuuuuugag

SEQ ID NO: 574359 - RNA, 64 nt, hsa
guugggauuauaggugugagccacugcacccagccuacuucacucuucugaauuauucugauuu

SEQ ID NO: 574360 - RNA, 64 nt, hsa
guucauucaauuccagaaaaacucauggaugagacuacuucagaaucagguacugaugaagagc

SEQ ID NO: 574361 - RNA, 64 nt, hsa
acaaagguggcagcaguugaaggaagagauugagcuacuucaggacuuaaaacaaaccuugugc

SEQ ID NO: 574362 - RNA, 64 nt, hsa; identical to SEQ ID NO: 154522

SEQ ID NO: 574363 - RNA, 64 nt, hsa; identical to SEQ ID NO: 154523

SEQ ID NO: 574364 - RNA, 64 nt, hsa; identical to SEQ ID NO: 154524

SEQ ID NO: 574365 - RNA, 64 nt, hsa; identical to SEQ ID NO: 154525

SEQ ID NO: 574366 - RNA, 64 nt, hsa; identical to SEQ ID NO: 154526

SEQ ID NO: 574367 - RNA, 64 nt, hsa; identical to SEQ ID NO: 154527

SEQ ID NO: 574368 - RNA, 64 nt, hsa; identical to SEQ ID NO: 154528

SEQ ID NO: 574369 - RNA, 64 nt, hsa; identical to SEQ ID NO: 154529

SEQ ID NO: 574370 - RNA, 64 nt, hsa; identical to SEQ ID NO: 154530

SEQ ID NO: 574371 - RNA, 64 nt, hsa; identical to SEQ ID NO: 154531

SEQ ID NO: 574372 - RNA, 64 nt, hsa; identical to SEQ ID NO: 154532

SEQ ID NO: 574373 - RNA, 64 nt, hsa; identical to SEQ ID NO: 154533

SEQ ID NO: 574374 - RNA, 64 nt, hsa; identical to SEQ ID NO: 154534

SEQ ID NO: 574375 - RNA, 64 nt, hsa; identical to SEQ ID NO: 154535

SEQ ID NO: 574376 - RNA, 64 nt, hsa; identical to SEQ ID NO: 154536

SEQ ID NO: 574377 - RNA, 64 nt, hsa; identical to SEQ ID NO: 154537

SEQ ID NO: 574378 - RNA, 64 nt, hsa; identical to SEQ ID NO: 154538

SEQ ID NO: 574379 - RNA, 64 nt, hsa; identical to SEQ ID NO: 154539

SEQ ID NO: 574380 - RNA, 64 nt, hsa; identical to SEQ ID NO: 154540

SEQ ID NO: 574381 - RNA, 64 nt, hsa; identical to SEQ ID NO: 154541

SEQ ID NO: 574382 - RNA, 64 nt, hsa; identical to SEQ ID NO: 154542

SEQ ID NO: 574383 - RNA, 64 nt, hsa; identical to SEQ ID NO: 154543

SEQ ID NO: 574384 - RNA, 64 nt, hsa; identical to SEQ ID NO: 154544

SEQ ID NO: 574385 - RNA, 64 nt, hsa; identical to SEQ ID NO: 154545

SEQ ID NO: 574386 - RNA, 64 nt, hsa; identical to SEQ ID NO: 154546

SEQ ID NO: 574387 - RNA, 64 nt, hsa; identical to SEQ ID NO: 154547

SEQ ID NO: 574388 - RNA, 64 nt, hsa; identical to SEQ ID NO: 154548

SEQ ID NO: 574389 - RNA, 64 nt, hsa; identical to SEQ ID NO: 154549

SEQ ID NO: 574390 - RNA, 64 nt, hsa; identical to SEQ ID NO: 154550

SEQ ID NO: 574391 - RNA, 64 nt, hsa; identical to SEQ ID NO: 154551

SEQ ID NO: 574392 - RNA, 64 nt, hsa
caacacuugcauuguagagaaaggcuucuuauauccuuuucaauagacugcccuggcucuuucc

SEQ ID NO: 574393 - RNA, 64 nt, hsa
cuuuguacagagauuuguacauuuguguaauaggccuuuucaugcuuuauguguagcuuuuuac

SEQ ID NO: 574394 - RNA, 64 nt, hsa
agggaaaagauaaagaccagaaauucccuuuucaccuuuucaggaaaauaacuuagacucuagu

SEQ ID NO: 574395 - RNA, 64 nt, hsa
aggugauaagggaaaagauaaagaccagaaauucccuuuucaccuuuucaggaaaauaacuuag

SEQ ID NO: 574396 - RNA, 64 nt, hsa
ugaacuuuggcaaugagaacacagcacacagcucccuuuucaaaaagggucucaaccccagugu

SEQ ID NO: 574397 - RNA, 64 nt, hsa
aaagggggagcucaauagcucaaaagugacaaguccuuuucacagcaccauucucagaacaccu

SEQ ID NO: 574398 - RNA, 64 nt, hsa
ggagggacuuguuuacgggaauuuuuuuaguuuuccuuuucaaaggaaaacauuaaaaucccuu

SEQ ID NO: 574399 - RNA, 64 nt, hsa
cucucugccuugaaaacuaaagagacuauuacuuccuuuucacaugaccacaaguccucugaug

SEQ ID NO: 574400 - RNA, 64 nt, hsa
cuagccacuguuaauaucuauuuguauucuuauaccuuuucaauauauuugaacaaauauaguu

SEQ ID NO: 574401 - RNA, 64 nt, hsa
agaucucucuaagaguuuuuuuccuucugagcuuccuuuucaaaauaaaagugacaauuguagc

SEQ ID NO: 574402 - RNA, 64 nt, hsa
uucaucaucgcuguaacuaguaaguucaucuaguccuuuucaaauagaaaaacaacaaaaccca

SEQ ID NO: 574403 - RNA, 64 nt, hsa
uucagugauucuguuuucauaggcuuuuuaaagcccuuuucagucaaauuagaugcuccuuugu

SEQ ID NO: 574404 - RNA, 64 nt, hsa
uguaaaugcaguuauaaccuuuuauacagauuuaccuuuucaguguucaguacaaguuuaaguu

SEQ ID NO: 574405 - RNA, 64 nt, hsa
aguuaccagaaguauggccucuaaugguguugagccuuuucaagaaccaacaaauuaucuuugu

SEQ ID NO: 574406 - RNA, 64 nt, hsa
accuccauauuuucaggauuuuugaagcuguugaccuuuucauguugauuauuuuaaauugugu

SEQ ID NO: 574407 - RNA, 64 nt, hsa
aacguguauuuuuuuaauauaaauauauaacuguccuuuucaucccauguugccgcuaagugau

SEQ ID NO: 574408 - RNA, 64 nt, hsa
auuuucccugcccucagguugccuauguauuuuaccuuuucauauuuaaggcaaaaguacuuga

SEQ ID NO: 574409 - RNA, 64 nt, hsa
aaucauguuuucuugcugugauagguuuugcaagccuuuucauuauuuuuuagcuuuuaugcuu

SEQ ID NO: 574410 - RNA, 64 nt, hsa
aagaaaaaguguaacacuaaggugaacuugcuucccuuuucacuaauuuugcuaaacuuuguaa

SEQ ID NO: 574411 - RNA, 64 nt, hsa
aagcaagugaaguauagcugcuucuuuuaaccugccuuuucacugaauguuggcagcauuuagu

SEQ ID NO: 574412 - RNA, 64 nt, hsa
uccuuuugaugcacugaccaggaauugugauaauccuuuucauuuuuauggcuuuuuacaguuu

SEQ ID NO: 574413 - RNA, 64 nt, hsa
aacuaugcagccaugaaacacaagaaaaucauguccuuuucagcaacauggaugcaacuagagg

SEQ ID NO: 574414 - RNA, 64 nt, hsa
uucauaacaugauaguuuccuaaccuuuucauaaccuuuucauaacaugauaguuuccauaaca

SEQ ID NO: 574415 - RNA, 64 nt, hsa
aauauuagcuuuucauaacaugauaguuuccuaaccuuuucauaaccuuuucauaacaugauag

SEQ ID NO: 574416 - RNA, 63 nt, hsa
aggacauccuggaggugugaacuucuucucugaccuuuucaauaauauuuuaaauacaguuuu

SEQ ID NO: 574417 - RNA, 64 nt, hsa
cuuccucaggaaaucugaaauacaauugcuguugccuuuucagagaaacuuuugguuuucuuua

SEQ ID NO: 574418 - RNA, 64 nt, hsa
guagcccccagggaucaugugaaagugagaaagcccuuuucacacuguggagcggugcagaugu

SEQ ID NO: 574419 - RNA, 64 nt, hsa
uugaacaaugauacacagcugcaccggggggucaccuuuucacaaauguagaccuccaugaacu

SEQ ID NO: 574420 - RNA, 64 nt, hsa
agaaaugugcugcauugccgaguucuuauuuucaccuuuucauaaucccaacuacaauaacaag

SEQ ID NO: 574421 - RNA, 64 nt, hsa
ggguggcucccuugcuccaggaacugaacgaggcccuuuucauaccuuaaauauauucugcaca

SEQ ID NO: 574422 - RNA, 64 nt, hsa
guaguauuauauauaaaauauaguuccccgucccccuuuucauugaguuugauauucuucagua

SEQ ID NO: 574423 - RNA, 64 nt, hsa
aauuaguauuuauaugaaagucaagaucuaaguaccuuuucauauaauucaaacugauugcuug

SEQ ID NO: 574424 - RNA, 64 nt, hsa
acuggucuaaaaacuauuguuaucuuuuuuuuuuccuuuucacuguuauggccuuuucacauuu

SEQ ID NO: 574425 - RNA, 64 nt, hsa
uguuaucuuuuuuuuuuccuuuucacuguuauggccuuuucacauuucuaaaucccaucuugau

SEQ ID NO: 574426 - RNA, 64 nt, hsa
uagaagaaugaaguacucugaaguauuuugguugccuuuucauuucaacuguguuuugaauuug

SEQ ID NO: 574427 - RNA, 64 nt, hsa
augaauaaacuuuaaaaaugugaaguguccuuuuccuuuucacaauacaaaaaaaauuucaaca

SEQ ID NO: 574428 - RNA, 64 nt, hsa
cccacuugcccuuucucuuuagucuuugucccuuccuuuucacuaagugccccucauccuuuuc

SEQ ID NO: 574429 - RNA, 64 nt, hsa
cuuugucccuuccuuuucacuaagugccccucauccuuuucaaucucauugucacuggauagug

SEQ ID NO: 574430 - RNA, 64 nt, hsa
gguaaccauguuguguucuucuaggcauuacuggccuuuucacugacaaguuaccccugaaauc

SEQ ID NO: 574431 - RNA, 64 nt, hsa
ucugcaguggcaaaugguaggggcaauagcgcucccuuuucaccugaaaugccuucagcucagg

SEQ ID NO: 574432 - RNA, 64 nt, hsa
aauucaaguuuaugggagaaaucucaauuagccaccuuuucacaguuguguggauauaacauuu

SEQ ID NO: 574433 - RNA, 64 nt, hsa
guaugucaguauauuaugcagaagauagauacagccuuuucagaagaucuccacuaguuuuugu

SEQ ID NO: 574434 - RNA, 64 nt, hsa
uuaauguauuaguccaaauuauuuuuacguagucaucaacaauuugaccagggccuuuauuugg

SEQ ID NO: 574435 - RNA, 64 nt, hsa
aaaagacaagcacuuuggaagaauuauuuuaaugaucaacaauuuaauguauuaguccaaauua

SEQ ID NO: 574436 - RNA, 64 nt, hsa
ucuuuucaccccaccuucaaucaacaaguccucaaucaacaaguccuacugacugcacaucuua

SEQ ID NO: 574437 - RNA, 64 nt, hsa
cagaaaccugugucaucuuuucaccccaccuucaaucaacaaguccucaaucaacaaguccuac

SEQ ID NO: 574438 - RNA, 64 nt, hsa
uuuagcauucuaaauuuaaaugcuuaaaacgucaaucaacaaaacuuuguuuuaaauauuguaa

SEQ ID NO: 574439 - RNA, 64 nt, hsa
acaaaugaauccagacuugucuaacagauuuuccaucaacaaauauuguuaugugcaaaaguau

SEQ ID NO: 574440 - RNA, 64 nt, hsa; identical to SEQ ID NO: 172974

SEQ ID NO: 574441 - RNA, 64 nt, hsa; identical to SEQ ID NO: 172975

SEQ ID NO: 574442 - RNA, 64 nt, hsa; identical to SEQ ID NO: 172976

SEQ ID NO: 574443 - RNA, 64 nt, hsa; identical to SEQ ID NO: 172977

SEQ ID NO: 574444 - RNA, 64 nt, hsa; identical to SEQ ID NO: 172978

SEQ ID NO: 574445 - RNA, 64 nt, hsa; identical to SEQ ID NO: 172979

SEQ ID NO: 574446 - RNA, 64 nt, hsa; identical to SEQ ID NO: 172980

SEQ ID NO: 574447 - RNA, 64 nt, hsa; identical to SEQ ID NO: 172981

SEQ ID NO: 574448 - RNA, 64 nt, hsa; identical to SEQ ID NO: 172982

SEQ ID NO: 574449 - RNA, 64 nt, hsa; identical to SEQ ID NO: 172983

SEQ ID NO: 574450 - RNA, 64 nt, hsa; identical to SEQ ID NO: 172984

SEQ ID NO: 574451 - RNA, 64 nt, hsa; identical to SEQ ID NO: 172985

SEQ ID NO: 574452 - RNA, 64 nt, hsa; identical to SEQ ID NO: 172986

SEQ ID NO: 574453 - RNA, 64 nt, hsa; identical to SEQ ID NO: 172987

SEQ ID NO: 574454 - RNA, 64 nt, hsa; identical to SEQ ID NO: 172988

SEQ ID NO: 574455 - RNA, 54 nt, hsa; identical to SEQ ID NO: 172989

SEQ ID NO: 574456 - RNA, 64 nt, hsa; identical to SEQ ID NO: 172990

SEQ ID NO: 574457 - RNA, 64 nt, hsa; identical to SEQ ID NO: 172991

SEQ ID NO: 574458 - RNA, 64 nt, hsa; identical to SEQ ID NO: 172992

SEQ ID NO: 574459 - RNA, 64 nt, hsa; identical to SEQ ID NO: 172993

SEQ ID NO: 574460 - RNA, 64 nt, hsa; identical to SEQ ID NO: 172994

SEQ ID NO: 574461 - RNA, 64 nt, hsa; identical to SEQ ID NO: 172995

SEQ ID NO: 574462 - RNA, 64 nt, hsa; identical to SEQ ID NO: 172996

SEQ ID NO: 574463 - RNA, 64 nt, hsa; identical to SEQ ID NO: 172997

SEQ ID NO: 574464 - RNA, 64 nt, hsa; identical to SEQ ID NO: 172998

SEQ ID NO: 574465 - RNA, 64 nt, hsa; identical to SEQ ID NO: 172999

SEQ ID NO: 574466 - RNA, 64 nt, hsa; identical to SEQ ID NO: 173000

SEQ ID NO: 574467 - RNA, 64 nt, hsa; identical to SEQ ID NO: 173001

SEQ ID NO: 574468 - RNA, 64 nt, hsa; identical to SEQ ID NO: 173002

SEQ ID NO: 574469 - RNA, 64 nt, hsa; identical to SEQ ID NO: 173003

SEQ ID NO: 574470 - RNA, 64 nt, hsa; identical to SEQ ID NO: 173004

SEQ ID NO: 574471 - RNA, 61 nt, hsa; identical to SEQ ID NO: 173005

SEQ ID NO: 574472 - RNA, 64 nt, hsa; identical to SEQ ID NO: 173006

SEQ ID NO: 574473 - RNA, 64 nt, hsa; identical to SEQ ID NO: 173007

SEQ ID NO: 574474 - RNA, 64 nt, hsa; identical to SEQ ID NO: 173008

SEQ ID NO: 574475 - RNA, 64 nt, hsa; identical to SEQ ID NO: 173009

SEQ ID NO: 574476 - RNA, 64 nt, hsa
gagcuugucagcaagaggaggacagaauucucccagcguuaacacaaaauccaugggcaguaug

SEQ ID NO: 574477 - RNA, 64 nt, hsa
auaaaaaauguuuagauacauaaauaugguggucagcguuaauaaaguggagaaauauuggaga

SEQ ID NO: 574478 - RNA, 64 nt, hsa
aaaccucucauaaucccacugcauagaaauaacaagcguuaacauuuucauauuuuuuucuuuc

SEQ ID NO: 574479 - RNA, 64 nt, hsa
uccacuaagaaaugccaagauucuuaaauuugccagcguuaaaguagaaaauaacauuucagaa

SEQ ID NO: 574480 - RNA, 64 nt, hsa
uuuuuaaagaagaaaaaaaaaaauucacacugccagcguuaacaguuccuuucaaaggagaaug

SEQ ID NO: 574481 - RNA, 64 nt, hsa
ccauaaaacuuagcuaaguuuuguuuuguuuuucagcguuaauguaaaggggcagcagugccaa

SEQ ID NO: 574482 - RNA, 64 nt, hsa
ucucgcaauuuugaggaggcuguuccgaccuggaagcguuaaacugcugcaugucaucuggcgu

SEQ ID NO: 574483 - RNA, 64 nt, hsa
aaacaauccaaaucuaagcuuagaagaaaaguuuagcguuaagcaccuuuaucuucaugaauaa

SEQ ID NO: 574484 - RNA, 64 nt, hsa
gguauuauguuaaaugucuguuuuaaaagaaaguagcguuaagauagaucaguaaccaaaauca

SEQ ID NO: 574485 - RNA, 64 nt, hsa
gguauuauguuaacugucuguuuuaaaagaaaguagcguuaagauagaucaguaaccaaaauca

SEQ ID NO: 574486 - RNA, 64 nt, hsa
uaaauagcgacuucaguauuguguuauguuuuacagcguuaaaacaacuaugaagaucugcagc

SEQ ID NO: 574487 - RNA, 64 nt, hsa
cucaggauaaaaacuguaaacaaagcaaugccuuagcguuaaccuucguaacuaauuacauauc

SEQ ID NO: 574488 - RNA, 64 nt, hsa
ccuguacauugucacauugcauuauuuuucuucaagcguuaauaaaaguuuuaaauaaauggcu

SEQ ID NO: 574489 - RNA, 64 nt, hsa
augaacuuuggucccaaauauccaucuuuucaguagcguuaauuaugcucuguuuccaacugca

SEQ ID NO: 574490 - RNA, 64 nt, hsa
aaaaagcaaugaauauguaagaaucaucagcuguagcguuaacacuaaauacaccaaggacaaa

SEQ ID NO: 574491 - RNA, 64 nt, hsa
gccacugaaacuggguauauuuaugauuucuuucagcguuaaaaagaaacauaguguugcccuu

SEQ ID NO: 574492 - RNA, 64 nt, hsa
aacuaauguuuuauggcacuuaagaauaauuagcagcguuaaauuuuguuuguauuaagcacuu

SEQ ID NO: 574493 - RNA, 64 nt, hsa
caauucaguccugggcaaagguauuaguacaauaagcguuaagggcagagucuaccuugaaacc

SEQ ID NO: 574494 - RNA, 64 nt, hsa
ugugaacagagaaaugccucccguaguguuugaaagcguuaagcugauaauguaauuaacaacu

SEQ ID NO: 574495 - RNA, 64 nt, hsa
agaauguguauaggaggguuuggcugaguccuucagcguuaaguggaggaaagcuuggggaagc

SEQ ID NO: 574496 - RNA, 64 nt, hsa
uguuagauguccucagaagucaguugcaaauuuuagcguuaaagucaggauuuauuguucauac

SEQ ID NO: 574497 - RNA, 64 nt, hsa
auauucuguaaaccuaaugucuguauaaauaaugagcguuaacacaguaaaauauucaauaaga

SEQ ID NO: 574498 - RNA, 64 nt, hsa
uuucuacacaauauaaauauccaguauaaaggaaagcguuaagucgguaagcuagaggauugua

SEQ ID NO: 574499 - RNA, 64 nt, hsa
gguagaaaaaaaacaagaaaaaaauuuuaaaaauagcguuaaaaugcauuuuaggcuccuaaug

SEQ ID NO: 574500 - RNA, 64 nt, hsa
ucaguacauugauguuuugauggcggacuacauaagcguuaaaaauuguguuuuucagaaucuu

SEQ ID NO: 574501 - RNA, 64 nt, hsa
aaacggcucuuuuauuuaugaaggcccugggagcagcguuaagggcuccaggauccagcucucu

SEQ ID NO: 574502 - RNA, 64 nt, hsa
augaaacugggccaaggggaaaauucaguaaguuagcguuaaauggaaguaaauauauguauac

SEQ ID NO: 574503 - RNA, 64 nt, hsa
ggacaacucauuaguguuuugacuuuucuuacccagcguuaauugaauucuugcuuuuagacaa

SEQ ID NO: 574504 - RNA, 64 nt, hsa
uagcgauauaaccuugcuuugcaaacagaaugcaagcguuaacuuuggucuucuguauuuugga

SEQ ID NO: 574505 - RNA, 64 nt, hsa
acaguguaaguuuccauuaacaaaaccauccuaaagcguuaacugcucauaauuuuaaucagcu

SEQ ID NO: 574506 - RNA, 64 nt, hsa
ucucaagcaugguuccaacucugugucacuuuuuagcguuaauggcaguugugugucuguggca

SEQ ID NO: 574507 - RNA, 64 nt, hsa
uaauuuuggcaaauuguuaagacacugugaagucagcguuaaccaugugcauacaacuuaagga

SEQ ID NO: 574508 - RNA, 64 nt, hsa
agagaggggaauggccaaaaucacaaagcaaguuagcguuaagagcugagacuagaauucaggg

SEQ ID NO: 574509 - RNA, 64 nt, hsa
ucuuugccucuccccggggggaccaaaccgucccagcguuaaugucgucacuugaaaacgagaa

SEQ ID NO: 574510 - RNA, 64 nt, hsa
uuagaaagaaaaaugaggcaaugauuuuauuaacagcguuaaguuuuaauuuacaacuuuuaaa

SEQ ID NO: 574511 - RNA, 64 nt, hsa
gcgcugugacccugcaguagcgcaaaggcugcgcagcguuaaugcgcauugcgugcgaaugaac

SEQ ID NO: 574512 - RNA, 64 nt, hsa
cauaacucauugaauuuuggagaggaauaagcuuagcguuaauauugacaauauuaaggcaaua

SEQ ID NO: 574513 - RNA, 64 nt, hsa; identical to SEQ ID NO: 129470

SEQ ID NO: 574514 - RNA, 64 nt, hsa; identical to SEQ ID NO: 129471

SEQ ID NO: 574515 - RNA, 64 nt, hsa; identical to SEQ ID NO: 129472

SEQ ID NO: 574516 - RNA, 64 nt, hsa; identical to SEQ ID NO: 129473

SEQ ID NO: 574517 - RNA, 64 nt, hsa; identical to SEQ ID NO: 129474

SEQ ID NO: 574518 - RNA, 64 nt, hsa; identical to SEQ ID NO: 129475

SEQ ID NO: 574519 - RNA, 64 nt, hsa; identical to SEQ ID NO: 129476

SEQ ID NO: 574520 - RNA, 64 nt, hsa; identical to SEQ ID NO: 129477

SEQ ID NO: 574521 - RNA, 64 nt, hsa; identical to SEQ ID NO: 129478

SEQ ID NO: 574522 - RNA, 64 nt, hsa; identical to SEQ ID NO: 129479

SEQ ID NO: 574523 - RNA, 64 nt, hsa
caaccaagaauucuguauccugggacagucagauucuucuaaaucaggccaggaaggaggggaa

SEQ ID NO: 574524 - RNA, 64 nt, hsa
cuccuuaagucuuguaggggguuccaaggauggcucuucuaaccagaggcuggccugucuuuaa

SEQ ID NO: 574525 - RNA, 64 nt, hsa
cuuguuagaaaucccuggaggcauuucaaauucaucuucuaaccuaccuaagcacuuuaaaaua

SEQ ID NO: 574526 - RNA, 64 nt, hsa
uagagucccuggcuucuggccacugccuccucccucuucuaagccuuggccugaaucugguuga

SEQ ID NO: 574527 - RNA, 64 nt, hsa
uuuuaauucucaaaaguguaggaggcuaauauugucuucuaaguuccaaaagaagauguaauaa

SEQ ID NO: 574528 - RNA, 64 nt, hsa
uaauccaaggucaagaagauuaaugccuguguuuucuucuaagaacuauacuuuuaguucucac

SEQ ID NO: 574529 - RNA, 64 nt, hsa
uacgauaauguguacuaugacaaacgugcuuuauucuucuaacgcaguaagaauuagguggaau

SEQ ID NO: 574530 - RNA, 64 nt, hsa
gaaauucuuauuuugaccaucaaugccuaugaauucuucuaauacgugaagaaaauaguuugag

SEQ ID NO: 574531 - RNA, 64 nt, hsa
ucuucuaugguaguaccuacagaucugcccuucuucuucuaaaggguaagucauaaucugugua

SEQ ID NO: 574532 - RNA, 64 nt, hsa
uacaauuuaugggaugcucacuaugcccuguuucucuucuaaacaauuuacauguaaugucuca

SEQ ID NO: 574533 - RNA, 64 nt, hsa
acccuuuacuaaagaaauaaacuucaauauuuucucuucuaaccaacuuaaaagacaccaaucu

SEQ ID NO: 574534 - RNA, 64 nt, hsa
ucuccguuuucauuaacuuuaugcaauugcuauaucuucuaauuguauguaguaaguuuccuuu

SEQ ID NO: 574535 - RNA, 64 nt, hsa
aacuaccuauccuuacauuucaccuacuaaugucucuucuaacaucuuagagguccauggagaa

SEQ ID NO: 574536 - RNA, 64 nt, hsa
aucugguucuauaugaaugcuauuuuuucccuucucuucuaacaugaaauauauuuucucuuuu

SEQ ID NO: 574537 - RNA, 64 nt, hsa
aagauuucuugaaggauuuuagaaaucauauaucucuucuaacccccugaaauccugaguuuaa

SEQ ID NO: 574538 - RNA, 64 nt, hsa
cgaggagggccggggaggacacuuccggacacgcucuucuaaagcgugugcagcacggggcgaa

SEQ ID NO: 574539 - RNA, 64 nt, hsa
uacagcugggaaaaaucauuuaacacaaagccuaucuucuaaugaaguauggaauaucucaugu

SEQ ID NO: 574540 - RNA, 64 nt, hsa
gggcaaaaccaugacuuucauugggcagacagagucuucuaagcccacagggauccccagaugg

SEQ ID NO: 574541 - RNA, 64 nt, hsa
acucaggccaagaaacgucuucuaaacuuccccaucuucuaaacccaauccaaauggcgucugg

SEQ ID NO: 574542 - RNA, 64 nt, hsa
aucucuacucuuaagagacucaggccaagaaacgucuucuaaacuuccccaucuucuaaaccca

SEQ ID NO: 574543 - RNA, 51 nt, hsa; identical to SEQ ID NO: 516816

SEQ ID NO: 574544 - RNA, 64 nt, hsa; identical to SEQ ID NO: 516817

SEQ ID NO: 574545 - RNA, 64 nt, hsa; identical to SEQ ID NO: 516818

SEQ ID NO: 574546 - RNA, 64 nt, hsa; identical to SEQ ID NO: 516819

SEQ ID NO: 574547 - RNA, 64 nt, hsa; identical to SEQ ID NO: 516820

SEQ ID NO: 574548 - RNA, 64 nt, hsa; identical to SEQ ID NO: 516821

SEQ ID NO: 574549 - RNA, 64 nt, hsa; identical to SEQ ID NO: 516822

SEQ ID NO: 574550 - RNA, 64 nt, hsa; identical to SEQ ID NO: 516823

SEQ ID NO: 574551 - RNA, 64 nt, hsa; identical to SEQ ID NO: 516824

SEQ ID NO: 574552 - RNA, 64 nt, hsa; identical to SEQ ID NO: 516825

SEQ ID NO: 574553 - RNA, 64 nt, hsa; identical to SEQ ID NO: 516826

SEQ ID NO: 574554 - RNA, 64 nt, hsa; identical to SEQ ID NO: 516827

SEQ ID NO: 574555 - RNA, 64 nt, hsa; identical to SEQ ID NO: 516828

SEQ ID NO: 574556 - RNA, 64 nt, hsa; identical to SEQ ID NO: 516829

SEQ ID NO: 574557 - RNA, 64 nt, hsa; identical to SEQ ID NO: 516830

SEQ ID NO: 574558 - RNA, 64 nt, hsa; identical to SEQ ID NO: 516831

SEQ ID NO: 574559 - RNA, 64 nt, hsa; identical to SEQ ID NO: 516832

SEQ ID NO: 574560 - RNA, 64 nt, hsa; identical to SEQ ID NO: 516833

SEQ ID NO: 574561 - RNA, 64 nt, hsa; identical to SEQ ID NO: 516834

SEQ ID NO: 574562 - RNA, 64 nt, hsa; identical to SEQ ID NO: 516835

SEQ ID NO: 574563 - RNA, 64 nt, hsa; identical to SEQ ID NO: 516836

SEQ ID NO: 574564 - RNA, 64 nt, hsa; identical to SEQ ID NO: 516837

SEQ ID NO: 574565 - RNA, 64 nt, hsa; identical to SEQ ID NO: 516838

SEQ ID NO: 574566 - RNA, 64 nt, hsa; identical to SEQ ID NO: 516839

SEQ ID NO: 574567 - RNA, 64 nt, hsa; identical to SEQ ID NO: 516840

SEQ ID NO: 574568 - RNA, 64 nt, hsa; identical to SEQ ID NO: 516841

SEQ ID NO: 574569 - RNA, 64 nt, hsa; identical to SEQ ID NO: 516842

SEQ ID NO: 574570 - RNA, 64 nt, hsa; identical to SEQ ID NO: 516843

SEQ ID NO: 574571 - RNA, 64 nt, hsa; identical to SEQ ID NO: 516844

SEQ ID NO: 574572 - RNA, 64 nt, hsa; identical to SEQ ID NO: 516845

SEQ ID NO: 574573 - RNA, 64 nt, hsa; identical to SEQ ID NO: 516846

SEQ ID NO: 574574 - RNA, 64 nt, hsa; identical to SEQ ID NO: 516847

SEQ ID NO: 574575 - RNA, 64 nt, hsa; identical to SEQ ID NO: 516848

SEQ ID NO: 574576 - RNA, 64 nt, hsa; identical to SEQ ID NO: 516849

SEQ ID NO: 574577 - RNA, 64 nt, hsa; identical to SEQ ID NO: 516850

SEQ ID NO: 574578 - RNA, 64 nt, hsa; identical to SEQ ID NO: 516851

SEQ ID NO: 574579 - RNA, 64 nt, hsa; identical to SEQ ID NO: 516852

SEQ ID NO: 574580 - RNA, 64 nt, hsa; identical to SEQ ID NO: 516853

SEQ ID NO: 574581 - RNA, 64 nt, hsa; identical to SEQ ID NO: 516854

SEQ ID NO: 574582 - RNA, 64 nt, hsa; identical to SEQ ID NO: 516855

SEQ ID NO: 574583 - RNA, 64 nt, hsa; identical to SEQ ID NO: 516856

SEQ ID NO: 574584 - RNA, 64 nt, hsa; identical to SEQ ID NO: 516857

SEQ ID NO: 574585 - RNA, 64 nt, hsa; identical to SEQ ID NO: 516858

SEQ ID NO: 574586 - RNA, 64 nt, hsa; identical to SEQ ID NO: 516859

SEQ ID NO: 574587 - RNA, 64 nt, hsa; identical to SEQ ID NO: 516860

SEQ ID NO: 574588 - RNA, 64 nt, hsa; identical to SEQ ID NO: 516861

SEQ ID NO: 574589 - RNA, 64 nt, hsa; identical to SEQ ID NO: 516862

SEQ ID NO: 574590 - RNA, 64 nt, hsa; identical to SEQ ID NO: 516863

SEQ ID NO: 574591 - RNA, 64 nt, hsa; identical to SEQ ID NO: 516864

SEQ ID NO: 574592 - RNA, 64 nt, hsa; identical to SEQ ID NO: 516865

SEQ ID NO: 574593 - RNA, 64 nt, hsa; identical to SEQ ID NO: 516866

SEQ ID NO: 574594 - RNA, 64 nt, hsa; identical to SEQ ID NO: 235822

SEQ ID NO: 574595 - RNA, 64 nt, hsa; identical to SEQ ID NO: 235823

SEQ ID NO: 574596 - RNA, 64 nt, hsa; identical to SEQ ID NO: 235824

SEQ ID NO: 574597 - RNA, 64 nt, hsa; identical to SEQ ID NO: 235825

SEQ ID NO: 574598 - RNA, 64 nt, hsa; identical to SEQ ID NO: 235826

SEQ ID NO: 574599 - RNA, 64 nt, hsa; identical to SEQ ID NO: 235827

SEQ ID NO: 574600 - RNA, 64 nt, hsa; identical to SEQ ID NO: 235828

SEQ ID NO: 574601 - RNA, 64 nt, hsa; identical to SEQ ID NO: 235829

SEQ ID NO: 574602 - RNA, 64 nt, hsa; identical to SEQ ID NO: 235830

SEQ ID NO: 574603 - RNA, 64 nt, hsa; identical to SEQ ID NO: 235831

SEQ ID NO: 574604 - RNA, 64 nt, hsa; identical to SEQ ID NO: 235832

SEQ ID NO: 574605 - RNA, 64 nt, hsa; identical to SEQ ID NO: 235833

SEQ ID NO: 574606 - RNA, 64 nt, hsa; identical to SEQ ID NO: 235834

SEQ ID NO: 574607 - RNA, 64 nt, hsa; identical to SEQ ID NO: 235835

SEQ ID NO: 574608 - RNA, 64 nt, hsa; identical to SEQ ID NO: 235836

SEQ ID NO: 574609 - RNA, 64 nt, hsa; identical to SEQ ID NO: 235837

SEQ ID NO: 574610 - RNA, 64 nt, hsa; identical to SEQ ID NO: 235838

SEQ ID NO: 574611 - RNA, 64 nt, hsa; identical to SEQ ID NO: 235839

SEQ ID NO: 574612 - RNA, 64 nt, hsa; identical to SEQ ID NO: 235840

SEQ ID NO: 574613 - RNA, 64 nt, hsa; identical to SEQ ID NO: 235841

SEQ ID NO: 574614 - RNA, 64 nt, hsa; identical to SEQ ID NO: 235842

SEQ ID NO: 574615 - RNA, 64 nt, hsa; identical to SEQ ID NO: 235843

SEQ ID NO: 574616 - RNA, 64 nt, hsa; identical to SEQ ID NO: 235844

SEQ ID NO: 574617 - RNA, 64 nt, hsa; identical to SEQ ID NO: 235845

SEQ ID NO: 574618 - RNA, 55 nt, hsa; identical to SEQ ID NO: 235846

SEQ ID NO: 574619 - RNA, 64 nt, hsa; identical to SEQ ID NO: 235847

SEQ ID NO: 574620 - RNA, 64 nt, hsa; identical to SEQ ID NO: 235848

SEQ ID NO: 574621 - RNA, 64 nt, hsa; identical to SEQ ID NO: 235849

SEQ ID NO: 574622 - RNA, 64 nt, hsa; identical to SEQ ID NO: 235850

SEQ ID NO: 574623 - RNA, 64 nt, hsa; identical to SEQ ID NO: 235851

SEQ ID NO: 574624 - RNA, 64 nt, hsa; identical to SEQ ID NO: 235852

SEQ ID NO: 574625 - RNA, 64 nt, hsa; identical to SEQ ID NO: 235853

SEQ ID NO: 574626 - RNA, 64 nt, hsa; identical to SEQ ID NO: 235854

SEQ ID NO: 574627 - RNA, 64 nt, hsa; identical to SEQ ID NO: 235855

SEQ ID NO: 574628 - RNA, 64 nt, hsa; identical to SEQ ID NO: 235856

SEQ ID NO: 574629 - RNA, 64 nt, hsa; identical to SEQ ID NO: 235857

SEQ ID NO: 574630 - RNA, 64 nt, hsa; identical to SEQ ID NO: 235858

SEQ ID NO: 574631 - RNA, 64 nt, hsa; identical to SEQ ID NO: 235859

SEQ ID NO: 574632 - RNA, 64 nt, hsa; identical to SEQ ID NO: 235860

SEQ ID NO: 574633 - RNA, 64 nt, hsa; identical to SEQ ID NO: 235861

SEQ ID NO: 574634 - RNA, 64 nt, hsa; identical to SEQ ID NO: 235862

SEQ ID NO: 574635 - RNA, 64 nt, hsa; identical to SEQ ID NO: 235863

SEQ ID NO: 574636 - RNA, 64 nt, hsa; identical to SEQ ID NO: 235864

SEQ ID NO: 574637 - RNA, 64 nt, hsa; identical to SEQ ID NO: 235865

SEQ ID NO: 574638 - RNA, 64 nt, hsa; identical to SEQ ID NO: 235866

SEQ ID NO: 574639 - RNA, 64 nt, hsa; identical to SEQ ID NO: 235867

SEQ ID NO: 574640 - RNA, 64 nt, hsa; identical to SEQ ID NO: 235868

SEQ ID NO: 574641 - RNA, 64 nt, hsa; identical to SEQ ID NO: 235869

SEQ ID NO: 574642 - RNA, 64 nt, hsa; identical to SEQ ID NO: 235870

SEQ ID NO: 574643 - RNA, 64 nt, hsa; identical to SEQ ID NO: 235871

SEQ ID NO: 574644 - RNA, 64 nt, hsa; identical to SEQ ID NO: 235872

SEQ ID NO: 574645 - RNA, 64 nt, hsa; identical to SEQ ID NO: 235873

SEQ ID NO: 574646 - RNA, 64 nt, hsa; identical to SEQ ID NO: 235874

SEQ ID NO: 574647 - RNA, 64 nt, hsa; identical to SEQ ID NO: 235875

SEQ ID NO: 574648 - RNA, 64 nt, hsa; identical to SEQ ID NO: 235876

SEQ ID NO: 574649 - RNA, 64 nt, hsa; identical to SEQ ID NO: 235877

SEQ ID NO: 574650 - RNA, 64 nt, hsa; identical to SEQ ID NO: 235878

SEQ ID NO: 574651 - RNA, 64 nt, hsa; identical to SEQ ID NO: 235879

SEQ ID NO: 574652 - RNA, 64 nt, hsa; identical to SEQ ID NO: 235880

SEQ ID NO: 574653 - RNA, 64 nt, hsa; identical to SEQ ID NO: 235881

SEQ ID NO: 574654 - RNA, 64 nt, hsa; identical to SEQ ID NO: 235882

SEQ ID NO: 574655 - RNA, 64 nt, hsa; identical to SEQ ID NO: 235883

SEQ ID NO: 574656 - RNA, 64 nt, hsa; identical to SEQ ID NO: 235884

SEQ ID NO: 574657 - RNA, 64 nt, hsa; identical to SEQ ID NO: 235885

SEQ ID NO: 574658 - RNA, 64 nt, hsa; identical to SEQ ID NO: 235886

SEQ ID NO: 574659 - RNA, 64 nt, hsa; identical to SEQ ID NO: 111411

SEQ ID NO: 574660 - RNA, 64 nt, hsa; identical to SEQ ID NO: 111412

SEQ ID NO: 574661 - RNA, 64 nt, hsa; identical to SEQ ID NO: 111413

SEQ ID NO: 574662 - RNA, 64 nt, hsa; identical to SEQ ID NO: 111414

SEQ ID NO: 574663 - RNA, 64 nt, hsa; identical to SEQ ID NO: 111415

SEQ ID NO: 574664 - RNA, 64 nt, hsa; identical to SEQ ID NO: 111416

SEQ ID NO: 574665 - RNA, 64 nt, hsa; identical to SEQ ID NO: 111417

SEQ ID NO: 574666 - RNA, 64 nt, hsa; identical to SEQ ID NO: 111418

SEQ ID NO: 574667 - RNA, 64 nt, hsa; identical to SEQ ID NO: 111419

SEQ ID NO: 574668 - RNA, 64 nt, hsa; identical to SEQ ID NO: 111420

SEQ ID NO: 574669 - RNA, 64 nt, hsa; identical to SEQ ID NO: 111421

SEQ ID NO: 574670 - RNA, 64 nt, hsa; identical to SEQ ID NO: 111422

SEQ ID NO: 574671 - RNA, 64 nt, hsa; identical to SEQ ID NO: 111423

SEQ ID NO: 574672 - RNA, 64 nt, hsa; identical to SEQ ID NO: 111424

SEQ ID NO: 574673 - RNA, 64 nt, hsa; identical to SEQ ID NO: 111425

SEQ ID NO: 574674 - RNA, 64 nt, hsa; identical to SEQ ID NO: 111426

SEQ ID NO: 574675 - RNA, 64 nt, hsa; identical to SEQ ID NO: 111427

SEQ ID NO: 574676 - RNA, 64 nt, hsa; identical to SEQ ID NO: 111428

SEQ ID NO: 574677 - RNA, 64 nt, hsa; identical to SEQ ID NO: 111429

SEQ ID NO: 574678 - RNA, 64 nt, hsa; identical to SEQ ID NO: 111430

SEQ ID NO: 574679 - RNA, 64 nt, hsa; identical to SEQ ID NO: 111431

SEQ ID NO: 574680 - RNA, 64 nt, hsa; identical to SEQ ID NO: 111432

SEQ ID NO: 574681 - RNA, 64 nt, hsa; identical to SEQ ID NO: 111433

SEQ ID NO: 574682 - RNA, 64 nt, hsa; identical to SEQ ID NO: 111434

SEQ ID NO: 574683 - RNA, 58 nt, hsa; identical to SEQ ID NO: 111435

SEQ ID NO: 574684 - RNA, 64 nt, hsa; identical to SEQ ID NO: 111436

SEQ ID NO: 574685 - RNA, 64 nt, hsa; identical to SEQ ID NO: 111437

SEQ ID NO: 574686 - RNA, 64 nt, hsa; identical to SEQ ID NO: 111438

SEQ ID NO: 574687 - RNA, 64 nt, hsa; identical to SEQ ID NO: 111439

SEQ ID NO: 574688 - RNA, 64 nt, hsa; identical to SEQ ID NO: 111440

SEQ ID NO: 574689 - RNA, 64 nt, hsa; identical to SEQ ID NO: 111441

SEQ ID NO: 574690 - RNA, 64 nt, hsa; identical to SEQ ID NO: 111442

SEQ ID NO: 574691 - RNA, 64 nt, hsa; identical to SEQ ID NO: 111443

SEQ ID NO: 574692 - RNA, 64 nt, hsa; identical to SEQ ID NO: 111444

SEQ ID NO: 574693 - RNA, 64 nt, hsa; identical to SEQ ID NO: 111445

SEQ ID NO: 574694 - RNA, 64 nt, hsa; identical to SEQ ID NO: 111446

SEQ ID NO: 574695 - RNA, 64 nt, hsa; identical to SEQ ID NO: 111447

SEQ ID NO: 574696 - RNA, 64 nt, hsa; identical to SEQ ID NO: 111448

SEQ ID NO: 574697 - RNA, 64 nt, hsa; identical to SEQ ID NO: 111449

SEQ ID NO: 574698 - RNA, 64 nt, hsa; identical to SEQ ID NO: 111450

SEQ ID NO: 574699 - RNA, 64 nt, hsa; identical to SEQ ID NO: 111451

SEQ ID NO: 574700 - RNA, 64 nt, hsa; identical to SEQ ID NO: 111452

SEQ ID NO: 574701 - RNA, 64 nt, hsa; identical to SEQ ID NO: 111453

SEQ ID NO: 574702 - RNA, 64 nt, hsa; identical to SEQ ID NO: 111454

SEQ ID NO: 574703 - RNA, 64 nt, hsa; identical to SEQ ID NO: 111455

SEQ ID NO: 574704 - RNA, 64 nt, hsa; identical to SEQ ID NO: 111456

SEQ ID NO: 574705 - RNA, 64 nt, hsa; identical to SEQ ID NO: 111457

SEQ ID NO: 574706 - RNA, 64 nt, hsa; identical to SEQ ID NO: 111458

SEQ ID NO: 574707 - RNA, 64 nt, hsa; identical to SEQ ID NO: 111459

SEQ ID NO: 574708 - RNA, 52 nt, hsa; identical to SEQ ID NO: 111460

SEQ ID NO: 574709 - RNA, 64 nt, hsa; identical to SEQ ID NO: 111461

SEQ ID NO: 574710 - RNA, 64 nt, hsa; identical to SEQ ID NO: 111462

SEQ ID NO: 574711 - RNA, 64 nt, hsa; identical to SEQ ID NO: 111463

SEQ ID NO: 574712 - RNA, 64 nt, hsa; identical to SEQ ID NO: 111464

SEQ ID NO: 574713 - RNA, 64 nt, hsa; identical to SEQ ID NO: 111465

SEQ ID NO: 574714 - RNA, 64 nt, hsa; identical to SEQ ID NO: 111466

SEQ ID NO: 574715 - RNA, 64 nt, hsa; identical to SEQ ID NO: 111467

SEQ ID NO: 574716 - RNA, 64 nt, hsa
caacccauuugaagagaagaccacuaaugagaagaccacuaaagagagacaucaagaauggauu

SEQ ID NO: 574717 - RNA, 64 nt, hsa
uuccuagugagaaaacaacccauuugaagagaagaccacuaaugagaagaccacuaaagagaga

SEQ ID NO: 574718 - RNA, 64 nt, hsa; identical to SEQ ID NO: 296599

SEQ ID NO: 574719 - RNA, 64 nt, hsa; identical to SEQ ID NO: 296600

SEQ ID NO: 574720 - RNA, 64 nt, hsa; identical to SEQ ID NO: 296601

SEQ ID NO: 574721 - RNA, 64 nt, hsa; identical to SEQ ID NO: 296602

SEQ ID NO: 574722 - RNA, 64 nt, hsa
cagagucuagagaaagugaucaccaagcugucucaucaccaaauagguagucaaggcagccuca

SEQ ID NO: 574723 - RNA, 64 nt, hsa
guugaacagcauggcucagagucuagagaaagugaucaccaagcugucucaucaccaaauaggu

SEQ ID NO: 574724 - RNA, 64 nt, hsa
uccuaacugcagacuuuugcccuuuuucucucucaucaccaaagucccauccauuuuuuuuuaa

SEQ ID NO: 574725 - RNA, 64 nt, hsa
caacuaaacuuuucuaaagguuaccaguuauccaaucaccaaauccauggcuuuuucucaaagc

SEQ ID NO: 574726 - RNA, 64 nt, hsa
agagucugggggaagggucguggguggggaauuuaucaccaacauccauuguagggggaaucua

SEQ ID NO: 574727 - RNA, 64 nt, hsa
agcggaugaaggauggcagcaucucacaugccccaucaccaacucugaggcaccuggggugggg

SEQ ID NO: 574728 - RNA, 64 nt, hsa
uaagaauguagugcauguggccaagccuuuaguuaucaccaauccccuacuguuaaucagagau

SEQ ID NO: 574729 - RNA, 64 nt, hsa
cauuucaggcagccagcucuuccucacccacuacaucaccaaguccuguggauauaucugcuaa

SEQ ID NO: 574730 - RNA, 64 nt, hsa; identical to SEQ ID NO: 107009

SEQ ID NO: 574731 - RNA, 64 nt, hsa; identical to SEQ ID NO: 107010

SEQ ID NO: 574732 - RNA, 64 nt, hsa
cagaacuccugaauucugaagauugcccuccucccauuaauaggauuguauggauguaagaugg

SEQ ID NO: 574733 - RNA, 64 nt, hsa
uaccuucaccugggaaacugaucacuucacaugccauuaauaaaacccaagaucuuuuaaauca

SEQ ID NO: 574734 - RNA, 64 nt, hsa
cauuuaaugcauaaaucaacacaaaagguuuucccauuaauaugaaauauuacauauauauaag

SEQ ID NO: 574735 - RNA, 64 nt, hsa
cagugacucaaugauggggaaaaaaaucucugcucauuaauauuucaagauaaagaacaaaugu

SEQ ID NO: 574736 - RNA, 64 nt, hsa
ggaauaaaauuuguguaagaaaaaagcuguuuaacauuaauaaacuauauuucuucuuacacau

SEQ ID NO: 574737 - RNA, 64 nt, hsa
uaaagucuauuucugagauacgagaggguagucacauuaauagaagauucaugagugagauaua

SEQ ID NO: 574738 - RNA, 64 nt, hsa
aggacuuugaucuuuuaagguuuuuuuuccccagcauuaauauugauuuauaaagauuugaaaa

SEQ ID NO: 574739 - RNA, 64 nt, hsa
agcuauuaaauuuugauguugccucaguuauuuucauuaauaacuuuugcuaaaauuuaccuuu

SEQ ID NO: 574740 - RNA, 64 nt, hsa
uagaaacugcagauuuuagaucuaauguauacugcauuaauaaaugauauaaaguguuuguuga

SEQ ID NO: 574741 - RNA, 64 nt, hsa
aagauacuucaaaaccaaaaaaaccaaggugcaucauuaauauucauuuaauucaaauaccaaa

SEQ ID NO: 574742 - RNA, 64 nt, hsa
agugauaagauagccuugauuuuaaaagcugauucauuaauaucaaaauacuuuaauaaguguc

SEQ ID NO: 574743 - RNA, 64 nt, hsa
uauucuucuuuauaucucugacaugacauauuuucauuaauaguuuaaaucagugaccaucaua

SEQ ID NO: 574744 - RNA, 64 nt, hsa
caguugguugauuggauuuuuuucugagguacagcauuaauacuaguccaaaaaaugucauaaa

SEQ ID NO: 574745 - RNA, 64 nt, hsa
auauuccauuuagaaauuuugccauucuguuuuccauuaauaauaggugaaauacaggaaaacu

SEQ ID NO: 574746 - RNA, 64 nt, hsa
cacuccuaaguaccuuuaaggaaaauuaauaaaucauuaauaguuaaaauguuuacauugagca

SEQ ID NO: 574747 - RNA, 64 nt, hsa
uugguauaaaacaauauuuugacaguuuaggcuucauuaauagaacuauucugauuauuuggac

SEQ ID NO: 574748 - RNA, 64 nt, hsa
cccccucuccuuuuuuuguagacccauucaaaaccauuaauaagcccauuuuacuaagccccua

SEQ ID NO: 574749 - RNA, 64 nt, hsa
caguuuuuugauagcuuuuuaacaguuaugcuugcauuaauaauuucaauguggaccagacauu

SEQ ID NO: 574750 - RNA, 64 nt, hsa
aauuuuuaaagguauugguuaaauaacguuuaaaaacauguacugagaugaaucuaauuuuuag

SEQ ID NO: 574751 - RNA, 64 nt, hsa
ugaaucuaauuuuuagauugcccuguauuuuguuaacauguauauauguacaacaguguguuug

SEQ ID NO: 574752 - RNA, 64 nt, hsa
caauugaauccaaauuucaacgacaaaaaaaaaaaacauguauuuuagaguucaucuuuggcaa

SEQ ID NO: 574753 - RNA, 64 nt, hsa
ucuuaauuuuugccuuuugcauaagccucuuuauaacauguaucuuuaaaacaauuaagucuuu

SEQ ID NO: 574754 - RNA, 64 nt, hsa
ucgccagauagggaccggugaacaccugauuccaaacauguaggaugggggucuuguccucuuu

SEQ ID NO: 574755 - RNA, 64 nt, hsa
cuuuuugauuaagagcacaaacuuuuuuuuguaaaacauguaaaaaaaaaaacugggauuaauu

SEQ ID NO: 574756 - RNA, 64 nt, hsa
uuaaguggugcuuugugguaucugaacaauucauaacauguaaauaaugugggaaaauaguauu

SEQ ID NO: 574757 - RNA, 64 nt, hsa
uggcaugcagugaugaugugcucuuacacuuguuaacauguauuaaguguuauuugcaaaaggu

SEQ ID NO: 574758 - RNA, 64 nt, hsa
agaaguggccaccuccgaaaaauuccccuucuagaacauguagacacuugagaaauguuucugu

SEQ ID NO: 574759 - RNA, 64 nt, hsa
gaaugaaaaccuagagauuuuaaaucaugaauugaacauguaaaauuccaguaaaauguaaaaa

SEQ ID NO: 574760 - RNA, 64 nt, hsa
cuaaaaaaaacaccaacaacaaaagaaaugaugcaacauguaggcuuacuuaggaaguccagca

SEQ ID NO: 574761 - RNA, 64 nt, hsa
gacauuucuuuguuuucaacauuagaagugguguaacauguaagcugagcacgguggcaugccu

SEQ ID NO: 574762 - RNA, 64 nt, hsa
aacaaauaggaagaaauugaaauuucuuuucaucaacauguagagcugcuauuuuacuauuugg

SEQ ID NO: 574763 - RNA, 64 nt, hsa
uugauaaaauuaacacaaaaucagucaagaaggaaacauguauauuagugaaguguuuuuggag

SEQ ID NO: 574764 - RNA, 64 nt, hsa
gguaacccucucagguauauuuaccugguagaaaaacauguagauuguuucuauuacuuaaaug

SEQ ID NO: 574765 - RNA, 64 nt, hsa
auaauuauaauuuuaacauaucuucacuguagucaacauguagagucugcuucccucauuauug

SEQ ID NO: 574766 - RNA, 64 nt, hsa
caaccagaagcacauccauuuuuguagugucacaaacauguauaugccacacuuugcaccuuaa

SEQ ID NO: 574767 - RNA, 64 nt, hsa
cgaaggugggagggaggacugguacccacaaagcaacauguaccgagaggacuaaaugucaucu

SEQ ID NO: 574768 - RNA, 64 nt, hsa
auauuaugaccacacacaucucugcuggaaagucaacauguaguaagcaagauuuaacuguuug

SEQ ID NO: 574769 - RNA, 64 nt, hsa
agugaguggaaauggaaauaaugguuauaucuaaaacauguagaaaaagaguaacugguagauu

SEQ ID NO: 574770 - RNA, 64 nt, hsa
gcuuuugauacucagcugucauguuuauaauucaaacauguaguaaacauauguagguaagguu

SEQ ID NO: 574771 - RNA, 64 nt, hsa
uauccaagcugaaaagcaugccuauugacagauaaacauguaucuguaagaucagccuuuccca

SEQ ID NO: 574772 - RNA, 64 nt, hsa
uaacaccaucacaaauagguucauggucagccuaaacauguauacugugcauuuuaugggugac

SEQ ID NO: 574773 - RNA, 64 nt, hsa
auauauauauuuaucugaaacgugauauuuuaaaaacauguagguuuaacaaaccuuccuagga

SEQ ID NO: 574774 - RNA, 64 nt, hsa; identical to SEQ ID NO: 110317

SEQ ID NO: 574775 - RNA, 64 nt, hsa; identical to SEQ ID NO: 110318

SEQ ID NO: 574776 - RNA, 64 nt, hsa; identical to SEQ ID NO: 110319

SEQ ID NO: 574777 - RNA, 64 nt, hsa; identical to SEQ ID NO: 110320

SEQ ID NO: 574778 - RNA, 64 nt, hsa; identical to SEQ ID NO: 110321

SEQ ID NO: 574779 - RNA, 64 nt, hsa; identical to SEQ ID NO: 110322

SEQ ID NO: 574780 - RNA, 51 nt, hsa; identical to SEQ ID NO: 110323

SEQ ID NO: 574781 - RNA, 64 nt, hsa; identical to SEQ ID NO: 110324

SEQ ID NO: 574782 - RNA, 64 nt, hsa; identical to SEQ ID NO: 110325

SEQ ID NO: 574783 - RNA, 64 nt, hsa; identical to SEQ ID NO: 110326

SEQ ID NO: 574784 - RNA, 64 nt, hsa; identical to SEQ ID NO: 110327

SEQ ID NO: 574785 - RNA, 64 nt, hsa; identical to SEQ ID NO: 110328

SEQ ID NO: 574786 - RNA, 64 nt, hsa; identical to SEQ ID NO: 110329

SEQ ID NO: 574787 - RNA, 64 nt, hsa; identical to SEQ ID NO: 110330

SEQ ID NO: 574788 - RNA, 64 nt, hsa; identical to SEQ ID NO: 110331

SEQ ID NO: 574789 - RNA, 64 nt, hsa; identical to SEQ ID NO: 110332

SEQ ID NO: 574790 - RNA, 64 nt, hsa; identical to SEQ ID NO: 110333

SEQ ID NO: 574791 - RNA, 64 nt, hsa; identical to SEQ ID NO: 110334

SEQ ID NO: 574792 - RNA, 64 nt, hsa; identical to SEQ ID NO: 110335

SEQ ID NO: 574793 - RNA, 64 nt, hsa; identical to SEQ ID NO: 110336

SEQ ID NO: 574794 - RNA, 64 nt, hsa; identical to SEQ ID NO: 110337

SEQ ID NO: 574795 - RNA, 64 nt, hsa; identical to SEQ ID NO: 110338

SEQ ID NO: 574796 - RNA, 64 nt, hsa; identical to SEQ ID NO: 110339

SEQ ID NO: 574797 - RNA, 64 nt, hsa; identical to SEQ ID NO: 110340

SEQ ID NO: 574798 - RNA, 64 nt, hsa; identical to SEQ ID NO: 110341

SEQ ID NO: 574799 - RNA, 64 nt, hsa; identical to SEQ ID NO: 110342

SEQ ID NO: 574800 - RNA, 64 nt, hsa; identical to SEQ ID NO: 110343

SEQ ID NO: 574801 - RNA, 64 nt, hsa; identical to SEQ ID NO: 110344

SEQ ID NO: 574802 - RNA, 64 nt, hsa; identical to SEQ ID NO: 110345

SEQ ID NO: 574803 - RNA, 64 nt, hsa; identical to SEQ ID NO: 110346

SEQ ID NO: 574804 - RNA, 64 nt, hsa; identical to SEQ ID NO: 110347

SEQ ID NO: 574805 - RNA, 64 nt, hsa; identical to SEQ ID NO: 110348

SEQ ID NO: 574806 - RNA, 64 nt, hsa; identical to SEQ ID NO: 110349

SEQ ID NO: 574807 - RNA, 64 nt, hsa; identical to SEQ ID NO: 110350

SEQ ID NO: 574808 - RNA, 64 nt, hsa; identical to SEQ ID NO: 110351

SEQ ID NO: 574809 - RNA, 64 nt, hsa; identical to SEQ ID NO: 110352

SEQ ID NO: 574810 - RNA, 64 nt, hsa; identical to SEQ ID NO: 110353

SEQ ID NO: 574811 - RNA, 64 nt, hsa; identical to SEQ ID NO: 110354

SEQ ID NO: 574812 - RNA, 64 nt, hsa; identical to SEQ ID NO: 110355

SEQ ID NO: 574813 - RNA, 64 nt, hsa; identical to SEQ ID NO: 110356

SEQ ID NO: 574814 - RNA, 64 nt, hsa; identical to SEQ ID NO: 110357

SEQ ID NO: 574815 - RNA, 64 nt, hsa; identical to SEQ ID NO: 110358

SEQ ID NO: 574816 - RNA, 64 nt, hsa; identical to SEQ ID NO: 110359

SEQ ID NO: 574817 - RNA, 64 nt, hsa
aacccggcuguugccuuaaaugugugagagggacuuggccaaggcaaaagcuggggagaugcca

SEQ ID NO: 574818 - RNA, 64 nt, hsa
gcacagcucucaggcccagcccugggcgaccuccuuggccaagucugccuuucacccuggggug

SEQ ID NO: 574819 - RNA, 64 nt, hsa
auucacauauuagcaacaaaaucccguaauucuuuuggccaacagcagcuauuuuggggagcag

SEQ ID NO: 574820 - RNA, 64 nt, hsa
cuaggguuucagguugccuccccucauaugguuuuuggccaagugacuaaaacaguuuuccaca

SEQ ID NO: 574821 - RNA, 64 nt, hsa
ccacaugggagucucccagcaccucugacucagcuuggccaaugcagaacuuggcaucugaacc

SEQ ID NO: 574822 - RNA, 52 nt, hsa
gccugcauccuacagagugagcuuggccaagccagcugcaaaccuggccaga

SEQ ID NO: 574823 - RNA, 64 nt, hsa
gggcugcgugaaguccagugacccugaggggauuuuggccaaaggaaacagccagggcugggcu

SEQ ID NO: 574824 - RNA, 64 nt, hsa
cagucuucaauguccacuaauucacucuaagcauuuggccaaaaaaaggagagagaaauaacug

SEQ ID NO: 574825 - RNA, 64 nt, hsa
aaagcagcaacacugauacuugugugcaccugauuuggccaauaggaucaacagugaaaagaca

SEQ ID NO: 574826 - RNA, 64 nt, hsa
gaaaucagaucccagggugagaguaacaggccauuuggccaagaaagaaaccuguuuguuuuuc

SEQ ID NO: 574827 - RNA, 64 nt, hsa
augacaguaucugcagauacuauaauaauaugcuuuggccaaauuugcuguuuauagagugaac

SEQ ID NO: 574828 - RNA, 64 nt, hsa
uuugcuuauuuuaguauuuugaaucagagaauacuuggccaagcucguauuuguaaacuaaaac

SEQ ID NO: 574829 - RNA, 64 nt, hsa
uuagggcuuugguuuucauuccuuuuuguuuggcuuggccaaaccagaauucagcuuaucugaa

SEQ ID NO: 574830 - RNA, 64 nt, hsa
auugagguaacaagauaaagacaaauccacuucuuuggccaaauucaggcuuuggcuuuaugac

SEQ ID NO: 574831 - RNA, 64 nt, hsa
uuuuuucuuuuuuuccccuccaaacuccuuuuccuuggccaagccuucaugcuucccccuuucc

SEQ ID NO: 574832 - RNA, 64 nt, hsa
uccaccacggcuucccucuuggcucauuccaagcuuggccaaauuggggaagugggauggaggu

SEQ ID NO: 574833 - RNA, 64 nt, hsa
uguugucccugcugccucccucuggaguggccacuuggccaaagcgcccauccacaucuggaaa

SEQ ID NO: 574834 - RNA, 64 nt, hsa
accucaguuuuucugacacagcgaaucgagggcuuuggccaaggccaggucucucaaacuuguc

SEQ ID NO: 574835 - RNA, 64 nt, hsa
uguuucaaaggaagaaccagucaccuuucacuucuuggccaaauuuuauccugagaaugcugaa

SEQ ID NO: 574836 - RNA, 64 nt, hsa
aaguagcugggacuacaggcaugcaccaccacacuuggccaauguucuguauuuuuaauaggga

SEQ ID NO: 574837 - RNA, 64 nt, hsa
cggugccccaggaugggcuccucccggcgggggcuuggccaaagcuuucuuaauaaaaugccuu

SEQ ID NO: 574838 - RNA, 64 nt, hsa
gaguuauggagcgcuccgaccagacagcgucucauuggccaaagaugggaggguuccgcuuaaa

SEQ ID NO: 574839 - RNA, 64 nt, hsa
cuggaccauguccuaauauggugguuuuaaguuguuggccaaaauccuuuaaagacauacgaaa

SEQ ID NO: 574840 - RNA, 64 nt, hsa
ggcgggagaagguugucuccucuggggccagcauuuggccaagcucggaggcuuggccagcacu

SEQ ID NO: 574841 - RNA, 64 nt, hsa; identical to SEQ ID NO: 38255

SEQ ID NO: 574842 - RNA, 64 nt, hsa; identical to SEQ ID NO: 38256

SEQ ID NO: 574843 - RNA, 64 nt, hsa; identical to SEQ ID NO: 38257

SEQ ID NO: 574844 - RNA, 64 nt, hsa; identical to SEQ ID NO: 38258

SEQ ID NO: 574845 - RNA, 64 nt, hsa; identical to SEQ ID NO: 38259

SEQ ID NO: 574846 - RNA, 64 nt, hsa; identical to SEQ ID NO: 38260

SEQ ID NO: 574847 - RNA, 64 nt, hsa; identical to SEQ ID NO: 38261

SEQ ID NO: 574848 - RNA, 64 nt, hsa; identical to SEQ ID NO: 38262

SEQ ID NO: 574849 - RNA, 64 nt, hsa; identical to SEQ ID NO: 38263

SEQ ID NO: 574850 - RNA, 64 nt, hsa; identical to SEQ ID NO: 38264

SEQ ID NO: 574851 - RNA, 64 nt, hsa; identical to SEQ ID NO: 38265

SEQ ID NO: 574852 - RNA, 64 nt, hsa; identical to SEQ ID NO: 38266

SEQ ID NO: 574853 - RNA, 64 nt, hsa; identical to SEQ ID NO: 38267

SEQ ID NO: 574854 - RNA, 64 nt, hsa; identical to SEQ ID NO: 38268

SEQ ID NO: 574855 - RNA, 64 nt, hsa; identical to SEQ ID NO: 38269

SEQ ID NO: 574856 - RNA, 64 nt, hsa; identical to SEQ ID NO: 38270

SEQ ID NO: 574857 - RNA, 64 nt, hsa; identical to SEQ ID NO: 38271

SEQ ID NO: 574858 - RNA, 64 nt, hsa; identical to SEQ ID NO: 38272

SEQ ID NO: 574859 - RNA, 64 nt, hsa; identical to SEQ ID NO: 38273

SEQ ID NO: 574860 - RNA, 64 nt, hsa; identical to SEQ ID NO: 38274

SEQ ID NO: 574861 - RNA, 64 nt, hsa; identical to SEQ ID NO: 38275

SEQ ID NO: 574862 - RNA, 64 nt, hsa; identical to SEQ ID NO: 38276

SEQ ID NO: 574863 - RNA, 64 nt, hsa; identical to SEQ ID NO: 38277

SEQ ID NO: 574864 - RNA, 64 nt, hsa; identical to SEQ ID NO: 38278

SEQ ID NO: 574865 - RNA, 64 nt, hsa; identical to SEQ ID NO: 38279

SEQ ID NO: 574866 - RNA, 64 nt, hsa; identical to SEQ ID NO: 38280

SEQ ID NO: 574867 - RNA, 64 nt, hsa; identical to SEQ ID NO: 38281

SEQ ID NO: 574868 - RNA, 64 nt, hsa; identical to SEQ ID NO: 38282

SEQ ID NO: 574869 - RNA, 64 nt, hsa; identical to SEQ ID NO: 38283

SEQ ID NO: 574870 - RNA, 64 nt, hsa; identical to SEQ ID NO: 38284

SEQ ID NO: 574871 - RNA, 62 nt, hsa; identical to SEQ ID NO: 38285

SEQ ID NO: 574872 - RNA, 64 nt, hsa; identical to SEQ ID NO: 38286

SEQ ID NO: 574873 - RNA, 64 nt, hsa; identical to SEQ ID NO: 38287

SEQ ID NO: 574874 - RNA, 64 nt, hsa; identical to SEQ ID NO: 38288

SEQ ID NO: 574875 - RNA, 64 nt, hsa; identical to SEQ ID NO: 38289

SEQ ID NO: 574876 - RNA, 64 nt, hsa; identical to SEQ ID NO: 38290

SEQ ID NO: 574877 - RNA, 64 nt, hsa; identical to SEQ ID NO: 38291

SEQ ID NO: 574878 - RNA, 64 nt, hsa; identical to SEQ ID NO: 38292

SEQ ID NO: 574879 - RNA, 64 nt, hsa; identical to SEQ ID NO: 38293

SEQ ID NO: 574880 - RNA, 64 nt, hsa; identical to SEQ ID NO: 38294

SEQ ID NO: 574881 - RNA, 64 nt, hsa; identical to SEQ ID NO: 38295

SEQ ID NO: 574882 - RNA, 64 nt, hsa; identical to SEQ ID NO: 38296

SEQ ID NO: 574883 - RNA, 64 nt, hsa; identical to SEQ ID NO: 38297

SEQ ID NO: 574884 - RNA, 64 nt, hsa; identical to SEQ ID NO: 38298

SEQ ID NO: 574885 - RNA, 64 nt, hsa; identical to SEQ ID NO: 38299

SEQ ID NO: 574886 - RNA, 64 nt, hsa; identical to SEQ ID NO: 38300

SEQ ID NO: 574887 - RNA, 64 nt, hsa; identical to SEQ ID NO: 38301

SEQ ID NO: 574888 - RNA, 64 nt, hsa; identical to SEQ ID NO: 38302

SEQ ID NO: 574889 - RNA, 64 nt, hsa; identical to SEQ ID NO: 38303

SEQ ID NO: 574890 - RNA, 64 nt, hsa; identical to SEQ ID NO: 38304

SEQ ID NO: 574891 - RNA, 64 nt, hsa; identical to SEQ ID NO: 38305

SEQ ID NO: 574892 - RNA, 64 nt, hsa; identical to SEQ ID NO: 38306

SEQ ID NO: 574893 - RNA, 64 nt, hsa; identical to SEQ ID NO: 38307

SEQ ID NO: 574894 - RNA, 64 nt, hsa; identical to SEQ ID NO: 38308

SEQ ID NO: 574895 - RNA, 64 nt, hsa; identical to SEQ ID NO: 38309

SEQ ID NO: 574896 - RNA, 64 nt, hsa; identical to SEQ ID NO: 38310

SEQ ID NO: 574897 - RNA, 64 nt, hsa; identical to SEQ ID NO: 38311

SEQ ID NO: 574898 - RNA, 64 nt, hsa; identical to SEQ ID NO: 38312

SEQ ID NO: 574899 - RNA, 64 nt, hsa; identical to SEQ ID NO: 38313

SEQ ID NO: 574900 - RNA, 64 nt, hsa; identical to SEQ ID NO: 38314

SEQ ID NO: 574901 - RNA, 64 nt, hsa; identical to SEQ ID NO: 38315

SEQ ID NO: 574902 - RNA, 64 nt, hsa; identical to SEQ ID NO: 38316

SEQ ID NO: 574903 - RNA, 64 nt, hsa; identical to SEQ ID NO: 38317

SEQ ID NO: 574904 - RNA, 64 nt, hsa; identical to SEQ ID NO: 38318

SEQ ID NO: 574905 - RNA, 64 nt, hsa; identical to SEQ ID NO: 459316

SEQ ID NO: 574906 - RNA, 64 nt, hsa; identical to SEQ ID NO: 459317

SEQ ID NO: 574907 - RNA, 64 nt, hsa; identical to SEQ ID NO: 459318

SEQ ID NO: 574908 - RNA, 64 nt, hsa; identical to SEQ ID NO: 459319

SEQ ID NO: 574909 - RNA, 64 nt, hsa; identical to SEQ ID NO: 459320

SEQ ID NO: 574910 - RNA, 64 nt, hsa; identical to SEQ ID NO: 459321

SEQ ID NO: 574911 - RNA, 64 nt, hsa; identical to SEQ ID NO: 459322

SEQ ID NO: 574912 - RNA, 64 nt, hsa; identical to SEQ ID NO: 459323

SEQ ID NO: 574913 - RNA, 64 nt, hsa; identical to SEQ ID NO: 459324

SEQ ID NO: 574914 - RNA, 64 nt, hsa; identical to SEQ ID NO: 459325

SEQ ID NO: 574915 - RNA, 64 nt, hsa; identical to SEQ ID NO: 459326

SEQ ID NO: 574916 - RNA, 64 nt, hsa; identical to SEQ ID NO: 459327

SEQ ID NO: 574917 - RNA, 64 nt, hsa; identical to SEQ ID NO: 459328

SEQ ID NO: 574918 - RNA, 64 nt, hsa; identical to SEQ ID NO: 459329

SEQ ID NO: 574919 - RNA, 64 nt, hsa; identical to SEQ ID NO: 459330

SEQ ID NO: 574920 - RNA, 64 nt, hsa; identical to SEQ ID NO: 459331

SEQ ID NO: 574921 - RNA, 64 nt, hsa; identical to SEQ ID NO: 459332

SEQ ID NO: 574922 - RNA, 64 nt, hsa; identical to SEQ ID NO: 459333

SEQ ID NO: 574923 - RNA, 64 nt, hsa; identical to SEQ ID NO: 459334

SEQ ID NO: 574924 - RNA, 64 nt, hsa; identical to SEQ ID NO: 459335

SEQ ID NO: 574925 - RNA, 64 nt, hsa; identical to SEQ ID NO: 459336

SEQ ID NO: 574926 - RNA, 64 nt, hsa; identical to SEQ ID NO: 459337

SEQ ID NO: 574927 - RNA, 64 nt, hsa; identical to SEQ ID NO: 459338

SEQ ID NO: 574928 - RNA, 64 nt, hsa; identical to SEQ ID NO: 459339

SEQ ID NO: 574929 - RNA, 64 nt, hsa; identical to SEQ ID NO: 459340

SEQ ID NO: 574930 - RNA, 64 nt, hsa; identical to SEQ ID NO: 459341

SEQ ID NO: 574931 - RNA, 64 nt, hsa; identical to SEQ ID NO: 459342

SEQ ID NO: 574932 - RNA, 64 nt, hsa; identical to SEQ ID NO: 459343

SEQ ID NO: 574933 - RNA, 64 nt, hsa; identical to SEQ ID NO: 459344

SEQ ID NO: 574934 - RNA, 64 nt, hsa; identical to SEQ ID NO: 459345

SEQ ID NO: 574935 - RNA, 64 nt, hsa; identical to SEQ ID NO: 459346

SEQ ID NO: 574936 - RNA, 64 nt, hsa; identical to SEQ ID NO: 459347

SEQ ID NO: 574937 - RNA, 64 nt, hsa; identical to SEQ ID NO: 459348

SEQ ID NO: 574938 - RNA, 64 nt, hsa; identical to SEQ ID NO: 459349

SEQ ID NO: 574939 - RNA, 64 nt, hsa; identical to SEQ ID NO: 459350

SEQ ID NO: 574940 - RNA, 64 nt, hsa; identical to SEQ ID NO: 459351

SEQ ID NO: 574941 - RNA, 64 nt, hsa; identical to SEQ ID NO: 459352

SEQ ID NO: 574942 - RNA, 64 nt, hsa; identical to SEQ ID NO: 459353

SEQ ID NO: 574943 - RNA, 64 nt, hsa; identical to SEQ ID NO: 38255

SEQ ID NO: 574944 - RNA, 64 nt, hsa; identical to SEQ ID NO: 38256

SEQ ID NO: 574945 - RNA, 64 nt, hsa; identical to SEQ ID NO: 38257

SEQ ID NO: 574946 - RNA, 64 nt, hsa; identical to SEQ ID NO: 38258

SEQ ID NO: 574947 - RNA, 64 nt, hsa; identical to SEQ ID NO: 38259

SEQ ID NO: 574948 - RNA, 64 nt, hsa; identical to SEQ ID NO: 38260

SEQ ID NO: 574949 - RNA, 64 nt, hsa; identical to SEQ ID NO: 38261

SEQ ID NO: 574950 - RNA, 64 nt, hsa; identical to SEQ ID NO: 38262

SEQ ID NO: 574951 - RNA, 64 nt, hsa; identical to SEQ ID NO: 38263

SEQ ID NO: 574952 - RNA, 64 nt, hsa; identical to SEQ ID NO: 38264

SEQ ID NO: 574953 - RNA, 64 nt, hsa; identical to SEQ ID NO: 38265

SEQ ID NO: 574954 - RNA, 64 nt, hsa; identical to SEQ ID NO: 38266

SEQ ID NO: 574955 - RNA, 64 nt, hsa; identical to SEQ ID NO: 38267

SEQ ID NO: 574956 - RNA, 64 nt, hsa; identical to SEQ ID NO: 38268

SEQ ID NO: 574957 - RNA, 64 nt, hsa; identical to SEQ ID NO: 38269

SEQ ID NO: 574958 - RNA, 64 nt, hsa; identical to SEQ ID NO: 38270

SEQ ID NO: 574959 - RNA, 64 nt, hsa; identical to SEQ ID NO: 38271

SEQ ID NO: 574960 - RNA, 64 nt, hsa; identical to SEQ ID NO: 38272

SEQ ID NO: 574961 - RNA, 64 nt, hsa; identical to SEQ ID NO: 38273

SEQ ID NO: 574962 - RNA, 64 nt, hsa; identical to SEQ ID NO: 38274

SEQ ID NO: 574963 - RNA, 64 nt, hsa; identical to SEQ ID NO: 38275

SEQ ID NO: 574964 - RNA, 64 nt, hsa; identical to SEQ ID NO: 38276

SEQ ID NO: 574965 - RNA, 64 nt, hsa; identical to SEQ ID NO: 38277

SEQ ID NO: 574966 - RNA, 64 nt, hsa; identical to SEQ ID NO: 38278

SEQ ID NO: 574967 - RNA, 64 nt, hsa; identical to SEQ ID NO: 38279

SEQ ID NO: 574968 - RNA, 64 nt, hsa; identical to SEQ ID NO: 38280

SEQ ID NO: 574969 - RNA, 64 nt, hsa; identical to SEQ ID NO: 38281

SEQ ID NO: 574970 - RNA, 64 nt, hsa; identical to SEQ ID NO: 38282

SEQ ID NO: 574971 - RNA, 64 nt, hsa; identical to SEQ ID NO: 38283

SEQ ID NO: 574972 - RNA, 64 nt, hsa; identical to SEQ ID NO: 38284

SEQ ID NO: 574973 - RNA, 62 nt, hsa; identical to SEQ ID NO: 38285

SEQ ID NO: 574974 - RNA, 64 nt, hsa; identical to SEQ ID NO: 38286

SEQ ID NO: 574975 - RNA, 64 nt, hsa; identical to SEQ ID NO: 38287

SEQ ID NO: 574976 - RNA, 64 nt, hsa; identical to SEQ ID NO: 38288

SEQ ID NO: 574977 - RNA, 64 nt, hsa; identical to SEQ ID NO: 38289

SEQ ID NO: 574978 - RNA, 64 nt, hsa; identical to SEQ ID NO: 38290

SEQ ID NO: 574979 - RNA, 64 nt, hsa; identical to SEQ ID NO: 38291

SEQ ID NO: 574980 - RNA, 64 nt, hsa; identical to SEQ ID NO: 38292

SEQ ID NO: 574981 - RNA, 64 nt, hsa; identical to SEQ ID NO: 38293

SEQ ID NO: 574982 - RNA, 64 nt, hsa; identical to SEQ ID NO: 38294

SEQ ID NO: 574983 - RNA, 64 nt, hsa; identical to SEQ ID NO: 38295

SEQ ID NO: 574984 - RNA, 64 nt, hsa; identical to SEQ ID NO: 38296

SEQ ID NO: 574985 - RNA, 64 nt, hsa; identical to SEQ ID NO: 38297

SEQ ID NO: 574986 - RNA, 64 nt, hsa; identical to SEQ ID NO: 38298

SEQ ID NO: 574987 - RNA, 64 nt, hsa; identical to SEQ ID NO: 38299

SEQ ID NO: 574988 - RNA, 64 nt, hsa; identical to SEQ ID NO: 38300

SEQ ID NO: 574989 - RNA, 64 nt, hsa; identical to SEQ ID NO: 38301

SEQ ID NO: 574990 - RNA, 64 nt, hsa; identical to SEQ ID NO: 38302

SEQ ID NO: 574991 - RNA, 64 nt, hsa; identical to SEQ ID NO: 38303

SEQ ID NO: 574992 - RNA, 64 nt, hsa; identical to SEQ ID NO: 38304

SEQ ID NO: 574993 - RNA, 64 nt, hsa; identical to SEQ ID NO: 38305

SEQ ID NO: 574994 - RNA, 64 nt, hsa; identical to SEQ ID NO: 38306

SEQ ID NO: 574995 - RNA, 64 nt, hsa; identical to SEQ ID NO: 38307

SEQ ID NO: 574996 - RNA, 64 nt, hsa; identical to SEQ ID NO: 38308

SEQ ID NO: 574997 - RNA, 64 nt, hsa; identical to SEQ ID NO: 38309

SEQ ID NO: 574998 - RNA, 64 nt, hsa; identical to SEQ ID NO: 38310

SEQ ID NO: 574999 - RNA, 64 nt, hsa; identical to SEQ ID NO: 38311

SEQ ID NO: 575000 - RNA, 64 nt, hsa; identical to SEQ ID NO: 38312

SEQ ID NO: 575001 - RNA, 64 nt, hsa; identical to SEQ ID NO: 38313

SEQ ID NO: 575002 - RNA, 64 nt, hsa; identical to SEQ ID NO: 38314

SEQ ID NO: 575003 - RNA, 64 nt, hsa; identical to SEQ ID NO: 38315

SEQ ID NO: 575004 - RNA, 64 nt, hsa; identical to SEQ ID NO: 38316

SEQ ID NO: 575005 - RNA, 64 nt, hsa; identical to SEQ ID NO: 38317

SEQ ID NO: 575006 - RNA, 64 nt, hsa; identical to SEQ ID NO: 38318

SEQ ID NO: 575007 - RNA, 64 nt, hsa; identical to SEQ ID NO: 459316

SEQ ID NO: 575008 - RNA, 64 nt, hsa; identical to SEQ ID NO: 459317

SEQ ID NO: 575009 - RNA, 64 nt, hsa; identical to SEQ ID NO: 459318

SEQ ID NO: 575010 - RNA, 64 nt, hsa; identical to SEQ ID NO: 459319

SEQ ID NO: 575011 - RNA, 64 nt, hsa; identical to SEQ ID NO: 459320

SEQ ID NO: 575012 - RNA, 64 nt, hsa; identical to SEQ ID NO: 459321

SEQ ID NO: 575013 - RNA, 64 nt, hsa; identical to SEQ ID NO: 459322

SEQ ID NO: 575014 - RNA, 64 nt, hsa; identical to SEQ ID NO: 459323

SEQ ID NO: 575015 - RNA, 64 nt, hsa; identical to SEQ ID NO: 459324

SEQ ID NO: 575016 - RNA, 64 nt, hsa; identical to SEQ ID NO: 459325

SEQ ID NO: 575017 - RNA, 64 nt, hsa; identical to SEQ ID NO: 459326

SEQ ID NO: 575018 - RNA, 64 nt, hsa; identical to SEQ ID NO: 459327

SEQ ID NO: 575019 - RNA, 64 nt, hsa; identical to SEQ ID NO: 459328

SEQ ID NO: 575020 - RNA, 64 nt, hsa; identical to SEQ ID NO: 459329

SEQ ID NO: 575021 - RNA, 64 nt, hsa; identical to SEQ ID NO: 459330

SEQ ID NO: 575022 - RNA, 64 nt, hsa; identical to SEQ ID NO: 459331

SEQ ID NO: 575023 - RNA, 64 nt, hsa; identical to SEQ ID NO: 459332

SEQ ID NO: 575024 - RNA, 64 nt, hsa; identical to SEQ ID NO: 459333

SEQ ID NO: 575025 - RNA, 64 nt, hsa; identical to SEQ ID NO: 459334

SEQ ID NO: 575026 - RNA, 64 nt, hsa; identical to SEQ ID NO: 459335

SEQ ID NO: 575027 - RNA, 64 nt, hsa; identical to SEQ ID NO: 459336

SEQ ID NO: 575028 - RNA, 64 nt, hsa; identical to SEQ ID NO: 459337

SEQ ID NO: 575029 - RNA, 64 nt, hsa; identical to SEQ ID NO: 459338

SEQ ID NO: 575030 - RNA, 64 nt, hsa; identical to SEQ ID NO: 459339

SEQ ID NO: 575031 - RNA, 64 nt, hsa; identical to SEQ ID NO: 459340

SEQ ID NO: 575032 - RNA, 64 nt, hsa; identical to SEQ ID NO: 459341

SEQ ID NO: 575033 - RNA, 64 nt, hsa; identical to SEQ ID NO: 459342

SEQ ID NO: 575034 - RNA, 64 nt, hsa; identical to SEQ ID NO: 459343

SEQ ID NO: 575035 - RNA, 64 nt, hsa; identical to SEQ ID NO: 459344

SEQ ID NO: 575036 - RNA, 64 nt, hsa; identical to SEQ ID NO: 459345

SEQ ID NO: 575037 - RNA, 64 nt, hsa; identical to SEQ ID NO: 459346

SEQ ID NO: 575038 - RNA, 64 nt, hsa; identical to SEQ ID NO: 459347

SEQ ID NO: 575039 - RNA, 64 nt, hsa; identical to SEQ ID NO: 459348

SEQ ID NO: 575040 - RNA, 64 nt, hsa; identical to SEQ ID NO: 459349

SEQ ID NO: 575041 - RNA, 64 nt, hsa; identical to SEQ ID NO: 459350

SEQ ID NO: 575042 - RNA, 64 nt, hsa; identical to SEQ ID NO: 459351

SEQ ID NO: 575043 - RNA, 64 nt, hsa; identical to SEQ ID NO: 459352

SEQ ID NO: 575044 - RNA, 64 nt, hsa; identical to SEQ ID NO: 459353

SEQ ID NO: 575045 - RNA, 64 nt, hsa; identical to SEQ ID NO: 120916

SEQ ID NO: 575046 - RNA, 64 nt, hsa; identical to SEQ ID NO: 120917

SEQ ID NO: 575047 - RNA, 64 nt, hsa; identical to SEQ ID NO: 120918

SEQ ID NO: 575048 - RNA, 64 nt, hsa; identical to SEQ ID NO: 120919

SEQ ID NO: 575049 - RNA, 64 nt, hsa; identical to SEQ ID NO: 120920

SEQ ID NO: 575050 - RNA, 64 nt, hsa; identical to SEQ ID NO: 120921

SEQ ID NO: 575051 - RNA, 64 nt, hsa; identical to SEQ ID NO: 120922

SEQ ID NO: 575052 - RNA, 64 nt, hsa; identical to SEQ ID NO: 120923

SEQ ID NO: 575053 - RNA, 64 nt, hsa; identical to SEQ ID NO: 120924

SEQ ID NO: 575054 - RNA, 64 nt, hsa; identical to SEQ ID NO: 120925

SEQ ID NO: 575055 - RNA, 64 nt, hsa
guuccuguaauuuugugacacgcucucugccaagcccaccaaguauuuccuuuauagcuaaaag

SEQ ID NO: 575056 - RNA, 64 nt, hsa
acacucuugaagagcuuccaagaaguugauggaacccaccaauaugucauaguaaagucuccug

SEQ ID NO: 575057 - RNA, 64 nt, hsa
ccuugaacccaacagucccuuaugagcgucacugcccaccaaaggucaaugucaagagaggaag

SEQ ID NO: 575058 - RNA, 64 nt, hsa
aaucaauaucccaacauucugcaauggcagcauucccaccaacaaaauccaugugaccauucug

SEQ ID NO: 575059 - RNA, 64 nt, hsa
cagccgaugccccccgguaugggaaccagcaccucccaccaaccaaccacacccggugggggca

SEQ ID NO: 575060 - RNA, 64 nt, hsa
cagccgaugccccccaguaugggaaccagcaccucccaccaaccagccacacccggugggggca

SEQ ID NO: 575061 - RNA, 64 nt, hsa
cagccgaugccccccggugugggaaccagcaccucccaccaaccagccacacccagugggggca

SEQ ID NO: 575062 - RNA, 64 nt, hsa
cccggggggcccccgggugcagaaaacagcaccucccaccaaccagccacucccgguggggaca

SEQ ID NO: 575063 - RNA, 64 nt, hsa
auugaccagaaaacaaugauuuuauaauauuuaacccaccaaaaagucccuccaacagcaauau

SEQ ID NO: 575064 - RNA, 64 nt, hsa
cacauucugacacaagaugcaagucugugcaaaacccaccaaaaugcuccuauccaacaauuau

SEQ ID NO: 575065 - RNA, 64 nt, hsa
uucaggaagccugugaaaaacgugauuccugggccccaccaagacccaccaaaaccaucucugg

SEQ ID NO: 575066 - RNA, 64 nt, hsa
cugugaaaaacgugauuccugggccccaccaagacccaccaaaaccaucucuggggcuuggugc

SEQ ID NO: 575067 - RNA, 64 nt, hsa; identical to SEQ ID NO: 218191

SEQ ID NO: 575068 - RNA, 64 nt, hsa; identical to SEQ ID NO: 218192

SEQ ID NO: 575069 - RNA, 64 nt, hsa; identical to SEQ ID NO: 218193

SEQ ID NO: 575070 - RNA, 64 nt, hsa; identical to SEQ ID NO: 218194

SEQ ID NO: 575071 - RNA, 64 nt, hsa; identical to SEQ ID NO: 218195

SEQ ID NO: 575072 - RNA, 64 nt, hsa; identical to SEQ ID NO: 218196

SEQ ID NO: 575073 - RNA, 64 nt, hsa; identical to SEQ ID NO: 218197

SEQ ID NO: 575074 - RNA, 64 nt, hsa; identical to SEQ ID NO: 218198

SEQ ID NO: 575075 - RNA, 64 nt, hsa; identical to SEQ ID NO: 218199

SEQ ID NO: 575076 - RNA, 64 nt, hsa; identical to SEQ ID NO: 218200

SEQ ID NO: 575077 - RNA, 64 nt, hsa; identical to SEQ ID NO: 218201

SEQ ID NO: 575078 - RNA, 64 nt, hsa; identical to SEQ ID NO: 218202

SEQ ID NO: 575079 - RNA, 64 nt, hsa; identical to SEQ ID NO: 218203

SEQ ID NO: 575080 - RNA, 64 nt, hsa; identical to SEQ ID NO: 218204

SEQ ID NO: 575081 - RNA, 64 nt, hsa; identical to SEQ ID NO: 218205

SEQ ID NO: 575082 - RNA, 64 nt, hsa; identical to SEQ ID NO: 218206

SEQ ID NO: 575083 - RNA, 64 nt, hsa; identical to SEQ ID NO: 218207

SEQ ID NO: 575084 - RNA, 64 nt, hsa; identical to SEQ ID NO: 218208

SEQ ID NO: 575085 - RNA, 64 nt, hsa; identical to SEQ ID NO: 218209

SEQ ID NO: 575086 - RNA, 64 nt, hsa; identical to SEQ ID NO: 218210

SEQ ID NO: 575087 - RNA, 64 nt, hsa; identical to SEQ ID NO: 218211

SEQ ID NO: 575088 - RNA, 64 nt, hsa; identical to SEQ ID NO: 218212

SEQ ID NO: 575089 - RNA, 64 nt, hsa; identical to SEQ ID NO: 218213

SEQ ID NO: 575090 - RNA, 64 nt, hsa; identical to SEQ ID NO: 218214

SEQ ID NO: 575091 - RNA, 64 nt, hsa; identical to SEQ ID NO: 218215

SEQ ID NO: 575092 - RNA, 64 nt, hsa; identical to SEQ ID NO: 218216

SEQ ID NO: 575093 - RNA, 64 nt, hsa; identical to SEQ ID NO: 218217

SEQ ID NO: 575094 - RNA, 64 nt, hsa; identical to SEQ ID NO: 218218

SEQ ID NO: 575095 - RNA, 64 nt, hsa; identical to SEQ ID NO: 218219

SEQ ID NO: 575096 - RNA, 64 nt, hsa; identical to SEQ ID NO: 218220

SEQ ID NO: 575097 - RNA, 64 nt, hsa; identical to SEQ ID NO: 218221

SEQ ID NO: 575098 - RNA, 64 nt, hsa; identical to SEQ ID NO: 218222

SEQ ID NO: 575099 - RNA, 64 nt, hsa; identical to SEQ ID NO: 218223

SEQ ID NO: 575100 - RNA, 64 nt, hsa; identical to SEQ ID NO: 218224

SEQ ID NO: 575101 - RNA, 64 nt, hsa; identical to SEQ ID NO: 218225

SEQ ID NO: 575102 - RNA, 64 nt, hsa; identical to SEQ ID NO: 218226

SEQ ID NO: 575103 - RNA, 64 nt, hsa; identical to SEQ ID NO: 218227

SEQ ID NO: 575104 - RNA, 64 nt, hsa; identical to SEQ ID NO: 218228

SEQ ID NO: 575105 - RNA, 64 nt, hsa; identical to SEQ ID NO: 218229

SEQ ID NO: 575106 - RNA, 64 nt, hsa; identical to SEQ ID NO: 218230

SEQ ID NO: 575107 - RNA, 64 nt, hsa; identical to SEQ ID NO: 218231

SEQ ID NO: 575108 - RNA, 64 nt, hsa; identical to SEQ ID NO: 218232

SEQ ID NO: 575109 - RNA, 64 nt, hsa; identical to SEQ ID NO: 218233

SEQ ID NO: 575110 - RNA, 64 nt, hsa; identical to SEQ ID NO: 218234

SEQ ID NO: 575111 - RNA, 64 nt, hsa; identical to SEQ ID NO: 218235

SEQ ID NO: 575112 - RNA, 64 nt, hsa; identical to SEQ ID NO: 218236

SEQ ID NO: 575113 - RNA, 64 nt, hsa; identical to SEQ ID NO: 218237

SEQ ID NO: 575114 - RNA, 64 nt, hsa; identical to SEQ ID NO: 218238

SEQ ID NO: 575115 - RNA, 64 nt, hsa; identical to SEQ ID NO: 218239

SEQ ID NO: 575116 - RNA, 64 nt, hsa; identical to SEQ ID NO: 218240

SEQ ID NO: 575117 - RNA, 64 nt, hsa; identical to SEQ ID NO: 218241

SEQ ID NO: 575118 - RNA, 64 nt, hsa; identical to SEQ ID NO: 218242

SEQ ID NO: 575119 - RNA, 64 nt, hsa; identical to SEQ ID NO: 218243

SEQ ID NO: 575120 - RNA, 64 nt, hsa; identical to SEQ ID NO: 218244

SEQ ID NO: 575121 - RNA, 64 nt, hsa; identical to SEQ ID NO: 218245

SEQ ID NO: 575122 - RNA, 64 nt, hsa; identical to SEQ ID NO: 218246

SEQ ID NO: 575123 - RNA, 64 nt, hsa; identical to SEQ ID NO: 218247

SEQ ID NO: 575124 - RNA, 64 nt, hsa; identical to SEQ ID NO: 218248

SEQ ID NO: 575125 - RNA, 64 nt, hsa; identical to SEQ ID NO: 218249

SEQ ID NO: 575126 - RNA, 64 nt, hsa; identical to SEQ ID NO: 218250

SEQ ID NO: 575127 - RNA, 64 nt, hsa; identical to SEQ ID NO: 218251

SEQ ID NO: 575128 - RNA, 64 nt, hsa; identical to SEQ ID NO: 218252

SEQ ID NO: 575129 - RNA, 64 nt, hsa; identical to SEQ ID NO: 218253

SEQ ID NO: 575130 - RNA, 64 nt, hsa; identical to SEQ ID NO: 218254

SEQ ID NO: 575131 - RNA, 64 nt, hsa; identical to SEQ ID NO: 218255

SEQ ID NO: 575132 - RNA, 64 nt, hsa; identical to SEQ ID NO: 218256

SEQ ID NO: 575133 - RNA, 64 nt, hsa; identical to SEQ ID NO: 218257

SEQ ID NO: 575134 - RNA, 64 nt, hsa; identical to SEQ ID NO: 218258

SEQ ID NO: 575135 - RNA, 64 nt, hsa; identical to SEQ ID NO: 218259

SEQ ID NO: 575136 - RNA, 64 nt, hsa; identical to SEQ ID NO: 218260

SEQ ID NO: 575137 - RNA, 64 nt, hsa; identical to SEQ ID NO: 218261

SEQ ID NO: 575138 - RNA, 64 nt, hsa; identical to SEQ ID NO: 218262

SEQ ID NO: 575139 - RNA, 64 nt, hsa; identical to SEQ ID NO: 218263

SEQ ID NO: 575140 - RNA, 64 nt, hsa; identical to SEQ ID NO: 218264

SEQ ID NO: 575141 - RNA, 64 nt, hsa; identical to SEQ ID NO: 218265

SEQ ID NO: 575142 - RNA, 64 nt, hsa; identical to SEQ ID NO: 218266

SEQ ID NO: 575143 - RNA, 64 nt, hsa; identical to SEQ ID NO: 218267

SEQ ID NO: 575144 - RNA, 64 nt, hsa; identical to SEQ ID NO: 218268

SEQ ID NO: 575145 - RNA, 64 nt, hsa; identical to SEQ ID NO: 218269

SEQ ID NO: 575146 - RNA, 64 nt, hsa; identical to SEQ ID NO: 218270

SEQ ID NO: 575147 - RNA, 64 nt, hsa; identical to SEQ ID NO: 218271

SEQ ID NO: 575148 - RNA, 64 nt, hsa; identical to SEQ ID NO: 218272

SEQ ID NO: 575149 - RNA, 64 nt, hsa; identical to SEQ ID NO: 218273

SEQ ID NO: 575150 - RNA, 64 nt, hsa; identical to SEQ ID NO: 218274

SEQ ID NO: 575151 - RNA, 64 nt, hsa; identical to SEQ ID NO: 218275

SEQ ID NO: 575152 - RNA, 64 nt, hsa; identical to SEQ ID NO: 218276

SEQ ID NO: 575153 - RNA, 64 nt, hsa; identical to SEQ ID NO: 218277

SEQ ID NO: 575154 - RNA, 64 nt, hsa; identical to SEQ ID NO: 218278

SEQ ID NO: 575155 - RNA, 64 nt, hsa; identical to SEQ ID NO: 218279

SEQ ID NO: 575156 - RNA, 64 nt, hsa; identical to SEQ ID NO: 218280

SEQ ID NO: 575157 - RNA, 64 nt, hsa; identical to SEQ ID NO: 218281

SEQ ID NO: 575158 - RNA, 64 nt, hsa; identical to SEQ ID NO: 218282

SEQ ID NO: 575159 - RNA, 64 nt, hsa; identical to SEQ ID NO: 218283

SEQ ID NO: 575160 - RNA, 64 nt, hsa; identical to SEQ ID NO: 218284

SEQ ID NO: 575161 - RNA, 64 nt, hsa; identical to SEQ ID NO: 218285

SEQ ID NO: 575162 - RNA, 64 nt, hsa; identical to SEQ ID NO: 218286

SEQ ID NO: 575163 - RNA, 64 nt, hsa; identical to SEQ ID NO: 218287

SEQ ID NO: 575164 - RNA, 64 nt, hsa; identical to SEQ ID NO: 218288

SEQ ID NO: 575165 - RNA, 64 nt, hsa; identical to SEQ ID NO: 218289

SEQ ID NO: 575166 - RNA, 64 nt, hsa; identical to SEQ ID NO: 218290

SEQ ID NO: 575167 - RNA, 64 nt, hsa; identical to SEQ ID NO: 218291

SEQ ID NO: 575168 - RNA, 64 nt, hsa; identical to SEQ ID NO: 218292

SEQ ID NO: 575169 - RNA, 64 nt, hsa; identical to SEQ ID NO: 218293

SEQ ID NO: 575170 - RNA, 64 nt, hsa; identical to SEQ ID NO: 218294

SEQ ID NO: 575171 - RNA, 64 nt, hsa; identical to SEQ ID NO: 218295

SEQ ID NO: 575172 - RNA, 64 nt, hsa; identical to SEQ ID NO: 218296

SEQ ID NO: 575173 - RNA, 64 nt, hsa; identical to SEQ ID NO: 218297

SEQ ID NO: 575174 - RNA, 64 nt, hsa; identical to SEQ ID NO: 218298

SEQ ID NO: 575175 - RNA, 64 nt, hsa; identical to SEQ ID NO: 218299

SEQ ID NO: 575176 - RNA, 64 nt, hsa; identical to SEQ ID NO: 218300

SEQ ID NO: 575177 - RNA, 64 nt, hsa; identical to SEQ ID NO: 218301

SEQ ID NO: 575178 - RNA, 64 nt, hsa; identical to SEQ ID NO: 218302

SEQ ID NO: 575179 - RNA, 64 nt, hsa; identical to SEQ ID NO: 218303

SEQ ID NO: 575180 - RNA, 64 nt, hsa; identical to SEQ ID NO: 218304

SEQ ID NO: 575181 - RNA, 64 nt, hsa; identical to SEQ ID NO: 218305

SEQ ID NO: 575182 - RNA, 64 nt, hsa; identical to SEQ ID NO: 218306

SEQ ID NO: 575183 - RNA, 64 nt, hsa; identical to SEQ ID NO: 218307

SEQ ID NO: 575184 - RNA, 64 nt, hsa; identical to SEQ ID NO: 218308

SEQ ID NO: 575185 - RNA, 64 nt, hsa; identical to SEQ ID NO: 218309

SEQ ID NO: 575186 - RNA, 64 nt, hsa; identical to SEQ ID NO: 218310

SEQ ID NO: 575187 - RNA, 64 nt, hsa; identical to SEQ ID NO: 218311

SEQ ID NO: 575188 - RNA, 64 nt, hsa; identical to SEQ ID NO: 218312

SEQ ID NO: 575189 - RNA, 64 nt, hsa; identical to SEQ ID NO: 218313

SEQ ID NO: 575190 - RNA, 64 nt, hsa; identical to SEQ ID NO: 218314

SEQ ID NO: 575191 - RNA, 64 nt, hsa; identical to SEQ ID NO: 218315

SEQ ID NO: 575192 - RNA, 64 nt, hsa; identical to SEQ ID NO: 218316

SEQ ID NO: 575193 - RNA, 64 nt, hsa; identical to SEQ ID NO: 218317

SEQ ID NO: 575194 - RNA, 64 nt, hsa; identical to SEQ ID NO: 218318

SEQ ID NO: 575195 - RNA, 64 nt, hsa; identical to SEQ ID NO: 218319

SEQ ID NO: 575196 - RNA, 64 nt, hsa; identical to SEQ ID NO: 218320

SEQ ID NO: 575197 - RNA, 64 nt, hsa; identical to SEQ ID NO: 218321

SEQ ID NO: 575198 - RNA, 64 nt, hsa; identical to SEQ ID NO: 218322

SEQ ID NO: 575199 - RNA, 64 nt, hsa; identical to SEQ ID NO: 218323

SEQ ID NO: 575200 - RNA, 64 nt, hsa; identical to SEQ ID NO: 218324

SEQ ID NO: 575201 - RNA, 64 nt, hsa; identical to SEQ ID NO: 218325

SEQ ID NO: 575202 - RNA, 64 nt, hsa; identical to SEQ ID NO: 218326

SEQ ID NO: 575203 - RNA, 64 nt, hsa; identical to SEQ ID NO: 218327

SEQ ID NO: 575204 - RNA, 64 nt, hsa; identical to SEQ ID NO: 218328

SEQ ID NO: 575205 - RNA, 64 nt, hsa; identical to SEQ ID NO: 218329

SEQ ID NO: 575206 - RNA, 64 nt, hsa; identical to SEQ ID NO: 218330

SEQ ID NO: 575207 - RNA, 64 nt, hsa; identical to SEQ ID NO: 218331

SEQ ID NO: 575208 - RNA, 64 nt, hsa; identical to SEQ ID NO: 218332

SEQ ID NO: 575209 - RNA, 64 nt, hsa; identical to SEQ ID NO: 218333

SEQ ID NO: 575210 - RNA, 64 nt, hsa; identical to SEQ ID NO: 218334

SEQ ID NO: 575211 - RNA, 64 nt, hsa; identical to SEQ ID NO: 218335

SEQ ID NO: 575212 - RNA, 64 nt, hsa; identical to SEQ ID NO: 218336

SEQ ID NO: 575213 - RNA, 64 nt, hsa; identical to SEQ ID NO: 218337

SEQ ID NO: 575214 - RNA, 64 nt, hsa; identical to SEQ ID NO: 218338

SEQ ID NO: 575215 - RNA, 64 nt, hsa; identical to SEQ ID NO: 218339

SEQ ID NO: 575216 - RNA, 64 nt, hsa; identical to SEQ ID NO: 218340

SEQ ID NO: 575217 - RNA, 64 nt, hsa; identical to SEQ ID NO: 218341

SEQ ID NO: 575218 - RNA, 64 nt, hsa; identical to SEQ ID NO: 218342

SEQ ID NO: 575219 - RNA, 64 nt, hsa; identical to SEQ ID NO: 218343

SEQ ID NO: 575220 - RNA, 64 nt, hsa; identical to SEQ ID NO: 218344

SEQ ID NO: 575221 - RNA, 64 nt, hsa
augaaauauaugugaaaggauaugaaucugagagaugcuguagacaucuguccuacacuugaga

SEQ ID NO: 575222 - RNA, 64 nt, hsa
gaagaaccgauacacuuggcauugacgucuagcuaugcuguaucugugcuuugcccacaugccc

SEQ ID NO: 575223 - RNA, 64 nt, hsa
uuaaauuuguguaaauacuucugcaaagguacugaugcuguaaagucaaaacaguuuuguggaa

SEQ ID NO: 575224 - RNA, 64 nt, hsa
ucauauucaccauucuuccaccucauugaauugcaugcuguaguucuagcuuuucugcuauaau

SEQ ID NO: 575225 - RNA, 64 nt, hsa
cacagccaggcgcuagcacagcucccuucuguugaugcuguauucccauaucaaaagacacagg

SEQ ID NO: 575226 - RNA, 64 nt, hsa
uuggacuuucuagcauauauguguccauuuccuuaugcuguaaaagcaaguccugcaaccaaac

SEQ ID NO: 575227 - RNA, 64 nt, hsa
gccgucuggccucuggccucagucuucagauagacaguaagaagaaagcagccucauugauccg

SEQ ID NO: 575228 - RNA, 64 nt, hsa
aaaagcucuccuuguaauugcaaguuuaguaacucaguaagaacaugccugcgacucccuuucu

SEQ ID NO: 575229 - RNA, 64 nt, hsa
aaaauaaguuuuaucuuaaaaucauauuugaagacaguaagacaguaaacuauuuuaggaaguc

SEQ ID NO: 575230 - RNA, 64 nt, hsa
gucaguagaagugagauaagauccucagaggaaacaguaagaagggauaaucauuaagauagua

SEQ ID NO: 575231 - RNA, 63 nt, hsa
uucccaggacauuuuuuuuucuguaucaugucuccccaucauugaagcgcaaauuuucuugaa

SEQ ID NO: 575232 - RNA, 63 nt, hsa
guguugagccgcucauagcaugugaccuaccuaccccaucagaaauaacuuuuuaucuugcuc

SEQ ID NO: 575233 - RNA, 63 nt, hsa
aacucuaagaaugccaaagggaccgacgagacuccccaucacagcgagcucuguccuuacaug

SEQ ID NO: 575234 - RNA, 63 nt, hsa
caccuuuucugcuugcuacacaggcaacgauucccccaucagcugcccggacccuuuggccug

SEQ ID NO: 575235 - RNA, 63 nt, hsa
gggaugcuucccucugcccucuuuccugccccuccccaucauaccugcacccaccccagccag

SEQ ID NO: 575236 - RNA, 63 nt, hsa
gcauuguggggggacaggcucaagcaauucuguccccaucaaggggucagcuggagagaccca

SEQ ID NO: 575237 - RNA, 63 nt, hsa
caugcuccgcaaaguucuccgcacacacuucuuccccaucaagcccauuuccuuccccaacca

SEQ ID NO: 575238 - RNA, 63 nt, hsa
aaucucacugucucguuuucacaccgcaucaguccccaucaucacuacuccuccccagagaca

SEQ ID NO: 575239 - RNA, 63 nt, hsa
acugcccaagguaauuuauagauucaaugccauccccaucaagcuaccaaugacuuucuucac

SEQ ID NO: 575240 - RNA, 63 nt, hsa
aaugaacucaaacaaauuuacaggaacaaacaaccccaucaaaaagucggcaaaggacaugaa

SEQ ID NO: 575241 - RNA, 63 nt, hsa
guucagcccagaagcccuuccaggcaugaucuuccccaucaggcugggcucuggcagggaccu

SEQ ID NO: 575242 - RNA, 63 nt, hsa
cugcagcuggacccugcaggguggcucccuccuccccaucaagcacaagagagggcccaggaa

SEQ ID NO: 575243 - RNA, 63 nt, hsa
ugcuucauacauacuugaccucucuuuucuauuccccaucacuuuugugcugaagcuaaucau

SEQ ID NO: 575244 - RNA, 63 nt, hsa
gcuaauggaaaauacccaagggagggcaaagccccccaucagaugcaugaauguuugcgaaug

SEQ ID NO: 575245 - RNA, 63 nt, hsa
gucucgguugucguuuuuucuugcugcuccuccccccaucaccugagcuguuuucuguuggcc

SEQ ID NO: 575246 - RNA, 63 nt, hsa
guuccagaggugcagacaagagguggcgagagcccccaucaugccccucaaccuaucccguuc

SEQ ID NO: 575247 - RNA, 63 nt, hsa
gggggcugggacuaaagaaaugggugucccccaccccaucagcugggaaagcccaggccgcag

SEQ ID NO: 575248 - RNA, 63 nt, hsa
ccccuuucccugacugucaaggacaacugacucccccaucagcucaaacauuaaggguacccg

SEQ ID NO: 575249 - RNA, 63 nt, hsa
cccccaccucgggucccugaccccagcucgaugccccaucaccgccucucccuggcucccaag

SEQ ID NO: 575250 - RNA, 63 nt, hsa
cucccaagggugcaggugggcgcaaggcccggcccccaucacauguucccuuggccucagagc

SEQ ID NO: 575251 - RNA, 64 nt, hsa; identical to SEQ ID NO: 441022

SEQ ID NO: 575252 - RNA, 64 nt, hsa; identical to SEQ ID NO: 441023

SEQ ID NO: 575253 - RNA, 64 nt, hsa; identical to SEQ ID NO: 441024

SEQ ID NO: 575254 - RNA, 64 nt, hsa; identical to SEQ ID NO: 441025

SEQ ID NO: 575255 - RNA, 64 nt, hsa; identical to SEQ ID NO: 441026

SEQ ID NO: 575256 - RNA, 64 nt, hsa; identical to SEQ ID NO: 441027

SEQ ID NO: 575257 - RNA, 64 nt, hsa; identical to SEQ ID NO: 441028

SEQ ID NO: 575258 - RNA, 64 nt, hsa; identical to SEQ ID NO: 441029

SEQ ID NO: 575259 - RNA, 64 nt, hsa; identical to SEQ ID NO: 441030

SEQ ID NO: 575260 - RNA, 64 nt, hsa; identical to SEQ ID NO: 441031

SEQ ID NO: 575261 - RNA, 64 nt, hsa; identical to SEQ ID NO: 441032

SEQ ID NO: 575262 - RNA, 64 nt, hsa; identical to SEQ ID NO: 441033

SEQ ID NO: 575263 - RNA, 64 nt, hsa; identical to SEQ ID NO: 441034

SEQ ID NO: 575264 - RNA, 64 nt, hsa; identical to SEQ ID NO: 441035

SEQ ID NO: 575265 - RNA, 64 nt, hsa; identical to SEQ ID NO: 441036

SEQ ID NO: 575266 - RNA, 64 nt, hsa; identical to SEQ ID NO: 441037

SEQ ID NO: 575267 - RNA, 64 nt, hsa; identical to SEQ ID NO: 441038

SEQ ID NO: 575268 - RNA, 64 nt, hsa; identical to SEQ ID NO: 441039

SEQ ID NO: 575269 - RNA, 64 nt, hsa; identical to SEQ ID NO: 441040

SEQ ID NO: 575270 - RNA, 64 nt, hsa; identical to SEQ ID NO: 441041

SEQ ID NO: 575271 - RNA, 64 nt, hsa; identical to SEQ ID NO: 441042

SEQ ID NO: 575272 - RNA, 64 nt, hsa
ccuucauaccccuccucaacguucuuuuacuuuauacuuuaacuaccugagaguuaucagagcu

SEQ ID NO: 575273 - RNA, 64 nt, hsa
agaaaauaccacccucuugugcccuuaaaagcauuacuuuaacugguagggaacgccagaaacu

SEQ ID NO: 575274 - RNA, 64 nt, hsa
ugaagguuucauaaugaucauuuuguuaaaggucuacuuuaaucagaaauagcaacgagaugaa

SEQ ID NO: 575275 - RNA, 64 nt, hsa
uucaccuuugcaaacuucccucauguaaggaagguacuuuaaauguagcagccacugacauuuc

SEQ ID NO: 575276 - RNA, 64 nt, hsa
ugcacugagcugugcugauguucagcauuuauuauacuuuaaugggauagugcuucuugaccau

SEQ ID NO: 575277 - RNA, 64 nt, hsa
acuggcuugagccacugcacccaccccuccagacuacuuuaaaugucucugcucugacugaauu

SEQ ID NO: 575278 - RNA, 64 nt, hsa
aucucuaaaauguauaaauauuuugauuugguuuuacuuuaauuucucauucauaauuucgcaa

SEQ ID NO: 575279 - RNA, 64 nt, hsa
ugguacuucauuuuucuuaacuaaaauuacuuuuuacuuuaagcuugaauaaaaaucuucauug

SEQ ID NO: 575280 - RNA, 64 nt, hsa
aauguguuuguauacacaugucauuuauuauuauuacuuuaagauagguauuauucauguguca

SEQ ID NO: 575281 - RNA, 64 nt, hsa
caaaguuuauuuugugaugcccucuugguuuugauacuuuaaaaucuguggcacccguucuaca

SEQ ID NO: 575282 - RNA, 64 nt, hsa
cuuuuuuuaacagauagaauuuguauuuuuauuguacuuuaaaaagauuuauguaauagguaua

SEQ ID NO: 575283 - RNA, 64 nt, hsa
uuaacuguguuuagcucauuuaaaucaaaauguguacuuuaaucuaaaauguuuuaauaaucug

SEQ ID NO: 575284 - RNA, 64 nt, hsa
uuuuugguuuauuuauacuauauucugcauacaguacuuuaaaugccaauuacagugcaaucuu

SEQ ID NO: 575285 - RNA, 64 nt, hsa
cagaguaccagguuuuauuuuucaccuuauucucuacuuuaaacaaaucauaacuuucucuuua

SEQ ID NO: 575286 - RNA, 64 nt, hsa
ucugucuugaauuuggcccucccucuccccucucuacuuuaauucauuggagcaugggauuugg

SEQ ID NO: 575287 - RNA, 64 nt, hsa
uuuuaaauuuacaacuuuccacaacuuguuuuuguacuuuaagguuucucaauuagaauauuuc

SEQ ID NO: 575288 - RNA, 64 nt, hsa
agccucggcaaaccaauuuggggaagaagcaagauacuuuaagagaaauacaaaggaaauuucu

SEQ ID NO: 575289 - RNA, 64 nt, hsa
auugucauuaugugaaaccaauauuggcaaauaguacuuuaaugaugaaguaaaugaccagaaa

SEQ ID NO: 575290 - RNA, 64 nt, hsa
ucauuauuuuuuuccuuuuaugugccacuguggcuacuuuaaaucacucugagagguaaaugga

SEQ ID NO: 575291 - RNA, 64 nt, hsa
aauugaaaaaugugaguuacauaaguuaaaaacuuacuuuaaaucuuaccuucuauagguagcu

SEQ ID NO: 575292 - RNA, 64 nt, hsa
caaaccagauguaaaacacucacauacaaguucauacuuuaaaagaggaaagcuacuuaacaau

SEQ ID NO: 575293 - RNA, 64 nt, hsa
gccuuaaguuauaguuauguauagauacccauuauacuuuaaauuuuucagcagaaauuaugcu

SEQ ID NO: 575294 - RNA, 64 nt, hsa
ucucucuugggcuuccucccgaaaugugagacuauacuuuaaagauguaugguuagaguccaau

SEQ ID NO: 575295 - RNA, 64 nt, hsa
aggccucuucagaaaacuauuaucuuuaaagcccuacuuuaacuccuuaauuccagcauacagc

SEQ ID NO: 575296 - RNA, 64 nt, hsa
ugaucuuauugcauguuuccaugggguguaccuauacuuuaagccaauccugcugcauucacug

SEQ ID NO: 575297 - RNA, 64 nt, hsa
gcaaaaguuacuccauauacaaccccaaaucuacuacuuuaaauguaacaucaacucaguugua

SEQ ID NO: 575298 - RNA, 64 nt, hsa
gaaaaguguuuuaaguguaagaucuccuauggaguacuuuaaauucauuuauacaaaugaauaa

SEQ ID NO: 575299 - RNA, 64 nt, hsa
ccuucuugguuucccauaguauaauaagcaugcauacuuuaacuucuauaguuuucuccuuuag

SEQ ID NO: 575300 - RNA, 64 nt, hsa
uagagcuaaauugauuuaauuacacuuuccuuuguacuuuaaaaaaaaguaugcuagcacuauu

SEQ ID NO: 575301 - RNA, 64 nt, hsa
aagcauugccauugaaggcuuaauugacugaaauuacuuuaacauuuuggaaauuguuguauau

SEQ ID NO: 575302 - RNA, 64 nt, hsa
aagcaugaauuggaacugcaaugaaagucaaauuuacuuuaaaaagaaauuaauauggcuucac

SEQ ID NO: 575303 - RNA, 64 nt, hsa
uauuaaauauauuuauuuauuuaaauguuauuauuacuuuaaauauuauuuuaaauauuuugga

SEQ ID NO: 575304 - RNA, 64 nt, hsa
uaauuuuuuaccuugauuuggcauguuuguauguuacuuuaaagaggauguguguucuaaagga

SEQ ID NO: 575305 - RNA, 64 nt, hsa
acucauuauuguaaguaaucucugaaagccuuuuuacuuuaaccaaaucuacaugguuuaauau

SEQ ID NO: 575306 - RNA, 64 nt, hsa
caaaucuacaugguuuaauaugugaaauuuuaacuacuuuaacuaguuuuauaaauuucuuaau

SEQ ID NO: 575307 - RNA, 64 nt, hsa
guuuaucaguuuucaauagauuaaauaaaaugauuacuuuaaaaauaauaaaauuuaucuaauu

SEQ ID NO: 575308 - RNA, 64 nt, hsa
uaaaaguauaaaacauuaaaaauaacccuagauauacuuuaaaauaauguuauauuuaugcuaa

SEQ ID NO: 575309 - RNA, 64 nt, hsa
ugcugauauauuagaaauggcaucccuaucuacuuacuuuaaugcuuaaaauuauacauaaaau

SEQ ID NO: 575310 - RNA, 64 nt, hsa
acugggagacacuaguaguauauguuuguaauguuacuuuaaaauuaucuuuuuauuuuauaag

SEQ ID NO: 575311 - RNA, 64 nt, hsa
caugaaaauaucucccuuuggagcugcucagacuuacuuuaagcucaaacagaagggaaugcua

SEQ ID NO: 575312 - RNA, 64 nt, hsa
guaacuccauggcauaaauaguuguauuuuuguguacuuuaaaaucaacuuauaacugugagau

SEQ ID NO: 575313 - RNA, 64 nt, hsa
uuagaaaacauucuauauaaaagaagucaguugauacuuuaaaaucucccauuugguuuauaaa

SEQ ID NO: 575314 - RNA, 64 nt, hsa
gaucauuauaucauuggaacaacugauacuucacuacuuuaauaaagaauuaacagagauugaa

SEQ ID NO: 575315 - RNA, 64 nt, hsa
uuaaaaucagcuuuauucuaagcaaaucugugucuacuuuaaaaaacuggaaauggaaaaaaaa

SEQ ID NO: 575316 - RNA, 64 nt, hsa
ucaaaagaaugaauaacauugauaauaaaaucgcuacuuuaagggguuuguccaaaauaaauau

SEQ ID NO: 575317 - RNA, 64 nt, hsa
uucucuuuacuucucuccaccuucuccaucucucuacuuuaaagauggaagucugugcaugagg

SEQ ID NO: 575318 - RNA, 64 nt, hsa
gccaagcacauuaacuuucucauacacugacuguuacuuuaacuguuagucuuaaauaguuggg

SEQ ID NO: 575319 - RNA, 64 nt, hsa
uauucuuccuuaaguaagugaagcauagcaaaucuacuuuaaacuggauggguuaauuuauaua

SEQ ID NO: 575320 - RNA, 64 nt, hsa
cacauauauauaugacuugaaaauuaagauuuaauacuuuaauguuuuaagugugggggguuug

SEQ ID NO: 575321 - RNA, 64 nt, hsa
uguguguguguguguguguguguguguaagggaguacuuuaaccuugccaguuuguucccucuu

SEQ ID NO: 575322 - RNA, 64 nt, hsa
ucagauauuuguuguaaguuaauucaauucuuaauacuuuaauuuugcuccaacaagggcuuua

SEQ ID NO: 575323 - RNA, 64 nt, hsa
auacuugaaauuuauuuguaugauauaaaguuauuacuuuaaacaaaaugcaaguaugggggga

SEQ ID NO: 575324 - RNA, 64 nt, hsa
uaaucuuuaaaucaugauccuaauuagcuguccuuacuuuaacuugaucuaauuauugcuuccu

SEQ ID NO: 575325 - RNA, 64 nt, hsa
uucgguccuuuuuaaucugggguauuauaggcaguacuuuaaauugcaaagucuuccgggccua

SEQ ID NO: 575326 - RNA, 64 nt, hsa
gaaagaauguguuucaguaucagugcuuuuuugguacuuuaacaaguauuguaggcacggugga

SEQ ID NO: 575327 - RNA, 64 nt, hsa
guggguauuuaagaaaaccuggagaauaaacucauacuuuaaaagaucacuucucuuuucaguu

SEQ ID NO: 575328 - RNA, 64 nt, hsa
uaaaaugauacuuaaauaaagaaagugugaggucuacuuuaaaaaaauucaaaugaagagaaaa

SEQ ID NO: 575329 - RNA, 64 nt, hsa
aggcagaacacaauggcuaaauaucuguugcauguacuuuaaaguuuauuauaaaauauaaaca

SEQ ID NO: 575330 - RNA, 64 nt, hsa
aauauaccagcgaauuuaaaucuaaaaaugcuccuacuuuaaguaccuugugcugcucuuuaug

SEQ ID NO: 575331 - RNA, 64 nt, hsa
uuauuacauacacaucagccaucaacuaaaguuguacuuuaaaaauuuacuacaauauguacau

SEQ ID NO: 575332 - RNA, 64 nt, hsa
caaaaccaaaaguuauuaaaauuguuguccgguuuacuuuaacuuaguuuugcauaguucuagu

SEQ ID NO: 575333 - RNA, 64 nt, hsa; identical to SEQ ID NO: 114130

SEQ ID NO: 575334 - RNA, 64 nt, hsa; identical to SEQ ID NO: 114131

SEQ ID NO: 575335 - RNA, 64 nt, hsa; identical to SEQ ID NO: 114132

SEQ ID NO: 575336 - RNA, 64 nt, hsa; identical to SEQ ID NO: 114133

SEQ ID NO: 575337 - RNA, 64 nt, hsa; identical to SEQ ID NO: 114134

SEQ ID NO: 575338 - RNA, 64 nt, hsa; identical to SEQ ID NO: 114135

SEQ ID NO: 575339 - RNA, 64 nt, hsa; identical to SEQ ID NO: 114136

SEQ ID NO: 575340 - RNA, 64 nt, hsa; identical to SEQ ID NO: 114137

SEQ ID NO: 575341 - RNA, 64 nt, hsa; identical to SEQ ID NO: 114138

SEQ ID NO: 575342 - RNA, 64 nt, hsa; identical to SEQ ID NO: 114139

SEQ ID NO: 575343 - RNA, 64 nt, hsa; identical to SEQ ID NO: 114140

SEQ ID NO: 575344 - RNA, 64 nt, hsa; identical to SEQ ID NO: 114141

SEQ ID NO: 575345 - RNA, 64 nt, hsa; identical to SEQ ID NO: 114142

SEQ ID NO: 575346 - RNA, 64 nt, hsa; identical to SEQ ID NO: 114143

SEQ ID NO: 575347 - RNA, 64 nt, hsa; identical to SEQ ID NO: 114144

SEQ ID NO: 575348 - RNA, 64 nt, hsa; identical to SEQ ID NO: 114145

SEQ ID NO: 575349 - RNA, 64 nt, hsa; identical to SEQ ID NO: 114146

SEQ ID NO: 575350 - RNA, 64 nt, hsa; identical to SEQ ID NO: 114147

SEQ ID NO: 575351 - RNA, 64 nt, hsa; identical to SEQ ID NO: 133830

SEQ ID NO: 575352 - RNA, 64 nt, hsa; identical to SEQ ID NO: 133831

SEQ ID NO: 575353 - RNA, 64 nt, hsa; identical to SEQ ID NO: 133832

SEQ ID NO: 575354 - RNA, 64 nt, hsa; identical to SEQ ID NO: 133833

SEQ ID NO: 575355 - RNA, 64 nt, hsa; identical to SEQ ID NO: 133834

SEQ ID NO: 575356 - RNA, 64 nt, hsa; identical to SEQ ID NO: 133835

SEQ ID NO: 575357 - RNA, 64 nt, hsa; identical to SEQ ID NO: 133836

SEQ ID NO: 575358 - RNA, 64 nt, hsa; identical to SEQ ID NO: 133837

SEQ ID NO: 575359 - RNA, 64 nt, hsa; identical to SEQ ID NO: 133838

SEQ ID NO: 575360 - RNA, 64 nt, hsa; identical to SEQ ID NO: 133839

SEQ ID NO: 575361 - RNA, 64 nt, hsa; identical to SEQ ID NO: 133840

SEQ ID NO: 575362 - RNA, 64 nt, hsa; identical to SEQ ID NO: 133841

SEQ ID NO: 575363 - RNA, 64 nt, hsa; identical to SEQ ID NO: 133842

SEQ ID NO: 575364 - RNA, 64 nt, hsa; identical to SEQ ID NO: 133843

SEQ ID NO: 575365 - RNA, 64 nt, hsa; identical to SEQ ID NO: 133844

SEQ ID NO: 575366 - RNA, 64 nt, hsa; identical to SEQ ID NO: 133845

SEQ ID NO: 575367 - RNA, 64 nt, hsa; identical to SEQ ID NO: 133846

SEQ ID NO: 575368 - RNA, 64 nt, hsa; identical to SEQ ID NO: 133847

SEQ ID NO: 575369 - RNA, 64 nt, hsa; identical to SEQ ID NO: 133848

SEQ ID NO: 575370 - RNA, 64 nt, hsa; identical to SEQ ID NO: 133849

SEQ ID NO: 575371 - RNA, 64 nt, hsa; identical to SEQ ID NO: 133850

SEQ ID NO: 575372 - RNA, 64 nt, hsa; identical to SEQ ID NO: 133851

SEQ ID NO: 575373 - RNA, 64 nt, hsa; identical to SEQ ID NO: 133852

SEQ ID NO: 575374 - RNA, 64 nt, hsa; identical to SEQ ID NO: 133853

SEQ ID NO: 575375 - RNA, 64 nt, hsa; identical to SEQ ID NO: 133854

SEQ ID NO: 575376 - RNA, 64 nt, hsa; identical to SEQ ID NO: 133855

SEQ ID NO: 575377 - RNA, 64 nt, hsa; identical to SEQ ID NO: 133856

SEQ ID NO: 575378 - RNA, 64 nt, hsa; identical to SEQ ID NO: 133857

SEQ ID NO: 575379 - RNA, 64 nt, hsa; identical to SEQ ID NO: 133858

SEQ ID NO: 575380 - RNA, 64 nt, hsa; identical to SEQ ID NO: 133859

SEQ ID NO: 575381 - RNA, 64 nt, hsa; identical to SEQ ID NO: 133860

SEQ ID NO: 575382 - RNA, 64 nt, hsa; identical to SEQ ID NO: 133861

SEQ ID NO: 575383 - RNA, 64 nt, hsa; identical to SEQ ID NO: 133862

SEQ ID NO: 575384 - RNA, 64 nt, hsa; identical to SEQ ID NO: 133863

SEQ ID NO: 575385 - RNA, 64 nt, hsa; identical to SEQ ID NO: 133864

SEQ ID NO: 575386 - RNA, 64 nt, hsa; identical to SEQ ID NO: 133865

SEQ ID NO: 575387 - RNA, 64 nt, hsa; identical to SEQ ID NO: 133866

SEQ ID NO: 575388 - RNA, 64 nt, hsa; identical to SEQ ID NO: 133867

SEQ ID NO: 575389 - RNA, 64 nt, hsa; identical to SEQ ID NO: 133868

SEQ ID NO: 575390 - RNA, 64 nt, hsa; identical to SEQ ID NO: 133869

SEQ ID NO: 575391 - RNA, 64 nt, hsa; identical to SEQ ID NO: 133870

SEQ ID NO: 575392 - RNA, 64 nt, hsa; identical to SEQ ID NO: 133871

SEQ ID NO: 575393 - RNA, 64 nt, hsa; identical to SEQ ID NO: 133872

SEQ ID NO: 575394 - RNA, 64 nt, hsa; identical to SEQ ID NO: 133873

SEQ ID NO: 575395 - RNA, 64 nt, hsa; identical to SEQ ID NO: 133874

SEQ ID NO: 575396 - RNA, 64 nt, hsa; identical to SEQ ID NO: 133875

SEQ ID NO: 575397 - RNA, 64 nt, hsa; identical to SEQ ID NO: 133876

SEQ ID NO: 575398 - RNA, 64 nt, hsa; identical to SEQ ID NO: 133877

SEQ ID NO: 575399 - RNA, 64 nt, hsa; identical to SEQ ID NO: 133878

SEQ ID NO: 575400 - RNA, 64 nt, hsa; identical to SEQ ID NO: 133879

SEQ ID NO: 575401 - RNA, 64 nt, hsa; identical to SEQ ID NO: 133880

SEQ ID NO: 575402 - RNA, 64 nt, hsa; identical to SEQ ID NO: 133881

SEQ ID NO: 575403 - RNA, 64 nt, hsa; identical to SEQ ID NO: 133882

SEQ ID NO: 575404 - RNA, 64 nt, hsa; identical to SEQ ID NO: 133883

SEQ ID NO: 575405 - RNA, 64 nt, hsa; identical to SEQ ID NO: 133884

SEQ ID NO: 575406 - RNA, 64 nt, hsa; identical to SEQ ID NO: 133885

SEQ ID NO: 575407 - RNA, 64 nt, hsa; identical to SEQ ID NO: 133886

SEQ ID NO: 575408 - RNA, 64 nt, hsa; identical to SEQ ID NO: 133887

SEQ ID NO: 575409 - RNA, 64 nt, hsa; identical to SEQ ID NO: 133888

SEQ ID NO: 575410 - RNA, 64 nt, hsa; identical to SEQ ID NO: 133889

SEQ ID NO: 575411 - RNA, 64 nt, hsa; identical to SEQ ID NO: 133890

SEQ ID NO: 575412 - RNA, 64 nt, hsa; identical to SEQ ID NO: 133891

SEQ ID NO: 575413 - RNA, 64 nt, hsa; identical to SEQ ID NO: 133892

SEQ ID NO: 575414 - RNA, 64 nt, hsa; identical to SEQ ID NO: 133893

SEQ ID NO: 575415 - RNA, 64 nt, hsa
augccgcuggacucucugaccuuggagaguguaaacaucauauaugauucuguguuccugagau

SEQ ID NO: 575416 - RNA, 64 nt, hsa
uuuuucagauuuuuuauaugcuucuuuacuacuuacaucauaaugcacaauuuuauauacugau

SEQ ID NO: 575417 - RNA, 64 nt, hsa
acagaacaagacuccaucucaaaaaaaaaaaaguacaucauaaaaguacaucauaugugaacau

SEQ ID NO: 575418 - RNA, 64 nt, hsa
ccaucucaaaaaaaaaaaaguacaucauaaaaguacaucauaugugaacaugcaaaagcaaugc

SEQ ID NO: 575419 - RNA, 64 nt, hsa; identical to SEQ ID NO: 245916

SEQ ID NO: 575420 - RNA, 64 nt, hsa; identical to SEQ ID NO: 245917

SEQ ID NO: 575421 - RNA, 64 nt, hsa; identical to SEQ ID NO: 245918

SEQ ID NO: 575422 - RNA, 64 nt, hsa; identical to SEQ ID NO: 245919

SEQ ID NO: 575423 - RNA, 64 nt, hsa; identical to SEQ ID NO: 245920

SEQ ID NO: 575424 - RNA, 64 nt, hsa; identical to SEQ ID NO: 245921

SEQ ID NO: 575425 - RNA, 64 nt, hsa; identical to SEQ ID NO: 245922

SEQ ID NO: 575426 - RNA, 64 nt, hsa; identical to SEQ ID NO: 245923

SEQ ID NO: 575427 - RNA, 64 nt, hsa; identical to SEQ ID NO: 245924

SEQ ID NO: 575428 - RNA, 64 nt, hsa; identical to SEQ ID NO: 245925

SEQ ID NO: 575429 - RNA, 64 nt, hsa; identical to SEQ ID NO: 245926

SEQ ID NO: 575430 - RNA, 64 nt, hsa; identical to SEQ ID NO: 245927

SEQ ID NO: 575431 - RNA, 64 nt, hsa; identical to SEQ ID NO: 245928

SEQ ID NO: 575432 - RNA, 64 nt, hsa; identical to SEQ ID NO: 245929

SEQ ID NO: 575433 - RNA, 64 nt, hsa; identical to SEQ ID NO: 245930

SEQ ID NO: 575434 - RNA, 64 nt, hsa; identical to SEQ ID NO: 245931

SEQ ID NO: 575435 - RNA, 64 nt, hsa; identical to SEQ ID NO: 245932

SEQ ID NO: 575436 - RNA, 64 nt, hsa; identical to SEQ ID NO: 245933

SEQ ID NO: 575437 - RNA, 64 nt, hsa; identical to SEQ ID NO: 245934

SEQ ID NO: 575438 - RNA, 64 nt, hsa; identical to SEQ ID NO: 245935

SEQ ID NO: 575439 - RNA, 64 nt, hsa; identical to SEQ ID NO: 245936

SEQ ID NO: 575440 - RNA, 64 nt, hsa
uuucucccaguacuccagcaauucauuucugaaagcaguugagccacuuuauuccaaaguacac

SEQ ID NO: 575441 - RNA, 64 nt, hsa
guuaggucauuuguggguugauucuucagaaacagcaguugauaccuagcagcguuauugaugg

SEQ ID NO: 575442 - RNA, 64 nt, hsa
auagcggguuacuuucacauacagcccucccccagcaguugaaugacaacagaagcuucagaag

SEQ ID NO: 575443 - RNA, 64 nt, hsa
gugguuuauagagggccaagacuuggcaacagaagcaguugagucgucaucacuuuucagugau

SEQ ID NO: 575444 - RNA, 64 nt, hsa
cugacuaacuuggcauuugcaggucaagcaggaagcaguugacaagacacauccucagugaauc

SEQ ID NO: 575445 - RNA, 64 nt, hsa
ugugcuacccuuucuaaacuguucuaagaagcaggcaguugauguauguuuauauuuuaaguca

SEQ ID NO: 575446 - RNA, 64 nt, hsa
augguguuaaugauauuagagaugaaaaacguuagcaguugauuuuuguccaaaagcaagucau

SEQ ID NO: 575447 - RNA, 64 nt, hsa
aaaugggaaaagggaaaaggagagagcaauugaggcaguugaccauauucaguuuuauuuauuu

SEQ ID NO: 575448 - RNA, 64 nt, hsa
ucuauaaaacacuauaggacauuuguuuucaaaagcaguugaguaacagcaacauaaaccacau

SEQ ID NO: 575449 - RNA, 64 nt, hsa
cgauucuguuuuguucaucuguucgagcagaggggcaguugaagucucguccuggucucugccc

SEQ ID NO: 575450 - RNA, 64 nt, hsa
aucagaaauuuuggaaggguucuuugaaauagcagcaguugaaacagagacacuuugccacagu

SEQ ID NO: 575451 - RNA, 64 nt, hsa
ccaccuucucuccacagaauguuugcagagcugggcaguugaggaaaggacagccccugguugg

SEQ ID NO: 575452 - RNA, 64 nt, hsa
uauuuauaaccuguuauaagugcuauauucuguuugcaguuaggaaaugcagaauucaaaguga

SEQ ID NO: 575453 - RNA, 64 nt, hsa
aucucaaaaaagaaggaauuucuccuuuguuucuugcaguuaauguaagaauacuuuaaaucuc

SEQ ID NO: 575454 - RNA, 64 nt, hsa
gcaaaugaacuuuuuuaaaaaucaucuuccauguugcaguuagucuuucuuuucauuacaaguc

SEQ ID NO: 575455 - RNA, 64 nt, hsa
ucacaaaagaaauugccuuacacugguucauguuugcaguuacuguuguacauugcauagaugu

SEQ ID NO: 575456 - RNA, 64 nt, hsa
auagcauucaggccuuccaugaacagaucgucauugcaguuaaagcuccagcagaaaccagauu

SEQ ID NO: 575457 - RNA, 64 nt, hsa
uuugauagauagaugccuuuaaaagggcugguaaugcaguuacauucuaacagagaaguccaaa

SEQ ID NO: 575458 - RNA, 64 nt, hsa
gaaaggacguguggagacagcagcaguccuguggugcaguuacugccuguguggccagcuucac

SEQ ID NO: 575459 - RNA, 64 nt, hsa
uggacgugcccaggaaugcuuuuggcuguuauuuugcaguuaauaccuccuguaacuaaagcau

SEQ ID NO: 575460 - RNA, 64 nt, hsa
gacuacaagaugaaagacaauuugguugcugagaugcaguuaauggcuucuguuacauggagcu

SEQ ID NO: 575461 - RNA, 64 nt, hsa
ucacccucagcuggcggaaccuggcugcgaacugugcaguuacguugcauccacaggauuccag

SEQ ID NO: 575462 - RNA, 64 nt, hsa
cuuguaaaccuggaggguugauauauucuuuccaugcaguuauuagaacuuaguuuuguuccaa

SEQ ID NO: 575463 - RNA, 64 nt, hsa
ggccccggggcauggcugcugacgugggcauggguggauuuagccaaggaccuggcaacccagg

SEQ ID NO: 575464 - RNA, 64 nt, hsa
gcugcuuugggggaggggggaacucgagaauguauggauuuaccugaaaacaaauuauucauuu

SEQ ID NO: 575465 - RNA, 64 nt, hsa
gcugcccucuguuuuuuuuauccacucguaaaucuggauuuauuucuucuguuuuauacaagcu

SEQ ID NO: 575466 - RNA, 64 nt, hsa
agucagguucuucucuacaguucaaaauugagaauggauuuaauuaacuagcauuuagccagcu

SEQ ID NO: 575467 - RNA, 64 nt, hsa
uccacauauguaccccuucuccuuuuuuuaaagauggauuuaaaccaagaugccuccaggaaag

SEQ ID NO: 575468 - RNA, 64 nt, hsa
uauuucauuauuuuaauaacugugaugucauguauggauuuacuuugggguucaaaucaaaaug

SEQ ID NO: 575469 - RNA, 64 nt, hsa
aaagcuauaccaaaagggccauguuucaagaaaauggauuuaaacauauuucccuguggaggua

SEQ ID NO: 575470 - RNA, 64 nt, hsa
gagacugauucagaggagcaacccuauuuagaaauggauuuaucaucaccucaaacgagauaua

SEQ ID NO: 575471 - RNA, 64 nt, hsa
acuuugguugauuuuuaagugggcuuccauuccauggauuuaaucagucccaagaagaucaaac

SEQ ID NO: 575472 - RNA, 64 nt, hsa
caaacucagcaguacuugggugcugaagaacuguuggauuuacccuggcacgugugccacuugc

SEQ ID NO: 575473 - RNA, 64 nt, hsa
uuauuguauucuaauauaauugaaauaaauggcauggauuuauuuuuucuuaacuauuuggauu

SEQ ID NO: 575474 - RNA, 64 nt, hsa
auggaagcuugaguauguucucccuuuuccauuuuggauuuaucucuuuacuguaaugacucaa

SEQ ID NO: 575475 - RNA, 64 nt, hsa
ugacuuucaaauguaugaaccagcauguaccccauggauuuaaucuuaucuaccccguggauuc

SEQ ID NO: 575476 - RNA, 64 nt, hsa
acagaaacaugcgcuguaaugaaucaaaguuuaauggauuuagggcugugcaggaugugccuug

SEQ ID NO: 575477 - RNA, 64 nt, hsa
cuagaagcacuuuauguuuccuuuuugggugaaauggauuuaugugagugcuuuaaacaaauag

SEQ ID NO: 575478 - RNA, 64 nt, hsa
cuaggcaugugaaaucacuuucauggauuauuaauggauuuaagagggcaucaaucagcucaac

SEQ ID NO: 575479 - RNA, 64 nt, hsa
uaaaauccuuuaagccaaaaggaagcuugcucuauggauuuaaaugcaaacuucauuuaccagu

SEQ ID NO: 575480 - RNA, 64 nt, hsa
cacuaaaacaggguucucuuuggauuaaaaguucuggauuuauugcaacuauuuuccuugagaa

SEQ ID NO: 575481 - RNA, 64 nt, hsa
gucagaauucuaaacuaaagacauguuuggaguguggauuuaucuucaguuuuucuuuggacaa

SEQ ID NO: 575482 - RNA, 64 nt, hsa
gaauauggcacauuggaaccauuuuauucaccaguggauuuacccuuagaguauuuuuagaucu

SEQ ID NO: 575483 - RNA, 64 nt, hsa
caggauguuaauaaugaagccauauguuuaugucuggauuuaaaaauuuuaaacaaucauuuac

SEQ ID NO: 575484 - RNA, 64 nt, hsa
uauaaacaauuuaugcaugcugugacuuagucuauggauuuauuccaaaauugcuuagucacca

SEQ ID NO: 575485 - RNA, 64 nt, hsa
auucuugaccugguguucuucaucauucuugcuauggauuuaucaauuuuguuccucuuuucca

SEQ ID NO: 575486 - RNA, 64 nt, hsa
ucauaaugcaucuucuucccuccuucuacuguacuggauuuaaagcgcaccuuauagagacauc

SEQ ID NO: 575487 - RNA, 64 nt, hsa
guaaagggucugccagauaggaagaugcuaguuauggauuuacaagguuguuaaggcuguaaga

SEQ ID NO: 575488 - RNA, 64 nt, hsa
cucgagagccaauacccugugcccuccacucaucuggauuuacaggaacugucauaguguucag

SEQ ID NO: 575489 - RNA, 64 nt, hsa
auuucuuaggcauuuucucucuuauaaaguuuccuggauuuauaaauuuucauugauuuuacua

SEQ ID NO: 575490 - RNA, 64 nt, hsa
ugaguguaaguuuacuauauauaaagcuaagauguggauuuacaggaagaacccugguuugaau

SEQ ID NO: 575491 - RNA, 64 nt, hsa
aguuguggucugacacacacugcugugguuccccuggauuuagugaaaugccguaugcagguuu

SEQ ID NO: 575492 - RNA, 64 nt, hsa
aagguagcagugcuucucugguccucaagagacuuggauuuaaagguaggaugauguuuuuuuc

SEQ ID NO: 575493 - RNA, 64 nt, hsa
caggcuacaaucuucauuuaauauaaauaauuuauggauuuaugacauuacaauccugcauugu

SEQ ID NO: 575494 - RNA, 64 nt, hsa
cuaaauaagcuuccacgccaguugccucuugaaguggauuuaacuaaagcgaagagacaagauc

SEQ ID NO: 575495 - RNA, 64 nt, hsa
ccauuucugauacgugguuuuuaaaaauaugaaauggauuuauauauacuauauuccucaaauc

SEQ ID NO: 575496 - RNA, 64 nt, hsa
auugauuguuacuuaaauuuuccaccuggaaucauggauuuaaaauuuccccaccucaugggga

SEQ ID NO: 575497 - RNA, 64 nt, hsa
uacaggcaugagccaccgcacccagccugguuauuggauuuauuuauuuauuuugagauagagc

SEQ ID NO: 575498 - RNA, 64 nt, hsa
uuuauuucugauuuucacaggaaaauacuguggauggauuuaauagguaaucaaggcaauucag

SEQ ID NO: 575499 - RNA, 64 nt, hsa
uuggcaaauuuaggagcuuguucccauugccaaauggauuuagaaauucccuugugagugccug

SEQ ID NO: 575500 - RNA, 64 nt, hsa
acacauacauacauauuaccauacugaagggaaauggauuuauauuugaauuugauauuugaau

SEQ ID NO: 575501 - RNA, 64 nt, hsa
uaccugcaugaauaaauaaugagaaauauuuugugacuuuaauugguaaauauguuacaaaacc

SEQ ID NO: 575502 - RNA, 64 nt, hsa
auacugcauagaggaacagacuaaggagagauaggacuuuaaucuggaggaaaaauauccuaca

SEQ ID NO: 575503 - RNA, 64 nt, hsa
aaagaaugugaaauuuuuacagaaucagacagaugacuuuaaagaaauuuuuuucaugauggaa

SEQ ID NO: 575504 - RNA, 64 nt, hsa
uaauuauuucugaaauauccaucuuuuucuuauggacuuuaagaccuuuauauuuuuaaagaua

SEQ ID NO: 575505 - RNA, 64 nt, hsa
aaauaaugcacagggcuugagcuuucugucauuugacuuuaaaaggaaguuucauucauauuua

SEQ ID NO: 575506 - RNA, 64 nt, hsa
guagucccaucuccacuauuuagaaauguucucagacuuuaaaauaaugcacagggcuugagcu

SEQ ID NO: 575507 - RNA, 64 nt, hsa
uuuccuuuucucugagaguuuuaauacuuucaaggacuuuaaaaaaauaaucauguuugaauug

SEQ ID NO: 575508 - RNA, 64 nt, hsa
cuuuugaacaacuugguuucagaauauguaaaaugacuuuaaggaucuuguguaucaaaccuau

SEQ ID NO: 575509 - RNA, 64 nt, hsa
cuggcaacaaauugugaaacaugaaauuucugcugacuuuaauauaugaaaccuaauccuaccc

SEQ ID NO: 575510 - RNA, 64 nt, hsa
uauuguagauuuauuuuuauauuaguuaauaaaugacuuuaaauugucaccaauugaaaaucuu

SEQ ID NO: 575511 - RNA, 64 nt, hsa
gugugacuuuucaaguguaacagccauucuuccugacuuuaauauuguccaguucuggucuuuu

SEQ ID NO: 575512 - RNA, 64 nt, hsa
gcuuuagggaauuuuaaguugcaugcauuucagagacuuuaagucaguugguuuuuauuagcug

SEQ ID NO: 575513 - RNA, 64 nt, hsa
ugccaggagccauaggaauaucuguauguuggaugacuuuaaugcuacauuuuaaaaaaagaaa

SEQ ID NO: 575514 - RNA, 64 nt, hsa
ugugcucuuaccagugguuaauaauuugaaguuugacuuuaauuguaaaagccguuaauguaga

SEQ ID NO: 575515 - RNA, 64 nt, hsa
uaucacacaaaguuccuguauuucuagggaagcagacuuuaaauuucuaaaaacuugauuuaau

SEQ ID NO: 575516 - RNA, 64 nt, hsa
aaauguagacauaugcuuggcuaaaggggaaauggacuuuaaauuuuaaagagcucauuugcaa

SEQ ID NO: 575517 - RNA, 64 nt, hsa
augaugaaacuuuuuaaaaaacuaaaccagaagagacuuuaaaauaagagaaagaaaucauaaa

SEQ ID NO: 575518 - RNA, 64 nt, hsa
caaaguuuagucacagcuuaaaaacauucagugugacuuuaauauuauaaaaugauuucccaug

SEQ ID NO: 575519 - RNA, 64 nt, hsa
uugggaaacuagagaacaccucuauuuuuaaaaggacuuuaacgaagucaaacaacuuauaaga

SEQ ID NO: 575520 - RNA, 64 nt, hsa
ucuuauuacccugauugaaugugugaugugaacugacuuuaaguaaucaggauugaauuccauu

SEQ ID NO: 575521 - RNA, 64 nt, hsa
uagucauuaacuugaauuuggucuguauagucuagacuuuaaauuuaaaguuuucuacaagggg

SEQ ID NO: 575522 - RNA, 64 nt, hsa
gaguuuguuggugaaguuugggggcgggguguugggaguagagacaggguaaggggacgugaga

SEQ ID NO: 575523 - RNA, 64 nt, hsa
gugccacccuaggucauaugaccuuggccaccuuggaguagacccagaccccucgggacccggg

SEQ ID NO: 575524 - RNA, 64 nt, hsa; identical to SEQ ID NO: 89905

SEQ ID NO: 575525 - RNA, 64 nt, hsa; identical to SEQ ID NO: 89906

SEQ ID NO: 575526 - RNA, 64 nt, hsa; identical to SEQ ID NO: 89907

SEQ ID NO: 575527 - RNA, 64 nt, hsa; identical to SEQ ID NO: 89908

SEQ ID NO: 575528 - RNA, 64 nt, hsa; identical to SEQ ID NO: 89909

SEQ ID NO: 575529 - RNA, 64 nt, hsa; identical to SEQ ID NO: 89910

SEQ ID NO: 575530 - RNA, 64 nt, hsa; identical to SEQ ID NO: 89911

SEQ ID NO: 575531 - RNA, 64 nt, hsa; identical to SEQ ID NO: 89912

SEQ ID NO: 575532 - RNA, 64 nt, hsa; identical to SEQ ID NO: 89913

SEQ ID NO: 575533 - RNA, 64 nt, hsa; identical to SEQ ID NO: 89914

SEQ ID NO: 575534 - RNA, 64 nt, hsa; identical to SEQ ID NO: 89915

SEQ ID NO: 575535 - RNA, 64 nt, hsa; identical to SEQ ID NO: 89916

SEQ ID NO: 575536 - RNA, 64 nt, hsa; identical to SEQ ID NO: 89917

SEQ ID NO: 575537 - RNA, 64 nt, hsa; identical to SEQ ID NO: 89918

SEQ ID NO: 575538 - RNA, 64 nt, hsa; identical to SEQ ID NO: 89919

SEQ ID NO: 575539 - RNA, 64 nt, hsa; identical to SEQ ID NO: 89920

SEQ ID NO: 575540 - RNA, 64 nt, hsa; identical to SEQ ID NO: 89921

SEQ ID NO: 575541 - RNA, 64 nt, hsa; identical to SEQ ID NO: 89922

SEQ ID NO: 575542 - RNA, 64 nt, hsa; identical to SEQ ID NO: 89923

SEQ ID NO: 575543 - RNA, 64 nt, hsa; identical to SEQ ID NO: 89924

SEQ ID NO: 575544 - RNA, 64 nt, hsa; identical to SEQ ID NO: 89925

SEQ ID NO: 575545 - RNA, 64 nt, hsa; identical to SEQ ID NO: 89926

SEQ ID NO: 575546 - RNA, 64 nt, hsa; identical to SEQ ID NO: 89927

SEQ ID NO: 575547 - RNA, 64 nt, hsa; identical to SEQ ID NO: 89928

SEQ ID NO: 575548 - RNA, 50 nt, hsa; identical to SEQ ID NO: 89929

SEQ ID NO: 575549 - RNA, 64 nt, hsa; identical to SEQ ID NO: 89930

SEQ ID NO: 575550 - RNA, 64 nt, hsa; identical to SEQ ID NO: 89931

SEQ ID NO: 575551 - RNA, 64 nt, hsa; identical to SEQ ID NO: 89932

SEQ ID NO: 575552 - RNA, 64 nt, hsa; identical to SEQ ID NO: 89933

SEQ ID NO: 575553 - RNA, 64 nt, hsa; identical to SEQ ID NO: 89934

SEQ ID NO: 575554 - RNA, 64 nt, hsa; identical to SEQ ID NO: 89935

SEQ ID NO: 575555 - RNA, 64 nt, hsa; identical to SEQ ID NO: 89936

SEQ ID NO: 575556 - RNA, 64 nt, hsa; identical to SEQ ID NO: 89937

SEQ ID NO: 575557 - RNA, 64 nt, hsa; identical to SEQ ID NO: 89938

SEQ ID NO: 575558 - RNA, 64 nt, hsa; identical to SEQ ID NO: 89939

SEQ ID NO: 575559 - RNA, 64 nt, hsa; identical to SEQ ID NO: 89940

SEQ ID NO: 575560 - RNA, 64 nt, hsa; identical to SEQ ID NO: 89941

SEQ ID NO: 575561 - RNA, 55 nt, hsa; identical to SEQ ID NO: 89942

SEQ ID NO: 575562 - RNA, 64 nt, hsa; identical to SEQ ID NO: 89943

SEQ ID NO: 575563 - RNA, 64 nt, hsa; identical to SEQ ID NO: 89944

SEQ ID NO: 575564 - RNA, 64 nt, hsa; identical to SEQ ID NO: 89945

SEQ ID NO: 575565 - RNA, 64 nt, hsa; identical to SEQ ID NO: 89946

SEQ ID NO: 575566 - RNA, 64 nt, hsa; identical to SEQ ID NO: 89947

SEQ ID NO: 575567 - RNA, 64 nt, hsa; identical to SEQ ID NO: 89948

SEQ ID NO: 575568 - RNA, 64 nt, hsa; identical to SEQ ID NO: 89949

SEQ ID NO: 575569 - RNA, 64 nt, hsa; identical to SEQ ID NO: 89950

SEQ ID NO: 575570 - RNA, 64 nt, hsa; identical to SEQ ID NO: 89951

SEQ ID NO: 575571 - RNA, 64 nt, hsa; identical to SEQ ID NO: 89952

SEQ ID NO: 575572 - RNA, 64 nt, hsa; identical to SEQ ID NO: 89953

SEQ ID NO: 575573 - RNA, 64 nt, hsa; identical to SEQ ID NO: 89954

SEQ ID NO: 575574 - RNA, 64 nt, hsa; identical to SEQ ID NO: 89955

SEQ ID NO: 575575 - RNA, 64 nt, hsa; identical to SEQ ID NO: 89956

SEQ ID NO: 575576 - RNA, 64 nt, hsa; identical to SEQ ID NO: 89957

SEQ ID NO: 575577 - RNA, 64 nt, hsa; identical to SEQ ID NO: 89958

SEQ ID NO: 575578 - RNA, 64 nt, hsa; identical to SEQ ID NO: 89959

SEQ ID NO: 575579 - RNA, 64 nt, hsa; identical to SEQ ID NO: 89960

SEQ ID NO: 575580 - RNA, 64 nt, hsa; identical to SEQ ID NO: 89961

SEQ ID NO: 575581 - RNA, 64 nt, hsa; identical to SEQ ID NO: 89962

SEQ ID NO: 575582 - RNA, 64 nt, hsa; identical to SEQ ID NO: 89963

SEQ ID NO: 575583 - RNA, 64 nt, hsa; identical to SEQ ID NO: 89964

SEQ ID NO: 575584 - RNA, 64 nt, hsa; identical to SEQ ID NO: 89965

SEQ ID NO: 575585 - RNA, 64 nt, hsa; identical to SEQ ID NO: 89966

SEQ ID NO: 575586 - RNA, 64 nt, hsa; identical to SEQ ID NO: 89967

SEQ ID NO: 575587 - RNA, 64 nt, hsa; identical to SEQ ID NO: 89968

SEQ ID NO: 575588 - RNA, 64 nt, hsa; identical to SEQ ID NO: 89969

SEQ ID NO: 575589 - RNA, 64 nt, hsa; identical to SEQ ID NO: 89970

SEQ ID NO: 575590 - RNA, 64 nt, hsa; identical to SEQ ID NO: 89971

SEQ ID NO: 575591 - RNA, 64 nt, hsa; identical to SEQ ID NO: 89972

SEQ ID NO: 575592 - RNA, 64 nt, hsa; identical to SEQ ID NO: 89973

SEQ ID NO: 575593 - RNA, 64 nt, hsa; identical to SEQ ID NO: 89974

SEQ ID NO: 575594 - RNA, 64 nt, hsa; identical to SEQ ID NO: 89975

SEQ ID NO: 575595 - RNA, 64 nt, hsa; identical to SEQ ID NO: 89976

SEQ ID NO: 575596 - RNA, 64 nt, hsa; identical to SEQ ID NO: 89977

SEQ ID NO: 575597 - RNA, 64 nt, hsa; identical to SEQ ID NO: 89978

SEQ ID NO: 575598 - RNA, 64 nt, hsa; identical to SEQ ID NO: 89979

SEQ ID NO: 575599 - RNA, 64 nt, hsa; identical to SEQ ID NO: 89980

SEQ ID NO: 575600 - RNA, 64 nt, hsa; identical to SEQ ID NO: 89981

SEQ ID NO: 575601 - RNA, 64 nt, hsa; identical to SEQ ID NO: 89982

SEQ ID NO: 575602 - RNA, 64 nt, hsa; identical to SEQ ID NO: 89983

SEQ ID NO: 575603 - RNA, 64 nt, hsa; identical to SEQ ID NO: 89984

SEQ ID NO: 575604 - RNA, 64 nt, hsa; identical to SEQ ID NO: 89985

SEQ ID NO: 575605 - RNA, 64 nt, hsa; identical to SEQ ID NO: 89986

SEQ ID NO: 575606 - RNA, 64 nt, hsa; identical to SEQ ID NO: 89987

SEQ ID NO: 575607 - RNA, 64 nt, hsa; identical to SEQ ID NO: 89988

SEQ ID NO: 575608 - RNA, 59 nt, hsa; identical to SEQ ID NO: 89989

SEQ ID NO: 575609 - RNA, 64 nt, hsa; identical to SEQ ID NO: 89990

SEQ ID NO: 575610 - RNA, 64 nt, hsa; identical to SEQ ID NO: 89991

SEQ ID NO: 575611 - RNA, 64 nt, hsa; identical to SEQ ID NO: 89992

SEQ ID NO: 575612 - RNA, 64 nt, hsa; identical to SEQ ID NO: 89993

SEQ ID NO: 575613 - RNA, 64 nt, hsa; identical to SEQ ID NO: 89994

SEQ ID NO: 575614 - RNA, 64 nt, hsa; identical to SEQ ID NO: 89995

SEQ ID NO: 575615 - RNA, 64 nt, hsa; identical to SEQ ID NO: 89996

SEQ ID NO: 575616 - RNA, 64 nt, hsa; identical to SEQ ID NO: 89997

SEQ ID NO: 575617 - RNA, 64 nt, hsa; identical to SEQ ID NO: 89998

SEQ ID NO: 575618 - RNA, 64 nt, hsa; identical to SEQ ID NO: 89999

SEQ ID NO: 575619 - RNA, 64 nt, hsa; identical to SEQ ID NO: 90000

SEQ ID NO: 575620 - RNA, 64 nt, hsa; identical to SEQ ID NO: 90001

SEQ ID NO: 575621 - RNA, 64 nt, hsa; identical to SEQ ID NO: 90002

SEQ ID NO: 575622 - RNA, 64 nt, hsa; identical to SEQ ID NO: 90003

SEQ ID NO: 575623 - RNA, 64 nt, hsa; identical to SEQ ID NO: 90004

SEQ ID NO: 575624 - RNA, 64 nt, hsa; identical to SEQ ID NO: 90005

SEQ ID NO: 575625 - RNA, 64 nt, hsa; identical to SEQ ID NO: 90006

SEQ ID NO: 575626 - RNA, 64 nt, hsa; identical to SEQ ID NO: 90007

SEQ ID NO: 575627 - RNA, 64 nt, hsa; identical to SEQ ID NO: 90008

SEQ ID NO: 575628 - RNA, 64 nt, hsa; identical to SEQ ID NO: 90009

SEQ ID NO: 575629 - RNA, 64 nt, hsa; identical to SEQ ID NO: 90010

SEQ ID NO: 575630 - RNA, 64 nt, hsa; identical to SEQ ID NO: 90011

SEQ ID NO: 575631 - RNA, 64 nt, hsa; identical to SEQ ID NO: 90012

SEQ ID NO: 575632 - RNA, 64 nt, hsa; identical to SEQ ID NO: 90013

SEQ ID NO: 575633 - RNA, 64 nt, hsa; identical to SEQ ID NO: 90014

SEQ ID NO: 575634 - RNA, 64 nt, hsa; identical to SEQ ID NO: 90015

SEQ ID NO: 575635 - RNA, 64 nt, hsa; identical to SEQ ID NO: 90016

SEQ ID NO: 575636 - RNA, 64 nt, hsa; identical to SEQ ID NO: 90017

SEQ ID NO: 575637 - RNA, 64 nt, hsa; identical to SEQ ID NO: 90018

SEQ ID NO: 575638 - RNA, 64 nt, hsa; identical to SEQ ID NO: 90019

SEQ ID NO: 575639 - RNA, 64 nt, hsa; identical to SEQ ID NO: 90020

SEQ ID NO: 575640 - RNA, 64 nt, hsa; identical to SEQ ID NO: 90021

SEQ ID NO: 575641 - RNA, 64 nt, hsa; identical to SEQ ID NO: 90022

SEQ ID NO: 575642 - RNA, 64 nt, hsa; identical to SEQ ID NO: 90023

SEQ ID NO: 575643 - RNA, 64 nt, hsa; identical to SEQ ID NO: 90024

SEQ ID NO: 575644 - RNA, 64 nt, hsa; identical to SEQ ID NO: 90025

SEQ ID NO: 575645 - RNA, 64 nt, hsa; identical to SEQ ID NO: 90026

SEQ ID NO: 575646 - RNA, 64 nt, hsa; identical to SEQ ID NO: 90027

SEQ ID NO: 575647 - RNA, 64 nt, hsa; identical to SEQ ID NO: 90028

SEQ ID NO: 575648 - RNA, 64 nt, hsa; identical to SEQ ID NO: 90029

SEQ ID NO: 575649 - RNA, 64 nt, hsa; identical to SEQ ID NO: 90030

SEQ ID NO: 575650 - RNA, 64 nt, hsa; identical to SEQ ID NO: 90031

SEQ ID NO: 575651 - RNA, 64 nt, hsa; identical to SEQ ID NO: 90032

SEQ ID NO: 575652 - RNA, 64 nt, hsa; identical to SEQ ID NO: 90033

SEQ ID NO: 575653 - RNA, 64 nt, hsa; identical to SEQ ID NO: 90034

SEQ ID NO: 575654 - RNA, 64 nt, hsa; identical to SEQ ID NO: 90035

SEQ ID NO: 575655 - RNA, 64 nt, hsa; identical to SEQ ID NO: 90036

SEQ ID NO: 575656 - RNA, 64 nt, hsa; identical to SEQ ID NO: 90037

SEQ ID NO: 575657 - RNA, 64 nt, hsa; identical to SEQ ID NO: 90038

SEQ ID NO: 575658 - RNA, 64 nt, hsa; identical to SEQ ID NO: 90039

SEQ ID NO: 575659 - RNA, 64 nt, hsa; identical to SEQ ID NO: 90040

SEQ ID NO: 575660 - RNA, 64 nt, hsa; identical to SEQ ID NO: 90041

SEQ ID NO: 575661 - RNA, 64 nt, hsa; identical to SEQ ID NO: 90042

SEQ ID NO: 575662 - RNA, 64 nt, hsa; identical to SEQ ID NO: 90043

SEQ ID NO: 575663 - RNA, 64 nt, hsa; identical to SEQ ID NO: 90044

SEQ ID NO: 575664 - RNA, 64 nt, hsa; identical to SEQ ID NO: 90045

SEQ ID NO: 575665 - RNA, 64 nt, hsa; identical to SEQ ID NO: 90046

SEQ ID NO: 575666 - RNA, 64 nt, hsa; identical to SEQ ID NO: 90047

SEQ ID NO: 575667 - RNA, 64 nt, hsa; identical to SEQ ID NO: 90048

SEQ ID NO: 575668 - RNA, 64 nt, hsa; identical to SEQ ID NO: 90049

SEQ ID NO: 575669 - RNA, 64 nt, hsa; identical to SEQ ID NO: 90050

SEQ ID NO: 575670 - RNA, 64 nt, hsa; identical to SEQ ID NO: 90051

SEQ ID NO: 575671 - RNA, 64 nt, hsa; identical to SEQ ID NO: 90052

SEQ ID NO: 575672 - RNA, 64 nt, hsa; identical to SEQ ID NO: 90053

SEQ ID NO: 575673 - RNA, 64 nt, hsa; identical to SEQ ID NO: 90054

SEQ ID NO: 575674 - RNA, 64 nt, hsa; identical to SEQ ID NO: 90055

SEQ ID NO: 575675 - RNA, 64 nt, hsa; identical to SEQ ID NO: 90056

SEQ ID NO: 575676 - RNA, 64 nt, hsa; identical to SEQ ID NO: 90057

SEQ ID NO: 575677 - RNA, 64 nt, hsa; identical to SEQ ID NO: 90058

SEQ ID NO: 575678 - RNA, 64 nt, hsa; identical to SEQ ID NO: 90059

SEQ ID NO: 575679 - RNA, 64 nt, hsa; identical to SEQ ID NO: 90060

SEQ ID NO: 575680 - RNA, 64 nt, hsa; identical to SEQ ID NO: 90061

SEQ ID NO: 575681 - RNA, 64 nt, hsa; identical to SEQ ID NO: 90062

SEQ ID NO: 575682 - RNA, 64 nt, hsa; identical to SEQ ID NO: 90063

SEQ ID NO: 575683 - RNA, 64 nt, hsa; identical to SEQ ID NO: 90064

SEQ ID NO: 575684 - RNA, 64 nt, hsa; identical to SEQ ID NO: 90065

SEQ ID NO: 575685 - RNA, 64 nt, hsa; identical to SEQ ID NO: 90066

SEQ ID NO: 575686 - RNA, 64 nt, hsa; identical to SEQ ID NO: 90067

SEQ ID NO: 575687 - RNA, 64 nt, hsa; identical to SEQ ID NO: 90068

SEQ ID NO: 575688 - RNA, 64 nt, hsa; identical to SEQ ID NO: 90069

SEQ ID NO: 575689 - RNA, 64 nt, hsa; identical to SEQ ID NO: 90070

SEQ ID NO: 575690 - RNA, 64 nt, hsa; identical to SEQ ID NO: 90071

SEQ ID NO: 575691 - RNA, 64 nt, hsa; identical to SEQ ID NO: 90072

SEQ ID NO: 575692 - RNA, 64 nt, hsa; identical to SEQ ID NO: 90073

SEQ ID NO: 575693 - RNA, 64 nt, hsa; identical to SEQ ID NO: 90074

SEQ ID NO: 575694 - RNA, 64 nt, hsa; identical to SEQ ID NO: 90075

SEQ ID NO: 575695 - RNA, 64 nt, hsa; identical to SEQ ID NO: 90076

SEQ ID NO: 575696 - RNA, 64 nt, hsa; identical to SEQ ID NO: 90077

SEQ ID NO: 575697 - RNA, 64 nt, hsa; identical to SEQ ID NO: 90078

SEQ ID NO: 575698 - RNA, 64 nt, hsa; identical to SEQ ID NO: 90079

SEQ ID NO: 575699 - RNA, 64 nt, hsa; identical to SEQ ID NO: 90080

SEQ ID NO: 575700 - RNA, 64 nt, hsa; identical to SEQ ID NO: 90081

SEQ ID NO: 575701 - RNA, 64 nt, hsa; identical to SEQ ID NO: 90082

SEQ ID NO: 575702 - RNA, 64 nt, hsa; identical to SEQ ID NO: 90083

SEQ ID NO: 575703 - RNA, 64 nt, hsa; identical to SEQ ID NO: 90084

SEQ ID NO: 575704 - RNA, 64 nt, hsa; identical to SEQ ID NO: 125569

SEQ ID NO: 575705 - RNA, 64 nt, hsa; identical to SEQ ID NO: 125570

SEQ ID NO: 575706 - RNA, 64 nt, hsa; identical to SEQ ID NO: 125571

SEQ ID NO: 575707 - RNA, 64 nt, hsa; identical to SEQ ID NO: 125572

SEQ ID NO: 575708 - RNA, 64 nt, hsa; identical to SEQ ID NO: 125573

SEQ ID NO: 575709 - RNA, 64 nt, hsa; identical to SEQ ID NO: 125574

SEQ ID NO: 575710 - RNA, 64 nt, hsa; identical to SEQ ID NO: 125575

SEQ ID NO: 575711 - RNA, 64 nt, hsa; identical to SEQ ID NO: 125576

SEQ ID NO: 575712 - RNA, 64 nt, hsa; identical to SEQ ID NO: 125577

SEQ ID NO: 575713 - RNA, 64 nt, hsa; identical to SEQ ID NO: 125578

SEQ ID NO: 575714 - RNA, 64 nt, hsa; identical to SEQ ID NO: 125579

SEQ ID NO: 575715 - RNA, 64 nt, hsa; identical to SEQ ID NO: 125580

SEQ ID NO: 575716 - RNA, 64 nt, hsa; identical to SEQ ID NO: 125581

SEQ ID NO: 575717 - RNA, 64 nt, hsa; identical to SEQ ID NO: 125582

SEQ ID NO: 575718 - RNA, 64 nt, hsa; identical to SEQ ID NO: 125583

SEQ ID NO: 575719 - RNA, 64 nt, hsa; identical to SEQ ID NO: 125584

SEQ ID NO: 575720 - RNA, 64 nt, hsa; identical to SEQ ID NO: 125585

SEQ ID NO: 575721 - RNA, 64 nt, hsa; identical to SEQ ID NO: 125586

SEQ ID NO: 575722 - RNA, 64 nt, hsa; identical to SEQ ID NO: 125587

SEQ ID NO: 575723 - RNA, 64 nt, hsa; identical to SEQ ID NO: 125588

SEQ ID NO: 575724 - RNA, 64 nt, hsa; identical to SEQ ID NO: 125589

SEQ ID NO: 575725 - RNA, 64 nt, hsa; identical to SEQ ID NO: 125590

SEQ ID NO: 575726 - RNA, 64 nt, hsa; identical to SEQ ID NO: 125591

SEQ ID NO: 575727 - RNA, 64 nt, hsa; identical to SEQ ID NO: 125592

SEQ ID NO: 575728 - RNA, 64 nt, hsa; identical to SEQ ID NO: 125593

SEQ ID NO: 575729 - RNA, 64 nt, hsa; identical to SEQ ID NO: 125594

SEQ ID NO: 575730 - RNA, 64 nt, hsa; identical to SEQ ID NO: 125595

SEQ ID NO: 575731 - RNA, 64 nt, hsa; identical to SEQ ID NO: 125596

SEQ ID NO: 575732 - RNA, 64 nt, hsa; identical to SEQ ID NO: 125597

SEQ ID NO: 575733 - RNA, 64 nt, hsa; identical to SEQ ID NO: 125598

SEQ ID NO: 575734 - RNA, 64 nt, hsa; identical to SEQ ID NO: 125599

SEQ ID NO: 575735 - RNA, 64 nt, hsa; identical to SEQ ID NO: 125600

SEQ ID NO: 575736 - RNA, 64 nt, hsa; identical to SEQ ID NO: 125601

SEQ ID NO: 575737 - RNA, 64 nt, hsa; identical to SEQ ID NO: 125602

SEQ ID NO: 575738 - RNA, 64 nt, hsa; identical to SEQ ID NO: 125603

SEQ ID NO: 575739 - RNA, 64 nt, hsa; identical to SEQ ID NO: 125604

SEQ ID NO: 575740 - RNA, 64 nt, hsa; identical to SEQ ID NO: 125605

SEQ ID NO: 575741 - RNA, 64 nt, hsa; identical to SEQ ID NO: 125606

SEQ ID NO: 575742 - RNA, 64 nt, hsa; identical to SEQ ID NO: 125607

SEQ ID NO: 575743 - RNA, 64 nt, hsa; identical to SEQ ID NO: 125608

SEQ ID NO: 575744 - RNA, 64 nt, hsa; identical to SEQ ID NO: 125609

SEQ ID NO: 575745 - RNA, 64 nt, hsa; identical to SEQ ID NO: 125610

SEQ ID NO: 575746 - RNA, 64 nt, hsa; identical to SEQ ID NO: 125611

SEQ ID NO: 575747 - RNA, 64 nt, hsa; identical to SEQ ID NO: 125612

SEQ ID NO: 575748 - RNA, 64 nt, hsa; identical to SEQ ID NO: 125613

SEQ ID NO: 575749 - RNA, 64 nt, hsa; identical to SEQ ID NO: 125614

SEQ ID NO: 575750 - RNA, 64 nt, hsa; identical to SEQ ID NO: 125615

SEQ ID NO: 575751 - RNA, 64 nt, hsa; identical to SEQ ID NO: 125616

SEQ ID NO: 575752 - RNA, 64 nt, hsa; identical to SEQ ID NO: 125617

SEQ ID NO: 575753 - RNA, 64 nt, hsa; identical to SEQ ID NO: 125618

SEQ ID NO: 575754 - RNA, 64 nt, hsa; identical to SEQ ID NO: 125619

SEQ ID NO: 575755 - RNA, 64 nt, hsa; identical to SEQ ID NO: 125620

SEQ ID NO: 575756 - RNA, 64 nt, hsa; identical to SEQ ID NO: 125621

SEQ ID NO: 575757 - RNA, 64 nt, hsa; identical to SEQ ID NO: 125622

SEQ ID NO: 575758 - RNA, 64 nt, hsa; identical to SEQ ID NO: 125623

SEQ ID NO: 575759 - RNA, 64 nt, hsa; identical to SEQ ID NO: 125624

SEQ ID NO: 575760 - RNA, 64 nt, hsa; identical to SEQ ID NO: 125625

SEQ ID NO: 575761 - RNA, 64 nt, hsa; identical to SEQ ID NO: 125626

SEQ ID NO: 575762 - RNA, 64 nt, hsa; identical to SEQ ID NO: 125627

SEQ ID NO: 575763 - RNA, 64 nt, hsa; identical to SEQ ID NO: 125628

SEQ ID NO: 575764 - RNA, 64 nt, hsa; identical to SEQ ID NO: 125629

SEQ ID NO: 575765 - RNA, 64 nt, hsa; identical to SEQ ID NO: 125630

SEQ ID NO: 575766 - RNA, 64 nt, hsa; identical to SEQ ID NO: 125631

SEQ ID NO: 575767 - RNA, 64 nt, hsa; identical to SEQ ID NO: 125632

SEQ ID NO: 575768 - RNA, 64 nt, hsa; identical to SEQ ID NO: 125633

SEQ ID NO: 575769 - RNA, 64 nt, hsa; identical to SEQ ID NO: 125634

SEQ ID NO: 575770 - RNA, 64 nt, hsa; identical to SEQ ID NO: 125635

SEQ ID NO: 575771 - RNA, 64 nt, hsa; identical to SEQ ID NO: 125636

SEQ ID NO: 575772 - RNA, 64 nt, hsa; identical to SEQ ID NO: 125637

SEQ ID NO: 575773 - RNA, 64 nt, hsa; identical to SEQ ID NO: 125638

SEQ ID NO: 575774 - RNA, 64 nt, hsa; identical to SEQ ID NO: 125639

SEQ ID NO: 575775 - RNA, 64 nt, hsa; identical to SEQ ID NO: 125640

SEQ ID NO: 575776 - RNA, 64 nt, hsa; identical to SEQ ID NO: 125641

SEQ ID NO: 575777 - RNA, 64 nt, hsa; identical to SEQ ID NO: 125642

SEQ ID NO: 575778 - RNA, 64 nt, hsa; identical to SEQ ID NO: 462554

SEQ ID NO: 575779 - RNA, 64 nt, hsa; identical to SEQ ID NO: 462555

SEQ ID NO: 575780 - RNA, 64 nt, hsa; identical to SEQ ID NO: 462556

SEQ ID NO: 575781 - RNA, 64 nt, hsa; identical to SEQ ID NO: 462557

SEQ ID NO: 575782 - RNA, 55 nt, hsa; identical to SEQ ID NO: 462558

SEQ ID NO: 575783 - RNA, 64 nt, hsa; identical to SEQ ID NO: 462559

SEQ ID NO: 575784 - RNA, 64 nt, hsa; identical to SEQ ID NO: 462560

SEQ ID NO: 575785 - RNA, 64 nt, hsa; identical to SEQ ID NO: 462561

SEQ ID NO: 575786 - RNA, 64 nt, hsa; identical to SEQ ID NO: 462562

SEQ ID NO: 575787 - RNA, 64 nt, hsa; identical to SEQ ID NO: 462563

SEQ ID NO: 575788 - RNA, 64 nt, hsa; identical to SEQ ID NO: 462564

SEQ ID NO: 575789 - RNA, 64 nt, hsa; identical to SEQ ID NO: 462565

SEQ ID NO: 575790 - RNA, 64 nt, hsa; identical to SEQ ID NO: 462566

SEQ ID NO: 575791 - RNA, 64 nt, hsa; identical to SEQ ID NO: 462567

SEQ ID NO: 575792 - RNA, 64 nt, hsa; identical to SEQ ID NO: 462568

SEQ ID NO: 575793 - RNA, 64 nt, hsa; identical to SEQ ID NO: 462569

SEQ ID NO: 575794 - RNA, 64 nt, hsa; identical to SEQ ID NO: 462570

SEQ ID NO: 575795 - RNA, 64 nt, hsa; identical to SEQ ID NO: 462571

SEQ ID NO: 575796 - RNA, 64 nt, hsa; identical to SEQ ID NO: 462572

SEQ ID NO: 575797 - RNA, 64 nt, hsa; identical to SEQ ID NO: 462573

SEQ ID NO: 575798 - RNA, 64 nt, hsa; identical to SEQ ID NO: 462574

SEQ ID NO: 575799 - RNA, 64 nt, hsa; identical to SEQ ID NO: 462575

SEQ ID NO: 575800 - RNA, 64 nt, hsa; identical to SEQ ID NO: 462576

SEQ ID NO: 575801 - RNA, 64 nt, hsa; identical to SEQ ID NO: 462577

SEQ ID NO: 575802 - RNA, 64 nt, hsa; identical to SEQ ID NO: 462578

SEQ ID NO: 575803 - RNA, 64 nt, hsa; identical to SEQ ID NO: 462579

SEQ ID NO: 575804 - RNA, 64 nt, hsa; identical to SEQ ID NO: 462580

SEQ ID NO: 575805 - RNA, 64 nt, hsa; identical to SEQ ID NO: 462581

SEQ ID NO: 575806 - RNA, 64 nt, hsa; identical to SEQ ID NO: 462582

SEQ ID NO: 575807 - RNA, 64 nt, hsa; identical to SEQ ID NO: 462583

SEQ ID NO: 575808 - RNA, 64 nt, hsa; identical to SEQ ID NO: 462584

SEQ ID NO: 575809 - RNA, 64 nt, hsa; identical to SEQ ID NO: 462585

SEQ ID NO: 575810 - RNA, 64 nt, hsa; identical to SEQ ID NO: 462586

SEQ ID NO: 575811 - RNA, 64 nt, hsa; identical to SEQ ID NO: 462587

SEQ ID NO: 575812 - RNA, 64 nt, hsa; identical to SEQ ID NO: 462588

SEQ ID NO: 575813 - RNA, 64 nt, hsa; identical to SEQ ID NO: 462589

SEQ ID NO: 575814 - RNA, 64 nt, hsa; identical to SEQ ID NO: 462590

SEQ ID NO: 575815 - RNA, 64 nt, hsa; identical to SEQ ID NO: 462591

SEQ ID NO: 575816 - RNA, 64 nt, hsa; identical to SEQ ID NO: 462592

SEQ ID NO: 575817 - RNA, 64 nt, hsa; identical to SEQ ID NO: 462593

SEQ ID NO: 575818 - RNA, 64 nt, hsa; identical to SEQ ID NO: 462594

SEQ ID NO: 575819 - RNA, 64 nt, hsa; identical to SEQ ID NO: 462595

SEQ ID NO: 575820 - RNA, 64 nt, hsa; identical to SEQ ID NO: 462596

SEQ ID NO: 575821 - RNA, 64 nt, hsa; identical to SEQ ID NO: 462597

SEQ ID NO: 575822 - RNA, 64 nt, hsa; identical to SEQ ID NO: 462598

SEQ ID NO: 575823 - RNA, 64 nt, hsa; identical to SEQ ID NO: 462599

SEQ ID NO: 575824 - RNA, 64 nt, hsa; identical to SEQ ID NO: 462600

SEQ ID NO: 575825 - RNA, 64 nt, hsa; identical to SEQ ID NO: 462601

SEQ ID NO: 575826 - RNA, 64 nt, hsa; identical to SEQ ID NO: 462602

SEQ ID NO: 575827 - RNA, 64 nt, hsa; identical to SEQ ID NO: 462603

SEQ ID NO: 575828 - RNA, 64 nt, hsa; identical to SEQ ID NO: 462604

SEQ ID NO: 575829 - RNA, 51 nt, hsa; identical to SEQ ID NO: 462605

SEQ ID NO: 575830 - RNA, 64 nt, hsa; identical to SEQ ID NO: 462606

SEQ ID NO: 575831 - RNA, 64 nt, hsa; identical to SEQ ID NO: 462607

SEQ ID NO: 575832 - RNA, 64 nt, hsa; identical to SEQ ID NO: 462608

SEQ ID NO: 575833 - RNA, 64 nt, hsa; identical to SEQ ID NO: 462609

SEQ ID NO: 575834 - RNA, 64 nt, hsa
cuucuaccccuauguccaaauuuucagccaccacagaccucagcuguguauccuaucuguucua

SEQ ID NO: 575835 - RNA, 64 nt, hsa
ucuguccaucuuguuccuguggcuuagcacauacagaccucagaucuuacuugguagugagugc

SEQ ID NO: 575836 - RNA, 64 nt, hsa
cugggcggccagaugaaugggucccugggaacccagaccucagaugaggacuuaaugucuucuu

SEQ ID NO: 575837 - RNA, 64 nt, hsa
aggggcccaggggcagccgaagcacgggguccugagaccucaggcaggauuggagaucaaacca

SEQ ID NO: 575838 - RNA, 64 nt, hsa
cagucuucauccaaacaccuuucccuuugcccugagaccucagaaucuucccuuuaacccaaga

SEQ ID NO: 575839 - RNA, 64 nt, hsa
cccaggccugggaucugacaccaucaccaguaggagaccucaguguuuugggucuaggugagag

SEQ ID NO: 575840 - RNA, 64 nt, hsa
ccuuauaccuccuugauugaauaccagacagccuagaccucaguacaaaagguauugaaacauu

SEQ ID NO: 575841 - RNA, 64 nt, hsa
uacaaaagguauugaaacauuuuugauacauaacagaccucagucuuuuuuaaaaauuaauaua

SEQ ID NO: 575842 - RNA, 64 nt, hsa
uuuguagguaaagauuuauugaaaauggugauauagaccucagagcuguuaucuuaguuuaaag

SEQ ID NO: 575843 - RNA, 64 nt, hsa
uuuuuugaguugugcuuucacaaaaccuugucaaagaccucaugcaauaucacuuugaaaguua

SEQ ID NO: 575844 - RNA, 64 nt, hsa
acuuuccacuucuacuuacaguaauugcaagaggagaccucacauucaggacuggccuagugaa

SEQ ID NO: 575845 - RNA, 64 nt, hsa
auggaaaaccugggggauggucagagcccagucgagaccucacacacggcugucccucauggag

SEQ ID NO: 575846 - RNA, 64 nt, hsa
cagucgagaccucacacacggcugucccucauggagaccucaugccauggucuuugcuaggccu

SEQ ID NO: 575847 - RNA, 64 nt, hsa
ggcccaaaggaaagacggcuucccuggacaaagaagaccucagggcuacccaaggaaauaggag

SEQ ID NO: 575848 - RNA, 64 nt, hsa
caaggauuccuggccagcuccugccaccuccagcagaccucagggaggguugaguuucucuaag

SEQ ID NO: 575849 - RNA, 64 nt, hsa
gcaggggcaaguggcucuccccauuaccuucucaagaccucagugggagcaccagccaauggua

SEQ ID NO: 575850 - RNA, 64 nt, hsa
auuaaaaaggaagaaaccacagaaagaaaacuacagaccucaagauuccacucugugcccgccu

SEQ ID NO: 575851 - RNA, 64 nt, hsa
caguuguggaugucagugugcauaagcaaguaucagaccucagaauguuugaguuauuuugucu

SEQ ID NO: 575852 - RNA, 64 nt, hsa
ccaccacagcgucaggguggagaucuggguuucuagaccucacugaacacacuggaauggcuga

SEQ ID NO: 575853 - RNA, 64 nt, hsa
agcaaguuguucaauuuuaauuuucuucuuucucagaccucagucggaugaacauauuccagua

SEQ ID NO: 575854 - RNA, 64 nt, hsa
ggaugugauggagaaguuaucaacugguguuuucagaccucaguuggaugaacccauuccacug

SEQ ID NO: 575855 - RNA, 64 nt, hsa
ccaggaguucuagacaagccugggaaacauagcaagaucucauccuuacaaaaaauaauaaugg

SEQ ID NO: 575856 - RNA, 64 nt, hsa
ugagcuaccuggccccuccccaaauuuuaacaucagaucucaacauauuuguugagaacuuguu

SEQ ID NO: 575857 - RNA, 54 nt, hsa
uugauguggaaaaucucugaagucagaucucaauuuuuagaaaacucucugaau

SEQ ID NO: 575858 - RNA, 64 nt, hsa
auauuucuaauggaaaaucagguguuuacaggaaagaucucagaggcuaugagcucugaauaaa

SEQ ID NO: 575859 - RNA, 64 nt, hsa
caggucaacaccagagaucucagaucagaaucagagaucucagaggggaauaaguucauccuca

SEQ ID NO: 575860 - RNA, 64 nt, hsa
ccauccugucuggaauacaccaggucaacaccagagaucucagaucagaaucagagaucucaga

SEQ ID NO: 575861 - RNA, 64 nt, hsa
cuugaaccggggaggcagagguugcagugagccgagaucucaccacuguacuccagccugggcg

SEQ ID NO: 575862 - RNA, 64 nt, hsa
ggcacuguggguggcucacccuagauuguggcccagaucucaggagucucugccuucaggguca

SEQ ID NO: 575863 - RNA, 64 nt, hsa
uaggugcacaauaaaucuaguaauagccccacacagaucucaucauuguugcuacuuccuuuug

SEQ ID NO: 575864 - RNA, 64 nt, hsa
cauucuacuucacaguaauagcucuaucagccacagaucucaugguggcuguugcaugauaaug

SEQ ID NO: 575865 - RNA, 64 nt, hsa; identical to SEQ ID NO: 313152

SEQ ID NO: 575866 - RNA, 64 nt, hsa; identical to SEQ ID NO: 313153

SEQ ID NO: 575867 - RNA, 64 nt, hsa; identical to SEQ ID NO: 313154

SEQ ID NO: 575868 - RNA, 64 nt, hsa; identical to SEQ ID NO: 313155

SEQ ID NO: 575869 - RNA, 64 nt, hsa
acucguaucugaguguaacuuugccaauauuuuaaaagccaaaauauucucuggacaacaaauu

SEQ ID NO: 575870 - RNA, 64 nt, hsa
ucauuugcucaaagucacagagaaaauuaguggcaaagccaaaaagauucagaucuucugacuc

SEQ ID NO: 575871 - RNA, 64 nt, hsa
ugguuaucuucuggauacuaaaaaguuguauuacaaagccaaacacuugcauucacaacuuuaa

SEQ ID NO: 575872 - RNA, 64 nt, hsa
gugcuucuaggauauaaaauucacauuacuuuugaaagccaagaaguuggucuuauccaguuag

SEQ ID NO: 575873 - RNA, 64 nt, hsa
aaugaaugaauaaauaaauaaaugaauaaagacaaaagccaagguguaugcucucaaguuccaa

SEQ ID NO: 575874 - RNA, 64 nt, hsa
aaagggacaauuuggcugaagucuuucucugaaaaaagccaaaggguuauagggguacacuuag

SEQ ID NO: 575875 - RNA, 64 nt, hsa
gauggcgcugggagaagauguucagaauaucucaaaagccaaguccagaagguaaacuccaggg

SEQ ID NO: 575876 - RNA, 64 nt, hsa
accagggugacugcaccucgaauaaaggccagauaaagccaaacuugcuggguuacauuccuug

SEQ ID NO: 575877 - RNA, 64 nt, hsa
cuucuccccuaaacaacuucugccaaacaauaauaaagccaacuggaaacgaaucggagccauu

SEQ ID NO: 575878 - RNA, 64 nt, hsa
agcagacugcauguguugauacuuuuuuuuucuuaaagccaauuauuuugaugcaaaagaaauu

SEQ ID NO: 575879 - RNA, 64 nt, hsa
ugacuuuuaccacaaaucuucauuuauaaaagaaaaagccaaagugaaaaaaaguuagauugug

SEQ ID NO: 575880 - RNA, 64 nt, hsa
accaaaagacuaaaaucuuucaacgucaaugccaaaagccaaggggaauuuugcagugacagga

SEQ ID NO: 575881 - RNA, 64 nt, hsa
gcgggagugguauguggcccugaauaaaagaggaaaagccaaacgagggugcagcccccggguu

SEQ ID NO: 575882 - RNA, 64 nt, hsa
auuauauguauacaucaguauaguguuuuauuauaaagccaauuaucugauuaagcauucuuuc

SEQ ID NO: 575883 - RNA, 64 nt, hsa
gauuuuucuguuucacacacucuaaaauauaaguaaagccaaccuuuuuuuuaaggcugagauu

SEQ ID NO: 575884 - RNA, 64 nt, hsa
aaauuaaagcaacaauaauuuugaagcauuugaaaaagccaaaguguacgguagaaauuucuac

SEQ ID NO: 575885 - RNA, 64 nt, hsa
agaguggacuguucccugaggugggagauguggaaaagccaagaggcugcagccaggccacugg

SEQ ID NO: 575886 - RNA, 64 nt, hsa
ggauuacuaggugcccagaaugaggcugcuuuccaaagccaaugugaacagcggcuggacuugg

SEQ ID NO: 575887 - RNA, 64 nt, hsa
agggaggcacucaagaugaaaacuacuucaacuaaaagccaaccacuugaacaaggugagugaa

SEQ ID NO: 575888 - RNA, 64 nt, hsa
cacuauucucauugccaacguuaaaccuuauuuaaaagccaaacgugcccugagcccucuccuc

SEQ ID NO: 575889 - RNA, 64 nt, hsa
accuuaacuuuuaaaaaagggacugcugugggccaaagccaagcccaucugccaggacgaggua

SEQ ID NO: 575890 - RNA, 64 nt, hsa
caaaagcuuuucauuaucugaagacaaaaccgaaaaagccaaaauuaccauugcuuccuccagc

SEQ ID NO: 575891 - RNA, 64 nt, hsa
augaugauuccaugacucccaccuaugcagccuuaaagccaaauccgcguguguguguuugugu

SEQ ID NO: 575892 - RNA, 64 nt, hsa
cuucgaggcuggggcucuguaaugaauuaguuuaaaagccaaggucauaacaugaauugauggu

SEQ ID NO: 575893 - RNA, 64 nt, hsa
aggcauugagaaaggggaaaggcggguauuuuuaaaagccaaagauugacccaguuacuugagg

SEQ ID NO: 575894 - RNA, 64 nt, hsa
aauaacuucagaggaggugaagacaucuggccucaaagccaagaacuuucuagaagcgaaauaa

SEQ ID NO: 575895 - RNA, 64 nt, hsa
cuuuuucauguugacagauuuguagacaauuacaaaagccaaaaaaggauaaaauaagcauuag

SEQ ID NO: 575896 - RNA, 64 nt, hsa
ugucuuuuugggguuggacuaaauaugaaauccgaaagccaaaccagacucaccagaaauugcu

SEQ ID NO: 575897 - RNA, 64 nt, hsa; identical to SEQ ID NO: 561089

SEQ ID NO: 575898 - RNA, 64 nt, hsa; identical to SEQ ID NO: 561090

SEQ ID NO: 575899 - RNA, 64 nt, hsa; identical to SEQ ID NO: 561091

SEQ ID NO: 575900 - RNA, 64 nt, hsa; identical to SEQ ID NO: 561092

SEQ ID NO: 575901 - RNA, 64 nt, hsa; identical to SEQ ID NO: 561093

SEQ ID NO: 575902 - RNA, 64 nt, hsa; identical to SEQ ID NO: 561094

SEQ ID NO: 575903 - RNA, 64 nt, hsa; identical to SEQ ID NO: 561095

SEQ ID NO: 575904 - RNA, 64 nt, hsa; identical to SEQ ID NO: 561096

SEQ ID NO: 575905 - RNA, 64 nt, hsa; identical to SEQ ID NO: 561097

SEQ ID NO: 575906 - RNA, 64 nt, hsa; identical to SEQ ID NO: 561098

SEQ ID NO: 575907 - RNA, 64 nt, hsa; identical to SEQ ID NO: 561099

SEQ ID NO: 575908 - RNA, 64 nt, hsa; identical to SEQ ID NO: 561100

SEQ ID NO: 575909 - RNA, 64 nt, hsa; identical to SEQ ID NO: 561101

SEQ ID NO: 575910 - RNA, 64 nt, hsa; identical to SEQ ID NO: 561102

SEQ ID NO: 575911 - RNA, 64 nt, hsa; identical to SEQ ID NO: 561103

SEQ ID NO: 575912 - RNA, 64 nt, hsa; identical to SEQ ID NO: 561104

SEQ ID NO: 575913 - RNA, 64 nt, hsa; identical to SEQ ID NO: 561105

SEQ ID NO: 575914 - RNA, 64 nt, hsa; identical to SEQ ID NO: 561106

SEQ ID NO: 575915 - RNA, 64 nt, hsa; identical to SEQ ID NO: 561107

SEQ ID NO: 575916 - RNA, 64 nt, hsa; identical to SEQ ID NO: 561108

SEQ ID NO: 575917 - RNA, 64 nt, hsa; identical to SEQ ID NO: 561109

SEQ ID NO: 575918 - RNA, 64 nt, hsa; identical to SEQ ID NO: 561110

SEQ ID NO: 575919 - RNA, 64 nt, hsa; identical to SEQ ID NO: 561111

SEQ ID NO: 575920 - RNA, 64 nt, hsa; identical to SEQ ID NO: 561112

SEQ ID NO: 575921 - RNA, 64 nt, hsa; identical to SEQ ID NO: 561113

SEQ ID NO: 575922 - RNA, 64 nt, hsa; identical to SEQ ID NO: 561114

SEQ ID NO: 575923 - RNA, 64 nt, hsa; identical to SEQ ID NO: 561115

SEQ ID NO: 575924 - RNA, 64 nt, hsa; identical to SEQ ID NO: 561116

SEQ ID NO: 575925 - RNA, 64 nt, hsa; identical to SEQ ID NO: 561117

SEQ ID NO: 575926 - RNA, 64 nt, hsa; identical to SEQ ID NO: 561118

SEQ ID NO: 575927 - RNA, 64 nt, hsa; identical to SEQ ID NO: 561119

SEQ ID NO: 575928 - RNA, 64 nt, hsa; identical to SEQ ID NO: 561120

SEQ ID NO: 575929 - RNA, 64 nt, hsa; identical to SEQ ID NO: 561121

SEQ ID NO: 575930 - RNA, 64 nt, hsa; identical to SEQ ID NO: 561122

SEQ ID NO: 575931 - RNA, 64 nt, hsa; identical to SEQ ID NO: 561123

SEQ ID NO: 575932 - RNA, 64 nt, hsa; identical to SEQ ID NO: 561124

SEQ ID NO: 575933 - RNA, 64 nt, hsa; identical to SEQ ID NO: 561125

SEQ ID NO: 575934 - RNA, 64 nt, hsa; identical to SEQ ID NO: 561126

SEQ ID NO: 575935 - RNA, 64 nt, hsa; identical to SEQ ID NO: 561127

SEQ ID NO: 575936 - RNA, 64 nt, hsa; identical to SEQ ID NO: 561128

SEQ ID NO: 575937 - RNA, 64 nt, hsa; identical to SEQ ID NO: 561129

SEQ ID NO: 575938 - RNA, 64 nt, hsa; identical to SEQ ID NO: 561130

SEQ ID NO: 575939 - RNA, 64 nt, hsa; identical to SEQ ID NO: 561131

SEQ ID NO: 575940 - RNA, 64 nt, hsa; identical to SEQ ID NO: 561132

SEQ ID NO: 575941 - RNA, 64 nt, hsa; identical to SEQ ID NO: 561133

SEQ ID NO: 575942 - RNA, 64 nt, hsa; identical to SEQ ID NO: 561134

SEQ ID NO: 575943 - RNA, 64 nt, hsa; identical to SEQ ID NO: 561135

SEQ ID NO: 575944 - RNA, 64 nt, hsa; identical to SEQ ID NO: 561136

SEQ ID NO: 575945 - RNA, 64 nt, hsa; identical to SEQ ID NO: 561137

SEQ ID NO: 575946 - RNA, 64 nt, hsa; identical to SEQ ID NO: 561138

SEQ ID NO: 575947 - RNA, 64 nt, hsa; identical to SEQ ID NO: 561139

SEQ ID NO: 575948 - RNA, 64 nt, hsa; identical to SEQ ID NO: 561140

SEQ ID NO: 575949 - RNA, 64 nt, hsa; identical to SEQ ID NO: 561141

SEQ ID NO: 575950 - RNA, 64 nt, hsa; identical to SEQ ID NO: 561142

SEQ ID NO: 575951 - RNA, 64 nt, hsa; identical to SEQ ID NO: 561143

SEQ ID NO: 575952 - RNA, 64 nt, hsa; identical to SEQ ID NO: 561144

SEQ ID NO: 575953 - RNA, 64 nt, hsa; identical to SEQ ID NO: 561145

SEQ ID NO: 575954 - RNA, 64 nt, hsa; identical to SEQ ID NO: 561146

SEQ ID NO: 575955 - RNA, 64 nt, hsa; identical to SEQ ID NO: 561147

SEQ ID NO: 575956 - RNA, 64 nt, hsa; identical to SEQ ID NO: 561148

SEQ ID NO: 575957 - RNA, 64 nt, hsa; identical to SEQ ID NO: 561149

SEQ ID NO: 575958 - RNA, 64 nt, hsa; identical to SEQ ID NO: 561150

SEQ ID NO: 575959 - RNA, 64 nt, hsa; identical to SEQ ID NO: 561151

SEQ ID NO: 575960 - RNA, 64 nt, hsa; identical to SEQ ID NO: 561152

SEQ ID NO: 575961 - RNA, 64 nt, hsa; identical to SEQ ID NO: 561153

SEQ ID NO: 575962 - RNA, 64 nt, hsa; identical to SEQ ID NO: 561154

SEQ ID NO: 575963 - RNA, 64 nt, hsa; identical to SEQ ID NO: 561155

SEQ ID NO: 575964 - RNA, 64 nt, hsa; identical to SEQ ID NO: 561156

SEQ ID NO: 575965 - RNA, 64 nt, hsa; identical to SEQ ID NO: 561157

SEQ ID NO: 575966 - RNA, 64 nt, hsa; identical to SEQ ID NO: 561158

SEQ ID NO: 575967 - RNA, 64 nt, hsa; identical to SEQ ID NO: 561159

SEQ ID NO: 575968 - RNA, 64 nt, hsa; identical to SEQ ID NO: 561160

SEQ ID NO: 575969 - RNA, 64 nt, hsa; identical to SEQ ID NO: 561161

SEQ ID NO: 575970 - RNA, 64 nt, hsa; identical to SEQ ID NO: 561162

SEQ ID NO: 575971 - RNA, 64 nt, hsa; identical to SEQ ID NO: 561163

SEQ ID NO: 575972 - RNA, 64 nt, hsa; identical to SEQ ID NO: 561164

SEQ ID NO: 575973 - RNA, 64 nt, hsa; identical to SEQ ID NO: 561165

SEQ ID NO: 575974 - RNA, 64 nt, hsa; identical to SEQ ID NO: 561166

SEQ ID NO: 575975 - RNA, 64 nt, hsa; identical to SEQ ID NO: 561167

SEQ ID NO: 575976 - RNA, 64 nt, hsa; identical to SEQ ID NO: 561168

SEQ ID NO: 575977 - RNA, 64 nt, hsa; identical to SEQ ID NO: 561169

SEQ ID NO: 575978 - RNA, 64 nt, hsa; identical to SEQ ID NO: 561170

SEQ ID NO: 575979 - RNA, 64 nt, hsa; identical to SEQ ID NO: 561171

SEQ ID NO: 575980 - RNA, 64 nt, hsa; identical to SEQ ID NO: 561172

SEQ ID NO: 575981 - RNA, 64 nt, hsa; identical to SEQ ID NO: 561173

SEQ ID NO: 575982 - RNA, 64 nt, hsa; identical to SEQ ID NO: 561174

SEQ ID NO: 575983 - RNA, 64 nt, hsa; identical to SEQ ID NO: 561175

SEQ ID NO: 575984 - RNA, 64 nt, hsa; identical to SEQ ID NO: 561176

SEQ ID NO: 575985 - RNA, 64 nt, hsa; identical to SEQ ID NO: 561177

SEQ ID NO: 575986 - RNA, 64 nt, hsa; identical to SEQ ID NO: 561178

SEQ ID NO: 575987 - RNA, 64 nt, hsa; identical to SEQ ID NO: 561179

SEQ ID NO: 575988 - RNA, 64 nt, hsa; identical to SEQ ID NO: 561180

SEQ ID NO: 575989 - RNA, 64 nt, hsa; identical to SEQ ID NO: 561181

SEQ ID NO: 575990 - RNA, 64 nt, hsa; identical to SEQ ID NO: 561182

SEQ ID NO: 575991 - RNA, 64 nt, hsa; identical to SEQ ID NO: 561183

SEQ ID NO: 575992 - RNA, 64 nt, hsa; identical to SEQ ID NO: 561184

SEQ ID NO: 575993 - RNA, 64 nt, hsa; identical to SEQ ID NO: 561185

SEQ ID NO: 575994 - RNA, 64 nt, hsa; identical to SEQ ID NO: 561186

SEQ ID NO: 575995 - RNA, 64 nt, hsa; identical to SEQ ID NO: 561187

SEQ ID NO: 575996 - RNA, 64 nt, hsa; identical to SEQ ID NO: 561188

SEQ ID NO: 575997 - RNA, 64 nt, hsa; identical to SEQ ID NO: 561189

SEQ ID NO: 575998 - RNA, 64 nt, hsa; identical to SEQ ID NO: 561190

SEQ ID NO: 575999 - RNA, 64 nt, hsa; identical to SEQ ID NO: 561191

SEQ ID NO: 576000 - RNA, 64 nt, hsa; identical to SEQ ID NO: 561192

SEQ ID NO: 576001 - RNA, 64 nt, hsa; identical to SEQ ID NO: 561193

SEQ ID NO: 576002 - RNA, 64 nt, hsa; identical to SEQ ID NO: 561194

SEQ ID NO: 576003 - RNA, 64 nt, hsa; identical to SEQ ID NO: 561195

SEQ ID NO: 576004 - RNA, 64 nt, hsa; identical to SEQ ID NO: 561196

SEQ ID NO: 576005 - RNA, 64 nt, hsa; identical to SEQ ID NO: 561197

SEQ ID NO: 576006 - RNA, 64 nt, hsa; identical to SEQ ID NO: 561198

SEQ ID NO: 576007 - RNA, 64 nt, hsa; identical to SEQ ID NO: 561199

SEQ ID NO: 576008 - RNA, 64 nt, hsa
caaaccuucagaacauucaaaccguuuauguuucucaucuaaucaaauagaguuacucucuaag

SEQ ID NO: 576009 - RNA, 64 nt, hsa
aucuuagcuuccuugcuuacaauuguucagugggucaucuaaauucuucuauguccugagcaug

SEQ ID NO: 576010 - RNA, 64 nt, hsa
cucuagauuuugaaaccaaaaaacugaacugaaaucaucuaaagaguuaaaauuucagugaucu

SEQ ID NO: 576011 - RNA, 64 nt, hsa
agucuugcgucucauccuuuaugauguugagaaaucaucuaauuucucagaacuuuuucuuauc

SEQ ID NO: 576012 - RNA, 64 nt, hsa
gggaaaucaugcaacuacucagaauguguccuccucaucuaaugcucaucuguuuaauggugau

SEQ ID NO: 576013 - RNA, 56 nt, hsa
caugcuuugcccuggaguaaccugaaucaucuaaaaaacacggucucaaccuggcc

SEQ ID NO: 576014 - RNA, 64 nt, hsa
agggagacaggugcagaugaggugaagaucacugucaucuaaaagcaggccaccaaauuuaaaa

SEQ ID NO: 576015 - RNA, 64 nt, hsa
uacugagcucaggagagcaagaugaagguaacaaucaucuaaaagccagccacugucagcaaag

SEQ ID NO: 576016 - RNA, 64 nt, hsa
ccaauccucccuaacaauucguuguguggacuucucaucuaaaagguuaguggcuuuugcuugg

SEQ ID NO: 576017 - RNA, 64 nt, hsa
acuucuugcauguugaagauauuugagcuauuuuucaucuaaaagaguaagguauuaggcccuu

SEQ ID NO: 576018 - RNA, 64 nt, hsa; identical to SEQ ID NO: 56858

SEQ ID NO: 576019 - RNA, 64 nt, hsa; identical to SEQ ID NO: 56859

SEQ ID NO: 576020 - RNA, 64 nt, hsa; identical to SEQ ID NO: 56860

SEQ ID NO: 576021 - RNA, 64 nt, hsa; identical to SEQ ID NO: 56861

SEQ ID NO: 576022 - RNA, 64 nt, hsa; identical to SEQ ID NO: 56862

SEQ ID NO: 576023 - RNA, 64 nt, hsa; identical to SEQ ID NO: 56863

SEQ ID NO: 576024 - RNA, 64 nt, hsa; identical to SEQ ID NO: 56864

SEQ ID NO: 576025 - RNA, 64 nt, hsa; identical to SEQ ID NO: 56865

SEQ ID NO: 576026 - RNA, 64 nt, hsa; identical to SEQ ID NO: 56866

SEQ ID NO: 576027 - RNA, 64 nt, hsa; identical to SEQ ID NO: 56867

SEQ ID NO: 576028 - RNA, 64 nt, hsa; identical to SEQ ID NO: 56868

SEQ ID NO: 576029 - RNA, 64 nt, hsa; identical to SEQ ID NO: 56869

SEQ ID NO: 576030 - RNA, 64 nt, hsa; identical to SEQ ID NO: 56870

SEQ ID NO: 576031 - RNA, 64 nt, hsa; identical to SEQ ID NO: 56871

SEQ ID NO: 576032 - RNA, 64 nt, hsa; identical to SEQ ID NO: 56872

SEQ ID NO: 576033 - RNA, 64 nt, hsa; identical to SEQ ID NO: 56873

SEQ ID NO: 576034 - RNA, 64 nt, hsa; identical to SEQ ID NO: 56874

SEQ ID NO: 576035 - RNA, 64 nt, hsa; identical to SEQ ID NO: 56875

SEQ ID NO: 576036 - RNA, 64 nt, hsa; identical to SEQ ID NO: 56876

SEQ ID NO: 576037 - RNA, 64 nt, hsa; identical to SEQ ID NO: 56877

SEQ ID NO: 576038 - RNA, 64 nt, hsa; identical to SEQ ID NO: 56878

SEQ ID NO: 576039 - RNA, 64 nt, hsa; identical to SEQ ID NO: 56879

SEQ ID NO: 576040 - RNA, 64 nt, hsa; identical to SEQ ID NO: 56880

SEQ ID NO: 576041 - RNA, 64 nt, hsa; identical to SEQ ID NO: 56881

SEQ ID NO: 576042 - RNA, 64 nt, hsa; identical to SEQ ID NO: 242974

SEQ ID NO: 576043 - RNA, 64 nt, hsa; identical to SEQ ID NO: 242975

SEQ ID NO: 576044 - RNA, 64 nt, hsa; identical to SEQ ID NO: 242976

SEQ ID NO: 576045 - RNA, 64 nt, hsa; identical to SEQ ID NO: 242977

SEQ ID NO: 576046 - RNA, 64 nt, hsa; identical to SEQ ID NO: 242978

SEQ ID NO: 576047 - RNA, 64 nt, hsa; identical to SEQ ID NO: 242979

SEQ ID NO: 576048 - RNA, 64 nt, hsa; identical to SEQ ID NO: 242980

SEQ ID NO: 576049 - RNA, 64 nt, hsa; identical to SEQ ID NO: 242981

SEQ ID NO: 576050 - RNA, 64 nt, hsa; identical to SEQ ID NO: 242982

SEQ ID NO: 576051 - RNA, 64 nt, hsa; identical to SEQ ID NO: 242983

SEQ ID NO: 576052 - RNA, 64 nt, hsa; identical to SEQ ID NO: 242984

SEQ ID NO: 576053 - RNA, 64 nt, hsa; identical to SEQ ID NO: 242985

SEQ ID NO: 576054 - RNA, 64 nt, hsa; identical to SEQ ID NO: 53697

SEQ ID NO: 576055 - RNA, 64 nt, hsa; identical to SEQ ID NO: 53698

SEQ ID NO: 576056 - RNA, 64 nt, hsa; identical to SEQ ID NO: 53699

SEQ ID NO: 576057 - RNA, 64 nt, hsa; identical to SEQ ID NO: 53700

SEQ ID NO: 576058 - RNA, 64 nt, hsa; identical to SEQ ID NO: 53701

SEQ ID NO: 576059 - RNA, 64 nt, hsa; identical to SEQ ID NO: 53702

SEQ ID NO: 576060 - RNA, 64 nt, hsa
cuugguuucacacucagcuacaugugaccuccagcuuggugagguugccugaagauuagggaaa

SEQ ID NO: 576061 - RNA, 64 nt, hsa
aucugcuuacccacuucauuauuugacagcuuuccuuggugacccaaaccuuguagccuaagcc

SEQ ID NO: 576062 - RNA, 64 nt, hsa
cuuccuaagaugugcuugcauuuuaaaaagggagcuuggugagagcuuugcuaauucacaggua

SEQ ID NO: 576063 - RNA, 64 nt, hsa
agcaggugcugccugugacucugaacagcaggaccuuggugacuggauucaacuugcuugggag

SEQ ID NO: 576064 - RNA, 64 nt, hsa
ucagaaaacacuuauuuuguuucuuaaguuaugacuuggugagucagggugccuguaggaagug

SEQ ID NO: 576065 - RNA, 64 nt, hsa
aaaagaacacuccuuucugagacuuugcuuaauacuuggugaccucacaaucacgucgguauga

SEQ ID NO: 576066 - RNA, 64 nt, hsa
gugacguagaccauuuuugaaaccgucucauggucuuggugacguagaccguuugcuucuuuaa

SEQ ID NO: 576067 - RNA, 64 nt, hsa
aggccaagccuauugugugaaaccaucucauggucuuggugacguagaccauuuuugaaaccgu

SEQ ID NO: 576068 - RNA, 64 nt, hsa
ugcuacuguuuuccaagugaaugggucucaaagacuuggugaccccagccucaucuucuaggcc

SEQ ID NO: 576069 - RNA, 64 nt, hsa
ggacccuguccagcacagcuucuggcacaggaugcuuggugaauguacccuuucuuucccuccc

SEQ ID NO: 576070 - RNA, 64 nt, hsa
acucaccauuucuauuaauuucuguugguaagaacuuggugagaaugccccguggaagauacac

SEQ ID NO: 576071 - RNA, 64 nt, hsa
uaaaagcauauuuuggguacauuuguuucaaaaccuuggugaugcauuacaacuuguuuucuua

SEQ ID NO: 576072 - RNA, 64 nt, hsa
aucuggcuauuaguauuuuacaggaaccauaguucuuggugacuacauauauauauauauuuuu

SEQ ID NO: 576073 - RNA, 64 nt, hsa
uauccagucgucaucucauucaaguauggcuuuacuuggugacacuggccauagcuaaguuaac

SEQ ID NO: 576074 - RNA, 64 nt, hsa
ucuccuguugacccugguuuagagccguuaaccacuuggugaguuauguggguguuguugcccu

SEQ ID NO: 576075 - RNA, 64 nt, hsa
cuugaggccaggaguucaagaccacccugaccaacuuggugaaaucccaucucuacuaaaaaua

SEQ ID NO: 576076 - RNA, 64 nt, hsa
uuaacucuucaauauaagcuaugaaguaauaguugguugugaauuaaaguggcaccagcuagca

SEQ ID NO: 576077 - RNA, 64 nt, hsa
agcuuagggggagggugggaaaguuugggggggggguugugaagauuuagggggaccuugauag

SEQ ID NO: 576078 - RNA, 64 nt, hsa
gacuagcagccaaauaacugccuaggauacugaugguugugaagacuguuucaaaugauuggau

SEQ ID NO: 576079 - RNA, 64 nt, hsa
uuaucccacucaaucaaaggaacucugggaaggagguugugauugcuggcaagucccccccaac

SEQ ID NO: 576080 - RNA, 64 nt, hsa; identical to SEQ ID NO: 480710

SEQ ID NO: 576081 - RNA, 64 nt, hsa; identical to SEQ ID NO: 480711

SEQ ID NO: 576082 - RNA, 64 nt, hsa; identical to SEQ ID NO: 480712

SEQ ID NO: 576083 - RNA, 64 nt, hsa; identical to SEQ ID NO: 480713

SEQ ID NO: 576084 - RNA, 64 nt, hsa; identical to SEQ ID NO: 480714

SEQ ID NO: 576085 - RNA, 64 nt, hsa; identical to SEQ ID NO: 480715

SEQ ID NO: 576086 - RNA, 64 nt, hsa; identical to SEQ ID NO: 480716

SEQ ID NO: 576087 - RNA, 64 nt, hsa; identical to SEQ ID NO: 480717

SEQ ID NO: 576088 - RNA, 64 nt, hsa; identical to SEQ ID NO: 480718

SEQ ID NO: 576089 - RNA, 64 nt, hsa; identical to SEQ ID NO: 480719

SEQ ID NO: 576090 - RNA, 64 nt, hsa; identical to SEQ ID NO: 480720

SEQ ID NO: 576091 - RNA, 64 nt, hsa; identical to SEQ ID NO: 480721

SEQ ID NO: 576092 - RNA, 64 nt, hsa; identical to SEQ ID NO: 480722

SEQ ID NO: 576093 - RNA, 64 nt, hsa; identical to SEQ ID NO: 480723

SEQ ID NO: 576094 - RNA, 64 nt, hsa; identical to SEQ ID NO: 84166

SEQ ID NO: 576095 - RNA, 64 nt, hsa; identical to SEQ ID NO: 84167

SEQ ID NO: 576096 - RNA, 64 nt, hsa; identical to SEQ ID NO: 84168

SEQ ID NO: 576097 - RNA, 64 nt, hsa; identical to SEQ ID NO: 84169

SEQ ID NO: 576098 - RNA, 64 nt, hsa; identical to SEQ ID NO: 84170

SEQ ID NO: 576099 - RNA, 64 nt, hsa; identical to SEQ ID NO: 84171

SEQ ID NO: 576100 - RNA, 64 nt, hsa; identical to SEQ ID NO: 84172

SEQ ID NO: 576101 - RNA, 64 nt, hsa; identical to SEQ ID NO: 84173

SEQ ID NO: 576102 - RNA, 64 nt, hsa; identical to SEQ ID NO: 84174

SEQ ID NO: 576103 - RNA, 64 nt, hsa; identical to SEQ ID NO: 84175

SEQ ID NO: 576104 - RNA, 64 nt, hsa; identical to SEQ ID NO: 84176

SEQ ID NO: 576105 - RNA, 64 nt, hsa; identical to SEQ ID NO: 84177

SEQ ID NO: 576106 - RNA, 64 nt, hsa; identical to SEQ ID NO: 84178

SEQ ID NO: 576107 - RNA, 64 nt, hsa; identical to SEQ ID NO: 84179

SEQ ID NO: 576108 - RNA, 64 nt, hsa; identical to SEQ ID NO: 84180

SEQ ID NO: 576109 - RNA, 64 nt, hsa; identical to SEQ ID NO: 84181

SEQ ID NO: 576110 - RNA, 64 nt, hsa; identical to SEQ ID NO: 84182

SEQ ID NO: 576111 - RNA, 64 nt, hsa; identical to SEQ ID NO: 84183

SEQ ID NO: 576112 - RNA, 64 nt, hsa; identical to SEQ ID NO: 84184

SEQ ID NO: 576113 - RNA, 64 nt, hsa; identical to SEQ ID NO: 84185

SEQ ID NO: 576114 - RNA, 64 nt, hsa; identical to SEQ ID NO: 84186

SEQ ID NO: 576115 - RNA, 64 nt, hsa; identical to SEQ ID NO: 84187

SEQ ID NO: 576116 - RNA, 64 nt, hsa; identical to SEQ ID NO: 84188

SEQ ID NO: 576117 - RNA, 64 nt, hsa; identical to SEQ ID NO: 84189

SEQ ID NO: 576118 - RNA, 64 nt, hsa; identical to SEQ ID NO: 84190

SEQ ID NO: 576119 - RNA, 64 nt, hsa; identical to SEQ ID NO: 84191

SEQ ID NO: 576120 - RNA, 64 nt, hsa; identical to SEQ ID NO: 84192

SEQ ID NO: 576121 - RNA, 64 nt, hsa; identical to SEQ ID NO: 84193

SEQ ID NO: 576122 - RNA, 64 nt, hsa; identical to SEQ ID NO: 84194

SEQ ID NO: 576123 - RNA, 64 nt, hsa; identical to SEQ ID NO: 84195

SEQ ID NO: 576124 - RNA, 64 nt, hsa; identical to SEQ ID NO: 84196

SEQ ID NO: 576125 - RNA, 64 nt, hsa; identical to SEQ ID NO: 84197

SEQ ID NO: 576126 - RNA, 64 nt, hsa; identical to SEQ ID NO: 84198

SEQ ID NO: 576127 - RNA, 64 nt, hsa; identical to SEQ ID NO: 84199

SEQ ID NO: 576128 - RNA, 64 nt, hsa; identical to SEQ ID NO: 84200

SEQ ID NO: 576129 - RNA, 64 nt, hsa; identical to SEQ ID NO: 84201

SEQ ID NO: 576130 - RNA, 64 nt, hsa; identical to SEQ ID NO: 84202

SEQ ID NO: 576131 - RNA, 64 nt, hsa; identical to SEQ ID NO: 84203

SEQ ID NO: 576132 - RNA, 64 nt, hsa; identical to SEQ ID NO: 84204

SEQ ID NO: 576133 - RNA, 64 nt, hsa; identical to SEQ ID NO: 84205

SEQ ID NO: 576134 - RNA, 64 nt, hsa; identical to SEQ ID NO: 84206

SEQ ID NO: 576135 - RNA, 64 nt, hsa; identical to SEQ ID NO: 84207

SEQ ID NO: 576136 - RNA, 64 nt, hsa; identical to SEQ ID NO: 84208

SEQ ID NO: 576137 - RNA, 64 nt, hsa; identical to SEQ ID NO: 84209

SEQ ID NO: 576138 - RNA, 64 nt, hsa; identical to SEQ ID NO: 84210

SEQ ID NO: 576139 - RNA, 64 nt, hsa; identical to SEQ ID NO: 84211

SEQ ID NO: 576140 - RNA, 64 nt, hsa; identical to SEQ ID NO: 84212

SEQ ID NO: 576141 - RNA, 64 nt, hsa; identical to SEQ ID NO: 84213

SEQ ID NO: 576142 - RNA, 64 nt, hsa; identical to SEQ ID NO: 84214

SEQ ID NO: 576143 - RNA, 64 nt, hsa; identical to SEQ ID NO: 84215

SEQ ID NO: 576144 - RNA, 64 nt, hsa; identical to SEQ ID NO: 84216

SEQ ID NO: 576145 - RNA, 64 nt, hsa; identical to SEQ ID NO: 84217

SEQ ID NO: 576146 - RNA, 64 nt, hsa; identical to SEQ ID NO: 84218

SEQ ID NO: 576147 - RNA, 64 nt, hsa; identical to SEQ ID NO: 84219

SEQ ID NO: 576148 - RNA, 64 nt, hsa; identical to SEQ ID NO: 84220

SEQ ID NO: 576149 - RNA, 64 nt, hsa; identical to SEQ ID NO: 84221

SEQ ID NO: 576150 - RNA, 64 nt, hsa; identical to SEQ ID NO: 84222

SEQ ID NO: 576151 - RNA, 64 nt, hsa; identical to SEQ ID NO: 84223

SEQ ID NO: 576152 - RNA, 64 nt, hsa; identical to SEQ ID NO: 84224

SEQ ID NO: 576153 - RNA, 64 nt, hsa; identical to SEQ ID NO: 84225

SEQ ID NO: 576154 - RNA, 64 nt, hsa; identical to SEQ ID NO: 84226

SEQ ID NO: 576155 - RNA, 64 nt, hsa; identical to SEQ ID NO: 84227

SEQ ID NO: 576156 - RNA, 64 nt, hsa; identical to SEQ ID NO: 84228

SEQ ID NO: 576157 - RNA, 64 nt, hsa; identical to SEQ ID NO: 84229

SEQ ID NO: 576158 - RNA, 64 nt, hsa; identical to SEQ ID NO: 84230

SEQ ID NO: 576159 - RNA, 64 nt, hsa; identical to SEQ ID NO: 84231

SEQ ID NO: 576160 - RNA, 64 nt, hsa; identical to SEQ ID NO: 84232

SEQ ID NO: 576161 - RNA, 64 nt, hsa; identical to SEQ ID NO: 84233

SEQ ID NO: 576162 - RNA, 64 nt, hsa
aaaugcugggacuuuucaugaacuuugucuuaaguguugacaugaaucauucuaaaaggcuaaa

SEQ ID NO: 576163 - RNA, 64 nt, hsa
aaaaaaacaaaaaaaaagcaauagauagagaaauuguugacaauuucuguagucuuuccuaguu

SEQ ID NO: 576164 - RNA, 64 nt, hsa
aaucaacuggcuuuuuuuaaaaaagguagcauuuuguugacaguuauuuuguaaacauaagcaa

SEQ ID NO: 576165 - RNA, 64 nt, hsa
uauguguguuaaauauauugaguuuggauuaaaauguugacaugauuucacauuugaaaauaaa

SEQ ID NO: 576166 - RNA, 64 nt, hsa
gauuaucgaccaugguaugcaugaucguuguaauuguugacauuccuuuuagaaguugugaaau

SEQ ID NO: 576167 - RNA, 64 nt, hsa
auuucauaaauuaaacauuuaugccucccuuuuguguugacacuguagcucauacuggaaaagu

SEQ ID NO: 576168 - RNA, 64 nt, hsa
ugccauuaucccagacagcaucagcagaugcaccuguugacagccugcuaggugaugguuuaug

SEQ ID NO: 576169 - RNA, 64 nt, hsa
ucuuuucugguuaauaucuugaguaauuuuaaaauguugacaccuuaaucggucccagguauga

SEQ ID NO: 576170 - RNA, 64 nt, hsa
cauuuguuccuuguaagaauggcuggaaacuguguguugacauuugaggauggguaugcaagga

SEQ ID NO: 576171 - RNA, 64 nt, hsa
ucaagguugauacguagcuuuaauacagcucuucuguugacaguuauuacuuuaauuuugcauu

SEQ ID NO: 576172 - RNA, 64 nt, hsa
gaaaacaugaauucugugauggaugacaacagguuguugacauuggccaacggggaacgcaucc

SEQ ID NO: 576173 - RNA, 64 nt, hsa
acgaauauaucaaacgccuugcuucuuugucuacuguugacacagaaggaguuugggccaaccc

SEQ ID NO: 576174 - RNA, 64 nt, hsa
uguaggcaggacugugauaacagugcaagcucuguguugacaagaguuguggacaaaaagccaa

SEQ ID NO: 576175 - RNA, 64 nt, hsa
gcguaguuggagucugucccugucuugguguuaauguugacauuguuauauaauaaaugauaau

SEQ ID NO: 576176 - RNA, 64 nt, hsa
agcuuaaaauacaagacugccauauuaaauuuuuuguugacauuagucucagugaagacuauga

SEQ ID NO: 576177 - RNA, 64 nt, hsa
aauugcaaaaaaaaaaaaaaaguugcagcuguuuuguugacauucugaaugcuucuaaguaaau

SEQ ID NO: 576178 - RNA, 64 nt, hsa
ucccugaggguuuacugugaagugcugaggacaguguugacaacuaacucguuuuccuagaugg

SEQ ID NO: 576179 - RNA, 64 nt, hsa
aaauuaaguuaccacagacucuguaguguguaaauguugacaaggaauuggaucacaaucaugu

SEQ ID NO: 576180 - RNA, 64 nt, hsa
accacauucaccuuguaaaugacuguauaaaacuuguugacaaugcacugacuuuagaaagaug

SEQ ID NO: 576181 - RNA, 64 nt, hsa
gcuaccuccuuuuuccugaaguuuuauuccauucuguugacaagauggagaaagcaagaucaug

SEQ ID NO: 576182 - RNA, 64 nt, hsa
ccgacagcucccuggguguccggggugggagagcuguugacagaagcucuccgggcccucaggg

SEQ ID NO: 576183 - RNA, 64 nt, hsa
agggucugagccaagccccucgacucccucacuguguugacacuuggcacuuugcuggccccga

SEQ ID NO: 576184 - RNA, 64 nt, hsa
uccucggcuccaugugccagaggcuccgguccaugcaguacaauggcagcuacuucgacagagg

SEQ ID NO: 576185 - RNA, 64 nt, hsa
acuacauaacugauuuuuaguugacuuagcuauagcaguacaaugauuaguaauguaaaaauua

SEQ ID NO: 576186 - RNA, 64 nt, hsa
aggaaauagaauguaaaacaucacaaaaaaaauugcaguacauaaaauuucuggacuauguuag

SEQ ID NO: 576187 - RNA, 64 nt, hsa
uuccugggaaucaagguaacucacacgacuacuugcaguacaaauuuuuugcuucucuuucgac

SEQ ID NO: 576188 - RNA, 64 nt, hsa
caauucagcuugaaaaauaaucucacuacauguagcaguacauuauauguacauuauauguaau

SEQ ID NO: 576189 - RNA, 64 nt, hsa
cuuuaugcuggacccaguaagaugaggaagucgggcaguacacaggaagaggagccaggcccuu

SEQ ID NO: 576190 - RNA, 64 nt, hsa
uaaucagaaaaaaaacuuauuucuuaaucaaaaggcaguacaaaaaaaguaauaauguuuuaua

SEQ ID NO: 576191 - RNA, 64 nt, hsa
aauaaucccaaagacacugacaacucaaggaacagcaguacaguacuauuagaaguuaaguaug

SEQ ID NO: 576192 - RNA, 64 nt, hsa
acuucucguugcugcucuguggcacauaucggaagcaguacagcgcgcggcucuacacgcuugg

SEQ ID NO: 576193 - RNA, 64 nt, hsa
uuaaucauagcuacauaccuauuuuuuauaaguagcaguacacauucaaagggguauuccuagc

SEQ ID NO: 576194 - RNA, 64 nt, hsa
ugggacucccagugaacuuacacuuggagcccgugcaguacaggcaaaacacgcaagggcauca

SEQ ID NO: 576195 - RNA, 64 nt, hsa
guauccucuggcgcgaaugcucucuguuggcucugcaguacaauauguaaccaauaaagcuccc

SEQ ID NO: 576196 - RNA, 64 nt, hsa
ggccaccagaagacacuuccaucccucgggcccagcaguacacacuugguuuccagagcuccca

SEQ ID NO: 576197 - RNA, 64 nt, hsa
uacucuuuuuugauuagcuacauuaccuugugaagcaguacacauuguccuuuuuuuaagacgu

SEQ ID NO: 576198 - RNA, 64 nt, hsa
uuuuguugguuaacuguguucacucaguaaaagagcaguacauguaagcagccauuaauaaacu

SEQ ID NO: 576199 - RNA, 64 nt, hsa
ugggaguguauuaacuggagggaagaugggucuugcaguacauuuguuuugcccagccaucacu

SEQ ID NO: 576200 - RNA, 64 nt, hsa
cuucauuucuaguacacgcccuauuuaaaaaagagcaguacauccugggaggaaaugaaacuaa

SEQ ID NO: 576201 - RNA, 64 nt, hsa
uguggaaugaugugaauuggcccuguuuacagaggcaguacaacugaauguuauuuuacaucca

SEQ ID NO: 576202 - RNA, 64 nt, hsa
caagaauuugggaaacacagauggccugagauaagcaguacaaguagguuuuugagacaaucac

SEQ ID NO: 576203 - RNA, 64 nt, hsa
ugauccuuuaauauuauccaugcuuuuauaaagugcaguacacauuuugacauugccacaguuu

SEQ ID NO: 576204 - RNA, 64 nt, hsa
agaguggugcgaggaguacauuuucagagcaggugcaguacaucuuccggcucuaugaaucauu

SEQ ID NO: 576205 - RNA, 64 nt, hsa
agcuccuaaagugaccuuccgggugggaagggcagcaguacacaugaccccauccuuuucuuug

SEQ ID NO: 576206 - RNA, 64 nt, hsa
gaugguaaauacugucccacucagcucugcuggcgcaguacagcagcagcagccccagcacagc

SEQ ID NO: 576207 - RNA, 64 nt, hsa
aaucauggccuugcauuaaaauauggaaagcagagcaguacauauucaaauguauucagaaagu

SEQ ID NO: 576208 - RNA, 64 nt, hsa
ugauuaaucagccuaugugccugacacuggucuugcaguacaacuggaagccaaaacaaggugg

SEQ ID NO: 576209 - RNA, 64 nt, hsa
agcuguaguauggagauuaauagacuggaucuuugcaguacaacaccucuaugcacuucuuucu

SEQ ID NO: 576210 - RNA, 60 nt, hsa
cacagcccucaggaaguugauuaaaaaccugcaguacaacaguuuuagauacucauuagu

SEQ ID NO: 576211 - RNA, 64 nt, hsa
cugcugauucgggcuguggccuccacguauuuaugcaguacagucugccugacgccagcccugc

SEQ ID NO: 576212 - RNA, 64 nt, hsa
gcgugcuagaggugucacgcuccauuggggacgggcaguacaagcgcugcggugucaccucugu

SEQ ID NO: 576213 - RNA, 57 nt, hsa
gucacagggaaggauucuaaaagguaugcaguacagcaguauagaauccaugccaau

SEQ ID NO: 576214 - RNA, 64 nt, hsa
uucaauucugaaguuauaccuagugauguuuuuugcaguacauuugaauggauuguagacacug

SEQ ID NO: 576215 - RNA, 64 nt, hsa
agacucacugaggaauacaagccaagcugaugaggcaguacaggggagaggcuggaaaacauau

SEQ ID NO: 576216 - RNA, 64 nt, hsa
aaaaucauaaauuucccucaaaauagacuguguugcaguacacaaguugccauaauaguauaaa

SEQ ID NO: 576217 - RNA, 64 nt, hsa
ggguugauauuaacaaaggaauguacuuagaauagcaguacauuuuaugcaaauauggaaauua

SEQ ID NO: 576218 - RNA, 64 nt, hsa
uggccucuaguuuauauaauuauuuaccucuuuggcaguacagauaacaaaauacacuuuacug

SEQ ID NO: 576219 - RNA, 64 nt, hsa
uuugaauugguuucuacacauuuccaguaguauggcaguacagugcucuguucauugcaagcug

SEQ ID NO: 576220 - RNA, 64 nt, hsa
caggguauguccuaacauggaguuaacuggaauagcaguacacuagcaaguaucugugaauccu

SEQ ID NO: 576221 - RNA, 64 nt, hsa
aacuuguaaacuucaucuauuucaaauauuuuaugcaguacauuauauuauucuguacaaaggc

SEQ ID NO: 576222 - RNA, 64 nt, hsa
uuguaugaaaauuccugugauuuuuuuuaaaugugcaguacacaucagccucacugagcuaaua

SEQ ID NO: 576223 - RNA, 64 nt, hsa
gugaacaauaaagauaaaaguccuuguccucacagcaguacauucuauuguucaucauauuuga

SEQ ID NO: 576224 - RNA, 64 nt, hsa
uauauugguggcaucagucaacaguguaugucaugcaguacagacauagcaagccuuguccuga

SEQ ID NO: 576225 - RNA, 64 nt, hsa
gagaacaggcaagacagaacuuugucacuucagugcaguacauuuuucugaaagcuacccauaa

SEQ ID NO: 576226 - RNA, 64 nt, hsa
uguuccugccccaagccgucaaucagauuguggagcaguacacagucagaugaaaauacuguaa

SEQ ID NO: 576227 - RNA, 64 nt, hsa
aaguccuggauuuccaagauccgcgucugaaagugcaguacaucguuuguaccugaaacugccg

SEQ ID NO: 576228 - RNA, 64 nt, hsa
uggaacuagucuuccuuccuuauuccucgaacaugcaguacauaaaaaggggaaaaggagaaaa

SEQ ID NO: 576229 - RNA, 64 nt, hsa
cuauuucuugugguuauaacuuaaugaaaacaaugcaguacaggacauauauuuuuuaaaauaa

SEQ ID NO: 576230 - RNA, 64 nt, hsa
uuugggggugcaauauaagaaguuuauauaauaugcaguacauuauccaaaagagaagguaguu

SEQ ID NO: 576231 - RNA, 64 nt, hsa
agaacauuuuccagaaguucuucuguuguagaaagcaguacaguaucuuaagugucaaccaguu

SEQ ID NO: 576232 - RNA, 64 nt, hsa
uuccaggcagccucugucaggccuucaggguucagcaguacagccgagacucgacucugugccu

SEQ ID NO: 576233 - RNA, 64 nt, hsa
acgugguggguuguggggaugcaguuuggcaucugcaguacaccaagcacaugauucaugucug

SEQ ID NO: 576234 - RNA, 64 nt, hsa
uauucccccaaacuuuuuguucauguggcagggagcaguacacaacuauggaauagauuauuaa

SEQ ID NO: 576235 - RNA, 64 nt, hsa
accuccuuuaugguuaauacuauuaagcaagaaugcaguacagaauuggauacaguacggauuu

SEQ ID NO: 576236 - RNA, 52 nt, hsa
ggaaacaucugccuucuuaaaugcaguacauucuaaagagagugagcaugag

SEQ ID NO: 576237 - RNA, 64 nt, hsa
caccccagcgccauuuguaaagagcaacuuuccagcaguacauuugaagcacuuuuuaacaaca

SEQ ID NO: 576238 - RNA, 64 nt, hsa
cuggcuuuuuaucuucuuagcucaucuuaaauaagcaguacacuuggaugcagugcgucugaag

SEQ ID NO: 576239 - RNA, 64 nt, hsa
uauucugacugacaucaauuugucuaaucuuguagcaguacaguacaguccugauuauugcaac

SEQ ID NO: 576240 - RNA, 64 nt, hsa
ugcagaucacuguuggccucaucuuccucugccugcaguacagacugagagguacagggcagag

SEQ ID NO: 576241 - RNA, 64 nt, hsa
auucggaugaugcaaggagacacaugccaccccagcaguacacaaagcacuuaccuugacuggu

SEQ ID NO: 576242 - RNA, 64 nt, hsa
cccucucuuuuuccucuguagagaaaugugaggggcaguacauuuacugugcuuuucacaccau

SEQ ID NO: 576243 - RNA, 64 nt, hsa
uaagacaaaguaacccucaacguuuuaucuuuaugcaguacagugggcuuauuguguuaacacu

SEQ ID NO: 576244 - RNA, 64 nt, hsa
uauaccuuuuaauagguauccacuuaaggcauuugcaguacaaauauuaauugaccacuuccuu

SEQ ID NO: 576245 - RNA, 64 nt, hsa
cugacucaauacaucugggauuucuacuuucaaagcaguacaugugauuuuaugcccuuaaagu

SEQ ID NO: 576246 - RNA, 64 nt, hsa
auuauaucauuuuaugaauugugcuuuucauaaugcaguacauuucaaaauuuuuagauuaugu

SEQ ID NO: 576247 - RNA, 64 nt, hsa
cuaguacaucuuuuaaaaaguuacuaauuuuccagcaguacaaauauuaacaauuauauuaaca

SEQ ID NO: 576248 - RNA, 64 nt, hsa
uauuuacacauauuuccaaauauuuauuucaugagcaguacagcuaauuaaaauauauaagcuu

SEQ ID NO: 576249 - RNA, 64 nt, hsa
ugugcauggggcugcuggaggagagcauuccagagcaguacaucugcuauaucugccgggaccc

SEQ ID NO: 576250 - RNA, 64 nt, hsa
ucuugcuuuaugggcucaagaaugccaugcgcuggcaguacaugugcacaaagcagaaucucag

SEQ ID NO: 576251 - RNA, 64 nt, hsa
uauaagaggugggaaucccaaaacugcuuagauugcaguacaugagucuacacaaagacuucaa

SEQ ID NO: 576252 - RNA, 64 nt, hsa
cauaugagagcgagauuuaacuuucugagcaucugcaguacagucuuaucaacugguuguauau

SEQ ID NO: 576253 - RNA, 64 nt, hsa
gugaaggccugcgcacugaacuguaaggcagugggcaguacaggguaacuggaggcggggccag

SEQ ID NO: 576254 - RNA, 64 nt, hsa
gaguggccuugaggacgaaccccgcagggagcaagcaguacaguggcauucccagggggaccag

SEQ ID NO: 576255 - RNA, 64 nt, hsa
aggucugccaggcugucccgugcccugcucgguggcaguacaagcuggcggccugcagcgugag

SEQ ID NO: 576256 - RNA, 64 nt, hsa
uuuguucuacggggaggaaagaccaaaaguauuugcaguacaaaagaaacuauaucaaacacua

SEQ ID NO: 576257 - RNA, 64 nt, hsa
ugagccuuugaauacaucuuuaucaaugaccagugcaguacagaacuccacauauacaacuucc

SEQ ID NO: 576258 - RNA, 64 nt, hsa
ugccaaaccccagggccuggccccgcccagucccgcaguacauccccuguccccuccccaaccc

SEQ ID NO: 576259 - RNA, 64 nt, hsa
ugucauauuguaacaugcgugugccagacaccgggcaguacacuuuggaaagaaugugaaaucc

SEQ ID NO: 576260 - RNA, 64 nt, hsa
uuuuaggaaaggaugaucaaaaauaaugcauccagcaguacaauaaaaguaaaccacaaaaaaa

SEQ ID NO: 576261 - RNA, 64 nt, hsa
uaauaaguaggauuuuuguuuuguuuugcauuuugcaguacaaaggagaaaugauuagaacuua

SEQ ID NO: 576262 - RNA, 64 nt, hsa
uaagcugaguccauauacuugucuaacuaagaaagcaguacagaggaaaacaggaaccugauuu

SEQ ID NO: 576263 - RNA, 64 nt, hsa
ccaaacauucagaugaacugagcgucuuacacacgcaguacagaggagcacacauuaggauaga

SEQ ID NO: 576264 - RNA, 52 nt, hsa
acaucuauggggaagacuaacagcaguacauguuauuauguaauuaggacac

SEQ ID NO: 576265 - RNA, 64 nt, hsa
gcauucccaucacggugcuccagccggcccugcagcaguacagccagacccaagaccuaggugg

SEQ ID NO: 576266 - RNA, 64 nt, hsa
gagagaucacuucaguguguguguauauuuauuugcaguacagugcgcgcgugugugugugugu

SEQ ID NO: 576267 - RNA, 64 nt, hsa
guagcuuaccugacacaagaggaauaagaauggagcaguacaugggaaaggaggcaugccucug

SEQ ID NO: 576268 - RNA, 61 nt, hsa
aaaaacuuguaaaccugugaauggaccccaagcaguacacuugcuggucuagguauuaacc

SEQ ID NO: 576269 - RNA, 64 nt, hsa
uuuuccauccgcuaaguuuagauggaguccaaacgcaguacagcagaagaguuaacauuuacac

SEQ ID NO: 576270 - RNA, 64 nt, hsa
ugaaaaucucccuguaauccucuuccuccauuaugcaguacacggacaccuggcuacagaccag

SEQ ID NO: 576271 - RNA, 64 nt, hsa
ccuggccucagagccauuuauauucccagaguaggcaguacaggaucucguguugauuugcugu

SEQ ID NO: 576272 - RNA, 64 nt, hsa
cuucagaauccuauggaagagaauauuccuacuugcaguacaucaaaggaauggaugguggacc

SEQ ID NO: 576273 - RNA, 64 nt, hsa
uuucuuucucugcuuucuugacuuaaagguugcagcaguacaucucgucaccuaggaauagauu

SEQ ID NO: 576274 - RNA, 64 nt, hsa
uacuaagaguucucuuacugucagaaucucucuugcaguacagcucaaaauaguggaugcauuu

SEQ ID NO: 576275 - RNA, 64 nt, hsa
ggaggauccggaaagaguuuccgaagagugaagggcaguacaguggcuucaagaguccuuacug

SEQ ID NO: 576276 - RNA, 64 nt, hsa
gacagaguacagagaagggccucagaggacaccugcaguacagcuauccagagagacugggcuu

SEQ ID NO: 576277 - RNA, 64 nt, hsa
gcucgguucucccaaacacauaauuucuguuucagcaguacaaaggcauguuuuaaaaucuaua

SEQ ID NO: 576278 - RNA, 64 nt, hsa
guuuucuagaaacuucuuuaaagugccacauuuggcaguacaaaugagucugaguguaauagcc

SEQ ID NO: 576279 - RNA, 64 nt, hsa
uuguuagacucauagaguuuuuucugcaaugauugcaguacaagaaaaggauuauugugaggau

SEQ ID NO: 576280 - RNA, 64 nt, hsa
uugauggaaaaagaaaaagaagaaaagcaaucucgcaguacauguuacuugucgaaaaaauucc

SEQ ID NO: 576281 - RNA, 64 nt, hsa
acuucaagguugcagugaaugaugcucacuuguugcaguacaaucaucggguuaaaaaacucaa

SEQ ID NO: 576282 - RNA, 64 nt, hsa
acaguacuuccaaauuuuaagguauggaaugaaugcaguacaucuggaauuguagucgaugaau

SEQ ID NO: 576283 - RNA, 64 nt, hsa
cagcuucagguucugcuccuguaguacagaaggugcaguacaucuaugggcugugauuccccuu

SEQ ID NO: 576284 - RNA, 64 nt, hsa
gcgaaguccuauggaaacccgaggguugauuaaggcaguacaaauuguggagccuuuuaacugu

SEQ ID NO: 576285 - RNA, 64 nt, hsa
uuuuugguuaaauaagaguaagguucaaacacaagcaguacauguucuguuucauuaugcucga

SEQ ID NO: 576286 - RNA, 64 nt, hsa
auguggaacaccuaucagggagcagaaaaggggugcaguacacuaagugaacccagauucugga

SEQ ID NO: 576287 - RNA, 64 nt, hsa
aaugccuuuuauuuauuuuucccaauugcccugagcaguacaaugaugaacacacguuucaaga

SEQ ID NO: 576288 - RNA, 64 nt, hsa
auacaaauagaugcaaugacuguaaauggugucagcaguacacauggauaaucaguauuugacu

SEQ ID NO: 576289 - RNA, 64 nt, hsa
ucaccgagagaggggcagguuuccugagaguucagcaguacagucuucaucuuuugaaagguag

SEQ ID NO: 576290 - RNA, 64 nt, hsa
gggcccuaggcugcuuccgguagucccuguuuuugcaguacaugggugacuaucuccccuguug

SEQ ID NO: 576291 - RNA, 64 nt, hsa
ucacucccagaagagaccagcugggaccuucuuugcaguacaauuugaaauuccugauguauuu

SEQ ID NO: 576292 - RNA, 64 nt, hsa
gcaaauagaguuccggagcuggguugcuucugcugcaguacagaauccacauucagauaaccau

SEQ ID NO: 576293 - RNA, 64 nt, hsa
agaaucuaauaacauuaaaaugcuggggcaagaugcaguacaaaguugaagagacuuuauucuc

SEQ ID NO: 576294 - RNA, 64 nt, hsa
caagcugcuaggaacuuacgguuuuauuaggagagcaguacaaggguaucuaucccaguaccaa

SEQ ID NO: 576295 - RNA, 64 nt, hsa
cucugcugccucuguggaagagauuccuauuacugcaguacauacgucugccagggguaaccug

SEQ ID NO: 576296 - RNA, 64 nt, hsa
cucucugcauuuuuuccccaguggaacagacucugcaguacauuaaucagguugagaauugaaa

SEQ ID NO: 576297 - RNA, 64 nt, hsa
aucuuccacgaaaugggccauuccaguacuuccugcaguacaagaaccucuccaucaucuuccg

SEQ ID NO: 576298 - RNA, 64 nt, hsa
gacgcccagcuccugucauccuuccuuagguccugcaguacagucuuccccugaaugccaccgg

SEQ ID NO: 576299 - RNA, 64 nt, hsa
ggcaggcgcaaaugauuuggcgauucgaguggcugcaguacaggaucugacucuggcucaggcu

SEQ ID NO: 576300 - RNA, 64 nt, hsa
uuagcagacacugcgcguggagaagggcuuaucugcaguacacucugccauguggagggugggc

SEQ ID NO: 576301 - RNA, 64 nt, hsa
gggucauuacccucugccuccuggaagaccaauugcaguacaaauugaaaugggucggcucuag

SEQ ID NO: 576302 - RNA, 64 nt, hsa
guuagaccacagaaguggaauuugaaaguauaaugcaguacauuaauauucauguucauggaac

SEQ ID NO: 576303 - RNA, 64 nt, hsa
uuggaaaagaccacucucuugugggacguuucaagcaguacauguuuuaauguagugaacacag

SEQ ID NO: 576304 - RNA, 64 nt, hsa
gggcggagcugggguuuggugcaguuuccagggugcaguacagcagggccugaauacuggcccu

SEQ ID NO: 576305 - RNA, 64 nt, hsa
gugggggguuucuuuuuaugucugggucauucaggcaguacaucugaauuaagcugaauguaga

SEQ ID NO: 576306 - RNA, 64 nt, hsa
gggagcuggacagauuauagugguugaagucugugcaguacagaagggcggagcuuauucacac

SEQ ID NO: 576307 - RNA, 64 nt, hsa
cuucagucaccaacauauuguggcuggacagcaggcaguacacacuggagaaagacugaaugcc

SEQ ID NO: 576308 - RNA, 64 nt, hsa
caggaacaaaacaaaaagaauggaacauugaagagcaguacaaaaaccaggggagaaaucucag

SEQ ID NO: 576309 - RNA, 64 nt, hsa
auggaugcguuggucuuucucccuugguuuguaagcaguacaagggcgugugcucccagaauau

SEQ ID NO: 576310 - RNA, 64 nt, hsa
uuauuuuacuauuuguacuuuuauguaauaaaaugcaguacauuuuuaaauuuucagaugaugu

SEQ ID NO: 576311 - RNA, 64 nt, hsa
auccugucucaguaggauacuccauaacacaauagcaguacaccacuaggcucuuaaacgauca

SEQ ID NO: 576312 - RNA, 64 nt, hsa
uccgagagggugggaacagcagcauccccuaauugcaguacacgguuccuuuuccgcccgccac

SEQ ID NO: 576313 - RNA, 64 nt, hsa
uggcucacggugaaauaagcuugccaggaggcuggcaguacagagugcagcagcgagcaaaucc

SEQ ID NO: 576314 - RNA, 64 nt, hsa
ucguuccuguugggcugaacccuaaggugagugugcaguacagugugugugggugaaauggaga

SEQ ID NO: 576315 - RNA, 64 nt, hsa
cucuggggcuccgagaaaccugguucuuuggacugcaguacacaaucaaggacacaguggccug

SEQ ID NO: 576316 - RNA, 64 nt, hsa
auccauuuaaaacaagcugauaguguuucguuaagcaguacaucuugugcaugcaaaaaugaau

SEQ ID NO: 576317 - RNA, 64 nt, hsa
aauuaagagcuuagcaucccucuuagaguagaaggcaguacagauaacaaagaaguugugagua

SEQ ID NO: 576318 - RNA, 64 nt, hsa
agccagacuauaccuuguguagcuucaagaacucgcaguacauuaccagcugugauucuccacu

SEQ ID NO: 576319 - RNA, 64 nt, hsa
uaccugggcacaaacagaauuuuccauuuauuaagcaguacaaauguuuuucauccauuccuaa

SEQ ID NO: 576320 - RNA, 64 nt, hsa
uacauguuugguaccaagaaaggaaccugucagggcaguacaaugugacuuugaaaauauauac

SEQ ID NO: 576321 - RNA, 64 nt, hsa
cuuuugacuuguacguguuagccuucaugaaauugcaguacagagauggguccccaaaguggag

SEQ ID NO: 576322 - RNA, 64 nt, hsa
uuacagcucugacaaaucaucagacagcugcucugcaguacagauguguaucccaccaaacuaa

SEQ ID NO: 576323 - RNA, 64 nt, hsa
uuuacugauuaagugaccaauauguucauauuaagcaguacagaguguaggcaagagaaagaau

SEQ ID NO: 576324 - RNA, 64 nt, hsa
ugaaaaagacaagauuuaugagaaauauuugaaggcaguacacucuggccaacuguuaccaguu

SEQ ID NO: 576325 - RNA, 64 nt, hsa
guaucuuaggcuuauauacguagggauagaguaagcaguacaaaguguauauuuuggaaaagac

SEQ ID NO: 576326 - RNA, 64 nt, hsa
guuagcagaccuaaagcaagccugaauuggcuaugcaguacauuguauucuguuugggggaauu

SEQ ID NO: 576327 - RNA, 64 nt, hsa
cgacuucagcagcuuccugcugcuagucgaugcagcaguacaaacggcugccgagcuggagcua

SEQ ID NO: 576328 - RNA, 64 nt, hsa
uuagccagacuauauuguguagcuucaagaacuugcaguacauuaccagcugugauucuccuga

SEQ ID NO: 576329 - RNA, 64 nt, hsa; identical to SEQ ID NO: 140312

SEQ ID NO: 576330 - RNA, 64 nt, hsa; identical to SEQ ID NO: 140313

SEQ ID NO: 576331 - RNA, 64 nt, hsa; identical to SEQ ID NO: 140314

SEQ ID NO: 576332 - RNA, 64 nt, hsa; identical to SEQ ID NO: 140315

SEQ ID NO: 576333 - RNA, 64 nt, hsa; identical to SEQ ID NO: 140316

SEQ ID NO: 576334 - RNA, 64 nt, hsa; identical to SEQ ID NO: 140317

SEQ ID NO: 576335 - RNA, 64 nt, hsa; identical to SEQ ID NO: 140318

SEQ ID NO: 576336 - RNA, 64 nt, hsa; identical to SEQ ID NO: 140319

SEQ ID NO: 576337 - RNA, 64 nt, hsa; identical to SEQ ID NO: 140320

SEQ ID NO: 576338 - RNA, 64 nt, hsa; identical to SEQ ID NO: 140321

SEQ ID NO: 576339 - RNA, 64 nt, hsa; identical to SEQ ID NO: 140322

SEQ ID NO: 576340 - RNA, 64 nt, hsa; identical to SEQ ID NO: 140323

SEQ ID NO: 576341 - RNA, 64 nt, hsa; identical to SEQ ID NO: 140324

SEQ ID NO: 576342 - RNA, 64 nt, hsa; identical to SEQ ID NO: 140325

SEQ ID NO: 576343 - RNA, 64 nt, hsa; identical to SEQ ID NO: 140326

SEQ ID NO: 576344 - RNA, 64 nt, hsa; identical to SEQ ID NO: 140327

SEQ ID NO: 576345 - RNA, 64 nt, hsa; identical to SEQ ID NO: 140328

SEQ ID NO: 576346 - RNA, 64 nt, hsa; identical to SEQ ID NO: 140329

SEQ ID NO: 576347 - RNA, 64 nt, hsa; identical to SEQ ID NO: 140330

SEQ ID NO: 576348 - RNA, 64 nt, hsa; identical to SEQ ID NO: 140331

SEQ ID NO: 576349 - RNA, 64 nt, hsa; identical to SEQ ID NO: 140332

SEQ ID NO: 576350 - RNA, 64 nt, hsa; identical to SEQ ID NO: 140333

SEQ ID NO: 576351 - RNA, 64 nt, hsa; identical to SEQ ID NO: 140334

SEQ ID NO: 576352 - RNA, 64 nt, hsa; identical to SEQ ID NO: 140335

SEQ ID NO: 576353 - RNA, 64 nt, hsa; identical to SEQ ID NO: 140336

SEQ ID NO: 576354 - RNA, 64 nt, hsa; identical to SEQ ID NO: 140337

SEQ ID NO: 576355 - RNA, 64 nt, hsa; identical to SEQ ID NO: 140338

SEQ ID NO: 576356 - RNA, 64 nt, hsa; identical to SEQ ID NO: 140339

SEQ ID NO: 576357 - RNA, 64 nt, hsa; identical to SEQ ID NO: 201717

SEQ ID NO: 576358 - RNA, 64 nt, hsa; identical to SEQ ID NO: 201718

SEQ ID NO: 576359 - RNA, 64 nt, hsa; identical to SEQ ID NO: 201719

SEQ ID NO: 576360 - RNA, 64 nt, hsa; identical to SEQ ID NO: 201720

SEQ ID NO: 576361 - RNA, 64 nt, hsa; identical to SEQ ID NO: 201721

SEQ ID NO: 576362 - RNA, 64 nt, hsa; identical to SEQ ID NO: 201722

SEQ ID NO: 576363 - RNA, 64 nt, hsa; identical to SEQ ID NO: 201723

SEQ ID NO: 576364 - RNA, 64 nt, hsa; identical to SEQ ID NO: 201724

SEQ ID NO: 576365 - RNA, 64 nt, hsa; identical to SEQ ID NO: 201725

SEQ ID NO: 576366 - RNA, 64 nt, hsa; identical to SEQ ID NO: 201726

SEQ ID NO: 576367 - RNA, 64 nt, hsa; identical to SEQ ID NO: 201727

SEQ ID NO: 576368 - RNA, 64 nt, hsa; identical to SEQ ID NO: 201728

SEQ ID NO: 576369 - RNA, 64 nt, hsa; identical to SEQ ID NO: 201729

SEQ ID NO: 576370 - RNA, 64 nt, hsa; identical to SEQ ID NO: 201730

SEQ ID NO: 576371 - RNA, 64 nt, hsa; identical to SEQ ID NO: 201731

SEQ ID NO: 576372 - RNA, 64 nt, hsa; identical to SEQ ID NO: 201732

SEQ ID NO: 576373 - RNA, 64 nt, hsa; identical to SEQ ID NO: 201733

SEQ ID NO: 576374 - RNA, 64 nt, hsa; identical to SEQ ID NO: 201734

SEQ ID NO: 576375 - RNA, 64 nt, hsa; identical to SEQ ID NO: 201735

SEQ ID NO: 576376 - RNA, 64 nt, hsa; identical to SEQ ID NO: 201736

SEQ ID NO: 576377 - RNA, 64 nt, hsa; identical to SEQ ID NO: 201737

SEQ ID NO: 576378 - RNA, 64 nt, hsa; identical to SEQ ID NO: 201738

SEQ ID NO: 576379 - RNA, 64 nt, hsa; identical to SEQ ID NO: 201739

SEQ ID NO: 576380 - RNA, 64 nt, hsa; identical to SEQ ID NO: 201740

SEQ ID NO: 576381 - RNA, 64 nt, hsa; identical to SEQ ID NO: 201741

SEQ ID NO: 576382 - RNA, 64 nt, hsa; identical to SEQ ID NO: 201742

SEQ ID NO: 576383 - RNA, 64 nt, hsa; identical to SEQ ID NO: 201743

SEQ ID NO: 576384 - RNA, 64 nt, hsa; identical to SEQ ID NO: 201744

SEQ ID NO: 576385 - RNA, 64 nt, hsa; identical to SEQ ID NO: 201745

SEQ ID NO: 576386 - RNA, 64 nt, hsa; identical to SEQ ID NO: 201746

SEQ ID NO: 576387 - RNA, 64 nt, hsa; identical to SEQ ID NO: 201747

SEQ ID NO: 576388 - RNA, 64 nt, hsa; identical to SEQ ID NO: 201748

SEQ ID NO: 576389 - RNA, 64 nt, hsa; identical to SEQ ID NO: 201749

SEQ ID NO: 576390 - RNA, 64 nt, hsa; identical to SEQ ID NO: 201750

SEQ ID NO: 576391 - RNA, 64 nt, hsa; identical to SEQ ID NO: 201751

SEQ ID NO: 576392 - RNA, 64 nt, hsa; identical to SEQ ID NO: 201752

SEQ ID NO: 576393 - RNA, 64 nt, hsa; identical to SEQ ID NO: 201753

SEQ ID NO: 576394 - RNA, 64 nt, hsa; identical to SEQ ID NO: 201754

SEQ ID NO: 576395 - RNA, 64 nt, hsa; identical to SEQ ID NO: 201755

SEQ ID NO: 576396 - RNA, 64 nt, hsa; identical to SEQ ID NO: 201756

SEQ ID NO: 576397 - RNA, 64 nt, hsa; identical to SEQ ID NO: 201757

SEQ ID NO: 576398 - RNA, 64 nt, hsa; identical to SEQ ID NO: 201758

SEQ ID NO: 576399 - RNA, 64 nt, hsa; identical to SEQ ID NO: 201759

SEQ ID NO: 576400 - RNA, 64 nt, hsa; identical to SEQ ID NO: 201760

SEQ ID NO: 576401 - RNA, 64 nt, hsa; identical to SEQ ID NO: 201761

SEQ ID NO: 576402 - RNA, 64 nt, hsa; identical to SEQ ID NO: 201762

SEQ ID NO: 576403 - RNA, 64 nt, hsa; identical to SEQ ID NO: 201763

SEQ ID NO: 576404 - RNA, 64 nt, hsa; identical to SEQ ID NO: 201764

SEQ ID NO: 576405 - RNA, 64 nt, hsa; identical to SEQ ID NO: 201765

SEQ ID NO: 576406 - RNA, 64 nt, hsa; identical to SEQ ID NO: 201766

SEQ ID NO: 576407 - RNA, 64 nt, hsa; identical to SEQ ID NO: 201767

SEQ ID NO: 576408 - RNA, 64 nt, hsa; identical to SEQ ID NO: 201768

SEQ ID NO: 576409 - RNA, 64 nt, hsa; identical to SEQ ID NO: 201769

SEQ ID NO: 576410 - RNA, 64 nt, hsa; identical to SEQ ID NO: 201770

SEQ ID NO: 576411 - RNA, 64 nt, hsa; identical to SEQ ID NO: 201771

SEQ ID NO: 576412 - RNA, 64 nt, hsa; identical to SEQ ID NO: 201772

SEQ ID NO: 576413 - RNA, 64 nt, hsa; identical to SEQ ID NO: 201773

SEQ ID NO: 576414 - RNA, 64 nt, hsa; identical to SEQ ID NO: 201774

SEQ ID NO: 576415 - RNA, 64 nt, hsa; identical to SEQ ID NO: 201775

SEQ ID NO: 576416 - RNA, 64 nt, hsa; identical to SEQ ID NO: 201776

SEQ ID NO: 576417 - RNA, 64 nt, hsa; identical to SEQ ID NO: 201777

SEQ ID NO: 576418 - RNA, 64 nt, hsa; identical to SEQ ID NO: 201778

SEQ ID NO: 576419 - RNA, 64 nt, hsa; identical to SEQ ID NO: 201779

SEQ ID NO: 576420 - RNA, 64 nt, hsa; identical to SEQ ID NO: 201780

SEQ ID NO: 576421 - RNA, 64 nt, hsa; identical to SEQ ID NO: 201781

SEQ ID NO: 576422 - RNA, 64 nt, hsa; identical to SEQ ID NO: 201782

SEQ ID NO: 576423 - RNA, 64 nt, hsa; identical to SEQ ID NO: 201783

SEQ ID NO: 576424 - RNA, 64 nt, hsa; identical to SEQ ID NO: 201784

SEQ ID NO: 576425 - RNA, 64 nt, hsa; identical to SEQ ID NO: 201785

SEQ ID NO: 576426 - RNA, 64 nt, hsa; identical to SEQ ID NO: 201786

SEQ ID NO: 576427 - RNA, 64 nt, hsa; identical to SEQ ID NO: 201787

SEQ ID NO: 576428 - RNA, 64 nt, hsa; identical to SEQ ID NO: 201788

SEQ ID NO: 576429 - RNA, 64 nt, hsa; identical to SEQ ID NO: 201789

SEQ ID NO: 576430 - RNA, 64 nt, hsa; identical to SEQ ID NO: 201790

SEQ ID NO: 576431 - RNA, 64 nt, hsa; identical to SEQ ID NO: 201791

SEQ ID NO: 576432 - RNA, 64 nt, hsa; identical to SEQ ID NO: 201792

SEQ ID NO: 576433 - RNA, 64 nt, hsa; identical to SEQ ID NO: 201793

SEQ ID NO: 576434 - RNA, 64 nt, hsa; identical to SEQ ID NO: 201794

SEQ ID NO: 576435 - RNA, 64 nt, hsa; identical to SEQ ID NO: 189516

SEQ ID NO: 576436 - RNA, 64 nt, hsa; identical to SEQ ID NO: 189517

SEQ ID NO: 576437 - RNA, 64 nt, hsa; identical to SEQ ID NO: 284063

SEQ ID NO: 576438 - RNA, 64 nt, hsa; identical to SEQ ID NO: 284064

SEQ ID NO: 576439 - RNA, 64 nt, hsa; identical to SEQ ID NO: 284065

SEQ ID NO: 576440 - RNA, 64 nt, hsa; identical to SEQ ID NO: 284066

SEQ ID NO: 576441 - RNA, 64 nt, hsa; identical to SEQ ID NO: 284067

SEQ ID NO: 576442 - RNA, 64 nt, hsa; identical to SEQ ID NO: 284068

SEQ ID NO: 576443 - RNA, 64 nt, hsa; identical to SEQ ID NO: 284069

SEQ ID NO: 576444 - RNA, 64 nt, hsa; identical to SEQ ID NO: 284070

SEQ ID NO: 576445 - RNA, 64 nt, hsa; identical to SEQ ID NO: 284071

SEQ ID NO: 576446 - RNA, 64 nt, hsa; identical to SEQ ID NO: 284072

SEQ ID NO: 576447 - RNA, 57 nt, hsa; identical to SEQ ID NO: 284073

SEQ ID NO: 576448 - RNA, 64 nt, hsa; identical to SEQ ID NO: 284074

SEQ ID NO: 576449 - RNA, 64 nt, hsa; identical to SEQ ID NO: 284075

SEQ ID NO: 576450 - RNA, 64 nt, hsa; identical to SEQ ID NO: 284076

SEQ ID NO: 576451 - RNA, 64 nt, hsa; identical to SEQ ID NO: 284077

SEQ ID NO: 576452 - RNA, 64 nt, hsa; identical to SEQ ID NO: 284078

SEQ ID NO: 576453 - RNA, 64 nt, hsa; identical to SEQ ID NO: 284079

SEQ ID NO: 576454 - RNA, 64 nt, hsa; identical to SEQ ID NO: 284080

SEQ ID NO: 576455 - RNA, 64 nt, hsa; identical to SEQ ID NO: 284081

SEQ ID NO: 576456 - RNA, 64 nt, hsa; identical to SEQ ID NO: 284082

SEQ ID NO: 576457 - RNA, 64 nt, hsa; identical to SEQ ID NO: 284083

SEQ ID NO: 576458 - RNA, 64 nt, hsa; identical to SEQ ID NO: 284084

SEQ ID NO: 576459 - RNA, 64 nt, hsa; identical to SEQ ID NO: 284085

SEQ ID NO: 576460 - RNA, 64 nt, hsa; identical to SEQ ID NO: 284086

SEQ ID NO: 576461 - RNA, 64 nt, hsa; identical to SEQ ID NO: 284087

SEQ ID NO: 576462 - RNA, 64 nt, hsa; identical to SEQ ID NO: 284088

SEQ ID NO: 576463 - RNA, 64 nt, hsa; identical to SEQ ID NO: 284089

SEQ ID NO: 576464 - RNA, 64 nt, hsa; identical to SEQ ID NO: 284090

SEQ ID NO: 576465 - RNA, 55 nt, hsa; identical to SEQ ID NO: 284091

SEQ ID NO: 576466 - RNA, 64 nt, hsa; identical to SEQ ID NO: 284092

SEQ ID NO: 576467 - RNA, 64 nt, hsa; identical to SEQ ID NO: 284093

SEQ ID NO: 576468 - RNA, 64 nt, hsa; identical to SEQ ID NO: 284094

SEQ ID NO: 576469 - RNA, 64 nt, hsa; identical to SEQ ID NO: 284095

SEQ ID NO: 576470 - RNA, 64 nt, hsa; identical to SEQ ID NO: 284096

SEQ ID NO: 576471 - RNA, 64 nt, hsa; identical to SEQ ID NO: 284097

SEQ ID NO: 576472 - RNA, 64 nt, hsa; identical to SEQ ID NO: 284098

SEQ ID NO: 576473 - RNA, 64 nt, hsa; identical to SEQ ID NO: 284099

SEQ ID NO: 576474 - RNA, 64 nt, hsa; identical to SEQ ID NO: 284100

SEQ ID NO: 576475 - RNA, 64 nt, hsa; identical to SEQ ID NO: 284101

SEQ ID NO: 576476 - RNA, 64 nt, hsa; identical to SEQ ID NO: 284102

SEQ ID NO: 576477 - RNA, 64 nt, hsa; identical to SEQ ID NO: 284103

SEQ ID NO: 576478 - RNA, 64 nt, hsa; identical to SEQ ID NO: 284104

SEQ ID NO: 576479 - RNA, 64 nt, hsa; identical to SEQ ID NO: 284105

SEQ ID NO: 576480 - RNA, 64 nt, hsa; identical to SEQ ID NO: 284106

SEQ ID NO: 576481 - RNA, 64 nt, hsa; identical to SEQ ID NO: 284107

SEQ ID NO: 576482 - RNA, 64 nt, hsa; identical to SEQ ID NO: 284108

SEQ ID NO: 576483 - RNA, 64 nt, hsa; identical to SEQ ID NO: 284109

SEQ ID NO: 576484 - RNA, 64 nt, hsa; identical to SEQ ID NO: 284110

SEQ ID NO: 576485 - RNA, 64 nt, hsa; identical to SEQ ID NO: 284111

SEQ ID NO: 576486 - RNA, 64 nt, hsa; identical to SEQ ID NO: 284112

SEQ ID NO: 576487 - RNA, 64 nt, hsa; identical to SEQ ID NO: 284113

SEQ ID NO: 576488 - RNA, 64 nt, hsa; identical to SEQ ID NO: 284114

SEQ ID NO: 576489 - RNA, 64 nt, hsa; identical to SEQ ID NO: 284115

SEQ ID NO: 576490 - RNA, 64 nt, hsa; identical to SEQ ID NO: 284116

SEQ ID NO: 576491 - RNA, 64 nt, hsa; identical to SEQ ID NO: 284117

SEQ ID NO: 576492 - RNA, 64 nt, hsa; identical to SEQ ID NO: 284118

SEQ ID NO: 576493 - RNA, 64 nt, hsa; identical to SEQ ID NO: 284119

SEQ ID NO: 576494 - RNA, 64 nt, hsa; identical to SEQ ID NO: 284120

SEQ ID NO: 576495 - RNA, 64 nt, hsa; identical to SEQ ID NO: 284121

SEQ ID NO: 576496 - RNA, 64 nt, hsa; identical to SEQ ID NO: 284122

SEQ ID NO: 576497 - RNA, 64 nt, hsa; identical to SEQ ID NO: 284123

SEQ ID NO: 576498 - RNA, 64 nt, hsa; identical to SEQ ID NO: 284124

SEQ ID NO: 576499 - RNA, 64 nt, hsa; identical to SEQ ID NO: 284125

SEQ ID NO: 576500 - RNA, 64 nt, hsa; identical to SEQ ID NO: 284126

SEQ ID NO: 576501 - RNA, 64 nt, hsa; identical to SEQ ID NO: 284127

SEQ ID NO: 576502 - RNA, 64 nt, hsa; identical to SEQ ID NO: 284128

SEQ ID NO: 576503 - RNA, 64 nt, hsa; identical to SEQ ID NO: 284129

SEQ ID NO: 576504 - RNA, 64 nt, hsa; identical to SEQ ID NO: 284130

SEQ ID NO: 576505 - RNA, 64 nt, hsa; identical to SEQ ID NO: 21560

SEQ ID NO: 576506 - RNA, 64 nt, hsa; identical to SEQ ID NO: 21561

SEQ ID NO: 576507 - RNA, 64 nt, hsa; identical to SEQ ID NO: 21562

SEQ ID NO: 576508 - RNA, 64 nt, hsa; identical to SEQ ID NO: 21563

SEQ ID NO: 576509 - RNA, 64 nt, hsa; identical to SEQ ID NO: 21564

SEQ ID NO: 576510 - RNA, 64 nt, hsa; identical to SEQ ID NO: 21565

SEQ ID NO: 576511 - RNA, 64 nt, hsa; identical to SEQ ID NO: 21566

SEQ ID NO: 576512 - RNA, 64 nt, hsa; identical to SEQ ID NO: 21567

SEQ ID NO: 576513 - RNA, 64 nt, hsa; identical to SEQ ID NO: 21568

SEQ ID NO: 576514 - RNA, 64 nt, hsa; identical to SEQ ID NO: 21569

SEQ ID NO: 576515 - RNA, 64 nt, hsa; identical to SEQ ID NO: 21570

SEQ ID NO: 576516 - RNA, 64 nt, hsa; identical to SEQ ID NO: 21571

SEQ ID NO: 576517 - RNA, 64 nt, hsa; identical to SEQ ID NO: 21572

SEQ ID NO: 576518 - RNA, 64 nt, hsa; identical to SEQ ID NO: 21573

SEQ ID NO: 576519 - RNA, 65 nt, hsa
caugagcucccuggaguccgacgcggguuuucucucugggggaccugggugguccccgcuguggu

SEQ ID NO: 576520 - RNA, 65 nt, hsa
ccucccccuccccagaaggccaagggaugugggggcugggggacugggaggccuggcagucuuca

SEQ ID NO: 576521 - RNA, 65 nt, hsa
uggaaggaaacacgcggaucugaacagcaguaauccugggggauacggggguugggcuagauuac

SEQ ID NO: 576522 - RNA, 65 nt, hsa
uugcccucugccugccucagcugcugccugaccggcugggggaggcacuggcgggaggccucggg

SEQ ID NO: 576523 - RNA, 65 nt, hsa
gacguggugggcugagguuaaucagggaagguuuccugggggaggugauccuugaacuggcuccc

SEQ ID NO: 576524 - RNA, 60 nt, hsa
ucccacggcagaagcccugaggacugacuccugggggagaacagcauucccgccgccucc

SEQ ID NO: 576525 - RNA, 65 nt, hsa
uucccugcugacccugccccacuuccagggaaaagcugggggagguuggaccccucucacugacu

SEQ ID NO: 576526 - RNA, 65 nt, hsa
ggauaaugacuuugcaucugcaccuggaacggggccugggggaccuggggucuggugugccaggc

SEQ ID NO: 576527 - RNA, 65 nt, hsa
agaauccuccuggaauuucuuggagacgaaaguaucugggggauuguuggguacuagggagacug

SEQ ID NO: 576528 - RNA, 65 nt, hsa
ugggagggggaggaaguuggcugagccauugagugcugggggaggccauccaagauggcaugaau

SEQ ID NO: 576529 - RNA, 65 nt, hsa
acuugagcacauaacucuaugucugaucuaggaggcugggggaagagccucccauaaaaucacac

SEQ ID NO: 576530 - RNA, 65 nt, hsa
ccuggcagagugacaaaggcucaggacggcuggcucugggggacucaggccaagccccuuggcac

SEQ ID NO: 576531 - RNA, 65 nt, hsa
cagggacagccaggcaccugcuccucuugcccuuccugggggaagggagcugccuucugucccug

SEQ ID NO: 576532 - RNA, 65 nt, hsa
ggucucaaaaaacaaauguguggcuaaggaguuaccugggggaaguagaaugagaggucuguugg

SEQ ID NO: 576533 - RNA, 65 nt, hsa
uccaaagcuuuagcagcuuaauuaaaucuguuggacugggggaggagagagcuguucucuagugg

SEQ ID NO: 576534 - RNA, 65 nt, hsa
ugcccccuaggccuaguggugaucccagugcucuacugggggaugagagaaaggcauuuuauagc

SEQ ID NO: 576535 - RNA, 65 nt, hsa
ggucuggcugcagcuagaggacaggcaagccagcucugggggagucuuaggaacugggaguuggu

SEQ ID NO: 576536 - RNA, 65 nt, hsa
gguuuaacugagguuuaugaauauucaaaccuuugcugggggaaagaaaugaaaguuaaugagca

SEQ ID NO: 576537 - RNA, 65 nt, hsa
gaaguguccucuccacguaacucauuaugccccuccugggggagauugcaucuccaggacaagca

SEQ ID NO: 576538 - RNA, 65 nt, hsa
aggucugcugcuucacuggggcccgaugacuuuggcugggggagggggccuagggccucuucuca

SEQ ID NO: 576539 - RNA, 65 nt, hsa
acccagcugaacugccccuccaagggacaggaaggcugggggagggaguuuacaacccaagccau

SEQ ID NO: 576540 - RNA, 65 nt, hsa
uucugcaggggcccacugaagcagaagguuuuucucugggggaaccugucucaguguugacugca

SEQ ID NO: 576541 - RNA, 65 nt, hsa
guuccugauggggaugccugugggauggcccacaccugggggaccuggcagauggggugaguugg

SEQ ID NO: 576542 - RNA, 65 nt, hsa
ggagacacagauguccagagugauuggagaauguccugggggaaugaaguuccuuccacaaacac

SEQ ID NO: 576543 - RNA, 65 nt, hsa
aggccuggggacggcuuuuacuuaaaccgccaaggcugggggaagaagcucucuccucccuuucu

SEQ ID NO: 576544 - RNA, 65 nt, hsa
aguaggguuuagccgggccccauggucacagaccccugggggaggcuuccagcucagucccacag

SEQ ID NO: 576545 - RNA, 65 nt, hsa
cagaccccuuccccaccaggcuaggccccccacaccugggggacccccuggccccucuuuugucu

SEQ ID NO: 576546 - RNA, 65 nt, hsa
ccuaaauccucucguaucucaccccaaaccccaaacugggggaaaaaaaguuaacucuuugugaa

SEQ ID NO: 576547 - RNA, 65 nt, hsa
cucuuucauauucuuuuaauacaucuugaucacagcugggggaaaaaaagcuuuuuaauucuaua

SEQ ID NO: 576548 - RNA, 65 nt, hsa
ucuugauucugcauuugaggaaggucagggugccgcugggggagcagggagcggggagggaggaa

SEQ ID NO: 576549 - RNA, 65 nt, hsa
agcaacccugagagagacagucuugugagggagaucugggggaggcaggaagcuccucagauuuu

SEQ ID NO: 576550 - RNA, 65 nt, hsa
uuguggaggcacccagguuguccaugcuugggauucugggggaaggagagaagggcagcucaggg

SEQ ID NO: 576551 - RNA, 65 nt, hsa
guuagcaacugugaacagagaggucgggauuugcccugggggaggaagagaggccaaguucagag

SEQ ID NO: 576552 - RNA, 65 nt, hsa
gguucucugauuuucguguucucugcccagaugggcugggggaguugagagugugcuuauuuuca

SEQ ID NO: 576553 - RNA, 65 nt, hsa
augggugguggucagggccugggggcuuggccaugcugggggaauggggcucuggguuccugccu

SEQ ID NO: 576554 - RNA, 65 nt, hsa
auggugcauucuguaaccauggagucuucuguuuccugggggaaaggggcauucaugaccugaac

SEQ ID NO: 576555 - RNA, 65 nt, hsa
cugcugugcacgacguggaugccguaugcauguugcugggggaagccacuccggacacuguguuu

SEQ ID NO: 576556 - RNA, 65 nt, hsa
uaggcuuuauucaucccuucuguucauuuaccaaccugggggauugauacgaccggggaaaaugu

SEQ ID NO: 576557 - RNA, 65 nt, hsa
ugcagcaaugggucccucuagccuguggacaccagcugggggauccagggucaggcccccuccuc

SEQ ID NO: 576558 - RNA, 65 nt, hsa
cucuaaggcuaugcaacccuccccacgucuuccagcugggggaugggggggagucauaggaaaag

SEQ ID NO: 576559 - RNA, 65 nt, hsa
cuggggcaccuuaccaccggagccgaaucuggucccugggggacccccaguuucucuucagacac

SEQ ID NO: 576560 - RNA, 65 nt, hsa
ccuugauggaguggggaacaagcaguagagugggacugggggagacccaggccccgggcugagca

SEQ ID NO: 576561 - RNA, 65 nt, hsa
uaucaggggacaaaccagggguaccaggcacauggcugggggagggacugcugacccaccaaggu

SEQ ID NO: 576562 - RNA, 65 nt, hsa
caccagccaaccacauagccuugggaccagccucucugggggaccagaaguagugagagaaggaa

SEQ ID NO: 576563 - RNA, 65 nt, hsa
ugaagucuucuccuccaugaacaucauggacugagcugggggaagaagggauaucuacugugguc

SEQ ID NO: 576564 - RNA, 65 nt, hsa
gggcugggcagggaggcgccguggacucagccaggcugggggagccggacauggcuuggccuggg

SEQ ID NO: 576565 - RNA, 65 nt, hsa
cucucguuuggcccucugaacaaggugcacgcgagcugggggaugaagacggcucccacuuccuu

SEQ ID NO: 576566 - RNA, 65 nt, hsa
uccagcgcugagggccagggucuugugcuguggggcugggggaugcccucuuuucuauauuuauu

SEQ ID NO: 576567 - RNA, 65 nt, hsa
acaucccacucucugaacuacaaucacugugcucccugggggagauccuucauguugaggguuuu

SEQ ID NO: 576568 - RNA, 65 nt, hsa
ugcccaccuguccugcuucucugcaggugaaaacucugggggaugcugaucaauagagcuugguc

SEQ ID NO: 576569 - RNA, 65 nt, hsa
gggaggggaggaaugacacaaauggcagggagcugcugggggacugaccccucggcgccuggccu

SEQ ID NO: 576570 - RNA, 65 nt, hsa
cugguaaccuuacucaaaagaagggucagugugugcugggggacuuuugccuuguuuguaauguu

SEQ ID NO: 576571 - RNA, 65 nt, hsa
ggcuacacucuuccaucagcaugaguccuggagagcugggggaacguaggaagaggagccuugcc

SEQ ID NO: 576572 - RNA, 65 nt, hsa
uuaauaauugcuuuuucuguguauuuuguauugggcugggggauagcaucaaagguugaacuuuu

SEQ ID NO: 576573 - RNA, 65 nt, hsa
ggccucgggugcccucucacaucuccuguuggaugcugggggagaagcaauaaaccucagcccuc

SEQ ID NO: 576574 - RNA, 65 nt, hsa
uccuuaguuagccacuugugucauuuccagguuuucugggggagugcagggggagaugggugaug

SEQ ID NO: 576575 - RNA, 65 nt, hsa
cuggaaggcaugggguggcugggauuuaaggacuucugggggaccaagacauccucaagaaaaca

SEQ ID NO: 576576 - RNA, 65 nt, hsa
gauugaugcuacuguugguaugugugcaaugauggcugggggaaucgucaugacugccaaucuca

SEQ ID NO: 576577 - RNA, 65 nt, hsa
ccagguggccccugaauucugcgcaagggaugggccugggggaacucaagggagggccuaaagca

SEQ ID NO: 576578 - RNA, 65 nt, hsa
ugucuuccccugcuccgcauuuuguaaaauggccccugggggaguguuuuugcuggaucugcucc

SEQ ID NO: 576579 - RNA, 65 nt, hsa
gugaggggacguccuuggucuugcacgcacacuaccugggggagucaacacugggauggucugug

SEQ ID NO: 576580 - RNA, 65 nt, hsa
gguuucuuuuucuuuaaucucccuuguuucuugggcugggggagggguggggggaacaacuggcu

SEQ ID NO: 576581 - RNA, 65 nt, hsa
aaaguucacuggaaauugcccucagauuuuauaaacugggggauuucuuaauuagauaaaaguuc

SEQ ID NO: 576582 - RNA, 65 nt, hsa
acugugcuucagggguagggcugggcccacagagccugggggagugucaccgccuuugcugccuc

SEQ ID NO: 576583 - RNA, 65 nt, hsa
agccaccacccagcaucccaggcugguggcaggagcugggggagaggacucuccccugugagacu

SEQ ID NO: 576584 - RNA, 65 nt, hsa
guguuuacauuuauaggaccacauaucccugguuucugggggaggguuucacuguuacaucacca

SEQ ID NO: 576585 - RNA, 65 nt, hsa
uagucauaggaaacauauuaugugcagguccuagccugggggaggaaaguagauagacagaaaau

SEQ ID NO: 576586 - RNA, 65 nt, hsa
aaugaaauuguucacuugagggauuagucaaccaucugggggagaaguugcucacugucaaauac

SEQ ID NO: 576587 - RNA, 65 nt, hsa
cccugaaagucuuguguaccccaccucugaagaugcugggggaggcagcugggaugggagccagc

SEQ ID NO: 576588 - RNA, 65 nt, hsa
aaaauauuuuaaaaauucuugguaguugagcagcucugggggaauaagggcaaauaugcuuguua

SEQ ID NO: 576589 - RNA, 65 nt, hsa
uguguuccccacagggagaggcucuggggggauggcugggggaugcagagccucagagcaaauaa

SEQ ID NO: 576590 - RNA, 65 nt, hsa
aagagggggaccugccaccagggagcuuccuggcucugggggacccaggugggacuuagcaguga

SEQ ID NO: 576591 - RNA, 65 nt, hsa
uuuuuuuuuugcuuguuacucaucuguugaccuaccugggggaaguagcacccuugcauuucaaa

SEQ ID NO: 576592 - RNA, 65 nt, hsa
ucugugaggggagagguuuuacaagccagacaggccugggggacugcaguccccaaggagacccu

SEQ ID NO: 576593 - RNA, 65 nt, hsa
uucauacuuuugguccauguaagugcuacccguugcugggggaggagucaugguuuauuuggaaa

SEQ ID NO: 576594 - RNA, 65 nt, hsa
acccaccgcccccaaucuaucuuggcucacucgcucugggggaagcuagcugccaugcuaugagc

SEQ ID NO: 576595 - RNA, 65 nt, hsa
ugagaaccagugcuuauguggugugcccuuggcuucugggggagagcuuggggcagcagaggccc

SEQ ID NO: 576596 - RNA, 65 nt, hsa
uacuaguuacaaaucacaguauaagauuuaagugccugggggaaggauacaauuuuuagaaauua

SEQ ID NO: 576597 - RNA, 65 nt, hsa
gcccggaguccucccuaggagaggggcucgaugggcugggggaaggagccugaagguugccccug

SEQ ID NO: 576598 - RNA, 65 nt, hsa
aucugccugucuaugugcuguuggugugccuaugccugggggaggucaguaggggcccccucccc

SEQ ID NO: 576599 - RNA, 65 nt, hsa
accuccacugcccccaggggcuguggacaaaccggcugggggacugcccagccucccaccuguuu

SEQ ID NO: 576600 - RNA, 65 nt, hsa
ucuuccaagaacagaagcggcauguugaagaaaaucugggggauugggauggggguaugugugga

SEQ ID NO: 576601 - RNA, 65 nt, hsa
cggcaugcuggucuuuccgaccuggugcucuucugcugggggacugaggcuggcccucauucggg

SEQ ID NO: 576602 - RNA, 65 nt, hsa
ucccggcaccgccgccgucgucucccggccccucgcugggggagaaagcaucugcuccaaggagg

SEQ ID NO: 576603 - RNA, 65 nt, hsa
uagcauugugugauaagcacuaagcagucaguccccugggggaaucuggcauaauucggcuauaa

SEQ ID NO: 576604 - RNA, 65 nt, hsa
ggaaggugacuucucucuguuugucuuaaguugcacugggggauuucugacuugaggcccaucuc

SEQ ID NO: 576605 - RNA, 65 nt, hsa
ucuggcucugugggucccugggcucuggacaagcacugggggacgugcccccagagccacccacu

SEQ ID NO: 576606 - RNA, 65 nt, hsa
uuccaggguucuuguggcuguugucagagcaggagcugggggagggaagacuuguucucucuuuc

SEQ ID NO: 576607 - RNA, 65 nt, hsa
cugcagggccagaaguucaggcugccccgccuccacugggggaucgcaccugugaauuaccugag

SEQ ID NO: 576608 - RNA, 65 nt, hsa
aagaaaacaaaacuggacagaaacaggaaugugagcugggggagcuggcuugaguuucucaaaag

SEQ ID NO: 576609 - RNA, 65 nt, hsa
ugcugacaugagccucagagaccccaaucccaugccugggggagagacagcggcucaggaguggg

SEQ ID NO: 576610 - RNA, 65 nt, hsa
ugccccuuguugguacauuccagaggcgcaggggccugggggauaugaagcuagggaagccccug

SEQ ID NO: 576611 - RNA, 65 nt, hsa
ugcagugagccaugaguaugccacugcacuccagccugggggacagagcaagacccugccucaaa

SEQ ID NO: 576612 - RNA, 65 nt, hsa
cccucaggcagcaugcuuagggacaacucuguggccugggggacaucugugucacaguauaggau

SEQ ID NO: 576613 - RNA, 65 nt, hsa
cacaccaagaacagcuuuugagucuguauccuccacugggggaagugcucccaguucagaacaag

SEQ ID NO: 576614 - RNA, 65 nt, hsa
ucccagcgaugcgucagaucuuacguggcuuccugcugggggagauggccuucacccacgggaug

SEQ ID NO: 576615 - RNA, 65 nt, hsa
ucgacauugagccuucgaguggccagcuucacucucugggggagugcaggguggacaucaccuug

SEQ ID NO: 576616 - RNA, 65 nt, hsa
ccuguaggaaauggugaagcauagcucugggucuccugggggagaccaggcuuggcugcgggaga

SEQ ID NO: 576617 - RNA, 65 nt, hsa
gcagugaacccccucagaucaguagaauauaguaucugggggagaagacuuacuuccuucagggc

SEQ ID NO: 576618 - RNA, 65 nt, hsa
gagcuguagacguacgcucaggcgcuccugcuguccugggggagagaagguucgccccuccccga

SEQ ID NO: 576619 - RNA, 65 nt, hsa
ugaggcgacuagggcaccauacucacuuuccagggcugggggaagggggacgcaggaucaucccc

SEQ ID NO: 576620 - RNA, 65 nt, hsa
cacccagaguagccaugaggaggcagagagggucacugggggacacuguggcagcaggagggacu

SEQ ID NO: 576621 - RNA, 65 nt, hsa
cuccagcagacucuccagcccucuuccuccuuccucugggggaggagggguuccugagggaccug

SEQ ID NO: 576622 - RNA, 65 nt, hsa
cugguguucccaugcacagggccauucaggaagggcugggggaguguguguggcaauaaagcuug

SEQ ID NO: 576623 - RNA, 65 nt, hsa
ugcagaaugcagucaucagaccugaaaaaacaacacugggggagggggacggugaaggccaaguu

SEQ ID NO: 576624 - RNA, 65 nt, hsa
aucuauuuuguuuaccuacuguaucaaaggggagucugggggagaaugguaguauuuuuuuuuuu

SEQ ID NO: 576625 - RNA, 65 nt, hsa
auccugcugccaaggguggacacggcugcagacuucugggggaauugucgccuccugcucuuuug

SEQ ID NO: 576626 - RNA, 65 nt, hsa
ccaaccugacaguccaggagauggacuggcuggugcugggggagcugcagauggcccuggagugg

SEQ ID NO: 576627 - RNA, 65 nt, hsa
cccucucaacaguggggucgggggcccacccccagcugggggaccccaugcaggcugaugggccc

SEQ ID NO: 576628 - RNA, 65 nt, hsa
cagggccugcccauccagaagggacuccccagggccugggggaggagacccuuggaaaaguccuc

SEQ ID NO: 576629 - RNA, 65 nt, hsa
gcaauagaaugaaccagaacuaguggauuccagggcugggggaaaaaaaaaaagaaaaaaccuca

SEQ ID NO: 576630 - RNA, 65 nt, hsa
ccuguggaaugagugugcauggaggcccuccugugcugggggaaugagcccagagaacagcgaag

SEQ ID NO: 576631 - RNA, 65 nt, hsa
auuacccacccgaccuggcugccccucaccuugggcugggggacuggggggccauuuccuuuucu

SEQ ID NO: 576632 - RNA, 65 nt, hsa
agggggcaccccaaagagggggcacugccagguagcugggggaguggcauggggcaggggcccag

SEQ ID NO: 576633 - RNA, 65 nt, hsa
accccaaaucccccgacucccuccccagaucuguccugggggaugcaaauaaagccugcucuccc

SEQ ID NO: 576634 - RNA, 65 nt, hsa
ggaacgggucacccugcugaagaucacucugugcccugggggaggagccaagcccucaccccaca

SEQ ID NO: 576635 - RNA, 65 nt, hsa
acccugaaugcauuggccggugcccggcucauggucugggggaugcaggcaggggaagggcagag

SEQ ID NO: 576636 - RNA, 65 nt, hsa
caagagccccgugcauccaggcggccaagcacaaacugggggagaggaggccgccagcccggagg

SEQ ID NO: 576637 - RNA, 65 nt, hsa
aaauuuaauggcgacuuggggggaagggagccacccugggggagucugaggaguucagacugugc

SEQ ID NO: 576638 - RNA, 65 nt, hsa
auuguauuugugguguugccuugccuugcaugaugcugggggaaaaagagaaaagaaaugguuuu

SEQ ID NO: 576639 - RNA, 65 nt, hsa
guuccugucuucuguuuuauagaaauugaucuucccugggggacuuuaacucuugaccuguaugc

SEQ ID NO: 576640 - RNA, 65 nt, hsa
cauagcuggggguuggggguggugggggucggggccugggggacugggagccgcagcagcucccc

SEQ ID NO: 576641 - RNA, 65 nt, hsa
uguauuacugcuucccauugaguaaucauacucaacugggggaaggggugcuccuuaaauauaua

SEQ ID NO: 576642 - RNA, 65 nt, hsa
ccaccuuggauggugucaguuacaccuucaaugggcugggggacuuccugcuggucggggcccaa

SEQ ID NO: 576643 - RNA, 65 nt, hsa
caaaggaaagacaacuggggaaagaagaccuaggacugggggaacccaaacagccuguccugcaa

SEQ ID NO: 576644 - RNA, 65 nt, hsa
ugaggucagcacuugggcccacugacagugacugacugggggagaagguccugcagcccccuucc

SEQ ID NO: 576645 - RNA, 65 nt, hsa
ccacccugccccuuguccucucagagccucagcuucugggggagacaugcucuccccacaggggg

SEQ ID NO: 576646 - RNA, 65 nt, hsa
ggucacugcuacaccuuagcagcucuuccccuuuccugggggaugugcacggcagcuugagccug

SEQ ID NO: 576647 - RNA, 65 nt, hsa
ccugucacguggucaaggcccggccccaucagaggcugggggaggcggcacauuggcaguguguc

SEQ ID NO: 576648 - RNA, 65 nt, hsa
agaaauaaacauaagacguauguaaacaaaaacaacugggggaaucaaaucaaacaguuggauuc

SEQ ID NO: 576649 - RNA, 65 nt, hsa
ugcuuugucagagauggguguggauuuagguuauacugggggagaacuuuucucagcacagauuc

SEQ ID NO: 576650 - RNA, 65 nt, hsa
ugcguguuguauucagcacuaaaaaauggugggagcugggggagaaugaagacuguuaaaugaaa

SEQ ID NO: 576651 - RNA, 65 nt, hsa
aacauguggauaggcuauagcuguucagaggucuccugggggagcuuaaaacgggggaaacacug

SEQ ID NO: 576652 - RNA, 65 nt, hsa
cuuccuaguaauuuugacuuggauuauuuucuagccugggggaugggguucauauguguuguugu

SEQ ID NO: 576653 - RNA, 65 nt, hsa
gcaaagaguuaauauauagaaggguaccuugaacacugggggaggggacauugaacaaguuguuu

SEQ ID NO: 576654 - RNA, 65 nt, hsa
ggauaaagaccuuccagcuccuguguucuagaccucugggggauaagggaguccaggguggauga

SEQ ID NO: 576655 - RNA, 65 nt, hsa
acuuaugagcaauacucuguggaggucugguggggcugggggagcacccaggcggaucugcaagc

SEQ ID NO: 576656 - RNA, 65 nt, hsa
ccgggagggcagagccagaagaaggcucauuagaccugggggacccaaagggucuggccucuuug

SEQ ID NO: 576657 - RNA, 65 nt, hsa
auucacuguguuauuugguuuaaaucaaagugauucugggggaagcuaugcucuuucaguggaua

SEQ ID NO: 576658 - RNA, 65 nt, hsa
ccuuuuagaggucuuacugcaauaagaaguaaugccugggggacgguaauccuaauaggacgucc

SEQ ID NO: 576659 - RNA, 65 nt, hsa
gggggccgcuggaggaagggcagccgacccggccgcugggggaagugccaggggcccggggcacc

SEQ ID NO: 576660 - RNA, 65 nt, hsa
uagcugucccaggcgucacaacccauccucccaggcugggggagaaaggaccuccuggaacugac

SEQ ID NO: 576661 - RNA, 65 nt, hsa
ugcuuccuggaguggauguggcccagagaaggaggcugggggaucaccagccccaaggucccgaa

SEQ ID NO: 576662 - RNA, 65 nt, hsa
aacugugcuacugaagggaacugccuuucccccuucugggggagacuuaacagagcguggaaggg

SEQ ID NO: 576663 - RNA, 65 nt, hsa
ugcagugagccgagauggcgccacugcacuccagccugggggacagagcgagacuccaucucaaa

SEQ ID NO: 576664 - RNA, 65 nt, hsa
caaaccaccuguuuccccuuccauuagcagaaacucugggggaacuuugugucucaguccuagaa

SEQ ID NO: 576665 - RNA, 65 nt, hsa
gguuuggaaauaaguggaaaauacgggauguaccccugggggaaaagccuggguuggguuuagaa

SEQ ID NO: 576666 - RNA, 65 nt, hsa
agcuguugucaucacugagucagcacucaccuggccugggggaauuaaaggaauuccccguaagg

SEQ ID NO: 576667 - RNA, 65 nt, hsa
cagaugaauguauuuauuugggagaccgggguauccugggggacccaauguaggagcugccuugg

SEQ ID NO: 576668 - RNA, 65 nt, hsa
cccuucuccccugugccguaguuugucuccugggacugggggaggaguccgaggugggguugguu

SEQ ID NO: 576669 - RNA, 65 nt, hsa
uauccccauccucugccucaucguuccccugagcacugggggacagacccucacccccacccugg

SEQ ID NO: 576670 - RNA, 65 nt, hsa
ggguguuggggggcccccuuccaugacucuguccccugggggagguaggacagggcugggcuucc

SEQ ID NO: 576671 - RNA, 65 nt, hsa
aacuccaagcacuacauuuuggcggcugccggccucugggggagguggcaguuaugcuguuacua

SEQ ID NO: 576672 - RNA, 65 nt, hsa
ggcccagccaccuccucagccccaugugaugcucccugggggagcccuacuccccuugcuacaug

SEQ ID NO: 576673 - RNA, 65 nt, hsa
gaggcagccaugggaaggagcccaggggagcuggccugggggagcgaagcccauguucgcuuccu

SEQ ID NO: 576674 - RNA, 65 nt, hsa
gggcccugccccccucccuuccgcuccugcccagccugggggaaggagaaaggaggggagaaagc

SEQ ID NO: 576675 - RNA, 65 nt, hsa
caaucccagugcugcaaucacacauccauucugcccugggggacccuggagccuacuugugcgcu

SEQ ID NO: 576676 - RNA, 57 nt, hsa; identical to SEQ ID NO: 284073

SEQ ID NO: 576677 - RNA, 65 nt, hsa
agccacaaaguaaacuucauuuucaggcaguguuucugggggagguuauggagggaagaaaaaag

SEQ ID NO: 576678 - RNA, 65 nt, hsa
ucuucuuugugaaccugugaguacuccacaguuuacugggggaaaaggcuucaguaaagcagagg

SEQ ID NO: 576679 - RNA, 65 nt, hsa
cgcacagcagugaucaagugucaucccuuacgugacugggggaugucuguccuaaaagcugacug

SEQ ID NO: 576680 - RNA, 65 nt, hsa
cugaccguaaguaaaaacacacagaauuguguugacugggggaggugaaucacaaaaaaguuacg

SEQ ID NO: 576681 - RNA, 65 nt, hsa
gggacagaccagcccuuccccauccugggguugcccugggggauaccagcugagucugaauucug

SEQ ID NO: 576682 - RNA, 65 nt, hsa
ugugagaguggcuuucuaccacacacagccugucccugggggaguaauucugucauuccuaaaac

SEQ ID NO: 576683 - RNA, 65 nt, hsa
ucaugauuacaauuuuuuccuuugcagaugccuuccugggggauacuccuccccacccuaaaggg

SEQ ID NO: 576684 - RNA, 65 nt, hsa
uccuagccucagcccccagcugggucucagaggagcugggggagcgguggccagcccauuuucug

SEQ ID NO: 576685 - RNA, 65 nt, hsa
cauccuguuguauacuaggagagaacuuaacccaccugggggaaaauagcuccccaagagcuggc

SEQ ID NO: 576686 - RNA, 65 nt, hsa
ggauguggggagaguggaagaggcagggaguaauccugggggacagcagggaggaggcacuucuu

SEQ ID NO: 576687 - RNA, 65 nt, hsa
ucaguagcacaaguuauuuaaaucuguuuuucuaacugggggaaaagauucccacccaauucaaa

SEQ ID NO: 576688 - RNA, 65 nt, hsa
ugcagugagccaugaucauuccacugcauuucagccugggggauacagugagaccuugucuuuaa

SEQ ID NO: 576689 - RNA, 65 nt, hsa
ugcagugagccaagaucacgccauugcacuccagccugggggacagagcaagacucuaucuccaa

SEQ ID NO: 576690 - RNA, 65 nt, hsa
guagccagggcggccgggcgccccaucgccacauccugggggagcauacccagugucuaccuuca

SEQ ID NO: 576691 - RNA, 65 nt, hsa
agcagggcugagggggugcagcuugcugguguucacugggggagggccugugggcacacauggca

SEQ ID NO: 576692 - RNA, 65 nt, hsa
auguuuaggacuucaagaucacacuugugggcaaucugggggagccacaacuuuucaugaagugc

SEQ ID NO: 576693 - RNA, 65 nt, hsa
ccuugucccagauacucuaaaugugaauguaugagcugggggagucaacccagcccaccaugccu

SEQ ID NO: 576694 - RNA, 65 nt, hsa
gggccuucccagccagccagcaggagaggcaagaacugggggaacacaggaaccuaggggaggag

SEQ ID NO: 576695 - RNA, 65 nt, hsa
uggccaugugggggcagcaggggccugggccauagcugggggaggccagacccugagggcuuugc

SEQ ID NO: 576696 - RNA, 65 nt, hsa
caucaccaacuguccccugcgaggagaaaucacuccugggggagaaccacugacccaaaugaauu

SEQ ID NO: 576697 - RNA, 65 nt, hsa
aagaagaggcucaaaugcuguccccggcagcuuuccugggggacuagagcuccuucuggccaugu

SEQ ID NO: 576698 - RNA, 65 nt, hsa
aagccagccuuggcccugcagccuccaccucgccgcugggggaccaacagguugcuuacagcuuu

SEQ ID NO: 576699 - RNA, 65 nt, hsa
aauagaaccaaaaacgccagucaugggaggcagagcugggggagcgaggcugacaaugacuccug

SEQ ID NO: 576700 - RNA, 65 nt, hsa
agccucagccccuagccuggccucuuugcauggggcugggggagauggggcgcugggagugagug

SEQ ID NO: 576701 - RNA, 65 nt, hsa
uuuauguacaaacauguuguuuguuuuauuuggggcugggggagguauaugaugagcagacuucu

SEQ ID NO: 576702 - RNA, 57 nt, hsa
cgccuccugagcgagacuagggcugggcugggggagggcagggccggacggagugga

SEQ ID NO: 576703 - RNA, 65 nt, hsa
aauggccugcuuuaagggugcagccccucgcccgucugggggauggagggggguggcauugguuc

SEQ ID NO: 576704 - RNA, 65 nt, hsa
gcugccaagcaucaguguuagggcuggggcucagccugggggagccuacuggggacugagccccc

SEQ ID NO: 576705 - RNA, 65 nt, hsa
caugccuguaaacccagggcuuuagaaggcugaggcugggggauugcuugaagucaggaguucaa

SEQ ID NO: 576706 - RNA, 65 nt, hsa
uugcagaagaguaaacacucucggaugccgcuguccugggggagcccgcgggagccugugaaugu

SEQ ID NO: 576707 - RNA, 65 nt, hsa
cccugggugaugagcagcuuuuccccccuggcuuucugggggaggagugggccuccuuagggaga

SEQ ID NO: 576708 - RNA, 65 nt, hsa
cagaggccugguggcccugcugggcagcccaacugcugggggagacguuucugccacccugggug

SEQ ID NO: 576709 - RNA, 65 nt, hsa
aagccccggggggcagcaggugggcucgggacgggcugggggagggacggccauggcacuugggg

SEQ ID NO: 576710 - RNA, 65 nt, hsa
gccgcacagguguccugugcuuccugugagacuuccugggggaaauauacaaacuaauauauuuu

SEQ ID NO: 576711 - RNA, 65 nt, hsa
uuguguuugcuuggugcugguuuauuuguuguuuucugggggaaaaagccauaucaugcuaaaau

SEQ ID NO: 576712 - RNA, 65 nt, hsa
ugaaucuuuggggguugguuugaggucuuagaacucugggggauauuccccugagcaaaacaaac

SEQ ID NO: 576713 - RNA, 65 nt, hsa
uauggaggagggagcagauguaagcucccaagagccugggggaucacaggucccucugcaaaacu

SEQ ID NO: 576714 - RNA, 65 nt, hsa
ggagagacccucccacccagcagaccaggagauagcugggggacaagggcagacggccccugccu

SEQ ID NO: 576715 - RNA, 65 nt, hsa
gacuaacucagauggugcucggcuggacaaggggacugggggaggggccaaagcagggacagugg

SEQ ID NO: 576716 - RNA, 65 nt, hsa
uggcacagaaauuguuugggggauggggggggggacugggggagggguagcugcuaucuuugaga

SEQ ID NO: 576717 - RNA, 65 nt, hsa
agccccaggacaagugagcuggugucaccuccugccugggggaagagccaggcccugaggaacag

SEQ ID NO: 576718 - RNA, 65 nt, hsa
caccuuaacucacccaccacgaggcacuuuacagacugggggaggggguuuuucuuuuuauuuuu

SEQ ID NO: 576719 - RNA, 65 nt, hsa
gccaccgcaggggcccuccacauucuggccgguaacugggggaaggugauggggcgggggucccc

SEQ ID NO: 576720 - RNA, 65 nt, hsa
ugucugcagugaauguucaacaguuugcccaggaacugggggaucauauaugucuuaguggacag

SEQ ID NO: 576721 - RNA, 65 nt, hsa
aaagcgcagugcaugcugggugcaugaagggcagccugggggacagacuguugugggaacguccc

SEQ ID NO: 576722 - RNA, 65 nt, hsa
ugcccauuugggaaacugagcuucuuucuucugcacugggggacuggaugcuagccaucuccagg

SEQ ID NO: 576723 - RNA, 65 nt, hsa
cuuccuucacaugcucuuguuuuccagcugcuuuccugggggaucagacugugaagcaggaagac

SEQ ID NO: 576724 - RNA, 65 nt, hsa
ugaaaacucuaaaaagccauugaugagauguauagcugggggacaaaacauaaagccaucaagca

SEQ ID NO: 576725 - RNA, 65 nt, hsa
aguacacucacuagggggcagggcgcugcugguuccugggggacugggugggaagggugguggga

SEQ ID NO: 576726 - RNA, 65 nt, hsa
cccugacaucccuuuccacugugugugugaccaugcugggggagggggacucugcuuggaauuaa

SEQ ID NO: 576727 - RNA, 65 nt, hsa
acuuccugaagauggagccucaggagguggagucccugggggagaccuaugacuucgacagcauc

SEQ ID NO: 576728 - RNA, 65 nt, hsa
gugguacugccacucugcagguggagcgggugacucugggggaccauuaagaccuccagaccggg

SEQ ID NO: 576729 - RNA, 65 nt, hsa
cucuucugaaauaaugcauccaaaggguugauauucugggggaggucacugcagaaggauggaac

SEQ ID NO: 576730 - RNA, 65 nt, hsa
uggcacaggcucugcuagguuccggacacaggcuucugggggaagggucucccuuggccaucacg

SEQ ID NO: 576731 - RNA, 65 nt, hsa
agaaagcuuuuugacugugaaggcagaggucagcacugggggaaacuugcugguggucucuccca

SEQ ID NO: 576732 - RNA, 65 nt, hsa
uacaugcacacacuugcauacauauauauuuuuggcugggggagugugaguuuugccuuucuaag

SEQ ID NO: 576733 - RNA, 65 nt, hsa
gccacgugaaaggcagcucuagacaucaaccaguccugggggaggggagugggaaccgggcacaa

SEQ ID NO: 576734 - RNA, 65 nt, hsa
uuaacagccuuuagaagccgcugcugaaauugauacugggggaaggguuccccuuccuucuagag

SEQ ID NO: 576735 - RNA, 65 nt, hsa
gccgcaccugcagcuccagggaguuaacucuucuucugggggacugagaacuguagaaagccaca

SEQ ID NO: 576736 - RNA, 65 nt, hsa
gagaugcuuccgaccuuucaggugacgcaggaacacugggggagucugaaugauuggggugaaga

SEQ ID NO: 576737 - RNA, 65 nt, hsa
gagggaggcugucgucgcccccaggaaagacgggccugggggaggcgggacagugggagaggcgc

SEQ ID NO: 576738 - RNA, 65 nt, hsa
cggccugggucuugcuggacgaguguggccuagagcugggggaggacacuccccacgugugcugg

SEQ ID NO: 576739 - RNA, 65 nt, hsa
cuccaggcccagcggaugcuggcacccaagcgcagcugggggaccccucagcuccgucucagagu

SEQ ID NO: 576740 - RNA, 65 nt, hsa
gcagcggccuccuguagcaccaucuugggaaaguccugggggacgugugugucgugcuuuuuacc

SEQ ID NO: 576741 - RNA, 65 nt, hsa
cucccacccuggucccaguuucccgcaaagugccucugggggaccccccagccucccacccuggu

SEQ ID NO: 576742 - RNA, 65 nt, hsa
ucagguggauggaagguucugggugcccgcaggggcugggggaugcuaggacugagacccugggu

SEQ ID NO: 576743 - RNA, 65 nt, hsa
cugguacuggacuaucuaccugccuugucccuguucugggggaagguguccaccccgaucaagaa

SEQ ID NO: 576744 - RNA, 65 nt, hsa
ggcuaacagucuagugcaaaagauuaagauuuuaucugggggaaagaaaagaauuuuuuaaaaaa

SEQ ID NO: 576745 - RNA, 65 nt, hsa
uucaauaacccuguaguggcuugaugcagggaacccugggggacuuucagcgaagagcugugcuc

SEQ ID NO: 576746 - RNA, 65 nt, hsa
gccuggcugcagagaggcggaggaggaagcuggcgcugggggaggcugagggugagggaacagcc

SEQ ID NO: 576747 - RNA, 65 nt, hsa
cuuuagucuccaauauggagcaucucaagcuucuccugggggauggggauugggaugggcagaau

SEQ ID NO: 576748 - RNA, 65 nt, hsa
gugcuggcucaggguucaucguucugccuuguccacugggggaccagcccugcagaccacucuga

SEQ ID NO: 576749 - RNA, 65 nt, hsa
gggcccgggacuguccguucucggggccagagcugcugggggaccgaguuuguacauuuuccauu

SEQ ID NO: 576750 - RNA, 65 nt, hsa
cugcaaccucaaaggagcaagccuugaaacaguugcugggggaaguggccagaguagagaugcug

SEQ ID NO: 576751 - RNA, 65 nt, hsa
acccccauaguuguauaaaggucauagugaagaagcugggggaagacugcuucagccagauccug

SEQ ID NO: 576752 - RNA, 65 nt, hsa
ccacagcaagauucuuucauucgucuccuccuagccugggggaccaggcucgaacugacccugga

SEQ ID NO: 576753 - RNA, 65 nt, hsa
auuuuuaaaaguuaaggggcaagcagcauugcauucugggggaacgauccuggccacagccgcca

SEQ ID NO: 576754 - RNA, 65 nt, hsa
gagcucccgccuugcgggcagugcuaaagguggagcugggggauuuuccugggaaugauuugagg

SEQ ID NO: 576755 - RNA, 65 nt, hsa
uggcggcugguguuggucagaugcaccugugugcacugggggagggaugguuugggcaggugcag

SEQ ID NO: 576756 - RNA, 65 nt, hsa
cucaccggaggcccggugaccacggaacucaccgucugggggaggaggagagaaggaaggggugg

SEQ ID NO: 576757 - RNA, 65 nt, hsa
cccagccagcucugccucucucagggccuggaguccugggggagcucagccagcucugccuuucu

SEQ ID NO: 576758 - RNA, 65 nt, hsa
acugggccacguacaagcagggcuucggcagucggcugggggaguucuggcuggggaaugacaac

SEQ ID NO: 576759 - RNA, 65 nt, hsa
agcugaggaggggugggggccguuuguucaguuaccugggggaaccucacccagcacccugcccc

SEQ ID NO: 576760 - RNA, 65 nt, hsa
ggcuaggguggucagaggaagccagcagggaagaucugggggacagaggaaggccuccugaggga

SEQ ID NO: 576761 - RNA, 65 nt, hsa
caaaagcacauuagagacuaacuguaacuuaagugcugggggaaaaaaaaugugaacuaacuuau

SEQ ID NO: 576762 - RNA, 65 nt, hsa
guaggagauguuuaggucucuuuauuuagugcaaucugggggauggcaacagagaaagaggaaag

SEQ ID NO: 576763 - RNA, 65 nt, hsa
cuuucccagccugagagaugcucaaagguggggagcugggggagccaccccucggccauucccuc

SEQ ID NO: 576764 - RNA, 65 nt, hsa
cuggcugugaccccucaggcuagcccuucuccacucugggggaggaggugggaagggccaccagg

SEQ ID NO: 576765 - RNA, 65 nt, hsa
agcaguauucuccuggauccuggggccugggugggcugggggacagcugaggaugggccuagcag

SEQ ID NO: 576766 - RNA, 65 nt, hsa
ccuggccuugcuggaauggaggcauccuuccaaaccugggggacggggguggggggugguagugg

SEQ ID NO: 576767 - RNA, 65 nt, hsa
uuguaaaauuuuuugugagcacuuugagauuuuugcugggggagggguguuuugugaaagugaug

SEQ ID NO: 576768 - RNA, 65 nt, hsa
cgugaccugucuggcucaggaaugggcucuggcugcugggggagccgugucacuccugggccaug

SEQ ID NO: 576769 - RNA, 65 nt, hsa
uugugaagggucagacacagucuacccaggggugucugggggacaagggggucucuggagauguc

SEQ ID NO: 576770 - RNA, 65 nt, hsa
gggaaguguccugagugaaggaggggacccccauccugggggaugcugggagugagugagugaga

SEQ ID NO: 576771 - RNA, 65 nt, hsa
acugcuuagugcuucagcugucccuuccuuguguccugggggaccugcuggcggccucuuccugg

SEQ ID NO: 576772 - RNA, 65 nt, hsa
cugaaccucaccaaacugaggccagagcugagcuccugggggaguuaauucagaggggagaggcc

SEQ ID NO: 576773 - RNA, 65 nt, hsa
ugaagaaaucuugaguuaagugaguucugaggcugcugggggaaccagaucaauucaaagcuaaa

SEQ ID NO: 576774 - RNA, 65 nt, hsa
ggagaauauucagcauaaugcuggcucuuguuucacugggggaaacaaguuauucucaaauauuu

SEQ ID NO: 576775 - RNA, 65 nt, hsa
gacacagcuacacgcccauuaaagcacagcacguccugggggaggggggcauuuuuuauguuaca

SEQ ID NO: 576776 - RNA, 65 nt, hsa
ugaagguagacaccagccagcaugguggcccuguucugggggagcaggguaaggcaggaggaagu

SEQ ID NO: 576777 - RNA, 65 nt, hsa
ugcagugagcugugaucgugccacugaccuccagccugggggacagagcaagaccgugucucaaa

SEQ ID NO: 576778 - RNA, 65 nt, hsa
agcugcuuugagcuccuggacucaccugaggcucccugggggaugacacucaguucugucacugu

SEQ ID NO: 576779 - RNA, 65 nt, hsa
aucacaggaucuccugggccuuggagcaccucacgcugggggaaucaaucccugagggacucaga

SEQ ID NO: 576780 - RNA, 65 nt, hsa
agcccuugggugcggggucucugugcacuugagagcugggggacccacccaccgucucccacucc

SEQ ID NO: 576781 - RNA, 65 nt, hsa
cugucggacgcagcggcuucgggaacaaguuagcgcugggggacuaucugggcucgucucucucu

SEQ ID NO: 576782 - RNA, 65 nt, hsa
uaccgguuacauuauuaaaugauucuagggauucacugggggauauuuuuguugcuuuuacuuuc

SEQ ID NO: 576783 - RNA, 65 nt, hsa
uacacauuuuuaacuuuaugaccagccuaaauauucugggggaagugggguauaauauuuaacga

SEQ ID NO: 576784 - RNA, 65 nt, hsa
caacaagcaauuaagagcaguuauaauagaggaagcugggggacccauuuugcaccaugaguuug

SEQ ID NO: 576785 - RNA, 65 nt, hsa
ccacuggugacugcuggugggcaggcuggcccugccugggggaguccguggcgaugggcgcuggg

SEQ ID NO: 576786 - RNA, 55 nt, hsa; identical to SEQ ID NO: 284091

SEQ ID NO: 576787 - RNA, 65 nt, hsa
gaaaccacagcauugguuuuuuucuacuugugugucugggggaaugaacgcacagaucuguuuga

SEQ ID NO: 576788 - RNA, 65 nt, hsa
ccuuggcugccccaggccuccuuggcccaugggugcugggggagguggaugucagaucugguagg

SEQ ID NO: 576789 - RNA, 65 nt, hsa
gucggcucagcaggaggaggcuguggcugcagagccugggggagcuuuuagguguugagaugggg

SEQ ID NO: 576790 - RNA, 65 nt, hsa
aauguaaaacucgcagcagauaucagugggaagggcugggggagggggcacccagcugccuuucc

SEQ ID NO: 576791 - RNA, 65 nt, hsa
cuacagaaucagggaaagaaccauuaggaguggaacugggggaaucugaguugugucacuucagu

SEQ ID NO: 576792 - RNA, 65 nt, hsa
gcaggaggggcgaccagauaaggagccccucucugcugggggagaagggaagacgaggaacccca

SEQ ID NO: 576793 - RNA, 65 nt, hsa
uauauaugggacuugagcauuuguggauuuugauacugggggauccuggaaccaaucccccaugg

SEQ ID NO: 576794 - RNA, 65 nt, hsa
aauaugcugcaccauugcugaaaugaaagaugacucugggggagcagagcuuggccuugugccca

SEQ ID NO: 576795 - RNA, 65 nt, hsa
gacugaucucuuccuugcagggaacagcuuuggggcugggggaacuagaacccacauguuggucu

SEQ ID NO: 576796 - RNA, 65 nt, hsa
augagcugugcgcugcucugcaggcuggggaggugcugggggagcccuggguuccgguuguugau

SEQ ID NO: 576797 - RNA, 65 nt, hsa
ggugucgggucccagagagggagcccaccugcugccugggggagagccuggccuggccgcgucau

SEQ ID NO: 576798 - RNA, 65 nt, hsa
agaugaacaccacuucuacacaacccuccuugguacugggggagggagagaucugacaaauacug

SEQ ID NO: 576799 - RNA, 63 nt, hsa
gccccgaugagggguccugaggaggggauggggcugggggaugggccugagugagaggggagg

SEQ ID NO: 576800 - RNA, 65 nt, hsa
gacucaagacugacucugauaguguagcauuuucccugggggaguuuugguuuuaauuagauggu

SEQ ID NO: 576801 - RNA, 65 nt, hsa
ucuaggauuccugccacuuuggucccuggccucuccugggggaggcugcuguucuuaggugcucu

SEQ ID NO: 576802 - RNA, 65 nt, hsa
cuagugccucugaggcagaaccaaaggagccugcacugggggaaaucccuuuuccugccugccug

SEQ ID NO: 576803 - RNA, 65 nt, hsa
ugcagugagcugagaucgugcuacugcacuccagccugggggacagaaagagacuccgucucaaa

SEQ ID NO: 576804 - RNA, 65 nt, hsa
ucuguugacacucaugauucugaauguugccugggcugggggaguaccuguagcacgccagugcu

SEQ ID NO: 576805 - RNA, 65 nt, hsa
ccacccuuggaccugacucagcuaacaaucuagcccugggggaaugugaucuaccugaugcgacc

SEQ ID NO: 576806 - RNA, 65 nt, hsa
uggaguugcaccgcggcagcuccauggaaaucaaucugggggagaaggacacugcaucccagauc

SEQ ID NO: 576807 - RNA, 65 nt, hsa
guucuuccagguggcucccgcugaggcagcggucucugggggaucccccagcugaaggaggcugg

SEQ ID NO: 576808 - RNA, 65 nt, hsa
ccugcccuguccaggugggaagcugagucccagugcugggggacuguggccugggcugaucuuga

SEQ ID NO: 576809 - RNA, 65 nt, hsa
caaagacccguguuggggguacugaaggagaggcccugggggacccucugaagcauuucugccuc

SEQ ID NO: 576810 - RNA, 65 nt, hsa
gcuugcauaaaggagaaaacaacucuauguacaugcugggggagagugccuaaugugggagacca

SEQ ID NO: 576811 - RNA, 65 nt, hsa
uggccugaacucugugauagagugugacugagcugcugggggacaugugagccucaaauccauag

SEQ ID NO: 576812 - RNA, 65 nt, hsa
cucacagucaccgcaggugcaggcaggaagcagcccugggggacuggacgcugcuauugauucau

SEQ ID NO: 576813 - RNA, 65 nt, hsa
aagcuuuuccgaugucacaauguggaggaaagcaccugggggacaacagugcucgugcagguggg

SEQ ID NO: 576814 - RNA, 65 nt, hsa
gauauucagauggagcacugucacuuagacauucucugggggauuuucugcuugucuuucuugag

SEQ ID NO: 576815 - RNA, 65 nt, hsa
ggccacacuguccuguuggcaucacagccccaaggcugggggaacuucaugcugggacaagcagc

SEQ ID NO: 576816 - RNA, 65 nt, hsa
gcccuagcauaggaaaagcuuccuugaugugagcucugggggagugugaaggaugcaucucuagc

SEQ ID NO: 576817 - RNA, 65 nt, hsa
ucuuuugcuauuaaaacuacuguucauuuugggggcugggggaagugagccuguuuggaugaugg

SEQ ID NO: 576818 - RNA, 65 nt, hsa
aaggggugcaagaggaaggagugugcccagaccagcugggggagcauugaaaggacagcuugggg

SEQ ID NO: 576819 - RNA, 65 nt, hsa
ucaggguugccgcagugucaccucaguggaccagccugggggaaggagcuuaauugcugagacau

SEQ ID NO: 576820 - RNA, 65 nt, hsa
cccugagcccucccagggacccuccacgaccagcucugggggaggcacaggcccucauccacccu

SEQ ID NO: 576821 - RNA, 65 nt, hsa
aaagguuccuuuguucccuaaguccaacuacuaaacugggggauauuaugaagggccuugagcau

SEQ ID NO: 576822 - RNA, 65 nt, hsa
uuccucuggcccagugaauuuggucucucccagcucugggggacuccuuccuugaacccuaauaa

SEQ ID NO: 576823 - RNA, 65 nt, hsa
ucagugccucaggaucuuauggcuccuuccuccagcugggggacucuuaaaggggcugggguaga

SEQ ID NO: 576824 - RNA, 65 nt, hsa
agccuuggcagacccuugacuccaggggagaugaccugggggaggaagugugucaacuauuucuu

SEQ ID NO: 576825 - RNA, 65 nt, hsa
gcucaggagugggcagcagucagggagagacagaacugggggaaagggaugguugugggucuuuc

SEQ ID NO: 576826 - RNA, 65 nt, hsa
aagcagucuauaccagcaugaguacugccccaccccugggggaaaccuggcuccaaccaaccccu

SEQ ID NO: 576827 - RNA, 65 nt, hsa
guuccuuaacugcugagccucagccagcguggguccugggggaaauaccauuccaaaggaagcca

SEQ ID NO: 576828 - RNA, 65 nt, hsa
ccaccaccuuugucugauacuuguuuccagggaagcugggggaacugccacaucugaggaacugg

SEQ ID NO: 576829 - RNA, 65 nt, hsa
ccuaggacccaggggagguuuagggguccuaucuccugggggaaggggagaucuaagauguccca

SEQ ID NO: 576830 - RNA, 65 nt, hsa
ccugccagggcugcaaagcaaggucuugcuucuaucugggggacgcugcucgagagaggccaaga

SEQ ID NO: 576831 - RNA, 65 nt, hsa
gaggaccacuacuauacugauggugggauugggaccugggggauacaggggccccaggaagaagc

SEQ ID NO: 576832 - RNA, 65 nt, hsa
gagaaugaaacuuguggagagcuuauacagagccucugggggaaaaaagagcccuuauuuguggg

SEQ ID NO: 576833 - RNA, 65 nt, hsa
cuugaaggggagacucccuccucuguaacuucuuucugggggauuggggugggcaguaccuaucc

SEQ ID NO: 576834 - RNA, 65 nt, hsa
aaacaacuugguugugaaccaacugccuuaaccuucugggggagggggauuagcuagacuaggag

SEQ ID NO: 576835 - RNA, 65 nt, hsa
gaugguggcuuuaggggaagggggaaagguguaggcugggggauugagguggggaaucauuuuag

SEQ ID NO: 576836 - RNA, 65 nt, hsa
gaagccugcguugguccagagcggaggcugugugccugggggaguuuuccucuauacaucucucc

SEQ ID NO: 576837 - RNA, 65 nt, hsa
uaaaccaagaaggagaccuuuucacaauggaaaaccugggggauggucagagcccagucgagacc

SEQ ID NO: 576838 - RNA, 65 nt, hsa
aguucaguaaacagacuguagagugucugacuauacugggggaagaggagccaaugacaggguag

SEQ ID NO: 576839 - RNA, 65 nt, hsa
acgcauuacuagaaucauuucauuauuucugcuuccugggggaaggaugcagaaggagucugaug

SEQ ID NO: 576840 - RNA, 65 nt, hsa
uguauucacccaggcuuccuucucaguagcucuagcugggggaggugucagcugggccccuccug

SEQ ID NO: 576841 - RNA, 52 nt, hsa
ccacugggaguagcggcuaaagcugggggauagaggggcugcagggccacug

SEQ ID NO: 576842 - RNA, 65 nt, hsa
cugcucucccaucaagcuucagaugccauguuguacugggggaauguagcccuugugcuccccac

SEQ ID NO: 576843 - RNA, 65 nt, hsa
ggaaggagguuuccaguucauuuacauuaagggcccugggggagaauaaagcucagagcaggagg

SEQ ID NO: 576844 - RNA, 65 nt, hsa
ucuacguuccugcccuuuacuauugcugauggagccugggggaaccaucacuuuuuuugugugcu

SEQ ID NO: 576845 - RNA, 65 nt, hsa
cacagcaacccagagauggccaaaagcauucaagccugggggaagauguuugacuauugcugcuc

SEQ ID NO: 576846 - RNA, 65 nt, hsa
ccagcuggaggccaggcccaggugcgugccuuguccugggggauugaccaucaugucuucccugc

SEQ ID NO: 576847 - RNA, 61 nt, hsa
auccuccaaaagacagaugaugcggagguuccugggggaaucaaagagaaaugugccucau

SEQ ID NO: 576848 - RNA, 65 nt, hsa
aaggucugcuugcaaaguuggcccuuggcuggcaucugggggaacuugguucuuggauggauucc

SEQ ID NO: 576849 - RNA, 65 nt, hsa
gaaguagcagucgcuggcagagcacacaggcugcucugggggaugagcuggugcguuuaaggaac

SEQ ID NO: 576850 - RNA, 65 nt, hsa
ccuggccacagagggcaaggacugugccggagucccugggggaggugcuggcgcgggaugaggac

SEQ ID NO: 576851 - RNA, 65 nt, hsa
caucuuccauguuguaaaggaacagccccagugcacugggggaggggagggagugaggggcagug

SEQ ID NO: 576852 - RNA, 65 nt, hsa
gcugccucucccaccacaagcccagaguggaugggcugggggaggggugcuguuuuaauuucuaa

SEQ ID NO: 576853 - RNA, 65 nt, hsa
ucuaagucauguauaggcuaagauuuuaagaagaucugggggaauaaaaagccaacaguaagccc

SEQ ID NO: 576854 - RNA, 65 nt, hsa
uucauaaggccaugcuccugacaggucuaggcaaccugggggaugacuuagguuaaugugcuagg

SEQ ID NO: 576855 - RNA, 65 nt, hsa
ccccacucucauuccccagguggcugacccagucccugggggaagcccuggauuucagaaagagc

SEQ ID NO: 576856 - RNA, 65 nt, hsa
aucaaaagaccuuuuucagguucuuucacuauugucugggggacucagaacaagauuguucucug

SEQ ID NO: 576857 - RNA, 51 nt, hsa
guggagagaagaagcccugagcugggggaaggggucaugcagcaccagggg

SEQ ID NO: 576858 - RNA, 65 nt, hsa
aggggcgccuguggggagggaaccaggaggccacacugggggagcgugcagccagcaugugcagu

SEQ ID NO: 576859 - RNA, 65 nt, hsa
gagugaggugugauugggcccuccggcuggauguucugggggaggaggcaaucgcuguagcugcc

SEQ ID NO: 576860 - RNA, 65 nt, hsa
ggagcaaauuaaacaauaaaccagacagcaaggcccugggggaaaggacaacauccugaaauaaa

SEQ ID NO: 576861 - RNA, 65 nt, hsa
ucuagaaauagaggcucccaaaguagggaaggcagcugggggaggguucagggcagcaaugcuga

SEQ ID NO: 576862 - RNA, 65 nt, hsa
ggcagcagacugaccaucucccagaccgccagugacugggggaggaccugcucugcccucucccc

SEQ ID NO: 576863 - RNA, 65 nt, hsa
gugauguaggggucuggucuccucagccuccucaucugggggaguggaauaguauccuccagguu

SEQ ID NO: 576864 - RNA, 65 nt, hsa
uggacugcagaacaaaccguggggcucucuggggucugggggaauacgggcaacagcagucagga

SEQ ID NO: 576865 - RNA, 65 nt, hsa
guugguuaucaucagaagguggucuccccucaggccugggggauaaggacgugggcccagccaca

SEQ ID NO: 576866 - RNA, 65 nt, hsa
gagggaacauuuccuuagauguuacccagaugguucugggggagacagaaaagaggugcggcagg

SEQ ID NO: 576867 - RNA, 65 nt, hsa
uugguuuuguuuuguugccaacgaggaacacagcucugggggaauggugucauccaccucgcuuu

SEQ ID NO: 576868 - RNA, 65 nt, hsa
uccucccacuggacaugguugcagcugggagugggcugggggaggggaacaggaugcccagccca

SEQ ID NO: 576869 - RNA, 65 nt, hsa
cacguuuuuauggaucugcaccagacuguuaccuucugggggagauggagauuugacuguuuaaa

SEQ ID NO: 576870 - RNA, 65 nt, hsa
uugauauuuauuguacuaagaguugucaaugcucccugggggagcccucggaaucuauuuaauaa

SEQ ID NO: 576871 - RNA, 65 nt, hsa
aagccagucucacugugaaccacacgaaaccucaacugggggagugaggggcuggccaggucugg

SEQ ID NO: 576872 - RNA, 65 nt, hsa
ucugagccaggagugaauggcccuuccuuaguagccugggggauguccagagacuaggccucucc

SEQ ID NO: 576873 - RNA, 65 nt, hsa
acuuagaaauugagcucuuacucucuucuguaauacugggggaccuacagcugccguggggcuga

SEQ ID NO: 576874 - RNA, 65 nt, hsa
aguaacuuaguaaaauugaccuucgcaaaaccucacugggggagugccuuguagagcugugggug

SEQ ID NO: 576875 - RNA, 65 nt, hsa
uaguugugccucagacuuggggguugcauguggcccugggggaguuacuacccuugguaugcaug

SEQ ID NO: 576876 - RNA, 65 nt, hsa
cuacauggcagggagggcugcacugacauugaugccugggggaccuuuugccucgaggcugagcu

SEQ ID NO: 576877 - RNA, 65 nt, hsa
aguuuaggggcacaggagauguagucguuccagggcugggggaggugggagggaucacgccuaua

SEQ ID NO: 576878 - RNA, 53 nt, hsa
ccauucugucccugguguagagccugggggacccaucuuccaccucaccucuu

SEQ ID NO: 576879 - RNA, 65 nt, hsa
gguguggcccucaggccuggugcugccuuggagggcugggggaaggaguguguggaggagggagg

SEQ ID NO: 576880 - RNA, 65 nt, hsa
gagaagagauugguuaguauggccugaacugguggcugggggaacugugucuggucaaguuaugg

SEQ ID NO: 576881 - RNA, 65 nt, hsa
uacuagggaggcugaggugggaggaucacuugagccugggggacugaggcugcagugagccauga

SEQ ID NO: 576882 - RNA, 65 nt, hsa
uuaauucucauuaauacucuuuauuuauccuauuucugggggaggauguacguggccauguauga

SEQ ID NO: 576883 - RNA, 65 nt, hsa
uaauucccagauugugccuuauaaccugccuuugccugggggaguggugccucgcaugcugauaa

SEQ ID NO: 576884 - RNA, 59 nt, hsa
ccuugaacucugucgguugaugcugacuccugggggagggaggagucauguuggagguu

SEQ ID NO: 576885 - RNA, 65 nt, hsa
agcuggggagguggauuuagcagaaggcaacuccucugggggauuugaaccggucugucuucacu

SEQ ID NO: 576886 - RNA, 65 nt, hsa
gaggacuaggagcccagccuugcgccgcauucgcacugggggacaugggaggggucuagcuggcc

SEQ ID NO: 576887 - RNA, 65 nt, hsa
augguaugagagucggaccuggacagggccagcugcugggggagcggcacuggggacuggaggcu

SEQ ID NO: 576888 - RNA, 65 nt, hsa
ccucaccugcagagaaacgcgcuccuuggcggacacugggggaggagaggaagaagcgcggcuaa

SEQ ID NO: 576889 - RNA, 65 nt, hsa
gguaggugauuguacgugguugcucuucuccuuggcugggggagguaaugagcagaucucugugg

SEQ ID NO: 576890 - RNA, 58 nt, hsa
augugaucauacaagacugaguggggagcugggggaggggaggucuguuacugaaaga

SEQ ID NO: 576891 - RNA, 65 nt, hsa
cccaacucugggaguuguggugggaggaggcacuucugggggauaggaccagacaagauaacagg

SEQ ID NO: 576892 - RNA, 65 nt, hsa
agggcucccggagagggagucagucuucacuugcacugggggaacagaugcuaauaaacuguuuu

SEQ ID NO: 576893 - RNA, 65 nt, hsa
cggguugcagucccgacacggcuuuaggaagauaccugggggauggagggguggugaugucaggg

SEQ ID NO: 576894 - RNA, 65 nt, hsa
auagaggaaguggaagugccuuuaggauggugauacugggggaccggguagugcuggggagagau

SEQ ID NO: 576895 - RNA, 65 nt, hsa
auuuuuauuucuacguuuuuaguaaauuuaauauucugggggaaaaaaggccuugauuuuagggu

SEQ ID NO: 576896 - RNA, 65 nt, hsa
aaauuuccacucgcauuauuuaaugauggaagauucugggggagaguuguggauuucauaaagcc

SEQ ID NO: 576897 - RNA, 65 nt, hsa
auggggguguguacaacuuaacaccuggacuuuuacugggggagugggaaagugauucuguaacc

SEQ ID NO: 576898 - RNA, 65 nt, hsa
uucauauuacauaagggaaaccuugagugguggugcugggggaggcaccccacagacucagcgcc

SEQ ID NO: 576899 - RNA, 65 nt, hsa
uuuggauaaggcaaauucaacuuucagucucuuuucugggggaaaaaaauaauaaaccuagccua

SEQ ID NO: 576900 - RNA, 65 nt, hsa
gcugagaucacacuacuguacuacuguacuccagccugggggaaagagugaaacuccaucucaaa

SEQ ID NO: 576901 - RNA, 65 nt, hsa
cagugugagaaggaagacagagaaguucuugaaagcugggggaugugugggcaagagguggauug

SEQ ID NO: 576902 - RNA, 65 nt, hsa
cuucuugauuucacuucugauggaugcauggggcucugggggaaugcugggaaaaugggcaagca

SEQ ID NO: 576903 - RNA, 65 nt, hsa
cugucuggccagggagauccaugugcucaauguugcugggggaccuacaaaagucaaacauugcu

SEQ ID NO: 576904 - RNA, 65 nt, hsa
aaugcgucuuuaaaaauagucucuguggcaggucacugggggacaauguacagcauucuggccau

SEQ ID NO: 576905 - RNA, 65 nt, hsa
gauuuaacagaaauguacagcaaggagauuuacaacugggggagggugaagugaagacaaugacu

SEQ ID NO: 576906 - RNA, 65 nt, hsa
ccgacugaggggugggcugcagaacggggugggaacugggggaccugggccucaggccugcucca

SEQ ID NO: 576907 - RNA, 65 nt, hsa
cagcaauagcaauccagaauugggguuuuggggggcugggggaugggucugaccccaccuagagc

SEQ ID NO: 576908 - RNA, 65 nt, hsa
gugauggcccugaagggcuguaggacggagguucccugggggaagucuguucuuugguauggaau

SEQ ID NO: 576909 - RNA, 65 nt, hsa
gggagcaggaugcccuggaccuguaccagcacagccugggggagcuacugcuguugcuggcaggu

SEQ ID NO: 576910 - RNA, 65 nt, hsa
uguggcugagacucuggacagaggcugggguccuccugggggacagcacagucaguggagagagc

SEQ ID NO: 576911 - RNA, 65 nt, hsa
cuuaaaggcagcgggcgcugcuagugcgcaccgugcugggggaagggggaaccccuccccacccu

SEQ ID NO: 576912 - RNA, 65 nt, hsa
uccuggcagcuuuuaacauuauagcaaauuugugucugggggacugcuggucacuguuucucaca

SEQ ID NO: 576913 - RNA, 65 nt, hsa
gggcauggugggcacaguucucccugccccucagccugggggaagaagagggccucgggggccuc

SEQ ID NO: 576914 - RNA, 65 nt, hsa
cccucuagcucccucagccgaacagcacccugcaucugggggauugaagcagucgcugacccccg

SEQ ID NO: 576915 - RNA, 65 nt, hsa
aucucgaagugacuccgggcugagcaguggggcggcugggggaggggugacgauucuccucaggc

SEQ ID NO: 576916 - RNA, 65 nt, hsa
cucauuccugccuccuuccugagccaguucagggccugggggagagccagcuugggguaggaagu

SEQ ID NO: 576917 - RNA, 65 nt, hsa
uuccuuauccagacaguggggaaggcaugacacaccugggggaaauuggcgaugucacccgugua

SEQ ID NO: 576918 - RNA, 65 nt, hsa
agggagaugugcgugucaaauauucaucuaguccccugggggaggggaagggugggucuagacau

SEQ ID NO: 576919 - RNA, 65 nt, hsa
ucaccuaccacccaaguccucaugcccuccgagggcugggggaggaggggcucaaggaagggggg

SEQ ID NO: 576920 - RNA, 65 nt, hsa
guccugccccugcuaccugcuucauuguccauccccugggggagugggucagagguacuggaggg

SEQ ID NO: 576921 - RNA, 65 nt, hsa
gggaaaggacacacacaggauaugggagccaggggcugggggagguggaaggggcggggggcggg

SEQ ID NO: 576922 - RNA, 65 nt, hsa
acugaaguguuacuugaaccgggggaaucucggaccugggggagccggggugugaggggacugga

SEQ ID NO: 576923 - RNA, 65 nt, hsa
cauucaugauggccuccuccuucaggccucaaugccugggggaggccugcacuguccugauuggc

SEQ ID NO: 576924 - RNA, 65 nt, hsa
cucccucugaacuucaagucuccaaagaucagaaucugggggagggagcgcgugcagggaggggc

SEQ ID NO: 576925 - RNA, 65 nt, hsa
uccacucuauucccacccuugagggagcccccuuacugggggaggguccuugcaauuccagcgaa

SEQ ID NO: 576926 - RNA, 65 nt, hsa
cuccaugaggacaugggaagguaggaguugccgcccugggggagggucccgggcugcucaccucu

SEQ ID NO: 576927 - RNA, 65 nt, hsa
gacaaaaccaugcagcucagaggucccugugggggcugggggagcugcccugcaggucuuggcac

SEQ ID NO: 576928 - RNA, 65 nt, hsa
ggccagcaaggcaguccccccacgcccgagaaagccugggggacccagacaccuguccccacagu

SEQ ID NO: 576929 - RNA, 65 nt, hsa
gcucauuuggguucaggcgcacuucaaaacccucccugggggaggcuguuucuucucaggauucc

SEQ ID NO: 576930 - RNA, 65 nt, hsa
guccuggccuccaggugugcagcaggggcugugugcugggggagguuccaguuaggcgaugggau

SEQ ID NO: 576931 - RNA, 65 nt, hsa
gaccgugcucugucggcccgagacauuuggaaguccugggggaugcuggcaaaucucagcuguug

SEQ ID NO: 576932 - RNA, 65 nt, hsa
cccugcccuuugguucauuuuucugcuucucuuggcugggggacucuggugccagccuugaaagu

SEQ ID NO: 576933 - RNA, 65 nt, hsa
gagggguuguggggccugaaccccggccucccacccugggggaggcccucugugaaugggucucu

SEQ ID NO: 576934 - RNA, 65 nt, hsa
ggccgggguuugaaggcagggccccugccacccuccugggggacacccgugcauguuuacgccuu

SEQ ID NO: 576935 - RNA, 65 nt, hsa
cauggccuuccugccacugcagagugggaagcuuccugggggaccucagccagcuccggggcucu

SEQ ID NO: 576936 - RNA, 65 nt, hsa
agccugcuuccaggagccuagagugggaaaggcaccugggggagcccuggugaagggcuggaccu

SEQ ID NO: 576937 - RNA, 65 nt, hsa
ccaggggcgucugcugugccccgccaaucacgagacugggggaccggccgggccuggcaccaauc

SEQ ID NO: 576938 - RNA, 65 nt, hsa
acuuagagaaaggucacuggcccgggcuugggagccugggggaugcagcucucucugugggcuuc

SEQ ID NO: 576939 - RNA, 65 nt, hsa
ggacuucuagagaaaggccuggugcaggcggcuugcugggggaugugagcgcucaggacgugaug

SEQ ID NO: 576940 - RNA, 65 nt, hsa
ucaacuugacaccacuaagaugauuuuuuaaggagcugggggaaggcaggagccuuccuuucucc

SEQ ID NO: 576941 - RNA, 65 nt, hsa
augccuggccugccagacacugcgccccgccugaccugggggagccgaccaauuagucacugcug

SEQ ID NO: 576942 - RNA, 65 nt, hsa
acauagcccaaggaggcaccacaggucuaugugugcugggggaugucaggugccacccaacgcug

SEQ ID NO: 576943 - RNA, 65 nt, hsa
cccgcugccugcacuggaacccacagaccucacaccugggggacagaggcagauaagaaggugcg

SEQ ID NO: 576944 - RNA, 65 nt, hsa
gggaucuuugagaccaaaacagaugcuccuguuugcugggggagggugugagcacggaguauuuc

SEQ ID NO: 576945 - RNA, 65 nt, hsa
gaaaagaaucccugcagccugguagaauugggaagcugggggaaggguggucugagcacccccuc

SEQ ID NO: 576946 - RNA, 65 nt, hsa
cucaccuuccagagaggacagacacagauuuccugcugggggagggaggaguccacgcauccuga

SEQ ID NO: 576947 - RNA, 65 nt, hsa
acagaugcccucagaauuggggcaugggaggggggcugggggaccccaugauucagccacggacu

SEQ ID NO: 576948 - RNA, 65 nt, hsa
cagaauauccuucaaguuccacuucccagggagcucugggggaggggcggccauucuggcuccgu

SEQ ID NO: 576949 - RNA, 65 nt, hsa
ggaaguggucuggcuggaacuccaaguggcuuagucugggggaucaggaggugggagguggaugg

SEQ ID NO: 576950 - RNA, 65 nt, hsa
cacucacuaggugacagcggccaccaggcucugugcugggggacgauacuggcccuggccucgac

SEQ ID NO: 576951 - RNA, 65 nt, hsa
gccaggugaguguuuucuucaggcagcugaggguccugggggagcugaggcucugugcugcaccc

SEQ ID NO: 576952 - RNA, 65 nt, hsa
gcccccugggaacugggggugcgggaguucucccucugggggacagaaaaucugacuacuaggaa

SEQ ID NO: 576953 - RNA, 65 nt, hsa
cccugugcagaaggcuacugccccuuaggccucagcugggggaaaggcaguucuggugcuguaga

SEQ ID NO: 576954 - RNA, 65 nt, hsa
agagguucaggcaguuccugucaucucugaaaagacugggggauaugaaaucuucccccuacccc

SEQ ID NO: 576955 - RNA, 65 nt, hsa
aaaucagguagcccagacuggugauggagcagagucugggggaagggucguggguggggaauuua

SEQ ID NO: 576956 - RNA, 65 nt, hsa
gguuuucucucuggauggaacgggcaugggccucucugggggaggcagggcuggaaugggagacc

SEQ ID NO: 576957 - RNA, 65 nt, hsa
ccucucccaggcugucccccuccucccagggccuccugggggaccuuuguauuaagccaauuaaa

SEQ ID NO: 576958 - RNA, 65 nt, hsa
aacugaacuugcuauggaaaggacagugugggaggcugggggagcuguguccugcaguucccagg

SEQ ID NO: 576959 - RNA, 65 nt, hsa
agccaccuugaccguaggggaaggaggaaugugggcugggggaagaugcccucaacucacccccu

SEQ ID NO: 576960 - RNA, 65 nt, hsa
ccaccugcccucccgggcaguacuggggaccuucccugggggacggggagggaggaggcagcgac

SEQ ID NO: 576961 - RNA, 65 nt, hsa
uacaggggggucuccccucaccccugcacccccagcugggggagcuggcucugccccgaccuccu

SEQ ID NO: 576962 - RNA, 65 nt, hsa
agaagagggagaaggagaggcucugaaagcugcuucugggggauuucaagggacugggggugcca

SEQ ID NO: 576963 - RNA, 65 nt, hsa
aagucccgggucugucucucucacucucgcucucacugggggagggaaagaauggcuuugguggc

SEQ ID NO: 576964 - RNA, 65 nt, hsa
gaggaugucugggccacucaggggucauucauggccugggggauguaccagcaucucccaguuca

SEQ ID NO: 576965 - RNA, 65 nt, hsa
uguggccagccuagggcucauggcaugggcccccacugggggagggaggcaucuuguuucuugug

SEQ ID NO: 576966 - RNA, 65 nt, hsa
guuuuugauggaauugauuuucccugaguggagugcugggggaaggaggagguccaggccgguag

SEQ ID NO: 576967 - RNA, 65 nt, hsa
agcuggcugagauuggggcagcggcucagcagucccugggggaagccauugacguguaccaggcg

SEQ ID NO: 576968 - RNA, 65 nt, hsa
cagccccagcuucgcacaggcuccuggagggcugccugggggaggcagacaugggagugccaagg

SEQ ID NO: 576969 - RNA, 65 nt, hsa
ggagcuaagggcgaggcccuucccuucagaggcuccugggggauuagggugugguguuugccaag

SEQ ID NO: 576970 - RNA, 65 nt, hsa
uggguccccccaccguggugccccucaccauccuccugggggagcaggggguggguucucccuga

SEQ ID NO: 576971 - RNA, 65 nt, hsa
ugaggaaauggaugauuucucuuuuccauaugucacugggggaaaggcugccuguaccucucaag

SEQ ID NO: 576972 - RNA, 65 nt, hsa
gugacaucuacaacuccaagauugccgggaagcuccugggggaugcucuaaagcugggcucaagc

SEQ ID NO: 576973 - RNA, 65 nt, hsa
gcgcuguggaacugccgcagccacgcaggaggucccugggggaugcuuugggaaguccuugcccc

SEQ ID NO: 576974 - RNA, 65 nt, hsa
gaaagcucugcaguggggggcugguggcuccggggcugggggaucacaggcuggugaaccccggu

SEQ ID NO: 576975 - RNA, 65 nt, hsa
uugguuccaggcuccuguucucuggacuucagauccugggggagccccuccccccccugaauccc

SEQ ID NO: 576976 - RNA, 65 nt, hsa
uaggcagcucccugcccuccgugugugucuguuaucugggggagaggaguguggaaggguugggg

SEQ ID NO: 576977 - RNA, 65 nt, hsa
cugggcuggguucccagucggagccuuucggggaucugggggaugagggcggaaggccuagcucc

SEQ ID NO: 576978 - RNA, 65 nt, hsa
gucagugcacgcaagcagggacauuuccuagccagcugggggacacuggaaauucgggaaaccaa

SEQ ID NO: 576979 - RNA, 65 nt, hsa
ggcugcucugggcagggugugcgggccgggcccggcugggggagggcagcucugggcacgccgca

SEQ ID NO: 576980 - RNA, 65 nt, hsa
ggcagcucugggcacgccgcacccacgccccccaccugggggaaacaggcgguuccugcccgguu

SEQ ID NO: 576981 - RNA, 65 nt, hsa
gucccucgggcaccugggcccccccgcuuggcucccugggggaauggcccaggcgggccgcgguu

SEQ ID NO: 576982 - RNA, 65 nt, hsa
gauggagcuaccguguccaggaugaagcugcaggucugggggacacugaccagcuugggcuccac

SEQ ID NO: 576983 - RNA, 65 nt, hsa
ucaugcggccccaggggccucccuccuguugaagacugggggagagcaguggguucugggggggc

SEQ ID NO: 576984 - RNA, 65 nt, hsa
cagagugugcgggggacggagguaagcuggauauccugggggaggaggggaaugcgcucuggaaa

SEQ ID NO: 576985 - RNA, 65 nt, hsa
guuggaggagggcuuguuuggagaagggaggcuggcugggggagaaacccggaucccgcugcauc

SEQ ID NO: 576986 - RNA, 65 nt, hsa
cccaaggccugccuggcucugucugaacagaaggucugggggaagcgacggguggaguacaauaa

SEQ ID NO: 576987 - RNA, 65 nt, hsa
ucucucuucgugccuggucugggacugggucagcccugggggaucagaaggggccaucugggccc

SEQ ID NO: 576988 - RNA, 65 nt, hsa
aaggaaugcagcccccugaagacagcacuacaagucugggggagccaguuuuaacaucagugcac

SEQ ID NO: 576989 - RNA, 65 nt, hsa
ccaacagguuuccaggagaugguagacauugggaccugggggaccucagagcagagugccacauu

SEQ ID NO: 576990 - RNA, 65 nt, hsa
ggaguguuccggcaaagacagagccagcagcugcgcugggggagggaagcgugccuccccacccc

SEQ ID NO: 576991 - RNA, 65 nt, hsa
uuaaguaauguuuggugucuguuucuuaggagugacugggggagggaagauuauuuuagcuauuu

SEQ ID NO: 576992 - RNA, 65 nt, hsa
cagacccccccauuucccgcacaugguguggggggcugggggagguccaagcagaguguuuuauu

SEQ ID NO: 576993 - RNA, 65 nt, hsa
gcucacugagcucuucuucauucucacccugaucccugggggacucaaagccaaaacugcccaaa

SEQ ID NO: 576994 - RNA, 65 nt, hsa
gaaagaguguggguucuaaguacaggcauucaaggcugggggaaggaaagcuacgccauccuucc

SEQ ID NO: 576995 - RNA, 65 nt, hsa
uuccccaaccacagagaacaagaguuuguucuguucugggggacagagaaggcgcuucccaacuu

SEQ ID NO: 576996 - RNA, 65 nt, hsa
gaggcuauagggucacuugccauuuccuaccuucucugggggauuugaggguagaggcaggggaa

SEQ ID NO: 576997 - RNA, 65 nt, hsa
uucauagugugcuuguguguuuguuuuagauccuccugggggauggggauggggccaggcucagu

SEQ ID NO: 576998 - RNA, 65 nt, hsa
ucagcccgcuccugcccgcccagcacccccaggcccugggggaccugggguucucagacugccaa

SEQ ID NO: 576999 - RNA, 54 nt, hsa
cuggaaccccacuggcuuagagggcugggggagagaaacacugcugcccucuuu

SEQ ID NO: 577000 - RNA, 65 nt, hsa
gaccuccucugggcccugucgccccuccuuuuggccugggggaggucagaacauucgaaucucug

SEQ ID NO: 577001 - RNA, 65 nt, hsa
uguccaucaaggcccugugcugcaacagagccccucugggggacuggaaugaccuccugaccacu

SEQ ID NO: 577002 - RNA, 65 nt, hsa
cugccuugcgugcuuuucuggguuuugaggggugucugggggaagcgguaaugguggcugugcau

SEQ ID NO: 577003 - RNA, 65 nt, hsa
cauguuaacccucuagcugauaaugcaaacacuaacugggggauuuuauuuauaagggcucuaga

SEQ ID NO: 577004 - RNA, 65 nt, hsa
gggccuggcuuaaaagcaggauugaagaaaagggacugggggaaggaaacuuauuggaaaacuug

SEQ ID NO: 577005 - RNA, 65 nt, hsa
gaagagcagcagcagcaggauggugaaguaguaaacugggggaggcagggcacagggagaugcuc

SEQ ID NO: 577006 - RNA, 65 nt, hsa
cugggaccuuucccucccaggaguccccuagguggcugggggaggcaggcucacuggccauuuuc

SEQ ID NO: 577007 - RNA, 65 nt, hsa
ggcuguggauggggcggagcagggcagaagauggacugggggagggggcagagagaggagaccaa

SEQ ID NO: 577008 - RNA, 65 nt, hsa
aggggcagagcgaaguucugggugggaugaccgcacugggggaggggccucaguccagaaaccuc

SEQ ID NO: 577009 - RNA, 65 nt, hsa
ucuacaugugugugucuacgugugugcgugcguggcugggggaggccuuuucuuugaggacguac

SEQ ID NO: 577010 - RNA, 65 nt, hsa
guauguguauaugcauggggaaaggcaccuggggccugggggaggcuauaggauauaagcauuag

SEQ ID NO: 577011 - RNA, 65 nt, hsa
aucugauuuagaaauaacauuuaaaugccaaguaucugggggauugaaggaagggucuauaugag

SEQ ID NO: 577012 - RNA, 65 nt, hsa
agcagggcacuguguccggcggagccaaguccacucugggggagcucuggcggggaccacgggcc

SEQ ID NO: 577013 - RNA, 65 nt, hsa
ugcccugugugggcccaaccaguggacaauggagucugggggagggggaaccccggggacaugcc

SEQ ID NO: 577014 - RNA, 65 nt, hsa
gggaggugacggcgcccgccgcagguggggcgaggcugggggagggcggcgccgcggcgggccug

SEQ ID NO: 577015 - RNA, 65 nt, hsa
cuagacggggaggggccaggacccacccacugcuccugggggaugagguccugguuuuaaagccc

SEQ ID NO: 577016 - RNA, 65 nt, hsa
aagggcaaccguugcuguucacacgcucagccugucugggggagcgggccucuagcuucagccag

SEQ ID NO: 577017 - RNA, 65 nt, hsa
ccacccccacccccuucaguguuaaguggggagcccugggggagucucuccugccucccagccuc

SEQ ID NO: 577018 - RNA, 65 nt, hsa
ugcagugagccuugaucgugccacugcacuccagccugggggacagagcacgacccugucuccaa

SEQ ID NO: 577019 - RNA, 65 nt, hsa
auacuccuggcgauacugacuagaaagucagggagcugggggagcuguucacuuuaggauacggg

SEQ ID NO: 577020 - RNA, 65 nt, hsa
aaaaacgcaaaccaaagcaggcaggcagacagcugcugggggaaauccugggguccuugagacag

SEQ ID NO: 577021 - RNA, 65 nt, hsa
ggcgcagaccugaggcgaggccaccccccuccauccugggggaagcgcccgcgaaaaccguggag

SEQ ID NO: 577022 - RNA, 65 nt, hsa
ccugcugaggcucagccccucaacccgguggcauucugggggaggaguggggcccacagcucucc

SEQ ID NO: 577023 - RNA, 65 nt, hsa
caugccucuaaucccagcacuuugggaggcugaggcugggggaucaccugaggucaggaguucga

SEQ ID NO: 577024 - RNA, 65 nt, hsa
ugcagugagcugagguggugccacuacgcuccagccugggggagggggacauagcgagacucggu

SEQ ID NO: 577025 - RNA, 65 nt, hsa
gcuggugccgccucauaggcagacgaggaucaucgcugggggaccuuucccgugggcuuucuucc

SEQ ID NO: 577026 - RNA, 65 nt, hsa
gccccuuaguccccaagccccucccccuaaggcagcugggggagaggugaccuaguacuggaaaa

SEQ ID NO: 577027 - RNA, 65 nt, hsa
ucccucccuggugcucauuggaaucugaguagagucugggggaggguccccaccuuccuguaccu

SEQ ID NO: 577028 - RNA, 65 nt, hsa
cccagaggcuuuggaguucaaucuugaaggggugucugggggaacuuuacuguugcaaguuguaa

SEQ ID NO: 577029 - RNA, 65 nt, hsa
ccggccugacgcuguggccccgggacccagcagagcugggggagggaucagcccccaaagaaaug

SEQ ID NO: 577030 - RNA, 65 nt, hsa
acgcagcugccaugaugccuugggaugcccugguccugggggacucaggugccucccugauuccu

SEQ ID NO: 577031 - RNA, 65 nt, hsa
gcagggagagcugcugagccuaaagacuggagaaucugggggacugggagugggggucagagagg

SEQ ID NO: 577032 - RNA, 65 nt, hsa
uuauggacaggggccugggcuuucuuccaagggcacugggggagccauggcaagguuguagguag

SEQ ID NO: 577033 - RNA, 65 nt, hsa
uaaacagaggaagacaacauaugucacuggggaggcugggggagcuagacaaaauucacacggga

SEQ ID NO: 577034 - RNA, 65 nt, hsa
caccuccccaccucccucccccgucagugggaugacugggggaggguugcugcagggaagaggag

SEQ ID NO: 577035 - RNA, 65 nt, hsa
ccugagcacacccgaggcucccaccugcggagccgcugggggaccucacgucccagccaggaucc

SEQ ID NO: 577036 - RNA, 65 nt, hsa
uagcacgguuuggggacuugggguguucccaagaccugggggacgacagacaucacgggaggaag

SEQ ID NO: 577037 - RNA, 56 nt, hsa
accgccgggacuucugguagaggcggcugggggagggugggggcagggcuggcugg

SEQ ID NO: 577038 - RNA, 65 nt, hsa
cuggaggacccugggccccaggccagcucccaucgcugggggacggugaacggccauguguuaau

SEQ ID NO: 577039 - RNA, 65 nt, hsa
gcguccugucccucacauuugaucacugugaccuucugggggaggggggaguugaaaaugcacau

SEQ ID NO: 577040 - RNA, 65 nt, hsa
ugcagugagccaagaucgcgccauugcacuccagccugggggacaagagugagacuuagucucaa

SEQ ID NO: 577041 - RNA, 65 nt, hsa
uaugugugugaccaucagcaguggugugcacauggcugggggacacucgguuugaccgccagcgg

SEQ ID NO: 577042 - RNA, 65 nt, hsa
cggcucaaaggcaagcgagcucucccucugcuucccugggggagccccgacggccacaggacucc

SEQ ID NO: 577043 - RNA, 65 nt, hsa
ccacccaaauaucaaacacggacccauagacagcccugggggagccucuuacggaaaauccgaca

SEQ ID NO: 577044 - RNA, 65 nt, hsa
auggcugaggagggugcugggaacggcaaggcggucugggggauggggaggggcaaaggugagag

SEQ ID NO: 577045 - RNA, 65 nt, hsa
ccagggaaugggggcuuugggucaucucccacugccugggggagucagauggggugcaggaaucu

SEQ ID NO: 577046 - RNA, 65 nt, hsa
ucccuuuccuuuugguuuugggauuacuuuugauccugggggaccaaugaggugagggggguucu

SEQ ID NO: 577047 - RNA, 65 nt, hsa
cggauacuugccaaaaugagacucuccgucggcagcugggggaagggucugagacucccuuuccu

SEQ ID NO: 577048 - RNA, 65 nt, hsa
gaugugugacuucuuaucaccuggauucagagagucugggggacaggaauccugauuuuuuuuuu

SEQ ID NO: 577049 - RNA, 65 nt, hsa
gugagggcaguagggauuggguugggggaagauaacugggggaaggccagggccccuaggcuaca

SEQ ID NO: 577050 - RNA, 65 nt, hsa
ucgagggggaaagggggugggacagggacucggggcugggggacggggcggggcuugaccugcgg

SEQ ID NO: 577051 - RNA, 51 nt, hsa
cagaauccagaaagguuugaucugggggaccacccauacugaggaguugaa

SEQ ID NO: 577052 - RNA, 65 nt, hsa
caccccaugucccagagccucagaacccacccucccugggggacccucgaaggaggcugucagag

SEQ ID NO: 577053 - RNA, 65 nt, hsa
uggggcucccccucgaggcgaggggccaugcaugucugggggaccccugccccccaaaacccucu

SEQ ID NO: 577054 - RNA, 65 nt, hsa
ggagggcagaggcgcagaauccugugagggugacucugggggaccccuggucugugggggcaucc

SEQ ID NO: 577055 - RNA, 65 nt, hsa
agaguucaguccuggcuggaggagccacagccugucugggggaaaggacaagucagggaccacuu

SEQ ID NO: 577056 - RNA, 58 nt, hsa
uggaguuacaggcaaagugaggagggagcugggggacacuuucgagcucccagcucca

SEQ ID NO: 577057 - RNA, 65 nt, hsa
gugggggccaccaaaaacccacaaaggccccggagcugggggaccacaaacaaacaggguccuua

SEQ ID NO: 577058 - RNA, 65 nt, hsa
ccucugcccagagaacucacaacccccucucugaccugggggacaaugcaaacaggucacagugc

SEQ ID NO: 577059 - RNA, 65 nt, hsa
gugaaacugcaggagcucagcauagacccagcucucugggggauggucaccuggugauuucaaug

SEQ ID NO: 577060 - RNA, 65 nt, hsa
ccugaaacgcuccuuugugugugugucagcugaggcugggggagagccguggucccugaggaugg

SEQ ID NO: 577061 - RNA, 65 nt, hsa
gcaggaauagcaaagagugcaaacuugggguaugacugggggagaguggaacaugccuuuuccgc

SEQ ID NO: 577062 - RNA, 65 nt, hsa
gagugcgcccugcacuccccgaacccgaguccgcgcugggggagccucgcccccgcccccaccgg

SEQ ID NO: 577063 - RNA, 65 nt, hsa
ugcccugauggccugagcaucccccagauccaagccugggggaucccgggaaagcgauggacaga

SEQ ID NO: 577064 - RNA, 65 nt, hsa
cuccaguaaauaccuggaagagggaaccugaaucccugggggagacagaaggggcaggggccacc

SEQ ID NO: 577065 - RNA, 65 nt, hsa
ucaauucuuucauucccugaccagugagaggguuccugggggaaguauggugaauaaacugacau

SEQ ID NO: 577066 - RNA, 65 nt, hsa
aguguuuuguagauuucagaugacuaugcagaggccugggggaccccuggcucugggccgggccu

SEQ ID NO: 577067 - RNA, 65 nt, hsa
aagauggauaaacugagccucacuugcccucgugccugggggagagaggcagcaagucuuaacaa

SEQ ID NO: 577068 - RNA, 65 nt, hsa
uaccaguggaagagacaucccuugacuuuuguggccugggggagggguagugcuccacagcuuuu

SEQ ID NO: 577069 - RNA, 65 nt, hsa
cauuucuguggagggagggcagcuggcccccagcccugggggauuccugagcuggccugucugcg

SEQ ID NO: 577070 - RNA, 65 nt, hsa
cuucuccaccgcacagacugggaaccccuccuggccugggggaagaguuuguuaccuaccuuacu

SEQ ID NO: 577071 - RNA, 65 nt, hsa
uccagaacccaucuggccagagaagcagcagcauccugggggauggccgugcaugggguguacac

SEQ ID NO: 577072 - RNA, 65 nt, hsa
guagugcucccaccccuggacugguggcccccacccugggggaggucuccucaugcgccugcacc

SEQ ID NO: 577073 - RNA, 65 nt, hsa
ugaauggucugcccugggcaagauggaggugggggcugggggaauaugcauguugcagaagccgg

SEQ ID NO: 577074 - RNA, 65 nt, hsa
gccugcugcagccaccuggugccuuaguccuugggcugggggagggggcccacccuuaaaggcgg

SEQ ID NO: 577075 - RNA, 65 nt, hsa
ugcgccuuccacgccccccaggacgggcccagaggcugggggagccccgcggcggccugaacccu

SEQ ID NO: 577076 - RNA, 65 nt, hsa
aaagacucagccaagacaaggagguagagaggggacugggggacugggagucagagcccuggcug

SEQ ID NO: 577077 - RNA, 65 nt, hsa
gcaaagaaaugugaaaaggcauugggagaagcagucugggggaggccagcccagugcgggcacag

SEQ ID NO: 577078 - RNA, 65 nt, hsa
gaucaaagaaaaaucccccuuauuuagaaauguuccugggggaugaagaaaccauaauuacuuga

SEQ ID NO: 577079 - RNA, 65 nt, hsa
accucuauaaaccagugacuucucugggccugggucugggggagaggguugccagggagacucag

SEQ ID NO: 577080 - RNA, 65 nt, hsa
cagagucgggaaggggcgggucacucaauccuggccugggggagaaugcuggagggagcacgccg

SEQ ID NO: 577081 - RNA, 65 nt, hsa
augaaaagggaccccauauguagcaaaaaucagggcugggggagagccggguucauucccugucc

SEQ ID NO: 577082 - RNA, 65 nt, hsa
gugagucuuccagcugccaccacggcugggacacgcugggggagggcuccucccaugccuccugc

SEQ ID NO: 577083 - RNA, 65 nt, hsa
cacaguaaacaucucugccuuugccuguguguguucugggggaggggggacauggaaaaauauug

SEQ ID NO: 577084 - RNA, 65 nt, hsa
ucuugccuuguccccaacguuccacaacagucccgcugggggauugaagcgguuucacuccgcaa

SEQ ID NO: 577085 - RNA, 65 nt, hsa
gaucauaaccccuucugugccuugggaugccggagcugggggaccuggaggcccaucagccggag

SEQ ID NO: 577086 - RNA, 65 nt, hsa
gcauccauguguguccguggguaccguaagggcuacugggggaagaaccuguaagcaggguguga

SEQ ID NO: 577087 - RNA, 65 nt, hsa
accaaagaggaguaaccaucucugagggugggauucugggggaauuuuuguuuuuuucuguuuuc

SEQ ID NO: 577088 - RNA, 65 nt, hsa
gaguggcucacgggcagagaaggguagcccuggggcugggggagggauuggaagccucccuggag

SEQ ID NO: 577089 - RNA, 65 nt, hsa
gggacaagauacucaccaggaccaggaaggggacucugggggacuggcuuccccugugagcagca

SEQ ID NO: 577090 - RNA, 65 nt, hsa
ccaucccugucccucaggguagcaccauggcaggacugggggaacuggaguguccuugcuguauc

SEQ ID NO: 577091 - RNA, 65 nt, hsa
gcugcuucgcaagcccccucauuagcagggcuuaucugggggagcugcugauggaguccucgcug

SEQ ID NO: 577092 - RNA, 65 nt, hsa
ucauuugaaguuugcuuuggcuaaauuuugacacccugggggauguccugggagaaugccaguac

SEQ ID NO: 577093 - RNA, 65 nt, hsa
gggacaagauacucaccaggaccaggaaggggacucugggggaccggcuuccccugugagcagca

SEQ ID NO: 577094 - RNA, 65 nt, hsa
ucacugcugauuuucuaugucuuugcuccauacugcugggggaugggagagccacaguguguuuc

SEQ ID NO: 577095 - RNA, 65 nt, hsa
uuccugugcgucugugucuuugugccuguaucucgcugggggacuucacaggaagcaggauuugg

SEQ ID NO: 577096 - RNA, 65 nt, hsa
ggcacagggcacaggcagggacagaaagccuucuccugggggagggugggaagccaggguguccu

SEQ ID NO: 577097 - RNA, 65 nt, hsa
acugucuuggccauggggaagcacuauggccucagcugggggaaagacccuggccuaggggucuu

SEQ ID NO: 577098 - RNA, 53 nt, hsa
agcccagcaagggucuuugagaccugggggaucucaggagccaccugggaugg

SEQ ID NO: 577099 - RNA, 65 nt, hsa
ugucugaaacaaacagucacaagcaaaggaagaggcugggggacuagaaagaggcccugcccucu

SEQ ID NO: 577100 - RNA, 65 nt, hsa
agcuguggcuggggguguggaggcagugggaugaacugggggacaggucugcgcugcagugggau

SEQ ID NO: 577101 - RNA, 65 nt, hsa
cggcugaggguagcaagcagggguugugagucaggcugggggacuuguuugaaagaaagaggagu

SEQ ID NO: 577102 - RNA, 65 nt, hsa
cugugugaggugugggaggugggaagggugagggucugggggaaugcggagaaaagggaggcuug

SEQ ID NO: 577103 - RNA, 65 nt, hsa
gauuuuaugcuggaaauaugacccugugcagacugcugggggaggcaggaggaugccugccugga

SEQ ID NO: 577104 - RNA, 65 nt, hsa
uccuuuuugcuuccucaguuuuuaucaggcuuucucugggggacagcagucucugagcaccaggg

SEQ ID NO: 577105 - RNA, 65 nt, hsa
ucccaaaacaaagcuguuugccucacucaggagaucugggggagguuucauuuaaaagugcuggg

SEQ ID NO: 577106 - RNA, 65 nt, hsa
ugaguggccaagaugaugccaggcugcccuauacacugggggauucugcccuggcccaugcacac

SEQ ID NO: 577107 - RNA, 65 nt, hsa
gucaaggagccuaaacacccugaaauugugacccccugggggacagcugccagacacagcuggcg

SEQ ID NO: 577108 - RNA, 65 nt, hsa
acaucugcccauccucccagcuccugugucagagccugggggacgagucacccagcucaccccca

SEQ ID NO: 577109 - RNA, 65 nt, hsa
ugggcagcaccuccgggacugaccuucggcaguggcugggggacugcuuucagugccugcuguuc

SEQ ID NO: 577110 - RNA, 65 nt, hsa
uaggccuaggcagcucugcaagccucucugcauggcugggggagucagggcagagcuuacuuuaa

SEQ ID NO: 577111 - RNA, 65 nt, hsa
ugcagugagcuaagaucaugccaucgcacuccagccugggggacaaaagugagacaucgucucaa

SEQ ID NO: 577112 - RNA, 65 nt, hsa
cucacugagggcgugcaaaguugaaaguggcaaggcugggggagggugucggguagagggaagag

SEQ ID NO: 577113 - RNA, 65 nt, hsa
ccccaccaugaguccuguguccaggccggacauggcugggggaccaacuacucuggcaggaucug

SEQ ID NO: 577114 - RNA, 65 nt, hsa
cguaggaagggaaugcgccugcguguguauacccacugggggaauucuccggccguggggucccc

SEQ ID NO: 577115 - RNA, 65 nt, hsa
gccugggggguggggccuccuucagcccccuccuccugggggaugcuccccaggguuagggugcu

SEQ ID NO: 577116 - RNA, 65 nt, hsa
uccagaaggugcauguccgggcucucgggggcccccugggggaccugggcccugcccuuggcuca

SEQ ID NO: 577117 - RNA, 65 nt, hsa
gacagaauuaccaaaguguaucuggugcugaaugacugggggacaagcagaaguggaagagaucu

SEQ ID NO: 577118 - RNA, 65 nt, hsa
agagacagaaaauuaacugaaaagcaguuuagagacugggggaggccggaucucuagagccaucc

SEQ ID NO: 577119 - RNA, 65 nt, hsa
guggaccuucuggaggaagguggggguuucaaagacugggggaccccuuccuccugacuccagca

SEQ ID NO: 577120 - RNA, 65 nt, hsa
uucugguuuguucucuguggggcaguuggugggggcugggggaagaggcuggcagaaguuacccu

SEQ ID NO: 577121 - RNA, 65 nt, hsa
gccagguggcucaugggcuguagugagccagcucccugggggaaaaggcugugggccguuaggac

SEQ ID NO: 577122 - RNA, 65 nt, hsa
caggcagggugggagcaggggcuggcgugggaggucugggggacagacaaggaugauggaccccu

SEQ ID NO: 577123 - RNA, 65 nt, hsa
gaggagaggaggcuguugguaggaaaguggcagggcugggggagacccagccccaaggguccggg

SEQ ID NO: 577124 - RNA, 65 nt, hsa
aauguuaagugcaaaaugacugauguuaaaaccaucugggggaaaucuugggaugcuuuuuccua

SEQ ID NO: 577125 - RNA, 65 nt, hsa
cuucaacuucgguaaugaggaagaaggagaaagagcugggggaagggcagaagacugguuuagga

SEQ ID NO: 577126 - RNA, 55 nt, hsa
cugaggaagaugacgaguaacuccccugggggauacgacacaugcccuugaugag

SEQ ID NO: 577127 - RNA, 65 nt, hsa
aucagagacccugaggaagaugaugaguaacuccccugggggauaugacacaugcccaugaugag

SEQ ID NO: 577128 - RNA, 65 nt, hsa
gcugccuuaaagucaguaacuuacccuuagggaggcugggggaaaagguuagauuuuguauucag

SEQ ID NO: 577129 - RNA, 65 nt, hsa
uggccuuuggaaccucuccauauacuuucuaagcucugggggaggaggaggaugggaccuccugg

SEQ ID NO: 577130 - RNA, 65 nt, hsa
uacauuucuuuaucauuccaguggguaggguuuagcugggggaaggacauuucauaaggguuagu

SEQ ID NO: 577131 - RNA, 65 nt, hsa
aacaguaaaccaguuuuucuagggauggcccuuggcugggggaugacagugugggagcugugggg

SEQ ID NO: 577132 - RNA, 65 nt, hsa
ugaguuucuauacuuuuaagaagagcucuuuguuccugggggaggggggcagggggugaauuuua

SEQ ID NO: 577133 - RNA, 65 nt, hsa
ggggccugccuuucccugacacuuuuggggucugccugggggaggaggggagaaagcaccaugag

SEQ ID NO: 577134 - RNA, 65 nt, hsa
ugagcugccccagccccucccagcccuugcccagccugggggaguggggaaggcuugggcauggc

SEQ ID NO: 577135 - RNA, 65 nt, hsa
cuuccgcccccagcccacucucaugguccacacugcugggggaaagggaaaggaaaucagcaacu

SEQ ID NO: 577136 - RNA, 65 nt, hsa
acucccugccagcgggcgagcaggacaguccgcgccugggggacgcuggcuggcucgacuggcag

SEQ ID NO: 577137 - RNA, 65 nt, hsa
aauucaugguauccugguuauuuuuuuuaagucaucugggggaaaaccuguuuaucacuccagug

SEQ ID NO: 577138 - RNA, 65 nt, hsa
uuaauuaccuaagagccacaauaagccacugguaucugggggacuagaacacaaauccaacgcuu

SEQ ID NO: 577139 - RNA, 65 nt, hsa
aguagucuacugaugggagcaacaguuauggcaugcugggggaagagaagggacuuuuccuugug

SEQ ID NO: 577140 - RNA, 65 nt, hsa
agcugcuuaccugccucagcccaggauucuuuauucugggggagguaaugcccuguuguuacccc

SEQ ID NO: 577141 - RNA, 65 nt, hsa
cccacccucccaugagacugcccugcccagguauccugggggaagaggagaugugaucaggcccc

SEQ ID NO: 577142 - RNA, 65 nt, hsa
caccauuccagagacaaggccaguguauaugcaaacugggggacucuccucccuucucuccccag

SEQ ID NO: 577143 - RNA, 65 nt, hsa
guacaacugagugguacagauaugacauggaagaucugggggaggaaguucaaggaaggcaccac

SEQ ID NO: 577144 - RNA, 65 nt, hsa
gacgacacccugaggcuugcugggagugggguggccugggggacccuagacagccgggaaggcug

SEQ ID NO: 577145 - RNA, 65 nt, hsa
gcugugcagcauggaacucaggccaggcuccgaggcugggggaucugcuuggaguuuucugcccc

SEQ ID NO: 577146 - RNA, 64 nt, hsa; identical to SEQ ID NO: 173443

SEQ ID NO: 577147 - RNA, 64 nt, hsa; identical to SEQ ID NO: 173444

SEQ ID NO: 577148 - RNA, 64 nt, hsa; identical to SEQ ID NO: 173445

SEQ ID NO: 577149 - RNA, 64 nt, hsa; identical to SEQ ID NO: 173446

SEQ ID NO: 577150 - RNA, 64 nt, hsa; identical to SEQ ID NO: 90702

SEQ ID NO: 577151 - RNA, 64 nt, hsa; identical to SEQ ID NO: 90703

SEQ ID NO: 577152 - RNA, 64 nt, hsa; identical to SEQ ID NO: 90704

SEQ ID NO: 577153 - RNA, 64 nt, hsa; identical to SEQ ID NO: 90705

SEQ ID NO: 577154 - RNA, 64 nt, hsa; identical to SEQ ID NO: 90706

SEQ ID NO: 577155 - RNA, 64 nt, hsa; identical to SEQ ID NO: 90707

SEQ ID NO: 577156 - RNA, 64 nt, hsa; identical to SEQ ID NO: 90708

SEQ ID NO: 577157 - RNA, 64 nt, hsa; identical to SEQ ID NO: 90709

SEQ ID NO: 577158 - RNA, 64 nt, hsa; identical to SEQ ID NO: 90710

SEQ ID NO: 577159 - RNA, 64 nt, hsa; identical to SEQ ID NO: 90711

SEQ ID NO: 577160 - RNA, 64 nt, hsa; identical to SEQ ID NO: 90712

SEQ ID NO: 577161 - RNA, 64 nt, hsa; identical to SEQ ID NO: 90713

SEQ ID NO: 577162 - RNA, 64 nt, hsa; identical to SEQ ID NO: 90714

SEQ ID NO: 577163 - RNA, 64 nt, hsa; identical to SEQ ID NO: 90715

SEQ ID NO: 577164 - RNA, 64 nt, hsa; identical to SEQ ID NO: 90716

SEQ ID NO: 577165 - RNA, 64 nt, hsa; identical to SEQ ID NO: 90717

SEQ ID NO: 577166 - RNA, 64 nt, hsa; identical to SEQ ID NO: 90718

SEQ ID NO: 577167 - RNA, 64 nt, hsa; identical to SEQ ID NO: 90719

SEQ ID NO: 577168 - RNA, 64 nt, hsa; identical to SEQ ID NO: 90720

SEQ ID NO: 577169 - RNA, 64 nt, hsa; identical to SEQ ID NO: 90721

SEQ ID NO: 577170 - RNA, 64 nt, hsa; identical to SEQ ID NO: 90722

SEQ ID NO: 577171 - RNA, 64 nt, hsa; identical to SEQ ID NO: 90723

SEQ ID NO: 577172 - RNA, 64 nt, hsa; identical to SEQ ID NO: 90724

SEQ ID NO: 577173 - RNA, 64 nt, hsa; identical to SEQ ID NO: 90725

SEQ ID NO: 577174 - RNA, 64 nt, hsa; identical to SEQ ID NO: 90726

SEQ ID NO: 577175 - RNA, 64 nt, hsa; identical to SEQ ID NO: 90727

SEQ ID NO: 577176 - RNA, 64 nt, hsa; identical to SEQ ID NO: 90728

SEQ ID NO: 577177 - RNA, 64 nt, hsa; identical to SEQ ID NO: 90729

SEQ ID NO: 577178 - RNA, 64 nt, hsa; identical to SEQ ID NO: 90730

SEQ ID NO: 577179 - RNA, 64 nt, hsa; identical to SEQ ID NO: 90731

SEQ ID NO: 577180 - RNA, 64 nt, hsa; identical to SEQ ID NO: 90732

SEQ ID NO: 577181 - RNA, 64 nt, hsa; identical to SEQ ID NO: 90733

SEQ ID NO: 577182 - RNA, 64 nt, hsa; identical to SEQ ID NO: 90734

SEQ ID NO: 577183 - RNA, 64 nt, hsa; identical to SEQ ID NO: 465663

SEQ ID NO: 577184 - RNA, 64 nt, hsa; identical to SEQ ID NO: 465664

SEQ ID NO: 577185 - RNA, 64 nt, hsa; identical to SEQ ID NO: 465665

SEQ ID NO: 577186 - RNA, 64 nt, hsa; identical to SEQ ID NO: 465666

SEQ ID NO: 577187 - RNA, 64 nt, hsa; identical to SEQ ID NO: 465667

SEQ ID NO: 577188 - RNA, 64 nt, hsa; identical to SEQ ID NO: 465668

SEQ ID NO: 577189 - RNA, 64 nt, hsa; identical to SEQ ID NO: 465669

SEQ ID NO: 577190 - RNA, 64 nt, hsa; identical to SEQ ID NO: 465670

SEQ ID NO: 577191 - RNA, 64 nt, hsa; identical to SEQ ID NO: 465671

SEQ ID NO: 577192 - RNA, 64 nt, hsa; identical to SEQ ID NO: 465672

SEQ ID NO: 577193 - RNA, 64 nt, hsa; identical to SEQ ID NO: 465673

SEQ ID NO: 577194 - RNA, 64 nt, hsa; identical to SEQ ID NO: 465674

SEQ ID NO: 577195 - RNA, 64 nt, hsa; identical to SEQ ID NO: 465675

SEQ ID NO: 577196 - RNA, 64 nt, hsa; identical to SEQ ID NO: 465676

SEQ ID NO: 577197 - RNA, 64 nt, hsa; identical to SEQ ID NO: 465677

SEQ ID NO: 577198 - RNA, 64 nt, hsa; identical to SEQ ID NO: 465678

SEQ ID NO: 577199 - RNA, 64 nt, hsa
uaaugcauguauuuguaaaccagauuuguuuaccacucaaaauuaacuuguuuucuucauccaa

SEQ ID NO: 577200 - RNA, 64 nt, hsa
ugccagaaaaaccgucacuugcaaaauacuuugcacucaaaauguuuuuacaaugcuucuaaau

SEQ ID NO: 577201 - RNA, 64 nt, hsa
cauuugcauaguucagacuaggagccaaaugaagacucaaaaccaagcuaguuauuaauccaag

SEQ ID NO: 577202 - RNA, 64 nt, hsa
uuguacuucagacauuuagagcagaauuccaagaacucaaaagugaaaagcaacaagcagcuuu

SEQ ID NO: 577203 - RNA, 64 nt, hsa
uucaaucacacuuuguggaaaaacauuuccagggacucaaaauuccaaaaagguggucaaauuc

SEQ ID NO: 577204 - RNA, 64 nt, hsa
uggcugcugcuguuuucuucauuuuauguuaaugacucaaaaaagguauuuuuauagaauuuuu

SEQ ID NO: 577205 - RNA, 64 nt, hsa
aguugcuguuccuggaguaucuaacuuucaguuuacucaaaaacuuuuggguaaauaaaaaagg

SEQ ID NO: 577206 - RNA, 64 nt, hsa
guucuguaagaaaugagugguauuugauguauuuacucaaaacacaauuugcacuguacacuag

SEQ ID NO: 577207 - RNA, 64 nt, hsa
uuugauaaugacuggacaucagaagaggaaaaaaacucaaaacaaaagcgagagagacuauugc

SEQ ID NO: 577208 - RNA, 64 nt, hsa
caaaacaaaagcgagagagacuauugccauaugaacucaaaagcuaucaugguguucacucuac

SEQ ID NO: 577209 - RNA, 64 nt, hsa
cacaggaagugaagaaucuguuucccagcaguggacucaaaacccaucugggcuccuaaccuuc

SEQ ID NO: 577210 - RNA, 64 nt, hsa
caucuuggcacauuuaagagacagucaccccaggacucaaaaauagggaaguaacaguaacgca

SEQ ID NO: 577211 - RNA, 64 nt, hsa; identical to SEQ ID NO: 46013

SEQ ID NO: 577212 - RNA, 64 nt, hsa; identical to SEQ ID NO: 46014

SEQ ID NO: 577213 - RNA, 64 nt, hsa; identical to SEQ ID NO: 46015

SEQ ID NO: 577214 - RNA, 64 nt, hsa; identical to SEQ ID NO: 46016

SEQ ID NO: 577215 - RNA, 64 nt, hsa; identical to SEQ ID NO: 46017

SEQ ID NO: 577216 - RNA, 64 nt, hsa; identical to SEQ ID NO: 46018

SEQ ID NO: 577217 - RNA, 64 nt, hsa; identical to SEQ ID NO: 46019

SEQ ID NO: 577218 - RNA, 64 nt, hsa; identical to SEQ ID NO: 46020

SEQ ID NO: 577219 - RNA, 64 nt, hsa; identical to SEQ ID NO: 46021

SEQ ID NO: 577220 - RNA, 64 nt, hsa; identical to SEQ ID NO: 46022

SEQ ID NO: 577221 - RNA, 64 nt, hsa; identical to SEQ ID NO: 46023

SEQ ID NO: 577222 - RNA, 64 nt, hsa; identical to SEQ ID NO: 46024

SEQ ID NO: 577223 - RNA, 64 nt, hsa; identical to SEQ ID NO: 46025

SEQ ID NO: 577224 - RNA, 64 nt, hsa; identical to SEQ ID NO: 46026

SEQ ID NO: 577225 - RNA, 64 nt, hsa; identical to SEQ ID NO: 46027

SEQ ID NO: 577226 - RNA, 64 nt, hsa; identical to SEQ ID NO: 46028

SEQ ID NO: 577227 - RNA, 64 nt, hsa; identical to SEQ ID NO: 46029

SEQ ID NO: 577228 - RNA, 64 nt, hsa; identical to SEQ ID NO: 46030

SEQ ID NO: 577229 - RNA, 64 nt, hsa; identical to SEQ ID NO: 385288

SEQ ID NO: 577230 - RNA, 64 nt, hsa; identical to SEQ ID NO: 385289

SEQ ID NO: 577231 - RNA, 64 nt, hsa; identical to SEQ ID NO: 385290

SEQ ID NO: 577232 - RNA, 64 nt, hsa; identical to SEQ ID NO: 385291

SEQ ID NO: 577233 - RNA, 64 nt, hsa; identical to SEQ ID NO: 385292

SEQ ID NO: 577234 - RNA, 64 nt, hsa; identical to SEQ ID NO: 385293

SEQ ID NO: 577235 - RNA, 64 nt, hsa; identical to SEQ ID NO: 385294

SEQ ID NO: 577236 - RNA, 64 nt, hsa; identical to SEQ ID NO: 385295

SEQ ID NO: 577237 - RNA, 64 nt, hsa; identical to SEQ ID NO: 312854

SEQ ID NO: 577238 - RNA, 64 nt, hsa; identical to SEQ ID NO: 312855

SEQ ID NO: 577239 - RNA, 64 nt, hsa; identical to SEQ ID NO: 312856

SEQ ID NO: 577240 - RNA, 64 nt, hsa; identical to SEQ ID NO: 312857

SEQ ID NO: 577241 - RNA, 64 nt, hsa; identical to SEQ ID NO: 312858

SEQ ID NO: 577242 - RNA, 64 nt, hsa; identical to SEQ ID NO: 312859

SEQ ID NO: 577243 - RNA, 64 nt, hsa; identical to SEQ ID NO: 312860

SEQ ID NO: 577244 - RNA, 64 nt, hsa; identical to SEQ ID NO: 312861

SEQ ID NO: 577245 - RNA, 64 nt, hsa; identical to SEQ ID NO: 312862

SEQ ID NO: 577246 - RNA, 64 nt, hsa; identical to SEQ ID NO: 312863

SEQ ID NO: 577247 - RNA, 64 nt, hsa; identical to SEQ ID NO: 312864

SEQ ID NO: 577248 - RNA, 64 nt, hsa; identical to SEQ ID NO: 312865

SEQ ID NO: 577249 - RNA, 64 nt, hsa; identical to SEQ ID NO: 312866

SEQ ID NO: 577250 - RNA, 64 nt, hsa; identical to SEQ ID NO: 312867

SEQ ID NO: 577251 - RNA, 64 nt, hsa; identical to SEQ ID NO: 312868

SEQ ID NO: 577252 - RNA, 64 nt, hsa; identical to SEQ ID NO: 312869

SEQ ID NO: 577253 - RNA, 64 nt, hsa; identical to SEQ ID NO: 312870

SEQ ID NO: 577254 - RNA, 64 nt, hsa; identical to SEQ ID NO: 312871

SEQ ID NO: 577255 - RNA, 64 nt, hsa; identical to SEQ ID NO: 312872

SEQ ID NO: 577256 - RNA, 64 nt, hsa; identical to SEQ ID NO: 312873

SEQ ID NO: 577257 - RNA, 64 nt, hsa; identical to SEQ ID NO: 312874

SEQ ID NO: 577258 - RNA, 64 nt, hsa; identical to SEQ ID NO: 312875

SEQ ID NO: 577259 - RNA, 64 nt, hsa; identical to SEQ ID NO: 312876

SEQ ID NO: 577260 - RNA, 64 nt, hsa; identical to SEQ ID NO: 312877

SEQ ID NO: 577261 - RNA, 64 nt, hsa; identical to SEQ ID NO: 312878

SEQ ID NO: 577262 - RNA, 64 nt, hsa; identical to SEQ ID NO: 312879

SEQ ID NO: 577263 - RNA, 64 nt, hsa; identical to SEQ ID NO: 312880

SEQ ID NO: 577264 - RNA, 64 nt, hsa; identical to SEQ ID NO: 312881

SEQ ID NO: 577265 - RNA, 64 nt, hsa; identical to SEQ ID NO: 312882

SEQ ID NO: 577266 - RNA, 64 nt, hsa; identical to SEQ ID NO: 312883

SEQ ID NO: 577267 - RNA, 64 nt, hsa; identical to SEQ ID NO: 312884

SEQ ID NO: 577268 - RNA, 64 nt, hsa; identical to SEQ ID NO: 312885

SEQ ID NO: 577269 - RNA, 64 nt, hsa; identical to SEQ ID NO: 312886

SEQ ID NO: 577270 - RNA, 64 nt, hsa; identical to SEQ ID NO: 312887

SEQ ID NO: 577271 - RNA, 64 nt, hsa; identical to SEQ ID NO: 312888

SEQ ID NO: 577272 - RNA, 64 nt, hsa; identical to SEQ ID NO: 312889

SEQ ID NO: 577273 - RNA, 64 nt, hsa; identical to SEQ ID NO: 312890

SEQ ID NO: 577274 - RNA, 64 nt, hsa; identical to SEQ ID NO: 312891

SEQ ID NO: 577275 - RNA, 64 nt, hsa; identical to SEQ ID NO: 312892

SEQ ID NO: 577276 - RNA, 64 nt, hsa; identical to SEQ ID NO: 312893

SEQ ID NO: 577277 - RNA, 64 nt, hsa; identical to SEQ ID NO: 312894

SEQ ID NO: 577278 - RNA, 64 nt, hsa; identical to SEQ ID NO: 312895

SEQ ID NO: 577279 - RNA, 64 nt, hsa; identical to SEQ ID NO: 312896

SEQ ID NO: 577280 - RNA, 64 nt, hsa; identical to SEQ ID NO: 312897

SEQ ID NO: 577281 - RNA, 64 nt, hsa; identical to SEQ ID NO: 312898

SEQ ID NO: 577282 - RNA, 64 nt, hsa; identical to SEQ ID NO: 312899

SEQ ID NO: 577283 - RNA, 64 nt, hsa; identical to SEQ ID NO: 312900

SEQ ID NO: 577284 - RNA, 64 nt, hsa; identical to SEQ ID NO: 312901

SEQ ID NO: 577285 - RNA, 64 nt, hsa; identical to SEQ ID NO: 312902

SEQ ID NO: 577286 - RNA, 64 nt, hsa; identical to SEQ ID NO: 312903

SEQ ID NO: 577287 - RNA, 64 nt, hsa; identical to SEQ ID NO: 312904

SEQ ID NO: 577288 - RNA, 64 nt, hsa; identical to SEQ ID NO: 312905

SEQ ID NO: 577289 - RNA, 64 nt, hsa; identical to SEQ ID NO: 312906

SEQ ID NO: 577290 - RNA, 64 nt, hsa; identical to SEQ ID NO: 312907

SEQ ID NO: 577291 - RNA, 64 nt, hsa; identical to SEQ ID NO: 312908

SEQ ID NO: 577292 - RNA, 64 nt, hsa; identical to SEQ ID NO: 312909

SEQ ID NO: 577293 - RNA, 64 nt, hsa; identical to SEQ ID NO: 312910

SEQ ID NO: 577294 - RNA, 64 nt, hsa; identical to SEQ ID NO: 312911

SEQ ID NO: 577295 - RNA, 64 nt, hsa; identical to SEQ ID NO: 312912

SEQ ID NO: 577296 - RNA, 64 nt, hsa; identical to SEQ ID NO: 312913

SEQ ID NO: 577297 - RNA, 64 nt, hsa; identical to SEQ ID NO: 312914

SEQ ID NO: 577298 - RNA, 64 nt, hsa; identical to SEQ ID NO: 312915

SEQ ID NO: 577299 - RNA, 64 nt, hsa; identical to SEQ ID NO: 312916

SEQ ID NO: 577300 - RNA, 64 nt, hsa; identical to SEQ ID NO: 312917

SEQ ID NO: 577301 - RNA, 64 nt, hsa; identical to SEQ ID NO: 312918

SEQ ID NO: 577302 - RNA, 64 nt, hsa; identical to SEQ ID NO: 312919

SEQ ID NO: 577303 - RNA, 64 nt, hsa; identical to SEQ ID NO: 312920

SEQ ID NO: 577304 - RNA, 64 nt, hsa; identical to SEQ ID NO: 312921

SEQ ID NO: 577305 - RNA, 64 nt, hsa; identical to SEQ ID NO: 312922

SEQ ID NO: 577306 - RNA, 64 nt, hsa; identical to SEQ ID NO: 312923

SEQ ID NO: 577307 - RNA, 64 nt, hsa
gaaugucuggagagggccagcaggcccucugaggguucuggaaucugugcaccuuauuugacca

SEQ ID NO: 577308 - RNA, 64 nt, hsa
acucccaauguuguuaaugcucugucuuccauuuguucuggaauccuacguguuggucuguggu

SEQ ID NO: 577309 - RNA, 64 nt, hsa
gucaagguucucuuggcuggacaucauuaagaaaguucuggaaacuguguuuguuugaugcugg

SEQ ID NO: 577310 - RNA, 64 nt, hsa
cugggaaaugucuacaaaugucuauuucuacugaguucuggaagaaauaugcaaaaguggguac

SEQ ID NO: 577311 - RNA, 64 nt, hsa
uggauacaaaguuucugauuggggugaugagaaaguucuggagguggauggggaggaugguugc

SEQ ID NO: 577312 - RNA, 64 nt, hsa
gaaccaaauauuagcuuugauggcagcauacaguguucuggaaaagaugccauucuuuuuaagc

SEQ ID NO: 577313 - RNA, 64 nt, hsa
ugacagcuuggugggaagggaagcacacucugcuguucuggaaucuuaugcccaggguuuuuca

SEQ ID NO: 577314 - RNA, 64 nt, hsa
guucccaccucuccuccuugggagguuccaguggguucuggagggagggugggcugugugcagc

SEQ ID NO: 577315 - RNA, 64 nt, hsa
aacugguuuucaccaaguccaaccaccgcaaugaguucuggagugcucugcuggagaaggcuua

SEQ ID NO: 577316 - RNA, 64 nt, hsa
cccgucugcagcaccaggucacugaggauggagaguucuggauguccuaugaggauuucaucua

SEQ ID NO: 577317 - RNA, 64 nt, hsa
ugacaaggauggagaugguaucaucaagcucaacguucuggaguggcugcagcucaccauguau

SEQ ID NO: 577318 - RNA, 64 nt, hsa
uuugugucucuguugucuaaaauagguuuucccuguucuggacauuucauauaaauggaaucac

SEQ ID NO: 577319 - RNA, 64 nt, hsa
auccagaaaguuguguaggcaccaccucugucacguucuggaacauucugucaucaccccguga

SEQ ID NO: 577320 - RNA, 64 nt, hsa
cuugguuucaccaucuuccuguccugccugacaguucgcucauuccaacuaaucaucaucuuca

SEQ ID NO: 577321 - RNA, 64 nt, hsa
cuaaggacucucaaaccauaccugguggggguucuucgcucaaccucuucuucccuaggucaaa

SEQ ID NO: 577322 - RNA, 64 nt, hsa
cagaccuggacucacagccuggcugugaugcuuguucgcucagcuucuccauuuaugagauggg

SEQ ID NO: 577323 - RNA, 64 nt, hsa
ccaagcaagacaugcaguuucaugccucugugccuucgcucaugcuguuucuuccgacuggaau

SEQ ID NO: 577324 - RNA, 64 nt, hsa
ccuguccaaaauugcagacuugaaaaguuuguucuucgcucaauuuuuuuguggacuacuuuuu

SEQ ID NO: 577325 - RNA, 64 nt, hsa
auuaccagagcaaaguguaacggccaacacuuuguucgcucauuuuacgcugucucugacauaa

SEQ ID NO: 577326 - RNA, 56 nt, hsa
aaauuaaaagaggauauugaaaaauguucgcucauuugugauauuauaaaacaugu

SEQ ID NO: 577327 - RNA, 64 nt, hsa
gugccaugccaauuguucuuauauucuauagaaguucgcucaaaauacucaacaggggaauagg

SEQ ID NO: 577328 - RNA, 64 nt, hsa
gcaauaacuggaggcgccuccuuccugcccacccuucgcucacgccccagcgcccucucugacc

SEQ ID NO: 577329 - RNA, 64 nt, hsa
aguccuuugaaagggaagcaaguuccggaauuuguucgcucauggaacuauaacaccuuagagc

SEQ ID NO: 577330 - RNA, 64 nt, hsa
uuuucagaagacugugacaaguucuggcccaggauucgcucacugacccucaauuguccucuuu

SEQ ID NO: 577331 - RNA, 64 nt, hsa
auugucggcucaacaucucaggccacucauuaccuucgcucaugaucccagcagccauuuuucu

SEQ ID NO: 577332 - RNA, 64 nt, hsa
acagcgaauacagcaaacagauuuuauuaccuaguucgcucaaacacuacaugaaguuauuuua

SEQ ID NO: 577333 - RNA, 64 nt, hsa
aacaucuuucucagccuauuuuguguccuaaugauucgcucaauaaacauguuugaauccacac

SEQ ID NO: 577334 - RNA, 64 nt, hsa
gggaggggagggcacguucuugacacaugggaacuucgcucaggagggccuccccuuccccucu

SEQ ID NO: 577335 - RNA, 64 nt, hsa
uuguuucuguucuuauguaaauaagaauccauuauucgcucauguggaagcuucuuuugcauca

SEQ ID NO: 577336 - RNA, 64 nt, hsa
augaaauggguuuagggaagacauugcaauguauuucgcucaucuggacccugcagugucaggg

SEQ ID NO: 577337 - RNA, 64 nt, hsa
cucucauuuuuaccagucugagugacagguccccuucgcucaucauucagauggcuuuccagau

SEQ ID NO: 577338 - RNA, 64 nt, hsa
aaagagcaaaguucaagugccuacuuaugugucauucgcucauguaagaguuuuuaagagaggg

SEQ ID NO: 577339 - RNA, 64 nt, hsa
guuuauaccucagauugggguauaaaaauuguuuuucgcucaguauuuacuggaaaauggacau

SEQ ID NO: 577340 - RNA, 64 nt, hsa
uguauggugaauauauuauuaaauaaugugguacuucgcucaucaggcauaaugucuaaaaucu

SEQ ID NO: 577341 - RNA, 64 nt, hsa
uucccucgcccccacccucuaccccacccccaccuucgcucagacuuuaccggcuuuccccagu

SEQ ID NO: 577342 - RNA, 64 nt, hsa
gugacucucaggguaucuucuccuuccagcuacuuucgcucacugaucucagcuuauccugcaa

SEQ ID NO: 577343 - RNA, 64 nt, hsa
agauacauguucccacagaggugccugcuccgucuucgcucaccagacacucaggcaggcuggc

SEQ ID NO: 577344 - RNA, 64 nt, hsa
uaguuggauggcauagagaucauacucagaaaccuucgcucacgcagcagguaucugguaaguc

SEQ ID NO: 577345 - RNA, 64 nt, hsa; identical to SEQ ID NO: 577344

SEQ ID NO: 577346 - RNA, 64 nt, hsa
gaggagaaggagccccucagcagaguggugcaguuucgcucagagcuugucuccuuggcuucca

SEQ ID NO: 577347 - RNA, 64 nt, hsa
cacauccugcugugauguaaacagaaaucacgaauucgcucacuggaucaaguuguuccacugg

SEQ ID NO: 577348 - RNA, 64 nt, hsa
guuaccugugacuauggagccaaugggaugugacuucgcucaucacggacagucauuccuucuc

SEQ ID NO: 577349 - RNA, 64 nt, hsa
guuuccacuuaaaucguuuugcacaaagucuugcuucgcucagaugagaugagauaugauuucc

SEQ ID NO: 577350 - RNA, 64 nt, hsa
cugggccuggggcgcgaccucggcccggccucccuucgcucagcuucuccgcgccccugcuccc

SEQ ID NO: 577351 - RNA, 64 nt, hsa
ugccuugccgcagagaaaacaccaaagucuccuguucgcucauaaagaaguuuuugggauggga

SEQ ID NO: 577352 - RNA, 64 nt, hsa
uugagagguugauguaaccuuuuaaaggccucaguucgcucaccugugaaaugggucuaagaau

SEQ ID NO: 577353 - RNA, 64 nt, hsa
cccacucaucucaggcugagccacaucucacuuuuucgcucaagcuauauaauccuagacugga

SEQ ID NO: 577354 - RNA, 64 nt, hsa
gcauuuggugcagcaggaaacauggggacugccuaggcucgaaucuguggcacccugagcaauu

SEQ ID NO: 577355 - RNA, 64 nt, hsa
cuguuagcucgugguccucaaggacucagaaaccaggcucgaggccuaucccagcaagugcugc

SEQ ID NO: 577356 - RNA, 64 nt, hsa
acgagacuuucagcauccaguagaugggaccucgaggcucgagcugaagcaggcgagagagaaa

SEQ ID NO: 577357 - RNA, 64 nt, hsa
augcccuuuuggccuuugugagggagcgaggaacaggcucgaaggcuccgggguaucugccuuc

SEQ ID NO: 577358 - RNA, 64 nt, hsa
gaauuuaugggacccacgugagcagaccugaggaaggcucgauuucuuuuguuucuugguccac

SEQ ID NO: 577359 - RNA, 64 nt, hsa
ccggcaccagcaggcccuuggggggcucaccugaaggcucgaaggcacugcacacuuguauauu

SEQ ID NO: 577360 - RNA, 64 nt, hsa
aauaagacaaaaucagcuuuacaacaaucccuagaggcucgaccacagaauaaugccagucacc

SEQ ID NO: 577361 - RNA, 64 nt, hsa
auacgccuuuuuuuuuuuucuuuuccugucgccaaggcucgacugagagaagucagaacagaga

SEQ ID NO: 577362 - RNA, 64 nt, hsa
cugaggcugcugccaggcccggcaugaggccccgaggcucgagcucggggcugggggcugcagg

SEQ ID NO: 577363 - RNA, 64 nt, hsa
gugguugaucauagcucccgggcuguagucucccaggcucgagcaauccucccacuucacccuc

SEQ ID NO: 577364 - RNA, 64 nt, hsa
gacuuuagucugcugggcuguauugaccucuggcaggcucgaagccucacuggguaugcaguca

SEQ ID NO: 577365 - RNA, 64 nt, hsa
gcugaccgaucucccuccuccucaccccaagugaaggcucgagacuuccugccccacccagugg

SEQ ID NO: 577366 - RNA, 64 nt, hsa
aauucaccugccccucccccaucccagguuguggaggcucgaggaagcugacuucuuaggcuaa

SEQ ID NO: 577367 - RNA, 64 nt, hsa
ccucucacccuccuccagucccacuucaggcagcaggcucgaguuugaggccauacaucagggg

SEQ ID NO: 577368 - RNA, 64 nt, hsa
aaaaagauauauuaaaaauauaaaacugcguuaaaggcucgauuuuguaucugcaggcagacac

SEQ ID NO: 577369 - RNA, 64 nt, hsa
gaggggcuaggggagaagcugcagcuggagcugaaggcucgaucuugugaaccccuaaauccgc

SEQ ID NO: 577370 - RNA, 64 nt, hsa
gauugaucauggcucacuguaaccucugccucccaggcucgauccucccaugucagccucccaa

SEQ ID NO: 577371 - RNA, 64 nt, hsa
uuccucuauggcuuugccuuucugauuuucucagaggcucgagucuuuaauauaaccccaaaug

SEQ ID NO: 577372 - RNA, 64 nt, hsa
ggauccacuguguaagaagacuguuggcaguggaaggcucgaguugauuaagugacaaagaggu

SEQ ID NO: 577373 - RNA, 64 nt, hsa
ggucccggcccuggcccagccagcccagcccucgaggcucgaugccugugccaaggccaggggc

SEQ ID NO: 577374 - RNA, 64 nt, hsa
ggcgcccgcacccacccggcccggccccgagagcaggcucgaccgccgccccauggaccccucg

SEQ ID NO: 577375 - RNA, 64 nt, hsa
caggcuggacaaaugaccacuauguuagacccccaggcucgacuucaggggucaguguuccugu

SEQ ID NO: 577376 - RNA, 64 nt, hsa
agccugcaggcuggggacccugggugcaggugccaggcucgaggcuguucccuguccugccuca

SEQ ID NO: 577377 - RNA, 64 nt, hsa
uucuuucauucgucuccuccuagccugggggaccaggcucgaacugacccuggacaucaaagga

SEQ ID NO: 577378 - RNA, 64 nt, hsa
uuuuugggcugagcuguuagaggggcuucuccagaggcucgagagcaggccauuucccaagaag

SEQ ID NO: 577379 - RNA, 64 nt, hsa
ccaggucaaauuacuuuccuuuggccucugccugaggcucgauuugccucucugguccaauggg

SEQ ID NO: 577380 - RNA, 64 nt, hsa
aagcucaacuugagggcguguaguaaguuguagaaggcucgaggggacguggacuuauuugccu

SEQ ID NO: 577381 - RNA, 64 nt, hsa
cccagcucaggccggcugaccgugguggugcuggaggcucgaggccugcguccaggacuugcag

SEQ ID NO: 577382 - RNA, 64 nt, hsa
gcacgccagugcuguuucccggccuccagacacaaggcucgagguuauggcagugacuuucagc

SEQ ID NO: 577383 - RNA, 64 nt, hsa
gagggccaggggcgugcaugccaggccgggccggaggcucgaaagucccgcgcgagcgccacgg

SEQ ID NO: 577384 - RNA, 64 nt, hsa
cagcccaucuuccuaaaagggaccagcuuauggaaggcucgaccuugaggggaaaguuuuacug

SEQ ID NO: 577385 - RNA, 62 nt, hsa
agaagcggaaaggccguuaaucacuuuuaugaaggcucgaguucugcuguucuguaaaagag

SEQ ID NO: 577386 - RNA, 64 nt, hsa
cuuugcaaguuugccaccaguagauaccggccacaggcucgacaaauaguggucuuuguuauua

SEQ ID NO: 577387 - RNA, 64 nt, hsa
caacagaaagauggggcugucccagccguaagucaggcucgagggagacugauccccugaccaa

SEQ ID NO: 577388 - RNA, 64 nt, hsa
agacaacagcacacaggcagccagccguggccagaggcucgaggggcucagggccucaggcacc

SEQ ID NO: 577389 - RNA, 64 nt, hsa
gaguacuaacauuuauugcucugucaauaaugaaaggcucgauguaauauagcuguaauuuacu

SEQ ID NO: 577390 - RNA, 64 nt, hsa
aauauauuuuuuucaacugccaaucaaggcuaggaggcucgaccaccucaacauuggagacauc

SEQ ID NO: 577391 - RNA, 64 nt, hsa
cauaaagucagggguucccuuuuuuggcugcugaaggcucgagcaugccuggauggggcugcac

SEQ ID NO: 577392 - RNA, 64 nt, hsa
ccuagaagcagccggcacaggagggaagguggccaggcucgaagcagucucuguuuccagcacu

SEQ ID NO: 577393 - RNA, 64 nt, hsa
aauguacaccuacucuaucagagaaaaacaggaaaggcucgaaauacaagccauucuaaggaaa

SEQ ID NO: 577394 - RNA, 64 nt, hsa
uccuauccccgacccccuccggggaacaccgggaaggcucgacgcuccaggacaggaccagcca

SEQ ID NO: 577395 - RNA, 64 nt, hsa
accggcuggggaucuguggggcagcggcgggcgcaggcucgacccgggccaggaggcccggggc

SEQ ID NO: 577396 - RNA, 64 nt, hsa
auaaauguagugagugugggaaagcuuuuagcaaaggcucgaaucuuacugcccaucaaagagu

SEQ ID NO: 577397 - RNA, 64 nt, hsa
ucgccccugggggcguagcacagcgucuucucggaggcucgaggucuaagagaaacgcugaguu

SEQ ID NO: 577398 - RNA, 63 nt, hsa
ccaagagcaagaagaacugaggagugguggaccaggcucgaacacuggccgaggaggagcucu

SEQ ID NO: 577399 - RNA, 64 nt, hsa
cggcuuuggggagaugggcgauaaguguugagguaggcucgagaacugcuccccaaaucaguga

SEQ ID NO: 577400 - RNA, 64 nt, hsa
cuaauucauuuauuaaguauauuuguaaaagcuaaggcucgaguuaaaacaaugaaguguuuua

SEQ ID NO: 577401 - RNA, 64 nt, hsa; identical to SEQ ID NO: 162601

SEQ ID NO: 577402 - RNA, 64 nt, hsa; identical to SEQ ID NO: 162602

SEQ ID NO: 577403 - RNA, 64 nt, hsa; identical to SEQ ID NO: 162603

SEQ ID NO: 577404 - RNA, 64 nt, hsa; identical to SEQ ID NO: 162604

SEQ ID NO: 577405 - RNA, 64 nt, hsa; identical to SEQ ID NO: 162605

SEQ ID NO: 577406 - RNA, 64 nt, hsa; identical to SEQ ID NO: 162606

SEQ ID NO: 577407 - RNA, 64 nt, hsa; identical to SEQ ID NO: 162607

SEQ ID NO: 577408 - RNA, 64 nt, hsa; identical to SEQ ID NO: 162608

SEQ ID NO: 577409 - RNA, 64 nt, hsa; identical to SEQ ID NO: 162609

SEQ ID NO: 577410 - RNA, 64 nt, hsa; identical to SEQ ID NO: 162610

SEQ ID NO: 577411 - RNA, 64 nt, hsa; identical to SEQ ID NO: 162611

SEQ ID NO: 577412 - RNA, 64 nt, hsa; identical to SEQ ID NO: 162612

SEQ ID NO: 577413 - RNA, 64 nt, hsa; identical to SEQ ID NO: 162613

SEQ ID NO: 577414 - RNA, 64 nt, hsa; identical to SEQ ID NO: 162614

SEQ ID NO: 577415 - RNA, 64 nt, hsa; identical to SEQ ID NO: 162615

SEQ ID NO: 577416 - RNA, 64 nt, hsa; identical to SEQ ID NO: 162616

SEQ ID NO: 577417 - RNA, 64 nt, hsa; identical to SEQ ID NO: 162617

SEQ ID NO: 577418 - RNA, 64 nt, hsa; identical to SEQ ID NO: 162618

SEQ ID NO: 577419 - RNA, 64 nt, hsa; identical to SEQ ID NO: 162619

SEQ ID NO: 577420 - RNA, 64 nt, hsa; identical to SEQ ID NO: 162620

SEQ ID NO: 577421 - RNA, 64 nt, hsa; identical to SEQ ID NO: 162621

SEQ ID NO: 577422 - RNA, 64 nt, hsa; identical to SEQ ID NO: 162622

SEQ ID NO: 577423 - RNA, 64 nt, hsa; identical to SEQ ID NO: 162623

SEQ ID NO: 577424 - RNA, 64 nt, hsa; identical to SEQ ID NO: 162624

SEQ ID NO: 577425 - RNA, 64 nt, hsa; identical to SEQ ID NO: 162625

SEQ ID NO: 577426 - RNA, 64 nt, hsa; identical to SEQ ID NO: 162626

SEQ ID NO: 577427 - RNA, 64 nt, hsa; identical to SEQ ID NO: 162627

SEQ ID NO: 577428 - RNA, 64 nt, hsa; identical to SEQ ID NO: 162628

SEQ ID NO: 577429 - RNA, 64 nt, hsa; identical to SEQ ID NO: 162629

SEQ ID NO: 577430 - RNA, 64 nt, hsa; identical to SEQ ID NO: 162630

SEQ ID NO: 577431 - RNA, 64 nt, hsa; identical to SEQ ID NO: 162631

SEQ ID NO: 577432 - RNA, 64 nt, hsa; identical to SEQ ID NO: 162632

SEQ ID NO: 577433 - RNA, 64 nt, hsa; identical to SEQ ID NO: 162633

SEQ ID NO: 577434 - RNA, 64 nt, hsa; identical to SEQ ID NO: 162634

SEQ ID NO: 577435 - RNA, 64 nt, hsa; identical to SEQ ID NO: 162635

SEQ ID NO: 577436 - RNA, 64 nt, hsa; identical to SEQ ID NO: 162636

SEQ ID NO: 577437 - RNA, 64 nt, hsa; identical to SEQ ID NO: 162637

SEQ ID NO: 577438 - RNA, 64 nt, hsa; identical to SEQ ID NO: 162638

SEQ ID NO: 577439 - RNA, 64 nt, hsa; identical to SEQ ID NO: 162639

SEQ ID NO: 577440 - RNA, 64 nt, hsa; identical to SEQ ID NO: 162640

SEQ ID NO: 577441 - RNA, 64 nt, hsa; identical to SEQ ID NO: 162641

SEQ ID NO: 577442 - RNA, 64 nt, hsa; identical to SEQ ID NO: 162642

SEQ ID NO: 577443 - RNA, 64 nt, hsa; identical to SEQ ID NO: 162643

SEQ ID NO: 577444 - RNA, 64 nt, hsa; identical to SEQ ID NO: 162644

SEQ ID NO: 577445 - RNA, 64 nt, hsa; identical to SEQ ID NO: 162645

SEQ ID NO: 577446 - RNA, 64 nt, hsa; identical to SEQ ID NO: 162646

SEQ ID NO: 577447 - RNA, 64 nt, hsa; identical to SEQ ID NO: 162647

SEQ ID NO: 577448 - RNA, 64 nt, hsa; identical to SEQ ID NO: 162648

SEQ ID NO: 577449 - RNA, 64 nt, hsa; identical to SEQ ID NO: 162649

SEQ ID NO: 577450 - RNA, 64 nt, hsa; identical to SEQ ID NO: 162650

SEQ ID NO: 577451 - RNA, 64 nt, hsa; identical to SEQ ID NO: 162651

SEQ ID NO: 577452 - RNA, 64 nt, hsa; identical to SEQ ID NO: 162652

SEQ ID NO: 577453 - RNA, 64 nt, hsa; identical to SEQ ID NO: 162653

SEQ ID NO: 577454 - RNA, 64 nt, hsa; identical to SEQ ID NO: 162654

SEQ ID NO: 577455 - RNA, 64 nt, hsa; identical to SEQ ID NO: 162655

SEQ ID NO: 577456 - RNA, 64 nt, hsa; identical to SEQ ID NO: 162656

SEQ ID NO: 577457 - RNA, 64 nt, hsa; identical to SEQ ID NO: 162657

SEQ ID NO: 577458 - RNA, 64 nt, hsa; identical to SEQ ID NO: 162658

SEQ ID NO: 577459 - RNA, 64 nt, hsa; identical to SEQ ID NO: 162659

SEQ ID NO: 577460 - RNA, 64 nt, hsa; identical to SEQ ID NO: 162660

SEQ ID NO: 577461 - RNA, 64 nt, hsa; identical to SEQ ID NO: 162661

SEQ ID NO: 577462 - RNA, 64 nt, hsa; identical to SEQ ID NO: 162662

SEQ ID NO: 577463 - RNA, 64 nt, hsa; identical to SEQ ID NO: 162663

SEQ ID NO: 577464 - RNA, 64 nt, hsa; identical to SEQ ID NO: 162664

SEQ ID NO: 577465 - RNA, 64 nt, hsa; identical to SEQ ID NO: 162665

SEQ ID NO: 577466 - RNA, 64 nt, hsa; identical to SEQ ID NO: 162666

SEQ ID NO: 577467 - RNA, 64 nt, hsa; identical to SEQ ID NO: 162667

SEQ ID NO: 577468 - RNA, 64 nt, hsa; identical to SEQ ID NO: 162668

SEQ ID NO: 577469 - RNA, 64 nt, hsa; identical to SEQ ID NO: 162669

SEQ ID NO: 577470 - RNA, 64 nt, hsa; identical to SEQ ID NO: 162670

SEQ ID NO: 577471 - RNA, 64 nt, hsa; identical to SEQ ID NO: 162671

SEQ ID NO: 577472 - RNA, 64 nt, hsa; identical to SEQ ID NO: 162672

SEQ ID NO: 577473 - RNA, 64 nt, hsa; identical to SEQ ID NO: 162673

SEQ ID NO: 577474 - RNA, 64 nt, hsa; identical to SEQ ID NO: 162674

SEQ ID NO: 577475 - RNA, 64 nt, hsa; identical to SEQ ID NO: 162675

SEQ ID NO: 577476 - RNA, 64 nt, hsa; identical to SEQ ID NO: 162676

SEQ ID NO: 577477 - RNA, 64 nt, hsa; identical to SEQ ID NO: 162677

SEQ ID NO: 577478 - RNA, 64 nt, hsa; identical to SEQ ID NO: 162678

SEQ ID NO: 577479 - RNA, 64 nt, hsa; identical to SEQ ID NO: 162679

SEQ ID NO: 577480 - RNA, 64 nt, hsa; identical to SEQ ID NO: 162680

SEQ ID NO: 577481 - RNA, 64 nt, hsa; identical to SEQ ID NO: 162681

SEQ ID NO: 577482 - RNA, 64 nt, hsa; identical to SEQ ID NO: 162682

SEQ ID NO: 577483 - RNA, 64 nt, hsa; identical to SEQ ID NO: 162683

SEQ ID NO: 577484 - RNA, 64 nt, hsa; identical to SEQ ID NO: 162684

SEQ ID NO: 577485 - RNA, 64 nt, hsa; identical to SEQ ID NO: 162685

SEQ ID NO: 577486 - RNA, 64 nt, hsa; identical to SEQ ID NO: 162686

SEQ ID NO: 577487 - RNA, 64 nt, hsa; identical to SEQ ID NO: 162687

SEQ ID NO: 577488 - RNA, 64 nt, hsa; identical to SEQ ID NO: 162688

SEQ ID NO: 577489 - RNA, 64 nt, hsa; identical to SEQ ID NO: 162689

SEQ ID NO: 577490 - RNA, 64 nt, hsa; identical to SEQ ID NO: 162690

SEQ ID NO: 577491 - RNA, 64 nt, hsa; identical to SEQ ID NO: 162691

SEQ ID NO: 577492 - RNA, 64 nt, hsa; identical to SEQ ID NO: 162692

SEQ ID NO: 577493 - RNA, 64 nt, hsa; identical to SEQ ID NO: 162693

SEQ ID NO: 577494 - RNA, 64 nt, hsa; identical to SEQ ID NO: 162694

SEQ ID NO: 577495 - RNA, 64 nt, hsa; identical to SEQ ID NO: 162695

SEQ ID NO: 577496 - RNA, 64 nt, hsa; identical to SEQ ID NO: 162696

SEQ ID NO: 577497 - RNA, 64 nt, hsa; identical to SEQ ID NO: 162697

SEQ ID NO: 577498 - RNA, 64 nt, hsa; identical to SEQ ID NO: 162698

SEQ ID NO: 577499 - RNA, 64 nt, hsa; identical to SEQ ID NO: 162699

SEQ ID NO: 577500 - RNA, 64 nt, hsa; identical to SEQ ID NO: 162700

SEQ ID NO: 577501 - RNA, 64 nt, hsa; identical to SEQ ID NO: 162701

SEQ ID NO: 577502 - RNA, 64 nt, hsa; identical to SEQ ID NO: 162702

SEQ ID NO: 577503 - RNA, 64 nt, hsa; identical to SEQ ID NO: 162703

SEQ ID NO: 577504 - RNA, 64 nt, hsa; identical to SEQ ID NO: 162704

SEQ ID NO: 577505 - RNA, 64 nt, hsa; identical to SEQ ID NO: 162705

SEQ ID NO: 577506 - RNA, 64 nt, hsa; identical to SEQ ID NO: 162706

SEQ ID NO: 577507 - RNA, 64 nt, hsa; identical to SEQ ID NO: 162707

SEQ ID NO: 577508 - RNA, 64 nt, hsa; identical to SEQ ID NO: 162708

SEQ ID NO: 577509 - RNA, 64 nt, hsa; identical to SEQ ID NO: 162709

SEQ ID NO: 577510 - RNA, 64 nt, hsa; identical to SEQ ID NO: 162710

SEQ ID NO: 577511 - RNA, 64 nt, hsa; identical to SEQ ID NO: 162711

SEQ ID NO: 577512 - RNA, 64 nt, hsa; identical to SEQ ID NO: 162712

SEQ ID NO: 577513 - RNA, 64 nt, hsa; identical to SEQ ID NO: 162713

SEQ ID NO: 577514 - RNA, 64 nt, hsa; identical to SEQ ID NO: 162714

SEQ ID NO: 577515 - RNA, 64 nt, hsa; identical to SEQ ID NO: 162715

SEQ ID NO: 577516 - RNA, 64 nt, hsa; identical to SEQ ID NO: 162716

SEQ ID NO: 577517 - RNA, 64 nt, hsa; identical to SEQ ID NO: 162717

SEQ ID NO: 577518 - RNA, 64 nt, hsa; identical to SEQ ID NO: 162718

SEQ ID NO: 577519 - RNA, 64 nt, hsa; identical to SEQ ID NO: 162719

SEQ ID NO: 577520 - RNA, 64 nt, hsa; identical to SEQ ID NO: 162720

SEQ ID NO: 577521 - RNA, 64 nt, hsa; identical to SEQ ID NO: 162721

SEQ ID NO: 577522 - RNA, 64 nt, hsa; identical to SEQ ID NO: 162722

SEQ ID NO: 577523 - RNA, 64 nt, hsa; identical to SEQ ID NO: 162723

SEQ ID NO: 577524 - RNA, 64 nt, hsa; identical to SEQ ID NO: 162724

SEQ ID NO: 577525 - RNA, 64 nt, hsa; identical to SEQ ID NO: 162725

SEQ ID NO: 577526 - RNA, 64 nt, hsa; identical to SEQ ID NO: 162726

SEQ ID NO: 577527 - RNA, 64 nt, hsa; identical to SEQ ID NO: 162727

SEQ ID NO: 577528 - RNA, 64 nt, hsa; identical to SEQ ID NO: 162728

SEQ ID NO: 577529 - RNA, 64 nt, hsa; identical to SEQ ID NO: 162729

SEQ ID NO: 577530 - RNA, 64 nt, hsa; identical to SEQ ID NO: 162730

SEQ ID NO: 577531 - RNA, 64 nt, hsa; identical to SEQ ID NO: 162731

SEQ ID NO: 577532 - RNA, 64 nt, hsa; identical to SEQ ID NO: 162732

SEQ ID NO: 577533 - RNA, 64 nt, hsa; identical to SEQ ID NO: 162733

SEQ ID NO: 577534 - RNA, 64 nt, hsa; identical to SEQ ID NO: 162734

SEQ ID NO: 577535 - RNA, 64 nt, hsa; identical to SEQ ID NO: 162735

SEQ ID NO: 577536 - RNA, 64 nt, hsa; identical to SEQ ID NO: 162736

SEQ ID NO: 577537 - RNA, 64 nt, hsa; identical to SEQ ID NO: 162737

SEQ ID NO: 577538 - RNA, 64 nt, hsa; identical to SEQ ID NO: 162738

SEQ ID NO: 577539 - RNA, 64 nt, hsa; identical to SEQ ID NO: 162739

SEQ ID NO: 577540 - RNA, 64 nt, hsa; identical to SEQ ID NO: 162740

SEQ ID NO: 577541 - RNA, 64 nt, hsa; identical to SEQ ID NO: 162741

SEQ ID NO: 577542 - RNA, 64 nt, hsa; identical to SEQ ID NO: 162742

SEQ ID NO: 577543 - RNA, 64 nt, hsa; identical to SEQ ID NO: 162743

SEQ ID NO: 577544 - RNA, 64 nt, hsa; identical to SEQ ID NO: 162744

SEQ ID NO: 577545 - RNA, 63 nt, hsa; identical to SEQ ID NO: 162745

SEQ ID NO: 577546 - RNA, 64 nt, hsa; identical to SEQ ID NO: 162746

SEQ ID NO: 577547 - RNA, 64 nt, hsa; identical to SEQ ID NO: 162747

SEQ ID NO: 577548 - RNA, 64 nt, hsa; identical to SEQ ID NO: 162748

SEQ ID NO: 577549 - RNA, 64 nt, hsa; identical to SEQ ID NO: 162749

SEQ ID NO: 577550 - RNA, 64 nt, hsa; identical to SEQ ID NO: 162750

SEQ ID NO: 577551 - RNA, 64 nt, hsa; identical to SEQ ID NO: 162751

SEQ ID NO: 577552 - RNA, 64 nt, hsa; identical to SEQ ID NO: 162752

SEQ ID NO: 577553 - RNA, 64 nt, hsa; identical to SEQ ID NO: 162753

SEQ ID NO: 577554 - RNA, 64 nt, hsa; identical to SEQ ID NO: 162754

SEQ ID NO: 577555 - RNA, 64 nt, hsa; identical to SEQ ID NO: 162755

SEQ ID NO: 577556 - RNA, 64 nt, hsa; identical to SEQ ID NO: 162756

SEQ ID NO: 577557 - RNA, 64 nt, hsa; identical to SEQ ID NO: 162757

SEQ ID NO: 577558 - RNA, 64 nt, hsa; identical to SEQ ID NO: 162758

SEQ ID NO: 577559 - RNA, 64 nt, hsa; identical to SEQ ID NO: 162759

SEQ ID NO: 577560 - RNA, 64 nt, hsa; identical to SEQ ID NO: 162760

SEQ ID NO: 577561 - RNA, 64 nt, hsa; identical to SEQ ID NO: 162761

SEQ ID NO: 577562 - RNA, 64 nt, hsa; identical to SEQ ID NO: 162762

SEQ ID NO: 577563 - RNA, 64 nt, hsa; identical to SEQ ID NO: 162763

SEQ ID NO: 577564 - RNA, 64 nt, hsa; identical to SEQ ID NO: 162764

SEQ ID NO: 577565 - RNA, 64 nt, hsa; identical to SEQ ID NO: 162765

SEQ ID NO: 577566 - RNA, 64 nt, hsa; identical to SEQ ID NO: 162766

SEQ ID NO: 577567 - RNA, 64 nt, hsa; identical to SEQ ID NO: 162767

SEQ ID NO: 577568 - RNA, 64 nt, hsa; identical to SEQ ID NO: 162768

SEQ ID NO: 577569 - RNA, 64 nt, hsa; identical to SEQ ID NO: 162769

SEQ ID NO: 577570 - RNA, 64 nt, hsa; identical to SEQ ID NO: 162770

SEQ ID NO: 577571 - RNA, 64 nt, hsa; identical to SEQ ID NO: 162771

SEQ ID NO: 577572 - RNA, 64 nt, hsa; identical to SEQ ID NO: 162772

SEQ ID NO: 577573 - RNA, 64 nt, hsa; identical to SEQ ID NO: 162773

SEQ ID NO: 577574 - RNA, 64 nt, hsa; identical to SEQ ID NO: 162774

SEQ ID NO: 577575 - RNA, 64 nt, hsa; identical to SEQ ID NO: 162775

SEQ ID NO: 577576 - RNA, 64 nt, hsa; identical to SEQ ID NO: 162776

SEQ ID NO: 577577 - RNA, 64 nt, hsa; identical to SEQ ID NO: 162777

SEQ ID NO: 577578 - RNA, 64 nt, hsa; identical to SEQ ID NO: 162778

SEQ ID NO: 577579 - RNA, 64 nt, hsa; identical to SEQ ID NO: 162779

SEQ ID NO: 577580 - RNA, 64 nt, hsa; identical to SEQ ID NO: 162780

SEQ ID NO: 577581 - RNA, 64 nt, hsa; identical to SEQ ID NO: 162781

SEQ ID NO: 577582 - RNA, 64 nt, hsa; identical to SEQ ID NO: 162782

SEQ ID NO: 577583 - RNA, 64 nt, hsa; identical to SEQ ID NO: 162783

SEQ ID NO: 577584 - RNA, 64 nt, hsa; identical to SEQ ID NO: 162784

SEQ ID NO: 577585 - RNA, 64 nt, hsa; identical to SEQ ID NO: 162785

SEQ ID NO: 577586 - RNA, 64 nt, hsa; identical to SEQ ID NO: 162786

SEQ ID NO: 577587 - RNA, 64 nt, hsa; identical to SEQ ID NO: 162787

SEQ ID NO: 577588 - RNA, 64 nt, hsa; identical to SEQ ID NO: 162788

SEQ ID NO: 577589 - RNA, 64 nt, hsa; identical to SEQ ID NO: 162789

SEQ ID NO: 577590 - RNA, 64 nt, hsa; identical to SEQ ID NO: 162790

SEQ ID NO: 577591 - RNA, 64 nt, hsa; identical to SEQ ID NO: 162791

SEQ ID NO: 577592 - RNA, 64 nt, hsa; identical to SEQ ID NO: 162792

SEQ ID NO: 577593 - RNA, 64 nt, hsa; identical to SEQ ID NO: 162793

SEQ ID NO: 577594 - RNA, 64 nt, hsa; identical to SEQ ID NO: 162794

SEQ ID NO: 577595 - RNA, 64 nt, hsa; identical to SEQ ID NO: 162795

SEQ ID NO: 577596 - RNA, 64 nt, hsa; identical to SEQ ID NO: 162796

SEQ ID NO: 577597 - RNA, 64 nt, hsa; identical to SEQ ID NO: 162797

SEQ ID NO: 577598 - RNA, 64 nt, hsa; identical to SEQ ID NO: 162798

SEQ ID NO: 577599 - RNA, 64 nt, hsa; identical to SEQ ID NO: 162799

SEQ ID NO: 577600 - RNA, 64 nt, hsa; identical to SEQ ID NO: 162800

SEQ ID NO: 577601 - RNA, 64 nt, hsa; identical to SEQ ID NO: 162801

SEQ ID NO: 577602 - RNA, 64 nt, hsa; identical to SEQ ID NO: 162802

SEQ ID NO: 577603 - RNA, 64 nt, hsa; identical to SEQ ID NO: 162803

SEQ ID NO: 577604 - RNA, 64 nt, hsa; identical to SEQ ID NO: 162804

SEQ ID NO: 577605 - RNA, 64 nt, hsa; identical to SEQ ID NO: 162805

SEQ ID NO: 577606 - RNA, 64 nt, hsa; identical to SEQ ID NO: 162806

SEQ ID NO: 577607 - RNA, 64 nt, hsa; identical to SEQ ID NO: 162807

SEQ ID NO: 577608 - RNA, 64 nt, hsa; identical to SEQ ID NO: 162808

SEQ ID NO: 577609 - RNA, 64 nt, hsa; identical to SEQ ID NO: 162809

SEQ ID NO: 577610 - RNA, 64 nt, hsa; identical to SEQ ID NO: 162810

SEQ ID NO: 577611 - RNA, 64 nt, hsa; identical to SEQ ID NO: 162811

SEQ ID NO: 577612 - RNA, 64 nt, hsa; identical to SEQ ID NO: 162812

SEQ ID NO: 577613 - RNA, 64 nt, hsa; identical to SEQ ID NO: 162813

SEQ ID NO: 577614 - RNA, 62 nt, hsa; identical to SEQ ID NO: 162814

SEQ ID NO: 577615 - RNA, 64 nt, hsa; identical to SEQ ID NO: 162815

SEQ ID NO: 577616 - RNA, 64 nt, hsa; identical to SEQ ID NO: 162816

SEQ ID NO: 577617 - RNA, 64 nt, hsa; identical to SEQ ID NO: 162817

SEQ ID NO: 577618 - RNA, 64 nt, hsa; identical to SEQ ID NO: 162818

SEQ ID NO: 577619 - RNA, 64 nt, hsa; identical to SEQ ID NO: 162819

SEQ ID NO: 577620 - RNA, 64 nt, hsa; identical to SEQ ID NO: 162820

SEQ ID NO: 577621 - RNA, 64 nt, hsa; identical to SEQ ID NO: 162821

SEQ ID NO: 577622 - RNA, 64 nt, hsa; identical to SEQ ID NO: 162822

SEQ ID NO: 577623 - RNA, 64 nt, hsa; identical to SEQ ID NO: 162823

SEQ ID NO: 577624 - RNA, 64 nt, hsa; identical to SEQ ID NO: 162824

SEQ ID NO: 577625 - RNA, 64 nt, hsa; identical to SEQ ID NO: 162825

SEQ ID NO: 577626 - RNA, 64 nt, hsa; identical to SEQ ID NO: 162826

SEQ ID NO: 577627 - RNA, 64 nt, hsa; identical to SEQ ID NO: 162827

SEQ ID NO: 577628 - RNA, 64 nt, hsa; identical to SEQ ID NO: 162828

SEQ ID NO: 577629 - RNA, 64 nt, hsa; identical to SEQ ID NO: 162829

SEQ ID NO: 577630 - RNA, 64 nt, hsa; identical to SEQ ID NO: 162830

SEQ ID NO: 577631 - RNA, 64 nt, hsa; identical to SEQ ID NO: 162831

SEQ ID NO: 577632 - RNA, 64 nt, hsa; identical to SEQ ID NO: 162832

SEQ ID NO: 577633 - RNA, 64 nt, hsa; identical to SEQ ID NO: 162833

SEQ ID NO: 577634 - RNA, 64 nt, hsa; identical to SEQ ID NO: 162834

SEQ ID NO: 577635 - RNA, 64 nt, hsa; identical to SEQ ID NO: 162835

SEQ ID NO: 577636 - RNA, 64 nt, hsa; identical to SEQ ID NO: 162836

SEQ ID NO: 577637 - RNA, 64 nt, hsa; identical to SEQ ID NO: 162837

SEQ ID NO: 577638 - RNA, 64 nt, hsa; identical to SEQ ID NO: 162838

SEQ ID NO: 577639 - RNA, 64 nt, hsa; identical to SEQ ID NO: 162839

SEQ ID NO: 577640 - RNA, 64 nt, hsa; identical to SEQ ID NO: 162840

SEQ ID NO: 577641 - RNA, 64 nt, hsa; identical to SEQ ID NO: 162841

SEQ ID NO: 577642 - RNA, 64 nt, hsa; identical to SEQ ID NO: 162842

SEQ ID NO: 577643 - RNA, 64 nt, hsa; identical to SEQ ID NO: 162843

SEQ ID NO: 577644 - RNA, 64 nt, hsa; identical to SEQ ID NO: 162844

SEQ ID NO: 577645 - RNA, 64 nt, hsa; identical to SEQ ID NO: 162845

SEQ ID NO: 577646 - RNA, 64 nt, hsa; identical to SEQ ID NO: 162846

SEQ ID NO: 577647 - RNA, 64 nt, hsa; identical to SEQ ID NO: 162847

SEQ ID NO: 577648 - RNA, 64 nt, hsa; identical to SEQ ID NO: 162848

SEQ ID NO: 577649 - RNA, 64 nt, hsa; identical to SEQ ID NO: 162849

SEQ ID NO: 577650 - RNA, 64 nt, hsa; identical to SEQ ID NO: 162850

SEQ ID NO: 577651 - RNA, 64 nt, hsa; identical to SEQ ID NO: 162851

SEQ ID NO: 577652 - RNA, 64 nt, hsa; identical to SEQ ID NO: 162852

SEQ ID NO: 577653 - RNA, 64 nt, hsa; identical to SEQ ID NO: 162853

SEQ ID NO: 577654 - RNA, 64 nt, hsa; identical to SEQ ID NO: 162854

SEQ ID NO: 577655 - RNA, 64 nt, hsa; identical to SEQ ID NO: 162855

SEQ ID NO: 577656 - RNA, 64 nt, hsa; identical to SEQ ID NO: 162856

SEQ ID NO: 577657 - RNA, 64 nt, hsa; identical to SEQ ID NO: 162857

SEQ ID NO: 577658 - RNA, 64 nt, hsa; identical to SEQ ID NO: 162858

SEQ ID NO: 577659 - RNA, 64 nt, hsa; identical to SEQ ID NO: 162859

SEQ ID NO: 577660 - RNA, 64 nt, hsa; identical to SEQ ID NO: 162860

SEQ ID NO: 577661 - RNA, 64 nt, hsa; identical to SEQ ID NO: 162861

SEQ ID NO: 577662 - RNA, 64 nt, hsa; identical to SEQ ID NO: 162862

SEQ ID NO: 577663 - RNA, 64 nt, hsa; identical to SEQ ID NO: 162863

SEQ ID NO: 577664 - RNA, 64 nt, hsa; identical to SEQ ID NO: 162864

SEQ ID NO: 577665 - RNA, 64 nt, hsa; identical to SEQ ID NO: 162865

SEQ ID NO: 577666 - RNA, 64 nt, hsa; identical to SEQ ID NO: 162866

SEQ ID NO: 577667 - RNA, 64 nt, hsa; identical to SEQ ID NO: 162867

SEQ ID NO: 577668 - RNA, 64 nt, hsa; identical to SEQ ID NO: 162868

SEQ ID NO: 577669 - RNA, 64 nt, hsa; identical to SEQ ID NO: 162869

SEQ ID NO: 577670 - RNA, 64 nt, hsa; identical to SEQ ID NO: 162870

SEQ ID NO: 577671 - RNA, 64 nt, hsa; identical to SEQ ID NO: 162871

SEQ ID NO: 577672 - RNA, 64 nt, hsa; identical to SEQ ID NO: 162872

SEQ ID NO: 577673 - RNA, 64 nt, hsa; identical to SEQ ID NO: 162873

SEQ ID NO: 577674 - RNA, 64 nt, hsa; identical to SEQ ID NO: 162874

SEQ ID NO: 577675 - RNA, 64 nt, hsa; identical to SEQ ID NO: 162875

SEQ ID NO: 577676 - RNA, 64 nt, hsa; identical to SEQ ID NO: 162876

SEQ ID NO: 577677 - RNA, 64 nt, hsa; identical to SEQ ID NO: 162877

SEQ ID NO: 577678 - RNA, 64 nt, hsa; identical to SEQ ID NO: 162878

SEQ ID NO: 577679 - RNA, 64 nt, hsa; identical to SEQ ID NO: 162879

SEQ ID NO: 577680 - RNA, 64 nt, hsa; identical to SEQ ID NO: 162880

SEQ ID NO: 577681 - RNA, 64 nt, hsa; identical to SEQ ID NO: 162881

SEQ ID NO: 577682 - RNA, 64 nt, hsa; identical to SEQ ID NO: 162882

SEQ ID NO: 577683 - RNA, 64 nt, hsa; identical to SEQ ID NO: 162883

SEQ ID NO: 577684 - RNA, 64 nt, hsa; identical to SEQ ID NO: 162884

SEQ ID NO: 577685 - RNA, 64 nt, hsa; identical to SEQ ID NO: 162885

SEQ ID NO: 577686 - RNA, 64 nt, hsa; identical to SEQ ID NO: 162886

SEQ ID NO: 577687 - RNA, 64 nt, hsa; identical to SEQ ID NO: 162887

SEQ ID NO: 577688 - RNA, 64 nt, hsa; identical to SEQ ID NO: 162888

SEQ ID NO: 577689 - RNA, 64 nt, hsa; identical to SEQ ID NO: 162889

SEQ ID NO: 577690 - RNA, 64 nt, hsa; identical to SEQ ID NO: 162890

SEQ ID NO: 577691 - RNA, 64 nt, hsa; identical to SEQ ID NO: 162891

SEQ ID NO: 577692 - RNA, 64 nt, hsa; identical to SEQ ID NO: 162892

SEQ ID NO: 577693 - RNA, 64 nt, hsa; identical to SEQ ID NO: 162893

SEQ ID NO: 577694 - RNA, 64 nt, hsa; identical to SEQ ID NO: 162894

SEQ ID NO: 577695 - RNA, 64 nt, hsa; identical to SEQ ID NO: 162895

SEQ ID NO: 577696 - RNA, 64 nt, hsa; identical to SEQ ID NO: 162896

SEQ ID NO: 577697 - RNA, 64 nt, hsa; identical to SEQ ID NO: 162897

SEQ ID NO: 577698 - RNA, 64 nt, hsa; identical to SEQ ID NO: 162898

SEQ ID NO: 577699 - RNA, 64 nt, hsa; identical to SEQ ID NO: 162899

SEQ ID NO: 577700 - RNA, 64 nt, hsa; identical to SEQ ID NO: 162900

SEQ ID NO: 577701 - RNA, 64 nt, hsa; identical to SEQ ID NO: 162901

SEQ ID NO: 577702 - RNA, 64 nt, hsa; identical to SEQ ID NO: 162902

SEQ ID NO: 577703 - RNA, 64 nt, hsa; identical to SEQ ID NO: 162903

SEQ ID NO: 577704 - RNA, 64 nt, hsa; identical to SEQ ID NO: 162904

SEQ ID NO: 577705 - RNA, 64 nt, hsa; identical to SEQ ID NO: 162905

SEQ ID NO: 577706 - RNA, 64 nt, hsa; identical to SEQ ID NO: 162906

SEQ ID NO: 577707 - RNA, 64 nt, hsa; identical to SEQ ID NO: 162907

SEQ ID NO: 577708 - RNA, 64 nt, hsa; identical to SEQ ID NO: 162908

SEQ ID NO: 577709 - RNA, 64 nt, hsa; identical to SEQ ID NO: 162909

SEQ ID NO: 577710 - RNA, 64 nt, hsa; identical to SEQ ID NO: 162910

SEQ ID NO: 577711 - RNA, 64 nt, hsa; identical to SEQ ID NO: 162911

SEQ ID NO: 577712 - RNA, 64 nt, hsa; identical to SEQ ID NO: 162912

SEQ ID NO: 577713 - RNA, 64 nt, hsa; identical to SEQ ID NO: 162913

SEQ ID NO: 577714 - RNA, 64 nt, hsa; identical to SEQ ID NO: 162914

SEQ ID NO: 577715 - RNA, 64 nt, hsa; identical to SEQ ID NO: 162915

SEQ ID NO: 577716 - RNA, 64 nt, hsa; identical to SEQ ID NO: 162916

SEQ ID NO: 577717 - RNA, 64 nt, hsa; identical to SEQ ID NO: 162917

SEQ ID NO: 577718 - RNA, 64 nt, hsa; identical to SEQ ID NO: 162918

SEQ ID NO: 577719 - RNA, 64 nt, hsa; identical to SEQ ID NO: 162919

SEQ ID NO: 577720 - RNA, 64 nt, hsa; identical to SEQ ID NO: 162920

SEQ ID NO: 577721 - RNA, 64 nt, hsa; identical to SEQ ID NO: 162921

SEQ ID NO: 577722 - RNA, 64 nt, hsa; identical to SEQ ID NO: 162922

SEQ ID NO: 577723 - RNA, 53 nt, hsa; identical to SEQ ID NO: 162923

SEQ ID NO: 577724 - RNA, 64 nt, hsa; identical to SEQ ID NO: 162924

SEQ ID NO: 577725 - RNA, 64 nt, hsa; identical to SEQ ID NO: 162925

SEQ ID NO: 577726 - RNA, 64 nt, hsa; identical to SEQ ID NO: 162926

SEQ ID NO: 577727 - RNA, 64 nt, hsa; identical to SEQ ID NO: 162927

SEQ ID NO: 577728 - RNA, 64 nt, hsa; identical to SEQ ID NO: 162928

SEQ ID NO: 577729 - RNA, 64 nt, hsa; identical to SEQ ID NO: 162929

SEQ ID NO: 577730 - RNA, 64 nt, hsa; identical to SEQ ID NO: 162930

SEQ ID NO: 577731 - RNA, 64 nt, hsa; identical to SEQ ID NO: 162931

SEQ ID NO: 577732 - RNA, 64 nt, hsa; identical to SEQ ID NO: 162932

SEQ ID NO: 577733 - RNA, 64 nt, hsa; identical to SEQ ID NO: 162933

SEQ ID NO: 577734 - RNA, 64 nt, hsa; identical to SEQ ID NO: 162934

SEQ ID NO: 577735 - RNA, 64 nt, hsa; identical to SEQ ID NO: 162935

SEQ ID NO: 577736 - RNA, 64 nt, hsa; identical to SEQ ID NO: 162936

SEQ ID NO: 577737 - RNA, 64 nt, hsa; identical to SEQ ID NO: 162937

SEQ ID NO: 577738 - RNA, 64 nt, hsa; identical to SEQ ID NO: 162938

SEQ ID NO: 577739 - RNA, 64 nt, hsa; identical to SEQ ID NO: 162939

SEQ ID NO: 577740 - RNA, 64 nt, hsa; identical to SEQ ID NO: 162940

SEQ ID NO: 577741 - RNA, 64 nt, hsa; identical to SEQ ID NO: 162941

SEQ ID NO: 577742 - RNA, 64 nt, hsa; identical to SEQ ID NO: 162942

SEQ ID NO: 577743 - RNA, 64 nt, hsa; identical to SEQ ID NO: 162943

SEQ ID NO: 577744 - RNA, 64 nt, hsa; identical to SEQ ID NO: 162944

SEQ ID NO: 577745 - RNA, 64 nt, hsa; identical to SEQ ID NO: 162945

SEQ ID NO: 577746 - RNA, 64 nt, hsa; identical to SEQ ID NO: 162946

SEQ ID NO: 577747 - RNA, 64 nt, hsa; identical to SEQ ID NO: 162947

SEQ ID NO: 577748 - RNA, 64 nt, hsa; identical to SEQ ID NO: 162948

SEQ ID NO: 577749 - RNA, 64 nt, hsa; identical to SEQ ID NO: 162949

SEQ ID NO: 577750 - RNA, 64 nt, hsa; identical to SEQ ID NO: 162950

SEQ ID NO: 577751 - RNA, 64 nt, hsa; identical to SEQ ID NO: 162951

SEQ ID NO: 577752 - RNA, 64 nt, hsa; identical to SEQ ID NO: 162952

SEQ ID NO: 577753 - RNA, 64 nt, hsa; identical to SEQ ID NO: 162953

SEQ ID NO: 577754 - RNA, 64 nt, hsa; identical to SEQ ID NO: 162954

SEQ ID NO: 577755 - RNA, 64 nt, hsa; identical to SEQ ID NO: 162955

SEQ ID NO: 577756 - RNA, 64 nt, hsa; identical to SEQ ID NO: 162956

SEQ ID NO: 577757 - RNA, 64 nt, hsa; identical to SEQ ID NO: 162957

SEQ ID NO: 577758 - RNA, 64 nt, hsa; identical to SEQ ID NO: 162958

SEQ ID NO: 577759 - RNA, 64 nt, hsa; identical to SEQ ID NO: 162959

SEQ ID NO: 577760 - RNA, 64 nt, hsa; identical to SEQ ID NO: 162960

SEQ ID NO: 577761 - RNA, 64 nt, hsa; identical to SEQ ID NO: 162961

SEQ ID NO: 577762 - RNA, 64 nt, hsa; identical to SEQ ID NO: 162962

SEQ ID NO: 577763 - RNA, 64 nt, hsa; identical to SEQ ID NO: 162963

SEQ ID NO: 577764 - RNA, 64 nt, hsa; identical to SEQ ID NO: 162964

SEQ ID NO: 577765 - RNA, 64 nt, hsa; identical to SEQ ID NO: 162965

SEQ ID NO: 577766 - RNA, 64 nt, hsa; identical to SEQ ID NO: 162966

SEQ ID NO: 577767 - RNA, 64 nt, hsa; identical to SEQ ID NO: 162967

SEQ ID NO: 577768 - RNA, 64 nt, hsa; identical to SEQ ID NO: 162968

SEQ ID NO: 577769 - RNA, 64 nt, hsa; identical to SEQ ID NO: 162969

SEQ ID NO: 577770 - RNA, 64 nt, hsa; identical to SEQ ID NO: 162970

SEQ ID NO: 577771 - RNA, 64 nt, hsa; identical to SEQ ID NO: 162971

SEQ ID NO: 577772 - RNA, 64 nt, hsa; identical to SEQ ID NO: 162972

SEQ ID NO: 577773 - RNA, 64 nt, hsa; identical to SEQ ID NO: 162973

SEQ ID NO: 577774 - RNA, 64 nt, hsa; identical to SEQ ID NO: 162974

SEQ ID NO: 577775 - RNA, 64 nt, hsa; identical to SEQ ID NO: 162975

SEQ ID NO: 577776 - RNA, 64 nt, hsa; identical to SEQ ID NO: 162976

SEQ ID NO: 577777 - RNA, 64 nt, hsa; identical to SEQ ID NO: 162977

SEQ ID NO: 577778 - RNA, 64 nt, hsa; identical to SEQ ID NO: 162978

SEQ ID NO: 577779 - RNA, 64 nt, hsa; identical to SEQ ID NO: 162979

SEQ ID NO: 577780 - RNA, 64 nt, hsa; identical to SEQ ID NO: 162980

SEQ ID NO: 577781 - RNA, 64 nt, hsa; identical to SEQ ID NO: 162981

SEQ ID NO: 577782 - RNA, 64 nt, hsa; identical to SEQ ID NO: 162982

SEQ ID NO: 577783 - RNA, 64 nt, hsa; identical to SEQ ID NO: 162983

SEQ ID NO: 577784 - RNA, 64 nt, hsa; identical to SEQ ID NO: 162984

SEQ ID NO: 577785 - RNA, 64 nt, hsa; identical to SEQ ID NO: 162985

SEQ ID NO: 577786 - RNA, 64 nt, hsa; identical to SEQ ID NO: 162986

SEQ ID NO: 577787 - RNA, 64 nt, hsa; identical to SEQ ID NO: 162987

SEQ ID NO: 577788 - RNA, 64 nt, hsa; identical to SEQ ID NO: 162988

SEQ ID NO: 577789 - RNA, 64 nt, hsa; identical to SEQ ID NO: 162989

SEQ ID NO: 577790 - RNA, 64 nt, hsa; identical to SEQ ID NO: 162990

SEQ ID NO: 577791 - RNA, 64 nt, hsa; identical to SEQ ID NO: 162991

SEQ ID NO: 577792 - RNA, 64 nt, hsa; identical to SEQ ID NO: 162992

SEQ ID NO: 577793 - RNA, 64 nt, hsa; identical to SEQ ID NO: 162993

SEQ ID NO: 577794 - RNA, 64 nt, hsa; identical to SEQ ID NO: 162994

SEQ ID NO: 577795 - RNA, 64 nt, hsa; identical to SEQ ID NO: 162995

SEQ ID NO: 577796 - RNA, 64 nt, hsa; identical to SEQ ID NO: 162996

SEQ ID NO: 577797 - RNA, 64 nt, hsa; identical to SEQ ID NO: 162997

SEQ ID NO: 577798 - RNA, 64 nt, hsa; identical to SEQ ID NO: 162998

SEQ ID NO: 577799 - RNA, 64 nt, hsa; identical to SEQ ID NO: 162999

SEQ ID NO: 577800 - RNA, 64 nt, hsa; identical to SEQ ID NO: 163000

SEQ ID NO: 577801 - RNA, 64 nt, hsa; identical to SEQ ID NO: 163001

SEQ ID NO: 577802 - RNA, 64 nt, hsa; identical to SEQ ID NO: 163002

SEQ ID NO: 577803 - RNA, 64 nt, hsa; identical to SEQ ID NO: 163003

SEQ ID NO: 577804 - RNA, 64 nt, hsa; identical to SEQ ID NO: 163004

SEQ ID NO: 577805 - RNA, 64 nt, hsa; identical to SEQ ID NO: 163005

SEQ ID NO: 577806 - RNA, 64 nt, hsa; identical to SEQ ID NO: 163006

SEQ ID NO: 577807 - RNA, 64 nt, hsa; identical to SEQ ID NO: 163007

SEQ ID NO: 577808 - RNA, 64 nt, hsa; identical to SEQ ID NO: 163008

SEQ ID NO: 577809 - RNA, 64 nt, hsa; identical to SEQ ID NO: 163009

SEQ ID NO: 577810 - RNA, 64 nt, hsa; identical to SEQ ID NO: 163010

SEQ ID NO: 577811 - RNA, 64 nt, hsa; identical to SEQ ID NO: 163011

SEQ ID NO: 577812 - RNA, 64 nt, hsa; identical to SEQ ID NO: 163012

SEQ ID NO: 577813 - RNA, 64 nt, hsa; identical to SEQ ID NO: 163013

SEQ ID NO: 577814 - RNA, 64 nt, hsa; identical to SEQ ID NO: 163014

SEQ ID NO: 577815 - RNA, 64 nt, hsa; identical to SEQ ID NO: 163015

SEQ ID NO: 577816 - RNA, 64 nt, hsa; identical to SEQ ID NO: 163016

SEQ ID NO: 577817 - RNA, 64 nt, hsa; identical to SEQ ID NO: 163017

SEQ ID NO: 577818 - RNA, 64 nt, hsa; identical to SEQ ID NO: 163018

SEQ ID NO: 577819 - RNA, 64 nt, hsa; identical to SEQ ID NO: 163019

SEQ ID NO: 577820 - RNA, 64 nt, hsa; identical to SEQ ID NO: 163020

SEQ ID NO: 577821 - RNA, 64 nt, hsa; identical to SEQ ID NO: 163021

SEQ ID NO: 577822 - RNA, 64 nt, hsa; identical to SEQ ID NO: 163022

SEQ ID NO: 577823 - RNA, 64 nt, hsa; identical to SEQ ID NO: 163023

SEQ ID NO: 577824 - RNA, 64 nt, hsa; identical to SEQ ID NO: 163024

SEQ ID NO: 577825 - RNA, 64 nt, hsa; identical to SEQ ID NO: 163025

SEQ ID NO: 577826 - RNA, 64 nt, hsa; identical to SEQ ID NO: 163026

SEQ ID NO: 577827 - RNA, 64 nt, hsa; identical to SEQ ID NO: 163027

SEQ ID NO: 577828 - RNA, 64 nt, hsa; identical to SEQ ID NO: 163028

SEQ ID NO: 577829 - RNA, 64 nt, hsa; identical to SEQ ID NO: 163029

SEQ ID NO: 577830 - RNA, 64 nt, hsa; identical to SEQ ID NO: 163030

SEQ ID NO: 577831 - RNA, 64 nt, hsa; identical to SEQ ID NO: 163031

SEQ ID NO: 577832 - RNA, 64 nt, hsa; identical to SEQ ID NO: 163032

SEQ ID NO: 577833 - RNA, 64 nt, hsa; identical to SEQ ID NO: 163033

SEQ ID NO: 577834 - RNA, 64 nt, hsa; identical to SEQ ID NO: 163034

SEQ ID NO: 577835 - RNA, 64 nt, hsa; identical to SEQ ID NO: 163035

SEQ ID NO: 577836 - RNA, 64 nt, hsa; identical to SEQ ID NO: 163036

SEQ ID NO: 577837 - RNA, 64 nt, hsa; identical to SEQ ID NO: 163037

SEQ ID NO: 577838 - RNA, 64 nt, hsa; identical to SEQ ID NO: 163038

SEQ ID NO: 577839 - RNA, 64 nt, hsa; identical to SEQ ID NO: 163039

SEQ ID NO: 577840 - RNA, 64 nt, hsa; identical to SEQ ID NO: 163040

SEQ ID NO: 577841 - RNA, 64 nt, hsa; identical to SEQ ID NO: 163041

SEQ ID NO: 577842 - RNA, 64 nt, hsa; identical to SEQ ID NO: 163042

SEQ ID NO: 577843 - RNA, 64 nt, hsa; identical to SEQ ID NO: 163043

SEQ ID NO: 577844 - RNA, 64 nt, hsa; identical to SEQ ID NO: 163044

SEQ ID NO: 577845 - RNA, 64 nt, hsa; identical to SEQ ID NO: 163045

SEQ ID NO: 577846 - RNA, 64 nt, hsa; identical to SEQ ID NO: 163046

SEQ ID NO: 577847 - RNA, 64 nt, hsa; identical to SEQ ID NO: 162809

SEQ ID NO: 577848 - RNA, 64 nt, hsa; identical to SEQ ID NO: 163048

SEQ ID NO: 577849 - RNA, 64 nt, hsa; identical to SEQ ID NO: 163049

SEQ ID NO: 577850 - RNA, 64 nt, hsa; identical to SEQ ID NO: 163050

SEQ ID NO: 577851 - RNA, 64 nt, hsa; identical to SEQ ID NO: 163051

SEQ ID NO: 577852 - RNA, 64 nt, hsa; identical to SEQ ID NO: 163052

SEQ ID NO: 577853 - RNA, 64 nt, hsa; identical to SEQ ID NO: 163053

SEQ ID NO: 577854 - RNA, 64 nt, hsa; identical to SEQ ID NO: 163054

SEQ ID NO: 577855 - RNA, 64 nt, hsa; identical to SEQ ID NO: 163055

SEQ ID NO: 577856 - RNA, 64 nt, hsa; identical to SEQ ID NO: 163056

SEQ ID NO: 577857 - RNA, 64 nt, hsa; identical to SEQ ID NO: 163057

SEQ ID NO: 577858 - RNA, 64 nt, hsa; identical to SEQ ID NO: 163058

SEQ ID NO: 577859 - RNA, 64 nt, hsa; identical to SEQ ID NO: 163059

SEQ ID NO: 577860 - RNA, 64 nt, hsa; identical to SEQ ID NO: 163060

SEQ ID NO: 577861 - RNA, 64 nt, hsa; identical to SEQ ID NO: 163061

SEQ ID NO: 577862 - RNA, 64 nt, hsa; identical to SEQ ID NO: 163062

SEQ ID NO: 577863 - RNA, 64 nt, hsa; identical to SEQ ID NO: 163063

SEQ ID NO: 577864 - RNA, 64 nt, hsa; identical to SEQ ID NO: 163064

SEQ ID NO: 577865 - RNA, 64 nt, hsa; identical to SEQ ID NO: 163065

SEQ ID NO: 577866 - RNA, 64 nt, hsa; identical to SEQ ID NO: 163066

SEQ ID NO: 577867 - RNA, 64 nt, hsa; identical to SEQ ID NO: 163067

SEQ ID NO: 577868 - RNA, 64 nt, hsa; identical to SEQ ID NO: 163068

SEQ ID NO: 577869 - RNA, 64 nt, hsa; identical to SEQ ID NO: 163069

SEQ ID NO: 577870 - RNA, 64 nt, hsa; identical to SEQ ID NO: 163070

SEQ ID NO: 577871 - RNA, 64 nt, hsa; identical to SEQ ID NO: 163071

SEQ ID NO: 577872 - RNA, 64 nt, hsa; identical to SEQ ID NO: 163072

SEQ ID NO: 577873 - RNA, 64 nt, hsa; identical to SEQ ID NO: 163073

SEQ ID NO: 577874 - RNA, 64 nt, hsa; identical to SEQ ID NO: 163074

SEQ ID NO: 577875 - RNA, 64 nt, hsa; identical to SEQ ID NO: 163075

SEQ ID NO: 577876 - RNA, 64 nt, hsa; identical to SEQ ID NO: 163076

SEQ ID NO: 577877 - RNA, 64 nt, hsa; identical to SEQ ID NO: 163077

SEQ ID NO: 577878 - RNA, 64 nt, hsa; identical to SEQ ID NO: 163078

SEQ ID NO: 577879 - RNA, 64 nt, hsa; identical to SEQ ID NO: 163079

SEQ ID NO: 577880 - RNA, 64 nt, hsa; identical to SEQ ID NO: 163080

SEQ ID NO: 577881 - RNA, 64 nt, hsa; identical to SEQ ID NO: 163081

SEQ ID NO: 577882 - RNA, 64 nt, hsa; identical to SEQ ID NO: 163082

SEQ ID NO: 577883 - RNA, 64 nt, hsa; identical to SEQ ID NO: 163083

SEQ ID NO: 577884 - RNA, 64 nt, hsa; identical to SEQ ID NO: 163084

SEQ ID NO: 577885 - RNA, 64 nt, hsa; identical to SEQ ID NO: 163085

SEQ ID NO: 577886 - RNA, 64 nt, hsa; identical to SEQ ID NO: 163086

SEQ ID NO: 577887 - RNA, 64 nt, hsa; identical to SEQ ID NO: 163087

SEQ ID NO: 577888 - RNA, 64 nt, hsa; identical to SEQ ID NO: 163088

SEQ ID NO: 577889 - RNA, 64 nt, hsa; identical to SEQ ID NO: 163089

SEQ ID NO: 577890 - RNA, 64 nt, hsa; identical to SEQ ID NO: 163090

SEQ ID NO: 577891 - RNA, 64 nt, hsa; identical to SEQ ID NO: 163091

SEQ ID NO: 577892 - RNA, 64 nt, hsa; identical to SEQ ID NO: 163092

SEQ ID NO: 577893 - RNA, 64 nt, hsa; identical to SEQ ID NO: 163093

SEQ ID NO: 577894 - RNA, 64 nt, hsa; identical to SEQ ID NO: 163094

SEQ ID NO: 577895 - RNA, 64 nt, hsa; identical to SEQ ID NO: 163095

SEQ ID NO: 577896 - RNA, 64 nt, hsa; identical to SEQ ID NO: 163096

SEQ ID NO: 577897 - RNA, 64 nt, hsa; identical to SEQ ID NO: 163097

SEQ ID NO: 577898 - RNA, 64 nt, hsa; identical to SEQ ID NO: 163098

SEQ ID NO: 577899 - RNA, 64 nt, hsa; identical to SEQ ID NO: 163099

SEQ ID NO: 577900 - RNA, 64 nt, hsa; identical to SEQ ID NO: 163100

SEQ ID NO: 577901 - RNA, 64 nt, hsa; identical to SEQ ID NO: 163101

SEQ ID NO: 577902 - RNA, 64 nt, hsa; identical to SEQ ID NO: 163102

SEQ ID NO: 577903 - RNA, 64 nt, hsa; identical to SEQ ID NO: 163103

SEQ ID NO: 577904 - RNA, 64 nt, hsa; identical to SEQ ID NO: 163104

SEQ ID NO: 577905 - RNA, 64 nt, hsa; identical to SEQ ID NO: 163105

SEQ ID NO: 577906 - RNA, 64 nt, hsa; identical to SEQ ID NO: 163106

SEQ ID NO: 577907 - RNA, 64 nt, hsa; identical to SEQ ID NO: 163107

SEQ ID NO: 577908 - RNA, 64 nt, hsa; identical to SEQ ID NO: 163108

SEQ ID NO: 577909 - RNA, 64 nt, hsa; identical to SEQ ID NO: 163109

SEQ ID NO: 577910 - RNA, 64 nt, hsa; identical to SEQ ID NO: 163110

SEQ ID NO: 577911 - RNA, 64 nt, hsa; identical to SEQ ID NO: 163111

SEQ ID NO: 577912 - RNA, 64 nt, hsa; identical to SEQ ID NO: 163112

SEQ ID NO: 577913 - RNA, 64 nt, hsa; identical to SEQ ID NO: 163113

SEQ ID NO: 577914 - RNA, 64 nt, hsa; identical to SEQ ID NO: 163114

SEQ ID NO: 577915 - RNA, 64 nt, hsa; identical to SEQ ID NO: 163115

SEQ ID NO: 577916 - RNA, 64 nt, hsa; identical to SEQ ID NO: 163116

SEQ ID NO: 577917 - RNA, 64 nt, hsa; identical to SEQ ID NO: 163117

SEQ ID NO: 577918 - RNA, 64 nt, hsa; identical to SEQ ID NO: 163118

SEQ ID NO: 577919 - RNA, 64 nt, hsa; identical to SEQ ID NO: 163119

SEQ ID NO: 577920 - RNA, 64 nt, hsa; identical to SEQ ID NO: 163120

SEQ ID NO: 577921 - RNA, 64 nt, hsa; identical to SEQ ID NO: 163121

SEQ ID NO: 577922 - RNA, 64 nt, hsa; identical to SEQ ID NO: 163122

SEQ ID NO: 577923 - RNA, 64 nt, hsa; identical to SEQ ID NO: 163123

SEQ ID NO: 577924 - RNA, 64 nt, hsa; identical to SEQ ID NO: 163124

SEQ ID NO: 577925 - RNA, 64 nt, hsa; identical to SEQ ID NO: 163125

SEQ ID NO: 577926 - RNA, 64 nt, hsa; identical to SEQ ID NO: 163126

SEQ ID NO: 577927 - RNA, 64 nt, hsa; identical to SEQ ID NO: 163127

SEQ ID NO: 577928 - RNA, 64 nt, hsa; identical to SEQ ID NO: 163128

SEQ ID NO: 577929 - RNA, 64 nt, hsa; identical to SEQ ID NO: 163129

SEQ ID NO: 577930 - RNA, 64 nt, hsa; identical to SEQ ID NO: 163130

SEQ ID NO: 577931 - RNA, 64 nt, hsa; identical to SEQ ID NO: 163131

SEQ ID NO: 577932 - RNA, 64 nt, hsa; identical to SEQ ID NO: 163132

SEQ ID NO: 577933 - RNA, 64 nt, hsa; identical to SEQ ID NO: 163133

SEQ ID NO: 577934 - RNA, 64 nt, hsa; identical to SEQ ID NO: 163134

SEQ ID NO: 577935 - RNA, 64 nt, hsa; identical to SEQ ID NO: 163135

SEQ ID NO: 577936 - RNA, 64 nt, hsa; identical to SEQ ID NO: 163136

SEQ ID NO: 577937 - RNA, 64 nt, hsa; identical to SEQ ID NO: 163137

SEQ ID NO: 577938 - RNA, 64 nt, hsa; identical to SEQ ID NO: 163138

SEQ ID NO: 577939 - RNA, 64 nt, hsa; identical to SEQ ID NO: 163139

SEQ ID NO: 577940 - RNA, 64 nt, hsa; identical to SEQ ID NO: 163140

SEQ ID NO: 577941 - RNA, 64 nt, hsa; identical to SEQ ID NO: 163141

SEQ ID NO: 577942 - RNA, 64 nt, hsa; identical to SEQ ID NO: 163142

SEQ ID NO: 577943 - RNA, 64 nt, hsa; identical to SEQ ID NO: 163143

SEQ ID NO: 577944 - RNA, 64 nt, hsa; identical to SEQ ID NO: 163144

SEQ ID NO: 577945 - RNA, 64 nt, hsa; identical to SEQ ID NO: 163145

SEQ ID NO: 577946 - RNA, 64 nt, hsa; identical to SEQ ID NO: 163146

SEQ ID NO: 577947 - RNA, 64 nt, hsa; identical to SEQ ID NO: 163147

SEQ ID NO: 577948 - RNA, 64 nt, hsa; identical to SEQ ID NO: 163148

SEQ ID NO: 577949 - RNA, 64 nt, hsa; identical to SEQ ID NO: 163149

SEQ ID NO: 577950 - RNA, 64 nt, hsa; identical to SEQ ID NO: 163150

SEQ ID NO: 577951 - RNA, 64 nt, hsa; identical to SEQ ID NO: 163151

SEQ ID NO: 577952 - RNA, 64 nt, hsa; identical to SEQ ID NO: 163152

SEQ ID NO: 577953 - RNA, 64 nt, hsa; identical to SEQ ID NO: 163153

SEQ ID NO: 577954 - RNA, 64 nt, hsa; identical to SEQ ID NO: 163154

SEQ ID NO: 577955 - RNA, 64 nt, hsa; identical to SEQ ID NO: 163155

SEQ ID NO: 577956 - RNA, 64 nt, hsa; identical to SEQ ID NO: 163156

SEQ ID NO: 577957 - RNA, 64 nt, hsa; identical to SEQ ID NO: 163157

SEQ ID NO: 577958 - RNA, 64 nt, hsa; identical to SEQ ID NO: 163158

SEQ ID NO: 577959 - RNA, 64 nt, hsa; identical to SEQ ID NO: 163159

SEQ ID NO: 577960 - RNA, 64 nt, hsa; identical to SEQ ID NO: 163160

SEQ ID NO: 577961 - RNA, 64 nt, hsa; identical to SEQ ID NO: 163161

SEQ ID NO: 577962 - RNA, 64 nt, hsa; identical to SEQ ID NO: 163162

SEQ ID NO: 577963 - RNA, 64 nt, hsa; identical to SEQ ID NO: 163163

SEQ ID NO: 577964 - RNA, 64 nt, hsa; identical to SEQ ID NO: 163164

SEQ ID NO: 577965 - RNA, 64 nt, hsa; identical to SEQ ID NO: 163165

SEQ ID NO: 577966 - RNA, 64 nt, hsa; identical to SEQ ID NO: 163166

SEQ ID NO: 577967 - RNA, 64 nt, hsa; identical to SEQ ID NO: 162657

SEQ ID NO: 577968 - RNA, 64 nt, hsa; identical to SEQ ID NO: 163168

SEQ ID NO: 577969 - RNA, 64 nt, hsa; identical to SEQ ID NO: 163169

SEQ ID NO: 577970 - RNA, 64 nt, hsa; identical to SEQ ID NO: 163170

SEQ ID NO: 577971 - RNA, 64 nt, hsa; identical to SEQ ID NO: 163171

SEQ ID NO: 577972 - RNA, 64 nt, hsa; identical to SEQ ID NO: 163172

SEQ ID NO: 577973 - RNA, 64 nt, hsa; identical to SEQ ID NO: 163173

SEQ ID NO: 577974 - RNA, 64 nt, hsa; identical to SEQ ID NO: 163174

SEQ ID NO: 577975 - RNA, 64 nt, hsa; identical to SEQ ID NO: 163175

SEQ ID NO: 577976 - RNA, 64 nt, hsa; identical to SEQ ID NO: 163176

SEQ ID NO: 577977 - RNA, 64 nt, hsa; identical to SEQ ID NO: 163177

SEQ ID NO: 577978 - RNA, 64 nt, hsa; identical to SEQ ID NO: 163178

SEQ ID NO: 577979 - RNA, 64 nt, hsa; identical to SEQ ID NO: 163179

SEQ ID NO: 577980 - RNA, 64 nt, hsa; identical to SEQ ID NO: 163180

SEQ ID NO: 577981 - RNA, 64 nt, hsa; identical to SEQ ID NO: 163181

SEQ ID NO: 577982 - RNA, 64 nt, hsa; identical to SEQ ID NO: 163182

SEQ ID NO: 577983 - RNA, 64 nt, hsa; identical to SEQ ID NO: 163183

SEQ ID NO: 577984 - RNA, 64 nt, hsa; identical to SEQ ID NO: 163184

SEQ ID NO: 577985 - RNA, 64 nt, hsa
gcccacaccaccauccucucaucccagccaguaagaauuucaguugugggccuccagucuucug

SEQ ID NO: 577986 - RNA, 64 nt, hsa
uuuuuuuguuuuuuuuguuuguuuguauuagauggaauuucacucuugucgcccaggcuggagu

SEQ ID NO: 577987 - RNA, 64 nt, hsa
cuuuugccagccucagaauaggcgagguaaccuugaauuucagggcccuggaaacucuagcuga

SEQ ID NO: 577988 - RNA, 64 nt, hsa
gguuagauucacauccuuaaucuugcagagacuagaauuucacagcucgcuuuggaacauauuc

SEQ ID NO: 577989 - RNA, 64 nt, hsa
ccauauauuuaauaugucaaaaagggcuugaggugaauuucauuaaauggaauaauaugaugcc

SEQ ID NO: 577990 - RNA, 64 nt, hsa
gggcuggauuuugguucccuuguaaagacagagugaauuucaguauaaagaucacccguuguau

SEQ ID NO: 577991 - RNA, 64 nt, hsa
aguaccuuguaagauaaauauaaauuggaguuaggaauuucaugaaccucacuaugaccaaaau

SEQ ID NO: 577992 - RNA, 64 nt, hsa
auuguuaaauuuaauuauaguguauuucuuucuugaauuucagucugcugcuuuguaaaaaaua

SEQ ID NO: 577993 - RNA, 64 nt, hsa
ucuggacaacuggcccaguuuacagugaaauggagaauuucaggucuccacgucugcccaggaa

SEQ ID NO: 577994 - RNA, 64 nt, hsa
cagggcuggggaaugaugggacuggaggaccugggaauuucaucuuucugccuccaccccuggg

SEQ ID NO: 577995 - RNA, 64 nt, hsa
cuucaaucaauugaacuuuuacaaaaccacuugagaauuucaugagcacuuuaaaaucugaacu

SEQ ID NO: 577996 - RNA, 64 nt, hsa
uucauaauaaaguuuaauaauagguuuauuaacugaauuucauuaguuuuuuaaaaguguuuuu

SEQ ID NO: 577997 - RNA, 64 nt, hsa
gggaacaguuuuguccuguaugcugauguguccagaauuucauuuaaugauagacggaaaaugu

SEQ ID NO: 577998 - RNA, 64 nt, hsa
aaaugugugguuacugaaaacuguauaugauacagaauuucauaagagccaugcuguugggcaa

SEQ ID NO: 577999 - RNA, 64 nt, hsa
ugcaauuguucuugagcaaugaacuuucacugcagaauuucagguuaguuacaaaaagcucagu

SEQ ID NO: 578000 - RNA, 64 nt, hsa
uuuagauauacguauauacacaugcugcgguucugaauuucauuuuuuauaacaugaagugcug

SEQ ID NO: 578001 - RNA, 64 nt, hsa
aaguaaaggagaaauauuuuccuacaagaguacugaauuucaggaaaugggauagagcuucuaa

SEQ ID NO: 578002 - RNA, 64 nt, hsa
uaggacaaaaaaauuuaaccaauuuuauugaaacgaauuucacuguguaaaaguugguuugauu

SEQ ID NO: 578003 - RNA, 64 nt, hsa
agcaaaugaguguugcugaggaauaauuaaaugagaauuucauaggagcuccaccauuccuguu

SEQ ID NO: 578004 - RNA, 64 nt, hsa
gccucagggaagccacgugauauaacugguuauagaauuucaggguuaggguuuaaagaaagga

SEQ ID NO: 578005 - RNA, 64 nt, hsa
agcaaauaaaaauaaagauugcccaguuagauuugaauuucagauaaacaauuaguuuuuuaau

SEQ ID NO: 578006 - RNA, 64 nt, hsa
gugccuguuucuggacaauggaggcgaaagaguggaauuucauucaaaggcauaauagcaauga

SEQ ID NO: 578007 - RNA, 64 nt, hsa
uugcagcagagcuugagaaaaguacauuguucuggaauuucaucauuaacauuuuauaaucuua

SEQ ID NO: 578008 - RNA, 64 nt, hsa
gagaaaugaggauuugcuaugcagacagggaagggaauuucacuuaaaaggaaggucauuugga

SEQ ID NO: 578009 - RNA, 64 nt, hsa
ucuguaaaauguuaucugcccuuuggcugcauuggaauuucagagaaggcugcagaggccuggg

SEQ ID NO: 578010 - RNA, 64 nt, hsa
ugcgagguaguagacaggaugcccaguuaaguuugaauuucagauagaaaauaauuuuagaaua

SEQ ID NO: 578011 - RNA, 64 nt, hsa
auuucaaucccacguacuuauaaagaagguuggugaauuucacaagcuauuuuuggaauauuuu

SEQ ID NO: 578012 - RNA, 64 nt, hsa
aagcuauuuuuggaauauuuuuagaauauuuuaagaauuucacaagcuauucccucaaaucuga

SEQ ID NO: 578013 - RNA, 64 nt, hsa
aauaguugacggaauuggguuucugaaugucugugaauuucagaggucucugcuagccuuggua

SEQ ID NO: 578014 - RNA, 64 nt, hsa
uuucuagcaauaacugagagccaguuaauuuuaagaauuucacacauuuagccaaucuuucuag

SEQ ID NO: 578015 - RNA, 64 nt, hsa
auggugaugguagagaagcugcccggaauaaacugaauuucauauguucuaaaaugacuagcaa

SEQ ID NO: 578016 - RNA, 64 nt, hsa
aauuuacaagauuuaauaggaaaugaaacagcuugaauuucaaacuaaauuguauuuucagagc

SEQ ID NO: 578017 - RNA, 64 nt, hsa
uuguuguuguugcuguuguuguuaauuuuguuaagaauuucaauaucaagacugacuggcacca

SEQ ID NO: 578018 - RNA, 64 nt, hsa
aggagcuuaauaaugguuacucauuuuaucaggggaauuucagggaacguaggcgucaaagagc

SEQ ID NO: 578019 - RNA, 64 nt, hsa
auauuuaagaauuccaagaggauauuaugugucagaauuucagacacugaugagaaguuuuuaa

SEQ ID NO: 578020 - RNA, 64 nt, hsa
uuuuuuagagagagagauuagaaaacgacauuaggaauuucacuuuaaaaugcgcauuacaaac

SEQ ID NO: 578021 - RNA, 64 nt, hsa
ucuucuaaguccuuuguggcuuguaaguggagaagaauuucauccaaauguuacccuguaauac

SEQ ID NO: 578022 - RNA, 64 nt, hsa
cuguccucauucccauauguaauagacauccaaagaauuucaauugcuuuguugaacuuuuacu

SEQ ID NO: 578023 - RNA, 64 nt, hsa
uuugcaagguuuacccauguuguagcaugugucagaauuucauuccuuucuauggcugaauaaa

SEQ ID NO: 578024 - RNA, 64 nt, hsa
ccuuaugugaaaugcuuggggcuagaaguguuuugaauuucagauuuuggaauauuugcauaua

SEQ ID NO: 578025 - RNA, 64 nt, hsa
ugagaguauggggaaaagaaucaagagaccugacugccgccaacucacuagugacuuagauaca

SEQ ID NO: 578026 - RNA, 64 nt, hsa
gucauuaacuugaucccuuucuccagacuggccaugccgccauauaccuuuccuuuuguauucc

SEQ ID NO: 578027 - RNA, 64 nt, hsa
acaugauaugcggcuaugccugccucaaagggacugccgccaugcggaacaccaaacgagguuc

SEQ ID NO: 578028 - RNA, 64 nt, hsa
gugcaaggagaugucugaauacugcagcacucugugccgccaccucuaccuguucccaggacac

SEQ ID NO: 578029 - RNA, 64 nt, hsa; identical to SEQ ID NO: 161048

SEQ ID NO: 578030 - RNA, 64 nt, hsa; identical to SEQ ID NO: 161049

SEQ ID NO: 578031 - RNA, 64 nt, hsa; identical to SEQ ID NO: 161050

SEQ ID NO: 578032 - RNA, 64 nt, hsa; identical to SEQ ID NO: 161051

SEQ ID NO: 578033 - RNA, 64 nt, hsa; identical to SEQ ID NO: 161052

SEQ ID NO: 578034 - RNA, 64 nt, hsa; identical to SEQ ID NO: 161053

SEQ ID NO: 578035 - RNA, 64 nt, hsa; identical to SEQ ID NO: 161054

SEQ ID NO: 578036 - RNA, 64 nt, hsa; identical to SEQ ID NO: 161055

SEQ ID NO: 578037 - RNA, 64 nt, hsa; identical to SEQ ID NO: 161056

SEQ ID NO: 578038 - RNA, 64 nt, hsa; identical to SEQ ID NO: 161057

SEQ ID NO: 578039 - RNA, 64 nt, hsa; identical to SEQ ID NO: 161058

SEQ ID NO: 578040 - RNA, 64 nt, hsa; identical to SEQ ID NO: 161059

SEQ ID NO: 578041 - RNA, 64 nt, hsa; identical to SEQ ID NO: 161060

SEQ ID NO: 578042 - RNA, 64 nt, hsa; identical to SEQ ID NO: 161061

SEQ ID NO: 578043 - RNA, 64 nt, hsa; identical to SEQ ID NO: 161062

SEQ ID NO: 578044 - RNA, 64 nt, hsa; identical to SEQ ID NO: 161063

SEQ ID NO: 578045 - RNA, 64 nt, hsa; identical to SEQ ID NO: 161064

SEQ ID NO: 578046 - RNA, 64 nt, hsa; identical to SEQ ID NO: 161065

SEQ ID NO: 578047 - RNA, 64 nt, hsa; identical to SEQ ID NO: 161066

SEQ ID NO: 578048 - RNA, 64 nt, hsa; identical to SEQ ID NO: 161067

SEQ ID NO: 578049 - RNA, 64 nt, hsa; identical to SEQ ID NO: 161068

SEQ ID NO: 578050 - RNA, 64 nt, hsa; identical to SEQ ID NO: 161069

SEQ ID NO: 578051 - RNA, 64 nt, hsa; identical to SEQ ID NO: 161070

SEQ ID NO: 578052 - RNA, 64 nt, hsa; identical to SEQ ID NO: 161071

SEQ ID NO: 578053 - RNA, 64 nt, hsa; identical to SEQ ID NO: 161072

SEQ ID NO: 578054 - RNA, 64 nt, hsa; identical to SEQ ID NO: 161073

SEQ ID NO: 578055 - RNA, 64 nt, hsa; identical to SEQ ID NO: 161074

SEQ ID NO: 578056 - RNA, 64 nt, hsa; identical to SEQ ID NO: 161075

SEQ ID NO: 578057 - RNA, 64 nt, hsa; identical to SEQ ID NO: 161076

SEQ ID NO: 578058 - RNA, 62 nt, hsa; identical to SEQ ID NO: 161077

SEQ ID NO: 578059 - RNA, 64 nt, hsa; identical to SEQ ID NO: 161078

SEQ ID NO: 578060 - RNA, 64 nt, hsa; identical to SEQ ID NO: 161079

SEQ ID NO: 578061 - RNA, 64 nt, hsa; identical to SEQ ID NO: 161080

SEQ ID NO: 578062 - RNA, 64 nt, hsa; identical to SEQ ID NO: 161081

SEQ ID NO: 578063 - RNA, 64 nt, hsa; identical to SEQ ID NO: 161082

SEQ ID NO: 578064 - RNA, 64 nt, hsa; identical to SEQ ID NO: 161083

SEQ ID NO: 578065 - RNA, 64 nt, hsa; identical to SEQ ID NO: 161084

SEQ ID NO: 578066 - RNA, 64 nt, hsa; identical to SEQ ID NO: 161085

SEQ ID NO: 578067 - RNA, 64 nt, hsa; identical to SEQ ID NO: 161086

SEQ ID NO: 578068 - RNA, 64 nt, hsa; identical to SEQ ID NO: 161087

SEQ ID NO: 578069 - RNA, 64 nt, hsa; identical to SEQ ID NO: 161088

SEQ ID NO: 578070 - RNA, 64 nt, hsa; identical to SEQ ID NO: 161089

SEQ ID NO: 578071 - RNA, 64 nt, hsa; identical to SEQ ID NO: 161090

SEQ ID NO: 578072 - RNA, 64 nt, hsa; identical to SEQ ID NO: 161091

SEQ ID NO: 578073 - RNA, 64 nt, hsa; identical to SEQ ID NO: 161092

SEQ ID NO: 578074 - RNA, 64 nt, hsa; identical to SEQ ID NO: 161093

SEQ ID NO: 578075 - RNA, 64 nt, hsa; identical to SEQ ID NO: 161094

SEQ ID NO: 578076 - RNA, 64 nt, hsa; identical to SEQ ID NO: 161095

SEQ ID NO: 578077 - RNA, 64 nt, hsa; identical to SEQ ID NO: 161096

SEQ ID NO: 578078 - RNA, 64 nt, hsa
uuacaacugcagccagaacaauggcuggguggaucgcacguaaagcuugccacuaaaaaucaaa

SEQ ID NO: 578079 - RNA, 64 nt, hsa
cucccaaacugcugggauuacaggugugagccaccgcacguagcauuuacauuagguauuacaa

SEQ ID NO: 578080 - RNA, 64 nt, hsa
gaaacucccaggaauuggaauucagcaccuguuccgcacguaauuggcaugugucugcaaacau

SEQ ID NO: 578081 - RNA, 64 nt, hsa
uaaaaauuuguuuuguauaaagagguuagcccugcgcacguaggacugaauucagugauauccc

SEQ ID NO: 578082 - RNA, 64 nt, hsa
ugucugcugaugagagcaccacucaucugcgaaacgcacguaaaacaaagugaaccgugacugu

SEQ ID NO: 578083 - RNA, 64 nt, hsa
gaccucaccgggccauggaccccccccccguccccgcacguagaucgcagcaggcgugauuaca

SEQ ID NO: 578084 - RNA, 64 nt, hsa
aaauugccuauacagucuuagugaccauuuaaaccggacgaacuagguguuuaauuuucacucu

SEQ ID NO: 578085 - RNA, 64 nt, hsa
aaagaggaaugaaguacucauacauguuacaacacggacgaaccuugaaaacuuuaugcuaagu

SEQ ID NO: 578086 - RNA, 64 nt, hsa
gagcaccucacgcacagcucucagaagcugcaggcggacgaacaucugaccaaagagguguggu

SEQ ID NO: 578087 - RNA, 64 nt, hsa
aaggccaggggaaugaauucaagagagauguccacggacgaaacauacggugaauaauucacgc

SEQ ID NO: 578088 - RNA, 64 nt, hsa
ugacguauagucaucuaccaccugcgguccuggccggacgaaacacacguguugcaucucaagg

SEQ ID NO: 578089 - RNA, 64 nt, hsa
cugguguagcuggaaacaaacagcaacuugcaaacggacgaagagccugccguguguuaaucau

SEQ ID NO: 578090 - RNA, 64 nt, hsa
uuguguaggucugcaggaaggaaggcugaaaaagcggacgaagauuuugacuuaagugggacuu

SEQ ID NO: 578091 - RNA, 64 nt, hsa
gggaaaagucaacuccgaugccaccauugcgggccggacgaaggaugcuuucuuccuagaggcu

SEQ ID NO: 578092 - RNA, 64 nt, hsa
ugaagaagugaaaccuuucccuuuucccaucugccggacgaaccacaacagcguuccccaugau

SEQ ID NO: 578093 - RNA, 64 nt, hsa; identical to SEQ ID NO: 83438

SEQ ID NO: 578094 - RNA, 64 nt, hsa; identical to SEQ ID NO: 83439

SEQ ID NO: 578095 - RNA, 64 nt, hsa; identical to SEQ ID NO: 83440

SEQ ID NO: 578096 - RNA, 64 nt, hsa; identical to SEQ ID NO: 83441

SEQ ID NO: 578097 - RNA, 64 nt, hsa; identical to SEQ ID NO: 83442

SEQ ID NO: 578098 - RNA, 64 nt, hsa; identical to SEQ ID NO: 83443

SEQ ID NO: 578099 - RNA, 64 nt, hsa; identical to SEQ ID NO: 83444

SEQ ID NO: 578100 - RNA, 64 nt, hsa; identical to SEQ ID NO: 83445

SEQ ID NO: 578101 - RNA, 64 nt, hsa; identical to SEQ ID NO: 83446

SEQ ID NO: 578102 - RNA, 64 nt, hsa; identical to SEQ ID NO: 83447

SEQ ID NO: 578103 - RNA, 64 nt, hsa; identical to SEQ ID NO: 83448

SEQ ID NO: 578104 - RNA, 64 nt, hsa; identical to SEQ ID NO: 83449

SEQ ID NO: 578105 - RNA, 64 nt, hsa; identical to SEQ ID NO: 83450

SEQ ID NO: 578106 - RNA, 64 nt, hsa; identical to SEQ ID NO: 83451

SEQ ID NO: 578107 - RNA, 51 nt, hsa; identical to SEQ ID NO: 83452

SEQ ID NO: 578108 - RNA, 64 nt, hsa; identical to SEQ ID NO: 83453

SEQ ID NO: 578109 - RNA, 64 nt, hsa; identical to SEQ ID NO: 83454

SEQ ID NO: 578110 - RNA, 64 nt, hsa; identical to SEQ ID NO: 83455

SEQ ID NO: 578111 - RNA, 64 nt, hsa; identical to SEQ ID NO: 83456

SEQ ID NO: 578112 - RNA, 64 nt, hsa; identical to SEQ ID NO: 83457

SEQ ID NO: 578113 - RNA, 64 nt, hsa; identical to SEQ ID NO: 83458

SEQ ID NO: 578114 - RNA, 64 nt, hsa; identical to SEQ ID NO: 83459

SEQ ID NO: 578115 - RNA, 64 nt, hsa; identical to SEQ ID NO: 83460

SEQ ID NO: 578116 - RNA, 64 nt, hsa; identical to SEQ ID NO: 83461

SEQ ID NO: 578117 - RNA, 64 nt, hsa; identical to SEQ ID NO: 83462

SEQ ID NO: 578118 - RNA, 64 nt, hsa; identical to SEQ ID NO: 83463

SEQ ID NO: 578119 - RNA, 64 nt, hsa; identical to SEQ ID NO: 83464

SEQ ID NO: 578120 - RNA, 64 nt, hsa; identical to SEQ ID NO: 83465

SEQ ID NO: 578121 - RNA, 64 nt, hsa; identical to SEQ ID NO: 83466

SEQ ID NO: 578122 - RNA, 64 nt, hsa; identical to SEQ ID NO: 83467

SEQ ID NO: 578123 - RNA, 64 nt, hsa; identical to SEQ ID NO: 83468

SEQ ID NO: 578124 - RNA, 64 nt, hsa; identical to SEQ ID NO: 83469

SEQ ID NO: 578125 - RNA, 64 nt, hsa; identical to SEQ ID NO: 83470

SEQ ID NO: 578126 - RNA, 64 nt, hsa; identical to SEQ ID NO: 83471

SEQ ID NO: 578127 - RNA, 64 nt, hsa; identical to SEQ ID NO: 83472

SEQ ID NO: 578128 - RNA, 64 nt, hsa; identical to SEQ ID NO: 83473

SEQ ID NO: 578129 - RNA, 64 nt, hsa; identical to SEQ ID NO: 83474

SEQ ID NO: 578130 - RNA, 64 nt, hsa; identical to SEQ ID NO: 83475

SEQ ID NO: 578131 - RNA, 64 nt, hsa; identical to SEQ ID NO: 83476

SEQ ID NO: 578132 - RNA, 64 nt, hsa; identical to SEQ ID NO: 83477

SEQ ID NO: 578133 - RNA, 64 nt, hsa; identical to SEQ ID NO: 83478

SEQ ID NO: 578134 - RNA, 64 nt, hsa; identical to SEQ ID NO: 83479

SEQ ID NO: 578135 - RNA, 64 nt, hsa; identical to SEQ ID NO: 83480

SEQ ID NO: 578136 - RNA, 64 nt, hsa; identical to SEQ ID NO: 83481

SEQ ID NO: 578137 - RNA, 64 nt, hsa; identical to SEQ ID NO: 83482

SEQ ID NO: 578138 - RNA, 64 nt, hsa; identical to SEQ ID NO: 83483

SEQ ID NO: 578139 - RNA, 64 nt, hsa; identical to SEQ ID NO: 83484

SEQ ID NO: 578140 - RNA, 64 nt, hsa; identical to SEQ ID NO: 83485

SEQ ID NO: 578141 - RNA, 64 nt, hsa; identical to SEQ ID NO: 83486

SEQ ID NO: 578142 - RNA, 64 nt, hsa; identical to SEQ ID NO: 83487

SEQ ID NO: 578143 - RNA, 64 nt, hsa
uaguuugaaaaauaguauuuuauuucucagaacaagguaaaaaggugagugggugcauauguac

SEQ ID NO: 578144 - RNA, 64 nt, hsa
caaaauauuuuccugccacuguguaacauagcugagguaaaaacugaacuauguaaaugacucu

SEQ ID NO: 578145 - RNA, 64 nt, hsa
uacuuuuacaaauggagcccuugggagguggguuagguaaaagaagcuuuuuacuuaacguugu

SEQ ID NO: 578146 - RNA, 64 nt, hsa
acuagagcuugcuuggguuucuuccugcauuacaagguaaaaauuuguuaauguuuguuuuuau

SEQ ID NO: 578147 - RNA, 64 nt, hsa
ugacaauugauaaaugacaaggaaauauuuaauuagguaaaacuaaaucauugcucucuauacu

SEQ ID NO: 578148 - RNA, 64 nt, hsa
uuugcugacagauaacuaaccgaugaugaggccgagguaaaagagacaucugcagugugacaga

SEQ ID NO: 578149 - RNA, 64 nt, hsa
uguuuacacaacgauuacucgaagaugacugcaaagguaaaaggaaaauaaaaguguauugcac

SEQ ID NO: 578150 - RNA, 64 nt, hsa
gugaaaauuggaaggguuuugugcaaugacuaaaagguaaaacgcuguuaagguucaagaauca

SEQ ID NO: 578151 - RNA, 64 nt, hsa
uggcaagauuucaagaccacucucugcacugaagagguaaaauuugcacugcaagucacauccc

SEQ ID NO: 578152 - RNA, 64 nt, hsa
uucuggguuuucuuuuugacaauucuuggacuugagguaaaacaaggaggauuguggccggauu

SEQ ID NO: 578153 - RNA, 64 nt, hsa
acaaaucuuauuauuucuaaaaauaagaauaaaaagguaaaacuacauuuagacuucuuucuca

SEQ ID NO: 578154 - RNA, 64 nt, hsa
cagucauuuuuuaagaaugcaagaugaaaaaaucagguaaaaucuaaccauuuuauucucugcu

SEQ ID NO: 578155 - RNA, 64 nt, hsa
auaaauaaauguaauauuucauccuuuauuuuucagguaaaaggucaugcuguuacagguguag

SEQ ID NO: 578156 - RNA, 64 nt, hsa
aauauaauauugcauccuuugugggaaugacuauagguaaaauguaguaaguaacgcagaacca

SEQ ID NO: 578157 - RNA, 64 nt, hsa
auccuccuaccugguccaccccagggcuaccggaagguaaaaucuucaccugaaccaauuauga

SEQ ID NO: 578158 - RNA, 64 nt, hsa
ucgcguaaggcuucuugcuuauuuaaacugugcaagguaaaaaucaagccuuuggagccacaga

SEQ ID NO: 578159 - RNA, 64 nt, hsa
uaugccucuaaaaugaugcuguuuucucugcuaaagguaaaagaaaagaaaaaaauaguuggaa

SEQ ID NO: 578160 - RNA, 64 nt, hsa
uaguuuuauacuucaugaacugauuuagcaacacagguaaaaaugcaccuuuuaaagcacuacg

SEQ ID NO: 578161 - RNA, 64 nt, hsa
uucuucaaggaauuacuauuguuccuuuugucacagguaaaaucaguguugggaauuauaauuu

SEQ ID NO: 578162 - RNA, 64 nt, hsa
gugcaugacuaugugcuuauccacuuaagacaauagguaaaaggggaucugagaaauuauguaa

SEQ ID NO: 578163 - RNA, 64 nt, hsa
aaaaaaacaaaaacaaaaaaacaaaaccagaaucagguaaaacagcuaugugauuaaaauauuu

SEQ ID NO: 578164 - RNA, 64 nt, hsa
agaucuuugcaccuuaauauuaauggacuguuucagguaaaagagaaugaauguaugauuguga

SEQ ID NO: 578165 - RNA, 64 nt, hsa
uaacuuagaggagauuuuaacuuuauuuaaaaauagguaaaauuauuguaccuaauuaugucua

SEQ ID NO: 578166 - RNA, 64 nt, hsa
uguaguuuacccuaacgcuucuuuaaaagaaaguagguaaaaaaagaaaaggguagauaaucuu

SEQ ID NO: 578167 - RNA, 64 nt, hsa
uuauuuuaauucuuaaguggccaaauaacagauuagguaaaaugagauuacaugaaaagguucu

SEQ ID NO: 578168 - RNA, 64 nt, hsa
uucauugaauuuaguuugucuaaaauagucucacagguaaaaaacauaacaacaaugaccacca

SEQ ID NO: 578169 - RNA, 64 nt, hsa
cugccuuugcuuguucacugcagucuuaagaaagagguaaaaggcaagcaaaggagaugaaauc

SEQ ID NO: 578170 - RNA, 64 nt, hsa
aagaaaccuggcauuuaaaucauauuuugucuuuagguaaaagcuuugguuuguguucguguuu

SEQ ID NO: 578171 - RNA, 64 nt, hsa
gccuuuuuauuauugccuguacaaauguauauuaagguaaaauaaaacugacaaaguguuucua

SEQ ID NO: 578172 - RNA, 64 nt, hsa
cucauuuguaacugcaugcauuauucuugaaacuagguaaaacucacugaauuguuguguaaua

SEQ ID NO: 578173 - RNA, 64 nt, hsa
gguuuuuguaaagauuucuguucagcguuuugcaagguaaaauuuuaggcaaguuuucccugaa

SEQ ID NO: 578174 - RNA, 64 nt, hsa
auucaaacugaaaagcugagaccaagagcaaggaagguaaaaaguuaacaggcaaacauuuucu

SEQ ID NO: 578175 - RNA, 64 nt, hsa
uugacccacucuggucuauuguguaaauauuuauuuagacuauuuuaauaauacauauuauuua

SEQ ID NO: 578176 - RNA, 64 nt, hsa
uaauuauguauaaaguuuuuuuauuuauuugaaguuagacuagauauacguuuuuaaauuuaac

SEQ ID NO: 578177 - RNA, 64 nt, hsa
gcaucuauagaagccuagaagaauucuguuauguuuagacuaugucuuaucuuuagacuauuuc

SEQ ID NO: 578178 - RNA, 64 nt, hsa
aagaauucuguuauguuuagacuaugucuuaucuuuagacuauuucaggcuuaauuuuccuaac

SEQ ID NO: 578179 - RNA, 64 nt, hsa; identical to SEQ ID NO: 352467

SEQ ID NO: 578180 - RNA, 64 nt, hsa; identical to SEQ ID NO: 352468

SEQ ID NO: 578181 - RNA, 64 nt, hsa; identical to SEQ ID NO: 352469

SEQ ID NO: 578182 - RNA, 64 nt, hsa; identical to SEQ ID NO: 352470

SEQ ID NO: 578183 - RNA, 64 nt, hsa; identical to SEQ ID NO: 352471

SEQ ID NO: 578184 - RNA, 64 nt, hsa; identical to SEQ ID NO: 352472

SEQ ID NO: 578185 - RNA, 64 nt, hsa; identical to SEQ ID NO: 352473

SEQ ID NO: 578186 - RNA, 64 nt, hsa; identical to SEQ ID NO: 352474

SEQ ID NO: 578187 - RNA, 64 nt, hsa; identical to SEQ ID NO: 352475

SEQ ID NO: 578188 - RNA, 64 nt, hsa; identical to SEQ ID NO: 352476

SEQ ID NO: 578189 - RNA, 64 nt, hsa; identical to SEQ ID NO: 369930

SEQ ID NO: 578190 - RNA, 64 nt, hsa; identical to SEQ ID NO: 369931

SEQ ID NO: 578191 - RNA, 64 nt, hsa; identical to SEQ ID NO: 369932

SEQ ID NO: 578192 - RNA, 64 nt, hsa; identical to SEQ ID NO: 369933

SEQ ID NO: 578193 - RNA, 64 nt, hsa; identical to SEQ ID NO: 369934

SEQ ID NO: 578194 - RNA, 64 nt, hsa; identical to SEQ ID NO: 369935

SEQ ID NO: 578195 - RNA, 64 nt, hsa; identical to SEQ ID NO: 369936

SEQ ID NO: 578196 - RNA, 64 nt, hsa; identical to SEQ ID NO: 369937

SEQ ID NO: 578197 - RNA, 64 nt, hsa; identical to SEQ ID NO: 369938

SEQ ID NO: 578198 - RNA, 64 nt, hsa; identical to SEQ ID NO: 369939

SEQ ID NO: 578199 - RNA, 64 nt, hsa; identical to SEQ ID NO: 369940

SEQ ID NO: 578200 - RNA, 64 nt, hsa; identical to SEQ ID NO: 369941

SEQ ID NO: 578201 - RNA, 64 nt, hsa; identical to SEQ ID NO: 369942

SEQ ID NO: 578202 - RNA, 64 nt, hsa; identical to SEQ ID NO: 369943

SEQ ID NO: 578203 - RNA, 64 nt, hsa; identical to SEQ ID NO: 369944

SEQ ID NO: 578204 - RNA, 64 nt, hsa; identical to SEQ ID NO: 369945

SEQ ID NO: 578205 - RNA, 64 nt, hsa; identical to SEQ ID NO: 369946

SEQ ID NO: 578206 - RNA, 64 nt, hsa; identical to SEQ ID NO: 369947

SEQ ID NO: 578207 - RNA, 64 nt, hsa; identical to SEQ ID NO: 369948

SEQ ID NO: 578208 - RNA, 64 nt, hsa; identical to SEQ ID NO: 369949

SEQ ID NO: 578209 - RNA, 64 nt, hsa; identical to SEQ ID NO: 369950

SEQ ID NO: 578210 - RNA, 64 nt, hsa; identical to SEQ ID NO: 369951

SEQ ID NO: 578211 - RNA, 64 nt, hsa; identical to SEQ ID NO: 369952

SEQ ID NO: 578212 - RNA, 64 nt, hsa; identical to SEQ ID NO: 369953

SEQ ID NO: 578213 - RNA, 64 nt, hsa; identical to SEQ ID NO: 369954

SEQ ID NO: 578214 - RNA, 64 nt, hsa; identical to SEQ ID NO: 369955

SEQ ID NO: 578215 - RNA, 64 nt, hsa; identical to SEQ ID NO: 369956

SEQ ID NO: 578216 - RNA, 64 nt, hsa; identical to SEQ ID NO: 369957

SEQ ID NO: 578217 - RNA, 64 nt, hsa; identical to SEQ ID NO: 369958

SEQ ID NO: 578218 - RNA, 64 nt, hsa; identical to SEQ ID NO: 369959

SEQ ID NO: 578219 - RNA, 64 nt, hsa; identical to SEQ ID NO: 369960

SEQ ID NO: 578220 - RNA, 64 nt, hsa; identical to SEQ ID NO: 316944

SEQ ID NO: 578221 - RNA, 64 nt, hsa; identical to SEQ ID NO: 316945

SEQ ID NO: 578222 - RNA, 64 nt, hsa; identical to SEQ ID NO: 316946

SEQ ID NO: 578223 - RNA, 64 nt, hsa; identical to SEQ ID NO: 316947

SEQ ID NO: 578224 - RNA, 64 nt, hsa; identical to SEQ ID NO: 316948

SEQ ID NO: 578225 - RNA, 64 nt, hsa; identical to SEQ ID NO: 316949

SEQ ID NO: 578226 - RNA, 64 nt, hsa; identical to SEQ ID NO: 316950

SEQ ID NO: 578227 - RNA, 64 nt, hsa; identical to SEQ ID NO: 316951

SEQ ID NO: 578228 - RNA, 64 nt, hsa; identical to SEQ ID NO: 367941

SEQ ID NO: 578229 - RNA, 64 nt, hsa; identical to SEQ ID NO: 367942

SEQ ID NO: 578230 - RNA, 64 nt, hsa; identical to SEQ ID NO: 367943

SEQ ID NO: 578231 - RNA, 64 nt, hsa; identical to SEQ ID NO: 367944

SEQ ID NO: 578232 - RNA, 64 nt, hsa; identical to SEQ ID NO: 367945

SEQ ID NO: 578233 - RNA, 64 nt, hsa; identical to SEQ ID NO: 367946

SEQ ID NO: 578234 - RNA, 64 nt, hsa; identical to SEQ ID NO: 367947

SEQ ID NO: 578235 - RNA, 64 nt, hsa; identical to SEQ ID NO: 367948

SEQ ID NO: 578236 - RNA, 64 nt, hsa; identical to SEQ ID NO: 367949

SEQ ID NO: 578237 - RNA, 64 nt, hsa; identical to SEQ ID NO: 367950

SEQ ID NO: 578238 - RNA, 64 nt, hsa; identical to SEQ ID NO: 367951

SEQ ID NO: 578239 - RNA, 64 nt, hsa; identical to SEQ ID NO: 367952

SEQ ID NO: 578240 - RNA, 64 nt, hsa; identical to SEQ ID NO: 367953

SEQ ID NO: 578241 - RNA, 64 nt, hsa; identical to SEQ ID NO: 367954

SEQ ID NO: 578242 - RNA, 64 nt, hsa
gagacucuguuucaaaaaaacagaaaagaaaauauaguuugauucuucauuuuuuuaaauuugc

SEQ ID NO: 578243 - RNA, 64 nt, hsa
auuaauguguauuuacuguacuaauuagaaaauauaguuugaggccgggcacgguggcucacgc

SEQ ID NO: 578244 - RNA, 64 nt, hsa
caugucaauauuggcacaaacuggaaugaaagaauaguuugauucagaccugcuccacuaugug

SEQ ID NO: 578245 - RNA, 64 nt, hsa
uauucacuagcuucugaaaagggaggaguauuuuuaguuugacaauuuaauaauuuaaaaacaa

SEQ ID NO: 578246 - RNA, 64 nt, hsa
aacaugaacuaaaauggcaugcuauuuggaaauuuaguuugagauaaacuaaaguguguugaug

SEQ ID NO: 578247 - RNA, 64 nt, hsa
uauggaagaaacaaugucagccaaguccauuuuauaguuugagugcaauucuuugaacaauaga

SEQ ID NO: 578248 - RNA, 64 nt, hsa
auuggauggagcuauuauucacuacuucuuuucuuaguuugaaaauuauaaacaaauuuuaagc

SEQ ID NO: 578249 - RNA, 64 nt, hsa
aaagaauuucaugaauauauauucuauauuuguauaguuugagggaugcuauguuaauguauuu

SEQ ID NO: 578250 - RNA, 64 nt, hsa
cucagugucuucugguaacuguugaaaauugucuuaguuugagagauggcugaaauaaugaaca

SEQ ID NO: 578251 - RNA, 64 nt, hsa
aaaugugaucagauuauuuuacuaccaacaguuauaguuugaaaguccaacuguauuaauugac

SEQ ID NO: 578252 - RNA, 64 nt, hsa
aauugugugaaaucauguaguugcaaauaaaaaauaguuugaggcaugacaacgcguguuucug

SEQ ID NO: 578253 - RNA, 64 nt, hsa
uucuuaaaaaauauaugcacuuuagauauugauauaguuugagaaauuuuauuaaaguuaguca

SEQ ID NO: 578254 - RNA, 64 nt, hsa
ccucuccaugcaagugcuguuugggcaggagucaccaugcaagggugacaucgacaaccacgua

SEQ ID NO: 578255 - RNA, 64 nt, hsa
cauggguccucggcccaucuguccauccuccucuccaugcaagugcuguuugggcaggagucac

SEQ ID NO: 578256 - RNA, 64 nt, hsa
guuuuuuuucuuuuuccugcuguauaacuccuugccaugcaaacucucaagaggccaauauauu

SEQ ID NO: 578257 - RNA, 64 nt, hsa
auguuugaaugagccucuuaaaauaaacuuagagccaugcaaaugccagcagcuuaauggauuu

SEQ ID NO: 578258 - RNA, 64 nt, hsa
uuuaauugaagcaugauugugguaauucgagccaucuggagaaugcucuggggaguacaccagg

SEQ ID NO: 578259 - RNA, 64 nt, hsa
ucaguugucuuuggccauugugggaagucauuauucuggagacaagaaaaucaucacucuggug

SEQ ID NO: 578260 - RNA, 64 nt, hsa
cccaccucugugaccucaggcacuagccuuuggcucuggagacagccccagagcaggguguugg

SEQ ID NO: 578261 - RNA, 64 nt, hsa
cuccccacgcccuccccuccccugcugcaggggcucuggagagaaacaauaaagagauucacac

SEQ ID NO: 578262 - RNA, 64 nt, hsa
acgggcccagcuccugcaccacggacacagaaugucuggagagggccagcaggcccucugaggg

SEQ ID NO: 578263 - RNA, 64 nt, hsa
augcuccuuucuguaccagguuuaaauguagucuucuggagaaguauuuuugacauugagcucu

SEQ ID NO: 578264 - RNA, 64 nt, hsa
augggaagguuugaguuccaggcagcguaugaacucuggagaggggcugccaguccucucuggg

SEQ ID NO: 578265 - RNA, 64 nt, hsa
ggcaccagccaggguaugauggcuacuacccuuuucuggagaaccauagacuucccuuacuaca

SEQ ID NO: 578266 - RNA, 64 nt, hsa
uaaggacuuggcuccaaaacaaaacaaaacaaaaucuggagaugcugaauuuuguuggggggaa

SEQ ID NO: 578267 - RNA, 64 nt, hsa
cacaggucuuuccucaaacuuuaaauugcuacucucuggagauagcuaccuggacuuuacagag

SEQ ID NO: 578268 - RNA, 64 nt, hsa
ugcuugaaaaaccaagaggauaugaaaaucugucucuggagaaacaaagacgcaggcauacuca

SEQ ID NO: 578269 - RNA, 64 nt, hsa
gcuguaaacuuaagaaaaggguaaaauaaaauuuucuggagaggaacuuggaauuugagggaga

SEQ ID NO: 578270 - RNA, 64 nt, hsa
aaagaugugaagaccacagucuuggguuuucauaucuggagaagacuauuugccaugacguuuu

SEQ ID NO: 578271 - RNA, 64 nt, hsa
uuuauuuuucuuuaaaaauaaaggauuuuggaacucuggagaguaagaauauaguauagaguuu

SEQ ID NO: 578272 - RNA, 64 nt, hsa
agauuccggggagugggaaugagccacucccaguucuggagagugaggaugaccaucuccacuu

SEQ ID NO: 578273 - RNA, 64 nt, hsa
aaacccuaaaggagaaggaagcagaauauaacccucuggagagcucaagacaguaggaaccugg

SEQ ID NO: 578274 - RNA, 64 nt, hsa
auuauugggucuuucauaaauaacaugagugguuucuggagacauuuaagauugucagcaaacu

SEQ ID NO: 578275 - RNA, 64 nt, hsa
aaugccuucucuccagacaauaagacaguucacaucuggagacaucagccuuugguaccuaauu

SEQ ID NO: 578276 - RNA, 64 nt, hsa
gcucugaaccgugcguggugccuacagccugcagucuggagacaagcucuuccggagugcucug

SEQ ID NO: 578277 - RNA, 64 nt, hsa
uagacaacgcccauaaacagagaugguccugaacucuggagagauccuucccugauccuuucgg

SEQ ID NO: 578278 - RNA, 64 nt, hsa
gucuuucuuggccugagcuaugccuguugaggcaucuggagacugagaaagaaucaaaggcaga

SEQ ID NO: 578279 - RNA, 64 nt, hsa
ggcuuccuuuggaggugggagugggcuggaggccucuggagaagaccuggggugggggcugaug

SEQ ID NO: 578280 - RNA, 64 nt, hsa
agaagcuggaggacuagaaccuggagggcuggaaucuggagagcuagaaccuggagggcuagaa

SEQ ID NO: 578281 - RNA, 64 nt, hsa
agaaccuggagggcuagaaccuggagggcuagaaucuggagagcuagaaccuggagggcuagaa

SEQ ID NO: 578282 - RNA, 64 nt, hsa
agaaucuggagagcuagaaccuggagggcuagaaucuggagagcuagaaccuggagggcuagaa

SEQ ID NO: 578283 - RNA, 64 nt, hsa
gaaccuagaagggcuagaaccuggagggcuggaaucuggagagcuagaaccuggagggcuagaa

SEQ ID NO: 578284 - RNA, 64 nt, hsa; identical to SEQ ID NO: 578283

SEQ ID NO: 578285 - RNA, 64 nt, hsa
aaaacacuuuuuucccuggagucuucucuccacuucuggagaugaauuucuauguuuugcaccu

SEQ ID NO: 578286 - RNA, 64 nt, hsa
ccccagguccugggaguggcuaccgcagguaguuucuggagagcacguuuucuucauugauaag

SEQ ID NO: 578287 - RNA, 64 nt, hsa
ugccuuugaaugaggcagcuugugaggcaagcauucuggagagaggugcuuugaaaguaaggug

SEQ ID NO: 578288 - RNA, 64 nt, hsa
gcaucucuucuuuccuuuagucuucacagcuaacucuggagagcuucaaaacuagaaggaucua

SEQ ID NO: 578289 - RNA, 64 nt, hsa
cucauggcccaccuccaacccacuuuccucaguaucuggagagggaagggaagucaggcuuggg

SEQ ID NO: 578290 - RNA, 64 nt, hsa
ucugucuccgucauggggagggucccugcucaguucuggagacacuggaguuggggugggggug

SEQ ID NO: 578291 - RNA, 64 nt, hsa
guuuggauuucauguggggaacccucaaggccugucuggagaagugacacaggauuuacugggg

SEQ ID NO: 578292 - RNA, 64 nt, hsa
cguucuccugcguggcaguccugauuuccaugcuucuggagaauccauuucguuaacacugaaa

SEQ ID NO: 578293 - RNA, 64 nt, hsa
gcagccuuuguauggaggcccaaccgcgcucccgucuggagaagcggcuuccgggguguggcug

SEQ ID NO: 578294 - RNA, 64 nt, hsa
ugugugucacacuucaucaauuccggaaacaguuucuggagaucuccucauuaccucuuuuaca

SEQ ID NO: 578295 - RNA, 64 nt, hsa
gaaaugaccacagcagaaugucacacauggcuguucuggagagggccucugagaaggcacugaa

SEQ ID NO: 578296 - RNA, 64 nt, hsa
aaggcaauaaguaaauauguacugguugaaugccucuggagaccuagaguuuaaaguuuuaagu

SEQ ID NO: 578297 - RNA, 64 nt, hsa
aauuuucuaguaagcaagguguuccuacaucuuuucuggagagcuuaccauaguuuuauagcau

SEQ ID NO: 578298 - RNA, 64 nt, hsa; identical to SEQ ID NO: 81719

SEQ ID NO: 578299 - RNA, 64 nt, hsa; identical to SEQ ID NO: 81720

SEQ ID NO: 578300 - RNA, 64 nt, hsa; identical to SEQ ID NO: 81721

SEQ ID NO: 578301 - RNA, 64 nt, hsa; identical to SEQ ID NO: 81722

SEQ ID NO: 578302 - RNA, 64 nt, hsa; identical to SEQ ID NO: 81723

SEQ ID NO: 578303 - RNA, 64 nt, hsa; identical to SEQ ID NO: 81724

SEQ ID NO: 578304 - RNA, 64 nt, hsa; identical to SEQ ID NO: 81725

SEQ ID NO: 578305 - RNA, 64 nt, hsa; identical to SEQ ID NO: 81726

SEQ ID NO: 578306 - RNA, 64 nt, hsa; identical to SEQ ID NO: 81727

SEQ ID NO: 578307 - RNA, 64 nt, hsa; identical to SEQ ID NO: 81728

SEQ ID NO: 578308 - RNA, 64 nt, hsa; identical to SEQ ID NO: 81729

SEQ ID NO: 578309 - RNA, 64 nt, hsa; identical to SEQ ID NO: 81730

SEQ ID NO: 578310 - RNA, 64 nt, hsa; identical to SEQ ID NO: 81731

SEQ ID NO: 578311 - RNA, 64 nt, hsa; identical to SEQ ID NO: 81732

SEQ ID NO: 578312 - RNA, 64 nt, hsa; identical to SEQ ID NO: 81733

SEQ ID NO: 578313 - RNA, 64 nt, hsa; identical to SEQ ID NO: 81734

SEQ ID NO: 578314 - RNA, 64 nt, hsa
aggaacuucucaagggaugaggagacagaaccccuacuuccaagugcucuauuuguauuaccca

SEQ ID NO: 578315 - RNA, 64 nt, hsa
uucuaugugauggaaagacuagagcuuauaaaaguacuuccauuuuuuuauucuccugaauacc

SEQ ID NO: 578316 - RNA, 64 nt, hsa
gcaacuacagaaguggaagugcuugauauguaaguacuuccacuuguguauauuuuaaugaaua

SEQ ID NO: 578317 - RNA, 64 nt, hsa
auuuaugcugcucauccaaaguugccacagaugauacuuccaagugauaauuuuauuuauaaac

SEQ ID NO: 578318 - RNA, 64 nt, hsa
ucugauuucugugaaagcugcucagcaacaaacguacuuccaccagauguguccccagauccac

SEQ ID NO: 578319 - RNA, 64 nt, hsa
gacacuccugagguuggacuuccuugcuuuucucuacuuccaaaucacaauuucuuacaaccaa

SEQ ID NO: 578320 - RNA, 64 nt, hsa
cgccucccccuacgccgucuuggcuuuuccccucuacuuccaguccuuagguuagaugaaaagu

SEQ ID NO: 578321 - RNA, 64 nt, hsa
gcccuguuacauaaaccagagaugauaaaacagauacuuccagaacauagugugcuucaaaaca

SEQ ID NO: 578322 - RNA, 64 nt, hsa; identical to SEQ ID NO: 395564

SEQ ID NO: 578323 - RNA, 64 nt, hsa; identical to SEQ ID NO: 395565

SEQ ID NO: 578324 - RNA, 64 nt, hsa; identical to SEQ ID NO: 395566

SEQ ID NO: 578325 - RNA, 64 nt, hsa; identical to SEQ ID NO: 395567

SEQ ID NO: 578326 - RNA, 64 nt, hsa; identical to SEQ ID NO: 395568

SEQ ID NO: 578327 - RNA, 64 nt, hsa; identical to SEQ ID NO: 395569

SEQ ID NO: 578328 - RNA, 64 nt, hsa; identical to SEQ ID NO: 395570

SEQ ID NO: 578329 - RNA, 64 nt, hsa; identical to SEQ ID NO: 395571

SEQ ID NO: 578330 - RNA, 64 nt, hsa; identical to SEQ ID NO: 395572

SEQ ID NO: 578331 - RNA, 64 nt, hsa; identical to SEQ ID NO: 395573

SEQ ID NO: 578332 - RNA, 64 nt, hsa; identical to SEQ ID NO: 395574

SEQ ID NO: 578333 - RNA, 64 nt, hsa; identical to SEQ ID NO: 395575

SEQ ID NO: 578334 - RNA, 64 nt, hsa; identical to SEQ ID NO: 395576

SEQ ID NO: 578335 - RNA, 64 nt, hsa; identical to SEQ ID NO: 395577

SEQ ID NO: 578336 - RNA, 64 nt, hsa; identical to SEQ ID NO: 395578

SEQ ID NO: 578337 - RNA, 64 nt, hsa; identical to SEQ ID NO: 395579

SEQ ID NO: 578338 - RNA, 64 nt, hsa; identical to SEQ ID NO: 395580

SEQ ID NO: 578339 - RNA, 64 nt, hsa; identical to SEQ ID NO: 395581

SEQ ID NO: 578340 - RNA, 64 nt, hsa; identical to SEQ ID NO: 395582

SEQ ID NO: 578341 - RNA, 64 nt, hsa; identical to SEQ ID NO: 395583

SEQ ID NO: 578342 - RNA, 64 nt, hsa; identical to SEQ ID NO: 395584

SEQ ID NO: 578343 - RNA, 64 nt, hsa; identical to SEQ ID NO: 395585

SEQ ID NO: 578344 - RNA, 64 nt, hsa; identical to SEQ ID NO: 395586

SEQ ID NO: 578345 - RNA, 64 nt, hsa; identical to SEQ ID NO: 395587

SEQ ID NO: 578346 - RNA, 64 nt, hsa; identical to SEQ ID NO: 395588

SEQ ID NO: 578347 - RNA, 64 nt, hsa; identical to SEQ ID NO: 395589

SEQ ID NO: 578348 - RNA, 64 nt, hsa; identical to SEQ ID NO: 395590

SEQ ID NO: 578349 - RNA, 64 nt, hsa; identical to SEQ ID NO: 395591

SEQ ID NO: 578350 - RNA, 64 nt, hsa; identical to SEQ ID NO: 395592

SEQ ID NO: 578351 - RNA, 64 nt, hsa; identical to SEQ ID NO: 395593

SEQ ID NO: 578352 - RNA, 64 nt, hsa; identical to SEQ ID NO: 395594

SEQ ID NO: 578353 - RNA, 64 nt, hsa; identical to SEQ ID NO: 395595

SEQ ID NO: 578354 - RNA, 64 nt, hsa; identical to SEQ ID NO: 395596

SEQ ID NO: 578355 - RNA, 64 nt, hsa; identical to SEQ ID NO: 395597

SEQ ID NO: 578356 - RNA, 64 nt, hsa; identical to SEQ ID NO: 395598

SEQ ID NO: 578357 - RNA, 64 nt, hsa; identical to SEQ ID NO: 395599

SEQ ID NO: 578358 - RNA, 64 nt, hsa; identical to SEQ ID NO: 395600

SEQ ID NO: 578359 - RNA, 64 nt, hsa; identical to SEQ ID NO: 395601

SEQ ID NO: 578360 - RNA, 64 nt, hsa; identical to SEQ ID NO: 395602

SEQ ID NO: 578361 - RNA, 64 nt, hsa; identical to SEQ ID NO: 395603

SEQ ID NO: 578362 - RNA, 63 nt, hsa
uugcucgaagacugugacaucagaaguaacucccacuccuaaucaagagucucuccagccuca

SEQ ID NO: 578363 - RNA, 63 nt, hsa
gaaugugcugccuuuuuaaguuuuguuuguucacacuccuauauaugauuguuugcacagagg

SEQ ID NO: 578364 - RNA, 63 nt, hsa
uuacaacugaucugauuuggccccuucacaccucacuccuagauuuugcuagaccuuucuauu

SEQ ID NO: 578365 - RNA, 63 nt, hsa
cccucuguugaaacauccuaggcuuuuucuuuccacuccuauuacaacugaucugauuuggcc

SEQ ID NO: 578366 - RNA, 64 nt, hsa; identical to SEQ ID NO: 507233

SEQ ID NO: 578367 - RNA, 64 nt, hsa; identical to SEQ ID NO: 507234

SEQ ID NO: 578368 - RNA, 64 nt, hsa; identical to SEQ ID NO: 507235

SEQ ID NO: 578369 - RNA, 64 nt, hsa; identical to SEQ ID NO: 507236

SEQ ID NO: 578370 - RNA, 64 nt, hsa; identical to SEQ ID NO: 507237

SEQ ID NO: 578371 - RNA, 64 nt, hsa; identical to SEQ ID NO: 507238

SEQ ID NO: 578372 - RNA, 64 nt, hsa; identical to SEQ ID NO: 507239

SEQ ID NO: 578373 - RNA, 64 nt, hsa; identical to SEQ ID NO: 507240

SEQ ID NO: 578374 - RNA, 64 nt, hsa; identical to SEQ ID NO: 507241

SEQ ID NO: 578375 - RNA, 64 nt, hsa; identical to SEQ ID NO: 507242

SEQ ID NO: 578376 - RNA, 64 nt, hsa; identical to SEQ ID NO: 507243

SEQ ID NO: 578377 - RNA, 64 nt, hsa; identical to SEQ ID NO: 507244

SEQ ID NO: 578378 - RNA, 64 nt, hsa; identical to SEQ ID NO: 507245

SEQ ID NO: 578379 - RNA, 64 nt, hsa; identical to SEQ ID NO: 507246

SEQ ID NO: 578380 - RNA, 64 nt, hsa; identical to SEQ ID NO: 507247

SEQ ID NO: 578381 - RNA, 64 nt, hsa; identical to SEQ ID NO: 507248

SEQ ID NO: 578382 - RNA, 64 nt, hsa; identical to SEQ ID NO: 164859

SEQ ID NO: 578383 - RNA, 64 nt, hsa; identical to SEQ ID NO: 164860

SEQ ID NO: 578384 - RNA, 64 nt, hsa; identical to SEQ ID NO: 164861

SEQ ID NO: 578385 - RNA, 64 nt, hsa; identical to SEQ ID NO: 164862

SEQ ID NO: 578386 - RNA, 64 nt, hsa; identical to SEQ ID NO: 164863

SEQ ID NO: 578387 - RNA, 64 nt, hsa; identical to SEQ ID NO: 164864

SEQ ID NO: 578388 - RNA, 64 nt, hsa; identical to SEQ ID NO: 164865

SEQ ID NO: 578389 - RNA, 64 nt, hsa; identical to SEQ ID NO: 164866

SEQ ID NO: 578390 - RNA, 64 nt, hsa; identical to SEQ ID NO: 164867

SEQ ID NO: 578391 - RNA, 64 nt, hsa; identical to SEQ ID NO: 164868

SEQ ID NO: 578392 - RNA, 64 nt, hsa; identical to SEQ ID NO: 164869

SEQ ID NO: 578393 - RNA, 64 nt, hsa; identical to SEQ ID NO: 164870

SEQ ID NO: 578394 - RNA, 64 nt, hsa; identical to SEQ ID NO: 164871

SEQ ID NO: 578395 - RNA, 64 nt, hsa; identical to SEQ ID NO: 164872

SEQ ID NO: 578396 - RNA, 64 nt, hsa; identical to SEQ ID NO: 164873

SEQ ID NO: 578397 - RNA, 64 nt, hsa; identical to SEQ ID NO: 164874

SEQ ID NO: 578398 - RNA, 64 nt, hsa; identical to SEQ ID NO: 164875

SEQ ID NO: 578399 - RNA, 64 nt, hsa; identical to SEQ ID NO: 164876

SEQ ID NO: 578400 - RNA, 64 nt, hsa; identical to SEQ ID NO: 164877

SEQ ID NO: 578401 - RNA, 64 nt, hsa; identical to SEQ ID NO: 164878

SEQ ID NO: 578402 - RNA, 64 nt, hsa; identical to SEQ ID NO: 164879

SEQ ID NO: 578403 - RNA, 64 nt, hsa; identical to SEQ ID NO: 164880

SEQ ID NO: 578404 - RNA, 64 nt, hsa; identical to SEQ ID NO: 164881

SEQ ID NO: 578405 - RNA, 64 nt, hsa; identical to SEQ ID NO: 164882

SEQ ID NO: 578406 - RNA, 64 nt, hsa; identical to SEQ ID NO: 164883

SEQ ID NO: 578407 - RNA, 64 nt, hsa; identical to SEQ ID NO: 164884

SEQ ID NO: 578408 - RNA, 64 nt, hsa; identical to SEQ ID NO: 164885

SEQ ID NO: 578409 - RNA, 64 nt, hsa; identical to SEQ ID NO: 164886

SEQ ID NO: 578410 - RNA, 64 nt, hsa
uuccccuaaaccccugucccaugcaggcccuuugaagccucagcuacccacuuuccuucaugaa

SEQ ID NO: 578411 - RNA, 64 nt, hsa
auggccccugccuuaggccuaccugaucaaaauaaagccucagccacauuugcuauagucuugu

SEQ ID NO: 578412 - RNA, 64 nt, hsa
ucccccuaaaccccugucccaugcaggcccuuugaagccucagcuacccacuauccuucgugaa

SEQ ID NO: 578413 - RNA, 64 nt, hsa
auggucccugccuuaggccuaccugauggaaguaaagccucaaccacauuugcugugugucuug

SEQ ID NO: 578414 - RNA, 64 nt, hsa; identical to SEQ ID NO: 578412

SEQ ID NO: 578415 - RNA, 64 nt, hsa; identical to SEQ ID NO: 578413

SEQ ID NO: 578416 - RNA, 64 nt, hsa
ugaauaccccgaguggggagcaggguucuccucaaagccucacaaccauaggaucauaggaaag

SEQ ID NO: 578417 - RNA, 64 nt, hsa
ucucugcucaccuuccaaaggcaccuggaggugcaagccucaugcaucuccuuuccugagcacc

SEQ ID NO: 578418 - RNA, 64 nt, hsa
ucacuccgaaaguuccuuauguauauuuaaaagaaagccucagagaauugcugauucuugaguu

SEQ ID NO: 578419 - RNA, 64 nt, hsa
uuugaguuggaucaucuauugcuggcaaagacagaagccucacugcaagcacugcaugggcaag

SEQ ID NO: 578420 - RNA, 64 nt, hsa
cacuauaaacuuuuaggccugaauaggaguaguaaagccucaaggacaucugccugucacaaua

SEQ ID NO: 578421 - RNA, 64 nt, hsa
uuucuacccuaauuucacuggagugacuuauucuaagccucaucuauccccuaccuauuucuca

SEQ ID NO: 578422 - RNA, 64 nt, hsa
uuucuggaagaggaaagccaugcguggaacaucgaagccucagagagugggagacuguccccau

SEQ ID NO: 578423 - RNA, 64 nt, hsa
gcauccccuggggcugugaucaugguggaugaggaagccucaacguagauuccugaacucaagg

SEQ ID NO: 578424 - RNA, 64 nt, hsa
uucacuuacucuggcagucuuucugcuuuucauuaagccucaaaaucuccucuguucuacuugg

SEQ ID NO: 578425 - RNA, 64 nt, hsa
gcuuuuauuuaauaaggaggcugggcacccuauaaagccucaugcauucacaccuuugcagcau

SEQ ID NO: 578426 - RNA, 64 nt, hsa; identical to SEQ ID NO: 259226

SEQ ID NO: 578427 - RNA, 64 nt, hsa; identical to SEQ ID NO: 259227

SEQ ID NO: 578428 - RNA, 64 nt, hsa; identical to SEQ ID NO: 259228

SEQ ID NO: 578429 - RNA, 64 nt, hsa; identical to SEQ ID NO: 259229

SEQ ID NO: 578430 - RNA, 64 nt, hsa; identical to SEQ ID NO: 259230

SEQ ID NO: 578431 - RNA, 64 nt, hsa; identical to SEQ ID NO: 259231

SEQ ID NO: 578432 - RNA, 64 nt, hsa; identical to SEQ ID NO: 259232

SEQ ID NO: 578433 - RNA, 64 nt, hsa; identical to SEQ ID NO: 259233

SEQ ID NO: 578434 - RNA, 64 nt, hsa; identical to SEQ ID NO: 259234

SEQ ID NO: 578435 - RNA, 64 nt, hsa; identical to SEQ ID NO: 259235

SEQ ID NO: 578436 - RNA, 64 nt, hsa; identical to SEQ ID NO: 259236

SEQ ID NO: 578437 - RNA, 64 nt, hsa; identical to SEQ ID NO: 259237

SEQ ID NO: 578438 - RNA, 64 nt, hsa; identical to SEQ ID NO: 259238

SEQ ID NO: 578439 - RNA, 64 nt, hsa; identical to SEQ ID NO: 259239

SEQ ID NO: 578440 - RNA, 64 nt, hsa; identical to SEQ ID NO: 259240

SEQ ID NO: 578441 - RNA, 64 nt, hsa; identical to SEQ ID NO: 259241

SEQ ID NO: 578442 - RNA, 64 nt, hsa; identical to SEQ ID NO: 259242

SEQ ID NO: 578443 - RNA, 64 nt, hsa; identical to SEQ ID NO: 259243

SEQ ID NO: 578444 - RNA, 64 nt, hsa; identical to SEQ ID NO: 259244

SEQ ID NO: 578445 - RNA, 64 nt, hsa; identical to SEQ ID NO: 259245

SEQ ID NO: 578446 - RNA, 64 nt, hsa; identical to SEQ ID NO: 259246

SEQ ID NO: 578447 - RNA, 64 nt, hsa; identical to SEQ ID NO: 259247

SEQ ID NO: 578448 - RNA, 64 nt, hsa; identical to SEQ ID NO: 259248

SEQ ID NO: 578449 - RNA, 64 nt, hsa; identical to SEQ ID NO: 259249

SEQ ID NO: 578450 - RNA, 64 nt, hsa; identical to SEQ ID NO: 259250

SEQ ID NO: 578451 - RNA, 64 nt, hsa; identical to SEQ ID NO: 259251

SEQ ID NO: 578452 - RNA, 64 nt, hsa; identical to SEQ ID NO: 259252

SEQ ID NO: 578453 - RNA, 64 nt, hsa; identical to SEQ ID NO: 259253

SEQ ID NO: 578454 - RNA, 64 nt, hsa; identical to SEQ ID NO: 259254

SEQ ID NO: 578455 - RNA, 64 nt, hsa; identical to SEQ ID NO: 259255

SEQ ID NO: 578456 - RNA, 64 nt, hsa; identical to SEQ ID NO: 259256

SEQ ID NO: 578457 - RNA, 64 nt, hsa; identical to SEQ ID NO: 259257

SEQ ID NO: 578458 - RNA, 64 nt, hsa; identical to SEQ ID NO: 259258

SEQ ID NO: 578459 - RNA, 64 nt, hsa; identical to SEQ ID NO: 259259

SEQ ID NO: 578460 - RNA, 64 nt, hsa; identical to SEQ ID NO: 259260

SEQ ID NO: 578461 - RNA, 64 nt, hsa; identical to SEQ ID NO: 259261

SEQ ID NO: 578462 - RNA, 64 nt, hsa; identical to SEQ ID NO: 259262

SEQ ID NO: 578463 - RNA, 64 nt, hsa; identical to SEQ ID NO: 259263

SEQ ID NO: 578464 - RNA, 64 nt, hsa; identical to SEQ ID NO: 259264

SEQ ID NO: 578465 - RNA, 64 nt, hsa; identical to SEQ ID NO: 259265

SEQ ID NO: 578466 - RNA, 64 nt, hsa; identical to SEQ ID NO: 259266

SEQ ID NO: 578467 - RNA, 64 nt, hsa; identical to SEQ ID NO: 259267

SEQ ID NO: 578468 - RNA, 64 nt, hsa; identical to SEQ ID NO: 259268

SEQ ID NO: 578469 - RNA, 64 nt, hsa; identical to SEQ ID NO: 259269

SEQ ID NO: 578470 - RNA, 64 nt, hsa; identical to SEQ ID NO: 259270

SEQ ID NO: 578471 - RNA, 64 nt, hsa; identical to SEQ ID NO: 259271

SEQ ID NO: 578472 - RNA, 64 nt, hsa; identical to SEQ ID NO: 259272

SEQ ID NO: 578473 - RNA, 64 nt, hsa; identical to SEQ ID NO: 259273

SEQ ID NO: 578474 - RNA, 64 nt, hsa; identical to SEQ ID NO: 259274

SEQ ID NO: 578475 - RNA, 64 nt, hsa; identical to SEQ ID NO: 259275

SEQ ID NO: 578476 - RNA, 64 nt, hsa; identical to SEQ ID NO: 259276

SEQ ID NO: 578477 - RNA, 64 nt, hsa; identical to SEQ ID NO: 259277

SEQ ID NO: 578478 - RNA, 64 nt, hsa; identical to SEQ ID NO: 259278

SEQ ID NO: 578479 - RNA, 64 nt, hsa; identical to SEQ ID NO: 259279

SEQ ID NO: 578480 - RNA, 64 nt, hsa; identical to SEQ ID NO: 259280

SEQ ID NO: 578481 - RNA, 64 nt, hsa; identical to SEQ ID NO: 259281

SEQ ID NO: 578482 - RNA, 64 nt, hsa; identical to SEQ ID NO: 259282

SEQ ID NO: 578483 - RNA, 64 nt, hsa; identical to SEQ ID NO: 259283

SEQ ID NO: 578484 - RNA, 64 nt, hsa; identical to SEQ ID NO: 259284

SEQ ID NO: 578485 - RNA, 64 nt, hsa; identical to SEQ ID NO: 259285

SEQ ID NO: 578486 - RNA, 64 nt, hsa; identical to SEQ ID NO: 259286

SEQ ID NO: 578487 - RNA, 64 nt, hsa; identical to SEQ ID NO: 259287

SEQ ID NO: 578488 - RNA, 64 nt, hsa; identical to SEQ ID NO: 259288

SEQ ID NO: 578489 - RNA, 64 nt, hsa; identical to SEQ ID NO: 259289

SEQ ID NO: 578490 - RNA, 64 nt, hsa; identical to SEQ ID NO: 259290

SEQ ID NO: 578491 - RNA, 64 nt, hsa; identical to SEQ ID NO: 259291

SEQ ID NO: 578492 - RNA, 64 nt, hsa; identical to SEQ ID NO: 259292

SEQ ID NO: 578493 - RNA, 64 nt, hsa; identical to SEQ ID NO: 259293

SEQ ID NO: 578494 - RNA, 64 nt, hsa; identical to SEQ ID NO: 259294

SEQ ID NO: 578495 - RNA, 64 nt, hsa; identical to SEQ ID NO: 259295

SEQ ID NO: 578496 - RNA, 64 nt, hsa; identical to SEQ ID NO: 259296

SEQ ID NO: 578497 - RNA, 64 nt, hsa; identical to SEQ ID NO: 259297

SEQ ID NO: 578498 - RNA, 64 nt, hsa; identical to SEQ ID NO: 259298

SEQ ID NO: 578499 - RNA, 64 nt, hsa; identical to SEQ ID NO: 259299

SEQ ID NO: 578500 - RNA, 64 nt, hsa; identical to SEQ ID NO: 259300

SEQ ID NO: 578501 - RNA, 64 nt, hsa; identical to SEQ ID NO: 259301

SEQ ID NO: 578502 - RNA, 64 nt, hsa; identical to SEQ ID NO: 259302

SEQ ID NO: 578503 - RNA, 64 nt, hsa; identical to SEQ ID NO: 259303

SEQ ID NO: 578504 - RNA, 64 nt, hsa; identical to SEQ ID NO: 259304

SEQ ID NO: 578505 - RNA, 64 nt, hsa; identical to SEQ ID NO: 259305

SEQ ID NO: 578506 - RNA, 64 nt, hsa; identical to SEQ ID NO: 259306

SEQ ID NO: 578507 - RNA, 64 nt, hsa; identical to SEQ ID NO: 259307

SEQ ID NO: 578508 - RNA, 64 nt, hsa; identical to SEQ ID NO: 259308

SEQ ID NO: 578509 - RNA, 64 nt, hsa; identical to SEQ ID NO: 259309

SEQ ID NO: 578510 - RNA, 64 nt, hsa; identical to SEQ ID NO: 259310

SEQ ID NO: 578511 - RNA, 64 nt, hsa; identical to SEQ ID NO: 259311

SEQ ID NO: 578512 - RNA, 64 nt, hsa; identical to SEQ ID NO: 259312

SEQ ID NO: 578513 - RNA, 64 nt, hsa; identical to SEQ ID NO: 259313

SEQ ID NO: 578514 - RNA, 64 nt, hsa; identical to SEQ ID NO: 259314

SEQ ID NO: 578515 - RNA, 64 nt, hsa; identical to SEQ ID NO: 259315

SEQ ID NO: 578516 - RNA, 64 nt, hsa; identical to SEQ ID NO: 259316

SEQ ID NO: 578517 - RNA, 64 nt, hsa; identical to SEQ ID NO: 259317

SEQ ID NO: 578518 - RNA, 64 nt, hsa; identical to SEQ ID NO: 259318

SEQ ID NO: 578519 - RNA, 64 nt, hsa; identical to SEQ ID NO: 259319

SEQ ID NO: 578520 - RNA, 64 nt, hsa; identical to SEQ ID NO: 259320

SEQ ID NO: 578521 - RNA, 64 nt, hsa; identical to SEQ ID NO: 259321

SEQ ID NO: 578522 - RNA, 64 nt, hsa; identical to SEQ ID NO: 259322

SEQ ID NO: 578523 - RNA, 64 nt, hsa; identical to SEQ ID NO: 259323

SEQ ID NO: 578524 - RNA, 64 nt, hsa; identical to SEQ ID NO: 259324

SEQ ID NO: 578525 - RNA, 64 nt, hsa; identical to SEQ ID NO: 259325

SEQ ID NO: 578526 - RNA, 64 nt, hsa; identical to SEQ ID NO: 259326

SEQ ID NO: 578527 - RNA, 64 nt, hsa; identical to SEQ ID NO: 259327

SEQ ID NO: 578528 - RNA, 64 nt, hsa; identical to SEQ ID NO: 259328

SEQ ID NO: 578529 - RNA, 64 nt, hsa; identical to SEQ ID NO: 259329

SEQ ID NO: 578530 - RNA, 64 nt, hsa; identical to SEQ ID NO: 259330

SEQ ID NO: 578531 - RNA, 64 nt, hsa; identical to SEQ ID NO: 259331

SEQ ID NO: 578532 - RNA, 64 nt, hsa; identical to SEQ ID NO: 259332

SEQ ID NO: 578533 - RNA, 64 nt, hsa; identical to SEQ ID NO: 259333

SEQ ID NO: 578534 - RNA, 64 nt, hsa; identical to SEQ ID NO: 259334

SEQ ID NO: 578535 - RNA, 64 nt, hsa; identical to SEQ ID NO: 259335

SEQ ID NO: 578536 - RNA, 64 nt, hsa; identical to SEQ ID NO: 259336

SEQ ID NO: 578537 - RNA, 64 nt, hsa; identical to SEQ ID NO: 259337

SEQ ID NO: 578538 - RNA, 64 nt, hsa; identical to SEQ ID NO: 259338

SEQ ID NO: 578539 - RNA, 64 nt, hsa; identical to SEQ ID NO: 259339

SEQ ID NO: 578540 - RNA, 64 nt, hsa; identical to SEQ ID NO: 259340

SEQ ID NO: 578541 - RNA, 64 nt, hsa; identical to SEQ ID NO: 259341

SEQ ID NO: 578542 - RNA, 64 nt, hsa; identical to SEQ ID NO: 259342

SEQ ID NO: 578543 - RNA, 64 nt, hsa; identical to SEQ ID NO: 259343

SEQ ID NO: 578544 - RNA, 64 nt, hsa; identical to SEQ ID NO: 259344

SEQ ID NO: 578545 - RNA, 64 nt, hsa; identical to SEQ ID NO: 259345

SEQ ID NO: 578546 - RNA, 64 nt, hsa; identical to SEQ ID NO: 259346

SEQ ID NO: 578547 - RNA, 64 nt, hsa; identical to SEQ ID NO: 259347

SEQ ID NO: 578548 - RNA, 64 nt, hsa; identical to SEQ ID NO: 259348

SEQ ID NO: 578549 - RNA, 64 nt, hsa; identical to SEQ ID NO: 259349

SEQ ID NO: 578550 - RNA, 64 nt, hsa; identical to SEQ ID NO: 259350

SEQ ID NO: 578551 - RNA, 64 nt, hsa; identical to SEQ ID NO: 259351

SEQ ID NO: 578552 - RNA, 64 nt, hsa; identical to SEQ ID NO: 259352

SEQ ID NO: 578553 - RNA, 64 nt, hsa; identical to SEQ ID NO: 259353

SEQ ID NO: 578554 - RNA, 65 nt, hsa; identical to SEQ ID NO: 270344

SEQ ID NO: 578555 - RNA, 65 nt, hsa; identical to SEQ ID NO: 270345

SEQ ID NO: 578556 - RNA, 65 nt, hsa; identical to SEQ ID NO: 270346

SEQ ID NO: 578557 - RNA, 65 nt, hsa; identical to SEQ ID NO: 270347

SEQ ID NO: 578558 - RNA, 65 nt, hsa; identical to SEQ ID NO: 270348

SEQ ID NO: 578559 - RNA, 65 nt, hsa; identical to SEQ ID NO: 270349

SEQ ID NO: 578560 - RNA, 65 nt, hsa; identical to SEQ ID NO: 270350

SEQ ID NO: 578561 - RNA, 65 nt, hsa; identical to SEQ ID NO: 270351

SEQ ID NO: 578562 - RNA, 65 nt, hsa; identical to SEQ ID NO: 270352

SEQ ID NO: 578563 - RNA, 65 nt, hsa; identical to SEQ ID NO: 270353

SEQ ID NO: 578564 - RNA, 65 nt, hsa; identical to SEQ ID NO: 270354

SEQ ID NO: 578565 - RNA, 65 nt, hsa; identical to SEQ ID NO: 270355

SEQ ID NO: 578566 - RNA, 65 nt, hsa; identical to SEQ ID NO: 270356

SEQ ID NO: 578567 - RNA, 65 nt, hsa; identical to SEQ ID NO: 270357

SEQ ID NO: 578568 - RNA, 64 nt, hsa; identical to SEQ ID NO: 297911

SEQ ID NO: 578569 - RNA, 64 nt, hsa; identical to SEQ ID NO: 297912

SEQ ID NO: 578570 - RNA, 64 nt, hsa; identical to SEQ ID NO: 297913

SEQ ID NO: 578571 - RNA, 64 nt, hsa; identical to SEQ ID NO: 297914

SEQ ID NO: 578572 - RNA, 64 nt, hsa; identical to SEQ ID NO: 297915

SEQ ID NO: 578573 - RNA, 64 nt, hsa; identical to SEQ ID NO: 297916

SEQ ID NO: 578574 - RNA, 64 nt, hsa; identical to SEQ ID NO: 297917

SEQ ID NO: 578575 - RNA, 64 nt, hsa; identical to SEQ ID NO: 297918

SEQ ID NO: 578576 - RNA, 64 nt, hsa; identical to SEQ ID NO: 297919

SEQ ID NO: 578577 - RNA, 64 nt, hsa; identical to SEQ ID NO: 297920

SEQ ID NO: 578578 - RNA, 64 nt, hsa; identical to SEQ ID NO: 297921

SEQ ID NO: 578579 - RNA, 64 nt, hsa; identical to SEQ ID NO: 297922

SEQ ID NO: 578580 - RNA, 64 nt, hsa; identical to SEQ ID NO: 297923

SEQ ID NO: 578581 - RNA, 64 nt, hsa; identical to SEQ ID NO: 297924

SEQ ID NO: 578582 - RNA, 64 nt, hsa; identical to SEQ ID NO: 297925

SEQ ID NO: 578583 - RNA, 64 nt, hsa; identical to SEQ ID NO: 297926

SEQ ID NO: 578584 - RNA, 64 nt, hsa; identical to SEQ ID NO: 297927

SEQ ID NO: 578585 - RNA, 64 nt, hsa; identical to SEQ ID NO: 297928

SEQ ID NO: 578586 - RNA, 64 nt, hsa; identical to SEQ ID NO: 297929

SEQ ID NO: 578587 - RNA, 64 nt, hsa; identical to SEQ ID NO: 297930

SEQ ID NO: 578588 - RNA, 64 nt, hsa; identical to SEQ ID NO: 297931

SEQ ID NO: 578589 - RNA, 64 nt, hsa; identical to SEQ ID NO: 297932

SEQ ID NO: 578590 - RNA, 64 nt, hsa; identical to SEQ ID NO: 297933

SEQ ID NO: 578591 - RNA, 64 nt, hsa; identical to SEQ ID NO: 297934

SEQ ID NO: 578592 - RNA, 64 nt, hsa; identical to SEQ ID NO: 297935

SEQ ID NO: 578593 - RNA, 64 nt, hsa; identical to SEQ ID NO: 297936

SEQ ID NO: 578594 - RNA, 64 nt, hsa; identical to SEQ ID NO: 297937

SEQ ID NO: 578595 - RNA, 64 nt, hsa; identical to SEQ ID NO: 297938

SEQ ID NO: 578596 - RNA, 64 nt, hsa; identical to SEQ ID NO: 297939

SEQ ID NO: 578597 - RNA, 64 nt, hsa; identical to SEQ ID NO: 297940

SEQ ID NO: 578598 - RNA, 64 nt, hsa; identical to SEQ ID NO: 297941

SEQ ID NO: 578599 - RNA, 64 nt, hsa; identical to SEQ ID NO: 297942

SEQ ID NO: 578600 - RNA, 64 nt, hsa; identical to SEQ ID NO: 297943

SEQ ID NO: 578601 - RNA, 64 nt, hsa; identical to SEQ ID NO: 297944

SEQ ID NO: 578602 - RNA, 64 nt, hsa
cgccagcugucucagccaccaccugugcggcgcuugcuccgaggggucagcaagagcaacugau

SEQ ID NO: 578603 - RNA, 64 nt, hsa
gcccagcuugaccuccccuugguucccaggguccugcuccgaagcagucaucucugccugagau

SEQ ID NO: 578604 - RNA, 64 nt, hsa
ucggcuggagcccugaaacccgacguggaccuucugcuccgagaaaugcagcugcucaaaggcc

SEQ ID NO: 578605 - RNA, 64 nt, hsa
gagcagcagcacaacuaggaaaccccaaagcccaugcuccgacagguggcccuucacagggggc

SEQ ID NO: 578606 - RNA, 64 nt, hsa
gccuaccucccgacauucacgcuucgccccacgcugcuccgacuggcugcagcggacacugccc

SEQ ID NO: 578607 - RNA, 64 nt, hsa
aauugaacucucagucacguggaagccacgggacugcuccgaagccgccauaauaaaaucugau

SEQ ID NO: 578608 - RNA, 64 nt, hsa
ccuuccccaagccacacauccuccucccaucccuugcuccgaucccagccccugagcagggaga

SEQ ID NO: 578609 - RNA, 64 nt, hsa
auauacaugcgccgggagcuucuugcaggaauacugcuccgaaucacuuuuaauuuuuuucuuu

SEQ ID NO: 578610 - RNA, 64 nt, hsa
uauaacucauguauuugaagacuguuucaugcuuugcuccgaacaaauaguaaauaacugagua

SEQ ID NO: 578611 - RNA, 64 nt, hsa
agcaccuuccugaaggacgcgccaggggaguuccugcuccgagucuucucuaccgggcgagucu

SEQ ID NO: 578612 - RNA, 64 nt, hsa
cccccuggcagggccagcuaggccugugguucccugcuccgacucucagggcugccucccugag

SEQ ID NO: 578613 - RNA, 64 nt, hsa
uggaaggguggauaugggagacacauucucuaccugcuccgagccugguccucucgcaggaaug

SEQ ID NO: 578614 - RNA, 64 nt, hsa
ucuggucuuuuccuguugugcaaaaaugacucauugcuccgaaugucaaaaacaaaugcgacaa

SEQ ID NO: 578615 - RNA, 64 nt, hsa
cugguuuaccaguaagguguauuguucaguuuuuugcuccgauuugaauuguggagguggaagc

SEQ ID NO: 578616 - RNA, 64 nt, hsa
aucccagaucugucugacucugggucagugacccugcuccgauuccauacuguuuucugucauu

SEQ ID NO: 578617 - RNA, 64 nt, hsa
uauuugaauggaaagacacccaaaaaaaaaaaugugcuccgacuagggggaaaacaguaguucc

SEQ ID NO: 578618 - RNA, 64 nt, hsa
ggaccuuccaauccauuugccccgcaacccuggcugcuccgacaggggagacuugucucccuug

SEQ ID NO: 578619 - RNA, 64 nt, hsa
gcaguccugagggagaagacaggauucagggcagugcuccgaagcugugugcucaccugguugg

SEQ ID NO: 578620 - RNA, 64 nt, hsa
ggaggggcgggcaccagcgccacuuaugugccucugcuccgagggccagugggcugcagggccu

SEQ ID NO: 578621 - RNA, 64 nt, hsa
auuccugggaagucuucuguggguccaaacauguugcuccgaucaucacaggagagcaaaaggc

SEQ ID NO: 578622 - RNA, 64 nt, hsa
cugccuuucccagcuucggagacgcaggcucagcugcuccgaagcaccugccagcaccgcacag

SEQ ID NO: 578623 - RNA, 64 nt, hsa
ggccugaggacccggcgcugaguggcggggccccugcuccgaggggcucauguucaggcagaac

SEQ ID NO: 578624 - RNA, 64 nt, hsa
gcgcucggcccucaagugcccgggccggccuucgugcuccgaaacaagagaccugggagcccuc

SEQ ID NO: 578625 - RNA, 64 nt, hsa
acucaggaggggagcccugugauuguccagcucaugcuccgaggagggucccagcugcagugug

SEQ ID NO: 578626 - RNA, 64 nt, hsa
cuaggguguuguguagaacucuuuuuaaacucuaugcuccgaguagaguucaucuuuauauuaa

SEQ ID NO: 578627 - RNA, 64 nt, hsa
acaaaagggccaggugcggccuggggggaacggaugcuccgaggacuggacuguuuuuuucaca

SEQ ID NO: 578628 - RNA, 64 nt, hsa
ccccacugguaggaugguccucuuguacuucgugugcuccgacccauggugacgaugacacacc

SEQ ID NO: 578629 - RNA, 64 nt, hsa
ggaugcaaccugcuuucaccagacugcagaccccugcuccgaggacucuuaguuuuucaaaacc

SEQ ID NO: 578630 - RNA, 64 nt, hsa
ccacugcaacgaagacacuccuucuguccccaccugcuccgaagacaaaccaaccuccguuucu

SEQ ID NO: 578631 - RNA, 64 nt, hsa
ucagcaugaggacagaccacagagcugucacuuuugcuccgaagcuacuucuccacugucccgu

SEQ ID NO: 578632 - RNA, 64 nt, hsa
cucugauuguccuucagcagggaugagucuguuuugcuccgauggaagcaucuguaguguccau

SEQ ID NO: 578633 - RNA, 64 nt, hsa
gggccacgaagccccucggguccuccccguccccugcuccgaugcauaccucagugcagaacca

SEQ ID NO: 578634 - RNA, 64 nt, hsa
aaacaccuccuuuccgguggccuuggaaacagauugcuccgagcuggagaaugucgggugaggu

SEQ ID NO: 578635 - RNA, 64 nt, hsa
guggggcgcgugggcacggagcuuccugccucucugcuccgacacccggcaagcagccggagac

SEQ ID NO: 578636 - RNA, 64 nt, hsa
uucuuauuagacagagcucauaguauuuguuuucugcuccgaacacuuaaaaaauacuaagacg

SEQ ID NO: 578637 - RNA, 64 nt, hsa
caccauccuccucuucuuucuccuucaucgcuggugcuccgacaaaaaaaguaagucucacgaa

SEQ ID NO: 578638 - RNA, 64 nt, hsa
gacacaagcuguuucucggaagacccuggacaccugcuccgaagccaagcacgggauggggcuu

SEQ ID NO: 578639 - RNA, 64 nt, hsa
uguggguuuugaagacccucgacugccuccccgaugcuccgaagccugaucuuccagggugggg

SEQ ID NO: 578640 - RNA, 64 nt, hsa
cuauuugauccauggauaaccgguaaugggaaaaugcuccgacccucaaugcaguaaauauuua

SEQ ID NO: 578641 - RNA, 64 nt, hsa
cucccgagggcugcuuggacccuggugggcugagugcuccgaggagggguggacuccaccuugg

SEQ ID NO: 578642 - RNA, 64 nt, hsa
ccccgccuccacuucauccugcccggaaugccagugcuccgagcucagacagaggaagcccugc

SEQ ID NO: 578643 - RNA, 64 nt, hsa
ccccgcaaugcgaggguccugugucccacuucacugcuccgaagggaacuggcuggcuguccgu

SEQ ID NO: 578644 - RNA, 64 nt, hsa
ucguggacugagugggaagcccauccugaccagcugcuccgaggacccaggaaaggcaggauug

SEQ ID NO: 578645 - RNA, 64 nt, hsa
gcgcccuggaacaacccugccccugcacccagcaugcuccgacacagcagggaagcuccuccug

SEQ ID NO: 578646 - RNA, 64 nt, hsa
accuaugugcauaauuaaaaccagcuucauuuguugcuccgagaguguuucuccaagguuuucu

SEQ ID NO: 578647 - RNA, 64 nt, hsa
cucucucugggaccacuggguacaagagaugggaugcuccgacagcgucuccaauuaugaaacu

SEQ ID NO: 578648 - RNA, 64 nt, hsa
aaaucauuuacaacccuaaggcaucagaggaugcugcuccgaacuguuggaaacaaggacauua

SEQ ID NO: 578649 - RNA, 64 nt, hsa
ccuacugccaaacguccucaguguugucugcaccugcuccgacuccuucagccgccccauucag

SEQ ID NO: 578650 - RNA, 64 nt, hsa
ccuggccccgggcaaccagccagagaaggagggccgggcgcaccagugccuggagugugaccgc

SEQ ID NO: 578651 - RNA, 64 nt, hsa
cacgcagaagagcaacaugaagcugcacaugaagcgggcgcacagcuaugcuggugagaaugcu

SEQ ID NO: 578652 - RNA, 64 nt, hsa
guggagaugcugcagauccugcugccgcacuucagcgacgcacgagaggucgugcgcuccuccu

SEQ ID NO: 578653 - RNA, 64 nt, hsa
ggcgcugcagccagaggccgcacgcugcacugucgcgacgcagagaggcuucugugcaggcugg

SEQ ID NO: 578654 - RNA, 64 nt, hsa
cacgcagggccuugcaccaucaagggugacaccugcgacgcaaguaccaggaggacauaaccgc

SEQ ID NO: 578655 - RNA, 64 nt, hsa
augagcguccggucuugcccacagggccugugcugcgacgcacauacauacguguugugucugu

SEQ ID NO: 578656 - RNA, 64 nt, hsa
ccuuaaugcuaaagccaaaugcagcuucugcugugcgacgcacuccuggccaucuugccguguc

SEQ ID NO: 578657 - RNA, 64 nt, hsa
acccagacuuaacaggcaagguccugggcauugcgcgacgcaggacucaaugcuaaagcaagcc

SEQ ID NO: 578658 - RNA, 64 nt, hsa
aaacuuucugguccgagaacgagccgaacacagcgcgacgcagggacuaggacggcccggugac

SEQ ID NO: 578659 - RNA, 55 nt, hsa
gcaagucgcugagccauugaggaucgcgacgcagucggcgggacccucauggaag

SEQ ID NO: 578660 - RNA, 64 nt, hsa
ccuuggaggggacaagguugacugcuuaggaggcgcgacgcacagggcugccaggccuggcccc

SEQ ID NO: 578661 - RNA, 64 nt, hsa
ggaaacgccggaacccugacccagucgcucgacugcgacgcagguguaccucccccugccuucc

SEQ ID NO: 578662 - RNA, 64 nt, hsa
acuuuaaggugacaguauugauggcaggauuucagcgacgcacucugcuucaucauuugucagg

SEQ ID NO: 578663 - RNA, 64 nt, hsa
cgaccccuacaagccuaagugccccgagagcgacgcgacgcagcagaggccggccuucccugag

SEQ ID NO: 578664 - RNA, 64 nt, hsa
ugcuggcgccccggcccucgcggagguguccgaggcgacgcaccucgaggguguccgccggccc

SEQ ID NO: 578665 - RNA, 64 nt, hsa
gccugggagcggggcggggccgccgcgcaagggggcgacgcauaaaggccugcuggcuuggggc

SEQ ID NO: 578666 - RNA, 64 nt, hsa
uuccgggcugcucucuucccugagcccggaaccggcgacgcacaugugucuuuuguuggugugu

SEQ ID NO: 578667 - RNA, 64 nt, hsa
ccaucucuguccccuccacccucacuccauccaccucggagaccacccucccccagccagauac

SEQ ID NO: 578668 - RNA, 64 nt, hsa
gcgggucucccggugcccgaaccgccgcuggggccucggagacuuggaggaggacgcucuggaa

SEQ ID NO: 578669 - RNA, 64 nt, hsa
caggagguggccgacugcugcuagcggccugccgccacgucagcagcccagggcacagcgcucg

SEQ ID NO: 578670 - RNA, 64 nt, hsa
aggcugaggccugcacugcagaugauccugcggaccacgucaaggucccggcacacgcugcugu

SEQ ID NO: 578671 - RNA, 64 nt, hsa; identical to SEQ ID NO: 126132

SEQ ID NO: 578672 - RNA, 64 nt, hsa; identical to SEQ ID NO: 126133

SEQ ID NO: 578673 - RNA, 64 nt, hsa; identical to SEQ ID NO: 126134

SEQ ID NO: 578674 - RNA, 64 nt, hsa; identical to SEQ ID NO: 126135

SEQ ID NO: 578675 - RNA, 64 nt, hsa; identical to SEQ ID NO: 126136

SEQ ID NO: 578676 - RNA, 64 nt, hsa; identical to SEQ ID NO: 126137

SEQ ID NO: 578677 - RNA, 64 nt, hsa; identical to SEQ ID NO: 126138

SEQ ID NO: 578678 - RNA, 64 nt, hsa; identical to SEQ ID NO: 126139

SEQ ID NO: 578679 - RNA, 64 nt, hsa; identical to SEQ ID NO: 126140

SEQ ID NO: 578680 - RNA, 64 nt, hsa; identical to SEQ ID NO: 126141

SEQ ID NO: 578681 - RNA, 64 nt, hsa; identical to SEQ ID NO: 126142

SEQ ID NO: 578682 - RNA, 64 nt, hsa; identical to SEQ ID NO: 126143

SEQ ID NO: 578683 - RNA, 64 nt, hsa; identical to SEQ ID NO: 126144

SEQ ID NO: 578684 - RNA, 64 nt, hsa; identical to SEQ ID NO: 126145

SEQ ID NO: 578685 - RNA, 64 nt, hsa; identical to SEQ ID NO: 126146

SEQ ID NO: 578686 - RNA, 64 nt, hsa; identical to SEQ ID NO: 126147

SEQ ID NO: 578687 - RNA, 64 nt, hsa; identical to SEQ ID NO: 126148

SEQ ID NO: 578688 - RNA, 64 nt, hsa; identical to SEQ ID NO: 126149

SEQ ID NO: 578689 - RNA, 64 nt, hsa; identical to SEQ ID NO: 126150

SEQ ID NO: 578690 - RNA, 64 nt, hsa; identical to SEQ ID NO: 126151

SEQ ID NO: 578691 - RNA, 64 nt, hsa; identical to SEQ ID NO: 126152

SEQ ID NO: 578692 - RNA, 64 nt, hsa; identical to SEQ ID NO: 126153

SEQ ID NO: 578693 - RNA, 64 nt, hsa; identical to SEQ ID NO: 259970

SEQ ID NO: 578694 - RNA, 64 nt, hsa; identical to SEQ ID NO: 259971

SEQ ID NO: 578695 - RNA, 64 nt, hsa; identical to SEQ ID NO: 259972

SEQ ID NO: 578696 - RNA, 64 nt, hsa; identical to SEQ ID NO: 259973

SEQ ID NO: 578697 - RNA, 64 nt, hsa; identical to SEQ ID NO: 259974

SEQ ID NO: 578698 - RNA, 64 nt, hsa; identical to SEQ ID NO: 259975

SEQ ID NO: 578699 - RNA, 64 nt, hsa; identical to SEQ ID NO: 259976

SEQ ID NO: 578700 - RNA, 64 nt, hsa; identical to SEQ ID NO: 259977

SEQ ID NO: 578701 - RNA, 64 nt, hsa; identical to SEQ ID NO: 259978

SEQ ID NO: 578702 - RNA, 64 nt, hsa; identical to SEQ ID NO: 259979

SEQ ID NO: 578703 - RNA, 64 nt, hsa; identical to SEQ ID NO: 259980

SEQ ID NO: 578704 - RNA, 64 nt, hsa; identical to SEQ ID NO: 259981

SEQ ID NO: 578705 - RNA, 64 nt, hsa; identical to SEQ ID NO: 259982

SEQ ID NO: 578706 - RNA, 64 nt, hsa; identical to SEQ ID NO: 259983

SEQ ID NO: 578707 - RNA, 64 nt, hsa; identical to SEQ ID NO: 259984

SEQ ID NO: 578708 - RNA, 64 nt, hsa; identical to SEQ ID NO: 259985

SEQ ID NO: 578709 - RNA, 64 nt, hsa; identical to SEQ ID NO: 259986

SEQ ID NO: 578710 - RNA, 64 nt, hsa; identical to SEQ ID NO: 259987

SEQ ID NO: 578711 - RNA, 64 nt, hsa; identical to SEQ ID NO: 259988

SEQ ID NO: 578712 - RNA, 64 nt, hsa; identical to SEQ ID NO: 259989

SEQ ID NO: 578713 - RNA, 64 nt, hsa; identical to SEQ ID NO: 259990

SEQ ID NO: 578714 - RNA, 64 nt, hsa; identical to SEQ ID NO: 259991

SEQ ID NO: 578715 - RNA, 64 nt, hsa; identical to SEQ ID NO: 259992

SEQ ID NO: 578716 - RNA, 64 nt, hsa; identical to SEQ ID NO: 259993

SEQ ID NO: 578717 - RNA, 64 nt, hsa; identical to SEQ ID NO: 259994

SEQ ID NO: 578718 - RNA, 64 nt, hsa; identical to SEQ ID NO: 259995

SEQ ID NO: 578719 - RNA, 64 nt, hsa; identical to SEQ ID NO: 259996

SEQ ID NO: 578720 - RNA, 64 nt, hsa; identical to SEQ ID NO: 259997

SEQ ID NO: 578721 - RNA, 64 nt, hsa; identical to SEQ ID NO: 259998

SEQ ID NO: 578722 - RNA, 64 nt, hsa
aaaauggcuaaagaaauuauauuuuguucuauugcuaggguaaaauaaauacauuuguguccaa

SEQ ID NO: 578723 - RNA, 64 nt, hsa
cagcuaauuauugugguguacuauauuugugagccuaggguaggggcacugcugcaacuucugc

SEQ ID NO: 578724 - RNA, 64 nt, hsa
ccucccacccuaggagggagggaaggacaccguccuaggguauaaccuggcaauaaaccgugcc

SEQ ID NO: 578725 - RNA, 64 nt, hsa
ggccagaaacaccugacuuaccucugaguuuagacuaggguaucacuucuuugagucugaaguc

SEQ ID NO: 578726 - RNA, 64 nt, hsa
cucuuaaaauugagacggggucucacucugucaccuaggguagagugcaguggugccaccauag

SEQ ID NO: 578727 - RNA, 64 nt, hsa
aggugaugucuucucucugcucagagagcagggacuaggguaggacccucaccgcugcguccag

SEQ ID NO: 578728 - RNA, 64 nt, hsa
gggcagcagaucaggagcccacugauaaggggcccuaggguacagggugcugcccagcaggucg

SEQ ID NO: 578729 - RNA, 64 nt, hsa
uagcgcucaauaggaccaggauccagccucacuucuaggguaugggaaauccaaucagagacca

SEQ ID NO: 578730 - RNA, 64 nt, hsa
uugcagggguguuuuuaaaucuuggguauaaauucuaggguaaauuccaguuuauccagacuag

SEQ ID NO: 578731 - RNA, 64 nt, hsa
cacgggacuaguuagcuuuaagcacccuagaggacuaggguaaucugacuucucacuuccuaag

SEQ ID NO: 578732 - RNA, 64 nt, hsa
ggagauaauuguuuuaugggauuugggugugggacuaggguacaaugaaggccaagagcaucuc

SEQ ID NO: 578733 - RNA, 64 nt, hsa
ucucuugucuguggucuguuuaauaugugggucacuaggguauuuauucuuucucccauccuua

SEQ ID NO: 578734 - RNA, 64 nt, hsa
uaaggggugcauuuguagggugugacauuuuacccuaggguauaaaacuauuuuucuuuuauua

SEQ ID NO: 578735 - RNA, 64 nt, hsa
uguagcauucaaggcuugaggcuggaggagguagcuaggguauaguggcuggugaggcugcaca

SEQ ID NO: 578736 - RNA, 64 nt, hsa
ugcagcucuuuaagaaguuuuuuuuuuuuagcuucuaggguaaagauaaauucagaaaugcucu

SEQ ID NO: 578737 - RNA, 64 nt, hsa
caggcauucacagauaaacucauucucuguacuucuaggguagcaucuuuauguaucuauuaug

SEQ ID NO: 578738 - RNA, 64 nt, hsa
uugcagaauguggagggauguaaaauggacaguacuaggguagaggggaagucagauuagagga

SEQ ID NO: 578739 - RNA, 64 nt, hsa
ucccucugucagggucaguaaggaaaacgguggccuaggguacaggcaacaaugagcagaccaa

SEQ ID NO: 578740 - RNA, 64 nt, hsa
aguaaguucucaauuauuggccugcuaauagcugcuaggguaggaaagcgugguuccaagaaag

SEQ ID NO: 578741 - RNA, 64 nt, hsa
uggcagaauucaugcagggcuaucaagugguguucuaggguaacaguguccauaauuaacgcuu

SEQ ID NO: 578742 - RNA, 64 nt, hsa
cccauaccucccuggcuccucaggauucagguuccuaggguacguccuugauuaaaucacccca

SEQ ID NO: 578743 - RNA, 64 nt, hsa
gaaugaacacuuuggauuuuguuguaguuugauucuaggguagaaccaguccaugcuguuuuua

SEQ ID NO: 578744 - RNA, 64 nt, hsa
uuaguuuccucaacuagccuggaaaguuaggagucuaggguaauuacccccaaugagucuagcc

SEQ ID NO: 578745 - RNA, 64 nt, hsa
uuaauauuuuauucucauuuaauauaaaccucaucuaggguauauacaaauuaaaacugagaca

SEQ ID NO: 578746 - RNA, 64 nt, hsa
uuuacacauacauacacacacaaauacacaaucucuaggguaagccagaaggcaagaucagauu

SEQ ID NO: 578747 - RNA, 64 nt, hsa
aucuguucuuccucuacguuuauccuggcaugugcuaggguaaacgaaggcauaauaagccaug

SEQ ID NO: 578748 - RNA, 64 nt, hsa
cauuuuuaaguuguguugucaguaggugcggugucuaggguagugaauccuguaaguucaaauu

SEQ ID NO: 578749 - RNA, 64 nt, hsa
cuaauaaaaauguaccaaaucccugggguaaaagcuaggguaagguaaaggauagacucacauu

SEQ ID NO: 578750 - RNA, 64 nt, hsa
uuuauuuugucucugagauuuuguauuccacauucuaggguauucuguaauuuggcuccuuacc

SEQ ID NO: 578751 - RNA, 64 nt, hsa
gaugggcuguguagcaacucucccagggaacacacuaggguacuuagggaggugcuuuguggag

SEQ ID NO: 578752 - RNA, 64 nt, hsa
gagucaugcuguggaacuuauucuaggcugaauccuaggguaagguggaucaacugaacuguca

SEQ ID NO: 578753 - RNA, 64 nt, hsa
caucagaaaagcaggcccuagagagaaguauauacuaggguacuuuagagcaacuuaaugaggg

SEQ ID NO: 578754 - RNA, 64 nt, hsa
uuuuaaaagucaauugguaucaccuccacacugacuaggguaguggggugcauuugguuuucaa

SEQ ID NO: 578755 - RNA, 64 nt, hsa
ccguucucaagggagucagaucaggggaacuauucuaggguauguugcgggguauuaagcagga

SEQ ID NO: 578756 - RNA, 64 nt, hsa
gugucgccaguugguacuuucuguuuggguaguccuaggguaacacccugcccuaaacuccaug

SEQ ID NO: 578757 - RNA, 64 nt, hsa
acuuuugugucacaauuuauuuuuaucacccucucuaggguaacguguauauuuugguggagau

SEQ ID NO: 578758 - RNA, 64 nt, hsa
uuuuccagcacuuugcaaggaauguuuuguagcucuaggguauauauccgccuggcauuucaca

SEQ ID NO: 578759 - RNA, 64 nt, hsa
gggcuauagaucucaaauagagaccuguugguugcuaggguaguccagacaccccuuagauguc

SEQ ID NO: 578760 - RNA, 64 nt, hsa
uuaaagugacuuuuaaaggccacaucaccugagacuaggguaaucaucuuuacuucugguuccu

SEQ ID NO: 578761 - RNA, 64 nt, hsa
agauggaaauucuuuuuugggccuuggacugcuucuaggguagcauuuuguaggucacucuucu

SEQ ID NO: 578762 - RNA, 64 nt, hsa
gagaaccucuaaugauacugacaacauaaauuaccuaggguaaaggauagcugcaacaaugaaa

SEQ ID NO: 578763 - RNA, 64 nt, hsa
ugugaucauuuauugaucgugauaugacuuguuacuaggguacugaaaaaaaugucuaaggccu

SEQ ID NO: 578764 - RNA, 64 nt, hsa
auaaagugagaguaauguaauggagcucuuuucacuaggguauaaguagcugccaauuuguaau

SEQ ID NO: 578765 - RNA, 64 nt, hsa
ucaagggaaguaccuaagaagauauagaguguuucuaggguaagggaccugcagguguaagcau

SEQ ID NO: 578766 - RNA, 64 nt, hsa
ugcuauuauucauaagaacugugauuccagcaaacuaggguaauuggugccuuuuuacaguuuu

SEQ ID NO: 578767 - RNA, 64 nt, hsa
uuggggaaacuccuccucuuaggaaaggcuaauacuaggguauccuugggcccaaugaauuagg

SEQ ID NO: 578768 - RNA, 64 nt, hsa
ggaguaagacaaaaauuguuuugacauagguucccuaggguacacuugcucuagcauacuuuaa

SEQ ID NO: 578769 - RNA, 64 nt, hsa
cugcuuauauuguuaauugcacuaaugaacucuucuaggguaaauucuggcaaacuacccuuuu

SEQ ID NO: 578770 - RNA, 64 nt, hsa
cauggauaugacaaccaaacuggaaaucagaacacuaggguaaaguggauauugaaaugaagca

SEQ ID NO: 578771 - RNA, 64 nt, hsa
gacauugccagaaacuuaccauuaacuugcacuacuaggguagggaggacuuagggauguuucc

SEQ ID NO: 578772 - RNA, 64 nt, hsa
uccuaccuguggcucaugccaugccaugaagugccuaggguacauaugugaacauuccagccuu

SEQ ID NO: 578773 - RNA, 64 nt, hsa
uuucccuguauagccugcugggagagacccacuucuaggguaugggggaugcagcuucaagccc

SEQ ID NO: 578774 - RNA, 64 nt, hsa
aagauuagaaggaacaguggugcugacacaggaccuaggguagggccuguucccaccacccuag

SEQ ID NO: 578775 - RNA, 64 nt, hsa
ggccccaggggaacacuggggacuuggccucucucuaggguacauggugcugggagaggcagcc

SEQ ID NO: 578776 - RNA, 64 nt, hsa
ugagauaucauguuuuagcauuccauuuuacugacuaggguagaagaacacuuuucuuggcuac

SEQ ID NO: 578777 - RNA, 64 nt, hsa
guccugacuucaccuuuuugauuuggugugugcccuaggguauguacccuuccccaucugagcc

SEQ ID NO: 578778 - RNA, 64 nt, hsa
ccugucuuggguuggcuggcacuggggcgggcaucuaggguacagccucugcucauggcacugg

SEQ ID NO: 578779 - RNA, 64 nt, hsa
cugggguagcuccugccugcucucccugcguugccuaggguaaagccuccagauuugccauacu

SEQ ID NO: 578780 - RNA, 64 nt, hsa
ccuuucaggcauuucagcagcauacauugacaaucuaggguauauauguauguauguuucuuau

SEQ ID NO: 578781 - RNA, 64 nt, hsa
ggaaaggcuuaaugauggaauguuagcaucuucacuaggguaaagaagaacaaaaagaauguug

SEQ ID NO: 578782 - RNA, 64 nt, hsa
aauguaaacaguaguaguagcugccaccacaucucuaggguagccaugcagaggagggcuucau

SEQ ID NO: 578783 - RNA, 64 nt, hsa
gccuguuguuuucgcugugacuugggucucagugcuaggguauugagucaggcagcuggagggu

SEQ ID NO: 578784 - RNA, 64 nt, hsa
ucuuuuuguucauuggcaagaugaaauaauuuuucuaggguaaugccguaggaaaaauaaaacu

SEQ ID NO: 578785 - RNA, 64 nt, hsa
uuauacuguuggauacuuauaaucaaaacuuuuacuaggguauugaauaaaucuagucuuacua

SEQ ID NO: 578786 - RNA, 64 nt, hsa
guuuuucuaaaggggggcgcugucuagcacuuaacuaggguaagcauucuuaacauguauuucc

SEQ ID NO: 578787 - RNA, 64 nt, hsa
auguguggugcccagaauaaaauauaccucaugccuaggguagggacauccuuuccagcucaaa

SEQ ID NO: 578788 - RNA, 64 nt, hsa
uaaugucgaaacuaggccuuugaaccaaggcagucuaggguaaaauauaguuucaaaguaugaa

SEQ ID NO: 578789 - RNA, 64 nt, hsa
accacuagugccucuggauuuagagauauauauccuaggguaugauacuacugugacgggucua

SEQ ID NO: 578790 - RNA, 64 nt, hsa
uuacagacaggucccaccaaacccaaacaccugccuaggguaaaugggucucucuucuaucccc

SEQ ID NO: 578791 - RNA, 64 nt, hsa
ucuguuuucugccuguauuucccagugauuuacucuaggguaagguaguacacauuugguucag

SEQ ID NO: 578792 - RNA, 64 nt, hsa
gguagcuguaacccuuaaaaaugaaacgucaacucuaggguacauuugacauugaaagaauagu

SEQ ID NO: 578793 - RNA, 64 nt, hsa
uggaaauuuugcaaaauguuaugugaaacaacuucuaggguaaaaacagcuauuacuaaucucu

SEQ ID NO: 578794 - RNA, 64 nt, hsa
guggacuuuuaauguaucuugugaaguaugguuacuaggguagguucaagagcuacaugccucu

SEQ ID NO: 578795 - RNA, 64 nt, hsa
uccgaguagugucugagacucugcucugcagggccuaggguagcgcugggaguguagaaguggc

SEQ ID NO: 578796 - RNA, 64 nt, hsa
aaagccuuuggguuuauuuugggauaguuaggagcuaggguagaauauaauuuuuuuccaaaaa

SEQ ID NO: 578797 - RNA, 64 nt, hsa
ucccacgggacucagaagugcgccgccaugcugccuaggguacuguccccacaucugucccaac

SEQ ID NO: 578798 - RNA, 64 nt, hsa
cagcuuguggcuuuuuauuagagcucgccacgaacuaggguaaggugagugucuuagcauauuu

SEQ ID NO: 578799 - RNA, 64 nt, hsa
agccgcaccuagcuggccaacgucagggucggggcuaggguaggggcaaggaaacucgaauaaa

SEQ ID NO: 578800 - RNA, 64 nt, hsa
ucugcuucugucaagaggguugucauuaauacaucuaggguacccucccaugucaugaaguuac

SEQ ID NO: 578801 - RNA, 64 nt, hsa
uaggaagcuggcugcuuaaugagcuggcuuuacucuaggguaaguggcuguggacuuuucugca

SEQ ID NO: 578802 - RNA, 64 nt, hsa
caaaccugaggaaggcagaagugaauuuggagaacuaggguagagagagguugcuauaaaacga

SEQ ID NO: 578803 - RNA, 64 nt, hsa
aguuacuuccuggcugggacggcaccuauagaaacuaggguacaaaucucccaaagaugguuug

SEQ ID NO: 578804 - RNA, 64 nt, hsa
gucccugccccuucuuccugcucccccuccuagccuaggguagacuuugaacuguguguguuga

SEQ ID NO: 578805 - RNA, 64 nt, hsa
uauacagauauauauauaugacgcgucacagaaucuaggguagcgcuuucucagauuucccucc

SEQ ID NO: 578806 - RNA, 64 nt, hsa
acaaguauuugcuaaacacuaacuuaagcuaaugcuaggguagugacugagauguaaaaauaga

SEQ ID NO: 578807 - RNA, 64 nt, hsa
cugugugcugcgggaggcagacugcacagcuguccuaggguaacucacucugcagcccuugaac

SEQ ID NO: 578808 - RNA, 64 nt, hsa
gacccuggccuaggggucuuagccacuccccacccuaggguauaguucagggguauccaauccu

SEQ ID NO: 578809 - RNA, 64 nt, hsa
ggagacugagccggcaguggcuugcuuggaggggcuaggguacccgccuggucucggcuggcuc

SEQ ID NO: 578810 - RNA, 64 nt, hsa
ccauucuccuaaggacuuucccuucaccauuuuucuaggguauagugccacugacuuacauagc

SEQ ID NO: 578811 - RNA, 64 nt, hsa
gggcaaaccaggcugcaggugggguuuucacuuccuaggguaguuuaauuuuaaaauaggccaa

SEQ ID NO: 578812 - RNA, 64 nt, hsa
caguagcugcacaguuuuaagauuaugccaucaccuaggguaauguuuuguagaaucaguccuu

SEQ ID NO: 578813 - RNA, 64 nt, hsa
ggaaucuugaaugcuuauaaagguuaccacaugacuaggguacagccagauuuggaaaccauag

SEQ ID NO: 578814 - RNA, 64 nt, hsa
uuaucuacaguacugugagacagucaauuauugccuaggguaguucaaaaauaugaugugagcu

SEQ ID NO: 578815 - RNA, 64 nt, hsa; identical to SEQ ID NO: 84602

SEQ ID NO: 578816 - RNA, 64 nt, hsa; identical to SEQ ID NO: 84603

SEQ ID NO: 578817 - RNA, 64 nt, hsa; identical to SEQ ID NO: 84604

SEQ ID NO: 578818 - RNA, 64 nt, hsa; identical to SEQ ID NO: 84605

SEQ ID NO: 578819 - RNA, 64 nt, hsa; identical to SEQ ID NO: 84606

SEQ ID NO: 578820 - RNA, 64 nt, hsa; identical to SEQ ID NO: 84607

SEQ ID NO: 578821 - RNA, 64 nt, hsa; identical to SEQ ID NO: 84608

SEQ ID NO: 578822 - RNA, 64 nt, hsa; identical to SEQ ID NO: 84609

SEQ ID NO: 578823 - RNA, 64 nt, hsa; identical to SEQ ID NO: 84610

SEQ ID NO: 578824 - RNA, 64 nt, hsa; identical to SEQ ID NO: 84611

SEQ ID NO: 578825 - RNA, 64 nt, hsa; identical to SEQ ID NO: 84612

SEQ ID NO: 578826 - RNA, 64 nt, hsa; identical to SEQ ID NO: 84613

SEQ ID NO: 578827 - RNA, 64 nt, hsa; identical to SEQ ID NO: 84614

SEQ ID NO: 578828 - RNA, 64 nt, hsa; identical to SEQ ID NO: 84615

SEQ ID NO: 578829 - RNA, 64 nt, hsa; identical to SEQ ID NO: 84616

SEQ ID NO: 578830 - RNA, 64 nt, hsa; identical to SEQ ID NO: 84617

SEQ ID NO: 578831 - RNA, 64 nt, hsa; identical to SEQ ID NO: 84618

SEQ ID NO: 578832 - RNA, 64 nt, hsa; identical to SEQ ID NO: 84619

SEQ ID NO: 578833 - RNA, 64 nt, hsa; identical to SEQ ID NO: 84620

SEQ ID NO: 578834 - RNA, 64 nt, hsa; identical to SEQ ID NO: 84621

SEQ ID NO: 578835 - RNA, 64 nt, hsa; identical to SEQ ID NO: 84622

SEQ ID NO: 578836 - RNA, 64 nt, hsa; identical to SEQ ID NO: 84623

SEQ ID NO: 578837 - RNA, 64 nt, hsa; identical to SEQ ID NO: 84624

SEQ ID NO: 578838 - RNA, 64 nt, hsa; identical to SEQ ID NO: 84625

SEQ ID NO: 578839 - RNA, 64 nt, hsa; identical to SEQ ID NO: 84626

SEQ ID NO: 578840 - RNA, 64 nt, hsa; identical to SEQ ID NO: 84627

SEQ ID NO: 578841 - RNA, 64 nt, hsa; identical to SEQ ID NO: 84628

SEQ ID NO: 578842 - RNA, 64 nt, hsa; identical to SEQ ID NO: 84629

SEQ ID NO: 578843 - RNA, 64 nt, hsa; identical to SEQ ID NO: 84630

SEQ ID NO: 578844 - RNA, 64 nt, hsa; identical to SEQ ID NO: 84631

SEQ ID NO: 578845 - RNA, 64 nt, hsa
ucacaaaaucuuaccaaaauauuccagaguucuugcccuuaacccagcuucuuccaaagauaac

SEQ ID NO: 578846 - RNA, 64 nt, hsa
uagucauuuugggaaagccucuugccagauguaggcccuuaagauaucugcaaagaagaguaau

SEQ ID NO: 578847 - RNA, 64 nt, hsa; identical to SEQ ID NO: 182067

SEQ ID NO: 578848 - RNA, 64 nt, hsa; identical to SEQ ID NO: 182068

SEQ ID NO: 578849 - RNA, 64 nt, hsa; identical to SEQ ID NO: 182069

SEQ ID NO: 578850 - RNA, 64 nt, hsa; identical to SEQ ID NO: 182070

SEQ ID NO: 578851 - RNA, 64 nt, hsa; identical to SEQ ID NO: 182071

SEQ ID NO: 578852 - RNA, 64 nt, hsa; identical to SEQ ID NO: 182072

SEQ ID NO: 578853 - RNA, 64 nt, hsa; identical to SEQ ID NO: 182073

SEQ ID NO: 578854 - RNA, 64 nt, hsa; identical to SEQ ID NO: 182074

SEQ ID NO: 578855 - RNA, 64 nt, hsa; identical to SEQ ID NO: 182075

SEQ ID NO: 578856 - RNA, 64 nt, hsa; identical to SEQ ID NO: 182076

SEQ ID NO: 578857 - RNA, 64 nt, hsa; identical to SEQ ID NO: 182077

SEQ ID NO: 578858 - RNA, 64 nt, hsa; identical to SEQ ID NO: 182078

SEQ ID NO: 578859 - RNA, 64 nt, hsa; identical to SEQ ID NO: 182079

SEQ ID NO: 578860 - RNA, 64 nt, hsa; identical to SEQ ID NO: 182080

SEQ ID NO: 578861 - RNA, 64 nt, hsa; identical to SEQ ID NO: 182081

SEQ ID NO: 578862 - RNA, 64 nt, hsa; identical to SEQ ID NO: 182082

SEQ ID NO: 578863 - RNA, 64 nt, hsa; identical to SEQ ID NO: 182083

SEQ ID NO: 578864 - RNA, 64 nt, hsa; identical to SEQ ID NO: 182084

SEQ ID NO: 578865 - RNA, 64 nt, hsa; identical to SEQ ID NO: 182085

SEQ ID NO: 578866 - RNA, 64 nt, hsa; identical to SEQ ID NO: 182086

SEQ ID NO: 578867 - RNA, 64 nt, hsa; identical to SEQ ID NO: 182087

SEQ ID NO: 578868 - RNA, 64 nt, hsa; identical to SEQ ID NO: 182088

SEQ ID NO: 578869 - RNA, 64 nt, hsa; identical to SEQ ID NO: 182089

SEQ ID NO: 578870 - RNA, 64 nt, hsa; identical to SEQ ID NO: 182090

SEQ ID NO: 578871 - RNA, 64 nt, hsa; identical to SEQ ID NO: 182091

SEQ ID NO: 578872 - RNA, 64 nt, hsa; identical to SEQ ID NO: 182092

SEQ ID NO: 578873 - RNA, 64 nt, hsa; identical to SEQ ID NO: 182093

SEQ ID NO: 578874 - RNA, 64 nt, hsa; identical to SEQ ID NO: 182094

SEQ ID NO: 578875 - RNA, 64 nt, hsa; identical to SEQ ID NO: 182095

SEQ ID NO: 578876 - RNA, 64 nt, hsa; identical to SEQ ID NO: 182096

SEQ ID NO: 578877 - RNA, 64 nt, hsa; identical to SEQ ID NO: 182097

SEQ ID NO: 578878 - RNA, 64 nt, hsa; identical to SEQ ID NO: 182098

SEQ ID NO: 578879 - RNA, 64 nt, hsa; identical to SEQ ID NO: 206137

SEQ ID NO: 578880 - RNA, 64 nt, hsa; identical to SEQ ID NO: 206138

SEQ ID NO: 578881 - RNA, 64 nt, hsa; identical to SEQ ID NO: 206139

SEQ ID NO: 578882 - RNA, 64 nt, hsa; identical to SEQ ID NO: 206140

SEQ ID NO: 578883 - RNA, 64 nt, hsa; identical to SEQ ID NO: 206141

SEQ ID NO: 578884 - RNA, 64 nt, hsa; identical to SEQ ID NO: 206142

SEQ ID NO: 578885 - RNA, 64 nt, hsa; identical to SEQ ID NO: 206143

SEQ ID NO: 578886 - RNA, 64 nt, hsa; identical to SEQ ID NO: 206144

SEQ ID NO: 578887 - RNA, 64 nt, hsa; identical to SEQ ID NO: 206145

SEQ ID NO: 578888 - RNA, 64 nt, hsa; identical to SEQ ID NO: 206146

SEQ ID NO: 578889 - RNA, 64 nt, hsa; identical to SEQ ID NO: 206147

SEQ ID NO: 578890 - RNA, 64 nt, hsa; identical to SEQ ID NO: 206148

SEQ ID NO: 578891 - RNA, 64 nt, hsa; identical to SEQ ID NO: 206149

SEQ ID NO: 578892 - RNA, 64 nt, hsa; identical to SEQ ID NO: 206150

SEQ ID NO: 578893 - RNA, 64 nt, hsa; identical to SEQ ID NO: 73390

SEQ ID NO: 578894 - RNA, 64 nt, hsa; identical to SEQ ID NO: 73391

SEQ ID NO: 578895 - RNA, 64 nt, hsa; identical to SEQ ID NO: 73392

SEQ ID NO: 578896 - RNA, 64 nt, hsa; identical to SEQ ID NO: 73393

SEQ ID NO: 578897 - RNA, 64 nt, hsa; identical to SEQ ID NO: 73394

SEQ ID NO: 578898 - RNA, 64 nt, hsa; identical to SEQ ID NO: 73395

SEQ ID NO: 578899 - RNA, 64 nt, hsa; identical to SEQ ID NO: 73396

SEQ ID NO: 578900 - RNA, 64 nt, hsa; identical to SEQ ID NO: 73397

SEQ ID NO: 578901 - RNA, 64 nt, hsa; identical to SEQ ID NO: 73398

SEQ ID NO: 578902 - RNA, 64 nt, hsa; identical to SEQ ID NO: 73399

SEQ ID NO: 578903 - RNA, 64 nt, hsa; identical to SEQ ID NO: 73400

SEQ ID NO: 578904 - RNA, 64 nt, hsa; identical to SEQ ID NO: 73401

SEQ ID NO: 578905 - RNA, 64 nt, hsa; identical to SEQ ID NO: 73402

SEQ ID NO: 578906 - RNA, 64 nt, hsa; identical to SEQ ID NO: 73403

SEQ ID NO: 578907 - RNA, 64 nt, hsa; identical to SEQ ID NO: 73404

SEQ ID NO: 578908 - RNA, 64 nt, hsa; identical to SEQ ID NO: 73405

SEQ ID NO: 578909 - RNA, 64 nt, hsa; identical to SEQ ID NO: 73406

SEQ ID NO: 578910 - RNA, 64 nt, hsa; identical to SEQ ID NO: 73407

SEQ ID NO: 578911 - RNA, 64 nt, hsa; identical to SEQ ID NO: 73408

SEQ ID NO: 578912 - RNA, 64 nt, hsa; identical to SEQ ID NO: 73409

SEQ ID NO: 578913 - RNA, 64 nt, hsa; identical to SEQ ID NO: 354645

SEQ ID NO: 578914 - RNA, 64 nt, hsa; identical to SEQ ID NO: 354646

SEQ ID NO: 578915 - RNA, 64 nt, hsa; identical to SEQ ID NO: 354647

SEQ ID NO: 578916 - RNA, 64 nt, hsa; identical to SEQ ID NO: 354648

SEQ ID NO: 578917 - RNA, 64 nt, hsa; identical to SEQ ID NO: 354649

SEQ ID NO: 578918 - RNA, 64 nt, hsa; identical to SEQ ID NO: 354650

SEQ ID NO: 578919 - RNA, 64 nt, hsa; identical to SEQ ID NO: 354651

SEQ ID NO: 578920 - RNA, 64 nt, hsa; identical to SEQ ID NO: 354652

SEQ ID NO: 578921 - RNA, 64 nt, hsa; identical to SEQ ID NO: 354653

SEQ ID NO: 578922 - RNA, 64 nt, hsa; identical to SEQ ID NO: 354654

SEQ ID NO: 578923 - RNA, 64 nt, hsa; identical to SEQ ID NO: 354655

SEQ ID NO: 578924 - RNA, 64 nt, hsa; identical to SEQ ID NO: 354656

SEQ ID NO: 578925 - RNA, 64 nt, hsa; identical to SEQ ID NO: 354657

SEQ ID NO: 578926 - RNA, 64 nt, hsa; identical to SEQ ID NO: 354658

SEQ ID NO: 578927 - RNA, 64 nt, hsa; identical to SEQ ID NO: 354659

SEQ ID NO: 578928 - RNA, 64 nt, hsa; identical to SEQ ID NO: 354660

SEQ ID NO: 578929 - RNA, 64 nt, hsa; identical to SEQ ID NO: 354661

SEQ ID NO: 578930 - RNA, 64 nt, hsa; identical to SEQ ID NO: 354662

SEQ ID NO: 578931 - RNA, 64 nt, hsa; identical to SEQ ID NO: 354663

SEQ ID NO: 578932 - RNA, 64 nt, hsa; identical to SEQ ID NO: 354664

SEQ ID NO: 578933 - RNA, 64 nt, hsa; identical to SEQ ID NO: 354665

SEQ ID NO: 578934 - RNA, 64 nt, hsa; identical to SEQ ID NO: 354666

SEQ ID NO: 578935 - RNA, 64 nt, hsa
cuuuguugcagauagucuugccgcaucuuggcaaguugcagagaugguggagcuagaaaaaaaa

SEQ ID NO: 578936 - RNA, 64 nt, hsa
acugguggaauaaaaaaccuguauauuuuacuuuguugcagauagucuugccgcaucuuggcaa

SEQ ID NO: 578937 - RNA, 64 nt, hsa
cccaacuccuauaauucccuaucuuuuaguuuuaguugcagaaacauuuuguggucauuaagca

SEQ ID NO: 578938 - RNA, 64 nt, hsa
agcacauugaaagagaaccaguuucagguguuuaguugcagacucaguuugucagacuuuaaag

SEQ ID NO: 578939 - RNA, 64 nt, hsa
ucauggucaggugcuggugaggacccugaucuggguugcagacugcugacuucuuauugugucc

SEQ ID NO: 578940 - RNA, 64 nt, hsa
aggugaucugcaugccuguuaaagucugagcucuguugcagauaaccagagacccaacaaccaa

SEQ ID NO: 578941 - RNA, 64 nt, hsa
uuuuaauaaagauuccauggguugaacaagccacguugcagaaaaagagcuuccccuaaccugg

SEQ ID NO: 578942 - RNA, 64 nt, hsa
cguugcagaaaaagagcuuccccuaaccuggguuguugcagaguaaaucccacgacauaagcug

SEQ ID NO: 578943 - RNA, 64 nt, hsa; identical to SEQ ID NO: 167088

SEQ ID NO: 578944 - RNA, 64 nt, hsa; identical to SEQ ID NO: 167089

SEQ ID NO: 578945 - RNA, 64 nt, hsa; identical to SEQ ID NO: 167090

SEQ ID NO: 578946 - RNA, 64 nt, hsa; identical to SEQ ID NO: 167091

SEQ ID NO: 578947 - RNA, 64 nt, hsa; identical to SEQ ID NO: 167092

SEQ ID NO: 578948 - RNA, 64 nt, hsa; identical to SEQ ID NO: 167093

SEQ ID NO: 578949 - RNA, 64 nt, hsa; identical to SEQ ID NO: 167094

SEQ ID NO: 578950 - RNA, 64 nt, hsa; identical to SEQ ID NO: 167095

SEQ ID NO: 578951 - RNA, 64 nt, hsa; identical to SEQ ID NO: 167096

SEQ ID NO: 578952 - RNA, 64 nt, hsa; identical to SEQ ID NO: 167097

SEQ ID NO: 578953 - RNA, 64 nt, hsa; identical to SEQ ID NO: 167098

SEQ ID NO: 578954 - RNA, 64 nt, hsa; identical to SEQ ID NO: 167099

SEQ ID NO: 578955 - RNA, 64 nt, hsa; identical to SEQ ID NO: 167100

SEQ ID NO: 578956 - RNA, 64 nt, hsa; identical to SEQ ID NO: 167101

SEQ ID NO: 578957 - RNA, 64 nt, hsa; identical to SEQ ID NO: 167102

SEQ ID NO: 578958 - RNA, 64 nt, hsa; identical to SEQ ID NO: 167103

SEQ ID NO: 578959 - RNA, 64 nt, hsa; identical to SEQ ID NO: 167104

SEQ ID NO: 578960 - RNA, 64 nt, hsa; identical to SEQ ID NO: 167105

SEQ ID NO: 578961 - RNA, 64 nt, hsa; identical to SEQ ID NO: 167106

SEQ ID NO: 578962 - RNA, 64 nt, hsa; identical to SEQ ID NO: 167107

SEQ ID NO: 578963 - RNA, 64 nt, hsa; identical to SEQ ID NO: 167108

SEQ ID NO: 578964 - RNA, 64 nt, hsa; identical to SEQ ID NO: 167109

SEQ ID NO: 578965 - RNA, 64 nt, hsa; identical to SEQ ID NO: 167110

SEQ ID NO: 578966 - RNA, 64 nt, hsa; identical to SEQ ID NO: 167111

SEQ ID NO: 578967 - RNA, 64 nt, hsa; identical to SEQ ID NO: 167112

SEQ ID NO: 578968 - RNA, 64 nt, hsa; identical to SEQ ID NO: 167113

SEQ ID NO: 578969 - RNA, 64 nt, hsa; identical to SEQ ID NO: 167114

SEQ ID NO: 578970 - RNA, 64 nt, hsa; identical to SEQ ID NO: 167115

SEQ ID NO: 578971 - RNA, 64 nt, hsa; identical to SEQ ID NO: 167116

SEQ ID NO: 578972 - RNA, 64 nt, hsa; identical to SEQ ID NO: 167117

SEQ ID NO: 578973 - RNA, 64 nt, hsa; identical to SEQ ID NO: 167118

SEQ ID NO: 578974 - RNA, 64 nt, hsa; identical to SEQ ID NO: 167119

SEQ ID NO: 578975 - RNA, 64 nt, hsa; identical to SEQ ID NO: 167120

SEQ ID NO: 578976 - RNA, 64 nt, hsa; identical to SEQ ID NO: 167121

SEQ ID NO: 578977 - RNA, 64 nt, hsa; identical to SEQ ID NO: 167122

SEQ ID NO: 578978 - RNA, 64 nt, hsa; identical to SEQ ID NO: 167123

SEQ ID NO: 578979 - RNA, 64 nt, hsa; identical to SEQ ID NO: 167124

SEQ ID NO: 578980 - RNA, 64 nt, hsa; identical to SEQ ID NO: 167125

SEQ ID NO: 578981 - RNA, 64 nt, hsa; identical to SEQ ID NO: 167126

SEQ ID NO: 578982 - RNA, 64 nt, hsa; identical to SEQ ID NO: 167127

SEQ ID NO: 578983 - RNA, 64 nt, hsa; identical to SEQ ID NO: 167128

SEQ ID NO: 578984 - RNA, 64 nt, hsa; identical to SEQ ID NO: 167129

SEQ ID NO: 578985 - RNA, 64 nt, hsa; identical to SEQ ID NO: 167130

SEQ ID NO: 578986 - RNA, 64 nt, hsa; identical to SEQ ID NO: 167131

SEQ ID NO: 578987 - RNA, 64 nt, hsa; identical to SEQ ID NO: 167132

SEQ ID NO: 578988 - RNA, 64 nt, hsa; identical to SEQ ID NO: 167133

SEQ ID NO: 578989 - RNA, 64 nt, hsa; identical to SEQ ID NO: 167134

SEQ ID NO: 578990 - RNA, 64 nt, hsa; identical to SEQ ID NO: 167135

SEQ ID NO: 578991 - RNA, 64 nt, hsa; identical to SEQ ID NO: 167136

SEQ ID NO: 578992 - RNA, 64 nt, hsa; identical to SEQ ID NO: 167137

SEQ ID NO: 578993 - RNA, 64 nt, hsa; identical to SEQ ID NO: 167138

SEQ ID NO: 578994 - RNA, 64 nt, hsa; identical to SEQ ID NO: 167139

SEQ ID NO: 578995 - RNA, 64 nt, hsa; identical to SEQ ID NO: 167140

SEQ ID NO: 578996 - RNA, 64 nt, hsa; identical to SEQ ID NO: 167141

SEQ ID NO: 578997 - RNA, 64 nt, hsa; identical to SEQ ID NO: 167142

SEQ ID NO: 578998 - RNA, 64 nt, hsa; identical to SEQ ID NO: 167143

SEQ ID NO: 578999 - RNA, 64 nt, hsa; identical to SEQ ID NO: 167144

SEQ ID NO: 579000 - RNA, 64 nt, hsa; identical to SEQ ID NO: 167145

SEQ ID NO: 579001 - RNA, 64 nt, hsa; identical to SEQ ID NO: 167146

SEQ ID NO: 579002 - RNA, 64 nt, hsa; identical to SEQ ID NO: 167147

SEQ ID NO: 579003 - RNA, 64 nt, hsa; identical to SEQ ID NO: 167148

SEQ ID NO: 579004 - RNA, 64 nt, hsa; identical to SEQ ID NO: 167149

SEQ ID NO: 579005 - RNA, 64 nt, hsa; identical to SEQ ID NO: 167150

SEQ ID NO: 579006 - RNA, 64 nt, hsa; identical to SEQ ID NO: 167151

SEQ ID NO: 579007 - RNA, 64 nt, hsa; identical to SEQ ID NO: 167152

SEQ ID NO: 579008 - RNA, 64 nt, hsa; identical to SEQ ID NO: 167153

SEQ ID NO: 579009 - RNA, 64 nt, hsa; identical to SEQ ID NO: 167154

SEQ ID NO: 579010 - RNA, 64 nt, hsa; identical to SEQ ID NO: 167155

SEQ ID NO: 579011 - RNA, 64 nt, hsa; identical to SEQ ID NO: 167156

SEQ ID NO: 579012 - RNA, 64 nt, hsa; identical to SEQ ID NO: 167157

SEQ ID NO: 579013 - RNA, 64 nt, hsa; identical to SEQ ID NO: 167158

SEQ ID NO: 579014 - RNA, 64 nt, hsa; identical to SEQ ID NO: 167159

SEQ ID NO: 579015 - RNA, 64 nt, hsa; identical to SEQ ID NO: 167160

SEQ ID NO: 579016 - RNA, 64 nt, hsa; identical to SEQ ID NO: 167161

SEQ ID NO: 579017 - RNA, 64 nt, hsa; identical to SEQ ID NO: 167162

SEQ ID NO: 579018 - RNA, 64 nt, hsa; identical to SEQ ID NO: 167163

SEQ ID NO: 579019 - RNA, 64 nt, hsa; identical to SEQ ID NO: 167164

SEQ ID NO: 579020 - RNA, 64 nt, hsa; identical to SEQ ID NO: 167165

SEQ ID NO: 579021 - RNA, 64 nt, hsa; identical to SEQ ID NO: 167166

SEQ ID NO: 579022 - RNA, 64 nt, hsa; identical to SEQ ID NO: 167167

SEQ ID NO: 579023 - RNA, 64 nt, hsa; identical to SEQ ID NO: 167168

SEQ ID NO: 579024 - RNA, 64 nt, hsa; identical to SEQ ID NO: 350713

SEQ ID NO: 579025 - RNA, 64 nt, hsa; identical to SEQ ID NO: 350714

SEQ ID NO: 579026 - RNA, 64 nt, hsa; identical to SEQ ID NO: 350715

SEQ ID NO: 579027 - RNA, 64 nt, hsa; identical to SEQ ID NO: 350716

SEQ ID NO: 579028 - RNA, 64 nt, hsa; identical to SEQ ID NO: 350717

SEQ ID NO: 579029 - RNA, 64 nt, hsa; identical to SEQ ID NO: 350718

SEQ ID NO: 579030 - RNA, 64 nt, hsa; identical to SEQ ID NO: 350719

SEQ ID NO: 579031 - RNA, 64 nt, hsa; identical to SEQ ID NO: 350720

SEQ ID NO: 579032 - RNA, 64 nt, hsa
guucgugccaauccugacaucucgagguuuccucacuagacaacucucuuucgcaggcuccuuu

SEQ ID NO: 579033 - RNA, 64 nt, hsa
aaugaagugcuauuuucuuauuuuuaaucaaauaacuagacauauaucagaaacuuuaaaaugu

SEQ ID NO: 579034 - RNA, 64 nt, hsa
uacuuaauauuuauguuaauaggacuuaauucuuacuagacaucuaggaacauuacaaagcaaa

SEQ ID NO: 579035 - RNA, 64 nt, hsa
aggcucuuccuauuuuuaaucucuucaccucagaacuagacauauggagagcuuuaaaggcaag

SEQ ID NO: 579036 - RNA, 65 nt, hsa; identical to SEQ ID NO: 65698

SEQ ID NO: 579037 - RNA, 65 nt, hsa; identical to SEQ ID NO: 65699

SEQ ID NO: 579038 - RNA, 65 nt, hsa; identical to SEQ ID NO: 65706

SEQ ID NO: 579039 - RNA, 65 nt, hsa; identical to SEQ ID NO: 65707

SEQ ID NO: 579040 - RNA, 65 nt, hsa; identical to SEQ ID NO: 65720

SEQ ID NO: 579041 - RNA, 65 nt, hsa; identical to SEQ ID NO: 65721

SEQ ID NO: 579042 - RNA, 65 nt, hsa; identical to SEQ ID NO: 65744

SEQ ID NO: 579043 - RNA, 65 nt, hsa; identical to SEQ ID NO: 65745

SEQ ID NO: 579044 - RNA, 65 nt, hsa; identical to SEQ ID NO: 65788

SEQ ID NO: 579045 - RNA, 65 nt, hsa; identical to SEQ ID NO: 65789

SEQ ID NO: 579046 - RNA, 65 nt, hsa; identical to SEQ ID NO: 65808

SEQ ID NO: 579047 - RNA, 65 nt, hsa; identical to SEQ ID NO: 65809

SEQ ID NO: 579048 - RNA, 65 nt, hsa; identical to SEQ ID NO: 65810

SEQ ID NO: 579049 - RNA, 65 nt, hsa; identical to SEQ ID NO: 65811

SEQ ID NO: 579050 - RNA, 65 nt, hsa; identical to SEQ ID NO: 65827

SEQ ID NO: 579051 - RNA, 65 nt, hsa; identical to SEQ ID NO: 65828

SEQ ID NO: 579052 - RNA, 65 nt, hsa; identical to SEQ ID NO: 65831

SEQ ID NO: 579053 - RNA, 56 nt, hsa; identical to SEQ ID NO: 61369

SEQ ID NO: 579054 - RNA, 65 nt, hsa; identical to SEQ ID NO: 65853

SEQ ID NO: 579055 - RNA, 65 nt, hsa; identical to SEQ ID NO: 65854

SEQ ID NO: 579056 - RNA, 65 nt, hsa; identical to SEQ ID NO: 65891

SEQ ID NO: 579057 - RNA, 65 nt, hsa; identical to SEQ ID NO: 65892

SEQ ID NO: 579058 - RNA, 65 nt, hsa; identical to SEQ ID NO: 65896

SEQ ID NO: 579059 - RNA, 65 nt, hsa; identical to SEQ ID NO: 65897

SEQ ID NO: 579060 - RNA, 64 nt, hsa; identical to SEQ ID NO: 290194

SEQ ID NO: 579061 - RNA, 64 nt, hsa; identical to SEQ ID NO: 290195

SEQ ID NO: 579062 - RNA, 64 nt, hsa; identical to SEQ ID NO: 290196

SEQ ID NO: 579063 - RNA, 64 nt, hsa; identical to SEQ ID NO: 290197

SEQ ID NO: 579064 - RNA, 64 nt, hsa; identical to SEQ ID NO: 290198

SEQ ID NO: 579065 - RNA, 64 nt, hsa; identical to SEQ ID NO: 290199

SEQ ID NO: 579066 - RNA, 64 nt, hsa; identical to SEQ ID NO: 290200

SEQ ID NO: 579067 - RNA, 64 nt, hsa; identical to SEQ ID NO: 290201

SEQ ID NO: 579068 - RNA, 64 nt, hsa; identical to SEQ ID NO: 290202

SEQ ID NO: 579069 - RNA, 64 nt, hsa; identical to SEQ ID NO: 290203

SEQ ID NO: 579070 - RNA, 64 nt, hsa; identical to SEQ ID NO: 290204

SEQ ID NO: 579071 - RNA, 64 nt, hsa; identical to SEQ ID NO: 290205

SEQ ID NO: 579072 - RNA, 64 nt, hsa; identical to SEQ ID NO: 290206

SEQ ID NO: 579073 - RNA, 64 nt, hsa; identical to SEQ ID NO: 290207

SEQ ID NO: 579074 - RNA, 64 nt, hsa; identical to SEQ ID NO: 290208

SEQ ID NO: 579075 - RNA, 64 nt, hsa; identical to SEQ ID NO: 290209

SEQ ID NO: 579076 - RNA, 64 nt, hsa; identical to SEQ ID NO: 290210

SEQ ID NO: 579077 - RNA, 64 nt, hsa; identical to SEQ ID NO: 290211

SEQ ID NO: 579078 - RNA, 64 nt, hsa; identical to SEQ ID NO: 290212

SEQ ID NO: 579079 - RNA, 64 nt, hsa; identical to SEQ ID NO: 290213

SEQ ID NO: 579080 - RNA, 64 nt, hsa; identical to SEQ ID NO: 290214

SEQ ID NO: 579081 - RNA, 64 nt, hsa; identical to SEQ ID NO: 290215

SEQ ID NO: 579082 - RNA, 64 nt, hsa; identical to SEQ ID NO: 290216

SEQ ID NO: 579083 - RNA, 64 nt, hsa; identical to SEQ ID NO: 290217

SEQ ID NO: 579084 - RNA, 64 nt, hsa; identical to SEQ ID NO: 290218

SEQ ID NO: 579085 - RNA, 64 nt, hsa; identical to SEQ ID NO: 290219

SEQ ID NO: 579086 - RNA, 64 nt, hsa; identical to SEQ ID NO: 290220

SEQ ID NO: 579087 - RNA, 64 nt, hsa; identical to SEQ ID NO: 290221

SEQ ID NO: 579088 - RNA, 64 nt, hsa; identical to SEQ ID NO: 290222

SEQ ID NO: 579089 - RNA, 64 nt, hsa; identical to SEQ ID NO: 290223

SEQ ID NO: 579090 - RNA, 64 nt, hsa; identical to SEQ ID NO: 290224

SEQ ID NO: 579091 - RNA, 64 nt, hsa; identical to SEQ ID NO: 290225

SEQ ID NO: 579092 - RNA, 64 nt, hsa; identical to SEQ ID NO: 290226

SEQ ID NO: 579093 - RNA, 64 nt, hsa; identical to SEQ ID NO: 290227

SEQ ID NO: 579094 - RNA, 64 nt, hsa; identical to SEQ ID NO: 290228

SEQ ID NO: 579095 - RNA, 64 nt, hsa; identical to SEQ ID NO: 290229

SEQ ID NO: 579096 - RNA, 64 nt, hsa; identical to SEQ ID NO: 426773

SEQ ID NO: 579097 - RNA, 64 nt, hsa; identical to SEQ ID NO: 426774

SEQ ID NO: 579098 - RNA, 64 nt, hsa; identical to SEQ ID NO: 426775

SEQ ID NO: 579099 - RNA, 64 nt, hsa; identical to SEQ ID NO: 426776

SEQ ID NO: 579100 - RNA, 64 nt, hsa; identical to SEQ ID NO: 426777

SEQ ID NO: 579101 - RNA, 64 nt, hsa; identical to SEQ ID NO: 426778

SEQ ID NO: 579102 - RNA, 64 nt, hsa; identical to SEQ ID NO: 426779

SEQ ID NO: 579103 - RNA, 64 nt, hsa; identical to SEQ ID NO: 426780

SEQ ID NO: 579104 - RNA, 64 nt, hsa; identical to SEQ ID NO: 426781

SEQ ID NO: 579105 - RNA, 64 nt, hsa; identical to SEQ ID NO: 426782

SEQ ID NO: 579106 - RNA, 64 nt, hsa; identical to SEQ ID NO: 426783

SEQ ID NO: 579107 - RNA, 64 nt, hsa; identical to SEQ ID NO: 426784

SEQ ID NO: 579108 - RNA, 64 nt, hsa; identical to SEQ ID NO: 426785

SEQ ID NO: 579109 - RNA, 64 nt, hsa; identical to SEQ ID NO: 426786

SEQ ID NO: 579110 - RNA, 64 nt, hsa; identical to SEQ ID NO: 426787

SEQ ID NO: 579111 - RNA, 64 nt, hsa; identical to SEQ ID NO: 426788

SEQ ID NO: 579112 - RNA, 64 nt, hsa; identical to SEQ ID NO: 426789

SEQ ID NO: 579113 - RNA, 64 nt, hsa; identical to SEQ ID NO: 426790

SEQ ID NO: 579114 - RNA, 64 nt, hsa; identical to SEQ ID NO: 426791

SEQ ID NO: 579115 - RNA, 64 nt, hsa; identical to SEQ ID NO: 426792

SEQ ID NO: 579116 - RNA, 64 nt, hsa; identical to SEQ ID NO: 426793

SEQ ID NO: 579117 - RNA, 64 nt, hsa; identical to SEQ ID NO: 426794

SEQ ID NO: 579118 - RNA, 64 nt, hsa; identical to SEQ ID NO: 426795

SEQ ID NO: 579119 - RNA, 64 nt, hsa; identical to SEQ ID NO: 426796

SEQ ID NO: 579120 - RNA, 64 nt, hsa; identical to SEQ ID NO: 426797

SEQ ID NO: 579121 - RNA, 64 nt, hsa; identical to SEQ ID NO: 426798

SEQ ID NO: 579122 - RNA, 64 nt, hsa; identical to SEQ ID NO: 426799

SEQ ID NO: 579123 - RNA, 64 nt, hsa; identical to SEQ ID NO: 426800

SEQ ID NO: 579124 - RNA, 64 nt, hsa; identical to SEQ ID NO: 426801

SEQ ID NO: 579125 - RNA, 64 nt, hsa; identical to SEQ ID NO: 426802

SEQ ID NO: 579126 - RNA, 64 nt, hsa; identical to SEQ ID NO: 426803

SEQ ID NO: 579127 - RNA, 64 nt, hsa; identical to SEQ ID NO: 426804

SEQ ID NO: 579128 - RNA, 64 nt, hsa; identical to SEQ ID NO: 426805

SEQ ID NO: 579129 - RNA, 64 nt, hsa; identical to SEQ ID NO: 426806

SEQ ID NO: 579130 - RNA, 64 nt, hsa; identical to SEQ ID NO: 426807

SEQ ID NO: 579131 - RNA, 64 nt, hsa; identical to SEQ ID NO: 426808

SEQ ID NO: 579132 - RNA, 64 nt, hsa; identical to SEQ ID NO: 426809

SEQ ID NO: 579133 - RNA, 64 nt, hsa; identical to SEQ ID NO: 426810

SEQ ID NO: 579134 - RNA, 64 nt, hsa; identical to SEQ ID NO: 426811

SEQ ID NO: 579135 - RNA, 64 nt, hsa; identical to SEQ ID NO: 426812

SEQ ID NO: 579136 - RNA, 64 nt, hsa; identical to SEQ ID NO: 426813

SEQ ID NO: 579137 - RNA, 64 nt, hsa; identical to SEQ ID NO: 426814

SEQ ID NO: 579138 - RNA, 64 nt, hsa; identical to SEQ ID NO: 426815

SEQ ID NO: 579139 - RNA, 64 nt, hsa; identical to SEQ ID NO: 426816

SEQ ID NO: 579140 - RNA, 64 nt, hsa; identical to SEQ ID NO: 426817

SEQ ID NO: 579141 - RNA, 64 nt, hsa
ggaaggccugagguccagguaagaagggaaaauagacugggagugggacaagggacuugacucu

SEQ ID NO: 579142 - RNA, 64 nt, hsa
ugggaacucuuuuaaccugcagcugucugucugggacugggauuuacguuauagcaaugcacag

SEQ ID NO: 579143 - RNA, 64 nt, hsa
uuccacugcacauggcccuccuccccacccucaugacugggaaggaagccugugaugaggcuga

SEQ ID NO: 579144 - RNA, 64 nt, hsa
uuggguuuugagauccuuccuuauuuuaagccaggacugggauuaaaucucccucugucagauc

SEQ ID NO: 579145 - RNA, 64 nt, hsa
uccguuuucacgcugcugauaaagacauacccgagacugggaagaaaaagugguuuaauuggac

SEQ ID NO: 579146 - RNA, 64 nt, hsa
ucuguauuaaugcugcugauaaagacguacccgagacugggaagaaaaagagguuuacuuggac

SEQ ID NO: 579147 - RNA, 64 nt, hsa
ccacacuuugaagguaauaaauacacagcaugcagacugggaguugcuagcaaacaaauggcuu

SEQ ID NO: 579148 - RNA, 64 nt, hsa
uccucuagaagcagaaccagcucuacgagagugagacugggaacuugauggcucagagagcauc

SEQ ID NO: 579149 - RNA, 58 nt, hsa
gcccucagagugcucuguaggagcuguagacugggaagagaggccaggcgugguggcu

SEQ ID NO: 579150 - RNA, 64 nt, hsa
gacagcuagacccugucucaaaaaaaaaaaaaaagacugggaagagagcuagagggacuaggag

SEQ ID NO: 579151 - RNA, 64 nt, hsa
aaaccuacaguccuggaaggucucugcuggaagagacugggagaguggggaggggccagggacc

SEQ ID NO: 579152 - RNA, 64 nt, hsa
ggggcucccugaggacggggcugugucugccucagacugggaaucccugaagauggggccgugu

SEQ ID NO: 579153 - RNA, 64 nt, hsa
uuggcacauagcccacuaggaaaccaagaaguuugacugggagcguguguuucauugcacuggg

SEQ ID NO: 579154 - RNA, 64 nt, hsa
uguuuuucaaaagaagaauguacauauuccacuugacugggaagcuguguggcccaaaucacug

SEQ ID NO: 579155 - RNA, 64 nt, hsa
uuggcagagccuuugcaacaccuuaaguggacaggacugggaggucuuggugguuggagccaac

SEQ ID NO: 579156 - RNA, 64 nt, hsa
aguaugugugugcgugugcaugggagugugcguggacugggauaucaucucuacagccugcaaa

SEQ ID NO: 579157 - RNA, 64 nt, hsa
cuacaaaaaugugacugggaagggggcuuugagagacugggacugcucuggguuagguuuucug

SEQ ID NO: 579158 - RNA, 64 nt, hsa
guaggaauccauucugaacaaacuacaaaaaugugacugggaagggggcuuugagagacuggga

SEQ ID NO: 579159 - RNA, 64 nt, hsa
ggaaaacugagcauguguccuguuuuaagugguggacugggagggaagugucaacuucugaggu

SEQ ID NO: 579160 - RNA, 64 nt, hsa
guuccugauuuauuuucagccaguaaucaaaacagacugggaaugaauaaagcacuuacagaag

SEQ ID NO: 579161 - RNA, 64 nt, hsa
guuaaugacgucucucccucuaaaccccauuaaggacugggagaggcagagcaagccucagagc

SEQ ID NO: 579162 - RNA, 64 nt, hsa
cugcucuggacaagaauugagcaacuugucugaugacugggaaaggaggaccugcaaccaucug

SEQ ID NO: 579163 - RNA, 64 nt, hsa
agcccagagcgguggccuugcucuuccggcuggagacugggacaucccugauagguucacaucc

SEQ ID NO: 579164 - RNA, 64 nt, hsa
ucagcuggugaugaagaggagcaugcuggggugagacugggauucuggcuucucuuugaaccac

SEQ ID NO: 579165 - RNA, 64 nt, hsa
gcagagaccugcgcccacaggugcugucuuaguggacugggacgugaaccuuucgcucuccuuc

SEQ ID NO: 579166 - RNA, 64 nt, hsa
uggacugggacgugaaccuuucgcucuccuucuggacugggagaagggaggcuuggguguugug

SEQ ID NO: 579167 - RNA, 64 nt, hsa
agugccagcauccagcaugagcagaugucggggagacugggaagucuccagcguuacugcucuc

SEQ ID NO: 579168 - RNA, 64 nt, hsa
agugccagcauccagcgugagcagacgucggggagacugggaagucuccgauguuacugccugc

SEQ ID NO: 579169 - RNA, 64 nt, hsa
aacucaaaugcuggggguagguggcuaaucucaggacugggaagauuacggcgaauuaugcuca

SEQ ID NO: 579170 - RNA, 64 nt, hsa
aacaagaugcuuccaguuacagcggcaggagcgggacugggagcacgggcugacggcugcuggu

SEQ ID NO: 579171 - RNA, 64 nt, hsa; identical to SEQ ID NO: 88257

SEQ ID NO: 579172 - RNA, 64 nt, hsa; identical to SEQ ID NO: 88258

SEQ ID NO: 579173 - RNA, 64 nt, hsa; identical to SEQ ID NO: 88259

SEQ ID NO: 579174 - RNA, 64 nt, hsa; identical to SEQ ID NO: 88260

SEQ ID NO: 579175 - RNA, 64 nt, hsa; identical to SEQ ID NO: 88261

SEQ ID NO: 579176 - RNA, 64 nt, hsa; identical to SEQ ID NO: 88262

SEQ ID NO: 579177 - RNA, 64 nt, hsa; identical to SEQ ID NO: 88263

SEQ ID NO: 579178 - RNA, 64 nt, hsa; identical to SEQ ID NO: 88264

SEQ ID NO: 579179 - RNA, 64 nt, hsa; identical to SEQ ID NO: 88265

SEQ ID NO: 579180 - RNA, 64 nt, hsa; identical to SEQ ID NO: 88266

SEQ ID NO: 579181 - RNA, 64 nt, hsa; identical to SEQ ID NO: 88267

SEQ ID NO: 579182 - RNA, 64 nt, hsa; identical to SEQ ID NO: 88268

SEQ ID NO: 579183 - RNA, 64 nt, hsa; identical to SEQ ID NO: 88269

SEQ ID NO: 579184 - RNA, 64 nt, hsa; identical to SEQ ID NO: 88270

SEQ ID NO: 579185 - RNA, 64 nt, hsa; identical to SEQ ID NO: 88271

SEQ ID NO: 579186 - RNA, 64 nt, hsa; identical to SEQ ID NO: 88269

SEQ ID NO: 579187 - RNA, 64 nt, hsa; identical to SEQ ID NO: 88273

SEQ ID NO: 579188 - RNA, 64 nt, hsa; identical to SEQ ID NO: 88274

SEQ ID NO: 579189 - RNA, 64 nt, hsa; identical to SEQ ID NO: 88275

SEQ ID NO: 579190 - RNA, 64 nt, hsa; identical to SEQ ID NO: 88276

SEQ ID NO: 579191 - RNA, 64 nt, hsa; identical to SEQ ID NO: 88277

SEQ ID NO: 579192 - RNA, 64 nt, hsa; identical to SEQ ID NO: 88278

SEQ ID NO: 579193 - RNA, 64 nt, hsa; identical to SEQ ID NO: 88279

SEQ ID NO: 579194 - RNA, 64 nt, hsa; identical to SEQ ID NO: 88280

SEQ ID NO: 579195 - RNA, 64 nt, hsa; identical to SEQ ID NO: 88281

SEQ ID NO: 579196 - RNA, 64 nt, hsa; identical to SEQ ID NO: 88282

SEQ ID NO: 579197 - RNA, 64 nt, hsa; identical to SEQ ID NO: 88283

SEQ ID NO: 579198 - RNA, 64 nt, hsa; identical to SEQ ID NO: 88284

SEQ ID NO: 579199 - RNA, 64 nt, hsa; identical to SEQ ID NO: 88285

SEQ ID NO: 579200 - RNA, 64 nt, hsa; identical to SEQ ID NO: 88286

SEQ ID NO: 579201 - RNA, 64 nt, hsa; identical to SEQ ID NO: 88287

SEQ ID NO: 579202 - RNA, 64 nt, hsa; identical to SEQ ID NO: 88288

SEQ ID NO: 579203 - RNA, 64 nt, hsa; identical to SEQ ID NO: 88289

SEQ ID NO: 579204 - RNA, 64 nt, hsa; identical to SEQ ID NO: 88290

SEQ ID NO: 579205 - RNA, 64 nt, hsa; identical to SEQ ID NO: 88291

SEQ ID NO: 579206 - RNA, 64 nt, hsa; identical to SEQ ID NO: 88292

SEQ ID NO: 579207 - RNA, 64 nt, hsa; identical to SEQ ID NO: 88293

SEQ ID NO: 579208 - RNA, 64 nt, hsa; identical to SEQ ID NO: 88294

SEQ ID NO: 579209 - RNA, 64 nt, hsa; identical to SEQ ID NO: 88295

SEQ ID NO: 579210 - RNA, 64 nt, hsa; identical to SEQ ID NO: 88296

SEQ ID NO: 579211 - RNA, 64 nt, hsa; identical to SEQ ID NO: 88297

SEQ ID NO: 579212 - RNA, 64 nt, hsa; identical to SEQ ID NO: 88298

SEQ ID NO: 579213 - RNA, 64 nt, hsa; identical to SEQ ID NO: 88299

SEQ ID NO: 579214 - RNA, 64 nt, hsa; identical to SEQ ID NO: 88300

SEQ ID NO: 579215 - RNA, 64 nt, hsa; identical to SEQ ID NO: 88298

SEQ ID NO: 579216 - RNA, 64 nt, hsa; identical to SEQ ID NO: 88302

SEQ ID NO: 579217 - RNA, 64 nt, hsa; identical to SEQ ID NO: 88300

SEQ ID NO: 579218 - RNA, 64 nt, hsa; identical to SEQ ID NO: 88304

SEQ ID NO: 579219 - RNA, 64 nt, hsa; identical to SEQ ID NO: 88305

SEQ ID NO: 579220 - RNA, 64 nt, hsa; identical to SEQ ID NO: 88306

SEQ ID NO: 579221 - RNA, 64 nt, hsa; identical to SEQ ID NO: 88307

SEQ ID NO: 579222 - RNA, 64 nt, hsa; identical to SEQ ID NO: 88299

SEQ ID NO: 579223 - RNA, 64 nt, hsa; identical to SEQ ID NO: 88309

SEQ ID NO: 579224 - RNA, 64 nt, hsa; identical to SEQ ID NO: 88310

SEQ ID NO: 579225 - RNA, 64 nt, hsa; identical to SEQ ID NO: 88311

SEQ ID NO: 579226 - RNA, 64 nt, hsa; identical to SEQ ID NO: 88312

SEQ ID NO: 579227 - RNA, 64 nt, hsa; identical to SEQ ID NO: 88313

SEQ ID NO: 579228 - RNA, 64 nt, hsa; identical to SEQ ID NO: 88314

SEQ ID NO: 579229 - RNA, 64 nt, hsa; identical to SEQ ID NO: 88315

SEQ ID NO: 579230 - RNA, 64 nt, hsa; identical to SEQ ID NO: 88316

SEQ ID NO: 579231 - RNA, 64 nt, hsa; identical to SEQ ID NO: 88317

SEQ ID NO: 579232 - RNA, 64 nt, hsa; identical to SEQ ID NO: 88318

SEQ ID NO: 579233 - RNA, 64 nt, hsa; identical to SEQ ID NO: 88319

SEQ ID NO: 579234 - RNA, 64 nt, hsa; identical to SEQ ID NO: 88320

SEQ ID NO: 579235 - RNA, 64 nt, hsa; identical to SEQ ID NO: 88321

SEQ ID NO: 579236 - RNA, 64 nt, hsa; identical to SEQ ID NO: 88322

SEQ ID NO: 579237 - RNA, 64 nt, hsa; identical to SEQ ID NO: 88323

SEQ ID NO: 579238 - RNA, 64 nt, hsa; identical to SEQ ID NO: 88324

SEQ ID NO: 579239 - RNA, 64 nt, hsa; identical to SEQ ID NO: 88325

SEQ ID NO: 579240 - RNA, 64 nt, hsa; identical to SEQ ID NO: 88326

SEQ ID NO: 579241 - RNA, 64 nt, hsa; identical to SEQ ID NO: 88327

SEQ ID NO: 579242 - RNA, 64 nt, hsa; identical to SEQ ID NO: 88328

SEQ ID NO: 579243 - RNA, 64 nt, hsa; identical to SEQ ID NO: 88329

SEQ ID NO: 579244 - RNA, 64 nt, hsa; identical to SEQ ID NO: 88330

SEQ ID NO: 579245 - RNA, 64 nt, hsa; identical to SEQ ID NO: 544068

SEQ ID NO: 579246 - RNA, 64 nt, hsa; identical to SEQ ID NO: 544069

SEQ ID NO: 579247 - RNA, 64 nt, hsa; identical to SEQ ID NO: 544070

SEQ ID NO: 579248 - RNA, 64 nt, hsa; identical to SEQ ID NO: 544071

SEQ ID NO: 579249 - RNA, 64 nt, hsa; identical to SEQ ID NO: 544072

SEQ ID NO: 579250 - RNA, 64 nt, hsa; identical to SEQ ID NO: 544073

SEQ ID NO: 579251 - RNA, 64 nt, hsa; identical to SEQ ID NO: 544074

SEQ ID NO: 579252 - RNA, 64 nt, hsa; identical to SEQ ID NO: 544075

SEQ ID NO: 579253 - RNA, 64 nt, hsa; identical to SEQ ID NO: 84890

SEQ ID NO: 579254 - RNA, 64 nt, hsa; identical to SEQ ID NO: 84891

SEQ ID NO: 579255 - RNA, 64 nt, hsa; identical to SEQ ID NO: 84892

SEQ ID NO: 579256 - RNA, 64 nt, hsa; identical to SEQ ID NO: 84893

SEQ ID NO: 579257 - RNA, 64 nt, hsa; identical to SEQ ID NO: 84894

SEQ ID NO: 579258 - RNA, 64 nt, hsa; identical to SEQ ID NO: 84895

SEQ ID NO: 579259 - RNA, 64 nt, hsa; identical to SEQ ID NO: 84896

SEQ ID NO: 579260 - RNA, 64 nt, hsa; identical to SEQ ID NO: 84897

SEQ ID NO: 579261 - RNA, 64 nt, hsa; identical to SEQ ID NO: 84898

SEQ ID NO: 579262 - RNA, 64 nt, hsa; identical to SEQ ID NO: 84899

SEQ ID NO: 579263 - RNA, 64 nt, hsa; identical to SEQ ID NO: 84900

SEQ ID NO: 579264 - RNA, 64 nt, hsa; identical to SEQ ID NO: 84901

SEQ ID NO: 579265 - RNA, 64 nt, hsa; identical to SEQ ID NO: 84902

SEQ ID NO: 579266 - RNA, 64 nt, hsa; identical to SEQ ID NO: 84903

SEQ ID NO: 579267 - RNA, 64 nt, hsa; identical to SEQ ID NO: 84904

SEQ ID NO: 579268 - RNA, 64 nt, hsa; identical to SEQ ID NO: 84905

SEQ ID NO: 579269 - RNA, 52 nt, hsa; identical to SEQ ID NO: 84906

SEQ ID NO: 579270 - RNA, 64 nt, hsa; identical to SEQ ID NO: 84907

SEQ ID NO: 579271 - RNA, 64 nt, hsa; identical to SEQ ID NO: 84908

SEQ ID NO: 579272 - RNA, 64 nt, hsa; identical to SEQ ID NO: 84909

SEQ ID NO: 579273 - RNA, 64 nt, hsa; identical to SEQ ID NO: 84910

SEQ ID NO: 579274 - RNA, 64 nt, hsa; identical to SEQ ID NO: 84911

SEQ ID NO: 579275 - RNA, 64 nt, hsa; identical to SEQ ID NO: 84912

SEQ ID NO: 579276 - RNA, 64 nt, hsa; identical to SEQ ID NO: 84913

SEQ ID NO: 579277 - RNA, 64 nt, hsa; identical to SEQ ID NO: 84914

SEQ ID NO: 579278 - RNA, 64 nt, hsa; identical to SEQ ID NO: 84915

SEQ ID NO: 579279 - RNA, 64 nt, hsa; identical to SEQ ID NO: 84916

SEQ ID NO: 579280 - RNA, 64 nt, hsa; identical to SEQ ID NO: 84917

SEQ ID NO: 579281 - RNA, 64 nt, hsa; identical to SEQ ID NO: 84918

SEQ ID NO: 579282 - RNA, 64 nt, hsa; identical to SEQ ID NO: 84919

SEQ ID NO: 579283 - RNA, 64 nt, hsa; identical to SEQ ID NO: 84920

SEQ ID NO: 579284 - RNA, 64 nt, hsa; identical to SEQ ID NO: 84921

SEQ ID NO: 579285 - RNA, 64 nt, hsa; identical to SEQ ID NO: 84922

SEQ ID NO: 579286 - RNA, 64 nt, hsa; identical to SEQ ID NO: 84923

SEQ ID NO: 579287 - RNA, 64 nt, hsa; identical to SEQ ID NO: 84924

SEQ ID NO: 579288 - RNA, 64 nt, hsa; identical to SEQ ID NO: 84925

SEQ ID NO: 579289 - RNA, 64 nt, hsa; identical to SEQ ID NO: 84926

SEQ ID NO: 579290 - RNA, 64 nt, hsa; identical to SEQ ID NO: 84927

SEQ ID NO: 579291 - RNA, 64 nt, hsa; identical to SEQ ID NO: 84928

SEQ ID NO: 579292 - RNA, 64 nt, hsa; identical to SEQ ID NO: 84929

SEQ ID NO: 579293 - RNA, 64 nt, hsa; identical to SEQ ID NO: 84930

SEQ ID NO: 579294 - RNA, 64 nt, hsa; identical to SEQ ID NO: 84931

SEQ ID NO: 579295 - RNA, 64 nt, hsa; identical to SEQ ID NO: 84932

SEQ ID NO: 579296 - RNA, 64 nt, hsa; identical to SEQ ID NO: 84933

SEQ ID NO: 579297 - RNA, 64 nt, hsa; identical to SEQ ID NO: 84934

SEQ ID NO: 579298 - RNA, 64 nt, hsa; identical to SEQ ID NO: 84935

SEQ ID NO: 579299 - RNA, 64 nt, hsa; identical to SEQ ID NO: 84936

SEQ ID NO: 579300 - RNA, 64 nt, hsa; identical to SEQ ID NO: 84937

SEQ ID NO: 579301 - RNA, 64 nt, hsa; identical to SEQ ID NO: 84938

SEQ ID NO: 579302 - RNA, 64 nt, hsa; identical to SEQ ID NO: 84939

SEQ ID NO: 579303 - RNA, 64 nt, hsa; identical to SEQ ID NO: 84940

SEQ ID NO: 579304 - RNA, 64 nt, hsa; identical to SEQ ID NO: 84941

SEQ ID NO: 579305 - RNA, 64 nt, hsa; identical to SEQ ID NO: 84942

SEQ ID NO: 579306 - RNA, 64 nt, hsa; identical to SEQ ID NO: 84943

SEQ ID NO: 579307 - RNA, 64 nt, hsa; identical to SEQ ID NO: 84944

SEQ ID NO: 579308 - RNA, 64 nt, hsa; identical to SEQ ID NO: 84945

SEQ ID NO: 579309 - RNA, 64 nt, hsa; identical to SEQ ID NO: 84946

SEQ ID NO: 579310 - RNA, 64 nt, hsa; identical to SEQ ID NO: 84947

SEQ ID NO: 579311 - RNA, 64 nt, hsa; identical to SEQ ID NO: 84948

SEQ ID NO: 579312 - RNA, 64 nt, hsa; identical to SEQ ID NO: 84949

SEQ ID NO: 579313 - RNA, 64 nt, hsa; identical to SEQ ID NO: 84950

SEQ ID NO: 579314 - RNA, 64 nt, hsa; identical to SEQ ID NO: 84951

SEQ ID NO: 579315 - RNA, 64 nt, hsa; identical to SEQ ID NO: 84952

SEQ ID NO: 579316 - RNA, 64 nt, hsa; identical to SEQ ID NO: 84953

SEQ ID NO: 579317 - RNA, 64 nt, hsa; identical to SEQ ID NO: 84954

SEQ ID NO: 579318 - RNA, 64 nt, hsa; identical to SEQ ID NO: 84955

SEQ ID NO: 579319 - RNA, 64 nt, hsa; identical to SEQ ID NO: 84956

SEQ ID NO: 579320 - RNA, 64 nt, hsa; identical to SEQ ID NO: 84957

SEQ ID NO: 579321 - RNA, 64 nt, hsa; identical to SEQ ID NO: 84958

SEQ ID NO: 579322 - RNA, 64 nt, hsa; identical to SEQ ID NO: 84959

SEQ ID NO: 579323 - RNA, 64 nt, hsa; identical to SEQ ID NO: 84960

SEQ ID NO: 579324 - RNA, 64 nt, hsa; identical to SEQ ID NO: 84961

SEQ ID NO: 579325 - RNA, 64 nt, hsa; identical to SEQ ID NO: 84962

SEQ ID NO: 579326 - RNA, 64 nt, hsa; identical to SEQ ID NO: 84963

SEQ ID NO: 579327 - RNA, 64 nt, hsa; identical to SEQ ID NO: 84964

SEQ ID NO: 579328 - RNA, 64 nt, hsa; identical to SEQ ID NO: 84965

SEQ ID NO: 579329 - RNA, 64 nt, hsa; identical to SEQ ID NO: 84966

SEQ ID NO: 579330 - RNA, 64 nt, hsa; identical to SEQ ID NO: 84967

SEQ ID NO: 579331 - RNA, 64 nt, hsa; identical to SEQ ID NO: 84968

SEQ ID NO: 579332 - RNA, 64 nt, hsa; identical to SEQ ID NO: 84969

SEQ ID NO: 579333 - RNA, 64 nt, hsa; identical to SEQ ID NO: 84970

SEQ ID NO: 579334 - RNA, 64 nt, hsa; identical to SEQ ID NO: 84971

SEQ ID NO: 579335 - RNA, 64 nt, hsa; identical to SEQ ID NO: 84972

SEQ ID NO: 579336 - RNA, 58 nt, hsa; identical to SEQ ID NO: 84973

SEQ ID NO: 579337 - RNA, 64 nt, hsa; identical to SEQ ID NO: 84974

SEQ ID NO: 579338 - RNA, 64 nt, hsa; identical to SEQ ID NO: 84975

SEQ ID NO: 579339 - RNA, 64 nt, hsa; identical to SEQ ID NO: 84976

SEQ ID NO: 579340 - RNA, 64 nt, hsa; identical to SEQ ID NO: 84977

SEQ ID NO: 579341 - RNA, 64 nt, hsa; identical to SEQ ID NO: 84978

SEQ ID NO: 579342 - RNA, 64 nt, hsa; identical to SEQ ID NO: 84979

SEQ ID NO: 579343 - RNA, 64 nt, hsa; identical to SEQ ID NO: 84980

SEQ ID NO: 579344 - RNA, 64 nt, hsa; identical to SEQ ID NO: 84981

SEQ ID NO: 579345 - RNA, 64 nt, hsa; identical to SEQ ID NO: 84982

SEQ ID NO: 579346 - RNA, 64 nt, hsa; identical to SEQ ID NO: 84983

SEQ ID NO: 579347 - RNA, 64 nt, hsa; identical to SEQ ID NO: 84984

SEQ ID NO: 579348 - RNA, 64 nt, hsa; identical to SEQ ID NO: 84985

SEQ ID NO: 579349 - RNA, 64 nt, hsa; identical to SEQ ID NO: 84986

SEQ ID NO: 579350 - RNA, 64 nt, hsa; identical to SEQ ID NO: 84987

SEQ ID NO: 579351 - RNA, 64 nt, hsa; identical to SEQ ID NO: 84988

SEQ ID NO: 579352 - RNA, 64 nt, hsa; identical to SEQ ID NO: 84989

SEQ ID NO: 579353 - RNA, 64 nt, hsa; identical to SEQ ID NO: 84990

SEQ ID NO: 579354 - RNA, 64 nt, hsa; identical to SEQ ID NO: 84991

SEQ ID NO: 579355 - RNA, 64 nt, hsa; identical to SEQ ID NO: 84992

SEQ ID NO: 579356 - RNA, 64 nt, hsa; identical to SEQ ID NO: 84993

SEQ ID NO: 579357 - RNA, 64 nt, hsa; identical to SEQ ID NO: 84994

SEQ ID NO: 579358 - RNA, 64 nt, hsa; identical to SEQ ID NO: 84995

SEQ ID NO: 579359 - RNA, 64 nt, hsa; identical to SEQ ID NO: 84996

SEQ ID NO: 579360 - RNA, 64 nt, hsa; identical to SEQ ID NO: 84997

SEQ ID NO: 579361 - RNA, 64 nt, hsa; identical to SEQ ID NO: 84998

SEQ ID NO: 579362 - RNA, 64 nt, hsa; identical to SEQ ID NO: 84999

SEQ ID NO: 579363 - RNA, 64 nt, hsa; identical to SEQ ID NO: 85000

SEQ ID NO: 579364 - RNA, 64 nt, hsa; identical to SEQ ID NO: 85001

SEQ ID NO: 579365 - RNA, 64 nt, hsa; identical to SEQ ID NO: 85002

SEQ ID NO: 579366 - RNA, 64 nt, hsa; identical to SEQ ID NO: 85003

SEQ ID NO: 579367 - RNA, 64 nt, hsa; identical to SEQ ID NO: 128910

SEQ ID NO: 579368 - RNA, 64 nt, hsa; identical to SEQ ID NO: 128911

SEQ ID NO: 579369 - RNA, 64 nt, hsa; identical to SEQ ID NO: 128912

SEQ ID NO: 579370 - RNA, 64 nt, hsa; identical to SEQ ID NO: 128913

SEQ ID NO: 579371 - RNA, 64 nt, hsa; identical to SEQ ID NO: 128914

SEQ ID NO: 579372 - RNA, 64 nt, hsa; identical to SEQ ID NO: 128915

SEQ ID NO: 579373 - RNA, 64 nt, hsa; identical to SEQ ID NO: 128916

SEQ ID NO: 579374 - RNA, 64 nt, hsa; identical to SEQ ID NO: 128917

SEQ ID NO: 579375 - RNA, 64 nt, hsa; identical to SEQ ID NO: 128918

SEQ ID NO: 579376 - RNA, 64 nt, hsa; identical to SEQ ID NO: 128919

SEQ ID NO: 579377 - RNA, 64 nt, hsa; identical to SEQ ID NO: 128920

SEQ ID NO: 579378 - RNA, 64 nt, hsa; identical to SEQ ID NO: 128921

SEQ ID NO: 579379 - RNA, 64 nt, hsa; identical to SEQ ID NO: 128922

SEQ ID NO: 579380 - RNA, 64 nt, hsa; identical to SEQ ID NO: 128923

SEQ ID NO: 579381 - RNA, 64 nt, hsa; identical to SEQ ID NO: 128924

SEQ ID NO: 579382 - RNA, 64 nt, hsa; identical to SEQ ID NO: 128925

SEQ ID NO: 579383 - RNA, 64 nt, hsa; identical to SEQ ID NO: 128926

SEQ ID NO: 579384 - RNA, 64 nt, hsa; identical to SEQ ID NO: 128927

SEQ ID NO: 579385 - RNA, 64 nt, hsa; identical to SEQ ID NO: 128928

SEQ ID NO: 579386 - RNA, 64 nt, hsa; identical to SEQ ID NO: 128929

SEQ ID NO: 579387 - RNA, 64 nt, hsa; identical to SEQ ID NO: 128930

SEQ ID NO: 579388 - RNA, 64 nt, hsa; identical to SEQ ID NO: 128931

SEQ ID NO: 579389 - RNA, 64 nt, hsa; identical to SEQ ID NO: 128932

SEQ ID NO: 579390 - RNA, 64 nt, hsa; identical to SEQ ID NO: 128933

SEQ ID NO: 579391 - RNA, 64 nt, hsa; identical to SEQ ID NO: 128934

SEQ ID NO: 579392 - RNA, 64 nt, hsa; identical to SEQ ID NO: 128935

SEQ ID NO: 579393 - RNA, 64 nt, hsa; identical to SEQ ID NO: 128936

SEQ ID NO: 579394 - RNA, 64 nt, hsa; identical to SEQ ID NO: 128937

SEQ ID NO: 579395 - RNA, 64 nt, hsa; identical to SEQ ID NO: 128938

SEQ ID NO: 579396 - RNA, 64 nt, hsa; identical to SEQ ID NO: 128939

SEQ ID NO: 579397 - RNA, 64 nt, hsa; identical to SEQ ID NO: 128940

SEQ ID NO: 579398 - RNA, 64 nt, hsa; identical to SEQ ID NO: 128941

SEQ ID NO: 579399 - RNA, 64 nt, hsa; identical to SEQ ID NO: 128942

SEQ ID NO: 579400 - RNA, 64 nt, hsa; identical to SEQ ID NO: 128943

SEQ ID NO: 579401 - RNA, 64 nt, hsa; identical to SEQ ID NO: 246263

SEQ ID NO: 579402 - RNA, 64 nt, hsa; identical to SEQ ID NO: 246264

SEQ ID NO: 579403 - RNA, 64 nt, hsa; identical to SEQ ID NO: 246265

SEQ ID NO: 579404 - RNA, 64 nt, hsa; identical to SEQ ID NO: 246266

SEQ ID NO: 579405 - RNA, 64 nt, hsa; identical to SEQ ID NO: 246267

SEQ ID NO: 579406 - RNA, 64 nt, hsa; identical to SEQ ID NO: 246268

SEQ ID NO: 579407 - RNA, 64 nt, hsa; identical to SEQ ID NO: 226265

SEQ ID NO: 579408 - RNA, 64 nt, hsa; identical to SEQ ID NO: 226266

SEQ ID NO: 579409 - RNA, 64 nt, hsa; identical to SEQ ID NO: 226267

SEQ ID NO: 579410 - RNA, 64 nt, hsa; identical to SEQ ID NO: 226268

SEQ ID NO: 579411 - RNA, 64 nt, hsa; identical to SEQ ID NO: 226269

SEQ ID NO: 579412 - RNA, 64 nt, hsa; identical to SEQ ID NO: 226270

SEQ ID NO: 579413 - RNA, 64 nt, hsa; identical to SEQ ID NO: 226271

SEQ ID NO: 579414 - RNA, 64 nt, hsa; identical to SEQ ID NO: 226272

SEQ ID NO: 579415 - RNA, 64 nt, hsa; identical to SEQ ID NO: 226273

SEQ ID NO: 579416 - RNA, 64 nt, hsa; identical to SEQ ID NO: 226274

SEQ ID NO: 579417 - RNA, 64 nt, hsa; identical to SEQ ID NO: 226275

SEQ ID NO: 579418 - RNA, 64 nt, hsa; identical to SEQ ID NO: 226276

SEQ ID NO: 579419 - RNA, 64 nt, hsa; identical to SEQ ID NO: 226277

SEQ ID NO: 579420 - RNA, 64 nt, hsa; identical to SEQ ID NO: 226278

SEQ ID NO: 579421 - RNA, 64 nt, hsa; identical to SEQ ID NO: 226279

SEQ ID NO: 579422 - RNA, 64 nt, hsa; identical to SEQ ID NO: 226280

SEQ ID NO: 579423 - RNA, 64 nt, hsa; identical to SEQ ID NO: 226281

SEQ ID NO: 579424 - RNA, 64 nt, hsa; identical to SEQ ID NO: 226282

SEQ ID NO: 579425 - RNA, 64 nt, hsa; identical to SEQ ID NO: 226283

SEQ ID NO: 579426 - RNA, 64 nt, hsa; identical to SEQ ID NO: 226284

SEQ ID NO: 579427 - RNA, 64 nt, hsa; identical to SEQ ID NO: 226285

SEQ ID NO: 579428 - RNA, 64 nt, hsa; identical to SEQ ID NO: 226286

SEQ ID NO: 579429 - RNA, 64 nt, hsa; identical to SEQ ID NO: 226287

SEQ ID NO: 579430 - RNA, 64 nt, hsa; identical to SEQ ID NO: 226288

SEQ ID NO: 579431 - RNA, 64 nt, hsa; identical to SEQ ID NO: 226289

SEQ ID NO: 579432 - RNA, 64 nt, hsa; identical to SEQ ID NO: 226290

SEQ ID NO: 579433 - RNA, 64 nt, hsa; identical to SEQ ID NO: 226291

SEQ ID NO: 579434 - RNA, 64 nt, hsa; identical to SEQ ID NO: 226292

SEQ ID NO: 579435 - RNA, 64 nt, hsa; identical to SEQ ID NO: 226293

SEQ ID NO: 579436 - RNA, 64 nt, hsa; identical to SEQ ID NO: 226294

SEQ ID NO: 579437 - RNA, 64 nt, hsa; identical to SEQ ID NO: 226295

SEQ ID NO: 579438 - RNA, 64 nt, hsa; identical to SEQ ID NO: 226296

SEQ ID NO: 579439 - RNA, 64 nt, hsa; identical to SEQ ID NO: 226297

SEQ ID NO: 579440 - RNA, 64 nt, hsa; identical to SEQ ID NO: 226298

SEQ ID NO: 579441 - RNA, 64 nt, hsa; identical to SEQ ID NO: 226299

SEQ ID NO: 579442 - RNA, 64 nt, hsa; identical to SEQ ID NO: 226300

SEQ ID NO: 579443 - RNA, 64 nt, hsa; identical to SEQ ID NO: 226301

SEQ ID NO: 579444 - RNA, 64 nt, hsa; identical to SEQ ID NO: 226302

SEQ ID NO: 579445 - RNA, 64 nt, hsa; identical to SEQ ID NO: 226303

SEQ ID NO: 579446 - RNA, 64 nt, hsa; identical to SEQ ID NO: 226304

SEQ ID NO: 579447 - RNA, 64 nt, hsa; identical to SEQ ID NO: 226305

SEQ ID NO: 579448 - RNA, 64 nt, hsa; identical to SEQ ID NO: 226306

SEQ ID NO: 579449 - RNA, 64 nt, hsa; identical to SEQ ID NO: 226307

SEQ ID NO: 579450 - RNA, 64 nt, hsa; identical to SEQ ID NO: 226308

SEQ ID NO: 579451 - RNA, 64 nt, hsa; identical to SEQ ID NO: 226309

SEQ ID NO: 579452 - RNA, 64 nt, hsa; identical to SEQ ID NO: 226310

SEQ ID NO: 579453 - RNA, 64 nt, hsa; identical to SEQ ID NO: 226311

SEQ ID NO: 579454 - RNA, 64 nt, hsa; identical to SEQ ID NO: 226312

SEQ ID NO: 579455 - RNA, 64 nt, hsa; identical to SEQ ID NO: 226313

SEQ ID NO: 579456 - RNA, 64 nt, hsa
gaacagauggcugaggcugcagacucaggcccaggacacucaaccccaggaggggagccgcucg

SEQ ID NO: 579457 - RNA, 64 nt, hsa
ucacuucugggugcaagaggcuuucuagaccuuagacacucaagauuacggucccgggccagua

SEQ ID NO: 579458 - RNA, 64 nt, hsa
gccacugugaagagaaccauaucaagacucuuuggacacucacacggacacucaaaagcugggc

SEQ ID NO: 579459 - RNA, 64 nt, hsa
agaaccauaucaagacucuuuggacacucacacggacacucaaaagcugggcagguuggugggg

SEQ ID NO: 579460 - RNA, 64 nt, hsa
uaugcaggugaauuguggaaaaugucauguagcugacacucaagaaauagggauuccuaauaau

SEQ ID NO: 579461 - RNA, 64 nt, hsa
ugaggacacccacgaauggcaaaucuccacgcuagacacucaauacagguaaauaggccaccag

SEQ ID NO: 579462 - RNA, 64 nt, hsa
ugggauccaccugucaguccccagcgacucucaugacacucauucugcagcaccgccucuuggg

SEQ ID NO: 579463 - RNA, 64 nt, hsa
ccacgccggaagaguccuggagcuaaagcuggaagacacucagcucucuaagcaggggcucggc

SEQ ID NO: 579464 - RNA, 64 nt, hsa; identical to SEQ ID NO: 236284

SEQ ID NO: 579465 - RNA, 64 nt, hsa; identical to SEQ ID NO: 236285

SEQ ID NO: 579466 - RNA, 64 nt, hsa; identical to SEQ ID NO: 236286

SEQ ID NO: 579467 - RNA, 64 nt, hsa; identical to SEQ ID NO: 236287

SEQ ID NO: 579468 - RNA, 64 nt, hsa; identical to SEQ ID NO: 236288

SEQ ID NO: 579469 - RNA, 64 nt, hsa; identical to SEQ ID NO: 236289

SEQ ID NO: 579470 - RNA, 64 nt, hsa
caaaauggaaauugucggucauauuucuagaacuuuaaagaaaaaagaauguuauauuaguuuu

SEQ ID NO: 579471 - RNA, 64 nt, hsa
uuacauacccaaaaccuuaacuaugacuaagaaauuaaagaagaaaaccagcaaacuaaaacuu

SEQ ID NO: 579472 - RNA, 64 nt, hsa
gcaaaaucuuaacaggaacuguauuuucuauauuuuaaagaauuuuauuugucccacuuuuacu

SEQ ID NO: 579473 - RNA, 64 nt, hsa
ccacuuuuacuaaacaguggcagcagauuuuaaguuaaagaauauggaauauaguaaaauaagu

SEQ ID NO: 579474 - RNA, 64 nt, hsa
uuacccuaaacuguuuaaauaaagagcucuauuuuuaaagaaaaaagguacaauugaauggaaa

SEQ ID NO: 579475 - RNA, 64 nt, hsa
gagccaccgcgcccagccaaaccuuacuauuuuuuuaaagaauuuuuuccagaguuuaauuucu

SEQ ID NO: 579476 - RNA, 64 nt, hsa
uacaauaaugauaauuuauuagucuuucuguuauuuaaagaauaaaaacaugcuuauaaaagac

SEQ ID NO: 579477 - RNA, 64 nt, hsa
augaagcagaucaacuuaaaggauaauaaaauuuuuaaagaaaagauauucuaauguacucuca

SEQ ID NO: 579478 - RNA, 64 nt, hsa
uucaaaaaagaauaaaaaguuugaauagcuauuauuaaagaaaagccaugucuucaacaucuga

SEQ ID NO: 579479 - RNA, 64 nt, hsa
gucccaccugggcaacauaguaagaucuugucucuuaaagaaaaaaaaaaaagguacuuagagg

SEQ ID NO: 579480 - RNA, 64 nt, hsa
cccagcaggagggauugcugggauuguuuuuucuuuaaagaagaauguuaauauuuuacuuuua

SEQ ID NO: 579481 - RNA, 64 nt, hsa
gacacacaugacgcaccaguuacagggguuguuuuuaaagaaaaaaacaaucccagcaggaggg

SEQ ID NO: 579482 - RNA, 64 nt, hsa
uugggucuucuccaaaguaaauugcauggacuucuuaaagaaguuugaaaucaguaaaaagaca

SEQ ID NO: 579483 - RNA, 64 nt, hsa
acugaccacaaagaagaaaauucugucucaaaaauuaaagaauuuuguuuguuauuguuguucu

SEQ ID NO: 579484 - RNA, 64 nt, hsa
gaaauguucugguggguugaaaaacguucuuauuuuaaagaaagguugugcucgcuacacugcu

SEQ ID NO: 579485 - RNA, 64 nt, hsa
aaucuggaauagagaacguucacacuucgcuccuuuaaagaagcgaccccagaucugcaaggua

SEQ ID NO: 579486 - RNA, 64 nt, hsa
ugcacuuuuuuuacuucgucuucgcccucugaaauuaaagaaaugaaaaaaaaaaacaauaucu

SEQ ID NO: 579487 - RNA, 64 nt, hsa
aaccuauguguuaucauuacagcuuuggcugcuguuaaagaauccagcucucuauuuugauaaa

SEQ ID NO: 579488 - RNA, 64 nt, hsa
gcucuaauuccacagguaauacaauuuagugcaauuaaagaaacacggcuuguauuuuuaugag

SEQ ID NO: 579489 - RNA, 64 nt, hsa
uuuaguauaugaaaauuauuacucuuuuugggguuuaaagaaauggucugcauaaccugaauga

SEQ ID NO: 579490 - RNA, 64 nt, hsa
aguagcuaaaauuagaaaaaaacaaaauagaugcuuaaagaauuugcauccauuuuugagucua

SEQ ID NO: 579491 - RNA, 64 nt, hsa
uuggcuguaugucaaauugugcaaaauauugguauuaaagaaugcugcaacuuuuuuaugucuc

SEQ ID NO: 579492 - RNA, 64 nt, hsa
uaauuaggauaacuaaaauucugggccuaauuuuuuaaagaauccaagacaaacuaaacuuuac

SEQ ID NO: 579493 - RNA, 64 nt, hsa
aguauuauuugcaauuuuauuaguuacagugcuauuaaagaauaugugcuccuuuuuauuauau

SEQ ID NO: 579494 - RNA, 64 nt, hsa
ugggcacagagcaucacaugagcuguuucucuccuuaaagaagaucccuggaaaggaugcuuuu

SEQ ID NO: 579495 - RNA, 64 nt, hsa
uaggugugauauaguguuagauuuuuuugauguauuaaagaaugcaucuccaauccuuaggcca

SEQ ID NO: 579496 - RNA, 64 nt, hsa
uagugcccaggcauaugagaguuguccuacgagguuaaagaacacacuguuccacuguauggcu

SEQ ID NO: 579497 - RNA, 64 nt, hsa
uguggaaaaguucuuuuuuuuucuuuuuuuuuucuuaaagaagggcagccaagguaguaaccua

SEQ ID NO: 579498 - RNA, 64 nt, hsa
ccauuuucuuuugcaauuguaguuuuauguacuguuaaagaauuguauugaauucuuuuuagau

SEQ ID NO: 579499 - RNA, 64 nt, hsa
ucauuuucuuuugcaauuuuaguuuuauguacuguuaaagaauuguacugaauucuuuuuagau

SEQ ID NO: 579500 - RNA, 64 nt, hsa
cuguaguaacuaugauggguguaacaacauuuuuuuaaagaagggaaucuguuuaucgcuuuuc

SEQ ID NO: 579501 - RNA, 64 nt, hsa
aaaugauagcuaucuaacaacuaauuacuaauuuuuaaagaacaaaucacacauuuaaaaaauc

SEQ ID NO: 579502 - RNA, 64 nt, hsa
uguagacuauacuguaaaaauucaguuuguugcuuuaaagaaacaaacugauaccugaauuuug

SEQ ID NO: 579503 - RNA, 64 nt, hsa
caaacuuaguaacucuguuaaauauuuggaggauuuaaagaacaucccaguuugaauucauuuc

SEQ ID NO: 579504 - RNA, 64 nt, hsa
auggcggcucacaagugaaaacugauuucccauuuuaaagaagaaguggaucuaaauggaagca

SEQ ID NO: 579505 - RNA, 64 nt, hsa
gcuauuuuugcacagguacauagcucucauguauuuaaagaacacugcaguguuauuuucuuug

SEQ ID NO: 579506 - RNA, 64 nt, hsa
cagacucuugugaaguuuucuuaaauuguucacuuuaaagaaaaugacguaccaacaaugauuu

SEQ ID NO: 579507 - RNA, 64 nt, hsa
aaaugugaaacugcugucuuuuauauuaaaguaauuaaagaaaauguauugugauugaaauuau

SEQ ID NO: 579508 - RNA, 64 nt, hsa
guuuccuguuucuggaauuccuuguuagggaacuuuaaagaagaaaagaaaaacuugaauugug

SEQ ID NO: 579509 - RNA, 64 nt, hsa
cuaguuuucaaauuuugugugcgucuguaaguucuuaaagaaccagcuucuuagaauguucagu

SEQ ID NO: 579510 - RNA, 64 nt, hsa
aaaccaaaaaaaaaaacaaaaaaaaacuuuuuaauuaaagaaccuaguuugcuaugcuuaaaau

SEQ ID NO: 579511 - RNA, 64 nt, hsa
auacaguucuuguauuugaaaggaauugauccuuuuaaagaaacaugguguauauuguucuuac

SEQ ID NO: 579512 - RNA, 64 nt, hsa
uucacugauguagauuaauaauguaaguucugauuuaaagaaugguggcaaaauggugcaugua

SEQ ID NO: 579513 - RNA, 64 nt, hsa
aguuuguuguugcaguccuucuuugcaccuuauuuuaaagaauaaaugaaacauuuuucugguu

SEQ ID NO: 579514 - RNA, 64 nt, hsa
uguauaaugguagguguuugugugugauucauuuuuaaagaaauauuuuucucaagcuccuauu

SEQ ID NO: 579515 - RNA, 64 nt, hsa
aauaaaaaugugugcucuuuacuguuuuucauuuuuaaagaauauuauuauggaagcacgauuu

SEQ ID NO: 579516 - RNA, 64 nt, hsa
acuuuucaauauuuucauauuucuuaaccagauuuuaaagaaauuuguuguuaguuacgugaaa

SEQ ID NO: 579517 - RNA, 64 nt, hsa
cauguaaaacaggacaauuuaaaaauuuuaaauuuuaaagaauuaaaaauuuuaaaaauuuaaa

SEQ ID NO: 579518 - RNA, 64 nt, hsa
uuaauugaugccuuuauugucccaaauuuaccacuuaaagaauucuauuuucauuucuguccug

SEQ ID NO: 579519 - RNA, 64 nt, hsa
ccugcaaagccuaaaagauuuacuacuugucuccuuaaagaaaaaguuugccagcuccugaucu

SEQ ID NO: 579520 - RNA, 64 nt, hsa
aaguauuugauguuuuguuugaaacaauacagcauuaaagaaccaauguuauucacuaauauca

SEQ ID NO: 579521 - RNA, 64 nt, hsa
uugcacuuuuguugaggaaagacaguguaaauaguuaaagaauguugauaaaauugaaacauuu

SEQ ID NO: 579522 - RNA, 64 nt, hsa
uccucugccccauucacuauuuaccaauugggaauuaaagaaauaauuaauuugaacaguuaug

SEQ ID NO: 579523 - RNA, 64 nt, hsa
guuguauugcauuuuugggggaagcaaauugacuuuaaagaaaaaaguuguggcaaaagaugcu

SEQ ID NO: 579524 - RNA, 64 nt, hsa
ggugcugugugauccuuggaugaaaaacauauauuuaaagaaauggagaguguuuauuuuguuu

SEQ ID NO: 579525 - RNA, 64 nt, hsa
cucugagcccugcauugcaagggcgucuuuugcuuuaaagaauucuuaguuuugccacaacagc

SEQ ID NO: 579526 - RNA, 64 nt, hsa
uucacacaccacuuaauggggaaauaguuaauuguuaaagaaaacuucuuguagccucacauuc

SEQ ID NO: 579527 - RNA, 64 nt, hsa
cugcaucacaauugagguaauguagagcaacauguuaaagaaugaugguuagcagaagcuguug

SEQ ID NO: 579528 - RNA, 64 nt, hsa
uuuuuuauuuuuauauauuuuuucugacuccuauuuaaagaaccccuuagguuucuaaguaccc

SEQ ID NO: 579529 - RNA, 64 nt, hsa
auagcacucaucuuucaagagagggcagucaucuuuaaagaacauuuuauuuuuauacaauguu

SEQ ID NO: 579530 - RNA, 64 nt, hsa
ugcaucuguauccugcugggagaggcaauuacccuuaaagaaucugggugguaucucugccuuu

SEQ ID NO: 579531 - RNA, 64 nt, hsa
uuugccaaggcacacaaaaauagggaacauuuucuuaaagaacacuccaauucagccugagugc

SEQ ID NO: 579532 - RNA, 64 nt, hsa
uuugaaaaccuucaaauuagaauacauuguacaguuaaagaaauugacuugguacuuaaaagaa

SEQ ID NO: 579533 - RNA, 64 nt, hsa
ugaacagagaggccaugggaagauuugaaaauuauuaaagaaaaauuccuacagauuuucaaug

SEQ ID NO: 579534 - RNA, 64 nt, hsa
aggguuuuuaguuuuaucuacucuucuauugaaguuaaagaaagaaaaaaagauuuuuuuauuu

SEQ ID NO: 579535 - RNA, 64 nt, hsa
guaauugguugucacuguuguacggugucuagaauuaaagaauacauguaaacuuucaugguau

SEQ ID NO: 579536 - RNA, 64 nt, hsa
acacauuuccauucauggauauuugucaacagauuuaaagaaaaccacaguuauuaauuaaaga

SEQ ID NO: 579537 - RNA, 64 nt, hsa
ugucaacagauuuaaagaaaaccacaguuauuaauuaaagaaaauuaauuauguguaguuauaa

SEQ ID NO: 579538 - RNA, 64 nt, hsa
cugaccaugugauguacauuuauuaugucuuuuuuuaaagaauggaaauauuuauuucagaggc

SEQ ID NO: 579539 - RNA, 64 nt, hsa
cuaccaguuaaacuacuuuaauacacauucauuuuuaaagaaaauguuuguuuuaacauaaaua

SEQ ID NO: 579540 - RNA, 64 nt, hsa
guaguuuagauauucaaaaguaugcauguagaauuuaaagaauauguuaaaaauuauuaauuuu

SEQ ID NO: 579541 - RNA, 64 nt, hsa
uaugaaggauucaaugaaugaucucuagaaagauuuaaagaagaauauucagauaaggauguug

SEQ ID NO: 579542 - RNA, 64 nt, hsa
acacacacacacacacacacaguuuaaugaaggcuuaaagaauccaaggagacagauguuguau

SEQ ID NO: 579543 - RNA, 64 nt, hsa
ucaaaucuguuuuccugaguauaaauaagaguauuuaaagaaauaauuuggauugcuuuuguuu

SEQ ID NO: 579544 - RNA, 64 nt, hsa
gaucguuccauacaguaccuuguuuaucugcuucuuaaagaaucagccgagacaccauaaaaga

SEQ ID NO: 579545 - RNA, 64 nt, hsa
ugaccacaguugauugaaccagagcacuuauugcuuaaagaauaacagaguucuagagcugggg

SEQ ID NO: 579546 - RNA, 64 nt, hsa
aaguguuagagauggugaauauauuccauuuuaguuaaagaacaaauuuccugaauuuuaagca

SEQ ID NO: 579547 - RNA, 64 nt, hsa
agaauuuaaacucuuugucucauugaaaguuugguuaaagaacuugaacauauuucuaaauuug

SEQ ID NO: 579548 - RNA, 64 nt, hsa
cccaaaugggcccauuccccuaauaguuuuauuuuuaaagaaagccauacauagaaugcuucaa

SEQ ID NO: 579549 - RNA, 64 nt, hsa
aauauacaguauauauuaauaauguacaugguguuuaaagaaugguaagcauuguuaauuucug

SEQ ID NO: 579550 - RNA, 64 nt, hsa
auaccaacagugaagcuguggaaugcccagcuaguuaaagaaugcaaaggaaaauauuuucaca

SEQ ID NO: 579551 - RNA, 64 nt, hsa
cagcagucuuuagccagagaacucucuggaaccauuaaagaauuccugggggccgguugcggug

SEQ ID NO: 579552 - RNA, 64 nt, hsa
cuucuaaguugauuuuuuuccucccaagucuuuuuuaaagaaaguauacuguauuuuaccaacc

SEQ ID NO: 579553 - RNA, 64 nt, hsa
gacaaggcagaguuuaaagugaggaauuuuauauuuaaagaacuuuuugguuggauaaaaacau

SEQ ID NO: 579554 - RNA, 64 nt, hsa
acuagauuauagaguuuauuuuugcuuuuaugcuuuaaagaaugcaugcccaaaacacuacuac

SEQ ID NO: 579555 - RNA, 64 nt, hsa
ucuuuccccaaaagugaugaucucaaguccuuuuuuaaagaaugacaaauuuuaggagacuuca

SEQ ID NO: 579556 - RNA, 64 nt, hsa
cuucugaaugguuuuauuguucuuguaaucuagcuuaaagaaauguuaacugggagggugcuga

SEQ ID NO: 579557 - RNA, 64 nt, hsa
aguugcgcaaaaauuguuaaauccuuugucuuuauuaaagaaaaauuugaguaacauuaaguuu

SEQ ID NO: 579558 - RNA, 64 nt, hsa
uuggaaacauuuucauaaagcuccauggagaguuuuaaagaaacauauguagcaugauuuugua

SEQ ID NO: 579559 - RNA, 64 nt, hsa
gguuuuuuuguaaauccuuguauuccuauuuuuuuuaaagaaaaaaaaaaaaccuuaagcugca

SEQ ID NO: 579560 - RNA, 64 nt, hsa
uugcaaauguuauaaaugaacaauugggaaaugguuaaagaagugauggugcauugugugguag

SEQ ID NO: 579561 - RNA, 64 nt, hsa
uggugcauugugugguagaauauuaugcauauguuuaaagaaucauauuuucuaagauuauuug

SEQ ID NO: 579562 - RNA, 64 nt, hsa
agucagaagcucaucauuggaauucaguauuuucuuaaagaaaggaugauuuauuuucagcaac

SEQ ID NO: 579563 - RNA, 64 nt, hsa
uuguucuuuaaaauacauagacaaagcuguaaauuuaaagaaucauuuugaauauaaauuuaag

SEQ ID NO: 579564 - RNA, 64 nt, hsa
uugauuguccuggggcuaagaaagaagauaauuuuuaaagaaugggagugggcaacagugaaaa

SEQ ID NO: 579565 - RNA, 64 nt, hsa
uagacuuugcuaacuuacuaguaccagaguuauuuuaaagaaaaacacuaguguccaauuucau

SEQ ID NO: 579566 - RNA, 64 nt, hsa
aagaauauugcaaaauacaugaagcuucaugcacuuaaagaaguauuuuuagaauaagaauuug

SEQ ID NO: 579567 - RNA, 64 nt, hsa
ucugagggaaauguuuuguaaacauuuauuuuuuuuaaagaaaagaugaaaggcaggccuauuu

SEQ ID NO: 579568 - RNA, 64 nt, hsa
uaauauagauacaaagucugugucuaaauauuauuuaaagaagugauuuuucauucucuuggau

SEQ ID NO: 579569 - RNA, 64 nt, hsa
ucuccuacuaauauucccaagcuccauaugccaauuaaagaagaaacaaaaauaaaaguuuguc

SEQ ID NO: 579570 - RNA, 64 nt, hsa
cauguaauggcaguuauauuuugcaguucccacauuaaagaagaccugagaauguauccccaaa

SEQ ID NO: 579571 - RNA, 64 nt, hsa
agcauuuaaccccccuguacacaacucacuccuuuuaaagaaaaaaauugaaauguaaggcugu

SEQ ID NO: 579572 - RNA, 64 nt, hsa
aagaacccaucuguuaauguaguaaauguuggcuuuaaagaaauagcuccgauaaggacuuuuu

SEQ ID NO: 579573 - RNA, 64 nt, hsa
auaaaaucagugaguugaaaguaaaauuucuuauuuaaagaacccaucuguuaauguaguaaau

SEQ ID NO: 579574 - RNA, 64 nt, hsa
agugaucaucuguuaauuuuaaggucuuuaucauuuaaagaaacauuccucaguguaacauuug

SEQ ID NO: 579575 - RNA, 64 nt, hsa
cuguaacacuggcacugaaauaaagaccacacgguuaaagaaaucuuuccauauuguacuuuau

SEQ ID NO: 579576 - RNA, 64 nt, hsa
guagggcugcagugguggccagaauuagauaucuuuaaagaauuuuaaauacaauaaacacuuc

SEQ ID NO: 579577 - RNA, 64 nt, hsa
gaacugaugcacuauauagaacgaauuuggguuuuuaaagaaauauuaaaaguuagguacugua

SEQ ID NO: 579578 - RNA, 64 nt, hsa
auucacuugggcuuuuuuucuucccccucuuucuuuaaagaacugcucaauauucaaucuguug

SEQ ID NO: 579579 - RNA, 64 nt, hsa
uguugugaagaaccugauuugcacucuguaguguuuaaagaaacaaagaaacucuaauauugaa

SEQ ID NO: 579580 - RNA, 64 nt, hsa
uguuuggacuuuguaauuauuuuuuuagcaguaauuaaagaaaaaaguccucugugaggaauau

SEQ ID NO: 579581 - RNA, 64 nt, hsa
aagcauuugguaagcuuuaucauauauauauuuuuuaaagaagagaaaaacaccuugagccuua

SEQ ID NO: 579582 - RNA, 64 nt, hsa
acaauuagccguaauaacauuagagaaaauguuuuuaaagaagccagcucaagcaauauuaaug

SEQ ID NO: 579583 - RNA, 64 nt, hsa
ggaaugugcaacauucucugcccacucuggguccuuaaagaaacaaaguccaaaagucacuuuu

SEQ ID NO: 579584 - RNA, 64 nt, hsa
gguucuuuuacuaaguguucaaauaccagugaacuuaaagaauuugucaauccuagccuuccaa

SEQ ID NO: 579585 - RNA, 64 nt, hsa
ggaauaccgcugauugugcucuuuuuauccuacuuuaaagaagcuuucaugauuagauuugagc

SEQ ID NO: 579586 - RNA, 64 nt, hsa
ucuaaggaaaggaugcaugagcuaacaccugacauuaaagaagcaagccaagugaggagccagg

SEQ ID NO: 579587 - RNA, 64 nt, hsa
uauuaaaguaauuuuuauaugucuauuauuucauuuaaagaauaugcugugcuaauaauggagu

SEQ ID NO: 579588 - RNA, 64 nt, hsa
auggcaucucauuuuucaauacaugcucuuuugauuaaagaaacuuauuacuguugucaacuga

SEQ ID NO: 579589 - RNA, 64 nt, hsa
cuuugugaaagaaugugcuuugauucgaagggucuuaaagaauuuuuuuaaucgucaaccacuu

SEQ ID NO: 579590 - RNA, 64 nt, hsa
uagagaauguucccaauuugaauuuagggugauuuuaaagaacagugagaaagggcauacaucc

SEQ ID NO: 579591 - RNA, 64 nt, hsa
gccuguuuucuugcaaauuuagcacuuggaacauuuaaagaaaggucuaugcugucauaugggg

SEQ ID NO: 579592 - RNA, 64 nt, hsa
ccugccucaugguggcaacaugguucuugaacaauuaaagaaacaaaugacuuuuuggaauagc

SEQ ID NO: 579593 - RNA, 64 nt, hsa
uuuuguaauauauauaaggacuggaauuguguuuuuaaagaaaagcauucaaguaugacaauau

SEQ ID NO: 579594 - RNA, 64 nt, hsa
ucuaaaucuuuuucaccauggaugaaacuauaacuuaaagaauaauacuuagaaggguuaauug

SEQ ID NO: 579595 - RNA, 64 nt, hsa
auuuauucauguacaauuuugguuacuugaauuguuaaagaaaacauuguuuuugacuauggga

SEQ ID NO: 579596 - RNA, 64 nt, hsa
uaguuaggauaacuaaaauucugggccuaauuuuuuaaagaauccaagacaaacuaaacuuuac

SEQ ID NO: 579597 - RNA, 64 nt, hsa
aauggcuguaugugaaauuugcaaaauacugguauuaaagaacgcugcagcuuuuuuaugucac

SEQ ID NO: 579598 - RNA, 64 nt, hsa; identical to SEQ ID NO: 579596

SEQ ID NO: 579599 - RNA, 64 nt, hsa; identical to SEQ ID NO: 579597

SEQ ID NO: 579600 - RNA, 64 nt, hsa
accuuguagaagcucaaguguggaaaagaaaagcuuaaagaagcccuaaccaagcuguaucuuc

SEQ ID NO: 579601 - RNA, 63 nt, hsa
ucacacugaauccuuuaacuuggccaaaggacccuuaaagaacaucuaguccaaugucaacau

SEQ ID NO: 579602 - RNA, 64 nt, hsa
augcuauuguucugcuauuaccagauuuauugugccacacaaaaggaucaugugugucagcagg

SEQ ID NO: 579603 - RNA, 64 nt, hsa
aaaguaaaugugaaccuugucuaaguacuguaauccacacaacacauuauaagaagcaaaccag

SEQ ID NO: 579604 - RNA, 64 nt, hsa
ucccggaucaucagcacaauugugaaacuugucaccacacaauaaaaagcagucuuagagagug

SEQ ID NO: 579605 - RNA, 64 nt, hsa
gacuuauuuguuuuaauguacagaugugggaaaaccacacaaauuccgcaguuuauucuggaug

SEQ ID NO: 579606 - RNA, 64 nt, hsa
cacuuucuuagguaauucacugcagguuaagaauccacacaaccaaguucaugggaauuuugug

SEQ ID NO: 579607 - RNA, 64 nt, hsa
cuuauccuacauuauuggaaaauaaaugagauguccacacaaauggauuauccacauaaucaaa

SEQ ID NO: 579608 - RNA, 64 nt, hsa
ucgguuacaaauccauaacaaaugacuggaaaagccacacaacucuuacauacugauauuuaga

SEQ ID NO: 579609 - RNA, 64 nt, hsa
ggggaucugcaucuagccugcauaucacauugacccacacaaaagauuuuuaaguacgaaguaa

SEQ ID NO: 579610 - RNA, 64 nt, hsa
agccugggcuguguaugccugcggaugcagugucccacacaaggacacuuccucuaggaugcca

SEQ ID NO: 579611 - RNA, 60 nt, hsa
auucuggggagaagcuauagaaagaggagcccacacaaagcuugaaagccugugccagau

SEQ ID NO: 579612 - RNA, 64 nt, hsa
acauuccuugagcaaaauauacugcugugaauuugcaaacaagaaaucugagccaaaacuugac

SEQ ID NO: 579613 - RNA, 64 nt, hsa
aaauaucugaauaggugcaguuuuaguuuaacaugcaaacaaccauuguugcuaccuauccuga

SEQ ID NO: 579614 - RNA, 64 nt, hsa
gggcugguuuuaguacucugaaggacaaaaacaagcaaacaaaaaccccugcugcagcauuuca

SEQ ID NO: 579615 - RNA, 64 nt, hsa
gagacccuaccucuuaaaaccaguuuucauuuaugcaaacaaggacaauuaagggaacccugac

SEQ ID NO: 579616 - RNA, 64 nt, hsa
gauaggaggagaguccuucucggcagagcucacugcaaacaacuggaauugagguugcacacug

SEQ ID NO: 579617 - RNA, 64 nt, hsa
ucuugacauuuucuuuuuuaggauguugguuccugcaaacaagaacugacccuaucaccucugc

SEQ ID NO: 579618 - RNA, 64 nt, hsa
aaauuagucguauuuuaauggcuugggauuuggugcaaacaaacaugauugauagcuggacaga

SEQ ID NO: 579619 - RNA, 64 nt, hsa
uccaucagcauaaugacuguguguucugagaaaugcaaacaacuuuaugaaaguguggucaucu

SEQ ID NO: 579620 - RNA, 64 nt, hsa
aaaaucaaaauacauuaggguuuacuugguuguggcaaacaaacaaaaaaugcuuucaguguug

SEQ ID NO: 579621 - RNA, 64 nt, hsa
auaauauagguguuuuguagauucuugugucacugcaaacaauaugaacuccuuuuucguauug

SEQ ID NO: 579622 - RNA, 64 nt, hsa
aguuaacaauuuuuaauggaaagagcauguuagagcaaacaaaugcauaagcaagacugagcag

SEQ ID NO: 579623 - RNA, 64 nt, hsa
ugguuugaugguuugcugcauuaaagguauuugggcaaacaaaauuggagggcaagugacugca

SEQ ID NO: 579624 - RNA, 64 nt, hsa
auaucauuuugugacuguaaacaauuauuuauuagcaaacaauugaucccagaagggcaaauug

SEQ ID NO: 579625 - RNA, 64 nt, hsa
accgaauuggguuuagucaaucacugcacugcaugcaaacaagaaacgugucacacuugugacg

SEQ ID NO: 579626 - RNA, 64 nt, hsa
aaagguuauguucauuuuucaaaaagggaaguaagcaaacaaauauugccaacucuucuauuua

SEQ ID NO: 579627 - RNA, 64 nt, hsa
gacaacuaauguuaauaagaucucaguugcacgugcaaacaaauccaaauucgaacauucuuag

SEQ ID NO: 579628 - RNA, 64 nt, hsa
uuugugcugggacugcuauacuugacauuauacugcaaacaaaacuuaaagagauaagcauuaa

SEQ ID NO: 579629 - RNA, 64 nt, hsa
aacauuuuucauaauuagugcuguacauuugauugcaaacaaauuggugauacuucuaaacuau

SEQ ID NO: 579630 - RNA, 64 nt, hsa
aagagcuuuaaaauauuuucacagauaaaaaauugcaaacaaguacucugguuaauaaaugcug

SEQ ID NO: 579631 - RNA, 64 nt, hsa
gaauacauauguguauauaagagguuauugauaaacuucugaggcagacauuugucucgcuuuu

SEQ ID NO: 579632 - RNA, 64 nt, hsa
aucccuuguacuugccuacuguaauauggauuucacuucugaacaguuuacagcacaauauuua

SEQ ID NO: 579633 - RNA, 64 nt, hsa
uguccuagaguucuuuccugaccucuagcuccauacuucugauugccuaauaaauaugacaugg

SEQ ID NO: 579634 - RNA, 64 nt, hsa
accuugauuuuggggacacacauugcaacuucccacuucugacgaaaggucuccaugcuuuugc

SEQ ID NO: 579635 - RNA, 64 nt, hsa
uggacaaaagugguagggaaauuguucccucuccacuucugaaaguaugaugauguauuaagga

SEQ ID NO: 579636 - RNA, 64 nt, hsa
ugauuuuuuuaauuacuggcuucugauuucuuucacuucugauccuuuuccuuuuucucagaug

SEQ ID NO: 579637 - RNA, 62 nt, hsa; identical to SEQ ID NO: 275089

SEQ ID NO: 579638 - RNA, 64 nt, hsa
gggcucaucgacgccugugacagggagaaaggauacuucugaacaaggagccuccaagcaaauc

SEQ ID NO: 579639 - RNA, 64 nt, hsa
ggucacuagcuuggccauagcaccucucuucuccacuucugaucugcugcuucuaaccuucuau

SEQ ID NO: 579640 - RNA, 64 nt, hsa
caggguuucaccacguuagccaugauggucucaaacuucugaccucauaauccacccaccuugg

SEQ ID NO: 579641 - RNA, 64 nt, hsa
gaugggucauauucuuuauuuggaagaaguugugacuucugacaugggugugauugucuuccua

SEQ ID NO: 579642 - RNA, 64 nt, hsa
acacauuuguaaauacauuguuugcaggacgaaaacuucugaguuacagcucaggaaaagccug

SEQ ID NO: 579643 - RNA, 64 nt, hsa
cagacagaggaggauagcucuuuccagaauccacacuucugaccucagccucggucucaugaac

SEQ ID NO: 579644 - RNA, 64 nt, hsa
gagaagaccuacuugaacagggcauauuuuuuagacuucugaacaucaguauguucgaggguac

SEQ ID NO: 579645 - RNA, 64 nt, hsa
agaaauuuagaguaguugaaaucuuuaggaaugaacuucugagggccaaaaaaugugacugacg

SEQ ID NO: 579646 - RNA, 64 nt, hsa
gucugacuucgugaauauagagaccaaguuuaccacuucugaugaagagaccaauuaagauuca

SEQ ID NO: 579647 - RNA, 64 nt, hsa
uauuucauauacuuccgucucgaugcuguuaacaacuucugauaacauggaaaauucaaggauu

SEQ ID NO: 579648 - RNA, 64 nt, hsa
gcuauguaacagauacacuacaguagaagaacuuacuucugaaaugaagggaaaaaaaccaccc

SEQ ID NO: 579649 - RNA, 64 nt, hsa
aaucuguaucgugccaaaguuguaucacuguuaaacuucugaagacauaaccaguugagucuua

SEQ ID NO: 579650 - RNA, 64 nt, hsa
gcucaacccauauuauuggcuguacauccuggucacuucugacuucuguuuuuacuaauggaag

SEQ ID NO: 579651 - RNA, 64 nt, hsa
cccggguguuuccaacgucauggaagcagcugacacuucugaaacucagccaaggacacuugau

SEQ ID NO: 579652 - RNA, 64 nt, hsa
cuuaucguugguguuuuccaguauuacaagaucaacuucugacccugugaaaugugagaaguac

SEQ ID NO: 579653 - RNA, 64 nt, hsa
ugaucucuaccccugggugagaccagaaccucagggcugauacuguugaguggcuuccucgguu

SEQ ID NO: 579654 - RNA, 64 nt, hsa
caaucuggcugucggaacagauucuggugucuugggcugauaacaguguuguugauucugauug

SEQ ID NO: 579655 - RNA, 64 nt, hsa
cagcaguaggcuguggagcggguaggagagagauggcugauacugcucacgugcgcugcaggaa

SEQ ID NO: 579656 - RNA, 64 nt, hsa
acaaaugagaucagcucuccuuccagaacgaaagggcugauaauuuuuggccuuaguuccaggu

SEQ ID NO: 579657 - RNA, 64 nt, hsa
uugaaaagacgguguuaugcuuggguguuagugaggcugauaugucaugucaaucgauaaaccc

SEQ ID NO: 579658 - RNA, 64 nt, hsa
acugacaaaagcaaaucaauaacucuaaauucugggcugauauaaagaaaaaaacaauauugga

SEQ ID NO: 579659 - RNA, 64 nt, hsa; identical to SEQ ID NO: 557328

SEQ ID NO: 579660 - RNA, 64 nt, hsa; identical to SEQ ID NO: 557329

SEQ ID NO: 579661 - RNA, 64 nt, hsa; identical to SEQ ID NO: 557330

SEQ ID NO: 579662 - RNA, 64 nt, hsa; identical to SEQ ID NO: 557331

SEQ ID NO: 579663 - RNA, 64 nt, hsa; identical to SEQ ID NO: 557332

SEQ ID NO: 579664 - RNA, 64 nt, hsa; identical to SEQ ID NO: 557333

SEQ ID NO: 579665 - RNA, 64 nt, hsa; identical to SEQ ID NO: 557334

SEQ ID NO: 579666 - RNA, 64 nt, hsa; identical to SEQ ID NO: 557335

SEQ ID NO: 579667 - RNA, 64 nt, hsa; identical to SEQ ID NO: 557336

SEQ ID NO: 579668 - RNA, 64 nt, hsa; identical to SEQ ID NO: 557337

SEQ ID NO: 579669 - RNA, 64 nt, hsa; identical to SEQ ID NO: 557338

SEQ ID NO: 579670 - RNA, 64 nt, hsa; identical to SEQ ID NO: 557339

SEQ ID NO: 579671 - RNA, 64 nt, hsa; identical to SEQ ID NO: 557340

SEQ ID NO: 579672 - RNA, 64 nt, hsa; identical to SEQ ID NO: 557341

SEQ ID NO: 579673 - RNA, 64 nt, hsa; identical to SEQ ID NO: 557342

SEQ ID NO: 579674 - RNA, 64 nt, hsa; identical to SEQ ID NO: 557343

SEQ ID NO: 579675 - RNA, 64 nt, hsa; identical to SEQ ID NO: 557344

SEQ ID NO: 579676 - RNA, 64 nt, hsa; identical to SEQ ID NO: 557345

SEQ ID NO: 579677 - RNA, 64 nt, hsa; identical to SEQ ID NO: 557346

SEQ ID NO: 579678 - RNA, 64 nt, hsa; identical to SEQ ID NO: 557347

SEQ ID NO: 579679 - RNA, 64 nt, hsa; identical to SEQ ID NO: 557348

SEQ ID NO: 579680 - RNA, 64 nt, hsa; identical to SEQ ID NO: 557349

SEQ ID NO: 579681 - RNA, 64 nt, hsa; identical to SEQ ID NO: 557350

SEQ ID NO: 579682 - RNA, 64 nt, hsa; identical to SEQ ID NO: 557351

SEQ ID NO: 579683 - RNA, 64 nt, hsa; identical to SEQ ID NO: 557352

SEQ ID NO: 579684 - RNA, 64 nt, hsa; identical to SEQ ID NO: 557353

SEQ ID NO: 579685 - RNA, 64 nt, hsa; identical to SEQ ID NO: 557354

SEQ ID NO: 579686 - RNA, 64 nt, hsa; identical to SEQ ID NO: 557355

SEQ ID NO: 579687 - RNA, 64 nt, hsa; identical to SEQ ID NO: 125759

SEQ ID NO: 579688 - RNA, 64 nt, hsa; identical to SEQ ID NO: 125760

SEQ ID NO: 579689 - RNA, 64 nt, hsa
gcagauuaauuagucaccaugaggucacugggguggccccuaacccaccaugacugguguccuu

SEQ ID NO: 579690 - RNA, 64 nt, hsa
uucacaacuuuggacuguccaacuugcuucccgaggccccuacaagccgguggccucuguagga

SEQ ID NO: 579691 - RNA, 64 nt, hsa
aauggccggcgugagccaccaugcccggcuccacggccccuacuuuucacaacuuuggacuguc

SEQ ID NO: 579692 - RNA, 64 nt, hsa
ucaauuauucaggccccuacaguugugguauugaggccccuaaaggcuucugccuuucaccaau

SEQ ID NO: 579693 - RNA, 64 nt, hsa
acuuuuccauuaauuucucaacaucaauuauucaggccccuacaguugugguauugaggccccu

SEQ ID NO: 579694 - RNA, 64 nt, hsa
cagaagcuguacuuuuaccaguuucuuugucccaccaacuuaaaaaaaaaaaguacaauucauu

SEQ ID NO: 579695 - RNA, 64 nt, hsa
ucaaccuagguuauaagacuguuauucuauagcuccaacuuaaggugccuuuuuaauucccuac

SEQ ID NO: 579696 - RNA, 58 nt, hsa
aggaaggcgacagccccuaggggccggcccaacuuagacgcggcucuccuccggcagg

SEQ ID NO: 579697 - RNA, 64 nt, hsa
uaacuuuaaacaucuuucaucuucugaaagcugcccaacuuaaauccucauagaugucuuucuc

SEQ ID NO: 579698 - RNA, 64 nt, hsa
auuuuuucuuauuugaguccaccaaaggauaaugccaacuuauauaaguucucaaaucaugccu

SEQ ID NO: 579699 - RNA, 64 nt, hsa
agaaauuuuucucauaauauauaccuaugugaaaccaacuuaucugcauaauuaaaucuaauac

SEQ ID NO: 579700 - RNA, 63 nt, hsa
gcacacacagauggucacacagagauacgcaaacacaccgaugcacacgcacauagagauaug

SEQ ID NO: 579701 - RNA, 63 nt, hsa
acaucagugcacacggaugcacagagauaugcacacaccgaugugcgcacacacagauaugca

SEQ ID NO: 579702 - RNA, 63 nt, hsa
acauggaugagcacacacacaccaaugcgcacacacaccgauguacacacacagaugcacaca

SEQ ID NO: 579703 - RNA, 63 nt, hsa
auguacacacacagaugcacacacagaugcacacacaccgaugcugacuccaugugugcuguc

SEQ ID NO: 579704 - RNA, 64 nt, hsa; identical to SEQ ID NO: 274997

SEQ ID NO: 579705 - RNA, 64 nt, hsa; identical to SEQ ID NO: 274998

SEQ ID NO: 579706 - RNA, 64 nt, hsa; identical to SEQ ID NO: 274999

SEQ ID NO: 579707 - RNA, 64 nt, hsa; identical to SEQ ID NO: 275000

SEQ ID NO: 579708 - RNA, 64 nt, hsa; identical to SEQ ID NO: 51839

SEQ ID NO: 579709 - RNA, 64 nt, hsa; identical to SEQ ID NO: 51840

SEQ ID NO: 579710 - RNA, 64 nt, hsa; identical to SEQ ID NO: 51841

SEQ ID NO: 579711 - RNA, 64 nt, hsa; identical to SEQ ID NO: 51842

SEQ ID NO: 579712 - RNA, 64 nt, hsa; identical to SEQ ID NO: 51843

SEQ ID NO: 579713 - RNA, 64 nt, hsa; identical to SEQ ID NO: 51844

SEQ ID NO: 579714 - RNA, 64 nt, hsa; identical to SEQ ID NO: 51845

SEQ ID NO: 579715 - RNA, 64 nt, hsa; identical to SEQ ID NO: 51846

SEQ ID NO: 579716 - RNA, 64 nt, hsa; identical to SEQ ID NO: 51847

SEQ ID NO: 579717 - RNA, 64 nt, hsa; identical to SEQ ID NO: 51848

SEQ ID NO: 579718 - RNA, 64 nt, hsa; identical to SEQ ID NO: 51849

SEQ ID NO: 579719 - RNA, 64 nt, hsa; identical to SEQ ID NO: 51850

SEQ ID NO: 579720 - RNA, 64 nt, hsa; identical to SEQ ID NO: 51851

SEQ ID NO: 579721 - RNA, 64 nt, hsa; identical to SEQ ID NO: 51852

SEQ ID NO: 579722 - RNA, 64 nt, hsa; identical to SEQ ID NO: 51853

SEQ ID NO: 579723 - RNA, 64 nt, hsa; identical to SEQ ID NO: 51854

SEQ ID NO: 579724 - RNA, 64 nt, hsa; identical to SEQ ID NO: 51855

SEQ ID NO: 579725 - RNA, 64 nt, hsa; identical to SEQ ID NO: 51856

SEQ ID NO: 579726 - RNA, 64 nt, hsa; identical to SEQ ID NO: 51857

SEQ ID NO: 579727 - RNA, 64 nt, hsa; identical to SEQ ID NO: 51858

SEQ ID NO: 579728 - RNA, 64 nt, hsa; identical to SEQ ID NO: 51859

SEQ ID NO: 579729 - RNA, 64 nt, hsa; identical to SEQ ID NO: 51860

SEQ ID NO: 579730 - RNA, 64 nt, hsa; identical to SEQ ID NO: 51861

SEQ ID NO: 579731 - RNA, 64 nt, hsa; identical to SEQ ID NO: 51862

SEQ ID NO: 579732 - RNA, 64 nt, hsa; identical to SEQ ID NO: 51863

SEQ ID NO: 579733 - RNA, 64 nt, hsa; identical to SEQ ID NO: 51864

SEQ ID NO: 579734 - RNA, 64 nt, hsa; identical to SEQ ID NO: 51865

SEQ ID NO: 579735 - RNA, 64 nt, hsa; identical to SEQ ID NO: 51866

SEQ ID NO: 579736 - RNA, 64 nt, hsa; identical to SEQ ID NO: 51867

SEQ ID NO: 579737 - RNA, 64 nt, hsa; identical to SEQ ID NO: 51868

SEQ ID NO: 579738 - RNA, 64 nt, hsa; identical to SEQ ID NO: 51869

SEQ ID NO: 579739 - RNA, 64 nt, hsa; identical to SEQ ID NO: 51870

SEQ ID NO: 579740 - RNA, 64 nt, hsa; identical to SEQ ID NO: 51871

SEQ ID NO: 579741 - RNA, 64 nt, hsa; identical to SEQ ID NO: 51872

SEQ ID NO: 579742 - RNA, 64 nt, hsa; identical to SEQ ID NO: 51873

SEQ ID NO: 579743 - RNA, 64 nt, hsa; identical to SEQ ID NO: 51874

SEQ ID NO: 579744 - RNA, 64 nt, hsa; identical to SEQ ID NO: 51875

SEQ ID NO: 579745 - RNA, 64 nt, hsa; identical to SEQ ID NO: 51876

SEQ ID NO: 579746 - RNA, 64 nt, hsa; identical to SEQ ID NO: 51877

SEQ ID NO: 579747 - RNA, 64 nt, hsa; identical to SEQ ID NO: 51878

SEQ ID NO: 579748 - RNA, 64 nt, hsa; identical to SEQ ID NO: 51879

SEQ ID NO: 579749 - RNA, 64 nt, hsa; identical to SEQ ID NO: 51880

SEQ ID NO: 579750 - RNA, 64 nt, hsa; identical to SEQ ID NO: 51881

SEQ ID NO: 579751 - RNA, 64 nt, hsa; identical to SEQ ID NO: 51882

SEQ ID NO: 579752 - RNA, 64 nt, hsa; identical to SEQ ID NO: 51883

SEQ ID NO: 579753 - RNA, 64 nt, hsa; identical to SEQ ID NO: 51884

SEQ ID NO: 579754 - RNA, 64 nt, hsa; identical to SEQ ID NO: 51885

SEQ ID NO: 579755 - RNA, 64 nt, hsa; identical to SEQ ID NO: 51886

SEQ ID NO: 579756 - RNA, 64 nt, hsa; identical to SEQ ID NO: 51887

SEQ ID NO: 579757 - RNA, 64 nt, hsa; identical to SEQ ID NO: 51888

SEQ ID NO: 579758 - RNA, 64 nt, hsa; identical to SEQ ID NO: 51889

SEQ ID NO: 579759 - RNA, 64 nt, hsa; identical to SEQ ID NO: 51890

SEQ ID NO: 579760 - RNA, 63 nt, hsa; identical to SEQ ID NO: 51891

SEQ ID NO: 579761 - RNA, 64 nt, hsa; identical to SEQ ID NO: 51892

SEQ ID NO: 579762 - RNA, 64 nt, hsa; identical to SEQ ID NO: 51893

SEQ ID NO: 579763 - RNA, 64 nt, hsa; identical to SEQ ID NO: 51894

SEQ ID NO: 579764 - RNA, 64 nt, hsa; identical to SEQ ID NO: 51895

SEQ ID NO: 579765 - RNA, 64 nt, hsa; identical to SEQ ID NO: 51896

SEQ ID NO: 579766 - RNA, 64 nt, hsa; identical to SEQ ID NO: 51897

SEQ ID NO: 579767 - RNA, 64 nt, hsa; identical to SEQ ID NO: 51898

SEQ ID NO: 579768 - RNA, 64 nt, hsa; identical to SEQ ID NO: 51899

SEQ ID NO: 579769 - RNA, 64 nt, hsa; identical to SEQ ID NO: 51900

SEQ ID NO: 579770 - RNA, 64 nt, hsa; identical to SEQ ID NO: 51901

SEQ ID NO: 579771 - RNA, 64 nt, hsa; identical to SEQ ID NO: 51902

SEQ ID NO: 579772 - RNA, 64 nt, hsa; identical to SEQ ID NO: 51903

SEQ ID NO: 579773 - RNA, 64 nt, hsa; identical to SEQ ID NO: 51904

SEQ ID NO: 579774 - RNA, 64 nt, hsa; identical to SEQ ID NO: 51905

SEQ ID NO: 579775 - RNA, 64 nt, hsa; identical to SEQ ID NO: 51906

SEQ ID NO: 579776 - RNA, 64 nt, hsa; identical to SEQ ID NO: 51907

SEQ ID NO: 579777 - RNA, 64 nt, hsa; identical to SEQ ID NO: 51908

SEQ ID NO: 579778 - RNA, 64 nt, hsa; identical to SEQ ID NO: 51909

SEQ ID NO: 579779 - RNA, 64 nt, hsa; identical to SEQ ID NO: 51910

SEQ ID NO: 579780 - RNA, 64 nt, hsa; identical to SEQ ID NO: 51911

SEQ ID NO: 579781 - RNA, 64 nt, hsa; identical to SEQ ID NO: 51912

SEQ ID NO: 579782 - RNA, 64 nt, hsa; identical to SEQ ID NO: 51913

SEQ ID NO: 579783 - RNA, 64 nt, hsa; identical to SEQ ID NO: 51914

SEQ ID NO: 579784 - RNA, 64 nt, hsa; identical to SEQ ID NO: 51915

SEQ ID NO: 579785 - RNA, 64 nt, hsa; identical to SEQ ID NO: 51916

SEQ ID NO: 579786 - RNA, 64 nt, hsa; identical to SEQ ID NO: 51917

SEQ ID NO: 579787 - RNA, 64 nt, hsa; identical to SEQ ID NO: 238457

SEQ ID NO: 579788 - RNA, 64 nt, hsa; identical to SEQ ID NO: 238458

SEQ ID NO: 579789 - RNA, 64 nt, hsa; identical to SEQ ID NO: 238459

SEQ ID NO: 579790 - RNA, 64 nt, hsa; identical to SEQ ID NO: 238460

SEQ ID NO: 579791 - RNA, 64 nt, hsa; identical to SEQ ID NO: 76474

SEQ ID NO: 579792 - RNA, 64 nt, hsa; identical to SEQ ID NO: 76475

SEQ ID NO: 579793 - RNA, 64 nt, hsa; identical to SEQ ID NO: 76476

SEQ ID NO: 579794 - RNA, 64 nt, hsa; identical to SEQ ID NO: 76477

SEQ ID NO: 579795 - RNA, 64 nt, hsa; identical to SEQ ID NO: 76478

SEQ ID NO: 579796 - RNA, 64 nt, hsa; identical to SEQ ID NO: 76479

SEQ ID NO: 579797 - RNA, 64 nt, hsa; identical to SEQ ID NO: 76480

SEQ ID NO: 579798 - RNA, 64 nt, hsa; identical to SEQ ID NO: 76481

SEQ ID NO: 579799 - RNA, 64 nt, hsa; identical to SEQ ID NO: 76482

SEQ ID NO: 579800 - RNA, 64 nt, hsa; identical to SEQ ID NO: 76483

SEQ ID NO: 579801 - RNA, 64 nt, hsa
gcugggggaggcacuggcgggaggccucgggcuccccuggaagggcgcugggcuggcgggucag

SEQ ID NO: 579802 - RNA, 64 nt, hsa
aggcuguggaagaacucugcucgagggcagggugcccuggaacacugguaguucuggggcuggg

SEQ ID NO: 579803 - RNA, 64 nt, hsa
guauuuguuuucugugagagcacugaaauggcagcccuggaaucuacaauuuggcucuccacug

SEQ ID NO: 579804 - RNA, 64 nt, hsa
cccacagccgguucugcacuuaucaccgagucgccccuggaagcagauucccauugaguuuucc

SEQ ID NO: 579805 - RNA, 64 nt, hsa
uggggcaugugugccuguggcagaaaagaggagacccuggaauucagcacccugggugccauuc

SEQ ID NO: 579806 - RNA, 64 nt, hsa
gcuggaaggcagggcagagggaauguucccugcacccuggaaaggggaguugagucacaagagg

SEQ ID NO: 579807 - RNA, 64 nt, hsa
uauaauuugaccacagcaucugaacucccucucucccuggaauaaguauuuuucccacauuuuu

SEQ ID NO: 579808 - RNA, 64 nt, hsa
acuaaaagcaguauuuuaagguuggugucuuacucccuggaagccugaaauggguggaauagcg

SEQ ID NO: 579809 - RNA, 57 nt, hsa; identical to SEQ ID NO: 265214

SEQ ID NO: 579810 - RNA, 64 nt, hsa
gccuuaaaaagauacacaaagaugggcugugggucccuggaaagggggagaguugcccuuuaca

SEQ ID NO: 579811 - RNA, 64 nt, hsa
uaaugaacaugagaaaauuuauacuguagagaaacccuggaaaugugaagaacguggcaaaguu

SEQ ID NO: 579812 - RNA, 64 nt, hsa
uuacuguauauauauaauuccuacugaagaaauccccuggaaaugcaaaaaauguggcaggauu

SEQ ID NO: 579813 - RNA, 64 nt, hsa
uuaguccuuuaaaaugaguagaagcaaccuguuacccuggaaagagcacuggacauagaccuag

SEQ ID NO: 579814 - RNA, 64 nt, hsa
uuucuggaacagcggcaaccaagaggccuugcagcccuggaagugggucagggcccuugguggu

SEQ ID NO: 579815 - RNA, 64 nt, hsa
cagaagagccucauccugucugccccucacucugcccuggaaucaacaucuuccgaguccuucu

SEQ ID NO: 579816 - RNA, 64 nt, hsa
uagguguugagauggggcagcucugaauccuagacccuggaauagccugucccuuuucucuggg

SEQ ID NO: 579817 - RNA, 64 nt, hsa
uaugaagcccuuggugaugaggacauagcaucugcccuggaaaucguuauuccaacauaauauu

SEQ ID NO: 579818 - RNA, 64 nt, hsa
ucguuauuccaacauaauauuauuuucuagaaugcccuggaaggacagaauauuuaaaaauaua

SEQ ID NO: 579819 - RNA, 64 nt, hsa
agccccaagagaauaccaagacaagcaggcuguucccuggaaaaaaucuaaugcaaggagggcu

SEQ ID NO: 579820 - RNA, 64 nt, hsa
agccacacagggggcgugggagcaucccaguuaucccuggaaagcuagaaggggacagaggugu

SEQ ID NO: 579821 - RNA, 64 nt, hsa
aggguuucaagaagucuuagggcuuccagggguccccuggaagcuuuagaauauuuauggguuu

SEQ ID NO: 579822 - RNA, 64 nt, hsa
cuggacaggaagccuggcacccacuucugucuuccccuggaacugggcacuggcguacacuggu

SEQ ID NO: 579823 - RNA, 64 nt, hsa
caccauggauggucuuccuaguugccuggggaaacccuggaaugggcaucaggagaaagcaaca

SEQ ID NO: 579824 - RNA, 64 nt, hsa
uuccaccccacugggcccaaccaugggcucaggacccuggaauuccguuuucugauuugcuuug

SEQ ID NO: 579825 - RNA, 64 nt, hsa
aggagggcagggcugcggggaggccaggccgagccccuggaaccaucccguccuguaucauaug

SEQ ID NO: 579826 - RNA, 64 nt, hsa
acauguaaaggucuguuguugaauuguacucugccccuggaagcagauacagauggcugccugc

SEQ ID NO: 579827 - RNA, 64 nt, hsa
uugcccucugaggccccguacaccagaagggaggcccuggaaaauuuugugcuuccaacguggc

SEQ ID NO: 579828 - RNA, 64 nt, hsa
cgugaacuaacaaaccugugaacuguaaauaggccccuggaagcacgugcuuaagcccuuuugc

SEQ ID NO: 579829 - RNA, 64 nt, hsa
gcuaggaucugcauuuucagguuccgagccugaccccuggaacugaccagcgcucgauugucag

SEQ ID NO: 579830 - RNA, 64 nt, hsa
gucugggaaauugaggggacggcaggcccggcugcccuggaacugggagacagggagaaucccc

SEQ ID NO: 579831 - RNA, 64 nt, hsa
gaacugggagacagggagaauccccugccggggucccuggaaacagugcccaccccacaucacu

SEQ ID NO: 579832 - RNA, 64 nt, hsa
ugagcgaggggcagauucuagucgggagcccaugcccuggaaauccaucuuucuucaucuuucc

SEQ ID NO: 579833 - RNA, 64 nt, hsa
ucugcaccuccuuucccucucuccaucuuccaaucccuggaaaagucuggucugagugugacuu

SEQ ID NO: 579834 - RNA, 64 nt, hsa
cgaguuuuguaggggucacugucacaugcuugugcccuggaagccccaaggcucuuccuccagc

SEQ ID NO: 579835 - RNA, 64 nt, hsa; identical to SEQ ID NO: 145129

SEQ ID NO: 579836 - RNA, 64 nt, hsa; identical to SEQ ID NO: 145130

SEQ ID NO: 579837 - RNA, 64 nt, hsa; identical to SEQ ID NO: 145131

SEQ ID NO: 579838 - RNA, 64 nt, hsa; identical to SEQ ID NO: 145132

SEQ ID NO: 579839 - RNA, 64 nt, hsa; identical to SEQ ID NO: 145133

SEQ ID NO: 579840 - RNA, 64 nt, hsa; identical to SEQ ID NO: 145134

SEQ ID NO: 579841 - RNA, 64 nt, hsa; identical to SEQ ID NO: 145135

SEQ ID NO: 579842 - RNA, 64 nt, hsa; identical to SEQ ID NO: 145136

SEQ ID NO: 579843 - RNA, 64 nt, hsa; identical to SEQ ID NO: 145137

SEQ ID NO: 579844 - RNA, 64 nt, hsa; identical to SEQ ID NO: 145138

SEQ ID NO: 579845 - RNA, 64 nt, hsa; identical to SEQ ID NO: 145139

SEQ ID NO: 579846 - RNA, 64 nt, hsa; identical to SEQ ID NO: 145140

SEQ ID NO: 579847 - RNA, 64 nt, hsa; identical to SEQ ID NO: 145141

SEQ ID NO: 579848 - RNA, 64 nt, hsa; identical to SEQ ID NO: 145142

SEQ ID NO: 579849 - RNA, 64 nt, hsa; identical to SEQ ID NO: 145143

SEQ ID NO: 579850 - RNA, 64 nt, hsa; identical to SEQ ID NO: 145144

SEQ ID NO: 579851 - RNA, 64 nt, hsa; identical to SEQ ID NO: 145145

SEQ ID NO: 579852 - RNA, 64 nt, hsa; identical to SEQ ID NO: 145146

SEQ ID NO: 579853 - RNA, 64 nt, hsa; identical to SEQ ID NO: 145147

SEQ ID NO: 579854 - RNA, 64 nt, hsa; identical to SEQ ID NO: 145148

SEQ ID NO: 579855 - RNA, 64 nt, hsa; identical to SEQ ID NO: 145149

SEQ ID NO: 579856 - RNA, 64 nt, hsa; identical to SEQ ID NO: 145150

SEQ ID NO: 579857 - RNA, 64 nt, hsa; identical to SEQ ID NO: 145151

SEQ ID NO: 579858 - RNA, 64 nt, hsa; identical to SEQ ID NO: 145152

SEQ ID NO: 579859 - RNA, 64 nt, hsa; identical to SEQ ID NO: 145153

SEQ ID NO: 579860 - RNA, 64 nt, hsa; identical to SEQ ID NO: 145154

SEQ ID NO: 579861 - RNA, 64 nt, hsa; identical to SEQ ID NO: 145155

SEQ ID NO: 579862 - RNA, 64 nt, hsa; identical to SEQ ID NO: 145156

SEQ ID NO: 579863 - RNA, 64 nt, hsa; identical to SEQ ID NO: 145157

SEQ ID NO: 579864 - RNA, 64 nt, hsa; identical to SEQ ID NO: 145158

SEQ ID NO: 579865 - RNA, 64 nt, hsa; identical to SEQ ID NO: 145159

SEQ ID NO: 579866 - RNA, 64 nt, hsa; identical to SEQ ID NO: 145160

SEQ ID NO: 579867 - RNA, 64 nt, hsa; identical to SEQ ID NO: 145161

SEQ ID NO: 579868 - RNA, 64 nt, hsa; identical to SEQ ID NO: 145162

SEQ ID NO: 579869 - RNA, 64 nt, hsa; identical to SEQ ID NO: 145163

SEQ ID NO: 579870 - RNA, 64 nt, hsa; identical to SEQ ID NO: 145164

SEQ ID NO: 579871 - RNA, 64 nt, hsa; identical to SEQ ID NO: 145165

SEQ ID NO: 579872 - RNA, 64 nt, hsa; identical to SEQ ID NO: 145166

SEQ ID NO: 579873 - RNA, 64 nt, hsa; identical to SEQ ID NO: 145167

SEQ ID NO: 579874 - RNA, 64 nt, hsa; identical to SEQ ID NO: 145168

SEQ ID NO: 579875 - RNA, 64 nt, hsa; identical to SEQ ID NO: 145169

SEQ ID NO: 579876 - RNA, 64 nt, hsa; identical to SEQ ID NO: 145170

SEQ ID NO: 579877 - RNA, 64 nt, hsa; identical to SEQ ID NO: 145171

SEQ ID NO: 579878 - RNA, 64 nt, hsa; identical to SEQ ID NO: 145172

SEQ ID NO: 579879 - RNA, 64 nt, hsa; identical to SEQ ID NO: 145173

SEQ ID NO: 579880 - RNA, 64 nt, hsa; identical to SEQ ID NO: 145174

SEQ ID NO: 579881 - RNA, 64 nt, hsa; identical to SEQ ID NO: 145175

SEQ ID NO: 579882 - RNA, 64 nt, hsa; identical to SEQ ID NO: 145176

SEQ ID NO: 579883 - RNA, 64 nt, hsa; identical to SEQ ID NO: 145177

SEQ ID NO: 579884 - RNA, 64 nt, hsa; identical to SEQ ID NO: 145178

SEQ ID NO: 579885 - RNA, 64 nt, hsa; identical to SEQ ID NO: 145179

SEQ ID NO: 579886 - RNA, 64 nt, hsa; identical to SEQ ID NO: 134735

SEQ ID NO: 579887 - RNA, 64 nt, hsa; identical to SEQ ID NO: 134736

SEQ ID NO: 579888 - RNA, 64 nt, hsa; identical to SEQ ID NO: 134737

SEQ ID NO: 579889 - RNA, 64 nt, hsa; identical to SEQ ID NO: 134738

SEQ ID NO: 579890 - RNA, 64 nt, hsa; identical to SEQ ID NO: 134739

SEQ ID NO: 579891 - RNA, 64 nt, hsa; identical to SEQ ID NO: 134740

SEQ ID NO: 579892 - RNA, 64 nt, hsa; identical to SEQ ID NO: 134741

SEQ ID NO: 579893 - RNA, 64 nt, hsa; identical to SEQ ID NO: 134742

SEQ ID NO: 579894 - RNA, 64 nt, hsa; identical to SEQ ID NO: 134743

SEQ ID NO: 579895 - RNA, 64 nt, hsa; identical to SEQ ID NO: 134744

SEQ ID NO: 579896 - RNA, 64 nt, hsa; identical to SEQ ID NO: 134745

SEQ ID NO: 579897 - RNA, 64 nt, hsa; identical to SEQ ID NO: 134746

SEQ ID NO: 579898 - RNA, 64 nt, hsa; identical to SEQ ID NO: 134747

SEQ ID NO: 579899 - RNA, 64 nt, hsa; identical to SEQ ID NO: 134748

SEQ ID NO: 579900 - RNA, 64 nt, hsa; identical to SEQ ID NO: 134749

SEQ ID NO: 579901 - RNA, 64 nt, hsa; identical to SEQ ID NO: 134750

SEQ ID NO: 579902 - RNA, 64 nt, hsa; identical to SEQ ID NO: 134751

SEQ ID NO: 579903 - RNA, 64 nt, hsa; identical to SEQ ID NO: 134752

SEQ ID NO: 579904 - RNA, 64 nt, hsa; identical to SEQ ID NO: 134753

SEQ ID NO: 579905 - RNA, 64 nt, hsa; identical to SEQ ID NO: 134754

SEQ ID NO: 579906 - RNA, 64 nt, hsa
ugaauguaaguuuugagaaauacgagucugucagagcggccauaagccauaaagagucaaucuc

SEQ ID NO: 579907 - RNA, 64 nt, hsa
ucucugcuaugcuggagacgguuccagccuggaaagcggccaaguucaucuucucacugugagu

SEQ ID NO: 579908 - RNA, 56 nt, hsa
agcagaucccgcaguccugaggagccagcggccaccugcggggagaccaccgccgc

SEQ ID NO: 579909 - RNA, 64 nt, hsa
acucggauaccucuugauuucuguggauaagggaagcggccacuucucccucccugagacccga

SEQ ID NO: 579910 - RNA, 64 nt, hsa
ccaggggccaggcuugcggagggggagcccgcggagcggccagacuccccggggcgcucagccu

SEQ ID NO: 579911 - RNA, 64 nt, hsa
ccuggagcccagccugggagcgcaaaacccaagaagcggccagaacgcaccuccggcuccggcg

SEQ ID NO: 579912 - RNA, 64 nt, hsa
gagcagcuccuuggccagaggcuuacaggcaacaagcggccaggcagggucuggccccgggcug

SEQ ID NO: 579913 - RNA, 64 nt, hsa
ucccccgaccccuaccccacgcuacccagggcccagcggccaccccguaccacuguugauguga

SEQ ID NO: 579914 - RNA, 64 nt, hsa
ccuucauuccacggaggaagcugaggccacagggagcggccaucgccauugggaaggggcgacu

SEQ ID NO: 579915 - RNA, 64 nt, hsa; identical to SEQ ID NO: 242974

SEQ ID NO: 579916 - RNA, 64 nt, hsa; identical to SEQ ID NO: 242975

SEQ ID NO: 579917 - RNA, 64 nt, hsa; identical to SEQ ID NO: 242976

SEQ ID NO: 579918 - RNA, 64 nt, hsa; identical to SEQ ID NO: 242977

SEQ ID NO: 579919 - RNA, 64 nt, hsa; identical to SEQ ID NO: 242978

SEQ ID NO: 579920 - RNA, 64 nt, hsa; identical to SEQ ID NO: 242979

SEQ ID NO: 579921 - RNA, 64 nt, hsa; identical to SEQ ID NO: 242980

SEQ ID NO: 579922 - RNA, 64 nt, hsa; identical to SEQ ID NO: 242981

SEQ ID NO: 579923 - RNA, 64 nt, hsa; identical to SEQ ID NO: 242982

SEQ ID NO: 579924 - RNA, 64 nt, hsa; identical to SEQ ID NO: 242983

SEQ ID NO: 579925 - RNA, 64 nt, hsa; identical to SEQ ID NO: 242984

SEQ ID NO: 579926 - RNA, 64 nt, hsa; identical to SEQ ID NO: 242985

SEQ ID NO: 579927 - RNA, 64 nt, hsa; identical to SEQ ID NO: 415481

SEQ ID NO: 579928 - RNA, 64 nt, hsa; identical to SEQ ID NO: 415482

SEQ ID NO: 579929 - RNA, 64 nt, hsa; identical to SEQ ID NO: 415483

SEQ ID NO: 579930 - RNA, 64 nt, hsa; identical to SEQ ID NO: 415484

SEQ ID NO: 579931 - RNA, 64 nt, hsa; identical to SEQ ID NO: 415485

SEQ ID NO: 579932 - RNA, 64 nt, hsa; identical to SEQ ID NO: 415486

SEQ ID NO: 579933 - RNA, 64 nt, hsa; identical to SEQ ID NO: 415487

SEQ ID NO: 579934 - RNA, 64 nt, hsa; identical to SEQ ID NO: 415488

SEQ ID NO: 579935 - RNA, 64 nt, hsa; identical to SEQ ID NO: 415489

SEQ ID NO: 579936 - RNA, 64 nt, hsa; identical to SEQ ID NO: 415490

SEQ ID NO: 579937 - RNA, 64 nt, hsa; identical to SEQ ID NO: 415491

SEQ ID NO: 579938 - RNA, 64 nt, hsa; identical to SEQ ID NO: 415492

SEQ ID NO: 579939 - RNA, 64 nt, hsa; identical to SEQ ID NO: 415493

SEQ ID NO: 579940 - RNA, 64 nt, hsa; identical to SEQ ID NO: 415494

SEQ ID NO: 579941 - RNA, 64 nt, hsa; identical to SEQ ID NO: 415495

SEQ ID NO: 579942 - RNA, 64 nt, hsa; identical to SEQ ID NO: 415496

SEQ ID NO: 579943 - RNA, 64 nt, hsa; identical to SEQ ID NO: 415497

SEQ ID NO: 579944 - RNA, 64 nt, hsa; identical to SEQ ID NO: 415498

SEQ ID NO: 579945 - RNA, 64 nt, hsa; identical to SEQ ID NO: 415499

SEQ ID NO: 579946 - RNA, 64 nt, hsa; identical to SEQ ID NO: 415500

SEQ ID NO: 579947 - RNA, 64 nt, hsa; identical to SEQ ID NO: 415501

SEQ ID NO: 579948 - RNA, 64 nt, hsa; identical to SEQ ID NO: 415502

SEQ ID NO: 579949 - RNA, 58 nt, hsa; identical to SEQ ID NO: 415503

SEQ ID NO: 579950 - RNA, 64 nt, hsa; identical to SEQ ID NO: 415504

SEQ ID NO: 579951 - RNA, 64 nt, hsa; identical to SEQ ID NO: 415505

SEQ ID NO: 579952 - RNA, 64 nt, hsa; identical to SEQ ID NO: 415506

SEQ ID NO: 579953 - RNA, 64 nt, hsa; identical to SEQ ID NO: 415507

SEQ ID NO: 579954 - RNA, 64 nt, hsa; identical to SEQ ID NO: 415508

SEQ ID NO: 579955 - RNA, 64 nt, hsa; identical to SEQ ID NO: 415509

SEQ ID NO: 579956 - RNA, 64 nt, hsa; identical to SEQ ID NO: 415510

SEQ ID NO: 579957 - RNA, 64 nt, hsa; identical to SEQ ID NO: 415511

SEQ ID NO: 579958 - RNA, 64 nt, hsa; identical to SEQ ID NO: 415512

SEQ ID NO: 579959 - RNA, 63 nt, hsa; identical to SEQ ID NO: 415513

SEQ ID NO: 579960 - RNA, 64 nt, hsa; identical to SEQ ID NO: 415514

SEQ ID NO: 579961 - RNA, 64 nt, hsa; identical to SEQ ID NO: 415515

SEQ ID NO: 579962 - RNA, 64 nt, hsa; identical to SEQ ID NO: 415516

SEQ ID NO: 579963 - RNA, 64 nt, hsa; identical to SEQ ID NO: 415517

SEQ ID NO: 579964 - RNA, 64 nt, hsa; identical to SEQ ID NO: 415518

SEQ ID NO: 579965 - RNA, 64 nt, hsa; identical to SEQ ID NO: 415519

SEQ ID NO: 579966 - RNA, 64 nt, hsa; identical to SEQ ID NO: 415520

SEQ ID NO: 579967 - RNA, 64 nt, hsa; identical to SEQ ID NO: 415521

SEQ ID NO: 579968 - RNA, 57 nt, hsa; identical to SEQ ID NO: 415522

SEQ ID NO: 579969 - RNA, 64 nt, hsa; identical to SEQ ID NO: 415523

SEQ ID NO: 579970 - RNA, 64 nt, hsa; identical to SEQ ID NO: 415524

SEQ ID NO: 579971 - RNA, 64 nt, hsa; identical to SEQ ID NO: 415525

SEQ ID NO: 579972 - RNA, 64 nt, hsa; identical to SEQ ID NO: 242974

SEQ ID NO: 579973 - RNA, 64 nt, hsa; identical to SEQ ID NO: 242975

SEQ ID NO: 579974 - RNA, 64 nt, hsa; identical to SEQ ID NO: 242976

SEQ ID NO: 579975 - RNA, 64 nt, hsa; identical to SEQ ID NO: 242977

SEQ ID NO: 579976 - RNA, 64 nt, hsa; identical to SEQ ID NO: 242978

SEQ ID NO: 579977 - RNA, 64 nt, hsa; identical to SEQ ID NO: 242979

SEQ ID NO: 579978 - RNA, 64 nt, hsa; identical to SEQ ID NO: 242980

SEQ ID NO: 579979 - RNA, 64 nt, hsa; identical to SEQ ID NO: 242981

SEQ ID NO: 579980 - RNA, 64 nt, hsa; identical to SEQ ID NO: 242982

SEQ ID NO: 579981 - RNA, 64 nt, hsa; identical to SEQ ID NO: 242983

SEQ ID NO: 579982 - RNA, 64 nt, hsa; identical to SEQ ID NO: 242984

SEQ ID NO: 579983 - RNA, 64 nt, hsa; identical to SEQ ID NO: 242985

SEQ ID NO: 579984 - RNA, 64 nt, hsa; identical to SEQ ID NO: 415481

SEQ ID NO: 579985 - RNA, 64 nt, hsa; identical to SEQ ID NO: 415482

SEQ ID NO: 579986 - RNA, 64 nt, hsa; identical to SEQ ID NO: 415483

SEQ ID NO: 579987 - RNA, 64 nt, hsa; identical to SEQ ID NO: 415484

SEQ ID NO: 579988 - RNA, 64 nt, hsa; identical to SEQ ID NO: 415485

SEQ ID NO: 579989 - RNA, 64 nt, hsa; identical to SEQ ID NO: 415486

SEQ ID NO: 579990 - RNA, 64 nt, hsa; identical to SEQ ID NO: 415487

SEQ ID NO: 579991 - RNA, 64 nt, hsa; identical to SEQ ID NO: 415488

SEQ ID NO: 579992 - RNA, 64 nt, hsa; identical to SEQ ID NO: 415489

SEQ ID NO: 579993 - RNA, 64 nt, hsa; identical to SEQ ID NO: 415490

SEQ ID NO: 579994 - RNA, 64 nt, hsa; identical to SEQ ID NO: 415491

SEQ ID NO: 579995 - RNA, 64 nt, hsa; identical to SEQ ID NO: 415492

SEQ ID NO: 579996 - RNA, 64 nt, hsa; identical to SEQ ID NO: 415493

SEQ ID NO: 579997 - RNA, 64 nt, hsa; identical to SEQ ID NO: 415494

SEQ ID NO: 579998 - RNA, 64 nt, hsa; identical to SEQ ID NO: 415495

SEQ ID NO: 579999 - RNA, 64 nt, hsa; identical to SEQ ID NO: 415496

SEQ ID NO: 580000 - RNA, 64 nt, hsa; identical to SEQ ID NO: 415497

SEQ ID NO: 580001 - RNA, 64 nt, hsa; identical to SEQ ID NO: 415498

SEQ ID NO: 580002 - RNA, 64 nt, hsa; identical to SEQ ID NO: 415499

SEQ ID NO: 580003 - RNA, 64 nt, hsa; identical to SEQ ID NO: 415500

SEQ ID NO: 580004 - RNA, 64 nt, hsa; identical to SEQ ID NO: 415501

SEQ ID NO: 580005 - RNA, 64 nt, hsa; identical to SEQ ID NO: 415502

SEQ ID NO: 580006 - RNA, 58 nt, hsa; identical to SEQ ID NO: 415503

SEQ ID NO: 580007 - RNA, 64 nt, hsa; identical to SEQ ID NO: 415504

SEQ ID NO: 580008 - RNA, 64 nt, hsa; identical to SEQ ID NO: 415505

SEQ ID NO: 580009 - RNA, 64 nt, hsa; identical to SEQ ID NO: 415506

SEQ ID NO: 580010 - RNA, 64 nt, hsa; identical to SEQ ID NO: 415507

SEQ ID NO: 580011 - RNA, 64 nt, hsa; identical to SEQ ID NO: 415508

SEQ ID NO: 580012 - RNA, 64 nt, hsa; identical to SEQ ID NO: 415509

SEQ ID NO: 580013 - RNA, 64 nt, hsa; identical to SEQ ID NO: 415510

SEQ ID NO: 580014 - RNA, 64 nt, hsa; identical to SEQ ID NO: 415511

SEQ ID NO: 580015 - RNA, 64 nt, hsa; identical to SEQ ID NO: 415512

SEQ ID NO: 580016 - RNA, 63 nt, hsa; identical to SEQ ID NO: 415513

SEQ ID NO: 580017 - RNA, 64 nt, hsa; identical to SEQ ID NO: 415514

SEQ ID NO: 580018 - RNA, 64 nt, hsa; identical to SEQ ID NO: 415515

SEQ ID NO: 580019 - RNA, 64 nt, hsa; identical to SEQ ID NO: 415516

SEQ ID NO: 580020 - RNA, 64 nt, hsa; identical to SEQ ID NO: 415517

SEQ ID NO: 580021 - RNA, 64 nt, hsa; identical to SEQ ID NO: 415518

SEQ ID NO: 580022 - RNA, 64 nt, hsa; identical to SEQ ID NO: 415519

SEQ ID NO: 580023 - RNA, 64 nt, hsa; identical to SEQ ID NO: 415520

SEQ ID NO: 580024 - RNA, 64 nt, hsa; identical to SEQ ID NO: 415521

SEQ ID NO: 580025 - RNA, 57 nt, hsa; identical to SEQ ID NO: 415522

SEQ ID NO: 580026 - RNA, 64 nt, hsa; identical to SEQ ID NO: 415523

SEQ ID NO: 580027 - RNA, 64 nt, hsa; identical to SEQ ID NO: 415524

SEQ ID NO: 580028 - RNA, 64 nt, hsa; identical to SEQ ID NO: 415525

SEQ ID NO: 580029 - RNA, 64 nt, hsa; identical to SEQ ID NO: 138852

SEQ ID NO: 580030 - RNA, 64 nt, hsa; identical to SEQ ID NO: 138853

SEQ ID NO: 580031 - RNA, 64 nt, hsa; identical to SEQ ID NO: 138854

SEQ ID NO: 580032 - RNA, 64 nt, hsa; identical to SEQ ID NO: 138855

SEQ ID NO: 580033 - RNA, 64 nt, hsa; identical to SEQ ID NO: 138856

SEQ ID NO: 580034 - RNA, 64 nt, hsa; identical to SEQ ID NO: 138857

SEQ ID NO: 580035 - RNA, 64 nt, hsa; identical to SEQ ID NO: 138858

SEQ ID NO: 580036 - RNA, 64 nt, hsa; identical to SEQ ID NO: 138859

SEQ ID NO: 580037 - RNA, 64 nt, hsa; identical to SEQ ID NO: 138860

SEQ ID NO: 580038 - RNA, 64 nt, hsa; identical to SEQ ID NO: 138861

SEQ ID NO: 580039 - RNA, 64 nt, hsa; identical to SEQ ID NO: 138862

SEQ ID NO: 580040 - RNA, 64 nt, hsa; identical to SEQ ID NO: 138863

SEQ ID NO: 580041 - RNA, 64 nt, hsa; identical to SEQ ID NO: 138864

SEQ ID NO: 580042 - RNA, 64 nt, hsa; identical to SEQ ID NO: 138865

SEQ ID NO: 580043 - RNA, 64 nt, hsa; identical to SEQ ID NO: 138866

SEQ ID NO: 580044 - RNA, 64 nt, hsa; identical to SEQ ID NO: 138867

SEQ ID NO: 580045 - RNA, 64 nt, hsa; identical to SEQ ID NO: 138868

SEQ ID NO: 580046 - RNA, 64 nt, hsa; identical to SEQ ID NO: 138869

SEQ ID NO: 580047 - RNA, 64 nt, hsa; identical to SEQ ID NO: 138870

SEQ ID NO: 580048 - RNA, 64 nt, hsa; identical to SEQ ID NO: 138871

SEQ ID NO: 580049 - RNA, 64 nt, hsa; identical to SEQ ID NO: 138872

SEQ ID NO: 580050 - RNA, 64 nt, hsa; identical to SEQ ID NO: 138873

SEQ ID NO: 580051 - RNA, 64 nt, hsa; identical to SEQ ID NO: 138874

SEQ ID NO: 580052 - RNA, 64 nt, hsa; identical to SEQ ID NO: 138875

SEQ ID NO: 580053 - RNA, 64 nt, hsa; identical to SEQ ID NO: 138876

SEQ ID NO: 580054 - RNA, 64 nt, hsa; identical to SEQ ID NO: 138877

SEQ ID NO: 580055 - RNA, 64 nt, hsa; identical to SEQ ID NO: 138878

SEQ ID NO: 580056 - RNA, 64 nt, hsa; identical to SEQ ID NO: 138879

SEQ ID NO: 580057 - RNA, 64 nt, hsa; identical to SEQ ID NO: 138880

SEQ ID NO: 580058 - RNA, 64 nt, hsa; identical to SEQ ID NO: 138881

SEQ ID NO: 580059 - RNA, 64 nt, hsa; identical to SEQ ID NO: 138882

SEQ ID NO: 580060 - RNA, 64 nt, hsa; identical to SEQ ID NO: 138883

SEQ ID NO: 580061 - RNA, 64 nt, hsa; identical to SEQ ID NO: 138884

SEQ ID NO: 580062 - RNA, 64 nt, hsa; identical to SEQ ID NO: 138885

SEQ ID NO: 580063 - RNA, 64 nt, hsa; identical to SEQ ID NO: 138886

SEQ ID NO: 580064 - RNA, 64 nt, hsa; identical to SEQ ID NO: 138887

SEQ ID NO: 580065 - RNA, 64 nt, hsa; identical to SEQ ID NO: 138888

SEQ ID NO: 580066 - RNA, 64 nt, hsa; identical to SEQ ID NO: 138889

SEQ ID NO: 580067 - RNA, 64 nt, hsa; identical to SEQ ID NO: 138890

SEQ ID NO: 580068 - RNA, 64 nt, hsa; identical to SEQ ID NO: 138891

SEQ ID NO: 580069 - RNA, 64 nt, hsa; identical to SEQ ID NO: 138892

SEQ ID NO: 580070 - RNA, 64 nt, hsa
aaaaagaccuccagauaggcagacagacagauggaccaccaaccuggacagacagccaaagcuu

SEQ ID NO: 580071 - RNA, 64 nt, hsa
gccaacagcuugauagaccagugcagccagagagaccaccaaacagagcccccaaaagacagac

SEQ ID NO: 580072 - RNA, 64 nt, hsa
cccgcuccacaagacaccugugaucuggaaaucuaccaccaaucccgaucggcucuuauuagcu

SEQ ID NO: 580073 - RNA, 64 nt, hsa
cccgcuccacaagacaccugugcuuuggaaauccaccaccaaucccgaucggcucuuauuagcu

SEQ ID NO: 580074 - RNA, 64 nt, hsa
ccuccugaagccucugggaacuccuccuguggccaccaccaaaggaugaggaaucugaguugcc

SEQ ID NO: 580075 - RNA, 64 nt, hsa
uucacaccccaaaaugacccaacgauguccacacaccaccaaaacccagccaaugggccaccuc

SEQ ID NO: 580076 - RNA, 64 nt, hsa
ccaccuugaugucugcugugacaucagaggugccaccaccaaagcacucuucccacccuagucu

SEQ ID NO: 580077 - RNA, 64 nt, hsa
guugggaccugagggacagaggaucggaauggaaaccaccaacgugcacuggcacccucagaag

SEQ ID NO: 580078 - RNA, 64 nt, hsa
acugucgcugaagcacuuaagaaauaaagguacuuuacagcaacauucgccauacuagcggagg

SEQ ID NO: 580079 - RNA, 64 nt, hsa
caaaaguugaggacuuggugaaaggaaauagcaguuacagcaaaaccucagugauuacaauuga

SEQ ID NO: 580080 - RNA, 64 nt, hsa
uauggguagccuuuuuaccaauuauaaggaaaauuuacagcagugaacaugaacauucacuuag

SEQ ID NO: 580081 - RNA, 64 nt, hsa
uccagagucuuagcucacaugcacugagaauucuuuacagcaaagaagagauuuuuagaguggg

SEQ ID NO: 580082 - RNA, 64 nt, hsa
cuguuacuccguaggcuucuuaaucuuccaggcauuacagcagcacaguguucuacuuuuuaca

SEQ ID NO: 580083 - RNA, 64 nt, hsa
uauuuucugcuguauguuaguauuaugagaauaguuacagcaaaaacauaacucagucaaauga

SEQ ID NO: 580084 - RNA, 64 nt, hsa
gcuaaugccaaaaugcucuggcuuuguauuuucuuuacagcauagauagaaaaaugcacauuuu

SEQ ID NO: 580085 - RNA, 64 nt, hsa
gaggugugacaggcucuagucuccucccuguuguuuacagcauauuuaagucuugugaaacugu

SEQ ID NO: 580086 - RNA, 64 nt, hsa
uuuaaaugugaccauuuuucugguaugaauaaacuuacagcaacaaauaaucaaagauacaauu

SEQ ID NO: 580087 - RNA, 64 nt, hsa
ggcucaaaguaucuuuuagacuuuuaaggacaauuuacagcaaaugaaauuuaugaugcuguga

SEQ ID NO: 580088 - RNA, 64 nt, hsa
uuugauaaugcauaaauguuauauuuauauacaguuacagcaggccagaaacauacauacacug

SEQ ID NO: 580089 - RNA, 64 nt, hsa
gugagccaccgugcccggccagaaaauacauucuuuacagcaaauguuauagguuaaggagaca

SEQ ID NO: 580090 - RNA, 64 nt, hsa
aguuccauuagguuuucacauguguuaaucucauuuacagcauugaauugcggcaguaacauuu

SEQ ID NO: 580091 - RNA, 64 nt, hsa
guugcagaacugagccuugguaaaccugucucuauuacagcauguugccauacaucuauuuaag

SEQ ID NO: 580092 - RNA, 64 nt, hsa; identical to SEQ ID NO: 517266

SEQ ID NO: 580093 - RNA, 64 nt, hsa; identical to SEQ ID NO: 517267

SEQ ID NO: 580094 - RNA, 64 nt, hsa; identical to SEQ ID NO: 517268

SEQ ID NO: 580095 - RNA, 64 nt, hsa; identical to SEQ ID NO: 517269

SEQ ID NO: 580096 - RNA, 64 nt, hsa; identical to SEQ ID NO: 517270

SEQ ID NO: 580097 - RNA, 64 nt, hsa; identical to SEQ ID NO: 517271

SEQ ID NO: 580098 - RNA, 64 nt, hsa; identical to SEQ ID NO: 517272

SEQ ID NO: 580099 - RNA, 64 nt, hsa; identical to SEQ ID NO: 517273

SEQ ID NO: 580100 - RNA, 64 nt, hsa; identical to SEQ ID NO: 517274

SEQ ID NO: 580101 - RNA, 64 nt, hsa; identical to SEQ ID NO: 517275

SEQ ID NO: 580102 - RNA, 64 nt, hsa; identical to SEQ ID NO: 517276

SEQ ID NO: 580103 - RNA, 64 nt, hsa; identical to SEQ ID NO: 517277

SEQ ID NO: 580104 - RNA, 64 nt, hsa; identical to SEQ ID NO: 517278

SEQ ID NO: 580105 - RNA, 64 nt, hsa
ugugccuuaagcagagucaggagaccccaaggcaugugagcaucugcccagcaaccuguggaga

SEQ ID NO: 580106 - RNA, 64 nt, hsa
uauaaccauacuuuucuaacaaucccuggcugucugugagcagcacuugacagcucucccucug

SEQ ID NO: 580107 - RNA, 64 nt, hsa
auaaaagacaaaaggacaucacucuuaucaaaugugugagcaguagaagagaccacauuuacag

SEQ ID NO: 580108 - RNA, 64 nt, hsa
acacacacggaaaaccuuuauuuuaaagucaaguugugagcaaauagaaauaaaagacaaaagg

SEQ ID NO: 580109 - RNA, 64 nt, hsa
ccuuaucuguaaagcaaagcgacaccagcaagccugugagcauuguguauauagcagacaugga

SEQ ID NO: 580110 - RNA, 64 nt, hsa
guguguggcugagucucugacagcugugagugugugugagcaggguaaggguacgugagggguc

SEQ ID NO: 580111 - RNA, 64 nt, hsa
ugucacucagcugagaaggccagcccucccuggcugugagcagccuccacuguguccagagaca

SEQ ID NO: 580112 - RNA, 64 nt, hsa
gucugguggguggagucaggcuucucuugcuaccugugagcauccuucccagcagacauccuca

SEQ ID NO: 580113 - RNA, 64 nt, hsa
aaaucagaugcuuccauguauucagggcgcgcauugugagcaguggaguaugagccuugagggc

SEQ ID NO: 580114 - RNA, 64 nt, hsa
acuuagcccuguggacaacuucucuaugcaucugugugagcagaugaucauuguauuaccuuuu

SEQ ID NO: 580115 - RNA, 64 nt, hsa
agggcagcgucgaagcugggguuagguguaggguugugagcaaagcuccccuguuuguggccac

SEQ ID NO: 580116 - RNA, 64 nt, hsa
gcacaggugggcagcagcgagcuggcaggugaagugugagcagcacgcaaagugucacgugggc

SEQ ID NO: 580117 - RNA, 64 nt, hsa
gaacuguagaagacccugaggacuccugggcuagugugagcagcuauucugcaugggugcagau

SEQ ID NO: 580118 - RNA, 64 nt, hsa
acggaacguugucaagagguagugagauuguugcugugagcaaggcucugggagagucaccuca

SEQ ID NO: 580119 - RNA, 64 nt, hsa
guucaggacgggucaaaggcaaaggccuuugugaugugagcaaaggcaaccaaaacuuagccuc

SEQ ID NO: 580120 - RNA, 64 nt, hsa
ucuuucugacuccuagccaacaaaccauccuuaaugugagcaacuucuuuaggcauuuccucuu

SEQ ID NO: 580121 - RNA, 64 nt, hsa
auuacuauaagguacugugaaauaacugcgauuuugugagcaaaacauacuuggaaaugcugau

SEQ ID NO: 580122 - RNA, 64 nt, hsa
aaaaauggucuguucauaauugguaggugccuuuugugagcagggagcauaauuauugguuuau

SEQ ID NO: 580123 - RNA, 64 nt, hsa
auaccguuuugugaaaaccagccauaggaaaacaugugagcaacaacccccaugaacauuuguc

SEQ ID NO: 580124 - RNA, 64 nt, hsa
caacccccaugaacauuuguccuaacucagauuuugugagcagugaaguuuaacagagcaguga

SEQ ID NO: 580125 - RNA, 64 nt, hsa
gcugcuuccuggacgugcgcgcccaggccagugcugugagcaggcggggaggaggcugccggag

SEQ ID NO: 580126 - RNA, 64 nt, hsa
agcccugagccuggcagguccccugcccugaggcugugagcagcuagugguggcuucuccagcc

SEQ ID NO: 580127 - RNA, 64 nt, hsa
agcaacugaacagagcuccacacaucugucagggugugagcacuccaaggccucgcguggagca

SEQ ID NO: 580128 - RNA, 64 nt, hsa
aaggggaucagcuguauuugugugugugugugugugugagcaccugacaaaucuaugaaaccga

SEQ ID NO: 580129 - RNA, 63 nt, hsa
uaauauuugauuaaauaaugcagucagcuaagagccaacaaaaccccauauccagauaguuag

SEQ ID NO: 580130 - RNA, 63 nt, hsa
aaggaugucaacuugacauccuucccuuagcaugccaacaagccauuagacugauucuuccac

SEQ ID NO: 580131 - RNA, 63 nt, hsa
gcugcuuguaagucacagguuuuccagaugucugccaacaagaaaugacucauacugugauga

SEQ ID NO: 580132 - RNA, 63 nt, hsa
cacauauuacucuuuuuagcaaccuagcaugaugccaacaagacuauucuugaaagagcaaag

SEQ ID NO: 580133 - RNA, 64 nt, hsa; identical to SEQ ID NO: 74290

SEQ ID NO: 580134 - RNA, 64 nt, hsa; identical to SEQ ID NO: 74291

SEQ ID NO: 580135 - RNA, 64 nt, hsa; identical to SEQ ID NO: 74292

SEQ ID NO: 580136 - RNA, 64 nt, hsa; identical to SEQ ID NO: 74293

SEQ ID NO: 580137 - RNA, 64 nt, hsa; identical to SEQ ID NO: 74294

SEQ ID NO: 580138 - RNA, 64 nt, hsa; identical to SEQ ID NO: 74295

SEQ ID NO: 580139 - RNA, 64 nt, hsa; identical to SEQ ID NO: 161026

SEQ ID NO: 580140 - RNA, 64 nt, hsa; identical to SEQ ID NO: 161027

SEQ ID NO: 580141 - RNA, 64 nt, hsa; identical to SEQ ID NO: 161028

SEQ ID NO: 580142 - RNA, 64 nt, hsa; identical to SEQ ID NO: 161029

SEQ ID NO: 580143 - RNA, 64 nt, hsa; identical to SEQ ID NO: 161030

SEQ ID NO: 580144 - RNA, 64 nt, hsa; identical to SEQ ID NO: 161031

SEQ ID NO: 580145 - RNA, 64 nt, hsa; identical to SEQ ID NO: 161032

SEQ ID NO: 580146 - RNA, 64 nt, hsa; identical to SEQ ID NO: 161033

SEQ ID NO: 580147 - RNA, 64 nt, hsa; identical to SEQ ID NO: 161034

SEQ ID NO: 580148 - RNA, 50 nt, hsa; identical to SEQ ID NO: 161035

SEQ ID NO: 580149 - RNA, 64 nt, hsa; identical to SEQ ID NO: 161036

SEQ ID NO: 580150 - RNA, 64 nt, hsa; identical to SEQ ID NO: 161037

SEQ ID NO: 580151 - RNA, 64 nt, hsa; identical to SEQ ID NO: 161038

SEQ ID NO: 580152 - RNA, 64 nt, hsa; identical to SEQ ID NO: 161039

SEQ ID NO: 580153 - RNA, 64 nt, hsa; identical to SEQ ID NO: 161040

SEQ ID NO: 580154 - RNA, 64 nt, hsa; identical to SEQ ID NO: 161041

SEQ ID NO: 580155 - RNA, 64 nt, hsa; identical to SEQ ID NO: 161042

SEQ ID NO: 580156 - RNA, 64 nt, hsa; identical to SEQ ID NO: 161043

SEQ ID NO: 580157 - RNA, 64 nt, hsa; identical to SEQ ID NO: 161044

SEQ ID NO: 580158 - RNA, 64 nt, hsa; identical to SEQ ID NO: 161045

SEQ ID NO: 580159 - RNA, 64 nt, hsa; identical to SEQ ID NO: 161046

SEQ ID NO: 580160 - RNA, 64 nt, hsa; identical to SEQ ID NO: 161047

SEQ ID NO: 580161 - RNA, 63 nt, hsa; identical to SEQ ID NO: 530191

SEQ ID NO: 580162 - RNA, 64 nt, hsa; identical to SEQ ID NO: 530192

SEQ ID NO: 580163 - RNA, 64 nt, hsa; identical to SEQ ID NO: 530193

SEQ ID NO: 580164 - RNA, 64 nt, hsa; identical to SEQ ID NO: 530194

SEQ ID NO: 580165 - RNA, 64 nt, hsa; identical to SEQ ID NO: 530195

SEQ ID NO: 580166 - RNA, 64 nt, hsa; identical to SEQ ID NO: 530196

SEQ ID NO: 580167 - RNA, 64 nt, hsa; identical to SEQ ID NO: 530197

SEQ ID NO: 580168 - RNA, 64 nt, hsa; identical to SEQ ID NO: 530198

SEQ ID NO: 580169 - RNA, 64 nt, hsa; identical to SEQ ID NO: 530199

SEQ ID NO: 580170 - RNA, 64 nt, hsa; identical to SEQ ID NO: 530200

SEQ ID NO: 580171 - RNA, 64 nt, hsa; identical to SEQ ID NO: 530201

SEQ ID NO: 580172 - RNA, 64 nt, hsa; identical to SEQ ID NO: 530202

SEQ ID NO: 580173 - RNA, 64 nt, hsa; identical to SEQ ID NO: 530203

SEQ ID NO: 580174 - RNA, 64 nt, hsa; identical to SEQ ID NO: 530204

SEQ ID NO: 580175 - RNA, 64 nt, hsa; identical to SEQ ID NO: 530205

SEQ ID NO: 580176 - RNA, 64 nt, hsa; identical to SEQ ID NO: 530206

SEQ ID NO: 580177 - RNA, 64 nt, hsa; identical to SEQ ID NO: 530207

SEQ ID NO: 580178 - RNA, 64 nt, hsa; identical to SEQ ID NO: 530208

SEQ ID NO: 580179 - RNA, 64 nt, hsa; identical to SEQ ID NO: 530209

SEQ ID NO: 580180 - RNA, 64 nt, hsa; identical to SEQ ID NO: 530210

SEQ ID NO: 580181 - RNA, 64 nt, hsa; identical to SEQ ID NO: 530211

SEQ ID NO: 580182 - RNA, 64 nt, hsa; identical to SEQ ID NO: 530212

SEQ ID NO: 580183 - RNA, 64 nt, hsa; identical to SEQ ID NO: 530213

SEQ ID NO: 580184 - RNA, 64 nt, hsa; identical to SEQ ID NO: 530214

SEQ ID NO: 580185 - RNA, 64 nt, hsa; identical to SEQ ID NO: 530215

SEQ ID NO: 580186 - RNA, 64 nt, hsa; identical to SEQ ID NO: 530216

SEQ ID NO: 580187 - RNA, 64 nt, hsa; identical to SEQ ID NO: 530217

SEQ ID NO: 580188 - RNA, 64 nt, hsa; identical to SEQ ID NO: 530218

SEQ ID NO: 580189 - RNA, 64 nt, hsa; identical to SEQ ID NO: 530219

SEQ ID NO: 580190 - RNA, 64 nt, hsa; identical to SEQ ID NO: 530220

SEQ ID NO: 580191 - RNA, 64 nt, hsa; identical to SEQ ID NO: 530221

SEQ ID NO: 580192 - RNA, 63 nt, hsa; identical to SEQ ID NO: 530222

SEQ ID NO: 580193 - RNA, 64 nt, hsa; identical to SEQ ID NO: 530223

SEQ ID NO: 580194 - RNA, 64 nt, hsa; identical to SEQ ID NO: 530224

SEQ ID NO: 580195 - RNA, 64 nt, hsa; identical to SEQ ID NO: 530225

SEQ ID NO: 580196 - RNA, 64 nt, hsa; identical to SEQ ID NO: 530226

SEQ ID NO: 580197 - RNA, 64 nt, hsa; identical to SEQ ID NO: 530227

SEQ ID NO: 580198 - RNA, 64 nt, hsa; identical to SEQ ID NO: 530228

SEQ ID NO: 580199 - RNA, 64 nt, hsa; identical to SEQ ID NO: 530229

SEQ ID NO: 580200 - RNA, 64 nt, hsa; identical to SEQ ID NO: 530230

SEQ ID NO: 580201 - RNA, 64 nt, hsa; identical to SEQ ID NO: 530231

SEQ ID NO: 580202 - RNA, 64 nt, hsa; identical to SEQ ID NO: 530232

SEQ ID NO: 580203 - RNA, 64 nt, hsa; identical to SEQ ID NO: 530233

SEQ ID NO: 580204 - RNA, 64 nt, hsa; identical to SEQ ID NO: 530234

SEQ ID NO: 580205 - RNA, 64 nt, hsa; identical to SEQ ID NO: 530235

SEQ ID NO: 580206 - RNA, 64 nt, hsa; identical to SEQ ID NO: 530236

SEQ ID NO: 580207 - RNA, 64 nt, hsa; identical to SEQ ID NO: 530237

SEQ ID NO: 580208 - RNA, 64 nt, hsa; identical to SEQ ID NO: 530238

SEQ ID NO: 580209 - RNA, 64 nt, hsa; identical to SEQ ID NO: 530239

SEQ ID NO: 580210 - RNA, 64 nt, hsa; identical to SEQ ID NO: 530240

SEQ ID NO: 580211 - RNA, 64 nt, hsa; identical to SEQ ID NO: 530241

SEQ ID NO: 580212 - RNA, 64 nt, hsa; identical to SEQ ID NO: 530242

SEQ ID NO: 580213 - RNA, 64 nt, hsa; identical to SEQ ID NO: 530243

SEQ ID NO: 580214 - RNA, 64 nt, hsa; identical to SEQ ID NO: 530244

SEQ ID NO: 580215 - RNA, 64 nt, hsa; identical to SEQ ID NO: 530245

SEQ ID NO: 580216 - RNA, 64 nt, hsa; identical to SEQ ID NO: 530246

SEQ ID NO: 580217 - RNA, 64 nt, hsa; identical to SEQ ID NO: 530247

SEQ ID NO: 580218 - RNA, 64 nt, hsa; identical to SEQ ID NO: 530248

SEQ ID NO: 580219 - RNA, 64 nt, hsa; identical to SEQ ID NO: 530249

SEQ ID NO: 580220 - RNA, 64 nt, hsa; identical to SEQ ID NO: 530250

SEQ ID NO: 580221 - RNA, 64 nt, hsa; identical to SEQ ID NO: 530251

SEQ ID NO: 580222 - RNA, 64 nt, hsa; identical to SEQ ID NO: 530252

SEQ ID NO: 580223 - RNA, 64 nt, hsa; identical to SEQ ID NO: 530253

SEQ ID NO: 580224 - RNA, 64 nt, hsa; identical to SEQ ID NO: 530254

SEQ ID NO: 580225 - RNA, 64 nt, hsa; identical to SEQ ID NO: 530255

SEQ ID NO: 580226 - RNA, 64 nt, hsa; identical to SEQ ID NO: 530256

SEQ ID NO: 580227 - RNA, 64 nt, hsa; identical to SEQ ID NO: 530257

SEQ ID NO: 580228 - RNA, 64 nt, hsa; identical to SEQ ID NO: 530258

SEQ ID NO: 580229 - RNA, 64 nt, hsa; identical to SEQ ID NO: 530259

SEQ ID NO: 580230 - RNA, 64 nt, hsa; identical to SEQ ID NO: 530260

SEQ ID NO: 580231 - RNA, 64 nt, hsa; identical to SEQ ID NO: 530261

SEQ ID NO: 580232 - RNA, 64 nt, hsa; identical to SEQ ID NO: 530262

SEQ ID NO: 580233 - RNA, 64 nt, hsa; identical to SEQ ID NO: 530263

SEQ ID NO: 580234 - RNA, 64 nt, hsa; identical to SEQ ID NO: 530264

SEQ ID NO: 580235 - RNA, 64 nt, hsa; identical to SEQ ID NO: 530265

SEQ ID NO: 580236 - RNA, 64 nt, hsa; identical to SEQ ID NO: 530266

SEQ ID NO: 580237 - RNA, 64 nt, hsa; identical to SEQ ID NO: 530267

SEQ ID NO: 580238 - RNA, 64 nt, hsa; identical to SEQ ID NO: 530268

SEQ ID NO: 580239 - RNA, 64 nt, hsa; identical to SEQ ID NO: 530269

SEQ ID NO: 580240 - RNA, 64 nt, hsa; identical to SEQ ID NO: 530270

SEQ ID NO: 580241 - RNA, 64 nt, hsa; identical to SEQ ID NO: 530271

SEQ ID NO: 580242 - RNA, 64 nt, hsa; identical to SEQ ID NO: 530272

SEQ ID NO: 580243 - RNA, 64 nt, hsa; identical to SEQ ID NO: 530273

SEQ ID NO: 580244 - RNA, 64 nt, hsa; identical to SEQ ID NO: 530274

SEQ ID NO: 580245 - RNA, 64 nt, hsa; identical to SEQ ID NO: 530275

SEQ ID NO: 580246 - RNA, 64 nt, hsa; identical to SEQ ID NO: 530276

SEQ ID NO: 580247 - RNA, 64 nt, hsa; identical to SEQ ID NO: 530277

SEQ ID NO: 580248 - RNA, 64 nt, hsa; identical to SEQ ID NO: 530278

SEQ ID NO: 580249 - RNA, 64 nt, hsa; identical to SEQ ID NO: 530279

SEQ ID NO: 580250 - RNA, 64 nt, hsa; identical to SEQ ID NO: 530280

SEQ ID NO: 580251 - RNA, 64 nt, hsa; identical to SEQ ID NO: 530281

SEQ ID NO: 580252 - RNA, 64 nt, hsa; identical to SEQ ID NO: 530282

SEQ ID NO: 580253 - RNA, 64 nt, hsa; identical to SEQ ID NO: 530283

SEQ ID NO: 580254 - RNA, 64 nt, hsa; identical to SEQ ID NO: 530284

SEQ ID NO: 580255 - RNA, 64 nt, hsa; identical to SEQ ID NO: 530285

SEQ ID NO: 580256 - RNA, 64 nt, hsa; identical to SEQ ID NO: 530286

SEQ ID NO: 580257 - RNA, 64 nt, hsa; identical to SEQ ID NO: 530287

SEQ ID NO: 580258 - RNA, 64 nt, hsa; identical to SEQ ID NO: 530288

SEQ ID NO: 580259 - RNA, 64 nt, hsa; identical to SEQ ID NO: 530289

SEQ ID NO: 580260 - RNA, 64 nt, hsa; identical to SEQ ID NO: 530290

SEQ ID NO: 580261 - RNA, 64 nt, hsa; identical to SEQ ID NO: 530291

SEQ ID NO: 580262 - RNA, 64 nt, hsa; identical to SEQ ID NO: 530292

SEQ ID NO: 580263 - RNA, 64 nt, hsa; identical to SEQ ID NO: 530293

SEQ ID NO: 580264 - RNA, 64 nt, hsa; identical to SEQ ID NO: 530294

SEQ ID NO: 580265 - RNA, 64 nt, hsa; identical to SEQ ID NO: 530295

SEQ ID NO: 580266 - RNA, 64 nt, hsa; identical to SEQ ID NO: 530296

SEQ ID NO: 580267 - RNA, 64 nt, hsa; identical to SEQ ID NO: 530297

SEQ ID NO: 580268 - RNA, 64 nt, hsa; identical to SEQ ID NO: 530298

SEQ ID NO: 580269 - RNA, 64 nt, hsa; identical to SEQ ID NO: 530299

SEQ ID NO: 580270 - RNA, 64 nt, hsa; identical to SEQ ID NO: 530300

SEQ ID NO: 580271 - RNA, 64 nt, hsa; identical to SEQ ID NO: 530301

SEQ ID NO: 580272 - RNA, 64 nt, hsa; identical to SEQ ID NO: 530302

SEQ ID NO: 580273 - RNA, 64 nt, hsa; identical to SEQ ID NO: 530303

SEQ ID NO: 580274 - RNA, 64 nt, hsa; identical to SEQ ID NO: 530304

SEQ ID NO: 580275 - RNA, 64 nt, hsa; identical to SEQ ID NO: 530305

SEQ ID NO: 580276 - RNA, 64 nt, hsa; identical to SEQ ID NO: 530306

SEQ ID NO: 580277 - RNA, 64 nt, hsa; identical to SEQ ID NO: 530307

SEQ ID NO: 580278 - RNA, 64 nt, hsa; identical to SEQ ID NO: 530308

SEQ ID NO: 580279 - RNA, 64 nt, hsa; identical to SEQ ID NO: 530309

SEQ ID NO: 580280 - RNA, 64 nt, hsa; identical to SEQ ID NO: 530310

SEQ ID NO: 580281 - RNA, 64 nt, hsa; identical to SEQ ID NO: 530311

SEQ ID NO: 580282 - RNA, 64 nt, hsa; identical to SEQ ID NO: 530312

SEQ ID NO: 580283 - RNA, 64 nt, hsa; identical to SEQ ID NO: 530313

SEQ ID NO: 580284 - RNA, 64 nt, hsa; identical to SEQ ID NO: 530314

SEQ ID NO: 580285 - RNA, 64 nt, hsa; identical to SEQ ID NO: 530315

SEQ ID NO: 580286 - RNA, 64 nt, hsa; identical to SEQ ID NO: 530316

SEQ ID NO: 580287 - RNA, 64 nt, hsa; identical to SEQ ID NO: 530317

SEQ ID NO: 580288 - RNA, 64 nt, hsa; identical to SEQ ID NO: 530318

SEQ ID NO: 580289 - RNA, 64 nt, hsa; identical to SEQ ID NO: 530319

SEQ ID NO: 580290 - RNA, 64 nt, hsa; identical to SEQ ID NO: 530320

SEQ ID NO: 580291 - RNA, 64 nt, hsa; identical to SEQ ID NO: 530321

SEQ ID NO: 580292 - RNA, 64 nt, hsa; identical to SEQ ID NO: 530322

SEQ ID NO: 580293 - RNA, 64 nt, hsa; identical to SEQ ID NO: 530323

SEQ ID NO: 580294 - RNA, 64 nt, hsa; identical to SEQ ID NO: 530324

SEQ ID NO: 580295 - RNA, 64 nt, hsa; identical to SEQ ID NO: 530325

SEQ ID NO: 580296 - RNA, 64 nt, hsa; identical to SEQ ID NO: 530326

SEQ ID NO: 580297 - RNA, 64 nt, hsa; identical to SEQ ID NO: 530327

SEQ ID NO: 580298 - RNA, 64 nt, hsa; identical to SEQ ID NO: 530328

SEQ ID NO: 580299 - RNA, 64 nt, hsa; identical to SEQ ID NO: 530329

SEQ ID NO: 580300 - RNA, 64 nt, hsa; identical to SEQ ID NO: 530330

SEQ ID NO: 580301 - RNA, 64 nt, hsa; identical to SEQ ID NO: 530331

SEQ ID NO: 580302 - RNA, 64 nt, hsa; identical to SEQ ID NO: 530332

SEQ ID NO: 580303 - RNA, 64 nt, hsa; identical to SEQ ID NO: 530333

SEQ ID NO: 580304 - RNA, 64 nt, hsa; identical to SEQ ID NO: 530334

SEQ ID NO: 580305 - RNA, 64 nt, hsa; identical to SEQ ID NO: 530335

SEQ ID NO: 580306 - RNA, 64 nt, hsa; identical to SEQ ID NO: 530336

SEQ ID NO: 580307 - RNA, 64 nt, hsa; identical to SEQ ID NO: 530337

SEQ ID NO: 580308 - RNA, 64 nt, hsa; identical to SEQ ID NO: 530338

SEQ ID NO: 580309 - RNA, 64 nt, hsa; identical to SEQ ID NO: 530339

SEQ ID NO: 580310 - RNA, 64 nt, hsa; identical to SEQ ID NO: 530340

SEQ ID NO: 580311 - RNA, 64 nt, hsa; identical to SEQ ID NO: 530341

SEQ ID NO: 580312 - RNA, 64 nt, hsa; identical to SEQ ID NO: 530342

SEQ ID NO: 580313 - RNA, 64 nt, hsa; identical to SEQ ID NO: 530343

SEQ ID NO: 580314 - RNA, 64 nt, hsa; identical to SEQ ID NO: 530344

SEQ ID NO: 580315 - RNA, 64 nt, hsa; identical to SEQ ID NO: 530345

SEQ ID NO: 580316 - RNA, 64 nt, hsa
aaauccaugaaaacgcuuagugaauauauucuuaaucauuaauaaauuagcccauuauauuuuc

SEQ ID NO: 580317 - RNA, 64 nt, hsa
aguuuagugauacaaaugauugcaauuuuucuaaaucauuaaauuauuugguuugguggaguga

SEQ ID NO: 580318 - RNA, 64 nt, hsa
agauaugaucuaacaguauuucuaacuauauuugaucauuaaaagccucuuggaauuugaagcg

SEQ ID NO: 580319 - RNA, 64 nt, hsa
aaaaauaacaggacucuguacuggaccuaacuuuaucauuaauuagguaauauuuuccucauuu

SEQ ID NO: 580320 - RNA, 64 nt, hsa
gguuugccaaacagcccaaacuguauacauuacaaucauuaaaaguucuuauuuuuuuuaauau

SEQ ID NO: 580321 - RNA, 64 nt, hsa
ggacuguuuuugguuuuuuguuuuuaaauaaagcaucauuaaugcacaucugcagggguuugcc

SEQ ID NO: 580322 - RNA, 64 nt, hsa
cugcuuucugaacucuaaugugccuucauugauuaucauuaaaauuaucauuaaaauugccuua

SEQ ID NO: 580323 - RNA, 64 nt, hsa
cucuaaugugccuucauugauuaucauuaaaauuaucauuaaaauugccuuauuucuauggacu

SEQ ID NO: 580324 - RNA, 64 nt, hsa
gcagaggacuugcuauuugccaggugcuuuauguaucauuaaauuuuucucauaguucagaaaa

SEQ ID NO: 580325 - RNA, 64 nt, hsa
uuuaucauuaaauuuaguucuaucauuugguacuaucauuaauguauuauauacacugauacuu

SEQ ID NO: 580326 - RNA, 64 nt, hsa
uuuuuccuuuuaaauuuaguucuaucauuaauuuaucauuaaauuuaguucuaucauuugguac

SEQ ID NO: 580327 - RNA, 64 nt, hsa
cuuagaaugacuuuuuccuuuuaaauuuaguucuaucauuaauuuaucauuaaauuuaguucua

SEQ ID NO: 580328 - RNA, 64 nt, hsa
auacuguaacuuccuauaaccuaauauuuucgguaucauuaaccaaaauuucacacucauaguu

SEQ ID NO: 580329 - RNA, 64 nt, hsa
ucacacucauaguugcuaaagagaauguuauucaaucauuaaacucugaacugauuucuucuau

SEQ ID NO: 580330 - RNA, 64 nt, hsa; identical to SEQ ID NO: 85524

SEQ ID NO: 580331 - RNA, 64 nt, hsa; identical to SEQ ID NO: 85525

SEQ ID NO: 580332 - RNA, 64 nt, hsa; identical to SEQ ID NO: 85526

SEQ ID NO: 580333 - RNA, 64 nt, hsa; identical to SEQ ID NO: 85527

SEQ ID NO: 580334 - RNA, 64 nt, hsa; identical to SEQ ID NO: 85528

SEQ ID NO: 580335 - RNA, 64 nt, hsa; identical to SEQ ID NO: 85529

SEQ ID NO: 580336 - RNA, 64 nt, hsa; identical to SEQ ID NO: 85530

SEQ ID NO: 580337 - RNA, 64 nt, hsa; identical to SEQ ID NO: 85531

SEQ ID NO: 580338 - RNA, 64 nt, hsa; identical to SEQ ID NO: 85532

SEQ ID NO: 580339 - RNA, 64 nt, hsa; identical to SEQ ID NO: 85533

SEQ ID NO: 580340 - RNA, 64 nt, hsa; identical to SEQ ID NO: 85534

SEQ ID NO: 580341 - RNA, 64 nt, hsa; identical to SEQ ID NO: 85535

SEQ ID NO: 580342 - RNA, 55 nt, hsa; identical to SEQ ID NO: 85536

SEQ ID NO: 580343 - RNA, 64 nt, hsa; identical to SEQ ID NO: 85537

SEQ ID NO: 580344 - RNA, 64 nt, hsa; identical to SEQ ID NO: 85538

SEQ ID NO: 580345 - RNA, 64 nt, hsa; identical to SEQ ID NO: 85539

SEQ ID NO: 580346 - RNA, 64 nt, hsa; identical to SEQ ID NO: 85540

SEQ ID NO: 580347 - RNA, 64 nt, hsa; identical to SEQ ID NO: 85541

SEQ ID NO: 580348 - RNA, 64 nt, hsa; identical to SEQ ID NO: 85542

SEQ ID NO: 580349 - RNA, 64 nt, hsa; identical to SEQ ID NO: 85543

SEQ ID NO: 580350 - RNA, 64 nt, hsa; identical to SEQ ID NO: 85544

SEQ ID NO: 580351 - RNA, 64 nt, hsa; identical to SEQ ID NO: 85545

SEQ ID NO: 580352 - RNA, 64 nt, hsa; identical to SEQ ID NO: 85546

SEQ ID NO: 580353 - RNA, 64 nt, hsa; identical to SEQ ID NO: 85547

SEQ ID NO: 580354 - RNA, 64 nt, hsa; identical to SEQ ID NO: 85548

SEQ ID NO: 580355 - RNA, 64 nt, hsa; identical to SEQ ID NO: 85549

SEQ ID NO: 580356 - RNA, 64 nt, hsa; identical to SEQ ID NO: 85550

SEQ ID NO: 580357 - RNA, 64 nt, hsa; identical to SEQ ID NO: 85551

SEQ ID NO: 580358 - RNA, 64 nt, hsa; identical to SEQ ID NO: 85552

SEQ ID NO: 580359 - RNA, 64 nt, hsa; identical to SEQ ID NO: 85553

SEQ ID NO: 580360 - RNA, 64 nt, hsa; identical to SEQ ID NO: 85554

SEQ ID NO: 580361 - RNA, 64 nt, hsa; identical to SEQ ID NO: 85555

SEQ ID NO: 580362 - RNA, 64 nt, hsa; identical to SEQ ID NO: 85556

SEQ ID NO: 580363 - RNA, 64 nt, hsa; identical to SEQ ID NO: 85557

SEQ ID NO: 580364 - RNA, 64 nt, hsa; identical to SEQ ID NO: 85558

SEQ ID NO: 580365 - RNA, 64 nt, hsa; identical to SEQ ID NO: 85559

SEQ ID NO: 580366 - RNA, 64 nt, hsa; identical to SEQ ID NO: 85560

SEQ ID NO: 580367 - RNA, 64 nt, hsa; identical to SEQ ID NO: 85561

SEQ ID NO: 580368 - RNA, 64 nt, hsa; identical to SEQ ID NO: 85562

SEQ ID NO: 580369 - RNA, 64 nt, hsa; identical to SEQ ID NO: 85563

SEQ ID NO: 580370 - RNA, 62 nt, hsa; identical to SEQ ID NO: 85564

SEQ ID NO: 580371 - RNA, 57 nt, hsa; identical to SEQ ID NO: 85565

SEQ ID NO: 580372 - RNA, 64 nt, hsa; identical to SEQ ID NO: 85566

SEQ ID NO: 580373 - RNA, 64 nt, hsa; identical to SEQ ID NO: 85567

SEQ ID NO: 580374 - RNA, 64 nt, hsa; identical to SEQ ID NO: 85568

SEQ ID NO: 580375 - RNA, 64 nt, hsa; identical to SEQ ID NO: 85569

SEQ ID NO: 580376 - RNA, 64 nt, hsa; identical to SEQ ID NO: 85570

SEQ ID NO: 580377 - RNA, 64 nt, hsa; identical to SEQ ID NO: 85571

SEQ ID NO: 580378 - RNA, 64 nt, hsa; identical to SEQ ID NO: 170526

SEQ ID NO: 580379 - RNA, 64 nt, hsa; identical to SEQ ID NO: 170527

SEQ ID NO: 580380 - RNA, 64 nt, hsa; identical to SEQ ID NO: 170528

SEQ ID NO: 580381 - RNA, 64 nt, hsa; identical to SEQ ID NO: 170529

SEQ ID NO: 580382 - RNA, 64 nt, hsa; identical to SEQ ID NO: 170530

SEQ ID NO: 580383 - RNA, 64 nt, hsa; identical to SEQ ID NO: 170531

SEQ ID NO: 580384 - RNA, 64 nt, hsa; identical to SEQ ID NO: 170532

SEQ ID NO: 580385 - RNA, 64 nt, hsa; identical to SEQ ID NO: 170533

SEQ ID NO: 580386 - RNA, 64 nt, hsa; identical to SEQ ID NO: 170534

SEQ ID NO: 580387 - RNA, 64 nt, hsa; identical to SEQ ID NO: 170535

SEQ ID NO: 580388 - RNA, 64 nt, hsa; identical to SEQ ID NO: 170536

SEQ ID NO: 580389 - RNA, 64 nt, hsa; identical to SEQ ID NO: 170537

SEQ ID NO: 580390 - RNA, 64 nt, hsa; identical to SEQ ID NO: 170538

SEQ ID NO: 580391 - RNA, 64 nt, hsa; identical to SEQ ID NO: 170539

SEQ ID NO: 580392 - RNA, 64 nt, hsa; identical to SEQ ID NO: 170540

SEQ ID NO: 580393 - RNA, 64 nt, hsa; identical to SEQ ID NO: 170541

SEQ ID NO: 580394 - RNA, 64 nt, hsa; identical to SEQ ID NO: 170542

SEQ ID NO: 580395 - RNA, 64 nt, hsa; identical to SEQ ID NO: 170543

SEQ ID NO: 580396 - RNA, 64 nt, hsa; identical to SEQ ID NO: 170544

SEQ ID NO: 580397 - RNA, 64 nt, hsa; identical to SEQ ID NO: 170545

SEQ ID NO: 580398 - RNA, 64 nt, hsa; identical to SEQ ID NO: 170546

SEQ ID NO: 580399 - RNA, 64 nt, hsa; identical to SEQ ID NO: 170547

SEQ ID NO: 580400 - RNA, 64 nt, hsa; identical to SEQ ID NO: 170548

SEQ ID NO: 580401 - RNA, 64 nt, hsa; identical to SEQ ID NO: 170549

SEQ ID NO: 580402 - RNA, 64 nt, hsa; identical to SEQ ID NO: 170550

SEQ ID NO: 580403 - RNA, 53 nt, hsa; identical to SEQ ID NO: 170551

SEQ ID NO: 580404 - RNA, 64 nt, hsa; identical to SEQ ID NO: 170552

SEQ ID NO: 580405 - RNA, 64 nt, hsa; identical to SEQ ID NO: 170553

SEQ ID NO: 580406 - RNA, 64 nt, hsa; identical to SEQ ID NO: 170554

SEQ ID NO: 580407 - RNA, 64 nt, hsa; identical to SEQ ID NO: 170555

SEQ ID NO: 580408 - RNA, 64 nt, hsa; identical to SEQ ID NO: 170556

SEQ ID NO: 580409 - RNA, 64 nt, hsa; identical to SEQ ID NO: 170557

SEQ ID NO: 580410 - RNA, 64 nt, hsa; identical to SEQ ID NO: 170558

SEQ ID NO: 580411 - RNA, 64 nt, hsa; identical to SEQ ID NO: 170559

SEQ ID NO: 580412 - RNA, 64 nt, hsa; identical to SEQ ID NO: 170560

SEQ ID NO: 580413 - RNA, 64 nt, hsa; identical to SEQ ID NO: 170561

SEQ ID NO: 580414 - RNA, 64 nt, hsa; identical to SEQ ID NO: 170562

SEQ ID NO: 580415 - RNA, 64 nt, hsa; identical to SEQ ID NO: 170563

SEQ ID NO: 580416 - RNA, 64 nt, hsa; identical to SEQ ID NO: 170564

SEQ ID NO: 580417 - RNA, 64 nt, hsa; identical to SEQ ID NO: 170565

SEQ ID NO: 580418 - RNA, 52 nt, hsa; identical to SEQ ID NO: 170566

SEQ ID NO: 580419 - RNA, 64 nt, hsa; identical to SEQ ID NO: 170567

SEQ ID NO: 580420 - RNA, 64 nt, hsa; identical to SEQ ID NO: 170568

SEQ ID NO: 580421 - RNA, 64 nt, hsa; identical to SEQ ID NO: 170569

SEQ ID NO: 580422 - RNA, 64 nt, hsa; identical to SEQ ID NO: 170570

SEQ ID NO: 580423 - RNA, 64 nt, hsa; identical to SEQ ID NO: 170571

SEQ ID NO: 580424 - RNA, 64 nt, hsa; identical to SEQ ID NO: 170572

SEQ ID NO: 580425 - RNA, 64 nt, hsa; identical to SEQ ID NO: 170573

SEQ ID NO: 580426 - RNA, 64 nt, hsa; identical to SEQ ID NO: 170574

SEQ ID NO: 580427 - RNA, 64 nt, hsa; identical to SEQ ID NO: 170575

SEQ ID NO: 580428 - RNA, 64 nt, hsa; identical to SEQ ID NO: 170576

SEQ ID NO: 580429 - RNA, 64 nt, hsa; identical to SEQ ID NO: 170577

SEQ ID NO: 580430 - RNA, 64 nt, hsa; identical to SEQ ID NO: 170578

SEQ ID NO: 580431 - RNA, 64 nt, hsa; identical to SEQ ID NO: 170579

SEQ ID NO: 580432 - RNA, 64 nt, hsa; identical to SEQ ID NO: 170580

SEQ ID NO: 580433 - RNA, 64 nt, hsa; identical to SEQ ID NO: 170581

SEQ ID NO: 580434 - RNA, 64 nt, hsa; identical to SEQ ID NO: 170582

SEQ ID NO: 580435 - RNA, 64 nt, hsa; identical to SEQ ID NO: 170583

SEQ ID NO: 580436 - RNA, 64 nt, hsa; identical to SEQ ID NO: 170584

SEQ ID NO: 580437 - RNA, 64 nt, hsa; identical to SEQ ID NO: 170585

SEQ ID NO: 580438 - RNA, 64 nt, hsa; identical to SEQ ID NO: 170586

SEQ ID NO: 580439 - RNA, 64 nt, hsa; identical to SEQ ID NO: 170587

SEQ ID NO: 580440 - RNA, 64 nt, hsa; identical to SEQ ID NO: 170588

SEQ ID NO: 580441 - RNA, 64 nt, hsa; identical to SEQ ID NO: 170589

SEQ ID NO: 580442 - RNA, 64 nt, hsa; identical to SEQ ID NO: 170590

SEQ ID NO: 580443 - RNA, 64 nt, hsa; identical to SEQ ID NO: 170591

SEQ ID NO: 580444 - RNA, 64 nt, hsa; identical to SEQ ID NO: 170592

SEQ ID NO: 580445 - RNA, 64 nt, hsa; identical to SEQ ID NO: 170593

SEQ ID NO: 580446 - RNA, 64 nt, hsa; identical to SEQ ID NO: 170594

SEQ ID NO: 580447 - RNA, 64 nt, hsa; identical to SEQ ID NO: 170595

SEQ ID NO: 580448 - RNA, 64 nt, hsa; identical to SEQ ID NO: 170596

SEQ ID NO: 580449 - RNA, 64 nt, hsa; identical to SEQ ID NO: 170597

SEQ ID NO: 580450 - RNA, 64 nt, hsa; identical to SEQ ID NO: 170598

SEQ ID NO: 580451 - RNA, 64 nt, hsa; identical to SEQ ID NO: 170599

SEQ ID NO: 580452 - RNA, 64 nt, hsa; identical to SEQ ID NO: 170600

SEQ ID NO: 580453 - RNA, 64 nt, hsa; identical to SEQ ID NO: 170601

SEQ ID NO: 580454 - RNA, 64 nt, hsa; identical to SEQ ID NO: 170602

SEQ ID NO: 580455 - RNA, 64 nt, hsa; identical to SEQ ID NO: 170603

SEQ ID NO: 580456 - RNA, 64 nt, hsa; identical to SEQ ID NO: 170604

SEQ ID NO: 580457 - RNA, 64 nt, hsa; identical to SEQ ID NO: 170605

SEQ ID NO: 580458 - RNA, 64 nt, hsa; identical to SEQ ID NO: 170606

SEQ ID NO: 580459 - RNA, 64 nt, hsa; identical to SEQ ID NO: 170607

SEQ ID NO: 580460 - RNA, 64 nt, hsa; identical to SEQ ID NO: 170608

SEQ ID NO: 580461 - RNA, 64 nt, hsa; identical to SEQ ID NO: 170609

SEQ ID NO: 580462 - RNA, 64 nt, hsa; identical to SEQ ID NO: 170610

SEQ ID NO: 580463 - RNA, 64 nt, hsa; identical to SEQ ID NO: 170611

SEQ ID NO: 580464 - RNA, 64 nt, hsa; identical to SEQ ID NO: 170612

SEQ ID NO: 580465 - RNA, 64 nt, hsa; identical to SEQ ID NO: 170613

SEQ ID NO: 580466 - RNA, 64 nt, hsa; identical to SEQ ID NO: 170614

SEQ ID NO: 580467 - RNA, 64 nt, hsa; identical to SEQ ID NO: 468403

SEQ ID NO: 580468 - RNA, 64 nt, hsa; identical to SEQ ID NO: 468404

SEQ ID NO: 580469 - RNA, 64 nt, hsa; identical to SEQ ID NO: 468405

SEQ ID NO: 580470 - RNA, 64 nt, hsa; identical to SEQ ID NO: 468406

SEQ ID NO: 580471 - RNA, 64 nt, hsa; identical to SEQ ID NO: 468407

SEQ ID NO: 580472 - RNA, 64 nt, hsa; identical to SEQ ID NO: 468408

SEQ ID NO: 580473 - RNA, 64 nt, hsa; identical to SEQ ID NO: 468409

SEQ ID NO: 580474 - RNA, 64 nt, hsa; identical to SEQ ID NO: 468410

SEQ ID NO: 580475 - RNA, 64 nt, hsa; identical to SEQ ID NO: 468411

SEQ ID NO: 580476 - RNA, 64 nt, hsa; identical to SEQ ID NO: 468412

SEQ ID NO: 580477 - RNA, 64 nt, hsa; identical to SEQ ID NO: 468413

SEQ ID NO: 580478 - RNA, 64 nt, hsa; identical to SEQ ID NO: 468414

SEQ ID NO: 580479 - RNA, 64 nt, hsa; identical to SEQ ID NO: 468415

SEQ ID NO: 580480 - RNA, 64 nt, hsa; identical to SEQ ID NO: 484434

SEQ ID NO: 580481 - RNA, 64 nt, hsa; identical to SEQ ID NO: 484435

SEQ ID NO: 580482 - RNA, 64 nt, hsa; identical to SEQ ID NO: 484436

SEQ ID NO: 580483 - RNA, 64 nt, hsa; identical to SEQ ID NO: 484437

SEQ ID NO: 580484 - RNA, 64 nt, hsa; identical to SEQ ID NO: 484438

SEQ ID NO: 580485 - RNA, 64 nt, hsa; identical to SEQ ID NO: 484439

SEQ ID NO: 580486 - RNA, 64 nt, hsa; identical to SEQ ID NO: 484440

SEQ ID NO: 580487 - RNA, 64 nt, hsa; identical to SEQ ID NO: 484441

SEQ ID NO: 580488 - RNA, 64 nt, hsa; identical to SEQ ID NO: 484442

SEQ ID NO: 580489 - RNA, 64 nt, hsa; identical to SEQ ID NO: 484443

SEQ ID NO: 580490 - RNA, 64 nt, hsa; identical to SEQ ID NO: 484444

SEQ ID NO: 580491 - RNA, 64 nt, hsa; identical to SEQ ID NO: 484445

SEQ ID NO: 580492 - RNA, 64 nt, hsa; identical to SEQ ID NO: 484446

SEQ ID NO: 580493 - RNA, 64 nt, hsa; identical to SEQ ID NO: 484447

SEQ ID NO: 580494 - RNA, 64 nt, hsa; identical to SEQ ID NO: 484448

SEQ ID NO: 580495 - RNA, 64 nt, hsa; identical to SEQ ID NO: 484449

SEQ ID NO: 580496 - RNA, 64 nt, hsa; identical to SEQ ID NO: 484450

SEQ ID NO: 580497 - RNA, 64 nt, hsa; identical to SEQ ID NO: 484451

SEQ ID NO: 580498 - RNA, 64 nt, hsa; identical to SEQ ID NO: 484452

SEQ ID NO: 580499 - RNA, 64 nt, hsa; identical to SEQ ID NO: 484453

SEQ ID NO: 580500 - RNA, 64 nt, hsa; identical to SEQ ID NO: 484454

SEQ ID NO: 580501 - RNA, 64 nt, hsa; identical to SEQ ID NO: 484455

SEQ ID NO: 580502 - RNA, 64 nt, hsa; identical to SEQ ID NO: 484456

SEQ ID NO: 580503 - RNA, 64 nt, hsa; identical to SEQ ID NO: 484457

SEQ ID NO: 580504 - RNA, 64 nt, hsa; identical to SEQ ID NO: 484458

SEQ ID NO: 580505 - RNA, 64 nt, hsa; identical to SEQ ID NO: 484459

SEQ ID NO: 580506 - RNA, 64 nt, hsa; identical to SEQ ID NO: 484460

SEQ ID NO: 580507 - RNA, 64 nt, hsa; identical to SEQ ID NO: 484461

SEQ ID NO: 580508 - RNA, 64 nt, hsa; identical to SEQ ID NO: 484462

SEQ ID NO: 580509 - RNA, 64 nt, hsa; identical to SEQ ID NO: 484463

SEQ ID NO: 580510 - RNA, 64 nt, hsa; identical to SEQ ID NO: 484464

SEQ ID NO: 580511 - RNA, 64 nt, hsa; identical to SEQ ID NO: 484465

SEQ ID NO: 580512 - RNA, 64 nt, hsa; identical to SEQ ID NO: 484466

SEQ ID NO: 580513 - RNA, 64 nt, hsa; identical to SEQ ID NO: 484467

SEQ ID NO: 580514 - RNA, 64 nt, hsa; identical to SEQ ID NO: 484468

SEQ ID NO: 580515 - RNA, 64 nt, hsa; identical to SEQ ID NO: 484469

SEQ ID NO: 580516 - RNA, 64 nt, hsa; identical to SEQ ID NO: 484470

SEQ ID NO: 580517 - RNA, 64 nt, hsa; identical to SEQ ID NO: 484471

SEQ ID NO: 580518 - RNA, 64 nt, hsa; identical to SEQ ID NO: 484472

SEQ ID NO: 580519 - RNA, 64 nt, hsa; identical to SEQ ID NO: 484473

SEQ ID NO: 580520 - RNA, 64 nt, hsa; identical to SEQ ID NO: 484474

SEQ ID NO: 580521 - RNA, 64 nt, hsa; identical to SEQ ID NO: 484475

SEQ ID NO: 580522 - RNA, 64 nt, hsa; identical to SEQ ID NO: 484476

SEQ ID NO: 580523 - RNA, 64 nt, hsa; identical to SEQ ID NO: 484477

SEQ ID NO: 580524 - RNA, 64 nt, hsa; identical to SEQ ID NO: 484478

SEQ ID NO: 580525 - RNA, 64 nt, hsa; identical to SEQ ID NO: 484479

SEQ ID NO: 580526 - RNA, 64 nt, hsa; identical to SEQ ID NO: 484480

SEQ ID NO: 580527 - RNA, 64 nt, hsa; identical to SEQ ID NO: 484481

SEQ ID NO: 580528 - RNA, 64 nt, hsa; identical to SEQ ID NO: 484482

SEQ ID NO: 580529 - RNA, 64 nt, hsa; identical to SEQ ID NO: 100251

SEQ ID NO: 580530 - RNA, 64 nt, hsa; identical to SEQ ID NO: 100252

SEQ ID NO: 580531 - RNA, 64 nt, hsa; identical to SEQ ID NO: 100253

SEQ ID NO: 580532 - RNA, 64 nt, hsa; identical to SEQ ID NO: 100254

SEQ ID NO: 580533 - RNA, 64 nt, hsa; identical to SEQ ID NO: 100255

SEQ ID NO: 580534 - RNA, 64 nt, hsa; identical to SEQ ID NO: 100256

SEQ ID NO: 580535 - RNA, 64 nt, hsa; identical to SEQ ID NO: 100257

SEQ ID NO: 580536 - RNA, 64 nt, hsa; identical to SEQ ID NO: 100258

SEQ ID NO: 580537 - RNA, 64 nt, hsa; identical to SEQ ID NO: 100259

SEQ ID NO: 580538 - RNA, 64 nt, hsa; identical to SEQ ID NO: 100260

SEQ ID NO: 580539 - RNA, 64 nt, hsa; identical to SEQ ID NO: 100261

SEQ ID NO: 580540 - RNA, 64 nt, hsa; identical to SEQ ID NO: 100262

SEQ ID NO: 580541 - RNA, 64 nt, hsa; identical to SEQ ID NO: 100263

SEQ ID NO: 580542 - RNA, 64 nt, hsa; identical to SEQ ID NO: 100264

SEQ ID NO: 580543 - RNA, 64 nt, hsa; identical to SEQ ID NO: 100265

SEQ ID NO: 580544 - RNA, 64 nt, hsa; identical to SEQ ID NO: 100266

SEQ ID NO: 580545 - RNA, 64 nt, hsa; identical to SEQ ID NO: 100267

SEQ ID NO: 580546 - RNA, 64 nt, hsa; identical to SEQ ID NO: 100268

SEQ ID NO: 580547 - RNA, 64 nt, hsa; identical to SEQ ID NO: 100269

SEQ ID NO: 580548 - RNA, 64 nt, hsa; identical to SEQ ID NO: 100270

SEQ ID NO: 580549 - RNA, 64 nt, hsa; identical to SEQ ID NO: 100271

SEQ ID NO: 580550 - RNA, 64 nt, hsa; identical to SEQ ID NO: 100272

SEQ ID NO: 580551 - RNA, 64 nt, hsa; identical to SEQ ID NO: 100273

SEQ ID NO: 580552 - RNA, 64 nt, hsa; identical to SEQ ID NO: 100274

SEQ ID NO: 580553 - RNA, 64 nt, hsa; identical to SEQ ID NO: 100275

SEQ ID NO: 580554 - RNA, 64 nt, hsa; identical to SEQ ID NO: 100276

SEQ ID NO: 580555 - RNA, 64 nt, hsa; identical to SEQ ID NO: 100277

SEQ ID NO: 580556 - RNA, 64 nt, hsa; identical to SEQ ID NO: 100278

SEQ ID NO: 580557 - RNA, 64 nt, hsa; identical to SEQ ID NO: 100279

SEQ ID NO: 580558 - RNA, 64 nt, hsa; identical to SEQ ID NO: 100280

SEQ ID NO: 580559 - RNA, 64 nt, hsa; identical to SEQ ID NO: 100281

SEQ ID NO: 580560 - RNA, 64 nt, hsa; identical to SEQ ID NO: 100282

SEQ ID NO: 580561 - RNA, 64 nt, hsa; identical to SEQ ID NO: 100283

SEQ ID NO: 580562 - RNA, 64 nt, hsa; identical to SEQ ID NO: 100284

SEQ ID NO: 580563 - RNA, 64 nt, hsa; identical to SEQ ID NO: 100285

SEQ ID NO: 580564 - RNA, 64 nt, hsa; identical to SEQ ID NO: 100286

SEQ ID NO: 580565 - RNA, 64 nt, hsa; identical to SEQ ID NO: 100287

SEQ ID NO: 580566 - RNA, 64 nt, hsa; identical to SEQ ID NO: 100288

SEQ ID NO: 580567 - RNA, 64 nt, hsa; identical to SEQ ID NO: 100289

SEQ ID NO: 580568 - RNA, 64 nt, hsa; identical to SEQ ID NO: 100290

SEQ ID NO: 580569 - RNA, 64 nt, hsa; identical to SEQ ID NO: 100291

SEQ ID NO: 580570 - RNA, 64 nt, hsa; identical to SEQ ID NO: 100292

SEQ ID NO: 580571 - RNA, 64 nt, hsa; identical to SEQ ID NO: 100293

SEQ ID NO: 580572 - RNA, 64 nt, hsa; identical to SEQ ID NO: 100294

SEQ ID NO: 580573 - RNA, 64 nt, hsa; identical to SEQ ID NO: 100295

SEQ ID NO: 580574 - RNA, 64 nt, hsa; identical to SEQ ID NO: 100296

SEQ ID NO: 580575 - RNA, 64 nt, hsa; identical to SEQ ID NO: 100297

SEQ ID NO: 580576 - RNA, 64 nt, hsa; identical to SEQ ID NO: 100298

SEQ ID NO: 580577 - RNA, 64 nt, hsa; identical to SEQ ID NO: 100299

SEQ ID NO: 580578 - RNA, 64 nt, hsa; identical to SEQ ID NO: 100300

SEQ ID NO: 580579 - RNA, 64 nt, hsa; identical to SEQ ID NO: 100301

SEQ ID NO: 580580 - RNA, 64 nt, hsa; identical to SEQ ID NO: 100302

SEQ ID NO: 580581 - RNA, 64 nt, hsa; identical to SEQ ID NO: 100303

SEQ ID NO: 580582 - RNA, 62 nt, hsa
aguggccagcuucacucucugggggagugcaggguggacaucaccuuggaggcccugcacug

SEQ ID NO: 580583 - RNA, 62 nt, hsa
cagaagcucccagcugaccagacacugccugggguggacauucagcagagugcgaguggaga

SEQ ID NO: 580584 - RNA, 62 nt, hsa
ggaauaauaaaccaaugaguuagcucagggccgguggacauguucacugguggaccaguugg

SEQ ID NO: 580585 - RNA, 62 nt, hsa
guuccccuugguuaacugauuuuuuaauccaggguggacauuuuuucaaccuuuauuaaaaa

SEQ ID NO: 580586 - RNA, 62 nt, hsa
gggccggcaaggccauaccucggugagggacagguggacaacggucaccuaucuguagccag

SEQ ID NO: 580587 - RNA, 62 nt, hsa
uccucuugguaaguguggcccacacccagccugguggacauggaaaggcuucucagccucug

SEQ ID NO: 580588 - RNA, 62 nt, hsa
gaaccacguaaagcucgaaccacguggcaagugguggacaaaacuucaacgcaugauauuua

SEQ ID NO: 580589 - RNA, 62 nt, hsa
gggggcucuuccaagucagaagaauggaggaagguggacaagcaacccagcaucccccgacc

SEQ ID NO: 580590 - RNA, 62 nt, hsa
accuugguggcacugguggacaugggaaagcagguggacaugagcuaacccugagcuugucc

SEQ ID NO: 580591 - RNA, 62 nt, hsa
cccgcuggccagagggacaccuugguggcacugguggacaugggaaagcagguggacaugag

SEQ ID NO: 580592 - RNA, 62 nt, hsa
uccgcuuacgguacaagcugacauucaaccaagguggacagccuuucagcgaaguaggagaa

SEQ ID NO: 580593 - RNA, 62 nt, hsa
ugcaugaagaccugcccccugauugacuuggagguggacaauggaccugcgcagauggggac

SEQ ID NO: 580594 - RNA, 62 nt, hsa
acucaugccaacagucuuuaugaugggauuaagguggacaagaucuccuaagaucugugaau

SEQ ID NO: 580595 - RNA, 62 nt, hsa
caagaucuccuaagaucugugaaugggauuaagguggacaagaucuccuaagaucugaaaag

SEQ ID NO: 580596 - RNA, 64 nt, hsa; identical to SEQ ID NO: 266801

SEQ ID NO: 580597 - RNA, 64 nt, hsa; identical to SEQ ID NO: 266802

SEQ ID NO: 580598 - RNA, 64 nt, hsa; identical to SEQ ID NO: 266803

SEQ ID NO: 580599 - RNA, 64 nt, hsa; identical to SEQ ID NO: 266804

SEQ ID NO: 580600 - RNA, 64 nt, hsa; identical to SEQ ID NO: 266805

SEQ ID NO: 580601 - RNA, 64 nt, hsa; identical to SEQ ID NO: 266806

SEQ ID NO: 580602 - RNA, 64 nt, hsa; identical to SEQ ID NO: 58312

SEQ ID NO: 580603 - RNA, 64 nt, hsa; identical to SEQ ID NO: 58313

SEQ ID NO: 580604 - RNA, 64 nt, hsa; identical to SEQ ID NO: 58314

SEQ ID NO: 580605 - RNA, 64 nt, hsa; identical to SEQ ID NO: 58315

SEQ ID NO: 580606 - RNA, 64 nt, hsa; identical to SEQ ID NO: 58316

SEQ ID NO: 580607 - RNA, 64 nt, hsa; identical to SEQ ID NO: 58317

SEQ ID NO: 580608 - RNA, 64 nt, hsa; identical to SEQ ID NO: 58318

SEQ ID NO: 580609 - RNA, 64 nt, hsa; identical to SEQ ID NO: 58319

SEQ ID NO: 580610 - RNA, 64 nt, hsa; identical to SEQ ID NO: 58320

SEQ ID NO: 580611 - RNA, 64 nt, hsa; identical to SEQ ID NO: 58321

SEQ ID NO: 580612 - RNA, 64 nt, hsa; identical to SEQ ID NO: 58322

SEQ ID NO: 580613 - RNA, 64 nt, hsa; identical to SEQ ID NO: 58323

SEQ ID NO: 580614 - RNA, 64 nt, hsa; identical to SEQ ID NO: 58324

SEQ ID NO: 580615 - RNA, 64 nt, hsa; identical to SEQ ID NO: 58325

SEQ ID NO: 580616 - RNA, 64 nt, hsa; identical to SEQ ID NO: 58326

SEQ ID NO: 580617 - RNA, 64 nt, hsa; identical to SEQ ID NO: 58327

SEQ ID NO: 580618 - RNA, 64 nt, hsa; identical to SEQ ID NO: 58328

SEQ ID NO: 580619 - RNA, 64 nt, hsa; identical to SEQ ID NO: 58329

SEQ ID NO: 580620 - RNA, 64 nt, hsa; identical to SEQ ID NO: 58330

SEQ ID NO: 580621 - RNA, 64 nt, hsa; identical to SEQ ID NO: 58331

SEQ ID NO: 580622 - RNA, 64 nt, hsa; identical to SEQ ID NO: 58332

SEQ ID NO: 580623 - RNA, 64 nt, hsa; identical to SEQ ID NO: 58333

SEQ ID NO: 580624 - RNA, 64 nt, hsa; identical to SEQ ID NO: 58334

SEQ ID NO: 580625 - RNA, 64 nt, hsa; identical to SEQ ID NO: 58335

SEQ ID NO: 580626 - RNA, 64 nt, hsa; identical to SEQ ID NO: 58336

SEQ ID NO: 580627 - RNA, 64 nt, hsa; identical to SEQ ID NO: 58337

SEQ ID NO: 580628 - RNA, 64 nt, hsa; identical to SEQ ID NO: 58338

SEQ ID NO: 580629 - RNA, 64 nt, hsa; identical to SEQ ID NO: 58339

SEQ ID NO: 580630 - RNA, 64 nt, hsa; identical to SEQ ID NO: 58340

SEQ ID NO: 580631 - RNA, 64 nt, hsa; identical to SEQ ID NO: 58341

SEQ ID NO: 580632 - RNA, 64 nt, hsa; identical to SEQ ID NO: 58342

SEQ ID NO: 580633 - RNA, 64 nt, hsa; identical to SEQ ID NO: 58343

SEQ ID NO: 580634 - RNA, 64 nt, hsa; identical to SEQ ID NO: 58344

SEQ ID NO: 580635 - RNA, 64 nt, hsa; identical to SEQ ID NO: 58345

SEQ ID NO: 580636 - RNA, 64 nt, hsa; identical to SEQ ID NO: 58346

SEQ ID NO: 580637 - RNA, 64 nt, hsa; identical to SEQ ID NO: 58347

SEQ ID NO: 580638 - RNA, 64 nt, hsa; identical to SEQ ID NO: 58348

SEQ ID NO: 580639 - RNA, 64 nt, hsa; identical to SEQ ID NO: 58349

SEQ ID NO: 580640 - RNA, 64 nt, hsa; identical to SEQ ID NO: 58350

SEQ ID NO: 580641 - RNA, 64 nt, hsa; identical to SEQ ID NO: 58351

SEQ ID NO: 580642 - RNA, 64 nt, hsa; identical to SEQ ID NO: 58352

SEQ ID NO: 580643 - RNA, 64 nt, hsa; identical to SEQ ID NO: 58353

SEQ ID NO: 580644 - RNA, 64 nt, hsa; identical to SEQ ID NO: 58354

SEQ ID NO: 580645 - RNA, 64 nt, hsa; identical to SEQ ID NO: 58355

SEQ ID NO: 580646 - RNA, 64 nt, hsa; identical to SEQ ID NO: 58356

SEQ ID NO: 580647 - RNA, 64 nt, hsa; identical to SEQ ID NO: 58357

SEQ ID NO: 580648 - RNA, 64 nt, hsa; identical to SEQ ID NO: 58358

SEQ ID NO: 580649 - RNA, 64 nt, hsa; identical to SEQ ID NO: 58359

SEQ ID NO: 580650 - RNA, 64 nt, hsa; identical to SEQ ID NO: 58360

SEQ ID NO: 580651 - RNA, 64 nt, hsa; identical to SEQ ID NO: 58361

SEQ ID NO: 580652 - RNA, 64 nt, hsa; identical to SEQ ID NO: 58362

SEQ ID NO: 580653 - RNA, 64 nt, hsa; identical to SEQ ID NO: 58363

SEQ ID NO: 580654 - RNA, 64 nt, hsa; identical to SEQ ID NO: 58364

SEQ ID NO: 580655 - RNA, 64 nt, hsa; identical to SEQ ID NO: 58365

SEQ ID NO: 580656 - RNA, 64 nt, hsa; identical to SEQ ID NO: 58366

SEQ ID NO: 580657 - RNA, 64 nt, hsa; identical to SEQ ID NO: 58367

SEQ ID NO: 580658 - RNA, 64 nt, hsa; identical to SEQ ID NO: 58368

SEQ ID NO: 580659 - RNA, 64 nt, hsa; identical to SEQ ID NO: 58369

SEQ ID NO: 580660 - RNA, 64 nt, hsa; identical to SEQ ID NO: 58370

SEQ ID NO: 580661 - RNA, 64 nt, hsa; identical to SEQ ID NO: 58371

SEQ ID NO: 580662 - RNA, 64 nt, hsa; identical to SEQ ID NO: 58372

SEQ ID NO: 580663 - RNA, 64 nt, hsa; identical to SEQ ID NO: 58373

SEQ ID NO: 580664 - RNA, 64 nt, hsa; identical to SEQ ID NO: 58374

SEQ ID NO: 580665 - RNA, 64 nt, hsa; identical to SEQ ID NO: 58375

SEQ ID NO: 580666 - RNA, 64 nt, hsa; identical to SEQ ID NO: 58376

SEQ ID NO: 580667 - RNA, 64 nt, hsa; identical to SEQ ID NO: 58377

SEQ ID NO: 580668 - RNA, 64 nt, hsa; identical to SEQ ID NO: 58378

SEQ ID NO: 580669 - RNA, 64 nt, hsa; identical to SEQ ID NO: 58379

SEQ ID NO: 580670 - RNA, 64 nt, hsa; identical to SEQ ID NO: 58380

SEQ ID NO: 580671 - RNA, 64 nt, hsa; identical to SEQ ID NO: 58381

SEQ ID NO: 580672 - RNA, 64 nt, hsa; identical to SEQ ID NO: 58382

SEQ ID NO: 580673 - RNA, 64 nt, hsa; identical to SEQ ID NO: 58383

SEQ ID NO: 580674 - RNA, 64 nt, hsa; identical to SEQ ID NO: 58384

SEQ ID NO: 580675 - RNA, 64 nt, hsa; identical to SEQ ID NO: 58385

SEQ ID NO: 580676 - RNA, 64 nt, hsa; identical to SEQ ID NO: 58386

SEQ ID NO: 580677 - RNA, 64 nt, hsa; identical to SEQ ID NO: 58387

SEQ ID NO: 580678 - RNA, 64 nt, hsa; identical to SEQ ID NO: 58388

SEQ ID NO: 580679 - RNA, 64 nt, hsa; identical to SEQ ID NO: 58389

SEQ ID NO: 580680 - RNA, 64 nt, hsa; identical to SEQ ID NO: 58390

SEQ ID NO: 580681 - RNA, 64 nt, hsa; identical to SEQ ID NO: 58391

SEQ ID NO: 580682 - RNA, 64 nt, hsa; identical to SEQ ID NO: 58392

SEQ ID NO: 580683 - RNA, 64 nt, hsa; identical to SEQ ID NO: 58393

SEQ ID NO: 580684 - RNA, 64 nt, hsa; identical to SEQ ID NO: 58394

SEQ ID NO: 580685 - RNA, 64 nt, hsa; identical to SEQ ID NO: 58395

SEQ ID NO: 580686 - RNA, 64 nt, hsa; identical to SEQ ID NO: 58396

SEQ ID NO: 580687 - RNA, 64 nt, hsa; identical to SEQ ID NO: 58397

SEQ ID NO: 580688 - RNA, 64 nt, hsa; identical to SEQ ID NO: 58398

SEQ ID NO: 580689 - RNA, 64 nt, hsa; identical to SEQ ID NO: 58399

SEQ ID NO: 580690 - RNA, 64 nt, hsa; identical to SEQ ID NO: 58400

SEQ ID NO: 580691 - RNA, 64 nt, hsa; identical to SEQ ID NO: 58401

SEQ ID NO: 580692 - RNA, 64 nt, hsa; identical to SEQ ID NO: 58402

SEQ ID NO: 580693 - RNA, 64 nt, hsa; identical to SEQ ID NO: 58403

SEQ ID NO: 580694 - RNA, 64 nt, hsa; identical to SEQ ID NO: 58404

SEQ ID NO: 580695 - RNA, 64 nt, hsa; identical to SEQ ID NO: 58405

SEQ ID NO: 580696 - RNA, 64 nt, hsa; identical to SEQ ID NO: 58406

SEQ ID NO: 580697 - RNA, 64 nt, hsa; identical to SEQ ID NO: 58407

SEQ ID NO: 580698 - RNA, 64 nt, hsa; identical to SEQ ID NO: 58408

SEQ ID NO: 580699 - RNA, 64 nt, hsa; identical to SEQ ID NO: 58409

SEQ ID NO: 580700 - RNA, 64 nt, hsa; identical to SEQ ID NO: 58410

SEQ ID NO: 580701 - RNA, 64 nt, hsa; identical to SEQ ID NO: 58411

SEQ ID NO: 580702 - RNA, 64 nt, hsa; identical to SEQ ID NO: 58412

SEQ ID NO: 580703 - RNA, 64 nt, hsa; identical to SEQ ID NO: 58413

SEQ ID NO: 580704 - RNA, 64 nt, hsa; identical to SEQ ID NO: 58414

SEQ ID NO: 580705 - RNA, 64 nt, hsa; identical to SEQ ID NO: 58415

SEQ ID NO: 580706 - RNA, 64 nt, hsa; identical to SEQ ID NO: 58416

SEQ ID NO: 580707 - RNA, 64 nt, hsa; identical to SEQ ID NO: 58417

SEQ ID NO: 580708 - RNA, 64 nt, hsa; identical to SEQ ID NO: 58418

SEQ ID NO: 580709 - RNA, 64 nt, hsa; identical to SEQ ID NO: 58419

SEQ ID NO: 580710 - RNA, 64 nt, hsa; identical to SEQ ID NO: 58420

SEQ ID NO: 580711 - RNA, 64 nt, hsa; identical to SEQ ID NO: 58421

SEQ ID NO: 580712 - RNA, 64 nt, hsa; identical to SEQ ID NO: 58422

SEQ ID NO: 580713 - RNA, 64 nt, hsa; identical to SEQ ID NO: 58423

SEQ ID NO: 580714 - RNA, 64 nt, hsa; identical to SEQ ID NO: 58424

SEQ ID NO: 580715 - RNA, 64 nt, hsa; identical to SEQ ID NO: 58425

SEQ ID NO: 580716 - RNA, 64 nt, hsa; identical to SEQ ID NO: 58426

SEQ ID NO: 580717 - RNA, 64 nt, hsa; identical to SEQ ID NO: 58427

SEQ ID NO: 580718 - RNA, 64 nt, hsa; identical to SEQ ID NO: 58428

SEQ ID NO: 580719 - RNA, 64 nt, hsa; identical to SEQ ID NO: 58429

SEQ ID NO: 580720 - RNA, 64 nt, hsa; identical to SEQ ID NO: 58430

SEQ ID NO: 580721 - RNA, 64 nt, hsa; identical to SEQ ID NO: 58431

SEQ ID NO: 580722 - RNA, 64 nt, hsa; identical to SEQ ID NO: 58432

SEQ ID NO: 580723 - RNA, 64 nt, hsa; identical to SEQ ID NO: 58433

SEQ ID NO: 580724 - RNA, 64 nt, hsa; identical to SEQ ID NO: 58434

SEQ ID NO: 580725 - RNA, 64 nt, hsa; identical to SEQ ID NO: 58435

SEQ ID NO: 580726 - RNA, 50 nt, hsa; identical to SEQ ID NO: 58436

SEQ ID NO: 580727 - RNA, 64 nt, hsa; identical to SEQ ID NO: 58437

SEQ ID NO: 580728 - RNA, 64 nt, hsa; identical to SEQ ID NO: 58438

SEQ ID NO: 580729 - RNA, 64 nt, hsa; identical to SEQ ID NO: 58439

SEQ ID NO: 580730 - RNA, 64 nt, hsa; identical to SEQ ID NO: 58440

SEQ ID NO: 580731 - RNA, 64 nt, hsa; identical to SEQ ID NO: 58441

SEQ ID NO: 580732 - RNA, 64 nt, hsa; identical to SEQ ID NO: 58442

SEQ ID NO: 580733 - RNA, 64 nt, hsa; identical to SEQ ID NO: 58443

SEQ ID NO: 580734 - RNA, 64 nt, hsa; identical to SEQ ID NO: 58444

SEQ ID NO: 580735 - RNA, 64 nt, hsa; identical to SEQ ID NO: 58445

SEQ ID NO: 580736 - RNA, 64 nt, hsa; identical to SEQ ID NO: 58446

SEQ ID NO: 580737 - RNA, 64 nt, hsa; identical to SEQ ID NO: 58447

SEQ ID NO: 580738 - RNA, 64 nt, hsa; identical to SEQ ID NO: 58448

SEQ ID NO: 580739 - RNA, 64 nt, hsa; identical to SEQ ID NO: 58449

SEQ ID NO: 580740 - RNA, 64 nt, hsa; identical to SEQ ID NO: 58450

SEQ ID NO: 580741 - RNA, 64 nt, hsa; identical to SEQ ID NO: 58451

SEQ ID NO: 580742 - RNA, 64 nt, hsa; identical to SEQ ID NO: 58452

SEQ ID NO: 580743 - RNA, 64 nt, hsa; identical to SEQ ID NO: 58453

SEQ ID NO: 580744 - RNA, 64 nt, hsa; identical to SEQ ID NO: 58454

SEQ ID NO: 580745 - RNA, 64 nt, hsa; identical to SEQ ID NO: 58455

SEQ ID NO: 580746 - RNA, 64 nt, hsa; identical to SEQ ID NO: 58456

SEQ ID NO: 580747 - RNA, 64 nt, hsa; identical to SEQ ID NO: 58457

SEQ ID NO: 580748 - RNA, 64 nt, hsa; identical to SEQ ID NO: 58458

SEQ ID NO: 580749 - RNA, 64 nt, hsa; identical to SEQ ID NO: 58459

SEQ ID NO: 580750 - RNA, 64 nt, hsa; identical to SEQ ID NO: 58460

SEQ ID NO: 580751 - RNA, 64 nt, hsa; identical to SEQ ID NO: 58461

SEQ ID NO: 580752 - RNA, 64 nt, hsa; identical to SEQ ID NO: 58462

SEQ ID NO: 580753 - RNA, 64 nt, hsa; identical to SEQ ID NO: 58463

SEQ ID NO: 580754 - RNA, 64 nt, hsa; identical to SEQ ID NO: 58464

SEQ ID NO: 580755 - RNA, 64 nt, hsa; identical to SEQ ID NO: 58465

SEQ ID NO: 580756 - RNA, 64 nt, hsa; identical to SEQ ID NO: 58466

SEQ ID NO: 580757 - RNA, 64 nt, hsa; identical to SEQ ID NO: 58467

SEQ ID NO: 580758 - RNA, 64 nt, hsa; identical to SEQ ID NO: 118152

SEQ ID NO: 580759 - RNA, 64 nt, hsa; identical to SEQ ID NO: 118153

SEQ ID NO: 580760 - RNA, 64 nt, hsa; identical to SEQ ID NO: 118154

SEQ ID NO: 580761 - RNA, 64 nt, hsa; identical to SEQ ID NO: 118155

SEQ ID NO: 580762 - RNA, 64 nt, hsa; identical to SEQ ID NO: 118156

SEQ ID NO: 580763 - RNA, 64 nt, hsa; identical to SEQ ID NO: 118157

SEQ ID NO: 580764 - RNA, 64 nt, hsa; identical to SEQ ID NO: 118158

SEQ ID NO: 580765 - RNA, 64 nt, hsa; identical to SEQ ID NO: 118159

SEQ ID NO: 580766 - RNA, 59 nt, hsa; identical to SEQ ID NO: 76155

SEQ ID NO: 580767 - RNA, 64 nt, hsa; identical to SEQ ID NO: 76156

SEQ ID NO: 580768 - RNA, 64 nt, hsa; identical to SEQ ID NO: 76157

SEQ ID NO: 580769 - RNA, 64 nt, hsa; identical to SEQ ID NO: 76158

SEQ ID NO: 580770 - RNA, 64 nt, hsa; identical to SEQ ID NO: 76159

SEQ ID NO: 580771 - RNA, 64 nt, hsa; identical to SEQ ID NO: 76160

SEQ ID NO: 580772 - RNA, 64 nt, hsa; identical to SEQ ID NO: 76161

SEQ ID NO: 580773 - RNA, 64 nt, hsa; identical to SEQ ID NO: 76162

SEQ ID NO: 580774 - RNA, 64 nt, hsa; identical to SEQ ID NO: 76163

SEQ ID NO: 580775 - RNA, 64 nt, hsa; identical to SEQ ID NO: 76164

SEQ ID NO: 580776 - RNA, 64 nt, hsa; identical to SEQ ID NO: 76165

SEQ ID NO: 580777 - RNA, 64 nt, hsa; identical to SEQ ID NO: 76166

SEQ ID NO: 580778 - RNA, 64 nt, hsa; identical to SEQ ID NO: 76167

SEQ ID NO: 580779 - RNA, 64 nt, hsa; identical to SEQ ID NO: 76168

SEQ ID NO: 580780 - RNA, 64 nt, hsa; identical to SEQ ID NO: 76169

SEQ ID NO: 580781 - RNA, 58 nt, hsa; identical to SEQ ID NO: 76170

SEQ ID NO: 580782 - RNA, 64 nt, hsa; identical to SEQ ID NO: 76171

SEQ ID NO: 580783 - RNA, 64 nt, hsa; identical to SEQ ID NO: 76172

SEQ ID NO: 580784 - RNA, 64 nt, hsa; identical to SEQ ID NO: 76173

SEQ ID NO: 580785 - RNA, 64 nt, hsa; identical to SEQ ID NO: 76174

SEQ ID NO: 580786 - RNA, 64 nt, hsa; identical to SEQ ID NO: 76175

SEQ ID NO: 580787 - RNA, 52 nt, hsa; identical to SEQ ID NO: 76176

SEQ ID NO: 580788 - RNA, 64 nt, hsa; identical to SEQ ID NO: 76177

SEQ ID NO: 580789 - RNA, 64 nt, hsa; identical to SEQ ID NO: 76178

SEQ ID NO: 580790 - RNA, 64 nt, hsa; identical to SEQ ID NO: 76179

SEQ ID NO: 580791 - RNA, 64 nt, hsa; identical to SEQ ID NO: 76180

SEQ ID NO: 580792 - RNA, 64 nt, hsa; identical to SEQ ID NO: 76181

SEQ ID NO: 580793 - RNA, 64 nt, hsa; identical to SEQ ID NO: 76182

SEQ ID NO: 580794 - RNA, 64 nt, hsa; identical to SEQ ID NO: 76183

SEQ ID NO: 580795 - RNA, 64 nt, hsa; identical to SEQ ID NO: 76184

SEQ ID NO: 580796 - RNA, 64 nt, hsa; identical to SEQ ID NO: 76185

SEQ ID NO: 580797 - RNA, 64 nt, hsa; identical to SEQ ID NO: 76186

SEQ ID NO: 580798 - RNA, 64 nt, hsa; identical to SEQ ID NO: 76187

SEQ ID NO: 580799 - RNA, 64 nt, hsa; identical to SEQ ID NO: 76188

SEQ ID NO: 580800 - RNA, 64 nt, hsa; identical to SEQ ID NO: 76189

SEQ ID NO: 580801 - RNA, 64 nt, hsa; identical to SEQ ID NO: 76190

SEQ ID NO: 580802 - RNA, 64 nt, hsa; identical to SEQ ID NO: 76191

SEQ ID NO: 580803 - RNA, 64 nt, hsa; identical to SEQ ID NO: 76192

SEQ ID NO: 580804 - RNA, 64 nt, hsa; identical to SEQ ID NO: 76193

SEQ ID NO: 580805 - RNA, 64 nt, hsa; identical to SEQ ID NO: 76194

SEQ ID NO: 580806 - RNA, 64 nt, hsa; identical to SEQ ID NO: 76195

SEQ ID NO: 580807 - RNA, 64 nt, hsa; identical to SEQ ID NO: 76196

SEQ ID NO: 580808 - RNA, 64 nt, hsa; identical to SEQ ID NO: 76197

SEQ ID NO: 580809 - RNA, 64 nt, hsa; identical to SEQ ID NO: 76198

SEQ ID NO: 580810 - RNA, 64 nt, hsa; identical to SEQ ID NO: 76199

SEQ ID NO: 580811 - RNA, 64 nt, hsa; identical to SEQ ID NO: 76200

SEQ ID NO: 580812 - RNA, 64 nt, hsa; identical to SEQ ID NO: 76201

SEQ ID NO: 580813 - RNA, 64 nt, hsa; identical to SEQ ID NO: 76202

SEQ ID NO: 580814 - RNA, 64 nt, hsa; identical to SEQ ID NO: 76203

SEQ ID NO: 580815 - RNA, 64 nt, hsa; identical to SEQ ID NO: 76204

SEQ ID NO: 580816 - RNA, 64 nt, hsa; identical to SEQ ID NO: 76205

SEQ ID NO: 580817 - RNA, 64 nt, hsa; identical to SEQ ID NO: 76206

SEQ ID NO: 580818 - RNA, 64 nt, hsa; identical to SEQ ID NO: 76207

SEQ ID NO: 580819 - RNA, 64 nt, hsa; identical to SEQ ID NO: 76208

SEQ ID NO: 580820 - RNA, 64 nt, hsa; identical to SEQ ID NO: 76209

SEQ ID NO: 580821 - RNA, 64 nt, hsa; identical to SEQ ID NO: 76210

SEQ ID NO: 580822 - RNA, 64 nt, hsa; identical to SEQ ID NO: 76211

SEQ ID NO: 580823 - RNA, 64 nt, hsa; identical to SEQ ID NO: 76212

SEQ ID NO: 580824 - RNA, 64 nt, hsa; identical to SEQ ID NO: 76213

SEQ ID NO: 580825 - RNA, 64 nt, hsa; identical to SEQ ID NO: 76214

SEQ ID NO: 580826 - RNA, 64 nt, hsa; identical to SEQ ID NO: 76215

SEQ ID NO: 580827 - RNA, 64 nt, hsa; identical to SEQ ID NO: 76216

SEQ ID NO: 580828 - RNA, 64 nt, hsa; identical to SEQ ID NO: 76217

SEQ ID NO: 580829 - RNA, 64 nt, hsa; identical to SEQ ID NO: 76218

SEQ ID NO: 580830 - RNA, 64 nt, hsa; identical to SEQ ID NO: 76219

SEQ ID NO: 580831 - RNA, 64 nt, hsa; identical to SEQ ID NO: 238461

SEQ ID NO: 580832 - RNA, 64 nt, hsa; identical to SEQ ID NO: 238462

SEQ ID NO: 580833 - RNA, 64 nt, hsa; identical to SEQ ID NO: 238463

SEQ ID NO: 580834 - RNA, 64 nt, hsa; identical to SEQ ID NO: 238464

SEQ ID NO: 580835 - RNA, 64 nt, hsa; identical to SEQ ID NO: 238465

SEQ ID NO: 580836 - RNA, 64 nt, hsa; identical to SEQ ID NO: 238466

SEQ ID NO: 580837 - RNA, 64 nt, hsa; identical to SEQ ID NO: 238467

SEQ ID NO: 580838 - RNA, 64 nt, hsa; identical to SEQ ID NO: 238468

SEQ ID NO: 580839 - RNA, 64 nt, hsa; identical to SEQ ID NO: 265126

SEQ ID NO: 580840 - RNA, 64 nt, hsa; identical to SEQ ID NO: 265127

SEQ ID NO: 580841 - RNA, 64 nt, hsa; identical to SEQ ID NO: 265128

SEQ ID NO: 580842 - RNA, 64 nt, hsa; identical to SEQ ID NO: 265129

SEQ ID NO: 580843 - RNA, 64 nt, hsa; identical to SEQ ID NO: 265130

SEQ ID NO: 580844 - RNA, 64 nt, hsa; identical to SEQ ID NO: 265131

SEQ ID NO: 580845 - RNA, 64 nt, hsa; identical to SEQ ID NO: 265132

SEQ ID NO: 580846 - RNA, 64 nt, hsa; identical to SEQ ID NO: 265133

SEQ ID NO: 580847 - RNA, 64 nt, hsa; identical to SEQ ID NO: 265134

SEQ ID NO: 580848 - RNA, 64 nt, hsa; identical to SEQ ID NO: 265135

SEQ ID NO: 580849 - RNA, 64 nt, hsa; identical to SEQ ID NO: 265136

SEQ ID NO: 580850 - RNA, 64 nt, hsa; identical to SEQ ID NO: 265137

SEQ ID NO: 580851 - RNA, 64 nt, hsa; identical to SEQ ID NO: 265138

SEQ ID NO: 580852 - RNA, 64 nt, hsa; identical to SEQ ID NO: 265139

SEQ ID NO: 580853 - RNA, 64 nt, hsa; identical to SEQ ID NO: 265140

SEQ ID NO: 580854 - RNA, 64 nt, hsa; identical to SEQ ID NO: 265141

SEQ ID NO: 580855 - RNA, 64 nt, hsa; identical to SEQ ID NO: 265142

SEQ ID NO: 580856 - RNA, 64 nt, hsa; identical to SEQ ID NO: 265143

SEQ ID NO: 580857 - RNA, 64 nt, hsa; identical to SEQ ID NO: 265144

SEQ ID NO: 580858 - RNA, 64 nt, hsa; identical to SEQ ID NO: 265145

SEQ ID NO: 580859 - RNA, 64 nt, hsa; identical to SEQ ID NO: 265146

SEQ ID NO: 580860 - RNA, 64 nt, hsa; identical to SEQ ID NO: 265147

SEQ ID NO: 580861 - RNA, 64 nt, hsa; identical to SEQ ID NO: 265148

SEQ ID NO: 580862 - RNA, 64 nt, hsa; identical to SEQ ID NO: 265149

SEQ ID NO: 580863 - RNA, 63 nt, hsa; identical to SEQ ID NO: 265150

SEQ ID NO: 580864 - RNA, 64 nt, hsa; identical to SEQ ID NO: 265151

SEQ ID NO: 580865 - RNA, 64 nt, hsa; identical to SEQ ID NO: 265152

SEQ ID NO: 580866 - RNA, 64 nt, hsa; identical to SEQ ID NO: 265153

SEQ ID NO: 580867 - RNA, 64 nt, hsa; identical to SEQ ID NO: 265154

SEQ ID NO: 580868 - RNA, 64 nt, hsa; identical to SEQ ID NO: 265155

SEQ ID NO: 580869 - RNA, 64 nt, hsa; identical to SEQ ID NO: 265156

SEQ ID NO: 580870 - RNA, 64 nt, hsa; identical to SEQ ID NO: 265157

SEQ ID NO: 580871 - RNA, 64 nt, hsa; identical to SEQ ID NO: 265158

SEQ ID NO: 580872 - RNA, 64 nt, hsa; identical to SEQ ID NO: 265159

SEQ ID NO: 580873 - RNA, 64 nt, hsa; identical to SEQ ID NO: 265160

SEQ ID NO: 580874 - RNA, 64 nt, hsa; identical to SEQ ID NO: 265161

SEQ ID NO: 580875 - RNA, 64 nt, hsa; identical to SEQ ID NO: 265162

SEQ ID NO: 580876 - RNA, 64 nt, hsa; identical to SEQ ID NO: 265163

SEQ ID NO: 580877 - RNA, 64 nt, hsa; identical to SEQ ID NO: 265164

SEQ ID NO: 580878 - RNA, 64 nt, hsa; identical to SEQ ID NO: 265165

SEQ ID NO: 580879 - RNA, 64 nt, hsa; identical to SEQ ID NO: 265166

SEQ ID NO: 580880 - RNA, 64 nt, hsa; identical to SEQ ID NO: 265167

SEQ ID NO: 580881 - RNA, 64 nt, hsa; identical to SEQ ID NO: 265168

SEQ ID NO: 580882 - RNA, 64 nt, hsa; identical to SEQ ID NO: 265169

SEQ ID NO: 580883 - RNA, 64 nt, hsa; identical to SEQ ID NO: 265170

SEQ ID NO: 580884 - RNA, 64 nt, hsa; identical to SEQ ID NO: 265171

SEQ ID NO: 580885 - RNA, 64 nt, hsa; identical to SEQ ID NO: 265172

SEQ ID NO: 580886 - RNA, 64 nt, hsa; identical to SEQ ID NO: 265173

SEQ ID NO: 580887 - RNA, 64 nt, hsa; identical to SEQ ID NO: 265174

SEQ ID NO: 580888 - RNA, 64 nt, hsa; identical to SEQ ID NO: 265175

SEQ ID NO: 580889 - RNA, 64 nt, hsa; identical to SEQ ID NO: 265176

SEQ ID NO: 580890 - RNA, 64 nt, hsa; identical to SEQ ID NO: 265177

SEQ ID NO: 580891 - RNA, 64 nt, hsa; identical to SEQ ID NO: 265178

SEQ ID NO: 580892 - RNA, 64 nt, hsa; identical to SEQ ID NO: 265179

SEQ ID NO: 580893 - RNA, 64 nt, hsa
uugagccguggucaccgagaggguugaggacgcagcacccgaggucccagccuuugcaggagcc

SEQ ID NO: 580894 - RNA, 64 nt, hsa
ccuuggggaccuggcuucauucugcucucucuuggcacccgacccuuggcagcauguaccacac

SEQ ID NO: 580895 - RNA, 64 nt, hsa
gaaggacaauguuaucugggauucaccgugcccagcacccgaagugccaaauuccaggaggaca

SEQ ID NO: 580896 - RNA, 64 nt, hsa
ccuggcccucugggcccaacgcaggaggcccucagcacccgaacacaucuuccuccuccccacc

SEQ ID NO: 580897 - RNA, 64 nt, hsa
ggccagggccuggcacccaccuggagaagcccccgcacccgagggaacccaugguggacuccac

SEQ ID NO: 580898 - RNA, 64 nt, hsa
ucauucauuuugcacaauucuugaacugaugucagcacccgaguggcuccugaauuuaagucug

SEQ ID NO: 580899 - RNA, 64 nt, hsa
guucggugagccuggcacugcuccuugccuaccagcacccgacuuuuaauuauauggaucucuu

SEQ ID NO: 580900 - RNA, 64 nt, hsa
gaaauuaaaggaaagggaaagaaauagaucuggugcacccgaacauuaggagaaaaugaaaaau

SEQ ID NO: 580901 - RNA, 64 nt, hsa
uuccuuuuuacuugugugguuauguguggggcuggcacccgaaaugugugacauucagcuucua

SEQ ID NO: 580902 - RNA, 64 nt, hsa
auuuacaagaaaaugaaaagcguccucuuaauuggcacccgaauguugcuguggcucagucaca

SEQ ID NO: 580903 - RNA, 64 nt, hsa
cuucgcccguccgcaugggcgcuucuguccagcugcacccgaggccggggguuucccucaccuc

SEQ ID NO: 580904 - RNA, 64 nt, hsa
ucgggcccagccccaggcugcagcccauucgcaggcacccgaaagaacuuccccaguauggugg

SEQ ID NO: 580905 - RNA, 64 nt, hsa
cugcuuucagggccgacugccugugaaguggauggcacccgaggcauuauuugaccggaucuac

SEQ ID NO: 580906 - RNA, 64 nt, hsa
ggaaggagccgugaggagaggagugaggcaacaggcacccgaagucccucguccuucccucugu

SEQ ID NO: 580907 - RNA, 64 nt, hsa
ccuuccuggagcucccagccagagcugagcuuaggcacccgaguggagccugcagcugagucug

SEQ ID NO: 580908 - RNA, 64 nt, hsa
gauccagaaauaaacaauuccuacauuuuaaacugcacccgauucugaguagugggaugaaguc

SEQ ID NO: 580909 - RNA, 64 nt, hsa
gucagugccccugggagggaagggcaucccugaggcacccgaauggucccucagggugcaggga

SEQ ID NO: 580910 - RNA, 64 nt, hsa
acguccuccgcauccacuuuccagcucagcagccgcacccgaggcucagccugagggguaugug

SEQ ID NO: 580911 - RNA, 64 nt, hsa
acagcuccaugagauagagaccugccucccccuugcacccgaggcccucgcagcagggagcuca

SEQ ID NO: 580912 - RNA, 64 nt, hsa
uuccgcugggguuuccgagccgcccccgaaccgcgcacccgacuugcaggcguccgccugggcc

SEQ ID NO: 580913 - RNA, 64 nt, hsa
ucccaaagugcugggauuacaggcaugagccaccgcacccgacggucuuuucaaagcuauuuau

SEQ ID NO: 580914 - RNA, 64 nt, hsa
uaaaaaaugacaauuaaaugugcagauuccccacgcacccgaugaccuauuuuuucagccgugg

SEQ ID NO: 580915 - RNA, 64 nt, hsa
auguggaagaauagcuaucauuccugucucuguggcacccgaucaauggcuuaaaucugucguu

SEQ ID NO: 580916 - RNA, 64 nt, hsa
uucuagugcuccauccaccccucucuccacagacgcacccgaauuucuguccguucccaaagau

SEQ ID NO: 580917 - RNA, 64 nt, hsa
ccugccugccccugcuccccagcuccuccugccugcacccgacucggcccccuccugacuugcc

SEQ ID NO: 580918 - RNA, 64 nt, hsa
ucaguuuccaaaauggaaccaccucaccuccgcagcacccgacuuaccaggacgcaugccccuc

SEQ ID NO: 580919 - RNA, 64 nt, hsa
gcugacuauagcaaccagcuggacccggccucuggcacccgaaacuuccacccccgacggcucc

SEQ ID NO: 580920 - RNA, 64 nt, hsa
ugugggccugcugugugccaaaccugagcuaccugcacccgagcccuggggcucagccccacca

SEQ ID NO: 580921 - RNA, 64 nt, hsa
aguccaucagaaacaggagcugacaaccugcugggcacccgaagaccaagcccccugccagcuc

SEQ ID NO: 580922 - RNA, 64 nt, hsa
acuucugacuuucuaaggaaaugaugcuucccaagcacccgagguugguuggucccaaaucuau

SEQ ID NO: 580923 - RNA, 64 nt, hsa
ccuccccaggcuggccccagaggagcgagcaccagcacccgacgccuggccugccagggauggg

SEQ ID NO: 580924 - RNA, 64 nt, hsa
ccaaugugggggguccugaagacacccccuuggggcacccgagugccccuucucagggcucagu

SEQ ID NO: 580925 - RNA, 64 nt, hsa
ugaccacacuguggaaaauaccuuugcagacguggcacccgagugcacacaccgaccgccacau

SEQ ID NO: 580926 - RNA, 64 nt, hsa
gcccaggggucccugcuggaucagagaaauagaagcacccgaagacgguuaguggcaauuccuu

SEQ ID NO: 580927 - RNA, 64 nt, hsa
gacagagguugugguggggcaagaucgcaccauugcacccgagccuaggcaacaagagugaaau

SEQ ID NO: 580928 - RNA, 64 nt, hsa
auuuguguggcccauggauuugaaagaagcugcugcacccgaaacugccagugugcggugacaa

SEQ ID NO: 580929 - RNA, 64 nt, hsa
ggaagauucuggaaugccgugcggaugaacuucagcacccgagucagucccagcucauccuccc

SEQ ID NO: 580930 - RNA, 64 nt, hsa
ucccaaagugcugggauuacaggugugagccacugcacccgaccgauacucacauuuuuaaacu

SEQ ID NO: 580931 - RNA, 64 nt, hsa
acccagcuuucucccagccacagccaagauucccaaagucaaggcccaaagauuuccaagguuc

SEQ ID NO: 580932 - RNA, 64 nt, hsa
ccaaagucaaggcccaaagauuuccaagguucccaaagucaaggccaggccaaggccugguugg

SEQ ID NO: 580933 - RNA, 64 nt, hsa
agaacauugguuuagauaaauacuuauacuuugcaaagucaaaaauggcuugauuuuuggaaac

SEQ ID NO: 580934 - RNA, 64 nt, hsa
gagauggcauuguguaagaaggagcccuagacugaaagucaagacaucugaauuucaggcugga

SEQ ID NO: 580935 - RNA, 64 nt, hsa
uguauucccuauaauauacaaauuuuccuguaauaaagucaacuuagaaacuccaaggagguua

SEQ ID NO: 580936 - RNA, 64 nt, hsa
cauacuagauguucaguuaaauauacuuuagcacaaagucaaacuagagaauguguuaaggagg

SEQ ID NO: 580937 - RNA, 64 nt, hsa
uucggagcuagaggacauggaaaauaaagccaggaaagucaaaaaaacgaaagagaaggagaag

SEQ ID NO: 580938 - RNA, 64 nt, hsa
agagaaggagaagaaaaaggaaaagggcaaauugaaagucaaggagaaaaagcgcaaagaggag

SEQ ID NO: 580939 - RNA, 64 nt, hsa
ucaucaggguaguagaccugucagauuggaggucaaagucaaaaguauaauaaguguuaauuug

SEQ ID NO: 580940 - RNA, 64 nt, hsa
aacaguaacuucgguuuuguuuuugugaaacauaaaagucaauucuaauagggcagucgccaga

SEQ ID NO: 580941 - RNA, 64 nt, hsa
aaauaguuuucuuagauuaaucucaggauaugagaaagucaauuaagugugaguaaaguuagua

SEQ ID NO: 580942 - RNA, 64 nt, hsa
aauaggauauacuaauaaauacaaaguaauaacaaaagucaaagcaguguucuaaauaaaaauu

SEQ ID NO: 580943 - RNA, 64 nt, hsa
aaucuuuugaucuuucccuaucuugauuagauccaaagucaaagcaaccauacuucaccuagag

SEQ ID NO: 580944 - RNA, 64 nt, hsa
gcaaucaugacaccuguaauaaaaacuugaauccaaagucaaaacuuaagcaagauacaaaugu

SEQ ID NO: 580945 - RNA, 64 nt, hsa
aaaaauauacaaccaaccguucgugagucaucaaaaagucaaagucagccuggccaacauggca

SEQ ID NO: 580946 - RNA, 64 nt, hsa
agagagaccuugucucaaaaaacaacaacaacaaaaagucaaagucauaauaagcaaauuauug

SEQ ID NO: 580947 - RNA, 64 nt, hsa
uaugaucccagcaauacacuuuuuaaaaaaugugaaagucaaagaauuaaguucuaguucugac

SEQ ID NO: 580948 - RNA, 64 nt, hsa
aauuaccuacuaaacagugguagccaugacauggaaagucaacugauucuacaauuggacauuc

SEQ ID NO: 580949 - RNA, 64 nt, hsa
auagacaguguccuguaaauggacacaacacaauaaagucaaguuauuauugcuguuacucugg

SEQ ID NO: 580950 - RNA, 64 nt, hsa
ugcugugaaaagcugggcuaaauauucuuucuguaaagucaaacaggauuccauccccugugaa

SEQ ID NO: 580951 - RNA, 64 nt, hsa
cauggauagucagacugaacugugugcaacaggaaaagucaaaagggaaaagguagcugaugag

SEQ ID NO: 580952 - RNA, 64 nt, hsa
cuuuuaaauucugaacugcuacuacacacaagugaaagucaacccuauguaaacugguguccuc

SEQ ID NO: 580953 - RNA, 64 nt, hsa
auaguuguaacuauaguccagcuuuguucuucuuaaagucaagauuuccauauaaauauuagaa

SEQ ID NO: 580954 - RNA, 64 nt, hsa
guguggcaguccuagaugcucuaugugcuuguaaaaagucaauguuuucaguucucuugauuuu

SEQ ID NO: 580955 - RNA, 64 nt, hsa
uucuaacacaaaauaaguguuuuauguuuggaauaaagucaaccuuguuucuacuguuuuauac

SEQ ID NO: 580956 - RNA, 64 nt, hsa
ugauauaauuuaguuccacaaaugguggguacaaaaagucaaguuuguggcuuauggauucaua

SEQ ID NO: 580957 - RNA, 64 nt, hsa
guccauuuuuaaggacaccugucuuuauuuccucaaagucaagcagcuuucucuggaaaaugaa

SEQ ID NO: 580958 - RNA, 64 nt, hsa
agaacacuauuuuuacauaacaguuucuuaaccuaaagucaaggccuuggacucuucccugagg

SEQ ID NO: 580959 - RNA, 64 nt, hsa
gguuugauugauuuccuuuuuucuuagacacaucaaagucaagaaagaugguuuuaccuuuacu

SEQ ID NO: 580960 - RNA, 64 nt, hsa
aauccacuguccauguuccucaucagucaaauccaaagucaaaggauuugaaccugcaucugga

SEQ ID NO: 580961 - RNA, 64 nt, hsa
ucuuuuuccagggacgacuguccccucuaaaguuaaagucaauacaagaaaacugucuauuuuu

SEQ ID NO: 580962 - RNA, 64 nt, hsa
uauuacuaaucauauguugauuaacugucuacuuaaagucaagguaccuguauuuuuaauccac

SEQ ID NO: 580963 - RNA, 64 nt, hsa
uuugacuuuuaaaaaugacauaguuagauuauuuaaagucaauguauauaguauauauuaugua

SEQ ID NO: 580964 - RNA, 64 nt, hsa
aaaaagcauuaaccuucuaaacaguauauucuaaaaagucaaaacguuaacaauaguuuuuauc

SEQ ID NO: 580965 - RNA, 64 nt, hsa
ugaggagcagaggugagaagagagagagagagagaaagucaaauaaagucaaagaccaguuugg

SEQ ID NO: 580966 - RNA, 64 nt, hsa
aggugagaagagagagagagagagaaagucaaauaaagucaaagaccaguuuggaaaccaaagu

SEQ ID NO: 580967 - RNA, 64 nt, hsa
agucguuguaagagauguggagucuucgguguuuaaagucaacaaccaugccagggauugagga

SEQ ID NO: 580968 - RNA, 64 nt, hsa
aucccaagccaaccaagagcacauucuuaaaggaaaagucaacaucuucucucuuuuuuuuuuu

SEQ ID NO: 580969 - RNA, 64 nt, hsa
ugaaaggaaaauaaaaauuacuaagccaaagagaaaagucaaucugggaacugcgucagacaaa

SEQ ID NO: 580970 - RNA, 64 nt, hsa
ucaguaauaaauaugugagacuuuucauuuaaaaaaagucaaaugacuuaauucuguauuuuaa

SEQ ID NO: 580971 - RNA, 64 nt, hsa
aacauugcauguucucaauuauuugcgggaucuaaaagucaaaacaauugaacucauggauaua

SEQ ID NO: 580972 - RNA, 64 nt, hsa
gauaugcuuuauuacacgcuauuuucaccucuugaaagucaaaggugaugauuaauuucauuua

SEQ ID NO: 580973 - RNA, 64 nt, hsa
agguguauccagagcccagcccggugcugggaaagcuuugcauagggccagggccacuugucag

SEQ ID NO: 580974 - RNA, 64 nt, hsa
ccagccugcagcauagguacgaccucagaggauggcuuugcacuuggcauaguuucauggaaag

SEQ ID NO: 580975 - RNA, 64 nt, hsa
gagagcccccuuccccaucagaagacuguugacugcuuugcauuuugggcucuucuauauauuu

SEQ ID NO: 580976 - RNA, 64 nt, hsa
ugcuaccacaggccaucaaaauauaaguuuccaggcuuugcagaagaccuugucuccuuagaaa

SEQ ID NO: 580977 - RNA, 64 nt, hsa
cuggcaccucacuuugagaagagugagcacacuggcuuugcauccuggaagaccugcagggggc

SEQ ID NO: 580978 - RNA, 64 nt, hsa
uguuagcaagcggcauuuggaugucuugacaggggcuuugcagggauuuuuaggguuuuuucca

SEQ ID NO: 580979 - RNA, 64 nt, hsa; identical to SEQ ID NO: 485963

SEQ ID NO: 580980 - RNA, 64 nt, hsa; identical to SEQ ID NO: 485964

SEQ ID NO: 580981 - RNA, 64 nt, hsa; identical to SEQ ID NO: 485965

SEQ ID NO: 580982 - RNA, 64 nt, hsa; identical to SEQ ID NO: 485966

SEQ ID NO: 580983 - RNA, 64 nt, hsa; identical to SEQ ID NO: 485967

SEQ ID NO: 580984 - RNA, 64 nt, hsa; identical to SEQ ID NO: 485968

SEQ ID NO: 580985 - RNA, 64 nt, hsa; identical to SEQ ID NO: 485969

SEQ ID NO: 580986 - RNA, 64 nt, hsa; identical to SEQ ID NO: 485970

SEQ ID NO: 580987 - RNA, 64 nt, hsa; identical to SEQ ID NO: 115740

SEQ ID NO: 580988 - RNA, 64 nt, hsa; identical to SEQ ID NO: 115741

SEQ ID NO: 580989 - RNA, 64 nt, hsa; identical to SEQ ID NO: 115742

SEQ ID NO: 580990 - RNA, 64 nt, hsa; identical to SEQ ID NO: 115743

SEQ ID NO: 580991 - RNA, 64 nt, hsa; identical to SEQ ID NO: 115744

SEQ ID NO: 580992 - RNA, 64 nt, hsa; identical to SEQ ID NO: 115745

SEQ ID NO: 580993 - RNA, 64 nt, hsa; identical to SEQ ID NO: 115746

SEQ ID NO: 580994 - RNA, 64 nt, hsa; identical to SEQ ID NO: 115747

SEQ ID NO: 580995 - RNA, 64 nt, hsa; identical to SEQ ID NO: 115748

SEQ ID NO: 580996 - RNA, 64 nt, hsa; identical to SEQ ID NO: 115749

SEQ ID NO: 580997 - RNA, 64 nt, hsa; identical to SEQ ID NO: 115750

SEQ ID NO: 580998 - RNA, 64 nt, hsa; identical to SEQ ID NO: 115751

SEQ ID NO: 580999 - RNA, 64 nt, hsa; identical to SEQ ID NO: 115752

SEQ ID NO: 581000 - RNA, 64 nt, hsa; identical to SEQ ID NO: 115753

SEQ ID NO: 581001 - RNA, 64 nt, hsa; identical to SEQ ID NO: 115754

SEQ ID NO: 581002 - RNA, 64 nt, hsa; identical to SEQ ID NO: 115755

SEQ ID NO: 581003 - RNA, 64 nt, hsa; identical to SEQ ID NO: 115756

SEQ ID NO: 581004 - RNA, 64 nt, hsa; identical to SEQ ID NO: 115757

SEQ ID NO: 581005 - RNA, 64 nt, hsa; identical to SEQ ID NO: 115758

SEQ ID NO: 581006 - RNA, 64 nt, hsa; identical to SEQ ID NO: 115759

SEQ ID NO: 581007 - RNA, 64 nt, hsa; identical to SEQ ID NO: 115760

SEQ ID NO: 581008 - RNA, 64 nt, hsa; identical to SEQ ID NO: 115761

SEQ ID NO: 581009 - RNA, 64 nt, hsa; identical to SEQ ID NO: 115762

SEQ ID NO: 581010 - RNA, 64 nt, hsa; identical to SEQ ID NO: 115763

SEQ ID NO: 581011 - RNA, 64 nt, hsa; identical to SEQ ID NO: 115764

SEQ ID NO: 581012 - RNA, 64 nt, hsa; identical to SEQ ID NO: 115765

SEQ ID NO: 581013 - RNA, 64 nt, hsa; identical to SEQ ID NO: 115766

SEQ ID NO: 581014 - RNA, 64 nt, hsa; identical to SEQ ID NO: 115767

SEQ ID NO: 581015 - RNA, 64 nt, hsa; identical to SEQ ID NO: 115768

SEQ ID NO: 581016 - RNA, 64 nt, hsa; identical to SEQ ID NO: 115769

SEQ ID NO: 581017 - RNA, 64 nt, hsa; identical to SEQ ID NO: 115770

SEQ ID NO: 581018 - RNA, 64 nt, hsa; identical to SEQ ID NO: 115771

SEQ ID NO: 581019 - RNA, 64 nt, hsa; identical to SEQ ID NO: 115772

SEQ ID NO: 581020 - RNA, 64 nt, hsa; identical to SEQ ID NO: 115773

SEQ ID NO: 581021 - RNA, 64 nt, hsa; identical to SEQ ID NO: 115774

SEQ ID NO: 581022 - RNA, 64 nt, hsa; identical to SEQ ID NO: 115775

SEQ ID NO: 581023 - RNA, 64 nt, hsa; identical to SEQ ID NO: 115776

SEQ ID NO: 581024 - RNA, 64 nt, hsa; identical to SEQ ID NO: 115777

SEQ ID NO: 581025 - RNA, 61 nt, hsa
ugcagacucaaaccuucccaacaucuuuaugacucuagaauaaucauauugaugaaaucgu

SEQ ID NO: 581026 - RNA, 61 nt, hsa
uuguuuuuugguuuuuuuuuuuacccagacaacucuagaaaugcggaccaaacuacuucau

SEQ ID NO: 581027 - RNA, 61 nt, hsa
caguuuuuccaucaugagaugaaugagcauuacucuagauaaauuucaagacaggauacua

SEQ ID NO: 581028 - RNA, 61 nt, hsa
gauccuagcucuuguaggcagacaccagugcacucuagauaccuccugagaccuccguccu

SEQ ID NO: 581029 - RNA, 61 nt, hsa
cugaagcccucccagguguuaacauuccaagacucuagaguccaagguuuaaagagucuag

SEQ ID NO: 581030 - RNA, 61 nt, hsa
aagauucuaacggucuguucuguuucaaggcacucuagauuccauugguccaagauuccgg

SEQ ID NO: 581031 - RNA, 64 nt, hsa
gugcacacaaauguuggcaaagucaaaaccccaugaauuaaaaccuacuggaauuugguuuuua

SEQ ID NO: 581032 - RNA, 64 nt, hsa
ucuugacaccaauuuuaagaauagcugugagaccgaauuaaagauaaucccuaccaagugaaaa

SEQ ID NO: 581033 - RNA, 64 nt, hsa
uuuguuaaauauuuuacugugguaauauagagaagaauuaaagcaagaaaaucugaaguauugu

SEQ ID NO: 581034 - RNA, 64 nt, hsa
uauuagucaggcccuucaaagaugauauguggaggaauuaaauauaaaggaauuggagguuuuu

SEQ ID NO: 581035 - RNA, 64 nt, hsa
aaaaguuaagguuguucacuaugauggcaucuuagaauuaaacaaaacuuuuacuagggcugaa

SEQ ID NO: 581036 - RNA, 64 nt, hsa
caaugcugucuucaucagaaaacaguuggcauaagaauuaaacauaugaacaucacaaaacaau

SEQ ID NO: 581037 - RNA, 64 nt, hsa
guaaauuaguguaccuauuaaaaguugcaaaguggaauuaaaggaaucccuagaauaaggauuc

SEQ ID NO: 581038 - RNA, 64 nt, hsa
auuucaguucuaaaaagauguaauaaucauuuuagaauuaaaauuuauucuacuuuuaaauaaa

SEQ ID NO: 581039 - RNA, 64 nt, hsa
acagguguaguuugugugcauaaauaauacuuccgaauuaaauuauuuaauauuugacugauuu

SEQ ID NO: 581040 - RNA, 64 nt, hsa
gcagaauuaaauuucuaauugagcagauuagauugaauuaaauagaaacuuauugaauauacau

SEQ ID NO: 581041 - RNA, 64 nt, hsa
auucaguacuuugcuuuaaaaaaauuuuguggcagaauuaaauuucuaauugagcagauuagau

SEQ ID NO: 581042 - RNA, 64 nt, hsa
aauuuaaauuuauccuccaacuaaauuuuugauagaauuaaauuuaaauuuguccuccaacugu

SEQ ID NO: 581043 - RNA, 64 nt, hsa
guuugcacaauuuaaauuugauaaauuuuugauagaauuaaauuuaaauuuauccuccaacuaa

SEQ ID NO: 581044 - RNA, 64 nt, hsa
ucuaugccaauuuugaaaaaacuauaagcacaaggaauuaaauacuauugaguauagaacuguu

SEQ ID NO: 581045 - RNA, 64 nt, hsa
uuuguagaugauguauuuugcuugggcaccaacagaauuaaaaacgaaaaacaaaaaaaaacuc

SEQ ID NO: 581046 - RNA, 64 nt, hsa
cuguagucaucuuauuugagaugggggugggaacgaauuaaaauaugauagagaacuauaugca

SEQ ID NO: 581047 - RNA, 64 nt, hsa
cgagcaauacuauagcuucacacaguuugcgcuggaauuaaaugaaauggauccaucaucaaag

SEQ ID NO: 581048 - RNA, 64 nt, hsa
gcauugugcuagcauggaagaaucaugggcuuuggaauuaaacccauuugguggaauuaaaccc

SEQ ID NO: 581049 - RNA, 64 nt, hsa
gaaucaugggcuuuggaauuaaacccauuugguggaauuaaacccauuugguuucaaaucccag

SEQ ID NO: 581050 - RNA, 64 nt, hsa
uuuacauguuacuuugagaugcuagguauuuguggaauuaaaaagaaucaggcucuuuuguacu

SEQ ID NO: 581051 - RNA, 64 nt, hsa
auuccucucaaauucauaacaguucuauuuaacugaauuaaauaaccauaugaaaaaucuuuug

SEQ ID NO: 581052 - RNA, 64 nt, hsa
aaauugcaggagauuuaauguauaaaauuucuaggaauuaaaagcuuaaacccaaaaauuguuc

SEQ ID NO: 581053 - RNA, 64 nt, hsa
ccaaaaauuguucauccauauauaagaaauuaucgaauuaaaacuuaauguaugucaauuauuu

SEQ ID NO: 581054 - RNA, 64 nt, hsa
auuguaauugguugucacuguuguacggugucuagaauuaaagaauacauguaaacuuucaugg

SEQ ID NO: 581055 - RNA, 64 nt, hsa
uaauguacagaaugguuggagaaaugccuauggugaauuaaagcuucauaucugcuuucugaau

SEQ ID NO: 581056 - RNA, 64 nt, hsa
aaagcaaagacuauuuuuaugcuuccauaaccuagaauuaaaaccaaauuaugaccuuaugaua

SEQ ID NO: 581057 - RNA, 64 nt, hsa
uagugaaauguggaagucaaccagaccaaugauggaauuaaauguaaauuccaagagggcuuuc

SEQ ID NO: 581058 - RNA, 64 nt, hsa
caauagaagacauuuucacuggaauuacaaagcagaauuaaaauuauauuguagaaggaaacac

SEQ ID NO: 581059 - RNA, 64 nt, hsa
guuuguaauauauucaugaggcuggaaguaagaagaauuaaaaauuuguccuaauuacaaugag

SEQ ID NO: 581060 - RNA, 64 nt, hsa
ccuucccagcauuugacuguucauugcauagaaugaauuaaauauccaguuacuugaaugggua

SEQ ID NO: 581061 - RNA, 64 nt, hsa
cucucaagggaaggugaugcaggggagaaaaugugaauuaaauuacauagauggguguuuuuau

SEQ ID NO: 581062 - RNA, 64 nt, hsa
gcuguaauucugaaauacacauccaagugaaugagaauuaaaaauuuucuaaauauuaauacua

SEQ ID NO: 581063 - RNA, 64 nt, hsa
aucuggaguugaguuggugucagauaguguaugagaauuaaaugugucaucugagcaugcuacu

SEQ ID NO: 581064 - RNA, 64 nt, hsa
guuccagggaugaucaugagcaggcgcaaaaucagaauuaaaggucgcacauagacguuucaga

SEQ ID NO: 581065 - RNA, 64 nt, hsa
auaucagcaucaaauucuuuggguaucucucuaagaauuaaauaaucuuuucuagcuuaauauu

SEQ ID NO: 581066 - RNA, 64 nt, hsa
auaaugacauuuucuuuaaauuagacucuauuuugaauuaaaagaguuuuauuauaaaccgugu

SEQ ID NO: 581067 - RNA, 64 nt, hsa
gcauuagcauauucagcaaauccaucuguggugggaauuaaaaauauuauugguauuaaagaaa

SEQ ID NO: 581068 - RNA, 64 nt, hsa
uaacuuucgaggcacuggaacauaccugaacuaagaauuaaaucuuuuacuuuauacucacuua

SEQ ID NO: 581069 - RNA, 64 nt, hsa
acauauaccccaaaaugcuaaguggaaacugcaugaauuaaaagagggguaugauagggacauu

SEQ ID NO: 581070 - RNA, 64 nt, hsa
aaugaguuaaauauaauaacaaugacuuuaugaggaauuaaagguuaagcuuuguguuuaccua

SEQ ID NO: 581071 - RNA, 64 nt, hsa
auaugcauaccuaaugaaguauugguuuuaguaagaauuaaauacauuucauugagcuuuaaag

SEQ ID NO: 581072 - RNA, 64 nt, hsa
uaaaaucgggcacucuauauucauuaagguuuaugaauuaaaaagaaagcuuuauguaguuaug

SEQ ID NO: 581073 - RNA, 64 nt, hsa
gcuggacuggauuucuucuggagggaagcaccaugaauuaaaggugccagagcuccaugcaugg

SEQ ID NO: 581074 - RNA, 64 nt, hsa
acaauguaacggaugaccauaugcacaauuccaugaauuaaaucuguuuccuguguuagucagu

SEQ ID NO: 581075 - RNA, 64 nt, hsa
ugcagcccuccuucugggcacuaagaaggucuaugaauuaaaugccuaucuaaaauucugauuu

SEQ ID NO: 581076 - RNA, 64 nt, hsa
ugaagaaaguuuuggaaaagaaacaaugaagacugaauuaaauuaaaaauguugcagcucauaa

SEQ ID NO: 581077 - RNA, 64 nt, hsa
uaacauccaguaaccacaggaauauauucucugugaauuaaaagucuucaaaguuaucauuucu

SEQ ID NO: 581078 - RNA, 64 nt, hsa
uaauaauccgaaauguuaccgggguugacucacggaauuaaauuuuuccucuauuuuuauaucc

SEQ ID NO: 581079 - RNA, 64 nt, hsa
ggagaacagagaugagauuugacaaaaaaaaauugaauuaaaaauaacacagucuuuuuaaaac

SEQ ID NO: 581080 - RNA, 64 nt, hsa
caugccaucuucccugcgaucaggcaaaaaaguggaauuaaaaagucaaaccuuuauaugcaug

SEQ ID NO: 581081 - RNA, 64 nt, hsa
aaagaauuaaagcuucuaugaguauaugguuuaagaauuaaauuauuaguaauuuauuauuuua

SEQ ID NO: 581082 - RNA, 64 nt, hsa
uacauuccccaagggucaaauuggagcuuuuaaagaauuaaagcuucuaugaguauaugguuua

SEQ ID NO: 581083 - RNA, 64 nt, hsa
uguacuuuuuuugaucaguuggcaugaagccauagaauuaaauuuuggcuuuagaauacagaug

SEQ ID NO: 581084 - RNA, 64 nt, hsa; identical to SEQ ID NO: 344043

SEQ ID NO: 581085 - RNA, 64 nt, hsa; identical to SEQ ID NO: 344044

SEQ ID NO: 581086 - RNA, 64 nt, hsa; identical to SEQ ID NO: 344045

SEQ ID NO: 581087 - RNA, 64 nt, hsa; identical to SEQ ID NO: 344046

SEQ ID NO: 581088 - RNA, 64 nt, hsa; identical to SEQ ID NO: 344047

SEQ ID NO: 581089 - RNA, 64 nt, hsa; identical to SEQ ID NO: 344048

SEQ ID NO: 581090 - RNA, 64 nt, hsa; identical to SEQ ID NO: 344049

SEQ ID NO: 581091 - RNA, 64 nt, hsa; identical to SEQ ID NO: 344050

SEQ ID NO: 581092 - RNA, 64 nt, hsa; identical to SEQ ID NO: 344051

SEQ ID NO: 581093 - RNA, 64 nt, hsa; identical to SEQ ID NO: 344052

SEQ ID NO: 581094 - RNA, 64 nt, hsa
aagcgacagguaacgcagugcgggguuagggauuccccgggagagaggacgaagcgaggagagu

SEQ ID NO: 581095 - RNA, 64 nt, hsa
ggcgaagacagcccgguaggcugcgucgcccgagccccgggagagaggagcgaagauccggaac

SEQ ID NO: 581096 - RNA, 64 nt, hsa
agacaagguggcaucucaaccucacccaagaaacccccgggacuuuaccccagcaggcugccac

SEQ ID NO: 581097 - RNA, 64 nt, hsa
cuggcugaggcuaggcgcucucaugauccaccugccccgggagggcagcggggaagacagagaa

SEQ ID NO: 581098 - RNA, 64 nt, hsa
gaaggugggggcacagggcccaccccgcccgggaccccgggagcagaagacgcgccugggcucc

SEQ ID NO: 581099 - RNA, 64 nt, hsa
ugccagccccaccacauccuggaagaggagggggccccgggaaggggccuccccuacaucgcug

SEQ ID NO: 581100 - RNA, 64 nt, hsa
cuuccccaaccacaaagguguuugugauuccucaccccgggaaaccaaggagcugcaaagugga

SEQ ID NO: 581101 - RNA, 64 nt, hsa
guccggucggaguuguagccagucuuucaggggaccccgggacgcugaugaggcccagggugca

SEQ ID NO: 581102 - RNA, 64 nt, hsa
cccgcccuccccgcgugugcgccaggcuugggguccccgggagagcagagcuugcgccucgggc

SEQ ID NO: 581103 - RNA, 64 nt, hsa
uccaggagaugcugcuucaggcgccgccacugggccccgggacccccacggcgcugcccgauga

SEQ ID NO: 581104 - RNA, 64 nt, hsa
ucagcacacacacagcucagacccacggacaggaccccgggacagaaccccgggagcacugccc

SEQ ID NO: 581105 - RNA, 64 nt, hsa
agcucagacccacggacaggaccccgggacagaaccccgggagcacugcccuaggagcccggac

SEQ ID NO: 581106 - RNA, 64 nt, hsa
agaggcagagggcacaggaaagaagccgggccaagcucggaauuaaugugccacaaguguugug

SEQ ID NO: 581107 - RNA, 64 nt, hsa
agccacguugacuucagguggucuucuaccagcagcucggaauaguugcacugaaucuauacuu

SEQ ID NO: 581108 - RNA, 64 nt, hsa
ccauacuuuuaaccuccuaaagcuaaaaacaauagcucggaaaccauucuuucuaguuacuuuu

SEQ ID NO: 581109 - RNA, 64 nt, hsa
uuggaugcauauucguuaucaaucuaaacugcaggcucggaaagccuuaagcaaagaugggagg

SEQ ID NO: 581110 - RNA, 64 nt, hsa
ugcccagccugcgguuccccacagcaucgcaggcgcucggaaauccucucccgugccuuuagag

SEQ ID NO: 581111 - RNA, 64 nt, hsa
uaugaacuggaccugcaccaaagcuggcaccagggcucggaaggucucugaacucagaaggaug

SEQ ID NO: 581112 - RNA, 64 nt, hsa
uaaagagguagaggagguuugaggagagagaacugcucggaagacauugguagauggaccauaa

SEQ ID NO: 581113 - RNA, 64 nt, hsa
gagaagugugcgccacuccccuugcugcccgaaugcucggaaacaggagccuuucccaggaacu

SEQ ID NO: 581114 - RNA, 64 nt, hsa
cccugggccuucaccgcaccccaucugcuuaagugcucggaaccccgucaccuaauuaaaguuu

SEQ ID NO: 581115 - RNA, 64 nt, hsa
ugguggggcagguuauuggaugcagagaagaucugcucggaauuguagccauauguuacagauc

SEQ ID NO: 581116 - RNA, 64 nt, hsa
uccgccuccacggaacgucucgccuugcgagcaagcucggaauccaguuccucaggaaccccuc

SEQ ID NO: 581117 - RNA, 64 nt, hsa
ggagaccuaugacuucgacagcaucaugcauuacgcucggaacacauucuccaggugggagacg

SEQ ID NO: 581118 - RNA, 64 nt, hsa
uccaaaugcugcuguguacaaaaguggauucuuggcucggaaaauucaugcagauauggaugga

SEQ ID NO: 581119 - RNA, 64 nt, hsa
uguugcauauuuuaaauuuuucaugugcaguauggcucggaauauguuuggccuuuugcauguu

SEQ ID NO: 581120 - RNA, 64 nt, hsa
acacucccuccuccuuaucugcggggcugccugggcucggaaucccggcuccugguccucacag

SEQ ID NO: 581121 - RNA, 64 nt, hsa
uacauggccacaaagggacacacagugacaaaaggcucggaauguuacaaugguaaaaugagug

SEQ ID NO: 581122 - RNA, 64 nt, hsa
gucugacaggaagacuggagacuguccacuucuagcucggaacuuacuguguaaauaaacuuuc

SEQ ID NO: 581123 - RNA, 64 nt, hsa
caauuuccacaacuaugacaaccugaggcacugugcucggaaguuagacccacggcgugaaggg

SEQ ID NO: 581124 - RNA, 64 nt, hsa
cgauggucagggagagggcuagagcucacacccagcucggaauagaucuucccugaugacauuu

SEQ ID NO: 581125 - RNA, 64 nt, hsa
acuacaccugcuccaggaccaaucagugaaaccugcucggaauuaaaggcuuccucugggugcc

SEQ ID NO: 581126 - RNA, 64 nt, hsa
cccagcagagggcagcuagauggacauuuccccugcucggaaggguuggccugccuggcugggg

SEQ ID NO: 581127 - RNA, 64 nt, hsa
auucuugggacacagguuuguuuucugcugacuugcucggaaacccauuggagguaucugaaau

SEQ ID NO: 581128 - RNA, 64 nt, hsa
uaggagauucuuuuuucuuuuuguucuacuuuucgcucggaaaguuuuuaaauccucauuuggu

SEQ ID NO: 581129 - RNA, 64 nt, hsa
agagcuggaggggguggguccgggggagggaguggcucggaaggggcccccacucuccuuucau

SEQ ID NO: 581130 - RNA, 64 nt, hsa
agugaacagcaccgcgagacaggccaggcucguggcucggaagacaaaccccacacacacucaa

SEQ ID NO: 581131 - RNA, 64 nt, hsa
uucuagccucaccuuuucuuucugguuugaacuugcucggaaagcguaagacaagaugaagagc

SEQ ID NO: 581132 - RNA, 64 nt, hsa
gagucgaccucccggccaccccggcccugugccugcucggaagagcucacugccagcugcggcc

SEQ ID NO: 581133 - RNA, 64 nt, hsa
auagccacagcuuccagugguggccguagacuuggcucggaacuuaguggcaccagaguaacuc

SEQ ID NO: 581134 - RNA, 64 nt, hsa
uugaccuugggggaauauuucacauccauccagagcucggaaucuacagcguccagccauuucc

SEQ ID NO: 581135 - RNA, 64 nt, hsa
ggguggagagucggccaccaaaggaccgaguugcgcucggaauuugagcugaauuccacagccu

SEQ ID NO: 581136 - RNA, 64 nt, hsa; identical to SEQ ID NO: 196427

SEQ ID NO: 581137 - RNA, 64 nt, hsa; identical to SEQ ID NO: 196428

SEQ ID NO: 581138 - RNA, 64 nt, hsa; identical to SEQ ID NO: 196429

SEQ ID NO: 581139 - RNA, 64 nt, hsa; identical to SEQ ID NO: 196430

SEQ ID NO: 581140 - RNA, 64 nt, hsa; identical to SEQ ID NO: 196431

SEQ ID NO: 581141 - RNA, 64 nt, hsa; identical to SEQ ID NO: 196432

SEQ ID NO: 581142 - RNA, 64 nt, hsa; identical to SEQ ID NO: 196433

SEQ ID NO: 581143 - RNA, 64 nt, hsa; identical to SEQ ID NO: 196434

SEQ ID NO: 581144 - RNA, 64 nt, hsa; identical to SEQ ID NO: 196435

SEQ ID NO: 581145 - RNA, 64 nt, hsa; identical to SEQ ID NO: 196436

SEQ ID NO: 581146 - RNA, 64 nt, hsa; identical to SEQ ID NO: 196437

SEQ ID NO: 581147 - RNA, 64 nt, hsa; identical to SEQ ID NO: 196438

SEQ ID NO: 581148 - RNA, 64 nt, hsa; identical to SEQ ID NO: 196439

SEQ ID NO: 581149 - RNA, 64 nt, hsa; identical to SEQ ID NO: 196440

SEQ ID NO: 581150 - RNA, 64 nt, hsa; identical to SEQ ID NO: 196441

SEQ ID NO: 581151 - RNA, 57 nt, hsa; identical to SEQ ID NO: 196442

SEQ ID NO: 581152 - RNA, 64 nt, hsa; identical to SEQ ID NO: 196443

SEQ ID NO: 581153 - RNA, 64 nt, hsa; identical to SEQ ID NO: 196444

SEQ ID NO: 581154 - RNA, 64 nt, hsa; identical to SEQ ID NO: 196445

SEQ ID NO: 581155 - RNA, 64 nt, hsa; identical to SEQ ID NO: 196446

SEQ ID NO: 581156 - RNA, 64 nt, hsa; identical to SEQ ID NO: 196447

SEQ ID NO: 581157 - RNA, 64 nt, hsa; identical to SEQ ID NO: 196032

SEQ ID NO: 581158 - RNA, 64 nt, hsa; identical to SEQ ID NO: 196033

SEQ ID NO: 581159 - RNA, 64 nt, hsa; identical to SEQ ID NO: 196034

SEQ ID NO: 581160 - RNA, 64 nt, hsa; identical to SEQ ID NO: 196035

SEQ ID NO: 581161 - RNA, 64 nt, hsa; identical to SEQ ID NO: 196036

SEQ ID NO: 581162 - RNA, 64 nt, hsa; identical to SEQ ID NO: 196037

SEQ ID NO: 581163 - RNA, 64 nt, hsa; identical to SEQ ID NO: 196038

SEQ ID NO: 581164 - RNA, 64 nt, hsa; identical to SEQ ID NO: 196039

SEQ ID NO: 581165 - RNA, 64 nt, hsa; identical to SEQ ID NO: 196040

SEQ ID NO: 581166 - RNA, 64 nt, hsa; identical to SEQ ID NO: 196041

SEQ ID NO: 581167 - RNA, 64 nt, hsa; identical to SEQ ID NO: 196042

SEQ ID NO: 581168 - RNA, 64 nt, hsa; identical to SEQ ID NO: 196043

SEQ ID NO: 581169 - RNA, 64 nt, hsa; identical to SEQ ID NO: 196044

SEQ ID NO: 581170 - RNA, 64 nt, hsa; identical to SEQ ID NO: 196045

SEQ ID NO: 581171 - RNA, 64 nt, hsa; identical to SEQ ID NO: 196046

SEQ ID NO: 581172 - RNA, 64 nt, hsa; identical to SEQ ID NO: 196047

SEQ ID NO: 581173 - RNA, 64 nt, hsa; identical to SEQ ID NO: 196048

SEQ ID NO: 581174 - RNA, 64 nt, hsa; identical to SEQ ID NO: 196049

SEQ ID NO: 581175 - RNA, 64 nt, hsa; identical to SEQ ID NO: 196050

SEQ ID NO: 581176 - RNA, 64 nt, hsa; identical to SEQ ID NO: 196051

SEQ ID NO: 581177 - RNA, 64 nt, hsa; identical to SEQ ID NO: 196052

SEQ ID NO: 581178 - RNA, 64 nt, hsa; identical to SEQ ID NO: 196053

SEQ ID NO: 581179 - RNA, 64 nt, hsa; identical to SEQ ID NO: 196054

SEQ ID NO: 581180 - RNA, 64 nt, hsa; identical to SEQ ID NO: 196055

SEQ ID NO: 581181 - RNA, 64 nt, hsa; identical to SEQ ID NO: 492612

SEQ ID NO: 581182 - RNA, 64 nt, hsa; identical to SEQ ID NO: 492613

SEQ ID NO: 581183 - RNA, 64 nt, hsa; identical to SEQ ID NO: 492614

SEQ ID NO: 581184 - RNA, 64 nt, hsa; identical to SEQ ID NO: 492615

SEQ ID NO: 581185 - RNA, 64 nt, hsa; identical to SEQ ID NO: 492616

SEQ ID NO: 581186 - RNA, 64 nt, hsa; identical to SEQ ID NO: 492617

SEQ ID NO: 581187 - RNA, 61 nt, hsa; identical to SEQ ID NO: 47225

SEQ ID NO: 581188 - RNA, 61 nt, hsa; identical to SEQ ID NO: 47226

SEQ ID NO: 581189 - RNA, 61 nt, hsa; identical to SEQ ID NO: 47227

SEQ ID NO: 581190 - RNA, 61 nt, hsa; identical to SEQ ID NO: 47228

SEQ ID NO: 581191 - RNA, 61 nt, hsa; identical to SEQ ID NO: 47229

SEQ ID NO: 581192 - RNA, 61 nt, hsa; identical to SEQ ID NO: 47230

SEQ ID NO: 581193 - RNA, 61 nt, hsa; identical to SEQ ID NO: 47231

SEQ ID NO: 581194 - RNA, 61 nt, hsa; identical to SEQ ID NO: 47232

SEQ ID NO: 581195 - RNA, 61 nt, hsa; identical to SEQ ID NO: 47233

SEQ ID NO: 581196 - RNA, 61 nt, hsa; identical to SEQ ID NO: 47234

SEQ ID NO: 581197 - RNA, 61 nt, hsa; identical to SEQ ID NO: 47235

SEQ ID NO: 581198 - RNA, 61 nt, hsa; identical to SEQ ID NO: 47236

SEQ ID NO: 581199 - RNA, 61 nt, hsa; identical to SEQ ID NO: 47237

SEQ ID NO: 581200 - RNA, 61 nt, hsa; identical to SEQ ID NO: 47238

SEQ ID NO: 581201 - RNA, 61 nt, hsa; identical to SEQ ID NO: 47239

SEQ ID NO: 581202 - RNA, 61 nt, hsa; identical to SEQ ID NO: 47240

SEQ ID NO: 581203 - RNA, 61 nt, hsa; identical to SEQ ID NO: 47241

SEQ ID NO: 581204 - RNA, 64 nt, hsa
acaaccaagaacaaagccccgggacuguuuucuuuuuaauaaagccacaggcaggcaucguagc

SEQ ID NO: 581205 - RNA, 64 nt, hsa
ugaaugagucaccuugugauuuuuaaauuuuuauuuuaauaaagcuaaucaauuucuacaaccu

SEQ ID NO: 581206 - RNA, 64 nt, hsa
ggugcucuuaggaaggaguauaguaaaugccucauuuaauaacauacuccuuuuugaaaguugc

SEQ ID NO: 581207 - RNA, 64 nt, hsa
aggaacccuagagcagccaggugaggcucucuaguuuaauaaaaaucauggaaagacucuuaau

SEQ ID NO: 581208 - RNA, 64 nt, hsa
gauacuauuuuggauguguaucaguauuuuuguuuuuaauaaugauugauuuguggagcauugu

SEQ ID NO: 581209 - RNA, 64 nt, hsa
cacuggcacuucucuccucaacuguaauucuauuuuuaauaauaaaaauggcauacuguagggu

SEQ ID NO: 581210 - RNA, 64 nt, hsa
uagucuuaauuuaccuugcauuguaauauucaguuuuaauaaaucuucaaaauauuuuguauuu

SEQ ID NO: 581211 - RNA, 64 nt, hsa
uucaaaauauuuuguauuuaggaauagaucugacuuuaauaaaaacauggcucagaaucuacag

SEQ ID NO: 581212 - RNA, 64 nt, hsa
guacuauaguauucuuaauacagugcucacugcauuuaauaaauauuuaauaaaugaugaauga

SEQ ID NO: 581213 - RNA, 64 nt, hsa
uucuuaauacagugcucacugcauuuaauaaauauuuaauaaaugaugaaugauagaaguuucc

SEQ ID NO: 581214 - RNA, 64 nt, hsa
uaaaugaauuuaccaguuuaguaugcugugguauuuuaauaaguuuucaaagauaauugggaaa

SEQ ID NO: 581215 - RNA, 64 nt, hsa
uuaagaccucaagcccuuuauucuuaaaaggguuuuuaauaaagucuuucucaaaugagguaga

SEQ ID NO: 581216 - RNA, 64 nt, hsa
ucaccuuaucaaauuaaaaugggaagaaaguaauuuuaauaauuuuuaauaaucauaugucagc

SEQ ID NO: 581217 - RNA, 64 nt, hsa
aaauuaaaaugggaagaaaguaauuuuaauaauuuuuaauaaucauaugucagcauucugacua

SEQ ID NO: 581218 - RNA, 64 nt, hsa
uuuguaagguauucauuuagguuugaaaauacuauuuaauaagggcagaagggcuauauaugau

SEQ ID NO: 581219 - RNA, 64 nt, hsa
uugaugcucaggccugguuaagcugaggcuuaccuuuaauaacagccuccaagggaaugaauua

SEQ ID NO: 581220 - RNA, 64 nt, hsa
ugcugacacuuucuaugaagugguuaugagcagguuuaauaaauccucuauacaaguguuugaa

SEQ ID NO: 581221 - RNA, 64 nt, hsa
ccauaucagaagaaauaacuuuauaacaauuuuuuuuaauaaugaaaaauauuuucgugacaag

SEQ ID NO: 581222 - RNA, 64 nt, hsa
uuaauaaacacuuuuuguuaaauuguauucuuccuuuaauaaaauauuuuaagcaauuguggaa

SEQ ID NO: 581223 - RNA, 64 nt, hsa
augugccuuaaacauauuacuauauauuuuccccuuuaauaaacacuuuuuguuaaauuguauu

SEQ ID NO: 581224 - RNA, 64 nt, hsa
aaaggcuggagacaagaaaaaauaaguagaucguuuuaauaacaauuauuuaauugccuauaag

SEQ ID NO: 581225 - RNA, 64 nt, hsa
uugcuguuucagaggcuagcccaaaggcaucaaauuuaauaaaguuaaacaaauugauuuacuu

SEQ ID NO: 581226 - RNA, 64 nt, hsa
caaccuucuccuuauaaauaaguucagacauacauuuaauaacauagggugacuuguguuuuua

SEQ ID NO: 581227 - RNA, 64 nt, hsa
uaaacacauacaugauaccauccaaauucuugcuuuuaauaacaaagguacaauauuuuguuuu

SEQ ID NO: 581228 - RNA, 64 nt, hsa
uguuagagcuuaugcauuuguuuuuaugagagauuuuaauaaauuuaauuauuugcuuguccag

SEQ ID NO: 581229 - RNA, 64 nt, hsa
acaucuagcuaaaagugugguuuaucuaaaccguuuuaauaagcaagaugacugggaaaucucu

SEQ ID NO: 581230 - RNA, 64 nt, hsa
uguguauauuugguguuccuauuuaaugagauuauuuaauaaggguguacaguaauagaggcuu

SEQ ID NO: 581231 - RNA, 64 nt, hsa
guggcuguagauagaagaagaguccuauggcuuauuuaauaacuguaaauguguauauuuggug

SEQ ID NO: 581232 - RNA, 64 nt, hsa
auacagaauuauuuuaaguguuuugaacuuaauuuuuaauaacaugcaugggucccucucacua

SEQ ID NO: 581233 - RNA, 64 nt, hsa
ccugguaccuguauuuaaaauguacauuccacauuuuaauaaauuaaccacaagaaaauaaucc

SEQ ID NO: 581234 - RNA, 64 nt, hsa
uuuacaaauuuuucaagagguuagccacuaagacuuuaauaauuuuacaagggaaaaagccuuu

SEQ ID NO: 581235 - RNA, 64 nt, hsa
acuauuccauuacugcagagauuuaaguaucuguuuuaauaagcucuuuuuguuauuuaaaggc

SEQ ID NO: 581236 - RNA, 64 nt, hsa
auuuggcauuuagacuaacuucuagauguauauuuuuaauaauagauucauaauguuacauuua

SEQ ID NO: 581237 - RNA, 64 nt, hsa
ucagauuuuauucacauuuuuuaacucacugaacuuuaauaaucaggucaccuguacucuaguc

SEQ ID NO: 581238 - RNA, 64 nt, hsa
cuaucuguuuacuauaguguagcuacuggcuucauuuaauaaaaauaaaugauuuugaaauuaa

SEQ ID NO: 581239 - RNA, 64 nt, hsa
guuuugaaauauucuguacaguacguuccuauuguuuaauaauaaauucaaaaauauuucuaaa

SEQ ID NO: 581240 - RNA, 64 nt, hsa
uuauccuucugcauuaguauaaagagucuguauuuuuaauaaauguuaaauaagcuaacaaugu

SEQ ID NO: 581241 - RNA, 64 nt, hsa
caaagcaggagacagccugcguuaauuuuuuuuuuuuaauaauuuucaaaagcagugguagaaa

SEQ ID NO: 581242 - RNA, 64 nt, hsa
uaugaugguuaaagccuuuacacugaauguaauguuuaauaaagaaauuacaaauucucacuuu

SEQ ID NO: 581243 - RNA, 64 nt, hsa
aauaugaugugagauuauaauaagaauuauacuauuuaauaaaaauggauuuauauuuuugguc

SEQ ID NO: 581244 - RNA, 64 nt, hsa
cauuguuuaaaugugccuuucccuaaauuucuauuuuaauaacuguacuauuccugcuucuaca

SEQ ID NO: 581245 - RNA, 64 nt, hsa
guugguuuuguuuuucugccacauucacuaguuuuuuaauaaauauuuuccaaaaauggauauu

SEQ ID NO: 581246 - RNA, 64 nt, hsa
aaccuucaaaauuauuugggcauagugcucuauguuuaauaaagguuuuuauagauguuuuauu

SEQ ID NO: 581247 - RNA, 64 nt, hsa
guggaauccuuuaagauuauguccaguuauuugcuuuaauaaagaagaaguuacccuugucaaa

SEQ ID NO: 581248 - RNA, 64 nt, hsa
uuauucagaaauguccuaacauggaucuguuuguuuuaauaauugugcuuuuuuuaggcuuauc

SEQ ID NO: 581249 - RNA, 64 nt, hsa
uacugugaauuaauauaauguauucacauuauucuuuaauaaucuguuuauuaauaagccauga

SEQ ID NO: 581250 - RNA, 64 nt, hsa
aguuacuuaugauauauuuuguuuccucuugugguuuaauaaagugaagugugugugugugugu

SEQ ID NO: 581251 - RNA, 64 nt, hsa
acaugggacuguuugcaauaccauauggaaaucuuuuaauaaauauauguaaauaaaauaaaaa

SEQ ID NO: 581252 - RNA, 64 nt, hsa
auaaaaugcauaguaaaccacuaacguuagcuguuuuaauaaaaguuuucaguuauaaguuuag

SEQ ID NO: 581253 - RNA, 64 nt, hsa
uuauauguauguacguauuucagguccuugaaauuuuaauaaauauuacaguuaaauccugaua

SEQ ID NO: 581254 - RNA, 64 nt, hsa
ggaggcauuuuauuuuaaguuaaagacagauuucuuuaauaaguuuuuaaaauugaucaacuuu

SEQ ID NO: 581255 - RNA, 64 nt, hsa
uauauauucauuuacagauuauucauacauucauuuuaauaacauugaguacugauggauguuu

SEQ ID NO: 581256 - RNA, 64 nt, hsa
auuagguccaguaacaccuguauauauguauauauuuaauaaagaguacuuguacaaaaaagcu

SEQ ID NO: 581257 - RNA, 64 nt, hsa
caucauguugguuuuuuugggaguuuuuuuaagguuuaauaacuaaggggaauauuuuaaaauu

SEQ ID NO: 581258 - RNA, 64 nt, hsa
ggaaugacuuaaugucaauuuguuuguugguuguuuuaauaauacuuccuuauguagccauuaa

SEQ ID NO: 581259 - RNA, 64 nt, hsa
acagugucaugauguaguagugucuuacugguuuuuuaauaaauccuuuuguauaaaaauguau

SEQ ID NO: 581260 - RNA, 64 nt, hsa
uagaucguguuuagaggcuuuguaugugugucauuuuaauaagcaagaagauauauuuagauua

SEQ ID NO: 581261 - RNA, 64 nt, hsa
uuaguauagaaaaauugcauaaagaauagcaaucuuuaauaaaccuuuuuauuacauugugauu

SEQ ID NO: 581262 - RNA, 64 nt, hsa
gacccaaaugccaagguaauuuuaaauuuacauuuuuaauaaaagcaacauguugaaacaagag

SEQ ID NO: 581263 - RNA, 64 nt, hsa
gcauauuuucaggcaugguaacagaaauuuaccuuuuaauaaauuaaaaaaucuaaauuuuaac

SEQ ID NO: 581264 - RNA, 64 nt, hsa
ugguuuuucacucuuuuuauuuacuucauuuuccuuuaauaacuuaaucucuucauguucaguu

SEQ ID NO: 581265 - RNA, 64 nt, hsa
cuguaacaucagauauuguucaacuagacuaggauuuaauaaaaauugugaaagcuuacuggcc

SEQ ID NO: 581266 - RNA, 64 nt, hsa
aacauuuauuuugacauaaaguugauaaagauuuuuuaauaauuuagacuucaagcauggcuau

SEQ ID NO: 581267 - RNA, 64 nt, hsa
cucucuuuaugucuguggauuuuuuccuucaaaguuuaauaaauuuauuuucuuggauuccuga

SEQ ID NO: 581268 - RNA, 64 nt, hsa
aagauguuaucaauugguuauuguacuguauaguuuuaauaauuuugauugaaacccuuuaaca

SEQ ID NO: 581269 - RNA, 64 nt, hsa
ucacaggcacauucuacuuuuaaucagaaauauauuuaauaaguauaauugugaaguuuucaac

SEQ ID NO: 581270 - RNA, 64 nt, hsa
agaguuaccauucauauuugagaagaaaagaacauuuaauaaauguauguguggggcugagguu

SEQ ID NO: 581271 - RNA, 64 nt, hsa
aaacaauuucagaaaguguuagaagaauucuauguuuaauaaugaauauuguugaguucaaaau

SEQ ID NO: 581272 - RNA, 64 nt, hsa
uugggaaaaaaucagcaucuagguaaauuauuauuuuaauaacaacucuuaaauugccaaccuc

SEQ ID NO: 581273 - RNA, 64 nt, hsa
ucgucuaauuugaccaguguuaagaauuuucuaauuuaauaauuuaauagugaucucaauacca

SEQ ID NO: 581274 - RNA, 64 nt, hsa
aucucuaaaucuaagaacuaagcuuugaguauuauuuaauaauuucuaauaacacucauuccuc

SEQ ID NO: 581275 - RNA, 64 nt, hsa
uggaaaaucauaugccacaacauucauuguaagguuuaauaaaauuaaauuugcaccaaauuua

SEQ ID NO: 581276 - RNA, 64 nt, hsa
auuuguguuauuuuuugaaccacagaugaguaaauuuaauaaugaaccaauuacacucuugagu

SEQ ID NO: 581277 - RNA, 64 nt, hsa
cauuugcuuuccucugagauucuaagagaaggccuuuaauaaauuuaauaaauauugaguuagc

SEQ ID NO: 581278 - RNA, 64 nt, hsa
uccucugagauucuaagagaaggccuuuaauaaauuuaauaaauauugaguuagcaccuucuuu

SEQ ID NO: 581279 - RNA, 64 nt, hsa
ugucacuuaguucuucauguuucuccuucugacuuuuaauaaugguaauaggaaaacaaaaccc

SEQ ID NO: 581280 - RNA, 64 nt, hsa
uuucuauuacuaaaguucauaucacaaaaugauauuuaauaauaaccuugggguaaaucaugaa

SEQ ID NO: 581281 - RNA, 64 nt, hsa
uguagcaauaaaaugaccaagugcaaugacuugauuuaauaaaaucauauuuuaaaaguugcug

SEQ ID NO: 581282 - RNA, 64 nt, hsa
cacaaaugagagugugagagaaaguaccuucuauuuuaauaauaauauuauuauaaaaauaaua

SEQ ID NO: 581283 - RNA, 64 nt, hsa
cugccaggccugauaggaaaaaucugcucuuccuuuuaauaacagugaugaauugucaggaccu

SEQ ID NO: 581284 - RNA, 64 nt, hsa
acauucucuuuguuuucauuuuccaaauauaaucuuuaauaaacuugauuuaguuucuugggaa

SEQ ID NO: 581285 - RNA, 64 nt, hsa
auuaaguguuugucauuuggacaaauugaaaacuuuuaauaaagccauuuucuucuuuguuaaa

SEQ ID NO: 581286 - RNA, 64 nt, hsa
guacucacauacuauagaaagauauuaguaugcauuuaauaaaacauauucacuugaauauaug

SEQ ID NO: 581287 - RNA, 64 nt, hsa
aaauaaucauguucugguauuauaucuaucuauauuuaauaaauauauacauuuuaauuuauua

SEQ ID NO: 581288 - RNA, 63 nt, hsa
uguguaucuauaaauaaagcauccuauaugaguuuuuaauaauaaacaagggauuuguccuua

SEQ ID NO: 581289 - RNA, 64 nt, hsa
acaucgcugucugaaauuuuaguuauuuuuuguuuuuaauaaagacuaacacaaacuuaaugau

SEQ ID NO: 581290 - RNA, 64 nt, hsa
cacuuuucauguggcaggaaacuggaauaucgcuuuuaauaaaauggaaaaauaugcuucuaca

SEQ ID NO: 581291 - RNA, 64 nt, hsa
uacaaagaugauaaagcagucacuucuggcgcauuuuaauaauuuaaagauuuuuagugcaaug

SEQ ID NO: 581292 - RNA, 64 nt, hsa
aaaauguuauuuguacaaacauugcacagacuauuuuaauaacaugauuuguucuuuaaauuuu

SEQ ID NO: 581293 - RNA, 64 nt, hsa
auggacgauuacacuuagaaaaugaguaauaguguuuaauaagucagugauuauaugugugcuc

SEQ ID NO: 581294 - RNA, 64 nt, hsa
uagcucuuuacucuuucucaaccccuuuuaugauuuuaauaauucucacuuaacuaauuuugua

SEQ ID NO: 581295 - RNA, 64 nt, hsa
uccccauuuuuacuauuaagaagaccagugauaauuuaauaaugccaccaacucuggcuuaguu

SEQ ID NO: 581296 - RNA, 64 nt, hsa
ugaucaguaugcuguuuuaauaauuaugugccauuuuaauaaaaugaaagggucaacggcccug

SEQ ID NO: 581297 - RNA, 64 nt, hsa
ggcuagcagaaguauaaagugaucaguaugcuguuuuaauaauuaugugccauuuuaauaaaau

SEQ ID NO: 581298 - RNA, 64 nt, hsa
uguguagaguuaagaagcuguuguacauuuaugauuuaauaaaauaauucuaaaggaaauugug

SEQ ID NO: 581299 - RNA, 64 nt, hsa
augcagagagccauuuugugaauggauuggauuauuuaauaacauuaccuuacuguggaggaag

SEQ ID NO: 581300 - RNA, 64 nt, hsa
gguguuucacuauaaggaacagcuaaggaauaauuuuaauaaaagugaaccagaacaaaucacu

SEQ ID NO: 581301 - RNA, 64 nt, hsa
uuaauaaauacuuuaauaagauaugggaaaauauuuuaauaaaacaaggaaaacauaaugaugu

SEQ ID NO: 581302 - RNA, 64 nt, hsa
uaagcucuacagggacagaaugcuuaauaaauacuuuaauaagauaugggaaaauauuuuaaua

SEQ ID NO: 581303 - RNA, 64 nt, hsa
ugaacuuauuaaaagcuaucuaugauuuaauagauuuaauaaaauuccuucacgaccugguacc

SEQ ID NO: 581304 - RNA, 64 nt, hsa
acauaaaaggaaaaagguagcucucucgagucucuuuaauaaagauacuaauucucaugacuga

SEQ ID NO: 581305 - RNA, 64 nt, hsa
gugauuauauugcuaacucucauugcaugauaccuuuaauaaaaugaacaauauaagaguuaag

SEQ ID NO: 581306 - RNA, 64 nt, hsa
guugugagccaccacaccuggcuugaauguagauuuuaauaauugaauuuauucugccguguug

SEQ ID NO: 581307 - RNA, 64 nt, hsa
ccaguuaucuguuaaucaaaauugcauuuuacaauuuaauaaugugauauuuccuaugucuaca

SEQ ID NO: 581308 - RNA, 64 nt, hsa
aaaacuaugcauaucuauauauuggccaauuaucuuuaauaauuuaccuuuugaaauugcaugu

SEQ ID NO: 581309 - RNA, 64 nt, hsa
uuuauaaugcauuuuacucccaguauuauguucauuuaauaaauuauuuuuucacuacaacagu

SEQ ID NO: 581310 - RNA, 64 nt, hsa
gauuuuaaaagcugauucauuaauaucaaaauacuuuaauaagugucacaguuauuaauauguu

SEQ ID NO: 581311 - RNA, 64 nt, hsa
guaucuuauauaaaccucaaguuggauuuuauauuuuaauaaggaaguuaagaccuucauuuaa

SEQ ID NO: 581312 - RNA, 64 nt, hsa
augugcuaaauauaucuuguaugauuuuuuauuuuuuaauaacauuggaaauauauucaagaga

SEQ ID NO: 581313 - RNA, 64 nt, hsa
gaugcauacaaagaauuauauauaaagaaggguguuuaauaaugauaguuauaauaauaaauaa

SEQ ID NO: 581314 - RNA, 64 nt, hsa
uaaauuauuuuauacgaguugguaauuuuugcuuuuuaauaaaguggaagcuugcuuuuuuaac

SEQ ID NO: 581315 - RNA, 63 nt, hsa
caagaagaucuggaaaguuaaauaaauuuauaaauuuaauaacauucauuuggcuucauuuuu

SEQ ID NO: 581316 - RNA, 64 nt, hsa
cauuauaucauuggaacaacugauacuucacuacuuuaauaaagaauuaacagagauugaacuc

SEQ ID NO: 581317 - RNA, 64 nt, hsa
cccuuaccccaguuuuuugaacauggaaagaaaauuuaauaacuuuuuaaagugacauaauuua

SEQ ID NO: 581318 - RNA, 64 nt, hsa
guauuaaaauguacaaaauguuuuguuaauaaaauuuaauaauguuuauaacuccgugccauuc

SEQ ID NO: 581319 - RNA, 64 nt, hsa
uacuauuuauaggauuccguuuuuucacaagacuuuuaauaaaaagaaauuguagaaauaaaca

SEQ ID NO: 581320 - RNA, 64 nt, hsa
uguuucuauauacuccguccaauauagauaauguuuuaauaacaacugugggauaaaaguuauc

SEQ ID NO: 581321 - RNA, 64 nt, hsa
auuaguuuucaaguauaagguuuaaguaauuugguuuaauaaucagaaaauauucaauacagug

SEQ ID NO: 581322 - RNA, 64 nt, hsa
aaucauuacuguuauaugagaaacauuuuaguaauuuaauaaaaggauaauguuuauuuaaaaa

SEQ ID NO: 581323 - RNA, 64 nt, hsa
auguguugaauuacuacauuugcuguacauauuauuuaauaaacuuuauucagaauugcguggc

SEQ ID NO: 581324 - RNA, 64 nt, hsa
agaaauucagguaugccucaccaauuugcccgucuuuaauaaaaucuuguguuaaaauuugcau

SEQ ID NO: 581325 - RNA, 64 nt, hsa
uaauuaaucugcauaugaagcauuuucugauauauuuaauaagagguauagaagcucuucaagc

SEQ ID NO: 581326 - RNA, 64 nt, hsa
acauggaaagcccccauuugcacagauguagaacuuuaauaauccagaugcaaucauuggaagu

SEQ ID NO: 581327 - RNA, 64 nt, hsa
aguaauggucaaucuuaacauuuuguuuuaauuguuuaauaaagcugcugggcaguggugcagc

SEQ ID NO: 581328 - RNA, 64 nt, hsa
acaggaagagaugguauaauuuacaauuuggagauuuaauaaccagggcuacccagaaaaagug

SEQ ID NO: 581329 - RNA, 64 nt, hsa
gaaggaagaccagaucuguaugauuuguuccauuuuuaauaacaaaaauauccacacccuuuua

SEQ ID NO: 581330 - RNA, 64 nt, hsa
guuccauuuuuaauaacaaaaauauccacacccuuuuaauaaugcucaguucuguaggcucucu

SEQ ID NO: 581331 - RNA, 64 nt, hsa
uuaaaaugccgauuacacccaaauauugugcacauuuaauaaucagacaccagauuuuuagcuc

SEQ ID NO: 581332 - RNA, 64 nt, hsa
cacaauuccagacuuucuauuaauauuuauguguuuuaauaaacguuugaaauuauuuaugacu

SEQ ID NO: 581333 - RNA, 64 nt, hsa
ggacaaagaaggaaauaucaucguauuucuuuuuuuuaauaaggaaaaaauaauauccauacag

SEQ ID NO: 581334 - RNA, 64 nt, hsa
uaaacauugugaugauuauuauuuaaaaccauuauuuaauaagaguaaaaauaugugaaucugg

SEQ ID NO: 581335 - RNA, 64 nt, hsa
uuugaagcauagaagaaaauaguugcugagguuuuuuaauaaccauuccuacuaucuguguucc

SEQ ID NO: 581336 - RNA, 64 nt, hsa
guacagagaaaccaucuacauuccauggaauguuuuuaauaaguaggcaagaaaaaugccacua

SEQ ID NO: 581337 - RNA, 64 nt, hsa
uaugcagcagguguaaaaauuaauaaauauauuuuuuaauaaacauguuuguaugugugaagcu

SEQ ID NO: 581338 - RNA, 64 nt, hsa
uuaacuuuaaacauauugugacucaucuagaccuuuuaauaagacggucaacuucacacuuagg

SEQ ID NO: 581339 - RNA, 64 nt, hsa
aaagacauuuuaugaaaucuucauugucaaaaccuuuaauaaaaguggaaauauuuugaaaugc

SEQ ID NO: 581340 - RNA, 64 nt, hsa
uacauugagaauuucaacuagcuucugaucaauuuuuaauaaaaaauuuucaaaucauguuagc

SEQ ID NO: 581341 - RNA, 64 nt, hsa
cauuucuuuaugaauaugaauaauuguucuaugcuuuaauaaucuauugugaggaaacuacuaa

SEQ ID NO: 581342 - RNA, 64 nt, hsa
guccuuacuugaaaugggucuguauuaugguacuuuuaauaaauauuugauuuuucuuucucuu

SEQ ID NO: 581343 - RNA, 64 nt, hsa
ccccuucaguuucuauuuaggaggugaagaaucuuuuaauaagguagaaaguugcuuuauuuaa

SEQ ID NO: 581344 - RNA, 64 nt, hsa
uaauuucucaaagucuauuguuugaucuaguuauuuuaauaaaggaacucuagaaguuucaagu

SEQ ID NO: 581345 - RNA, 64 nt, hsa
ugaauagacagaacccuauccaguggaaggagaauuuaauaaagauagugcugaaagaauuccu

SEQ ID NO: 581346 - RNA, 64 nt, hsa
acauugcauaaacacuuuucaagucugauccauauuuaauaaugcuuuaaaauaaaaauaaaaa

SEQ ID NO: 581347 - RNA, 64 nt, hsa
uauuaaaaauuugggggaauccauauauaucuuuuuuaauaaccaaguaaauacuuuucauuuc

SEQ ID NO: 581348 - RNA, 64 nt, hsa
caagauuuguuaguaacaaucuugaagagcuaauuuuaauaaaaauaagaaaaauuaauacuau

SEQ ID NO: 581349 - RNA, 64 nt, hsa
gcuauacagguauguucaucuuuguguacagagguuuaauaaauuaguuuucauauacauaauc

SEQ ID NO: 581350 - RNA, 64 nt, hsa
ucugaauaauggcuugacuuagcacugagagcuauuuaauaacuuuguuccguuaauuaguacu

SEQ ID NO: 581351 - RNA, 64 nt, hsa
ccaagcacuugcaacugauguuacugucuucaauuuuaauaauuacacauauuuguauauuuca

SEQ ID NO: 581352 - RNA, 64 nt, hsa
uccuguuuucagucucuauguguacagcaguauuuuuaauaaagaauuacagagauaaauuugu

SEQ ID NO: 581353 - RNA, 64 nt, hsa
uucuuaaauauucuaaaauguaagucaaauauguuuuaauaacaaagacuuaaauggcuuuucu

SEQ ID NO: 581354 - RNA, 64 nt, hsa
uugcuugagacuuaagaggucauguugcuuuagguuuaauaaauagccuuaacuauuuggaggg

SEQ ID NO: 581355 - RNA, 64 nt, hsa
agggcuuggggacccaaugcaaagaugaugacuauuuaauaaaauggaaaauuuaauaaauccu

SEQ ID NO: 581356 - RNA, 64 nt, hsa
ugcaaagaugaugacuauuuaauaaaauggaaaauuuaauaaauccucauuuuauuaacuaaga

SEQ ID NO: 581357 - RNA, 64 nt, hsa
aaacaugccuuuuguuuucuauauacccugaccuuuuaauaaaguuucaguguauuuaucauug

SEQ ID NO: 581358 - RNA, 64 nt, hsa
caaggcauaggaagagaucuugcaggucuaguauuuuaauaaugcacuauuacccagggcagau

SEQ ID NO: 581359 - RNA, 64 nt, hsa
gccugaaauaccaugauuguuuauggaaaguaucuuuaauaaagcuggauacaguuugaaagaa

SEQ ID NO: 581360 - RNA, 64 nt, hsa
cagacuuacauguagugaaauagaauuuguauuauuuaauaaaauuuuaggguuugguuuuuac

SEQ ID NO: 581361 - RNA, 64 nt, hsa
gcuuggggcaagugaaguuugugacuaugcuugauuuaauaagcugagagucucuuguuugucu

SEQ ID NO: 581362 - RNA, 64 nt, hsa
aguccuuuauuuuauucuauucuauuuauuuuauuuuaauaaguacuuagccucuucugacuuc

SEQ ID NO: 581363 - RNA, 64 nt, hsa
aggggcccugaauuuaugugguuuuuauacauuuuuuaauaagaugcacuuuaugucauuuuuu

SEQ ID NO: 581364 - RNA, 64 nt, hsa
uacauuuuuuaauaagaugcacuuuaugucauuuuuuaauaaagucugaagaauuacuguuuaa

SEQ ID NO: 581365 - RNA, 64 nt, hsa
uuucuuggguuaguauuuaaagucuuaacauuuauuuaauaauuauauuuauuaaaccauuuuu

SEQ ID NO: 581366 - RNA, 64 nt, hsa
cuucugcaggagcugauccauuuauaaaugcaguuuuaauaaaccauggaauaccaaggcacaa

SEQ ID NO: 581367 - RNA, 64 nt, hsa
cucccuuccaggagcauuuuaauaaaagauuuuuuuuaauaacagaauuuuaguuugcuugcag

SEQ ID NO: 581368 - RNA, 64 nt, hsa
cuaugcaauaccaccugcucccuuccaggagcauuuuaauaaaagauuuuuuuuaauaacagaa

SEQ ID NO: 581369 - RNA, 64 nt, hsa
agugaaaagauuuguauacaaauguuuucuaugauuuaauaaaaauauauggcacaccuuuugu

SEQ ID NO: 581370 - RNA, 64 nt, hsa
acaaccuguuaccaauuauuucagcuuuuuuuguuuuaauaagugugacaacuuaaaacuuguu

SEQ ID NO: 581371 - RNA, 64 nt, hsa
uuuaaaaacaaauugcuuuugugucccugaaguauuuaauaagaagcauuuugcacucuagaaa

SEQ ID NO: 581372 - RNA, 64 nt, hsa
uucugauuaaaguaaguagaaaugggauguuuuguuuaauaacagccauaguguguguuuagac

SEQ ID NO: 581373 - RNA, 64 nt, hsa
cugucuggggugggaugccuuacuuugcacuuaauuuaauaagggcauucucggaggaguagac

SEQ ID NO: 581374 - RNA, 64 nt, hsa
auucuaugugaaauaucuuuuuacuuuuaugcauuuuaauaagauuuaaaaauauuuagauuaa

SEQ ID NO: 581375 - RNA, 64 nt, hsa
uuuagcuuuuaaucauuuuuaccaauuugaacaguuuaauaaacugguucugcucucuucugaa

SEQ ID NO: 581376 - RNA, 64 nt, hsa
gaauccaugugcccaggauuauauuagcauuauuuuuaauaaaucuauaugcuuaacauauuag

SEQ ID NO: 581377 - RNA, 64 nt, hsa
aauuuuugccuuaucaagaguuguuuuuuaaaaauuuaauaaauucauaaaaaagacucauauc

SEQ ID NO: 581378 - RNA, 64 nt, hsa
uauuuaaaucacuucaguuagcuuucaguguauguuuaauaauauacauuuaaugaugaaaaau

SEQ ID NO: 581379 - RNA, 64 nt, hsa
uuuucuuuuugaaaguuuuaauauugucuuccuuuuuaauaacuuauuuuauacauauugugca

SEQ ID NO: 581380 - RNA, 64 nt, hsa
ccuaugaaagaaucugugaauauauguaaauacguuuaauaaauuuuauuggucauguuaaauc

SEQ ID NO: 581381 - RNA, 64 nt, hsa
cuguuuaaugacuaguugauauuugugcauguuauuuaauaaagaguuauauuuuuauagaaaa

SEQ ID NO: 581382 - RNA, 64 nt, hsa
auauugaaguuuugguaaaaauucuuuuuucuuuuuuaauaaaaaauuagguuauuacuuuuuu

SEQ ID NO: 581383 - RNA, 64 nt, hsa
uuuucuuugguugucccuauuaacaaaaaaguauuuuaauaaaaaauugaaaugagugagucau

SEQ ID NO: 581384 - RNA, 64 nt, hsa
auucauaaauaaagaauuguucuuucuuugugguuuuaauaagaguucaagaauuguucagagu

SEQ ID NO: 581385 - RNA, 64 nt, hsa
guucaagaauuguucagagucuuguaaauguuauuuuaauaaucccuuuaaauuuuaucuguug

SEQ ID NO: 581386 - RNA, 64 nt, hsa
uugaaaguaagaaagggaggggaaacuuugcucuuuuaauaauuauguucagccuaugaugaag

SEQ ID NO: 581387 - RNA, 64 nt, hsa
uucgauguuuucccguguuguagagcuuccaggguuuaauaaaacugguuaaaaauugagucuu

SEQ ID NO: 581388 - RNA, 64 nt, hsa
aggcacugccccccuuuccugcccccuccucaucuuuaauaaagaccuggcuucucaucuuuaa

SEQ ID NO: 581389 - RNA, 64 nt, hsa
cuccucaucuuuaauaaagaccuggcuucucaucuuuaauaaagaccuguuuguaacagaaguu

SEQ ID NO: 581390 - RNA, 64 nt, hsa
uagucuuccuauagguuacuucaccuuuuuuuuuuuuaauaauuugauuugauacauauguagu

SEQ ID NO: 581391 - RNA, 64 nt, hsa
uacuauuacaguguaaauauauaacuuaugacaguuuaauaaguuaucagcaauuuagcacuuu

SEQ ID NO: 581392 - RNA, 64 nt, hsa
auagacaaucauaaaugaaugaucauggcuauguuuuaauaaaacuuuauggacacugagcuug

SEQ ID NO: 581393 - RNA, 64 nt, hsa
auagacaaucauaaaugaaugaucauggcuauguuuuaauaaaacuuuacagacacugaacuug

SEQ ID NO: 581394 - RNA, 64 nt, hsa
aauauuuucauuuaauaaagauugucagguuauauuuaauaagaaagaaaguaucauguaaaca

SEQ ID NO: 581395 - RNA, 64 nt, hsa
uuuuguuguuguugaugauacaaaaauauuuucauuuaauaaagauugucagguuauauuuaau

SEQ ID NO: 581396 - RNA, 64 nt, hsa
uggugggaguuguuauauuuaucuguaauauuucuuuaauaaaagagugaaagcaaauaugaca

SEQ ID NO: 581397 - RNA, 64 nt, hsa
augcacaaaggaacacaguauaacauuuguauaauuuaauaagaucuugcaaagaacaguacug

SEQ ID NO: 581398 - RNA, 64 nt, hsa
gugcuauugaaaucacuggggaaugaauggcuuauuuaauaaauggaagguucauaggagaaaa

SEQ ID NO: 581399 - RNA, 64 nt, hsa
aaguauccaaaaugguuacugaugacaaauacuuuuuaauaaaugucaaaaucacaauacuugg

SEQ ID NO: 581400 - RNA, 64 nt, hsa
gcuaaggcuuauaaaauaugaguauggucaggaauuuaauaaaaguacagugaugagcaugccu

SEQ ID NO: 581401 - RNA, 64 nt, hsa
aaugcaguuuggggaugaauauaauuaaaauauguuuaauaacuuagaauucaacuaauaaaaa

SEQ ID NO: 581402 - RNA, 64 nt, hsa
uuuuugaguuaauuauacucauaaaaugaguuucuuuaauaaauuaaauuuuauuguguaaaau

SEQ ID NO: 581403 - RNA, 64 nt, hsa
guacaauauauacauagacuguaacuacuuugcuuuuaauaauuuuaugaaauggcaaagguuu

SEQ ID NO: 581404 - RNA, 64 nt, hsa
uuuuaauuuauccuguaaauuucuguauauauaauuuaauaacagaagccuccaccagcaacag

SEQ ID NO: 581405 - RNA, 64 nt, hsa
guauugaguugcaaugugaccagcgaaagcugcauuuaauaaaugaaaguacagacuguuucuu

SEQ ID NO: 581406 - RNA, 64 nt, hsa
aucagggcagggcuuuaggauguucuggaugcuuuuuaauaauuaugcuucccaucauaacugg

SEQ ID NO: 581407 - RNA, 64 nt, hsa
uguaaaucaugcucuuuacacagaguaccacuuauuuaauaagacgggauguaaauuuacaaug

SEQ ID NO: 581408 - RNA, 64 nt, hsa
ugauauguagcuuuuucuuaaagacuuuugaauguuuaauaauuuuguaaaucaugcucuuuac

SEQ ID NO: 581409 - RNA, 64 nt, hsa
gcucaguaguguguucugaauucuauucaguuuguuuaauaaauagggaaaacuggcaacaugc

SEQ ID NO: 581410 - RNA, 64 nt, hsa
auaaauagggaaaacuggcaacaugcuaguuacuuuuaauaaaguaaucccugauucuauaccg

SEQ ID NO: 581411 - RNA, 64 nt, hsa
uuuuuacuaaugcuaaaacuuuuaaaguuuauuuuuuaauaaauuguugaguauuacaucauuu

SEQ ID NO: 581412 - RNA, 64 nt, hsa
uaguuuuaaucagcuuaaaagcuauuuaacccauuuuaauaagcuugcaguuuuguuucucugc

SEQ ID NO: 581413 - RNA, 64 nt, hsa
aaugaaauaaggaguaaaaaugcauuaccauuuguuuaauaauuaucuuuacagaaugcuaguu

SEQ ID NO: 581414 - RNA, 64 nt, hsa
gcagacugauacuaaauuuaaaauguaguuucaauuuaauaaucacauuagguuuaauuuuuuu

SEQ ID NO: 581415 - RNA, 64 nt, hsa; identical to SEQ ID NO: 160572

SEQ ID NO: 581416 - RNA, 64 nt, hsa; identical to SEQ ID NO: 160573

SEQ ID NO: 581417 - RNA, 64 nt, hsa; identical to SEQ ID NO: 160574

SEQ ID NO: 581418 - RNA, 64 nt, hsa; identical to SEQ ID NO: 160575

SEQ ID NO: 581419 - RNA, 64 nt, hsa; identical to SEQ ID NO: 160576

SEQ ID NO: 581420 - RNA, 64 nt, hsa; identical to SEQ ID NO: 160577

SEQ ID NO: 581421 - RNA, 64 nt, hsa; identical to SEQ ID NO: 160578

SEQ ID NO: 581422 - RNA, 64 nt, hsa; identical to SEQ ID NO: 160579

SEQ ID NO: 581423 - RNA, 64 nt, hsa; identical to SEQ ID NO: 160580

SEQ ID NO: 581424 - RNA, 64 nt, hsa; identical to SEQ ID NO: 160581

SEQ ID NO: 581425 - RNA, 64 nt, hsa; identical to SEQ ID NO: 160582

SEQ ID NO: 581426 - RNA, 64 nt, hsa; identical to SEQ ID NO: 160583

SEQ ID NO: 581427 - RNA, 64 nt, hsa; identical to SEQ ID NO: 160584

SEQ ID NO: 581428 - RNA, 64 nt, hsa; identical to SEQ ID NO: 160585

SEQ ID NO: 581429 - RNA, 64 nt, hsa; identical to SEQ ID NO: 160586

SEQ ID NO: 581430 - RNA, 64 nt, hsa; identical to SEQ ID NO: 160587

SEQ ID NO: 581431 - RNA, 64 nt, hsa; identical to SEQ ID NO: 160588

SEQ ID NO: 581432 - RNA, 64 nt, hsa; identical to SEQ ID NO: 160589

SEQ ID NO: 581433 - RNA, 64 nt, hsa; identical to SEQ ID NO: 160590

SEQ ID NO: 581434 - RNA, 64 nt, hsa; identical to SEQ ID NO: 160591

SEQ ID NO: 581435 - RNA, 64 nt, hsa; identical to SEQ ID NO: 160592

SEQ ID NO: 581436 - RNA, 64 nt, hsa; identical to SEQ ID NO: 160593

SEQ ID NO: 581437 - RNA, 64 nt, hsa; identical to SEQ ID NO: 160594

SEQ ID NO: 581438 - RNA, 64 nt, hsa; identical to SEQ ID NO: 160595

SEQ ID NO: 581439 - RNA, 64 nt, hsa; identical to SEQ ID NO: 160596

SEQ ID NO: 581440 - RNA, 64 nt, hsa; identical to SEQ ID NO: 160597

SEQ ID NO: 581441 - RNA, 64 nt, hsa; identical to SEQ ID NO: 160598

SEQ ID NO: 581442 - RNA, 64 nt, hsa; identical to SEQ ID NO: 160599

SEQ ID NO: 581443 - RNA, 64 nt, hsa; identical to SEQ ID NO: 160600

SEQ ID NO: 581444 - RNA, 64 nt, hsa; identical to SEQ ID NO: 160601

SEQ ID NO: 581445 - RNA, 64 nt, hsa; identical to SEQ ID NO: 160602

SEQ ID NO: 581446 - RNA, 64 nt, hsa; identical to SEQ ID NO: 160603

SEQ ID NO: 581447 - RNA, 64 nt, hsa; identical to SEQ ID NO: 160604

SEQ ID NO: 581448 - RNA, 51 nt, hsa; identical to SEQ ID NO: 160605

SEQ ID NO: 581449 - RNA, 64 nt, hsa; identical to SEQ ID NO: 160606

SEQ ID NO: 581450 - RNA, 64 nt, hsa; identical to SEQ ID NO: 160607

SEQ ID NO: 581451 - RNA, 64 nt, hsa; identical to SEQ ID NO: 160608

SEQ ID NO: 581452 - RNA, 64 nt, hsa; identical to SEQ ID NO: 160609

SEQ ID NO: 581453 - RNA, 64 nt, hsa; identical to SEQ ID NO: 160610

SEQ ID NO: 581454 - RNA, 64 nt, hsa; identical to SEQ ID NO: 160611

SEQ ID NO: 581455 - RNA, 64 nt, hsa; identical to SEQ ID NO: 160612

SEQ ID NO: 581456 - RNA, 64 nt, hsa; identical to SEQ ID NO: 160613

SEQ ID NO: 581457 - RNA, 64 nt, hsa; identical to SEQ ID NO: 160614

SEQ ID NO: 581458 - RNA, 64 nt, hsa; identical to SEQ ID NO: 160615

SEQ ID NO: 581459 - RNA, 64 nt, hsa; identical to SEQ ID NO: 160616

SEQ ID NO: 581460 - RNA, 64 nt, hsa; identical to SEQ ID NO: 160617

SEQ ID NO: 581461 - RNA, 64 nt, hsa; identical to SEQ ID NO: 160618

SEQ ID NO: 581462 - RNA, 64 nt, hsa; identical to SEQ ID NO: 160619

SEQ ID NO: 581463 - RNA, 64 nt, hsa; identical to SEQ ID NO: 160620

SEQ ID NO: 581464 - RNA, 64 nt, hsa; identical to SEQ ID NO: 160621

SEQ ID NO: 581465 - RNA, 64 nt, hsa
aguagcuuuucaauuugcuagaagcuuaauguaggcaagccacuucauuuuucagaacuuguuu

SEQ ID NO: 581466 - RNA, 64 nt, hsa
augcuuuaaaaaaaaaaaaggcaaugaaaauuuagcaagccacugaauuugaguuuucacuuug

SEQ ID NO: 581467 - RNA, 64 nt, hsa
ucuuuuucuuuuuugcuuucuugucuuuucagaagcaagccagaccuagcaggcuguuccaugu

SEQ ID NO: 581468 - RNA, 64 nt, hsa
cuggcuuugaaaccucagggcugucccagccccggcaagccacaggaaggaggggagagacagg

SEQ ID NO: 581469 - RNA, 64 nt, hsa
guguguccaggcucugggcacagugcugccccuugcaagccauaacgugcccccagaguguagg

SEQ ID NO: 581470 - RNA, 64 nt, hsa
uuuggguuuggccagggaggcgcagggacauggggcaagccagggcccagagcccuugacugua

SEQ ID NO: 581471 - RNA, 64 nt, hsa
uaaauacuauggaaggggcuuuguuguaaauacuauguaauauauauaaaauauugugacaugu

SEQ ID NO: 581472 - RNA, 64 nt, hsa
uauuacacagaugaagaaacauuucaagauauugauguaauaacauuacugagucccaugguaa

SEQ ID NO: 581473 - RNA, 64 nt, hsa
acuuauguacuacuaucacauguuguaaauuuucauguaauaguguuuucugugaguaaacucc

SEQ ID NO: 581474 - RNA, 64 nt, hsa
aguuaagaguuguaucuuaucccguuaguacaguauguaauagugggucugcugcuacuuucug

SEQ ID NO: 581475 - RNA, 64 nt, hsa
aguauauauuaggaucugcaaacaaugaagaauuauguaauauauuguacaaauguaagcaaag

SEQ ID NO: 581476 - RNA, 64 nt, hsa
ccuuaggguggcuuuaauuguauaagucaagcacauguaauaaauucaaaaccugcaguuaaca

SEQ ID NO: 581477 - RNA, 64 nt, hsa
ugcccggagcccugcucaucaaugaaaaacccauauguaauaaucgaauucauuuaacaugaau

SEQ ID NO: 581478 - RNA, 64 nt, hsa
uuugucauuuaaaaguucauuuugagggaauaacauguaauauaauuugaaauaaagguauagu

SEQ ID NO: 581479 - RNA, 64 nt, hsa
uuuuaauguauagauuuugcaaauauuaugcuauauguaauaccuaacuguaucuguaguguau

SEQ ID NO: 581480 - RNA, 64 nt, hsa
cuauauguaauaccuaacuguaucuguaguguauauguaauauauuuaugcccaauaaauguuu

SEQ ID NO: 581481 - RNA, 64 nt, hsa
agacaaauuacugauaaaaaugauauugcucuauauguaauauauccugaaagcauuauuuuuu

SEQ ID NO: 581482 - RNA, 64 nt, hsa
acacucauugaaauguaauuucaguucuaaaaagauguaauaaucauuuuagaauuaaaauuua

SEQ ID NO: 581483 - RNA, 64 nt, hsa
gcuaaauguugcuuguaggcuacauuaaacucaaauguaauaguuuaucuuauacuccugguuu

SEQ ID NO: 581484 - RNA, 64 nt, hsa
uaaauuucuuauuaaaucaaucuugaaauagaaaauguaauaacuuucuuaccauuaacauuuu

SEQ ID NO: 581485 - RNA, 64 nt, hsa
uucauaaauuauaauguauaaucuauacauuauaauguaauauauaaacuaaaauuuauggcac

SEQ ID NO: 581486 - RNA, 64 nt, hsa
guuuucaaaccaacaaacucucuuaagguucaauauguaauaaaaaacauaacacaaauaauua

SEQ ID NO: 581487 - RNA, 64 nt, hsa
ugauauauguuuacaguguagaaugauuaaaucaauguaauaaauuuauugccucauaccauuu

SEQ ID NO: 581488 - RNA, 64 nt, hsa
gacaguccucuggauccucuaaaugugaauuuugauguaauaacugcuaauaaaauuauauuga

SEQ ID NO: 581489 - RNA, 64 nt, hsa
cuuuauaaucgucauuguucaaccaagauuuugaauguaauaagaugaauauauuccuuacaaa

SEQ ID NO: 581490 - RNA, 64 nt, hsa
uucaaauuaccaagcacuguaauacuauaaauuaauguaauacugugugaauucagacuauaaa

SEQ ID NO: 581491 - RNA, 64 nt, hsa
augucuacauauuuguguguguguguguauauauauguaauaugcauacacagaugcauaugug

SEQ ID NO: 581492 - RNA, 64 nt, hsa
cugguggaugauuaucugcuaaguaagucugaaaauguaauauuuugauaauacuguaauauac

SEQ ID NO: 581493 - RNA, 64 nt, hsa
aguucugauuuaaagaaugguggcaaaauggugcauguaauacuuuugcaaguguuggggagau

SEQ ID NO: 581494 - RNA, 64 nt, hsa
auaugaaauauaauguuucagauugcaagguaauauguaauaguaguguuuguaagauacucuu

SEQ ID NO: 581495 - RNA, 64 nt, hsa
cuagauauauacacacacauauauauauggauggauguaauauauguagaacacacacauagau

SEQ ID NO: 581496 - RNA, 64 nt, hsa
cauuugcuauuuucauuauacacuaugagguaaaauguaauaacaaaagagagagaaguaccac

SEQ ID NO: 581497 - RNA, 64 nt, hsa
aucagggaauuuguauuggagaaaaacccugcaaauguaauaaauauggaaaaacauuuuuuca

SEQ ID NO: 581498 - RNA, 64 nt, hsa
uaaaauuaauuaucauuuuguugauugugcuuuuauguaauaaaaugcaguacuuuaaaacauu

SEQ ID NO: 581499 - RNA, 64 nt, hsa
acaaaaacagaauaauuuugaaguuuuagaauaaauguaauauauuuacuauaauucuaaaugu

SEQ ID NO: 581500 - RNA, 64 nt, hsa
uuucuaaugugguauuuuaaauaaaguaucauaaauguaauaaguaaauauuuauuuaggaaua

SEQ ID NO: 581501 - RNA, 64 nt, hsa
auggaaaaauuuuaauuuguagccaucuuuucccauguaauaguauugauucauagagaacuua

SEQ ID NO: 581502 - RNA, 64 nt, hsa
agaacuuaauguucaaaauuugcuuuguggaggcauguaauaagauaaacaucauacauuauaa

SEQ ID NO: 581503 - RNA, 64 nt, hsa
aaggaaauguaaauauaauauauauuuauauuugauguaauauggacaucugcagauucuaaua

SEQ ID NO: 581504 - RNA, 64 nt, hsa
aaaaaacaaaaaguacacagaaauauuuauuaaaauguaauacaguuuauugaacuuucuaggu

SEQ ID NO: 581505 - RNA, 64 nt, hsa
uaauuuguacccuuguuauuaucuacuaguaauaauguaauacuguagaaauauugcucuaauu

SEQ ID NO: 581506 - RNA, 64 nt, hsa
aucagguaaaauauuuuccaaagagccaugugucauguaauacugaaccacuuugauauugaga

SEQ ID NO: 581507 - RNA, 64 nt, hsa
uuuccuuaaaacuucagucuuuuuguaguauuauauguaauauauuaaaagugaaaaucacuac

SEQ ID NO: 581508 - RNA, 64 nt, hsa
ucaauaacaugcaaacaaacaagccacgggaaauauguaauaucuacuagugaguguuguuaga

SEQ ID NO: 581509 - RNA, 64 nt, hsa
caauguuugauacucuaguauguaagcuguauuuauguaauauuuagaacgacauguuaauaaa

SEQ ID NO: 581510 - RNA, 64 nt, hsa
ugacaacucuuauuugaauugauuuuuucaucuaauguaauaauggaagccaaaguauucauau

SEQ ID NO: 581511 - RNA, 64 nt, hsa
cuaagucucucaaacuagcguuuuauguaauaauauguaauauaaauaaaacuaugguaaaugu

SEQ ID NO: 581512 - RNA, 64 nt, hsa
agugaauguucuaagucucucaaacuagcguuuuauguaauaauauguaauauaaauaaaacua

SEQ ID NO: 581513 - RNA, 64 nt, hsa
cuucagcucuagcaguccaugacuuuuuaaggaaauguaauacaagucaaaccaggcaauacag

SEQ ID NO: 581514 - RNA, 64 nt, hsa
aaggcauaagcagauuuuacuguuagaggaaaauauguaauacuuacaugaauguugcaugugu

SEQ ID NO: 581515 - RNA, 64 nt, hsa
uaguaugcacagcaguguuagccauuucauauguauguaauaugcacguguguauccaaucugc

SEQ ID NO: 581516 - RNA, 64 nt, hsa
uucucaaaguugguuauuagaccaggaaaacuuaauguaauauuauuuuuaaaaucaucuuaaa

SEQ ID NO: 581517 - RNA, 64 nt, hsa
uagauguauaaugaaaaaggauaaugcaaaaauuauguaauagauaccaaauuagggaaguuug

SEQ ID NO: 581518 - RNA, 64 nt, hsa
agauucaucugaacuggaccaguguugaucuguaauguaauagaaaaucugauagaccagcacu

SEQ ID NO: 581519 - RNA, 64 nt, hsa
uuuuauguaauauuguguuaaauuauauuguuuuauguaauauauuauuuuaaauguuauuuua

SEQ ID NO: 581520 - RNA, 64 nt, hsa
uguauuauaaucuuuuaauauaauauuauauuuuauguaauauuguguuaaauuauauuguuuu

SEQ ID NO: 581521 - RNA, 64 nt, hsa
agaaagcccaucacgaacaauaugggaaauucuuauguaauacuauauaucuguaaaaugcaac

SEQ ID NO: 581522 - RNA, 64 nt, hsa
uuuuaucacggaugaauggauggacuugcucucuauguaauaugaaauuaaucuauuuuauuaa

SEQ ID NO: 581523 - RNA, 64 nt, hsa
ucaaucaauguuauugugaaaacugggaaugugaauguaauauauguagaaaaacauuuagcca

SEQ ID NO: 581524 - RNA, 64 nt, hsa
aaacauuuagccacagcccaaaucuuccaggcaaauguaauaaacgugacauugccguuagcca

SEQ ID NO: 581525 - RNA, 64 nt, hsa
aaaauuaguacguuauuuuacuauuuguacuuuuauguaauaaaaugcaguacauuuuuaaauu

SEQ ID NO: 581526 - RNA, 64 nt, hsa
aucagggaauucagauuggagaaaaacccugcaaauguaauaaauuugaaaaaaaaguuuucca

SEQ ID NO: 581527 - RNA, 64 nt, hsa
aaaauauauguuuggcugaaauuaugucaaauggauguaauauaggguuuguuugcugcuuuug

SEQ ID NO: 581528 - RNA, 64 nt, hsa
gaaauauaaacugugagauaaauaucauuauagcauguaauauuaaauuccuccugucuccucu

SEQ ID NO: 581529 - RNA, 64 nt, hsa
guucucaaggaauuugcauucuagaaaguagaagauguaauaaauguacugugggacauguuaa

SEQ ID NO: 581530 - RNA, 64 nt, hsa
uuucaaagauacaaauauuuacauaguuuuaaucauguaauauauacaauuuaauguccuagug

SEQ ID NO: 581531 - RNA, 64 nt, hsa
gauauuuaaggauugcauauuguuccuaaugaggauguaauaaacaggcauuaguaccccuuuc

SEQ ID NO: 581532 - RNA, 64 nt, hsa
aaguaaauagaauaauauuuuauuaauguaugauauguaauacuuauugucuaaaucaaguuuc

SEQ ID NO: 581533 - RNA, 64 nt, hsa
uucuuaaaauuuagcauuacuuuaaauagccagcauguaauacaaguaacuacacuaccucaua

SEQ ID NO: 581534 - RNA, 64 nt, hsa
gaaucuguaaauauuuuaaauguuuuauuaaggcauguaauaaacuauucuuugaaacuuguug

SEQ ID NO: 581535 - RNA, 64 nt, hsa
gcauuuauucacaagcaaccccaaaaguccaaaaauguaauaauuuugacaaggcccaaaguug

SEQ ID NO: 581536 - RNA, 64 nt, hsa
aagaauguacucauacagauuuuuguuagucaucauguaauaagccauuuauaucagaaaccuu

SEQ ID NO: 581537 - RNA, 64 nt, hsa
uuaaauagauauucuauauuaaacacuaauuuaaauguaauaaaggccaaaggccucuguauga

SEQ ID NO: 581538 - RNA, 64 nt, hsa
ccuaaaaauggccagauuguggaacagcuguugaauguaauacuuccaaaauguacauaucuuu

SEQ ID NO: 581539 - RNA, 64 nt, hsa; identical to SEQ ID NO: 117710

SEQ ID NO: 581540 - RNA, 64 nt, hsa; identical to SEQ ID NO: 117711

SEQ ID NO: 581541 - RNA, 64 nt, hsa; identical to SEQ ID NO: 117712

SEQ ID NO: 581542 - RNA, 64 nt, hsa; identical to SEQ ID NO: 117713

SEQ ID NO: 581543 - RNA, 64 nt, hsa; identical to SEQ ID NO: 117714

SEQ ID NO: 581544 - RNA, 64 nt, hsa; identical to SEQ ID NO: 117715

SEQ ID NO: 581545 - RNA, 64 nt, hsa; identical to SEQ ID NO: 117716

SEQ ID NO: 581546 - RNA, 64 nt, hsa; identical to SEQ ID NO: 117717

SEQ ID NO: 581547 - RNA, 64 nt, hsa; identical to SEQ ID NO: 117718

SEQ ID NO: 581548 - RNA, 64 nt, hsa; identical to SEQ ID NO: 117719

SEQ ID NO: 581549 - RNA, 64 nt, hsa; identical to SEQ ID NO: 117720

SEQ ID NO: 581550 - RNA, 64 nt, hsa; identical to SEQ ID NO: 117721

SEQ ID NO: 581551 - RNA, 64 nt, hsa; identical to SEQ ID NO: 117722

SEQ ID NO: 581552 - RNA, 64 nt, hsa; identical to SEQ ID NO: 117723

SEQ ID NO: 581553 - RNA, 64 nt, hsa; identical to SEQ ID NO: 117724

SEQ ID NO: 581554 - RNA, 64 nt, hsa; identical to SEQ ID NO: 117725

SEQ ID NO: 581555 - RNA, 64 nt, hsa; identical to SEQ ID NO: 117726

SEQ ID NO: 581556 - RNA, 64 nt, hsa; identical to SEQ ID NO: 117727

SEQ ID NO: 581557 - RNA, 64 nt, hsa; identical to SEQ ID NO: 117728

SEQ ID NO: 581558 - RNA, 64 nt, hsa; identical to SEQ ID NO: 117729

SEQ ID NO: 581559 - RNA, 64 nt, hsa; identical to SEQ ID NO: 117730

SEQ ID NO: 581560 - RNA, 64 nt, hsa; identical to SEQ ID NO: 117731

SEQ ID NO: 581561 - RNA, 64 nt, hsa; identical to SEQ ID NO: 117732

SEQ ID NO: 581562 - RNA, 64 nt, hsa; identical to SEQ ID NO: 117733

SEQ ID NO: 581563 - RNA, 64 nt, hsa; identical to SEQ ID NO: 117734

SEQ ID NO: 581564 - RNA, 64 nt, hsa; identical to SEQ ID NO: 117735

SEQ ID NO: 581565 - RNA, 64 nt, hsa; identical to SEQ ID NO: 117736

SEQ ID NO: 581566 - RNA, 64 nt, hsa; identical to SEQ ID NO: 117737

SEQ ID NO: 581567 - RNA, 64 nt, hsa; identical to SEQ ID NO: 117738

SEQ ID NO: 581568 - RNA, 64 nt, hsa; identical to SEQ ID NO: 117739

SEQ ID NO: 581569 - RNA, 64 nt, hsa; identical to SEQ ID NO: 117740

SEQ ID NO: 581570 - RNA, 64 nt, hsa; identical to SEQ ID NO: 117741

SEQ ID NO: 581571 - RNA, 64 nt, hsa; identical to SEQ ID NO: 117742

SEQ ID NO: 581572 - RNA, 64 nt, hsa; identical to SEQ ID NO: 117743

SEQ ID NO: 581573 - RNA, 64 nt, hsa; identical to SEQ ID NO: 117744

SEQ ID NO: 581574 - RNA, 64 nt, hsa; identical to SEQ ID NO: 117745

SEQ ID NO: 581575 - RNA, 64 nt, hsa; identical to SEQ ID NO: 117746

SEQ ID NO: 581576 - RNA, 64 nt, hsa; identical to SEQ ID NO: 117747

SEQ ID NO: 581577 - RNA, 64 nt, hsa; identical to SEQ ID NO: 117748

SEQ ID NO: 581578 - RNA, 64 nt, hsa; identical to SEQ ID NO: 117749

SEQ ID NO: 581579 - RNA, 64 nt, hsa; identical to SEQ ID NO: 117750

SEQ ID NO: 581580 - RNA, 64 nt, hsa; identical to SEQ ID NO: 117751

SEQ ID NO: 581581 - RNA, 64 nt, hsa; identical to SEQ ID NO: 117752

SEQ ID NO: 581582 - RNA, 64 nt, hsa; identical to SEQ ID NO: 117753

SEQ ID NO: 581583 - RNA, 64 nt, hsa; identical to SEQ ID NO: 117754

SEQ ID NO: 581584 - RNA, 64 nt, hsa; identical to SEQ ID NO: 117755

SEQ ID NO: 581585 - RNA, 64 nt, hsa; identical to SEQ ID NO: 117756

SEQ ID NO: 581586 - RNA, 64 nt, hsa; identical to SEQ ID NO: 117757

SEQ ID NO: 581587 - RNA, 64 nt, hsa; identical to SEQ ID NO: 117758

SEQ ID NO: 581588 - RNA, 64 nt, hsa; identical to SEQ ID NO: 117759

SEQ ID NO: 581589 - RNA, 64 nt, hsa; identical to SEQ ID NO: 117760

SEQ ID NO: 581590 - RNA, 64 nt, hsa; identical to SEQ ID NO: 117761

SEQ ID NO: 581591 - RNA, 64 nt, hsa; identical to SEQ ID NO: 117762

SEQ ID NO: 581592 - RNA, 64 nt, hsa; identical to SEQ ID NO: 117763

SEQ ID NO: 581593 - RNA, 64 nt, hsa; identical to SEQ ID NO: 117764

SEQ ID NO: 581594 - RNA, 64 nt, hsa; identical to SEQ ID NO: 117765

SEQ ID NO: 581595 - RNA, 64 nt, hsa; identical to SEQ ID NO: 117766

SEQ ID NO: 581596 - RNA, 64 nt, hsa; identical to SEQ ID NO: 117767

SEQ ID NO: 581597 - RNA, 64 nt, hsa; identical to SEQ ID NO: 117768

SEQ ID NO: 581598 - RNA, 64 nt, hsa; identical to SEQ ID NO: 117769

SEQ ID NO: 581599 - RNA, 64 nt, hsa; identical to SEQ ID NO: 117770

SEQ ID NO: 581600 - RNA, 64 nt, hsa; identical to SEQ ID NO: 117771

SEQ ID NO: 581601 - RNA, 64 nt, hsa; identical to SEQ ID NO: 117772

SEQ ID NO: 581602 - RNA, 64 nt, hsa; identical to SEQ ID NO: 117773

SEQ ID NO: 581603 - RNA, 64 nt, hsa; identical to SEQ ID NO: 117774

SEQ ID NO: 581604 - RNA, 64 nt, hsa; identical to SEQ ID NO: 117775

SEQ ID NO: 581605 - RNA, 64 nt, hsa; identical to SEQ ID NO: 117776

SEQ ID NO: 581606 - RNA, 64 nt, hsa; identical to SEQ ID NO: 117777

SEQ ID NO: 581607 - RNA, 64 nt, hsa; identical to SEQ ID NO: 117778

SEQ ID NO: 581608 - RNA, 64 nt, hsa; identical to SEQ ID NO: 117779

SEQ ID NO: 581609 - RNA, 64 nt, hsa; identical to SEQ ID NO: 117780

SEQ ID NO: 581610 - RNA, 64 nt, hsa; identical to SEQ ID NO: 117781

SEQ ID NO: 581611 - RNA, 64 nt, hsa; identical to SEQ ID NO: 117782

SEQ ID NO: 581612 - RNA, 64 nt, hsa; identical to SEQ ID NO: 117783

SEQ ID NO: 581613 - RNA, 64 nt, hsa; identical to SEQ ID NO: 117784

SEQ ID NO: 581614 - RNA, 64 nt, hsa; identical to SEQ ID NO: 117785

SEQ ID NO: 581615 - RNA, 64 nt, hsa; identical to SEQ ID NO: 117786

SEQ ID NO: 581616 - RNA, 59 nt, hsa; identical to SEQ ID NO: 58889

SEQ ID NO: 581617 - RNA, 64 nt, hsa; identical to SEQ ID NO: 117788

SEQ ID NO: 581618 - RNA, 64 nt, hsa; identical to SEQ ID NO: 117789

SEQ ID NO: 581619 - RNA, 64 nt, hsa; identical to SEQ ID NO: 117790

SEQ ID NO: 581620 - RNA, 64 nt, hsa; identical to SEQ ID NO: 117791

SEQ ID NO: 581621 - RNA, 64 nt, hsa; identical to SEQ ID NO: 117792

SEQ ID NO: 581622 - RNA, 64 nt, hsa; identical to SEQ ID NO: 117793

SEQ ID NO: 581623 - RNA, 64 nt, hsa; identical to SEQ ID NO: 117794

SEQ ID NO: 581624 - RNA, 64 nt, hsa; identical to SEQ ID NO: 117795

SEQ ID NO: 581625 - RNA, 64 nt, hsa; identical to SEQ ID NO: 117796

SEQ ID NO: 581626 - RNA, 64 nt, hsa; identical to SEQ ID NO: 117797

SEQ ID NO: 581627 - RNA, 64 nt, hsa; identical to SEQ ID NO: 117798

SEQ ID NO: 581628 - RNA, 64 nt, hsa; identical to SEQ ID NO: 117799

SEQ ID NO: 581629 - RNA, 64 nt, hsa; identical to SEQ ID NO: 117800

SEQ ID NO: 581630 - RNA, 64 nt, hsa; identical to SEQ ID NO: 117801

SEQ ID NO: 581631 - RNA, 64 nt, hsa; identical to SEQ ID NO: 117802

SEQ ID NO: 581632 - RNA, 64 nt, hsa; identical to SEQ ID NO: 117803

SEQ ID NO: 581633 - RNA, 64 nt, hsa; identical to SEQ ID NO: 117804

SEQ ID NO: 581634 - RNA, 64 nt, hsa; identical to SEQ ID NO: 117805

SEQ ID NO: 581635 - RNA, 64 nt, hsa; identical to SEQ ID NO: 117806

SEQ ID NO: 581636 - RNA, 64 nt, hsa; identical to SEQ ID NO: 117807

SEQ ID NO: 581637 - RNA, 64 nt, hsa; identical to SEQ ID NO: 117808

SEQ ID NO: 581638 - RNA, 64 nt, hsa; identical to SEQ ID NO: 117809

SEQ ID NO: 581639 - RNA, 64 nt, hsa; identical to SEQ ID NO: 117810

SEQ ID NO: 581640 - RNA, 64 nt, hsa; identical to SEQ ID NO: 117811

SEQ ID NO: 581641 - RNA, 64 nt, hsa; identical to SEQ ID NO: 117812

SEQ ID NO: 581642 - RNA, 64 nt, hsa; identical to SEQ ID NO: 117813

SEQ ID NO: 581643 - RNA, 64 nt, hsa; identical to SEQ ID NO: 117814

SEQ ID NO: 581644 - RNA, 64 nt, hsa; identical to SEQ ID NO: 117815

SEQ ID NO: 581645 - RNA, 64 nt, hsa; identical to SEQ ID NO: 117816

SEQ ID NO: 581646 - RNA, 64 nt, hsa; identical to SEQ ID NO: 117817

SEQ ID NO: 581647 - RNA, 64 nt, hsa; identical to SEQ ID NO: 117818

SEQ ID NO: 581648 - RNA, 64 nt, hsa; identical to SEQ ID NO: 117819

SEQ ID NO: 581649 - RNA, 64 nt, hsa; identical to SEQ ID NO: 117820

SEQ ID NO: 581650 - RNA, 64 nt, hsa; identical to SEQ ID NO: 117821

SEQ ID NO: 581651 - RNA, 64 nt, hsa; identical to SEQ ID NO: 117822

SEQ ID NO: 581652 - RNA, 64 nt, hsa; identical to SEQ ID NO: 117823

SEQ ID NO: 581653 - RNA, 64 nt, hsa
uuucuggaaaguagaucuuuucuugaccuaguauaucagugacaguugcagcccuugugaugug

SEQ ID NO: 581654 - RNA, 64 nt, hsa
ugaagaaaagaccuuuuggcccaaucucugccauaucagugaaccuuuagaaacucaaaaacug

SEQ ID NO: 581655 - RNA, 64 nt, hsa
agcaugacccaucuccagagaugggauuugagaaaucagugagagcuuccuauaaagaacucca

SEQ ID NO: 581656 - RNA, 64 nt, hsa
ggguaguggagcuucccuccccacccccauauguaucagugaagccuuugaaauuacuuaaggc

SEQ ID NO: 581657 - RNA, 64 nt, hsa
uugguggccaaguuauuuggggacaccuaaacagaucagugaccugaaugacuucucagaaccu

SEQ ID NO: 581658 - RNA, 64 nt, hsa
cccaggcuuuuacaaccuggugcucagcuuccccaucagugaaaagggguggcuagaguaacua

SEQ ID NO: 581659 - RNA, 64 nt, hsa
gcacggggaaaccuccugaguggaaguuucauucaucagugaugaauagcccccaaacaguggg

SEQ ID NO: 581660 - RNA, 64 nt, hsa
uaauaauacaagcuccaguguuauacaauaacccaucagugauuggggaaucaaacauuuuggu

SEQ ID NO: 581661 - RNA, 64 nt, hsa
uuuucagcaacaauucuucuguuuauucuaauuaaucagugacugccuuguaagaaauguuugu

SEQ ID NO: 581662 - RNA, 64 nt, hsa
aauacuagagcauugguucugacauucauuguaaaucagugaacuguaagauacugucuaaaaa

SEQ ID NO: 581663 - RNA, 64 nt, hsa
aaagucccaggccucugccuuggugcuuccaauuaucagugaccugccugcaagcauccccaga

SEQ ID NO: 581664 - RNA, 64 nt, hsa
uuauguaagaaucaucgccuuguggaacaagucaaucagugacuagcuuccuguagccaaucag

SEQ ID NO: 581665 - RNA, 64 nt, hsa
ugaucaccuuaaugcucaugagacuauauuuaugaucagugaauaaaaaugucagaacugugcu

SEQ ID NO: 581666 - RNA, 64 nt, hsa
aagaugccccgacuucuuuggccagugauggggaaucagugagugcuccaugauggucauguuc

SEQ ID NO: 581667 - RNA, 65 nt, hsa; identical to SEQ ID NO: 227063

SEQ ID NO: 581668 - RNA, 65 nt, hsa; identical to SEQ ID NO: 227064

SEQ ID NO: 581669 - RNA, 65 nt, hsa; identical to SEQ ID NO: 227065

SEQ ID NO: 581670 - RNA, 65 nt, hsa; identical to SEQ ID NO: 227066

SEQ ID NO: 581671 - RNA, 65 nt, hsa; identical to SEQ ID NO: 227067

SEQ ID NO: 581672 - RNA, 65 nt, hsa; identical to SEQ ID NO: 227068

SEQ ID NO: 581673 - RNA, 65 nt, hsa; identical to SEQ ID NO: 227069

SEQ ID NO: 581674 - RNA, 65 nt, hsa; identical to SEQ ID NO: 227070

SEQ ID NO: 581675 - RNA, 65 nt, hsa; identical to SEQ ID NO: 227071

SEQ ID NO: 581676 - RNA, 65 nt, hsa; identical to SEQ ID NO: 227072

SEQ ID NO: 581677 - RNA, 65 nt, hsa; identical to SEQ ID NO: 227073

SEQ ID NO: 581678 - RNA, 54 nt, hsa; identical to SEQ ID NO: 227074

SEQ ID NO: 581679 - RNA, 65 nt, hsa; identical to SEQ ID NO: 227075

SEQ ID NO: 581680 - RNA, 65 nt, hsa; identical to SEQ ID NO: 227076

SEQ ID NO: 581681 - RNA, 65 nt, hsa; identical to SEQ ID NO: 227077

SEQ ID NO: 581682 - RNA, 65 nt, hsa; identical to SEQ ID NO: 227078

SEQ ID NO: 581683 - RNA, 65 nt, hsa; identical to SEQ ID NO: 227079

SEQ ID NO: 581684 - RNA, 65 nt, hsa; identical to SEQ ID NO: 227080

SEQ ID NO: 581685 - RNA, 65 nt, hsa; identical to SEQ ID NO: 227081

SEQ ID NO: 581686 - RNA, 65 nt, hsa; identical to SEQ ID NO: 227082

SEQ ID NO: 581687 - RNA, 65 nt, hsa; identical to SEQ ID NO: 227083

SEQ ID NO: 581688 - RNA, 65 nt, hsa; identical to SEQ ID NO: 58812

SEQ ID NO: 581689 - RNA, 65 nt, hsa; identical to SEQ ID NO: 58813

SEQ ID NO: 581690 - RNA, 65 nt, hsa; identical to SEQ ID NO: 227086

SEQ ID NO: 581691 - RNA, 65 nt, hsa; identical to SEQ ID NO: 227087

SEQ ID NO: 581692 - RNA, 65 nt, hsa; identical to SEQ ID NO: 227088

SEQ ID NO: 581693 - RNA, 65 nt, hsa; identical to SEQ ID NO: 227089

SEQ ID NO: 581694 - RNA, 65 nt, hsa; identical to SEQ ID NO: 227090

SEQ ID NO: 581695 - RNA, 65 nt, hsa; identical to SEQ ID NO: 227091

SEQ ID NO: 581696 - RNA, 65 nt, hsa; identical to SEQ ID NO: 227092

SEQ ID NO: 581697 - RNA, 65 nt, hsa; identical to SEQ ID NO: 227093

SEQ ID NO: 581698 - RNA, 65 nt, hsa; identical to SEQ ID NO: 227094

SEQ ID NO: 581699 - RNA, 65 nt, hsa; identical to SEQ ID NO: 227095

SEQ ID NO: 581700 - RNA, 65 nt, hsa; identical to SEQ ID NO: 227096

SEQ ID NO: 581701 - RNA, 65 nt, hsa; identical to SEQ ID NO: 227097

SEQ ID NO: 581702 - RNA, 65 nt, hsa; identical to SEQ ID NO: 227098

SEQ ID NO: 581703 - RNA, 65 nt, hsa; identical to SEQ ID NO: 58814

SEQ ID NO: 581704 - RNA, 65 nt, hsa; identical to SEQ ID NO: 58815

SEQ ID NO: 581705 - RNA, 65 nt, hsa; identical to SEQ ID NO: 227101

SEQ ID NO: 581706 - RNA, 65 nt, hsa; identical to SEQ ID NO: 227102

SEQ ID NO: 581707 - RNA, 65 nt, hsa; identical to SEQ ID NO: 227103

SEQ ID NO: 581708 - RNA, 65 nt, hsa; identical to SEQ ID NO: 227104

SEQ ID NO: 581709 - RNA, 65 nt, hsa; identical to SEQ ID NO: 227105

SEQ ID NO: 581710 - RNA, 65 nt, hsa; identical to SEQ ID NO: 227106

SEQ ID NO: 581711 - RNA, 65 nt, hsa; identical to SEQ ID NO: 227107

SEQ ID NO: 581712 - RNA, 65 nt, hsa; identical to SEQ ID NO: 227108

SEQ ID NO: 581713 - RNA, 65 nt, hsa; identical to SEQ ID NO: 227109

SEQ ID NO: 581714 - RNA, 65 nt, hsa; identical to SEQ ID NO: 227110

SEQ ID NO: 581715 - RNA, 65 nt, hsa; identical to SEQ ID NO: 227111

SEQ ID NO: 581716 - RNA, 65 nt, hsa; identical to SEQ ID NO: 58816

SEQ ID NO: 581717 - RNA, 65 nt, hsa; identical to SEQ ID NO: 58817

SEQ ID NO: 581718 - RNA, 65 nt, hsa; identical to SEQ ID NO: 227114

SEQ ID NO: 581719 - RNA, 65 nt, hsa; identical to SEQ ID NO: 227115

SEQ ID NO: 581720 - RNA, 65 nt, hsa; identical to SEQ ID NO: 227116

SEQ ID NO: 581721 - RNA, 65 nt, hsa; identical to SEQ ID NO: 227117

SEQ ID NO: 581722 - RNA, 65 nt, hsa; identical to SEQ ID NO: 227118

SEQ ID NO: 581723 - RNA, 65 nt, hsa; identical to SEQ ID NO: 227119

SEQ ID NO: 581724 - RNA, 65 nt, hsa; identical to SEQ ID NO: 227120

SEQ ID NO: 581725 - RNA, 65 nt, hsa; identical to SEQ ID NO: 227121

SEQ ID NO: 581726 - RNA, 65 nt, hsa; identical to SEQ ID NO: 227122

SEQ ID NO: 581727 - RNA, 65 nt, hsa; identical to SEQ ID NO: 227123

SEQ ID NO: 581728 - RNA, 65 nt, hsa; identical to SEQ ID NO: 227124

SEQ ID NO: 581729 - RNA, 65 nt, hsa; identical to SEQ ID NO: 227125

SEQ ID NO: 581730 - RNA, 65 nt, hsa; identical to SEQ ID NO: 227126

SEQ ID NO: 581731 - RNA, 65 nt, hsa; identical to SEQ ID NO: 227127

SEQ ID NO: 581732 - RNA, 65 nt, hsa; identical to SEQ ID NO: 227128

SEQ ID NO: 581733 - RNA, 65 nt, hsa; identical to SEQ ID NO: 227129

SEQ ID NO: 581734 - RNA, 65 nt, hsa; identical to SEQ ID NO: 227130

SEQ ID NO: 581735 - RNA, 65 nt, hsa; identical to SEQ ID NO: 227131

SEQ ID NO: 581736 - RNA, 65 nt, hsa; identical to SEQ ID NO: 227132

SEQ ID NO: 581737 - RNA, 65 nt, hsa; identical to SEQ ID NO: 227133

SEQ ID NO: 581738 - RNA, 65 nt, hsa; identical to SEQ ID NO: 58818

SEQ ID NO: 581739 - RNA, 65 nt, hsa; identical to SEQ ID NO: 58819

SEQ ID NO: 581740 - RNA, 65 nt, hsa; identical to SEQ ID NO: 227136

SEQ ID NO: 581741 - RNA, 65 nt, hsa; identical to SEQ ID NO: 227137

SEQ ID NO: 581742 - RNA, 65 nt, hsa; identical to SEQ ID NO: 227138

SEQ ID NO: 581743 - RNA, 65 nt, hsa; identical to SEQ ID NO: 227139

SEQ ID NO: 581744 - RNA, 65 nt, hsa; identical to SEQ ID NO: 227140

SEQ ID NO: 581745 - RNA, 65 nt, hsa; identical to SEQ ID NO: 227141

SEQ ID NO: 581746 - RNA, 65 nt, hsa; identical to SEQ ID NO: 227142

SEQ ID NO: 581747 - RNA, 65 nt, hsa; identical to SEQ ID NO: 227143

SEQ ID NO: 581748 - RNA, 65 nt, hsa; identical to SEQ ID NO: 227144

SEQ ID NO: 581749 - RNA, 65 nt, hsa; identical to SEQ ID NO: 227145

SEQ ID NO: 581750 - RNA, 65 nt, hsa; identical to SEQ ID NO: 227146

SEQ ID NO: 581751 - RNA, 65 nt, hsa; identical to SEQ ID NO: 227147

SEQ ID NO: 581752 - RNA, 65 nt, hsa; identical to SEQ ID NO: 227148

SEQ ID NO: 581753 - RNA, 65 nt, hsa; identical to SEQ ID NO: 58820

SEQ ID NO: 581754 - RNA, 65 nt, hsa; identical to SEQ ID NO: 58821

SEQ ID NO: 581755 - RNA, 65 nt, hsa; identical to SEQ ID NO: 227151

SEQ ID NO: 581756 - RNA, 65 nt, hsa; identical to SEQ ID NO: 227152

SEQ ID NO: 581757 - RNA, 65 nt, hsa; identical to SEQ ID NO: 227153

SEQ ID NO: 581758 - RNA, 65 nt, hsa; identical to SEQ ID NO: 227154

SEQ ID NO: 581759 - RNA, 65 nt, hsa; identical to SEQ ID NO: 227155

SEQ ID NO: 581760 - RNA, 65 nt, hsa; identical to SEQ ID NO: 227156

SEQ ID NO: 581761 - RNA, 65 nt, hsa; identical to SEQ ID NO: 227157

SEQ ID NO: 581762 - RNA, 65 nt, hsa; identical to SEQ ID NO: 227158

SEQ ID NO: 581763 - RNA, 65 nt, hsa; identical to SEQ ID NO: 227159

SEQ ID NO: 581764 - RNA, 65 nt, hsa; identical to SEQ ID NO: 227160

SEQ ID NO: 581765 - RNA, 65 nt, hsa; identical to SEQ ID NO: 227161

SEQ ID NO: 581766 - RNA, 65 nt, hsa; identical to SEQ ID NO: 227162

SEQ ID NO: 581767 - RNA, 65 nt, hsa; identical to SEQ ID NO: 227163

SEQ ID NO: 581768 - RNA, 65 nt, hsa; identical to SEQ ID NO: 58822

SEQ ID NO: 581769 - RNA, 65 nt, hsa; identical to SEQ ID NO: 58823

SEQ ID NO: 581770 - RNA, 65 nt, hsa; identical to SEQ ID NO: 227166

SEQ ID NO: 581771 - RNA, 65 nt, hsa; identical to SEQ ID NO: 227167

SEQ ID NO: 581772 - RNA, 65 nt, hsa; identical to SEQ ID NO: 227168

SEQ ID NO: 581773 - RNA, 65 nt, hsa; identical to SEQ ID NO: 227169

SEQ ID NO: 581774 - RNA, 65 nt, hsa; identical to SEQ ID NO: 227170

SEQ ID NO: 581775 - RNA, 65 nt, hsa; identical to SEQ ID NO: 227171

SEQ ID NO: 581776 - RNA, 65 nt, hsa; identical to SEQ ID NO: 227172

SEQ ID NO: 581777 - RNA, 65 nt, hsa; identical to SEQ ID NO: 227173

SEQ ID NO: 581778 - RNA, 65 nt, hsa; identical to SEQ ID NO: 227174

SEQ ID NO: 581779 - RNA, 65 nt, hsa; identical to SEQ ID NO: 227175

SEQ ID NO: 581780 - RNA, 65 nt, hsa; identical to SEQ ID NO: 227176

SEQ ID NO: 581781 - RNA, 65 nt, hsa; identical to SEQ ID NO: 58824

SEQ ID NO: 581782 - RNA, 65 nt, hsa; identical to SEQ ID NO: 58825

SEQ ID NO: 581783 - RNA, 65 nt, hsa; identical to SEQ ID NO: 58826

SEQ ID NO: 581784 - RNA, 65 nt, hsa; identical to SEQ ID NO: 58827

SEQ ID NO: 581785 - RNA, 65 nt, hsa; identical to SEQ ID NO: 227181

SEQ ID NO: 581786 - RNA, 65 nt, hsa; identical to SEQ ID NO: 227182

SEQ ID NO: 581787 - RNA, 65 nt, hsa; identical to SEQ ID NO: 227183

SEQ ID NO: 581788 - RNA, 65 nt, hsa; identical to SEQ ID NO: 227184

SEQ ID NO: 581789 - RNA, 65 nt, hsa; identical to SEQ ID NO: 227185

SEQ ID NO: 581790 - RNA, 65 nt, hsa; identical to SEQ ID NO: 227186

SEQ ID NO: 581791 - RNA, 65 nt, hsa; identical to SEQ ID NO: 227187

SEQ ID NO: 581792 - RNA, 65 nt, hsa; identical to SEQ ID NO: 227188

SEQ ID NO: 581793 - RNA, 65 nt, hsa; identical to SEQ ID NO: 227189

SEQ ID NO: 581794 - RNA, 65 nt, hsa; identical to SEQ ID NO: 227190

SEQ ID NO: 581795 - RNA, 65 nt, hsa; identical to SEQ ID NO: 227191

SEQ ID NO: 581796 - RNA, 65 nt, hsa; identical to SEQ ID NO: 227192

SEQ ID NO: 581797 - RNA, 65 nt, hsa; identical to SEQ ID NO: 227193

SEQ ID NO: 581798 - RNA, 65 nt, hsa; identical to SEQ ID NO: 227194

SEQ ID NO: 581799 - RNA, 65 nt, hsa; identical to SEQ ID NO: 227195

SEQ ID NO: 581800 - RNA, 65 nt, hsa; identical to SEQ ID NO: 227196

SEQ ID NO: 581801 - RNA, 65 nt, hsa; identical to SEQ ID NO: 227197

SEQ ID NO: 581802 - RNA, 65 nt, hsa; identical to SEQ ID NO: 227198

SEQ ID NO: 581803 - RNA, 65 nt, hsa; identical to SEQ ID NO: 227199

SEQ ID NO: 581804 - RNA, 65 nt, hsa; identical to SEQ ID NO: 227200

SEQ ID NO: 581805 - RNA, 65 nt, hsa; identical to SEQ ID NO: 227201

SEQ ID NO: 581806 - RNA, 65 nt, hsa; identical to SEQ ID NO: 227202

SEQ ID NO: 581807 - RNA, 65 nt, hsa; identical to SEQ ID NO: 227203

SEQ ID NO: 581808 - RNA, 65 nt, hsa; identical to SEQ ID NO: 227204

SEQ ID NO: 581809 - RNA, 65 nt, hsa; identical to SEQ ID NO: 227205

SEQ ID NO: 581810 - RNA, 65 nt, hsa; identical to SEQ ID NO: 227206

SEQ ID NO: 581811 - RNA, 65 nt, hsa; identical to SEQ ID NO: 227207

SEQ ID NO: 581812 - RNA, 65 nt, hsa; identical to SEQ ID NO: 227208

SEQ ID NO: 581813 - RNA, 65 nt, hsa; identical to SEQ ID NO: 227209

SEQ ID NO: 581814 - RNA, 65 nt, hsa; identical to SEQ ID NO: 227210

SEQ ID NO: 581815 - RNA, 65 nt, hsa; identical to SEQ ID NO: 58828

SEQ ID NO: 581816 - RNA, 65 nt, hsa; identical to SEQ ID NO: 58829

SEQ ID NO: 581817 - RNA, 65 nt, hsa; identical to SEQ ID NO: 227213

SEQ ID NO: 581818 - RNA, 65 nt, hsa; identical to SEQ ID NO: 227214

SEQ ID NO: 581819 - RNA, 65 nt, hsa; identical to SEQ ID NO: 227215

SEQ ID NO: 581820 - RNA, 65 nt, hsa; identical to SEQ ID NO: 227216

SEQ ID NO: 581821 - RNA, 65 nt, hsa; identical to SEQ ID NO: 227217

SEQ ID NO: 581822 - RNA, 65 nt, hsa; identical to SEQ ID NO: 227218

SEQ ID NO: 581823 - RNA, 65 nt, hsa; identical to SEQ ID NO: 227219

SEQ ID NO: 581824 - RNA, 65 nt, hsa; identical to SEQ ID NO: 227220

SEQ ID NO: 581825 - RNA, 65 nt, hsa; identical to SEQ ID NO: 227221

SEQ ID NO: 581826 - RNA, 65 nt, hsa; identical to SEQ ID NO: 227222

SEQ ID NO: 581827 - RNA, 65 nt, hsa; identical to SEQ ID NO: 58830

SEQ ID NO: 581828 - RNA, 65 nt, hsa; identical to SEQ ID NO: 58831

SEQ ID NO: 581829 - RNA, 65 nt, hsa; identical to SEQ ID NO: 227225

SEQ ID NO: 581830 - RNA, 65 nt, hsa; identical to SEQ ID NO: 227226

SEQ ID NO: 581831 - RNA, 65 nt, hsa; identical to SEQ ID NO: 227227

SEQ ID NO: 581832 - RNA, 65 nt, hsa; identical to SEQ ID NO: 227228

SEQ ID NO: 581833 - RNA, 65 nt, hsa; identical to SEQ ID NO: 227229

SEQ ID NO: 581834 - RNA, 65 nt, hsa; identical to SEQ ID NO: 227230

SEQ ID NO: 581835 - RNA, 65 nt, hsa; identical to SEQ ID NO: 227231

SEQ ID NO: 581836 - RNA, 65 nt, hsa; identical to SEQ ID NO: 227232

SEQ ID NO: 581837 - RNA, 65 nt, hsa; identical to SEQ ID NO: 227233

SEQ ID NO: 581838 - RNA, 65 nt, hsa; identical to SEQ ID NO: 227234

SEQ ID NO: 581839 - RNA, 65 nt, hsa; identical to SEQ ID NO: 227235

SEQ ID NO: 581840 - RNA, 65 nt, hsa; identical to SEQ ID NO: 227236

SEQ ID NO: 581841 - RNA, 65 nt, hsa; identical to SEQ ID NO: 227237

SEQ ID NO: 581842 - RNA, 65 nt, hsa; identical to SEQ ID NO: 227238

SEQ ID NO: 581843 - RNA, 65 nt, hsa; identical to SEQ ID NO: 227239

SEQ ID NO: 581844 - RNA, 65 nt, hsa; identical to SEQ ID NO: 227240

SEQ ID NO: 581845 - RNA, 65 nt, hsa; identical to SEQ ID NO: 227241

SEQ ID NO: 581846 - RNA, 65 nt, hsa; identical to SEQ ID NO: 227242

SEQ ID NO: 581847 - RNA, 65 nt, hsa; identical to SEQ ID NO: 227243

SEQ ID NO: 581848 - RNA, 65 nt, hsa; identical to SEQ ID NO: 227244

SEQ ID NO: 581849 - RNA, 65 nt, hsa; identical to SEQ ID NO: 227245

SEQ ID NO: 581850 - RNA, 65 nt, hsa; identical to SEQ ID NO: 227246

SEQ ID NO: 581851 - RNA, 65 nt, hsa; identical to SEQ ID NO: 227247

SEQ ID NO: 581852 - RNA, 65 nt, hsa; identical to SEQ ID NO: 227248

SEQ ID NO: 581853 - RNA, 65 nt, hsa; identical to SEQ ID NO: 227249

SEQ ID NO: 581854 - RNA, 65 nt, hsa; identical to SEQ ID NO: 227250

SEQ ID NO: 581855 - RNA, 65 nt, hsa; identical to SEQ ID NO: 227251

SEQ ID NO: 581856 - RNA, 65 nt, hsa; identical to SEQ ID NO: 227252

SEQ ID NO: 581857 - RNA, 65 nt, hsa; identical to SEQ ID NO: 58832

SEQ ID NO: 581858 - RNA, 65 nt, hsa; identical to SEQ ID NO: 58833

SEQ ID NO: 581859 - RNA, 65 nt, hsa; identical to SEQ ID NO: 58834

SEQ ID NO: 581860 - RNA, 65 nt, hsa; identical to SEQ ID NO: 58835

SEQ ID NO: 581861 - RNA, 65 nt, hsa; identical to SEQ ID NO: 227257

SEQ ID NO: 581862 - RNA, 65 nt, hsa; identical to SEQ ID NO: 227258

SEQ ID NO: 581863 - RNA, 65 nt, hsa; identical to SEQ ID NO: 227259

SEQ ID NO: 581864 - RNA, 65 nt, hsa; identical to SEQ ID NO: 58836

SEQ ID NO: 581865 - RNA, 65 nt, hsa; identical to SEQ ID NO: 58837

SEQ ID NO: 581866 - RNA, 65 nt, hsa; identical to SEQ ID NO: 227262

SEQ ID NO: 581867 - RNA, 65 nt, hsa; identical to SEQ ID NO: 227263

SEQ ID NO: 581868 - RNA, 65 nt, hsa; identical to SEQ ID NO: 227264

SEQ ID NO: 581869 - RNA, 65 nt, hsa; identical to SEQ ID NO: 227265

SEQ ID NO: 581870 - RNA, 65 nt, hsa; identical to SEQ ID NO: 227266

SEQ ID NO: 581871 - RNA, 65 nt, hsa; identical to SEQ ID NO: 227267

SEQ ID NO: 581872 - RNA, 65 nt, hsa; identical to SEQ ID NO: 227268

SEQ ID NO: 581873 - RNA, 65 nt, hsa; identical to SEQ ID NO: 227269

SEQ ID NO: 581874 - RNA, 65 nt, hsa; identical to SEQ ID NO: 227270

SEQ ID NO: 581875 - RNA, 65 nt, hsa; identical to SEQ ID NO: 227271

SEQ ID NO: 581876 - RNA, 65 nt, hsa; identical to SEQ ID NO: 227272

SEQ ID NO: 581877 - RNA, 65 nt, hsa; identical to SEQ ID NO: 227273

SEQ ID NO: 581878 - RNA, 65 nt, hsa; identical to SEQ ID NO: 227274

SEQ ID NO: 581879 - RNA, 65 nt, hsa; identical to SEQ ID NO: 227275

SEQ ID NO: 581880 - RNA, 65 nt, hsa; identical to SEQ ID NO: 227276

SEQ ID NO: 581881 - RNA, 65 nt, hsa; identical to SEQ ID NO: 227277

SEQ ID NO: 581882 - RNA, 65 nt, hsa; identical to SEQ ID NO: 227278

SEQ ID NO: 581883 - RNA, 65 nt, hsa; identical to SEQ ID NO: 227279

SEQ ID NO: 581884 - RNA, 65 nt, hsa; identical to SEQ ID NO: 227280

SEQ ID NO: 581885 - RNA, 65 nt, hsa; identical to SEQ ID NO: 227281

SEQ ID NO: 581886 - RNA, 65 nt, hsa; identical to SEQ ID NO: 227282

SEQ ID NO: 581887 - RNA, 65 nt, hsa; identical to SEQ ID NO: 227283

SEQ ID NO: 581888 - RNA, 65 nt, hsa; identical to SEQ ID NO: 227284

SEQ ID NO: 581889 - RNA, 65 nt, hsa; identical to SEQ ID NO: 227285

SEQ ID NO: 581890 - RNA, 65 nt, hsa; identical to SEQ ID NO: 227286

SEQ ID NO: 581891 - RNA, 65 nt, hsa; identical to SEQ ID NO: 227287

SEQ ID NO: 581892 - RNA, 65 nt, hsa; identical to SEQ ID NO: 227288

SEQ ID NO: 581893 - RNA, 65 nt, hsa; identical to SEQ ID NO: 227289

SEQ ID NO: 581894 - RNA, 65 nt, hsa; identical to SEQ ID NO: 227290

SEQ ID NO: 581895 - RNA, 65 nt, hsa; identical to SEQ ID NO: 227291

SEQ ID NO: 581896 - RNA, 65 nt, hsa; identical to SEQ ID NO: 227292

SEQ ID NO: 581897 - RNA, 65 nt, hsa; identical to SEQ ID NO: 227293

SEQ ID NO: 581898 - RNA, 65 nt, hsa; identical to SEQ ID NO: 227294

SEQ ID NO: 581899 - RNA, 65 nt, hsa; identical to SEQ ID NO: 227295

SEQ ID NO: 581900 - RNA, 65 nt, hsa; identical to SEQ ID NO: 227296

SEQ ID NO: 581901 - RNA, 65 nt, hsa; identical to SEQ ID NO: 227297

SEQ ID NO: 581902 - RNA, 65 nt, hsa; identical to SEQ ID NO: 227298

SEQ ID NO: 581903 - RNA, 65 nt, hsa; identical to SEQ ID NO: 227299

SEQ ID NO: 581904 - RNA, 65 nt, hsa; identical to SEQ ID NO: 227300

SEQ ID NO: 581905 - RNA, 65 nt, hsa; identical to SEQ ID NO: 58838

SEQ ID NO: 581906 - RNA, 65 nt, hsa; identical to SEQ ID NO: 58839

SEQ ID NO: 581907 - RNA, 65 nt, hsa; identical to SEQ ID NO: 58840

SEQ ID NO: 581908 - RNA, 65 nt, hsa; identical to SEQ ID NO: 58841

SEQ ID NO: 581909 - RNA, 65 nt, hsa; identical to SEQ ID NO: 227305

SEQ ID NO: 581910 - RNA, 65 nt, hsa; identical to SEQ ID NO: 58842

SEQ ID NO: 581911 - RNA, 65 nt, hsa; identical to SEQ ID NO: 58843

SEQ ID NO: 581912 - RNA, 65 nt, hsa; identical to SEQ ID NO: 227308

SEQ ID NO: 581913 - RNA, 65 nt, hsa; identical to SEQ ID NO: 227309

SEQ ID NO: 581914 - RNA, 65 nt, hsa; identical to SEQ ID NO: 227310

SEQ ID NO: 581915 - RNA, 65 nt, hsa; identical to SEQ ID NO: 58844

SEQ ID NO: 581916 - RNA, 65 nt, hsa; identical to SEQ ID NO: 58845

SEQ ID NO: 581917 - RNA, 65 nt, hsa; identical to SEQ ID NO: 227313

SEQ ID NO: 581918 - RNA, 65 nt, hsa; identical to SEQ ID NO: 227314

SEQ ID NO: 581919 - RNA, 65 nt, hsa; identical to SEQ ID NO: 227315

SEQ ID NO: 581920 - RNA, 65 nt, hsa; identical to SEQ ID NO: 227316

SEQ ID NO: 581921 - RNA, 65 nt, hsa; identical to SEQ ID NO: 227317

SEQ ID NO: 581922 - RNA, 65 nt, hsa; identical to SEQ ID NO: 227318

SEQ ID NO: 581923 - RNA, 65 nt, hsa; identical to SEQ ID NO: 227319

SEQ ID NO: 581924 - RNA, 65 nt, hsa; identical to SEQ ID NO: 227320

SEQ ID NO: 581925 - RNA, 65 nt, hsa; identical to SEQ ID NO: 227321

SEQ ID NO: 581926 - RNA, 65 nt, hsa; identical to SEQ ID NO: 58846

SEQ ID NO: 581927 - RNA, 65 nt, hsa; identical to SEQ ID NO: 58847

SEQ ID NO: 581928 - RNA, 65 nt, hsa; identical to SEQ ID NO: 227324

SEQ ID NO: 581929 - RNA, 65 nt, hsa; identical to SEQ ID NO: 227325

SEQ ID NO: 581930 - RNA, 65 nt, hsa; identical to SEQ ID NO: 227326

SEQ ID NO: 581931 - RNA, 65 nt, hsa; identical to SEQ ID NO: 227327

SEQ ID NO: 581932 - RNA, 65 nt, hsa; identical to SEQ ID NO: 227328

SEQ ID NO: 581933 - RNA, 65 nt, hsa; identical to SEQ ID NO: 227329

SEQ ID NO: 581934 - RNA, 56 nt, hsa; identical to SEQ ID NO: 227330

SEQ ID NO: 581935 - RNA, 65 nt, hsa; identical to SEQ ID NO: 227331

SEQ ID NO: 581936 - RNA, 65 nt, hsa; identical to SEQ ID NO: 227332

SEQ ID NO: 581937 - RNA, 65 nt, hsa; identical to SEQ ID NO: 227333

SEQ ID NO: 581938 - RNA, 65 nt, hsa; identical to SEQ ID NO: 227334

SEQ ID NO: 581939 - RNA, 65 nt, hsa; identical to SEQ ID NO: 227335

SEQ ID NO: 581940 - RNA, 65 nt, hsa; identical to SEQ ID NO: 227336

SEQ ID NO: 581941 - RNA, 65 nt, hsa; identical to SEQ ID NO: 227337

SEQ ID NO: 581942 - RNA, 65 nt, hsa; identical to SEQ ID NO: 227338

SEQ ID NO: 581943 - RNA, 65 nt, hsa; identical to SEQ ID NO: 227339

SEQ ID NO: 581944 - RNA, 65 nt, hsa; identical to SEQ ID NO: 227340

SEQ ID NO: 581945 - RNA, 65 nt, hsa; identical to SEQ ID NO: 227341

SEQ ID NO: 581946 - RNA, 65 nt, hsa; identical to SEQ ID NO: 227342

SEQ ID NO: 581947 - RNA, 65 nt, hsa; identical to SEQ ID NO: 227343

SEQ ID NO: 581948 - RNA, 65 nt, hsa; identical to SEQ ID NO: 227344

SEQ ID NO: 581949 - RNA, 65 nt, hsa; identical to SEQ ID NO: 227345

SEQ ID NO: 581950 - RNA, 65 nt, hsa; identical to SEQ ID NO: 227346

SEQ ID NO: 581951 - RNA, 65 nt, hsa; identical to SEQ ID NO: 227347

SEQ ID NO: 581952 - RNA, 65 nt, hsa; identical to SEQ ID NO: 227348

SEQ ID NO: 581953 - RNA, 65 nt, hsa; identical to SEQ ID NO: 227349

SEQ ID NO: 581954 - RNA, 65 nt, hsa; identical to SEQ ID NO: 227350

SEQ ID NO: 581955 - RNA, 65 nt, hsa; identical to SEQ ID NO: 58848

SEQ ID NO: 581956 - RNA, 65 nt, hsa; identical to SEQ ID NO: 58849

SEQ ID NO: 581957 - RNA, 65 nt, hsa; identical to SEQ ID NO: 227353

SEQ ID NO: 581958 - RNA, 65 nt, hsa; identical to SEQ ID NO: 227354

SEQ ID NO: 581959 - RNA, 65 nt, hsa; identical to SEQ ID NO: 227355

SEQ ID NO: 581960 - RNA, 65 nt, hsa; identical to SEQ ID NO: 227356

SEQ ID NO: 581961 - RNA, 65 nt, hsa; identical to SEQ ID NO: 227357

SEQ ID NO: 581962 - RNA, 65 nt, hsa; identical to SEQ ID NO: 227358

SEQ ID NO: 581963 - RNA, 65 nt, hsa; identical to SEQ ID NO: 227359

SEQ ID NO: 581964 - RNA, 65 nt, hsa; identical to SEQ ID NO: 227360

SEQ ID NO: 581965 - RNA, 65 nt, hsa; identical to SEQ ID NO: 227361

SEQ ID NO: 581966 - RNA, 65 nt, hsa; identical to SEQ ID NO: 227362

SEQ ID NO: 581967 - RNA, 65 nt, hsa; identical to SEQ ID NO: 227363

SEQ ID NO: 581968 - RNA, 65 nt, hsa; identical to SEQ ID NO: 227364

SEQ ID NO: 581969 - RNA, 65 nt, hsa; identical to SEQ ID NO: 227365

SEQ ID NO: 581970 - RNA, 65 nt, hsa; identical to SEQ ID NO: 227366

SEQ ID NO: 581971 - RNA, 65 nt, hsa; identical to SEQ ID NO: 227367

SEQ ID NO: 581972 - RNA, 65 nt, hsa; identical to SEQ ID NO: 227368

SEQ ID NO: 581973 - RNA, 65 nt, hsa; identical to SEQ ID NO: 227369

SEQ ID NO: 581974 - RNA, 65 nt, hsa; identical to SEQ ID NO: 227370

SEQ ID NO: 581975 - RNA, 65 nt, hsa; identical to SEQ ID NO: 227371

SEQ ID NO: 581976 - RNA, 65 nt, hsa; identical to SEQ ID NO: 227372

SEQ ID NO: 581977 - RNA, 65 nt, hsa; identical to SEQ ID NO: 227373

SEQ ID NO: 581978 - RNA, 65 nt, hsa; identical to SEQ ID NO: 227374

SEQ ID NO: 581979 - RNA, 65 nt, hsa; identical to SEQ ID NO: 227375

SEQ ID NO: 581980 - RNA, 57 nt, hsa; identical to SEQ ID NO: 227376

SEQ ID NO: 581981 - RNA, 65 nt, hsa; identical to SEQ ID NO: 227377

SEQ ID NO: 581982 - RNA, 65 nt, hsa; identical to SEQ ID NO: 227378

SEQ ID NO: 581983 - RNA, 65 nt, hsa; identical to SEQ ID NO: 58850

SEQ ID NO: 581984 - RNA, 65 nt, hsa; identical to SEQ ID NO: 58851

SEQ ID NO: 581985 - RNA, 65 nt, hsa; identical to SEQ ID NO: 227381

SEQ ID NO: 581986 - RNA, 65 nt, hsa; identical to SEQ ID NO: 227382

SEQ ID NO: 581987 - RNA, 65 nt, hsa; identical to SEQ ID NO: 227383

SEQ ID NO: 581988 - RNA, 65 nt, hsa; identical to SEQ ID NO: 227384

SEQ ID NO: 581989 - RNA, 65 nt, hsa; identical to SEQ ID NO: 227385

SEQ ID NO: 581990 - RNA, 65 nt, hsa; identical to SEQ ID NO: 227386

SEQ ID NO: 581991 - RNA, 65 nt, hsa; identical to SEQ ID NO: 227387

SEQ ID NO: 581992 - RNA, 65 nt, hsa; identical to SEQ ID NO: 227388

SEQ ID NO: 581993 - RNA, 65 nt, hsa; identical to SEQ ID NO: 227389

SEQ ID NO: 581994 - RNA, 65 nt, hsa; identical to SEQ ID NO: 227390

SEQ ID NO: 581995 - RNA, 65 nt, hsa; identical to SEQ ID NO: 227391

SEQ ID NO: 581996 - RNA, 65 nt, hsa; identical to SEQ ID NO: 227392

SEQ ID NO: 581997 - RNA, 65 nt, hsa; identical to SEQ ID NO: 227393

SEQ ID NO: 581998 - RNA, 65 nt, hsa; identical to SEQ ID NO: 227394

SEQ ID NO: 581999 - RNA, 65 nt, hsa; identical to SEQ ID NO: 227395

SEQ ID NO: 582000 - RNA, 65 nt, hsa; identical to SEQ ID NO: 227396

SEQ ID NO: 582001 - RNA, 65 nt, hsa; identical to SEQ ID NO: 227397

SEQ ID NO: 582002 - RNA, 65 nt, hsa; identical to SEQ ID NO: 227398

SEQ ID NO: 582003 - RNA, 65 nt, hsa; identical to SEQ ID NO: 227399

SEQ ID NO: 582004 - RNA, 65 nt, hsa; identical to SEQ ID NO: 227400

SEQ ID NO: 582005 - RNA, 65 nt, hsa; identical to SEQ ID NO: 227401

SEQ ID NO: 582006 - RNA, 65 nt, hsa; identical to SEQ ID NO: 227402

SEQ ID NO: 582007 - RNA, 65 nt, hsa; identical to SEQ ID NO: 227403

SEQ ID NO: 582008 - RNA, 65 nt, hsa; identical to SEQ ID NO: 227404

SEQ ID NO: 582009 - RNA, 65 nt, hsa; identical to SEQ ID NO: 227405

SEQ ID NO: 582010 - RNA, 65 nt, hsa; identical to SEQ ID NO: 227406

SEQ ID NO: 582011 - RNA, 65 nt, hsa; identical to SEQ ID NO: 227407

SEQ ID NO: 582012 - RNA, 65 nt, hsa; identical to SEQ ID NO: 227408

SEQ ID NO: 582013 - RNA, 65 nt, hsa; identical to SEQ ID NO: 227409

SEQ ID NO: 582014 - RNA, 65 nt, hsa; identical to SEQ ID NO: 227410

SEQ ID NO: 582015 - RNA, 65 nt, hsa; identical to SEQ ID NO: 227411

SEQ ID NO: 582016 - RNA, 65 nt, hsa; identical to SEQ ID NO: 227412

SEQ ID NO: 582017 - RNA, 65 nt, hsa; identical to SEQ ID NO: 227413

SEQ ID NO: 582018 - RNA, 65 nt, hsa; identical to SEQ ID NO: 227414

SEQ ID NO: 582019 - RNA, 65 nt, hsa; identical to SEQ ID NO: 227415

SEQ ID NO: 582020 - RNA, 65 nt, hsa; identical to SEQ ID NO: 227416

SEQ ID NO: 582021 - RNA, 65 nt, hsa; identical to SEQ ID NO: 227417

SEQ ID NO: 582022 - RNA, 65 nt, hsa; identical to SEQ ID NO: 227418

SEQ ID NO: 582023 - RNA, 65 nt, hsa; identical to SEQ ID NO: 227419

SEQ ID NO: 582024 - RNA, 65 nt, hsa; identical to SEQ ID NO: 227420

SEQ ID NO: 582025 - RNA, 65 nt, hsa; identical to SEQ ID NO: 227421

SEQ ID NO: 582026 - RNA, 65 nt, hsa; identical to SEQ ID NO: 227422

SEQ ID NO: 582027 - RNA, 65 nt, hsa; identical to SEQ ID NO: 58852

SEQ ID NO: 582028 - RNA, 65 nt, hsa; identical to SEQ ID NO: 58853

SEQ ID NO: 582029 - RNA, 65 nt, hsa; identical to SEQ ID NO: 58854

SEQ ID NO: 582030 - RNA, 65 nt, hsa; identical to SEQ ID NO: 58855

SEQ ID NO: 582031 - RNA, 65 nt, hsa; identical to SEQ ID NO: 227427

SEQ ID NO: 582032 - RNA, 65 nt, hsa; identical to SEQ ID NO: 227428

SEQ ID NO: 582033 - RNA, 65 nt, hsa; identical to SEQ ID NO: 227429

SEQ ID NO: 582034 - RNA, 57 nt, hsa; identical to SEQ ID NO: 227430

SEQ ID NO: 582035 - RNA, 65 nt, hsa; identical to SEQ ID NO: 227431

SEQ ID NO: 582036 - RNA, 65 nt, hsa; identical to SEQ ID NO: 227432

SEQ ID NO: 582037 - RNA, 65 nt, hsa; identical to SEQ ID NO: 227433

SEQ ID NO: 582038 - RNA, 65 nt, hsa; identical to SEQ ID NO: 227434

SEQ ID NO: 582039 - RNA, 65 nt, hsa; identical to SEQ ID NO: 227435

SEQ ID NO: 582040 - RNA, 65 nt, hsa; identical to SEQ ID NO: 227436

SEQ ID NO: 582041 - RNA, 65 nt, hsa; identical to SEQ ID NO: 227437

SEQ ID NO: 582042 - RNA, 65 nt, hsa; identical to SEQ ID NO: 58856

SEQ ID NO: 582043 - RNA, 65 nt, hsa; identical to SEQ ID NO: 58857

SEQ ID NO: 582044 - RNA, 65 nt, hsa; identical to SEQ ID NO: 58858

SEQ ID NO: 582045 - RNA, 65 nt, hsa; identical to SEQ ID NO: 58859

SEQ ID NO: 582046 - RNA, 65 nt, hsa; identical to SEQ ID NO: 227442

SEQ ID NO: 582047 - RNA, 65 nt, hsa; identical to SEQ ID NO: 227443

SEQ ID NO: 582048 - RNA, 65 nt, hsa; identical to SEQ ID NO: 227444

SEQ ID NO: 582049 - RNA, 65 nt, hsa; identical to SEQ ID NO: 227445

SEQ ID NO: 582050 - RNA, 65 nt, hsa; identical to SEQ ID NO: 227446

SEQ ID NO: 582051 - RNA, 65 nt, hsa; identical to SEQ ID NO: 227447

SEQ ID NO: 582052 - RNA, 65 nt, hsa; identical to SEQ ID NO: 227448

SEQ ID NO: 582053 - RNA, 65 nt, hsa; identical to SEQ ID NO: 58860

SEQ ID NO: 582054 - RNA, 65 nt, hsa; identical to SEQ ID NO: 58861

SEQ ID NO: 582055 - RNA, 65 nt, hsa; identical to SEQ ID NO: 227451

SEQ ID NO: 582056 - RNA, 65 nt, hsa; identical to SEQ ID NO: 227452

SEQ ID NO: 582057 - RNA, 65 nt, hsa; identical to SEQ ID NO: 227453

SEQ ID NO: 582058 - RNA, 65 nt, hsa; identical to SEQ ID NO: 227454

SEQ ID NO: 582059 - RNA, 65 nt, hsa; identical to SEQ ID NO: 227455

SEQ ID NO: 582060 - RNA, 65 nt, hsa; identical to SEQ ID NO: 227456

SEQ ID NO: 582061 - RNA, 65 nt, hsa; identical to SEQ ID NO: 227457

SEQ ID NO: 582062 - RNA, 65 nt, hsa; identical to SEQ ID NO: 227458

SEQ ID NO: 582063 - RNA, 65 nt, hsa; identical to SEQ ID NO: 227459

SEQ ID NO: 582064 - RNA, 65 nt, hsa; identical to SEQ ID NO: 227460

SEQ ID NO: 582065 - RNA, 65 nt, hsa; identical to SEQ ID NO: 227461

SEQ ID NO: 582066 - RNA, 65 nt, hsa; identical to SEQ ID NO: 227462

SEQ ID NO: 582067 - RNA, 65 nt, hsa; identical to SEQ ID NO: 227463

SEQ ID NO: 582068 - RNA, 65 nt, hsa; identical to SEQ ID NO: 227464

SEQ ID NO: 582069 - RNA, 65 nt, hsa; identical to SEQ ID NO: 227465

SEQ ID NO: 582070 - RNA, 65 nt, hsa; identical to SEQ ID NO: 58862

SEQ ID NO: 582071 - RNA, 65 nt, hsa; identical to SEQ ID NO: 58863

SEQ ID NO: 582072 - RNA, 65 nt, hsa; identical to SEQ ID NO: 227468

SEQ ID NO: 582073 - RNA, 65 nt, hsa; identical to SEQ ID NO: 227469

SEQ ID NO: 582074 - RNA, 65 nt, hsa; identical to SEQ ID NO: 227470

SEQ ID NO: 582075 - RNA, 65 nt, hsa; identical to SEQ ID NO: 227471

SEQ ID NO: 582076 - RNA, 65 nt, hsa; identical to SEQ ID NO: 227472

SEQ ID NO: 582077 - RNA, 65 nt, hsa; identical to SEQ ID NO: 227473

SEQ ID NO: 582078 - RNA, 65 nt, hsa; identical to SEQ ID NO: 227474

SEQ ID NO: 582079 - RNA, 65 nt, hsa; identical to SEQ ID NO: 227475

SEQ ID NO: 582080 - RNA, 65 nt, hsa; identical to SEQ ID NO: 227476

SEQ ID NO: 582081 - RNA, 65 nt, hsa; identical to SEQ ID NO: 227477

SEQ ID NO: 582082 - RNA, 65 nt, hsa; identical to SEQ ID NO: 227478

SEQ ID NO: 582083 - RNA, 65 nt, hsa; identical to SEQ ID NO: 227479

SEQ ID NO: 582084 - RNA, 65 nt, hsa; identical to SEQ ID NO: 58864

SEQ ID NO: 582085 - RNA, 65 nt, hsa; identical to SEQ ID NO: 58865

SEQ ID NO: 582086 - RNA, 65 nt, hsa; identical to SEQ ID NO: 227482

SEQ ID NO: 582087 - RNA, 65 nt, hsa; identical to SEQ ID NO: 227483

SEQ ID NO: 582088 - RNA, 65 nt, hsa; identical to SEQ ID NO: 227484

SEQ ID NO: 582089 - RNA, 65 nt, hsa; identical to SEQ ID NO: 227485

SEQ ID NO: 582090 - RNA, 65 nt, hsa; identical to SEQ ID NO: 227486

SEQ ID NO: 582091 - RNA, 65 nt, hsa; identical to SEQ ID NO: 227487

SEQ ID NO: 582092 - RNA, 65 nt, hsa; identical to SEQ ID NO: 227488

SEQ ID NO: 582093 - RNA, 65 nt, hsa; identical to SEQ ID NO: 227489

SEQ ID NO: 582094 - RNA, 65 nt, hsa; identical to SEQ ID NO: 227490

SEQ ID NO: 582095 - RNA, 65 nt, hsa; identical to SEQ ID NO: 58866

SEQ ID NO: 582096 - RNA, 65 nt, hsa; identical to SEQ ID NO: 58867

SEQ ID NO: 582097 - RNA, 65 nt, hsa; identical to SEQ ID NO: 227493

SEQ ID NO: 582098 - RNA, 65 nt, hsa; identical to SEQ ID NO: 227494

SEQ ID NO: 582099 - RNA, 65 nt, hsa; identical to SEQ ID NO: 227495

SEQ ID NO: 582100 - RNA, 58 nt, hsa; identical to SEQ ID NO: 227496

SEQ ID NO: 582101 - RNA, 65 nt, hsa; identical to SEQ ID NO: 227490

SEQ ID NO: 582102 - RNA, 65 nt, hsa; identical to SEQ ID NO: 227498

SEQ ID NO: 582103 - RNA, 65 nt, hsa; identical to SEQ ID NO: 227499

SEQ ID NO: 582104 - RNA, 65 nt, hsa; identical to SEQ ID NO: 227500

SEQ ID NO: 582105 - RNA, 65 nt, hsa; identical to SEQ ID NO: 227501

SEQ ID NO: 582106 - RNA, 65 nt, hsa; identical to SEQ ID NO: 227502

SEQ ID NO: 582107 - RNA, 65 nt, hsa; identical to SEQ ID NO: 227503

SEQ ID NO: 582108 - RNA, 65 nt, hsa; identical to SEQ ID NO: 227504

SEQ ID NO: 582109 - RNA, 65 nt, hsa; identical to SEQ ID NO: 227505

SEQ ID NO: 582110 - RNA, 65 nt, hsa; identical to SEQ ID NO: 58868

SEQ ID NO: 582111 - RNA, 65 nt, hsa; identical to SEQ ID NO: 58869

SEQ ID NO: 582112 - RNA, 65 nt, hsa; identical to SEQ ID NO: 227508

SEQ ID NO: 582113 - RNA, 65 nt, hsa; identical to SEQ ID NO: 227509

SEQ ID NO: 582114 - RNA, 65 nt, hsa; identical to SEQ ID NO: 227510

SEQ ID NO: 582115 - RNA, 65 nt, hsa; identical to SEQ ID NO: 227511

SEQ ID NO: 582116 - RNA, 65 nt, hsa; identical to SEQ ID NO: 227512

SEQ ID NO: 582117 - RNA, 65 nt, hsa; identical to SEQ ID NO: 227513

SEQ ID NO: 582118 - RNA, 65 nt, hsa; identical to SEQ ID NO: 227514

SEQ ID NO: 582119 - RNA, 65 nt, hsa; identical to SEQ ID NO: 227515

SEQ ID NO: 582120 - RNA, 65 nt, hsa; identical to SEQ ID NO: 227516

SEQ ID NO: 582121 - RNA, 65 nt, hsa; identical to SEQ ID NO: 227517

SEQ ID NO: 582122 - RNA, 65 nt, hsa; identical to SEQ ID NO: 58870

SEQ ID NO: 582123 - RNA, 65 nt, hsa; identical to SEQ ID NO: 58871

SEQ ID NO: 582124 - RNA, 65 nt, hsa; identical to SEQ ID NO: 227520

SEQ ID NO: 582125 - RNA, 65 nt, hsa; identical to SEQ ID NO: 227521

SEQ ID NO: 582126 - RNA, 65 nt, hsa; identical to SEQ ID NO: 227522

SEQ ID NO: 582127 - RNA, 65 nt, hsa; identical to SEQ ID NO: 58872

SEQ ID NO: 582128 - RNA, 65 nt, hsa; identical to SEQ ID NO: 58873

SEQ ID NO: 582129 - RNA, 65 nt, hsa; identical to SEQ ID NO: 227525

SEQ ID NO: 582130 - RNA, 65 nt, hsa; identical to SEQ ID NO: 227526

SEQ ID NO: 582131 - RNA, 65 nt, hsa; identical to SEQ ID NO: 227527

SEQ ID NO: 582132 - RNA, 65 nt, hsa; identical to SEQ ID NO: 227528

SEQ ID NO: 582133 - RNA, 65 nt, hsa; identical to SEQ ID NO: 227529

SEQ ID NO: 582134 - RNA, 65 nt, hsa; identical to SEQ ID NO: 227530

SEQ ID NO: 582135 - RNA, 65 nt, hsa; identical to SEQ ID NO: 227531

SEQ ID NO: 582136 - RNA, 65 nt, hsa; identical to SEQ ID NO: 227532

SEQ ID NO: 582137 - RNA, 65 nt, hsa; identical to SEQ ID NO: 227533

SEQ ID NO: 582138 - RNA, 65 nt, hsa; identical to SEQ ID NO: 227534

SEQ ID NO: 582139 - RNA, 65 nt, hsa; identical to SEQ ID NO: 227535

SEQ ID NO: 582140 - RNA, 65 nt, hsa; identical to SEQ ID NO: 227536

SEQ ID NO: 582141 - RNA, 65 nt, hsa; identical to SEQ ID NO: 227537

SEQ ID NO: 582142 - RNA, 65 nt, hsa; identical to SEQ ID NO: 227538

SEQ ID NO: 582143 - RNA, 65 nt, hsa; identical to SEQ ID NO: 227539

SEQ ID NO: 582144 - RNA, 65 nt, hsa; identical to SEQ ID NO: 227540

SEQ ID NO: 582145 - RNA, 65 nt, hsa; identical to SEQ ID NO: 227541

SEQ ID NO: 582146 - RNA, 65 nt, hsa; identical to SEQ ID NO: 227542

SEQ ID NO: 582147 - RNA, 65 nt, hsa; identical to SEQ ID NO: 227543

SEQ ID NO: 582148 - RNA, 65 nt, hsa; identical to SEQ ID NO: 227544

SEQ ID NO: 582149 - RNA, 65 nt, hsa; identical to SEQ ID NO: 227545

SEQ ID NO: 582150 - RNA, 65 nt, hsa; identical to SEQ ID NO: 227546

SEQ ID NO: 582151 - RNA, 65 nt, hsa; identical to SEQ ID NO: 227547

SEQ ID NO: 582152 - RNA, 65 nt, hsa; identical to SEQ ID NO: 227548

SEQ ID NO: 582153 - RNA, 65 nt, hsa; identical to SEQ ID NO: 227549

SEQ ID NO: 582154 - RNA, 65 nt, hsa; identical to SEQ ID NO: 58874

SEQ ID NO: 582155 - RNA, 65 nt, hsa; identical to SEQ ID NO: 58875

SEQ ID NO: 582156 - RNA, 65 nt, hsa; identical to SEQ ID NO: 227552

SEQ ID NO: 582157 - RNA, 65 nt, hsa; identical to SEQ ID NO: 227553

SEQ ID NO: 582158 - RNA, 65 nt, hsa; identical to SEQ ID NO: 227554

SEQ ID NO: 582159 - RNA, 65 nt, hsa; identical to SEQ ID NO: 58876

SEQ ID NO: 582160 - RNA, 65 nt, hsa; identical to SEQ ID NO: 58877

SEQ ID NO: 582161 - RNA, 65 nt, hsa; identical to SEQ ID NO: 58878

SEQ ID NO: 582162 - RNA, 65 nt, hsa; identical to SEQ ID NO: 58879

SEQ ID NO: 582163 - RNA, 65 nt, hsa; identical to SEQ ID NO: 58880

SEQ ID NO: 582164 - RNA, 65 nt, hsa; identical to SEQ ID NO: 58881

SEQ ID NO: 582165 - RNA, 65 nt, hsa; identical to SEQ ID NO: 58882

SEQ ID NO: 582166 - RNA, 65 nt, hsa; identical to SEQ ID NO: 58883

SEQ ID NO: 582167 - RNA, 65 nt, hsa; identical to SEQ ID NO: 58884

SEQ ID NO: 582168 - RNA, 65 nt, hsa; identical to SEQ ID NO: 58885

SEQ ID NO: 582169 - RNA, 65 nt, hsa; identical to SEQ ID NO: 58886

SEQ ID NO: 582170 - RNA, 65 nt, hsa; identical to SEQ ID NO: 227566

SEQ ID NO: 582171 - RNA, 65 nt, hsa; identical to SEQ ID NO: 227567

SEQ ID NO: 582172 - RNA, 65 nt, hsa; identical to SEQ ID NO: 58887

SEQ ID NO: 582173 - RNA, 65 nt, hsa; identical to SEQ ID NO: 58888

SEQ ID NO: 582174 - RNA, 65 nt, hsa; identical to SEQ ID NO: 227570

SEQ ID NO: 582175 - RNA, 59 nt, hsa; identical to SEQ ID NO: 58889

SEQ ID NO: 582176 - RNA, 65 nt, hsa; identical to SEQ ID NO: 58890

SEQ ID NO: 582177 - RNA, 65 nt, hsa; identical to SEQ ID NO: 58891

SEQ ID NO: 582178 - RNA, 65 nt, hsa; identical to SEQ ID NO: 227574

SEQ ID NO: 582179 - RNA, 65 nt, hsa; identical to SEQ ID NO: 227575

SEQ ID NO: 582180 - RNA, 65 nt, hsa; identical to SEQ ID NO: 227576

SEQ ID NO: 582181 - RNA, 65 nt, hsa; identical to SEQ ID NO: 227577

SEQ ID NO: 582182 - RNA, 65 nt, hsa; identical to SEQ ID NO: 227578

SEQ ID NO: 582183 - RNA, 65 nt, hsa; identical to SEQ ID NO: 227579

SEQ ID NO: 582184 - RNA, 65 nt, hsa; identical to SEQ ID NO: 227580

SEQ ID NO: 582185 - RNA, 65 nt, hsa; identical to SEQ ID NO: 58892

SEQ ID NO: 582186 - RNA, 65 nt, hsa; identical to SEQ ID NO: 58893

SEQ ID NO: 582187 - RNA, 60 nt, hsa; identical to SEQ ID NO: 227583

SEQ ID NO: 582188 - RNA, 65 nt, hsa; identical to SEQ ID NO: 227584

SEQ ID NO: 582189 - RNA, 65 nt, hsa; identical to SEQ ID NO: 227585

SEQ ID NO: 582190 - RNA, 65 nt, hsa; identical to SEQ ID NO: 58894

SEQ ID NO: 582191 - RNA, 65 nt, hsa; identical to SEQ ID NO: 58895

SEQ ID NO: 582192 - RNA, 65 nt, hsa; identical to SEQ ID NO: 58896

SEQ ID NO: 582193 - RNA, 65 nt, hsa; identical to SEQ ID NO: 58897

SEQ ID NO: 582194 - RNA, 65 nt, hsa; identical to SEQ ID NO: 58898

SEQ ID NO: 582195 - RNA, 65 nt, hsa; identical to SEQ ID NO: 58899

SEQ ID NO: 582196 - RNA, 65 nt, hsa; identical to SEQ ID NO: 58900

SEQ ID NO: 582197 - RNA, 65 nt, hsa; identical to SEQ ID NO: 58901

SEQ ID NO: 582198 - RNA, 65 nt, hsa; identical to SEQ ID NO: 58902

SEQ ID NO: 582199 - RNA, 65 nt, hsa; identical to SEQ ID NO: 58903

SEQ ID NO: 582200 - RNA, 65 nt, hsa; identical to SEQ ID NO: 58904

SEQ ID NO: 582201 - RNA, 65 nt, hsa; identical to SEQ ID NO: 58905

SEQ ID NO: 582202 - RNA, 65 nt, hsa; identical to SEQ ID NO: 58906

SEQ ID NO: 582203 - RNA, 65 nt, hsa; identical to SEQ ID NO: 58907

SEQ ID NO: 582204 - RNA, 65 nt, hsa; identical to SEQ ID NO: 58908

SEQ ID NO: 582205 - RNA, 65 nt, hsa; identical to SEQ ID NO: 227601

SEQ ID NO: 582206 - RNA, 65 nt, hsa; identical to SEQ ID NO: 227602

SEQ ID NO: 582207 - RNA, 65 nt, hsa; identical to SEQ ID NO: 227603

SEQ ID NO: 582208 - RNA, 65 nt, hsa; identical to SEQ ID NO: 58909

SEQ ID NO: 582209 - RNA, 65 nt, hsa; identical to SEQ ID NO: 58910

SEQ ID NO: 582210 - RNA, 65 nt, hsa; identical to SEQ ID NO: 227606

SEQ ID NO: 582211 - RNA, 65 nt, hsa; identical to SEQ ID NO: 227607

SEQ ID NO: 582212 - RNA, 65 nt, hsa; identical to SEQ ID NO: 58911

SEQ ID NO: 582213 - RNA, 65 nt, hsa; identical to SEQ ID NO: 58912

SEQ ID NO: 582214 - RNA, 65 nt, hsa; identical to SEQ ID NO: 58913

SEQ ID NO: 582215 - RNA, 65 nt, hsa; identical to SEQ ID NO: 58914

SEQ ID NO: 582216 - RNA, 65 nt, hsa; identical to SEQ ID NO: 58915

SEQ ID NO: 582217 - RNA, 65 nt, hsa; identical to SEQ ID NO: 227613

SEQ ID NO: 582218 - RNA, 65 nt, hsa; identical to SEQ ID NO: 227614

SEQ ID NO: 582219 - RNA, 65 nt, hsa; identical to SEQ ID NO: 227615

SEQ ID NO: 582220 - RNA, 65 nt, hsa; identical to SEQ ID NO: 227616

SEQ ID NO: 582221 - RNA, 65 nt, hsa; identical to SEQ ID NO: 227617

SEQ ID NO: 582222 - RNA, 65 nt, hsa; identical to SEQ ID NO: 227618

SEQ ID NO: 582223 - RNA, 65 nt, hsa; identical to SEQ ID NO: 227619

SEQ ID NO: 582224 - RNA, 65 nt, hsa; identical to SEQ ID NO: 227620

SEQ ID NO: 582225 - RNA, 65 nt, hsa; identical to SEQ ID NO: 227621

SEQ ID NO: 582226 - RNA, 65 nt, hsa; identical to SEQ ID NO: 58916

SEQ ID NO: 582227 - RNA, 65 nt, hsa; identical to SEQ ID NO: 58917

SEQ ID NO: 582228 - RNA, 65 nt, hsa; identical to SEQ ID NO: 227624

SEQ ID NO: 582229 - RNA, 65 nt, hsa; identical to SEQ ID NO: 227625

SEQ ID NO: 582230 - RNA, 65 nt, hsa; identical to SEQ ID NO: 227626

SEQ ID NO: 582231 - RNA, 65 nt, hsa; identical to SEQ ID NO: 227627

SEQ ID NO: 582232 - RNA, 65 nt, hsa; identical to SEQ ID NO: 227628

SEQ ID NO: 582233 - RNA, 65 nt, hsa; identical to SEQ ID NO: 227629

SEQ ID NO: 582234 - RNA, 65 nt, hsa; identical to SEQ ID NO: 227630

SEQ ID NO: 582235 - RNA, 65 nt, hsa; identical to SEQ ID NO: 227631

SEQ ID NO: 582236 - RNA, 65 nt, hsa; identical to SEQ ID NO: 58918

SEQ ID NO: 582237 - RNA, 65 nt, hsa; identical to SEQ ID NO: 58919

SEQ ID NO: 582238 - RNA, 65 nt, hsa; identical to SEQ ID NO: 227634

SEQ ID NO: 582239 - RNA, 65 nt, hsa; identical to SEQ ID NO: 227635

SEQ ID NO: 582240 - RNA, 65 nt, hsa; identical to SEQ ID NO: 227636

SEQ ID NO: 582241 - RNA, 65 nt, hsa; identical to SEQ ID NO: 227637

SEQ ID NO: 582242 - RNA, 65 nt, hsa; identical to SEQ ID NO: 227638

SEQ ID NO: 582243 - RNA, 65 nt, hsa; identical to SEQ ID NO: 227639

SEQ ID NO: 582244 - RNA, 65 nt, hsa; identical to SEQ ID NO: 227640

SEQ ID NO: 582245 - RNA, 65 nt, hsa; identical to SEQ ID NO: 58920

SEQ ID NO: 582246 - RNA, 65 nt, hsa; identical to SEQ ID NO: 58921

SEQ ID NO: 582247 - RNA, 65 nt, hsa; identical to SEQ ID NO: 227643

SEQ ID NO: 582248 - RNA, 65 nt, hsa; identical to SEQ ID NO: 227644

SEQ ID NO: 582249 - RNA, 65 nt, hsa; identical to SEQ ID NO: 227645

SEQ ID NO: 582250 - RNA, 65 nt, hsa; identical to SEQ ID NO: 227646

SEQ ID NO: 582251 - RNA, 65 nt, hsa; identical to SEQ ID NO: 227647

SEQ ID NO: 582252 - RNA, 65 nt, hsa; identical to SEQ ID NO: 58922

SEQ ID NO: 582253 - RNA, 65 nt, hsa; identical to SEQ ID NO: 58923

SEQ ID NO: 582254 - RNA, 65 nt, hsa; identical to SEQ ID NO: 227650

SEQ ID NO: 582255 - RNA, 65 nt, hsa; identical to SEQ ID NO: 58924

SEQ ID NO: 582256 - RNA, 65 nt, hsa; identical to SEQ ID NO: 58925

SEQ ID NO: 582257 - RNA, 65 nt, hsa; identical to SEQ ID NO: 227653

SEQ ID NO: 582258 - RNA, 65 nt, hsa; identical to SEQ ID NO: 227654

SEQ ID NO: 582259 - RNA, 65 nt, hsa; identical to SEQ ID NO: 227655

SEQ ID NO: 582260 - RNA, 65 nt, hsa; identical to SEQ ID NO: 227656

SEQ ID NO: 582261 - RNA, 65 nt, hsa; identical to SEQ ID NO: 227657

SEQ ID NO: 582262 - RNA, 65 nt, hsa; identical to SEQ ID NO: 227658

SEQ ID NO: 582263 - RNA, 65 nt, hsa; identical to SEQ ID NO: 227659

SEQ ID NO: 582264 - RNA, 65 nt, hsa; identical to SEQ ID NO: 227660

SEQ ID NO: 582265 - RNA, 65 nt, hsa; identical to SEQ ID NO: 227661

SEQ ID NO: 582266 - RNA, 65 nt, hsa; identical to SEQ ID NO: 227662

SEQ ID NO: 582267 - RNA, 65 nt, hsa; identical to SEQ ID NO: 227663

SEQ ID NO: 582268 - RNA, 65 nt, hsa; identical to SEQ ID NO: 227664

SEQ ID NO: 582269 - RNA, 65 nt, hsa; identical to SEQ ID NO: 227665

SEQ ID NO: 582270 - RNA, 65 nt, hsa; identical to SEQ ID NO: 227666

SEQ ID NO: 582271 - RNA, 65 nt, hsa; identical to SEQ ID NO: 227667

SEQ ID NO: 582272 - RNA, 65 nt, hsa; identical to SEQ ID NO: 227668

SEQ ID NO: 582273 - RNA, 65 nt, hsa; identical to SEQ ID NO: 227669

SEQ ID NO: 582274 - RNA, 65 nt, hsa; identical to SEQ ID NO: 227670

SEQ ID NO: 582275 - RNA, 65 nt, hsa; identical to SEQ ID NO: 227671

SEQ ID NO: 582276 - RNA, 65 nt, hsa; identical to SEQ ID NO: 227672

SEQ ID NO: 582277 - RNA, 64 nt, hsa
gcccccugguggugaguguaaagaagacuuugccucucacaacuacauguauguguggcauuuu

SEQ ID NO: 582278 - RNA, 64 nt, hsa
gaggacaagaagucuauuguuuggacuguguuugucucacaaucaccacaaaauaaaaguguag

SEQ ID NO: 582279 - RNA, 64 nt, hsa
ucugaacccauucuauuuugaaucuccccuuuccucucacaauacuugaacauuuuaaucuuuu

SEQ ID NO: 582280 - RNA, 64 nt, hsa
ggccaucacacuggccuguuccggagaauauuucucucacaauauuauuaucuacuuauaauua

SEQ ID NO: 582281 - RNA, 64 nt, hsa
auuacacaguuaaugccacaaaacugacaguaaaucucacaaaugaucgcuaucuagcaacccu

SEQ ID NO: 582282 - RNA, 64 nt, hsa
aagccaauggaaaaaucuuggauuaugaagugacucucacaagauggaaaucacauuuacaaaa

SEQ ID NO: 582283 - RNA, 64 nt, hsa
gauaugguauccuuuugagugagguauauacucaucucacaagugaagugccuacugauauuac

SEQ ID NO: 582284 - RNA, 64 nt, hsa
aguucuguuaggaauaaaagaugaaacuauuguaucucacaaaaaaucuuauuucagaauggaa

SEQ ID NO: 582285 - RNA, 64 nt, hsa
acugggacaaguuuacugcucuuguaggagcuccucucacaaguaguuguaaugcuguagcaug

SEQ ID NO: 582286 - RNA, 64 nt, hsa
gccauuuuuguaaauacaguaguuuugcacaaccucucacaaaugucuguauuaauuucacaua

SEQ ID NO: 582287 - RNA, 64 nt, hsa
gcaucuggcugacacuuaccugcuucugguuuucgaagacuauuuaguggaaccuuguagagga

SEQ ID NO: 582288 - RNA, 64 nt, hsa
agagaauuccuauuuaaaaaaauagaaaaauagugaagacuacacaagaggaaauagggcuuuu

SEQ ID NO: 582289 - RNA, 64 nt, hsa
uacauaggaauuuucuuucuuaaaaaacaguaaugaagacuauaucuccuuucccagcacugaa

SEQ ID NO: 582290 - RNA, 64 nt, hsa
caagaaaaagcaccucucuucaccugaaagcuuugaagacuagagacacgcuuuacacguuuua

SEQ ID NO: 582291 - RNA, 64 nt, hsa
gggaaggaugucugggaugugaagaggcaaggcagaaauggaugaugaacaucaaaaacuguca

SEQ ID NO: 582292 - RNA, 64 nt, hsa
guuuacuauuuuugaaguuuacauuguuacauaugaaauggaaacauuauuuugaaacguuguc

SEQ ID NO: 582293 - RNA, 64 nt, hsa
uucccccucaccuucaauaagguuuuucaaaaaggaaauggaaacuuuuuaaccaauuugugaa

SEQ ID NO: 582294 - RNA, 64 nt, hsa
uuuaaauuauuuuuaauaccaaaagaguucuuuugaaauggaacugauuaaaagggcagagggu

SEQ ID NO: 582295 - RNA, 64 nt, hsa
guuauagauaaggaauuuccuguacaccagauuggaaauggagugaaacaagcccucccaugcc

SEQ ID NO: 582296 - RNA, 64 nt, hsa
guuugaguuuguuggaaaagcaguuaacuggggggaaauggacaguuauagauaaggaauuucc

SEQ ID NO: 582297 - RNA, 64 nt, hsa
cuucucuagaaagcugccaagacagaggcagaaagaaauggaugauaguucugucaagcacacu

SEQ ID NO: 582298 - RNA, 64 nt, hsa
ggaacgcauuggcuuuuuuuuucuuguuuugauagaaauggaauuaagcaaaaguaguuuuugu

SEQ ID NO: 582299 - RNA, 64 nt, hsa
ggaugaauugagcuccuggcccuucugaugcuuugaaauggaaggauuguuccuuagagcuucu

SEQ ID NO: 582300 - RNA, 64 nt, hsa
gcguaagaggcaacagagccaucuagaagaacaagaaauggaaauagugacucuuggauuacag

SEQ ID NO: 582301 - RNA, 64 nt, hsa
uggcuugucuugggcuuucgucauuaaaccaaaggaaauggaagccauuccccuguugcucucc

SEQ ID NO: 582302 - RNA, 64 nt, hsa
ugucuuucucuggacaacuggcccaguuuacagugaaauggagaauuucaggucuccacgucug

SEQ ID NO: 582303 - RNA, 64 nt, hsa
auaagacccuguggagaaauucguuguucccacugaaauggacugacuguaacgauugacacca

SEQ ID NO: 582304 - RNA, 64 nt, hsa
auuucuagagagucuccuuacucauuaauucaaugaaauggauugguaagaugucuugaaaaca

SEQ ID NO: 582305 - RNA, 64 nt, hsa
cgcugcuuucauuuuucugaccuaauaauuacgggaaauggaaagucugggccagcaucaauaa

SEQ ID NO: 582306 - RNA, 64 nt, hsa
gacuggugugaggcaaagugaaaaagggaugggggaaauggagauggcacgggcuccucagagc

SEQ ID NO: 582307 - RNA, 64 nt, hsa
acuugguguccuuuuuucucccaaacuuuauuuagaaauggaaggaguucaauuuuuucuuguu

SEQ ID NO: 582308 - RNA, 64 nt, hsa
uucuaaaaguuuucaucgccuugguaaagcuccagaaauggacaaugcuagugacugcacaaua

SEQ ID NO: 582309 - RNA, 64 nt, hsa
uuagaaguagaauugacagggcauauuaguugaugaaauggagucauuugagucucuuaauagc

SEQ ID NO: 582310 - RNA, 64 nt, hsa
agucacuacaacugauuaguuguuuagagaaugagaaauggaacagugaggaauggaggccaua

SEQ ID NO: 582311 - RNA, 64 nt, hsa
uccgguucuuuccaugucuuaguuggaugucccugaaauggacacaggcugugccauugugcca

SEQ ID NO: 582312 - RNA, 64 nt, hsa
uuguauaaguagaaaauuacuuaauuucauacuagaaauggauggaugcugcaaguugaaaugg

SEQ ID NO: 582313 - RNA, 64 nt, hsa
auuucauacuagaaauggauggaugcugcaaguugaaauggacuguccauugacguuccuaaug

SEQ ID NO: 582314 - RNA, 64 nt, hsa
uuuagguauucuaauguauuuuguuaguugcuuagaaauggaaauaaaauauaugugcuuauua

SEQ ID NO: 582315 - RNA, 64 nt, hsa
ugaacauuuuuuucauaaaaauuaaaugcuuuaagaaauggagaaggaaaaauagcuuuuauca

SEQ ID NO: 582316 - RNA, 64 nt, hsa
augaugagaagccguugagcuuuguccauucaaggaaauggauuauuugucagcccgauuauuu

SEQ ID NO: 582317 - RNA, 64 nt, hsa
aacacugccaucuucaaauuuaaauguaauuuaggaaauggaagcuuuuaauuuuaauuucuuu

SEQ ID NO: 582318 - RNA, 64 nt, hsa
auuguacugaaggcucagcagcaauagagcuaaugaaauggaagcugggcagugcugagucccu

SEQ ID NO: 582319 - RNA, 64 nt, hsa
cuuuucuugacaggcacaccuuucugaaauccaagaaauggaauccaaaauaaauuuuccaauu

SEQ ID NO: 582320 - RNA, 64 nt, hsa
aagcaugggaaauguaaaggcagucuuucucugggaaauggaugcuauucuauucugcugcccc

SEQ ID NO: 582321 - RNA, 64 nt, hsa
uuaauagugaaugcuuuaaaauuaaagucaucacgaaauggaaguuuucccaggguggaaaaua

SEQ ID NO: 582322 - RNA, 64 nt, hsa
auacaccuaccauguacccauaaaaauuuaaaaagaaauggaauggcaaauaauggaacauaaa

SEQ ID NO: 582323 - RNA, 64 nt, hsa
uaaauagcuuacagacagucuaugcuuuguuuaagaaauggaauggcacuucauauauucucau

SEQ ID NO: 582324 - RNA, 64 nt, hsa
aauggacuacuuuuguaacuuaccuguuuguuaggaaauggaauggucucuuugauuuaaaaua

SEQ ID NO: 582325 - RNA, 64 nt, hsa
gaagugcugggaaucacuuauaccaaagccuuaugaaauggaugaaauuuuguuaaauaggcaa

SEQ ID NO: 582326 - RNA, 64 nt, hsa
uuaauucuaauaauuucaaaaugcauucacugaagaaauggacauuaaaauauucuaaaauuua

SEQ ID NO: 582327 - RNA, 64 nt, hsa
gcaggauuuaaucuggggagcaaauuccagcucugaaauggaguucucacaccguaucuaggga

SEQ ID NO: 582328 - RNA, 64 nt, hsa
aggcagagccugaggugguaggaggaggacccuggaaauggacugguuugagauugccccaggu

SEQ ID NO: 582329 - RNA, 64 nt, hsa
ucccaaugguccugacuuugggcgcuggguauuggaaauggaugcaaaguacaauguguuuuuc

SEQ ID NO: 582330 - RNA, 64 nt, hsa
acaccucuaugcaaauaaacuagaaaaucuagaagaaauggauaaauuccucaacacguacacc

SEQ ID NO: 582331 - RNA, 64 nt, hsa
aaccacugcuuaacgaaauaaaagaggaugcaaagaaauggaagagcauuccaugcucaugggu

SEQ ID NO: 582332 - RNA, 64 nt, hsa
uuuaaggaggugccucuguucuuuguggaggagugaaauggagcuuuaaguguguguguguguu

SEQ ID NO: 582333 - RNA, 64 nt, hsa
acgcgccaccacaccuggcuaauucuauuuaguagaaauggagucucaccauguuggucaggcu

SEQ ID NO: 582334 - RNA, 64 nt, hsa
gcauuucuaaaucaucaauauuugcuugucuuugccccuagacucuagacuauguuaacuaguu

SEQ ID NO: 582335 - RNA, 64 nt, hsa
aucuaugcuugcguuugaaacuacaacuugauaaccccuagaaagaagaggacaugaaaggaug

SEQ ID NO: 582336 - RNA, 64 nt, hsa
gaauuguccaguguggccccuagaauugagucacccccuagauaccaacugucugaccccgagg

SEQ ID NO: 582337 - RNA, 64 nt, hsa
caacucuccacuuggagggaauuguccaguguggccccuagaauugagucacccccuagauacc

SEQ ID NO: 582338 - RNA, 64 nt, hsa
gcccccaggagcugggagaggcaggaaggauccuccccuagagccuccagggggaacuggagga

SEQ ID NO: 582339 - RNA, 64 nt, hsa
guccccaggagcugggagaggcaggaaggacccuccccuagagucucuggagggaacuggauac

SEQ ID NO: 582340 - RNA, 64 nt, hsa
cucuuauuagcuccccgcuccacaagacaccugugaucuggaaaucuaccaccaaucccgaucg

SEQ ID NO: 582341 - RNA, 64 nt, hsa
cugcccaggaaagaacuucagcugacuccacggggaucuggaaauccacgaccaaucccgaucg

SEQ ID NO: 582342 - RNA, 64 nt, hsa
aauaguuugaaauagaaaaaaaguauuuaauuuggaucuggaucuguuaagauaugcacagucu

SEQ ID NO: 582343 - RNA, 64 nt, hsa
cauaguuguuuuccugcuuuacaaaauugcuccagaucuggaaugccaguuugaccuuugucuu

SEQ ID NO: 582344 - RNA, 64 nt, hsa
uucccaggacccugaaggggccaugauggcaacagaucuggaaccucagccuggccagacacag

SEQ ID NO: 582345 - RNA, 64 nt, hsa
aaauggggccagauccagccuggggucuggaguugaucuggaacccagacucagacauuggcac

SEQ ID NO: 582346 - RNA, 64 nt, hsa
agaggagacauuggcuuaucauggggaaaaagaggaucuggagaaccucauccagcuccccuuc

SEQ ID NO: 582347 - RNA, 64 nt, hsa
gccugcaagugguagcaagaagugauuagaggcagaucuggacuuggcaacagaagugguuucc

SEQ ID NO: 582348 - RNA, 64 nt, hsa
uuaggucacuacuuuugcagauuuugcuggcacugaucuggagaucugcagaucuggaggagac

SEQ ID NO: 582349 - RNA, 64 nt, hsa
gcagauuuugcuggcacugaucuggagaucugcagaucuggaggagacgggaaggagucgauuc

SEQ ID NO: 582350 - RNA, 64 nt, hsa
ccugguuugcauccggcucacagagcccagacugcuggaacagccaaggacugucaggcuggac

SEQ ID NO: 582351 - RNA, 64 nt, hsa
gacugacuggcugcagccuucccacgccaagaggcuggaacauagugucugccucgcuuccugg

SEQ ID NO: 582352 - RNA, 64 nt, hsa
ugccccaguucagaaauuuggcauugaucuuaaacuggaacaugcuuuuacuuuauugcccuaa

SEQ ID NO: 582353 - RNA, 64 nt, hsa
auucuuuuacuuaaccaggcuuauggcaugaucucuggaacaaauuuguaggaaaaaauuacuc

SEQ ID NO: 582354 - RNA, 64 nt, hsa
guuugugccccgccaggugaaggucaugcgaugccuggaacaccccaacgugcucaaguucauc

SEQ ID NO: 582355 - RNA, 64 nt, hsa
cacccaccugucacccaggccauccuuugugaagcuggaacacuggcuggagacccuccgcaug

SEQ ID NO: 582356 - RNA, 64 nt, hsa
guucguggucaaagguuugggggaauuugugacccuggaacauccccagagugaaagauggagc

SEQ ID NO: 582357 - RNA, 64 nt, hsa
auguuugacgaagguuugugcaagucaggcccuucuggaacacagcagggccuacaacgagggg

SEQ ID NO: 582358 - RNA, 64 nt, hsa
aggagagucacagggcuugacaccugacucugagcuggaacaguaggggcagggagaagacagg

SEQ ID NO: 582359 - RNA, 64 nt, hsa
uacuugaucuggagggcauugacaccuggcucagcuggaacaguggggacaggaggaggcaggu

SEQ ID NO: 582360 - RNA, 64 nt, hsa
ugcuucuuaaucaauccaaauuucauuuacagcucuggaacacuuuggggcugauuugucucuu

SEQ ID NO: 582361 - RNA, 64 nt, hsa
gaugcagcucagucaaggagcagcagaccuggcacuggaacaggguugaaaacccaggguuuug

SEQ ID NO: 582362 - RNA, 64 nt, hsa
uaagauagcccuaaauguacucuugaacuucuuacuggaacaauguuugauacucuaguaugua

SEQ ID NO: 582363 - RNA, 64 nt, hsa
guguauuuuaaaugugaccuuucguaaauuugggcuggaacauguaaaagggugaaaguuaguc

SEQ ID NO: 582364 - RNA, 64 nt, hsa
ugucugugcaaacuggaggacuccuuccaacuuccuggaacaaagcgacaucgccagcagcagg

SEQ ID NO: 582365 - RNA, 64 nt, hsa
ugacagugugcucacucucagagccauggauuaccuggaacaaagugcagauuagugcccacgg

SEQ ID NO: 582366 - RNA, 64 nt, hsa
cagugagugggucccaucgacaggguuccaggaccuggaacacuuuaacagaaggaaaugccga

SEQ ID NO: 582367 - RNA, 64 nt, hsa
uuggaccuuggcauuccguuugaauuccuucuaacuggaacauuuguguuguaucuguaacacu

SEQ ID NO: 582368 - RNA, 64 nt, hsa
ugacaguccuccuggcuucagcuagagaaggaugcuggaacaagcggcugguguugaaagagug

SEQ ID NO: 582369 - RNA, 64 nt, hsa
agcuuaccugccacagagcuuuucugcaugaacucuggaacagaaaggcccuguaaagcccuca

SEQ ID NO: 582370 - RNA, 64 nt, hsa
aguaaugaauuaucauucccaaacccguguccaccuggaacaucaggaugggaccauguuugaa

SEQ ID NO: 582371 - RNA, 64 nt, hsa
agucccugauagagaaggaggucccaucaggccccuggaacacacucaggcuucccugacucag

SEQ ID NO: 582372 - RNA, 64 nt, hsa
cuaauagcaugaagaucgugggucuguguguccgugaagugagucccgucugccaggagcugac

SEQ ID NO: 582373 - RNA, 64 nt, hsa
cauguguggccaggcuggucucgaacuccugaccugaagugauccacccgccucgaccucccaa

SEQ ID NO: 582374 - RNA, 64 nt, hsa
caagaugagagcagaaucguaagagcuuugaauuugaagugaguuuuuuuccccccauaaguua

SEQ ID NO: 582375 - RNA, 64 nt, hsa
cugggagaggacaguuauugacacugaugugcaaugaagugacaagaugagagcagaaucguaa

SEQ ID NO: 582376 - RNA, 64 nt, hsa
ccacuuuucucucuauuuguauuguuagccaucuugaagugauguuguuuaacauaaauuguac

SEQ ID NO: 582377 - RNA, 64 nt, hsa
aaacucuccaaauacugauggugcauuuuauucuugaagugaaaucugugcaauaaaauaacag

SEQ ID NO: 582378 - RNA, 56 nt, hsa
uuuucaauuuuccagaauaacugaagugaagugauggacuccgauuuggagaguag

SEQ ID NO: 582379 - RNA, 51 nt, hsa
uuuucaauuuuccagaauaacugaagugaagugauggacuccgauuuggag

SEQ ID NO: 582380 - RNA, 64 nt, hsa
uuuggggauuuucccccuugauguuuugacagauugaagugagcuuuagugagcaaaaggauca

SEQ ID NO: 582381 - RNA, 64 nt, hsa
ugaauguuuuucuuauaaaaaauuauacaaaugcugaagugagauucuacuauuguucauugcu

SEQ ID NO: 582382 - RNA, 64 nt, hsa
ugggagacaggauuuucuaaaagcuagaaaaaaaugaagugauugcaaugccaguauaacugau

SEQ ID NO: 582383 - RNA, 64 nt, hsa
gagacaggaauccccucacagugggcgacagaucugaagugaagacaggagaugaugagaaaag

SEQ ID NO: 582384 - RNA, 64 nt, hsa
uauuuagugaauuuuauuuaugaauaauuucuguugaagugaaaacuagauauuuaauauuuug

SEQ ID NO: 582385 - RNA, 64 nt, hsa
cugucaagaagguuuaugguauaaaugaugaaguugaagugauguuugaaagauuaaugagaua

SEQ ID NO: 582386 - RNA, 64 nt, hsa
aaguaaauuucuguacauguacuguuuucauaugugaagugagaagaaacuuuaugcuuguuua

SEQ ID NO: 582387 - RNA, 64 nt, hsa
gcuaaaugccuguauuugaagucucuccccuuccugaagugaccuuuuaugaggcucuuuccuu

SEQ ID NO: 582388 - RNA, 64 nt, hsa
ggcauuauccuuucaaaaucucagggauuugggaugaagugaagaggucaaauuacuuuuuaga

SEQ ID NO: 582389 - RNA, 64 nt, hsa
uaaauuggauguuucuuuauaugaccuuggaaacugaagugaucuuagcauuaaacaaaaaugc

SEQ ID NO: 582390 - RNA, 64 nt, hsa
uauucaaucauaggagcaaagaacuugcaaaauaugaagugacuuggaauuaaccauguuguag

SEQ ID NO: 582391 - RNA, 64 nt, hsa
auggcucuaccauucauucuucugguauuuguaaugaagugaauccacuguuuaaucagaucca

SEQ ID NO: 582392 - RNA, 64 nt, hsa
gauaaauuuaaaauguuacuuauuuuaaaauaaaugaagugagauggcauggugaggugaaagu

SEQ ID NO: 582393 - RNA, 64 nt, hsa
ggugugccaagacauuaauuuuuuuuuuaaacaaugaagugaaaaaguuuuacaaucucuaggu

SEQ ID NO: 582394 - RNA, 64 nt, hsa
acuuaauagcaucaagauuugaaauacuuaagcaugaagugacuuuuauaaugacucgaucccu

SEQ ID NO: 582395 - RNA, 64 nt, hsa
uccuuuuuaaaaaucauauagacaauuagcuguuugaagugaguauuaaauauuucagaagugu

SEQ ID NO: 582396 - RNA, 64 nt, hsa
caaaguaaaaaaaguaaaaucaaggugguauauuugaagugaauggugauuggaaauuuuuagc

SEQ ID NO: 582397 - RNA, 64 nt, hsa
aauaaagaguauucugaaaaaaagaagauauggaugaagugaacccaugcagugacuggaugau

SEQ ID NO: 582398 - RNA, 64 nt, hsa
guugcauucuuggacagacagcucuggcauccgaugaagugaucuuaguugucugcucauuuau

SEQ ID NO: 582399 - RNA, 64 nt, hsa
cucccaggcucacugcagccucaacguuuugagcugaagugauccucucgucucuguuucccca

SEQ ID NO: 582400 - RNA, 64 nt, hsa
uaaaugagugauucuguccccaaauguccauuuuugaagugauuuuccuggaggauuaggguau

SEQ ID NO: 582401 - RNA, 64 nt, hsa
gguacaaaaacucaucuuguaauauuuucauuuuugaagugaaaaaguacauauauuuugcaca

SEQ ID NO: 582402 - RNA, 64 nt, hsa
gaaccauaggacuguggcaaacaaaaccaauucaugaagugaauuaaugaugaggaucugaaaa

SEQ ID NO: 582403 - RNA, 64 nt, hsa
cucacauuggcaaguguaaaaagaugacuuaaggugaagugaggacaaaaucacauucugcaua

SEQ ID NO: 582404 - RNA, 64 nt, hsa
ugaacaaacuggaaaaugcaacauaccacauaacugaagugaaaaaagucuguguuuuuguguu

SEQ ID NO: 582405 - RNA, 64 nt, hsa
ccacuuaaaagaucucuguaucuuguucugugacugaagugauacacuaaucacggggaaccca

SEQ ID NO: 582406 - RNA, 64 nt, hsa
gguucacaguagacuuugagugaccgucccaccgugaagugaauucucugagcugguggugugg

SEQ ID NO: 582407 - RNA, 64 nt, hsa
guugcuguuuuuuaaaugaacacaguugaguauuugaagugaauuugaaaaagaaauguuacuu

SEQ ID NO: 582408 - RNA, 63 nt, hsa
uuauuucaugauucaaccugauacauuuacauagugcaaaacugugucacaguuucaggcuuu

SEQ ID NO: 582409 - RNA, 63 nt, hsa
augaauaaucaaagugauuuuucagaauuaugugugcaaaaaauuaaugugcauucauauauu

SEQ ID NO: 582410 - RNA, 63 nt, hsa
agcucaggugcuccccuccaccaugggcaggcugugcaaaaagccacuggcuuuucucagcau

SEQ ID NO: 582411 - RNA, 63 nt, hsa
uuuaaggaacaaguaacuaaaaauguuaagccagugcaaaauaaucugcuuaccuacucacau

SEQ ID NO: 582412 - RNA, 63 nt, hsa
uauuaacauaauuguuguagcauaauauuaauagugcaaaaguacauauaagucauuuugaug

SEQ ID NO: 582413 - RNA, 63 nt, hsa
gagcacuuugccuaaaagaaaggacugacaagugugcaaaauguuuacaaucuuuugugaaau

SEQ ID NO: 582414 - RNA, 63 nt, hsa
cugggucaggaacagagccaacaggaugaacgugugcaaaagccuuggacuuggcugugaucu

SEQ ID NO: 582415 - RNA, 63 nt, hsa
gccugacuggggacaccugagaguaguauaguagugcaaaauggaagacugauuuuugacucu

SEQ ID NO: 582416 - RNA, 63 nt, hsa
cagcaagguuggccucuggauggugaacgggcugugcaaaaaagcccugcuucuucccuuguc

SEQ ID NO: 582417 - RNA, 63 nt, hsa
uaccccauagacugguguuaaauguugucuacagugcaaaauccauguucuaacauauguaau

SEQ ID NO: 582418 - RNA, 63 nt, hsa
aucauguccaggccuggaaagaauacaaauccagugcaaaauuaaaccauuaguucuugauga

SEQ ID NO: 582419 - RNA, 63 nt, hsa
ugcucgucuaucaccaggaucgcuuuguacuuugugcaaaagggucuggcugucccuugcugu

SEQ ID NO: 582420 - RNA, 63 nt, hsa
agagaguguauagacugacucuaaguuaauaaugugcaaaauaucuuaaacaucccuccccuu

SEQ ID NO: 582421 - RNA, 63 nt, hsa
agagaguccuuacucccuuccaaucucuguucagugcaaaacccagaaacaugaacagauacg

SEQ ID NO: 582422 - RNA, 63 nt, hsa
ugaaacaaucacacaggacacuuuucuacauuggugcaaaauggaauauuuuguacauuuuua

SEQ ID NO: 582423 - RNA, 63 nt, hsa
guaauguuuugauuuugugacagucaaaaggacgugcaaaagucuagccuugcccgagcuuuc

SEQ ID NO: 582424 - RNA, 63 nt, hsa
ggucucuaaggaaaaccagcagaacauuagccugugcaaaaccaucuguuuggggagcacacu

SEQ ID NO: 582425 - RNA, 63 nt, hsa
ggaauauugagaaugagggccuggaggugaaaugugcaaaacccaccccucacacugcagcca

SEQ ID NO: 582426 - RNA, 63 nt, hsa
cucucauaggagacccaugugcuuccuugcucagugcaaaacugaugauucuacuugcuguag

SEQ ID NO: 582427 - RNA, 63 nt, hsa
auuaugagcccugaggaguuauuggcaagauuugugcaaaauaaaauauggggagacuuggga

SEQ ID NO: 582428 - RNA, 63 nt, hsa
ucaugaagaaaaaaauauauuuuaggaaaacaugugcaaaaagcaucuaagcaucuguuaaca

SEQ ID NO: 582429 - RNA, 63 nt, hsa
caccacagcugccuccugagcugccugagccuggugcaaaaggauuggcccccauuauggugc

SEQ ID NO: 582430 - RNA, 63 nt, hsa
uauaaauaggucagugggcagagaggcagaugugugcaaaaagcacaaccccaaucacacaca

SEQ ID NO: 582431 - RNA, 63 nt, hsa
cauuuucuuuaaaaaaaaguauuuugagaaaaggugcaaaauauucuugaaagucucuaggcc

SEQ ID NO: 582432 - RNA, 63 nt, hsa
uugaaagaaaaugaaggaacagggggaaaaaaggugcaaaaugcuaaauuucuaaaaauggau

SEQ ID NO: 582433 - RNA, 63 nt, hsa
acuuacugcaagagauauuucauuuucagcacagugcaaaaguucuuuaaaaugcauaugucu

SEQ ID NO: 582434 - RNA, 63 nt, hsa
uuuugguaauucauuuuuuuuuaagaucauuaugugcaaaacaccaaguuuuaaaaauaacuc

SEQ ID NO: 582435 - RNA, 63 nt, hsa
ucucucucucucucaaagaaaaaaaaaaugggagugcaaaaaaaacaaagccaaaaaauauau

SEQ ID NO: 582436 - RNA, 63 nt, hsa
agaaggcuaaaaaauuaccucuuuuuaaauuaugugcaaaauaauucuggcuaacuguaaaau

SEQ ID NO: 582437 - RNA, 63 nt, hsa
ggagcauuuauguagacauuguaaauaaauuuugugcaaaaaggacuggaaaaaugaacugua

SEQ ID NO: 582438 - RNA, 63 nt, hsa
guagaacauaaaacuuguauugcuucuguuucagugcaaaaauguacuagccaauacgcuuaa

SEQ ID NO: 582439 - RNA, 63 nt, hsa
uccuuggaacuggaaguguuauuccuaagucuagugcaaaaugcuucuacucucugugucuuc

SEQ ID NO: 582440 - RNA, 63 nt, hsa
gauaguguuauaaauacuguaaaagcauggaaggugcaaaacucaguauuucuacaauugcag

SEQ ID NO: 582441 - RNA, 63 nt, hsa
aacacuucgugguucuauauaucagcagcaagugugcaaaauaaaggaccuguuaacucagau

SEQ ID NO: 582442 - RNA, 63 nt, hsa
agccugcauuguguauuaaacaccagguaauaugugcaaaaccgagggcuccaguaacaccuu

SEQ ID NO: 582443 - RNA, 63 nt, hsa
gucgcugaguauuauuugacuccggucuccuuggugcaaaaacaaaaugggaaaaauaaauaa

SEQ ID NO: 582444 - RNA, 63 nt, hsa
gguuuuaguuuuuaaaauaucuuuugaccuguggugcaaaagcagaaaauacagcuggauugg

SEQ ID NO: 582445 - RNA, 63 nt, hsa
gcuaauuuaguucucagcucuucugacuuaagugugcaaaauauuuuuauagauuugaccuac

SEQ ID NO: 582446 - RNA, 63 nt, hsa
ggcuaacacggugaaaccccgucucuacuaaaagugcaaaaauuagccgggcgugguggcgca

SEQ ID NO: 582447 - RNA, 63 nt, hsa
uuuuuuaaacaaugauuaaauugaauguguaaugugcaaaagcccuggaacgcaauuaaauac

SEQ ID NO: 582448 - RNA, 63 nt, hsa
uguuccuaaguucuuagauaucuuuuuauugaugugcaaaaauuuuuggauugacaguaacuu

SEQ ID NO: 582449 - RNA, 63 nt, hsa
uuuucuaagcuguuucuugaugggagagguucugugcaaaacuaccacauucuguccccaaaa

SEQ ID NO: 582450 - RNA, 63 nt, hsa
ucaggcuuuauggccuauuuuccauugugucaagugcaaaacuacccuggcccaaaggaaggg

SEQ ID NO: 582451 - RNA, 63 nt, hsa
aaacuuaaguagauaggagcuuauggucaaaaagugcaaaaaaaaaaacaaaaaaaaagcaau

SEQ ID NO: 582452 - RNA, 63 nt, hsa
agagugaauggcuugacguacuugcaguuaacugugcaaaauuggcuggcugccucuguuccu

SEQ ID NO: 582453 - RNA, 63 nt, hsa
uccagaaaggguugcuagccuuaacuucagcuggugcaaaacaucugacuguagccgaacuuc

SEQ ID NO: 582454 - RNA, 63 nt, hsa
ccaaaucaaggaccaacuuaaacguuaauuuuugugcaaaaacaaaccugaaaaauaugcuuc

SEQ ID NO: 582455 - RNA, 63 nt, hsa
uaauuccagugguccauggaaugcuugaaaaaugugcaaaacagcguuuaagacuguaaugaa

SEQ ID NO: 582456 - RNA, 63 nt, hsa
acuggcuuuaccaaauugaaugaaaaggagcuugugcaaaaaaauuuaaaaauggaugucaag

SEQ ID NO: 582457 - RNA, 63 nt, hsa
ggggaaaaaaaaagaagaaaaaccuguuuccgugugcaaaagcacacauauguaugucugugu

SEQ ID NO: 582458 - RNA, 63 nt, hsa
aaaauacuagguaguauaaggcuuucucaaucagugcaaaaauggaagauauauaaagcaaca

SEQ ID NO: 582459 - RNA, 63 nt, hsa
aauuuucaaagaaaaacgagggaaaugggaggggugcaaaagaggagaguaagaaacagcaug

SEQ ID NO: 582460 - RNA, 63 nt, hsa
ucauugcacauaagcuuccauuuuaauuuuaaagugcaaaagggccagcguggcucuaaaagg

SEQ ID NO: 582461 - RNA, 63 nt, hsa
uguucucagagcugaauguuuauaucuuuugcugugcaaaagaaacauguaaaauguuguuca

SEQ ID NO: 582462 - RNA, 63 nt, hsa
agccuugaaaacuugcuaagugaaagaagccaggugcaaaagcccacauauugucugacugca

SEQ ID NO: 582463 - RNA, 63 nt, hsa
aaaagaaugagguuggaccuuuacucacacuaugugcaaaaaucaacucaaaacgcauccaag

SEQ ID NO: 582464 - RNA, 63 nt, hsa
uucaacaaauggcaccgagacaaugauaugcaagugcaaaagaaugagguuggaccuuuacuc

SEQ ID NO: 582465 - RNA, 63 nt, hsa
cagcauaugaucuuuuuuccauaaacuuguacagugcaaaagacauuuugaauaccaugaucg

SEQ ID NO: 582466 - RNA, 63 nt, hsa
uuuccacagcaaaauuacucuacuguuaaaauugugcaaaauaaaauaaacauuuaaaaugac

SEQ ID NO: 582467 - RNA, 63 nt, hsa
uuugaaaugcuaaacuuggcuguaugucaaauugugcaaaauauugguauuaaagaaugcugc

SEQ ID NO: 582468 - RNA, 63 nt, hsa
aguaguaguugcuauguacugauuuaccucaaggugcaaaauaauuaaaccuguacauauucc

SEQ ID NO: 582469 - RNA, 63 nt, hsa
uguucugagguuucaccuccauguguuucauuggugcaaaaguggaucucuuaguuggucacu

SEQ ID NO: 582470 - RNA, 63 nt, hsa
auagaggugaaggagguagggagugcccuccaagugcaaaaauaacaaauaugauuauugacc

SEQ ID NO: 582471 - RNA, 63 nt, hsa
uuugaagugccuaagaugaccuauuugucaguggugcaaaauuaauucucuucuuuuuugagu

SEQ ID NO: 582472 - RNA, 63 nt, hsa
ugauggagccucauuucccuuugugaacacaaagugcaaaaugaauucuuuuuaauuuuagua

SEQ ID NO: 582473 - RNA, 63 nt, hsa
gggcuaacauuuaggagaaguuggucuuacuuugugcaaaagcaggcuugugcuuuauacccc

SEQ ID NO: 582474 - RNA, 63 nt, hsa
gcucccugcaaguguaaauauuaaggaugaccugugcaaaauuauacccacaccagcacuagu

SEQ ID NO: 582475 - RNA, 63 nt, hsa
uuuuaaguggcagguauuguaacuguuuuuugugugcaaaauacugaguaaccacugggaaaa

SEQ ID NO: 582476 - RNA, 63 nt, hsa
ucaggguaaaauuugaaacaaaaaauuuuaccugugcaaaauaguuuuuuaaaaauuauacau

SEQ ID NO: 582477 - RNA, 63 nt, hsa
ugauuuuuuuaaaucuaaaauuuacauuaaugagugcaaaauaacacauaaaaugaaaauuca

SEQ ID NO: 582478 - RNA, 63 nt, hsa
ugccuccuuuugugguguaaaaaacaaauuauggugcaaaaaguaaucacuagauugaaauac

SEQ ID NO: 582479 - RNA, 63 nt, hsa
ugcuuagaggucaaggaccuuccuguguaguuggugcaaaagcaaucuccacaggacagcacu

SEQ ID NO: 582480 - RNA, 63 nt, hsa
aaaaaccuuugauauuuauaaaaucauuuuuacgugcaaaauauaaccuuaauauuugaagug

SEQ ID NO: 582481 - RNA, 63 nt, hsa
guuuuuaagugccuuggcaggcucacuucugaggugcaaaacauagauauagaacugaacagg

SEQ ID NO: 582482 - RNA, 63 nt, hsa
ggggaauggggagaugaugaugauggucaaagggugcaaaaucucacacaagacugaggcagg

SEQ ID NO: 582483 - RNA, 63 nt, hsa
gaacauuuuccaauuaucuggucuuuuccuguugugcaaaaaugacucauugcuccgaauguc

SEQ ID NO: 582484 - RNA, 63 nt, hsa
auauuuaugggcugguaaacucauuguacauaugugcaaaacugcuacugaguggggagcuuc

SEQ ID NO: 582485 - RNA, 63 nt, hsa
auuuccaguguucaguaaauagcagcuaugugugugcaaaauaaaagaaugauuucagaaaua

SEQ ID NO: 582486 - RNA, 63 nt, hsa
cauaaguucaggauauuucuuuucuauuugguugugcaaaauguuuuucccaguuauuuaauc

SEQ ID NO: 582487 - RNA, 63 nt, hsa
uucuggacguguuuagauaguuuccaccaugaggugcaaaacgagacagaagagugagaagca

SEQ ID NO: 582488 - RNA, 63 nt, hsa
guauugugcuuuuuagaacaaaucuggauaaaugugcaaaaguaccccuuugcacagauaguu

SEQ ID NO: 582489 - RNA, 63 nt, hsa
ucuuuucuuuucuccuaaagcuuuuauuuaacagugcaaaaggaucguuuuuuuuugcuuuuu

SEQ ID NO: 582490 - RNA, 63 nt, hsa
cccauaauaauaacuaacauuuauauuagguuggugcaaaacuaguugcgguuuuucccauua

SEQ ID NO: 582491 - RNA, 63 nt, hsa
guaagcagagauuuaauuuuauauugaaagucagugcaaaauuaugaauaggauauacuaaua

SEQ ID NO: 582492 - RNA, 63 nt, hsa
ugaauuauuuugagauuuuaaagaaguaauuaagugcaaaaugguauauaauguguacuuuuu

SEQ ID NO: 582493 - RNA, 63 nt, hsa
caauugcuuucugauaucagcucguuugauuuagugcaaaaauguuuucaagacuauuuaaug

SEQ ID NO: 582494 - RNA, 63 nt, hsa
auaaaaugaaugaauuacaaugaacaaagaaaagugcaaaauaacacuaacaaguaaauauua

SEQ ID NO: 582495 - RNA, 63 nt, hsa
uaauaugcuguuuacauuuauuuucuucagccugugcaaaacaaagcaauggaaaaggaaacu

SEQ ID NO: 582496 - RNA, 63 nt, hsa
aauaaaaauuuaauucugguuuuucugauuagagugcaaaagugagaaaaguucaauacucuu

SEQ ID NO: 582497 - RNA, 63 nt, hsa
auuuaauuacauacacagugaauugaaaccauugugcaaaauggauuacacauguauacaaag

SEQ ID NO: 582498 - RNA, 63 nt, hsa
caugauauguacuauagugauucuguuuuugaggugcaaaaaacauacauauauaccaguugg

SEQ ID NO: 582499 - RNA, 63 nt, hsa
aaggagaugcuuauagaugauaguuguacauaugugcaaaaaaaaauccacuugcaaugguaa

SEQ ID NO: 582500 - RNA, 63 nt, hsa
aauucuguaugaacaccuggaagcaaaaucauagugcaaaaauacauuuaagguguggucaaa

SEQ ID NO: 582501 - RNA, 63 nt, hsa
gggggaggguauuucuggaaaguggaccagcaugugcaaaaauauggaacugagcacgggugc

SEQ ID NO: 582502 - RNA, 63 nt, hsa
uuagcacuaauguucaccucguauuuuuuggaagugcaaaaaucucaauuugugucuguuuac

SEQ ID NO: 582503 - RNA, 63 nt, hsa
gcuuuuaucuucucugcaguguuauauguuggugugcaaaaauguuaaauuuauuuuuccuaa

SEQ ID NO: 582504 - RNA, 52 nt, hsa
aucguucuccugacacguaacagugcaaaaacuuucaugccuuuuuuuuuuu

SEQ ID NO: 582505 - RNA, 63 nt, hsa
uagcuccagagagugucaaacccagagaaaugugugcaaaaaugauacucuuuucugcauuag

SEQ ID NO: 582506 - RNA, 63 nt, hsa
uuaauuuauuuacgauaucuagagcuguguuuugugcaaaaacuuagugaugaaagccugucu

SEQ ID NO: 582507 - RNA, 63 nt, hsa
uauuucccuaaaaguaucuccauggaaugaacugugcaaaaucuguaggaaacugaaugguuu

SEQ ID NO: 582508 - RNA, 63 nt, hsa
auccaaauuucucauguuccuuuugaaauuguagugcaaaauggucaguauuaucuaaaugaa

SEQ ID NO: 582509 - RNA, 63 nt, hsa
auuguauuuguugccuuuuuuauauuagaugaggugcaaaaauuuuaaugcuagucaguaugc

SEQ ID NO: 582510 - RNA, 63 nt, hsa
cugaaaggcaugugaagggaaggaagaggaagagugcaaaacauugaagagagagcugaguga

SEQ ID NO: 582511 - RNA, 63 nt, hsa
uucuacccugcagagugugguuuugggagagaagugcaaaaucccacgacaggugaguugaag

SEQ ID NO: 582512 - RNA, 63 nt, hsa
uugggagccaggaugagugucgggcucucgugugugcaaaaggucagaugugacugcugcugu

SEQ ID NO: 582513 - RNA, 63 nt, hsa
gccuagguaaauguaagauagaauuaaauggcagugcaaaauuucugagucuuuacaacauac

SEQ ID NO: 582514 - RNA, 63 nt, hsa
auuaaaaaggcuaguggcuguguagcauccucagugcaaaacccagcuccagaauuuucaccu

SEQ ID NO: 582515 - RNA, 63 nt, hsa
agccagaauguuuccuguggaaauaugcaaccugugcaaaauaaaaugaguuaccucaugccg

SEQ ID NO: 582516 - RNA, 63 nt, hsa
ggguucagagcaguguccuccugggguucccacgugcaaaaucaacaucaggaacccagcuuc

SEQ ID NO: 582517 - RNA, 63 nt, hsa
auauaagacuacuggcuuugugagggaauguuugugcaaaauuuuuuccucuaauguauaaua

SEQ ID NO: 582518 - RNA, 63 nt, hsa
ucaaaccaauucacccagaaaaaagaccaauaggugcaaaaauaaaaggaaaaccagugaagu

SEQ ID NO: 582519 - RNA, 63 nt, hsa
caggcauaaauuagagaaaugguucuggauauggugcaaaaaugaguuuucaccugguaucca

SEQ ID NO: 582520 - RNA, 63 nt, hsa
acaggccugcuuuuugcuuauaauugacaacaugugcaaaaauaccaaauuuguguccugugc

SEQ ID NO: 582521 - RNA, 63 nt, hsa
ccuugcucuguuuuugcuuuugugcuuaggcaagugcaaaauacucuauggaaaucauaauug

SEQ ID NO: 582522 - RNA, 63 nt, hsa
uucucgcuuuggaaaaagacggccaucccuuuugugcaaaacaaauguaaauauuuucuugag

SEQ ID NO: 582523 - RNA, 63 nt, hsa
aacaugcaauuagccuuuugaaauccaacuucugugcaaaauuuuaguaucagaaaauacgag

SEQ ID NO: 582524 - RNA, 63 nt, hsa
accauaggcguuuuguucauaugagccugguuugugcaaaauuaaaucagaggcuucuacaac

SEQ ID NO: 582525 - RNA, 53 nt, hsa
acucuucgaagagggauuaaaaggugcaaaaagacaacuaaaauacccauuug

SEQ ID NO: 582526 - RNA, 63 nt, hsa
cgccccagggguuggcccaugcuuucccuaacugugcaaaaaugguuugggauaggcugggug

SEQ ID NO: 582527 - RNA, 63 nt, hsa
gaaaagagugaggaacagaauguuuuaaaucuggugcaaaagaacuauaucugcuggaugagc

SEQ ID NO: 582528 - RNA, 63 nt, hsa
cagaccuuuucuuuuuuuuuuuuuuuuuaaugugugcaaaagcccaaagguuccuaagccugg

SEQ ID NO: 582529 - RNA, 63 nt, hsa
uauaguaucuauaaauuaacaagaaguaugcaggugcaaaaaagugguggaacaaauaccaac

SEQ ID NO: 582530 - RNA, 63 nt, hsa
acuaaucuaccugagccagaagauugaguuugagugcaaaauauucccgcucauuucucaguc

SEQ ID NO: 582531 - RNA, 63 nt, hsa
aaucugcacccucuggagggcaucuguacuccugugcaaaaugcccaguccagagacaaaacc

SEQ ID NO: 582532 - RNA, 63 nt, hsa
aguuauuguuguugccucuaacauguauaaagggugcaaaaauuguagaauaaauguauaagg

SEQ ID NO: 582533 - RNA, 63 nt, hsa
uacucaauuuuauguuuccuuuuggcauucuuugugcaaaaagaagcaugugguggcucucau

SEQ ID NO: 582534 - RNA, 63 nt, hsa
caaaccuugggaagauguaucaauggagcaugugugcaaaaaaauguaagaggaaaaaaagua

SEQ ID NO: 582535 - RNA, 63 nt, hsa
guggaacucuccauuuuccuaaauguuagguuggugcaaaacuaaucgugguuuuugccauuu

SEQ ID NO: 582536 - RNA, 63 nt, hsa
uaaugccgagcuacccgcagugcugagccagccgugcaaaaggaaaucuucaggaggggacuu

SEQ ID NO: 582537 - RNA, 63 nt, hsa
cauuguggcugguuucuugaacacauucuaacugugcaaaauuaucuuggccuuggccgugua

SEQ ID NO: 582538 - RNA, 63 nt, hsa
acucgauuuaaacuccagcauuuagauaaucuugugcaaaauguguuucagccguauagugga

SEQ ID NO: 582539 - RNA, 63 nt, hsa
gugcuuucauccaugaaaucuccaauucaguaagugcaaaagagaauuggugugcaucugaga

SEQ ID NO: 582540 - RNA, 63 nt, hsa
agauguuccuagacauuuucuuuaugguuccaagugcaaaacagguguucuuaucuaaaacgu

SEQ ID NO: 582541 - RNA, 63 nt, hsa
uccuauucccuuccucccauuuuuuuccugcuagugcaaaagguagaugaguaggaagauuag

SEQ ID NO: 582542 - RNA, 63 nt, hsa
auaucugccgggacccaccaggucagagguggagugcaaaauaucguuaugauaaggaguggu

SEQ ID NO: 582543 - RNA, 63 nt, hsa
ggccuuauauuuugauguaaagauuaaaagaaugugcaaaacagucagaaauuuuuauugccu

SEQ ID NO: 582544 - RNA, 63 nt, hsa
uauucauagaccuugacuggaauauguaagacugugcaaaaaaaaaaaaaaaauuuaugugua

SEQ ID NO: 582545 - RNA, 63 nt, hsa
uaauuuuugaaaauuaauuaaagaugggaauaagugcaaaagaggauucuuacaaauucauua

SEQ ID NO: 582546 - RNA, 63 nt, hsa
uuucuugcuuuguuuucccuggcuaacagucuagugcaaaagauuaagauuuuaucuggggga

SEQ ID NO: 582547 - RNA, 63 nt, hsa
gacaguguggagaaaccaacaggcaaaacgugggugcaaaagugaugagaccccacacuuuac

SEQ ID NO: 582548 - RNA, 63 nt, hsa
uauuuuuaaaaucagaauuauugauacccuguagugcaaaaugucaauuuuuaauguauaauc

SEQ ID NO: 582549 - RNA, 63 nt, hsa
aaguagcauuuuuuuucccucuccugugaaucugugcaaaacauugaagguagaaguuuucuu

SEQ ID NO: 582550 - RNA, 63 nt, hsa
ucucccugugcgccugagcagaucaauccaccagugcaaaacagggcuaacggcaccugcagg

SEQ ID NO: 582551 - RNA, 63 nt, hsa
acaaccagaaguacacauuuacaauagauagaugugcaaaagaccuuuuuguagccaaacaag

SEQ ID NO: 582552 - RNA, 63 nt, hsa
uccuuggagcuggaaguauuauuccuaagucuagugcaaaaugcuucuacucucugugucuuc

SEQ ID NO: 582553 - RNA, 63 nt, hsa
ugaagccuugaauuuugaaaaaaagacaagaaggugcaaaagucuuuaauccuggcagggauu

SEQ ID NO: 582554 - RNA, 63 nt, hsa
gugagcucucaggccgagagccuuauuuaccuagugcaaaaacuguaaaaguguacagacucu

SEQ ID NO: 582555 - RNA, 63 nt, hsa
ggugcagguacucuuggggccccagcggugggagugcaaaagacccaacgccaacaccuggug

SEQ ID NO: 582556 - RNA, 63 nt, hsa
uccuuggaacuggaaguauuauuccuaagucuagugcaaaaugcuucuacucucugugucuuc

SEQ ID NO: 582557 - RNA, 63 nt, hsa
uuaaauuuuauuuuggaaaauaaauuauuuuuggugcaaaagucaacauggcaguuuuaauuu

SEQ ID NO: 582558 - RNA, 63 nt, hsa
ucaggggacugguagucacccaaucuuggagaggugcaaaaagcacugggggcuacccguuag

SEQ ID NO: 582559 - RNA, 63 nt, hsa
aaaaguggcacauuuaaaaauuuaaaaauugaagugcaaaaaaaauuuuuuagcaauuuuugu

SEQ ID NO: 582560 - RNA, 63 nt, hsa
agugcuaggacagcucuaaacagugagcucgaugugcaaaacgcaguccaugaaaaccagaaa

SEQ ID NO: 582561 - RNA, 63 nt, hsa
uuccuuacaaacaggguugggggggggaagggcgugcaaaaacuaacauugaaauuuugaaac

SEQ ID NO: 582562 - RNA, 63 nt, hsa
cugucauauuuacuucuaauucuacucucagaggugcaaaaagauacuuaucuaacuggacac

SEQ ID NO: 582563 - RNA, 63 nt, hsa
ggcaucuucauugagggaaagaaaacagucauugugcaaaauucuguuagucagugauucuuu

SEQ ID NO: 582564 - RNA, 63 nt, hsa
gaaaaagucgcugagucguuucuaguugugaaggugcaaaagaugcaguuaucccuuauggaa

SEQ ID NO: 582565 - RNA, 63 nt, hsa
cuguacuuugggaagucacagaaauacauuuuugugcaaaauggaaaacagagcgucuuuuuu

SEQ ID NO: 582566 - RNA, 63 nt, hsa
uaggaagugugaaguuuuguguguaugauuucugugcaaaaacaaaagcaacacuccugaguc

SEQ ID NO: 582567 - RNA, 63 nt, hsa
cuuuuccugaauuggaaaggaaaagaggcccaagugcaaaagaaaaaacauuuuagaaacgga

SEQ ID NO: 582568 - RNA, 63 nt, hsa
cacaugcuguuuuaccuuccaagaauaggacaugugcaaaaacuaggcuuccagaucgugagg

SEQ ID NO: 582569 - RNA, 63 nt, hsa
cauagcgguuuaccuaaaaguaaccaucagucagugcaaaaugugccugguucuuaagacaac

SEQ ID NO: 582570 - RNA, 63 nt, hsa
ggaagcccacaaccgcuaacacuuacaauuuuggugcaaaagcaaacaguuccagcaggcucu

SEQ ID NO: 582571 - RNA, 63 nt, hsa
aacaucuuguugcacgcauuugaggucaucagggugcaaaauuuguauuccugaaaaugucau

SEQ ID NO: 582572 - RNA, 63 nt, hsa
aaaaucccaggggcaaaauaaaguucaacaaaagugcaaaauaugacaaaaauagguacauuu

SEQ ID NO: 582573 - RNA, 63 nt, hsa
aauauguugcaaccacccaauucugccauuguagugcaaaagcagccauagacaacacauaca

SEQ ID NO: 582574 - RNA, 63 nt, hsa
uuuuucauugugaucagauuaaaauuacuauuugugcaaaacaaauuccacaccacauguacu

SEQ ID NO: 582575 - RNA, 63 nt, hsa
auguauguguaaaacaaucuguuuuggcuuuaugugcaaaaucuguuauagcuuuaaaauaua

SEQ ID NO: 582576 - RNA, 63 nt, hsa
agacuuauaacagcauagugaaugguaagacuagugcaaaacaguuauuucugaaaauuaaag

SEQ ID NO: 582577 - RNA, 63 nt, hsa
uaguaucuguuuuauuugacugcagucuccuuggugcaaaaacaaaaugggaaaaauaaggau

SEQ ID NO: 582578 - RNA, 63 nt, hsa
uuuguaaaaucagcaaaggcaguguuucaaaaagugcaaaaaaaaagauucuguuauaaagug

SEQ ID NO: 582579 - RNA, 63 nt, hsa
gucucaaauuuuauucuguagcauggagaaugggugcaaaaagcugacuucuguauccccaca

SEQ ID NO: 582580 - RNA, 63 nt, hsa
ucuuaaaauagaguuugaacaaauauuuuaaaggugcaaaauaccauuagaaaauacuauuug

SEQ ID NO: 582581 - RNA, 63 nt, hsa
aauauaacuuuggaguuauaacuauucaguuuagugcaaaagcauuaaacuauuuguguuuuu

SEQ ID NO: 582582 - RNA, 63 nt, hsa
ccucucugcccauuacagcuucuagccuguguugugcaaaagaauuggaaggauguggugugu

SEQ ID NO: 582583 - RNA, 63 nt, hsa
uauagucaaauguacuguaaagugaaaagggaugugcaaaaaaauaaaaaaaaacaacaaaaa

SEQ ID NO: 582584 - RNA, 63 nt, hsa
acucaguuauuuuuaaugcuuaauacauacauggugcaaaauuuaaaaagcgcaaauagguau

SEQ ID NO: 582585 - RNA, 63 nt, hsa
accucucccaaauugggaagaccagaggagaaagugcaaaacuguccccauuuggaaugccca

SEQ ID NO: 582586 - RNA, 63 nt, hsa
cgugucuccagauauugucaaauaucccaucgggugcaaaaugaucccuggucaagaucuguu

SEQ ID NO: 582587 - RNA, 63 nt, hsa
cgauaaucauugcauagugacugaaaagccuaagugcaaaaaaaaaaaaaaaagauguucuug

SEQ ID NO: 582588 - RNA, 63 nt, hsa
ggagcccggaaccguuagguacugccgaaugcggugcaaaauuucccccucucccccaguucg

SEQ ID NO: 582589 - RNA, 63 nt, hsa
ugaguucuuucagggaaccaaacccagaauucggugcaaaagccaaacaucuuggugggauuu

SEQ ID NO: 582590 - RNA, 63 nt, hsa
uauaacaaagcaguuacgaagccuacagauuuugugcaaaauaaaauacaaacaaggugaauu

SEQ ID NO: 582591 - RNA, 63 nt, hsa
caccuguggcacggaaugaaaacagagcuucccgugcaaaaagggucacgccucccacccccg

SEQ ID NO: 582592 - RNA, 63 nt, hsa
aaccccuucuuuguagaacugcccauuuccauggugcaaaaacucuuauggccaaauucaaac

SEQ ID NO: 582593 - RNA, 63 nt, hsa
agacugaaacucaaacaacccugggcaaguaaugugcaaaagauggcaggguggggauuugaa

SEQ ID NO: 582594 - RNA, 63 nt, hsa
gauuuuuaccuggaaauuccaugaccaauacaugugcaaaagaaaaugauggguugaauuuac

SEQ ID NO: 582595 - RNA, 63 nt, hsa
uuauauaaaauguuuaaucucugcugaaacucagugcaaaaaaaagaaaaaagaaaaaaaaaa

SEQ ID NO: 582596 - RNA, 63 nt, hsa
agcugacuaaagaaccagccaaagccuuaaauugugcaaaacauacuguugcuaugauguaac

SEQ ID NO: 582597 - RNA, 63 nt, hsa
uucucaguagaaaggaacagaaaacaaacaucugugcaaaacccuauaaaagugauauuccua

SEQ ID NO: 582598 - RNA, 63 nt, hsa
aguauccaaggcaaacucuaauacccauccauugugcaaaaccacaagcacgcaaguauuaaa

SEQ ID NO: 582599 - RNA, 63 nt, hsa
aaguguagucauuauuguuguauugggugaugugugcaaaacugcagaagcucacugccuaua

SEQ ID NO: 582600 - RNA, 63 nt, hsa
uucauuaucacaugauuauagaaggcugucuuagugcaaaaaacauacuuacauuucagacau

SEQ ID NO: 582601 - RNA, 63 nt, hsa
aauuuauucucuucagagagaaauauuagguuagugcaaaaguaauugugguuuuugccauug

SEQ ID NO: 582602 - RNA, 63 nt, hsa
uguagauauuguaaagcuuuuugugaauuaaaagugcaaaauaaagcaaccacauuuaaguag

SEQ ID NO: 582603 - RNA, 63 nt, hsa
auuaaauauuuuaucugcuuuuacaagcgcaaggugcaaaaauauauacaauagucucauuga

SEQ ID NO: 582604 - RNA, 63 nt, hsa
accaucuucuuuguuugugguacaauauuuucagugcaaaagagaugucauucaguuaaaaag

SEQ ID NO: 582605 - RNA, 63 nt, hsa
acugaaucugcuuguugaucaguguugaagaaagugcaaaaggaacuuuuauauauuugacag

SEQ ID NO: 582606 - RNA, 63 nt, hsa
caaggaccugaauucuguuuacuucuucuggcugugcaaaagcacacucaagugaaugacuaa

SEQ ID NO: 582607 - RNA, 63 nt, hsa
gggaccugagucaaugcgcaaaaugcagcuugugugcaaaagcagugggcuccuggcagaagg

SEQ ID NO: 582608 - RNA, 63 nt, hsa
ggggaauacuucaugcaaagaaaaaaguaacaugugcaaaagcuccccguccagcuuugacag

SEQ ID NO: 582609 - RNA, 63 nt, hsa
caaaugucugaagccaguuaguuugauuacccugugcaaaaccuuggacauacuucugcuauu

SEQ ID NO: 582610 - RNA, 63 nt, hsa
uaccugcucguucccaauguaucuuaaugaaaagugcaaaagaaaaaccuaccaauuaacuug

SEQ ID NO: 582611 - RNA, 63 nt, hsa
uugguugaauuuguucaguauaagcucguucuugugcaaaauuaaauaaauauuucucuuacc

SEQ ID NO: 582612 - RNA, 63 nt, hsa
guguuauuuauuuuguuccugaaaugggauuuagugcaaaaaguuuacaacuacagucuuuaa

SEQ ID NO: 582613 - RNA, 63 nt, hsa
uuuaguguuuuuuuauuucuacugucaaaugaugugcaaaaccuuuuacugguugcauggaaa

SEQ ID NO: 582614 - RNA, 63 nt, hsa
uaagaaaagcuggugacauauuuauacguuuuugugcaaaaauaaaugaauggcaauagauuu

SEQ ID NO: 582615 - RNA, 63 nt, hsa
ucaaaucuaguuauguauuggccuaaauuauuugugcaaaauuugaaauguuuuuuauuuaaa

SEQ ID NO: 582616 - RNA, 63 nt, hsa
aaguuaauagauuuuuucagacuugucaagccugugcaaaaaaauuaaaauggaugccuugaa

SEQ ID NO: 582617 - RNA, 63 nt, hsa
auggguuaggcauuaauguuucuaucugauuuugugcaaaagcuucaaauuaaaacagcugca

SEQ ID NO: 582618 - RNA, 63 nt, hsa
ucuuuuaggcauuuaaauuguuucuguuacucugugcaaaauaacuuugagauuggacaagaa

SEQ ID NO: 582619 - RNA, 63 nt, hsa
gcauauagcauaugugucauuacaugugaugcugugcaaaacuuuguauaauucuguguuauu

SEQ ID NO: 582620 - RNA, 63 nt, hsa
uugugauuguuaaaacuuguuuguaauggguuggugcaaaaguaauugugguuuuuccauuac

SEQ ID NO: 582621 - RNA, 63 nt, hsa
uugaugucacauucugacacaagaugcaagucugugcaaaacccaccaaaaugcuccuaucca

SEQ ID NO: 582622 - RNA, 63 nt, hsa
aguucucaggggagaacugggaauggggccagggugcaaaaaugcuuugcccaucuguaggua

SEQ ID NO: 582623 - RNA, 63 nt, hsa
auuaacuuuuuuccuuuuaccaauaacuuugaggugcaaaacucaaacuuaugugggucuuuu

SEQ ID NO: 582624 - RNA, 63 nt, hsa
ggucauuugugagcacaagaucucauagggcaggugcaaaauaggaauguuguucucaagugu

SEQ ID NO: 582625 - RNA, 63 nt, hsa
uccuccauuaucagccagaagugcaacauguaugugcaaaagcuaaaauggcuuaacaucaug

SEQ ID NO: 582626 - RNA, 63 nt, hsa
gugguuuuguguuuguuguuuuguguuuuuuuagugcaaaagguuuaaauuuauaguugugaa

SEQ ID NO: 582627 - RNA, 63 nt, hsa
uuauuucauuuuucaugcacaaccuuucccccagugcaaaagacuguuacuuuauuauuguau

SEQ ID NO: 582628 - RNA, 63 nt, hsa
acguuccugagcauccaagaugaacauuuuguagugcaaaaagacuuuugugaaaagcugaua

SEQ ID NO: 582629 - RNA, 63 nt, hsa
uuguuuccugcaguaaagaaaaauucuucauuugugcaaaauuugaacaaagaggaaaucauc

SEQ ID NO: 582630 - RNA, 63 nt, hsa
gcguugcagucacucgguuaucuaugaaggguugugcaaaacaggaaggucugggaaugacca

SEQ ID NO: 582631 - RNA, 63 nt, hsa
cagcuauuuuucugaucuuauucaacuuuaguugugcaaaagaaauucuaagugaaugcgcgu

SEQ ID NO: 582632 - RNA, 63 nt, hsa
agugguaaagaaacagguuguucacuugcugaggugcaaaaauucuuaagacuucuguuugaa

SEQ ID NO: 582633 - RNA, 63 nt, hsa
cuauucaccuuuuguuuaugaauggaaagcuuugugcaaaauauacauauaagcagaguaagc

SEQ ID NO: 582634 - RNA, 63 nt, hsa
agacagaucagacugauaaccuuaacaccauaggugcaaaaugaguuguucugagguuuuuuu

SEQ ID NO: 582635 - RNA, 63 nt, hsa
uucauccacgaaccauccagcgcacagaagcaagugcaaaaaugacacaagcacaacucucca

SEQ ID NO: 582636 - RNA, 63 nt, hsa
auuuuuagaucuggccuuuucuuaacaaaaucugugcaaaagaugcagguggaugucccuagg

SEQ ID NO: 582637 - RNA, 63 nt, hsa
ccuguucccuacaaugggaaaugucacaagaaugugcaaaaauaaaaaucugaggaaaaaacc

SEQ ID NO: 582638 - RNA, 63 nt, hsa
aacaaaaaagccccacacauaacuguuuugcacgugcaaaaauguauugggucaagaagugau

SEQ ID NO: 582639 - RNA, 63 nt, hsa
auuacugcuguucuagcccccaaagaguuuucugugcaaaaucuugagaaucaaucaauaaag

SEQ ID NO: 582640 - RNA, 63 nt, hsa
uuccccauccuuuuuuucccuuagcacuauucagugcaaaaagugaaaaagguugguaaaaua

SEQ ID NO: 582641 - RNA, 63 nt, hsa
agaaccucuuuggcaaauauggaaagguucugagugcaaaaguaguuacaaaugcucgaaguc

SEQ ID NO: 582642 - RNA, 63 nt, hsa
ucauuuuugaauuccaucagccuuuguaugugagugcaaaacauuuuaacaguuuucucaaau

SEQ ID NO: 582643 - RNA, 63 nt, hsa
gacuguuugaaucuugucucacuaguuuuuccugugcaaaaauaaaauggacagaauugcagc

SEQ ID NO: 582644 - RNA, 63 nt, hsa
ccccugacuucuggaggcuucccuugaagcucugugcaaaaggugggagacagagcuggaccu

SEQ ID NO: 582645 - RNA, 63 nt, hsa
ucuccaugauuuucaaaauugauucccuuuaaagugcaaaauggucaccuucuaaaagauaua

SEQ ID NO: 582646 - RNA, 63 nt, hsa
acagacuguuccuuuaccaauauguaaaagaaugugcaaaauuaguaaaaauauacccaaaaa

SEQ ID NO: 582647 - RNA, 63 nt, hsa
gggaacggugaucuucuugaaugauguuucagugugcaaaaacuauagagccugucagcacca

SEQ ID NO: 582648 - RNA, 63 nt, hsa
gcaaaauguuuggauguaauguuaaagcgcaaugugcaaaauuuaaaauaaagaauauuuauu

SEQ ID NO: 582649 - RNA, 63 nt, hsa
cuuuggcaccuugguaggugcaggaggagcucagugcaaaaaucacuuuggggccucauuaac

SEQ ID NO: 582650 - RNA, 63 nt, hsa
ucagacugcaagugagcaaaccugccccaucccgugcaaaacaugcuaccugaucccacuccu

SEQ ID NO: 582651 - RNA, 63 nt, hsa
cuugaaaaggacugaaucgccacuacagccugggugcaaaaucagcaagaaacauugaguauu

SEQ ID NO: 582652 - RNA, 63 nt, hsa
gcuguuuaggaaacugcagcugcacaacguggggugcaaaacugccccgcuuccuuuacagcu

SEQ ID NO: 582653 - RNA, 63 nt, hsa
aaauaaacguggauuuuaaaaaaucaaucaauggugcaaaaaaaaacuuaaagcaaaauagua

SEQ ID NO: 582654 - RNA, 63 nt, hsa
ugugugccucauaagggcuauucuuucuuucacgugcaaaacauuuuucugaaauagcaaaca

SEQ ID NO: 582655 - RNA, 63 nt, hsa
aaccauacauugucccaaaagugucugugcauugugcaaaaaguaaacuuaggaaacauuugg

SEQ ID NO: 582656 - RNA, 63 nt, hsa
uucccaaagaaauuuuauuuucacguagcugaagugcaaaacauagaugaccauuuuuaauaa

SEQ ID NO: 582657 - RNA, 63 nt, hsa
ucuugauguaaugaaaugcaauuuuaugguuuggugcaaaaacuccuauuuuccaguaaauua

SEQ ID NO: 582658 - RNA, 63 nt, hsa
gcgguaggaaccccggcccucgcucugcagcuggugcaaaagcuguggcugccaggucugggc

SEQ ID NO: 582659 - RNA, 63 nt, hsa
gccacagacagaagcuguggugguuuuuacuuugugcaaaaaggcagugaguuucgugaagcc

SEQ ID NO: 582660 - RNA, 63 nt, hsa
ucugggaguauacggaaacaaaaaugauccucagugcaaaaugucuuguguauuucucuguga

SEQ ID NO: 582661 - RNA, 63 nt, hsa
ccaaguucauuguuaacuuugcauuugcaauuggugcaaaaauacagauuucugucgucugaa

SEQ ID NO: 582662 - RNA, 63 nt, hsa
uugauacuguacacauggaugucuuguuucuaugugcaaaaaaaaaaaaaaaaaaaaguuugu

SEQ ID NO: 582663 - RNA, 63 nt, hsa
ccaggcuggaccugcccuguccucagcacgcgugugcaaaagugaacaauaaaucauuucaaa

SEQ ID NO: 582664 - RNA, 63 nt, hsa
cauaccacaaagccaagacguuccaugguauuugugcaaaagagaugaagacuucucaauaug

SEQ ID NO: 582665 - RNA, 63 nt, hsa
gcugugguaucuuuuauaaaaccucuugcuugugugcaaaaguuccuaaaaggaaacacaagu

SEQ ID NO: 582666 - RNA, 63 nt, hsa
aguugggauuuuugcacucagugaaaagcugaagugcaaaagagcuaucaaagacaagaggau

SEQ ID NO: 582667 - RNA, 63 nt, hsa
aucaguucuacggaucaucaacaagauuuccuugugcaaaauauuugacuauucuguaucuuu

SEQ ID NO: 582668 - RNA, 63 nt, hsa
cgguggugaaaaggggacaguuuuuacccuaaagugcaaaagugaaacauacaaaauaagacu

SEQ ID NO: 582669 - RNA, 63 nt, hsa
aguaaaaauuaggugugaaaauaggaaaauacagugcaaaauguguuaagggauuauaggacu

SEQ ID NO: 582670 - RNA, 63 nt, hsa
aaauuacauaagggacuuuuugccugcauucuagugcaaaacaucugaagagcuguacaccca

SEQ ID NO: 582671 - RNA, 63 nt, hsa
aaaacaaucccaugcuagaguugccauuaagcagugcaaaauuaaucggcuguaugguagauu

SEQ ID NO: 582672 - RNA, 63 nt, hsa
gccuuugcaaagugauagaaaagaucugaccaagugcaaaaaaaugcuuuuuaaaauuuuuac

SEQ ID NO: 582673 - RNA, 63 nt, hsa
uuuggcuaagcaucaaaaucaccuagggagucggugcaaaacaaaauaucccaguccccuccc

SEQ ID NO: 582674 - RNA, 63 nt, hsa
agaggaagccucugugagcucgcaccuuacugggugcaaaagaauccacggaacuugggagaa

SEQ ID NO: 582675 - RNA, 63 nt, hsa
acacuagggagaaacccuaucaauguaagcaaugugcaaaagccuuuauuucuuccacuucuu

SEQ ID NO: 582676 - RNA, 63 nt, hsa
aggaucacuugaggucaggaguuugagaccagugugcaaaacauagcaagaccucaucucaga

SEQ ID NO: 582677 - RNA, 63 nt, hsa
caugagguuacagcaagaagucagcagucuacagugcaaaagagggccuucaccagaacccaa

SEQ ID NO: 582678 - RNA, 63 nt, hsa
uguuugaguggauaauggaaacugaaaggugacgugcaaaacugccuauuacucccaggagug

SEQ ID NO: 582679 - RNA, 63 nt, hsa
cccuacuacucaggguugaugagaagauuaaaugugcaaaaccugcuugacugugcccacaaa

SEQ ID NO: 582680 - RNA, 63 nt, hsa
gguagauaaauucacgaagaugaggagaaaccagugcaaaaagccugaaaauuccaaaaacca

SEQ ID NO: 582681 - RNA, 63 nt, hsa
uaauugagagccgcucucuguaaguguuugcuugugcaaaagggaauagugccguggaggugu

SEQ ID NO: 582682 - RNA, 63 nt, hsa
aaauuaccuagucucagguaguucuuuauagcagugcaaaaauggacguaauaagucuuaugu

SEQ ID NO: 582683 - RNA, 63 nt, hsa
ccagcucucaggguugacucuguuccauccucugugcaaaauccucccgugcuucccuuuggc

SEQ ID NO: 582684 - RNA, 63 nt, hsa
cuguggaaaacuguucuugggacugucucaacugugcaaaaaacaaaagauggaguguuuaca

SEQ ID NO: 582685 - RNA, 63 nt, hsa
agcccuagcccuagauagauagcuauuagguuggugcaaaaguaauugugguuuuugccauaa

SEQ ID NO: 582686 - RNA, 63 nt, hsa
caguuuucaccuagccagucuugagucuucuccgugcaaaaaggauucacagaaauggaccag

SEQ ID NO: 582687 - RNA, 63 nt, hsa
aaagagcaacuugaugguuuuuuuuaauacugagugcaaaaggucacccaaauuccuaugaug

SEQ ID NO: 582688 - RNA, 63 nt, hsa
gguuccuuaauggcacuuuaaccaguuaacuuggugcaaaacuuuugauucucuuuuguagcu

SEQ ID NO: 582689 - RNA, 63 nt, hsa
ugauuuuacccaagccuaaguauuaaaguauaugugcaaaaacaguugugagccauucuauua

SEQ ID NO: 582690 - RNA, 63 nt, hsa
caggagcggccugcccagugucacccagggugagugcaaaauaaagacggcgaguguggcucu

SEQ ID NO: 582691 - RNA, 63 nt, hsa
caauguaauguauauuguauugaaauuuacagugugcaaaaguauuuuaccuuugcauaagug

SEQ ID NO: 582692 - RNA, 63 nt, hsa
augaaccuuccaccgucuucacugcauccuggagugcaaaaauaaaauccacucaagagucac

SEQ ID NO: 582693 - RNA, 63 nt, hsa
auuucucuaacuuaacauguugagucucugagagugcaaaacuugaaacaagagaaaguggcc

SEQ ID NO: 582694 - RNA, 63 nt, hsa
aaguucacuuuuuuuguucuaggggaaaugaaugugcaaaaaaagaaaaagaacuguugguua

SEQ ID NO: 582695 - RNA, 63 nt, hsa
uucagugaacucuguaugaaugcaguagugugugugcaaaauccgcuuccugagcguagggug

SEQ ID NO: 582696 - RNA, 63 nt, hsa
uagcugaugagcuaaaacaaaaaacaaugguuugugcaaaaaucucauaauguuuuaauaaag

SEQ ID NO: 582697 - RNA, 63 nt, hsa
gcagguacccauuuuaggacccuacacucaaaugugcaaaauaaaauuucuaucauuuugcua

SEQ ID NO: 582698 - RNA, 63 nt, hsa
uagucacacacugugaaagugaaaagagaaugugugcaaaacacgucacaguccugguuucug

SEQ ID NO: 582699 - RNA, 63 nt, hsa
aaggcuaguuuuagcuuccuuuguggcucccuggugcaaaacaauuagcaguuaugcaaugga

SEQ ID NO: 582700 - RNA, 63 nt, hsa
ugaagaaaauaaggcugcauuuugaaauguuaagugcaaaaugacugauguuaaaaccaucug

SEQ ID NO: 582701 - RNA, 63 nt, hsa
uguugcuuuuguuaugucaaguugaaagauuuugugcaaaauuaaauaaaugguguuuugggu

SEQ ID NO: 582702 - RNA, 63 nt, hsa
agcuugaugccaguaggcucaacuagggagugagugcaaaaagcugaguauggugagagaagc

SEQ ID NO: 582703 - RNA, 63 nt, hsa
uccugcauggaccuuucccaagcgcuagcacaggugcaaaauccaucagagccauuguuuuca

SEQ ID NO: 582704 - RNA, 63 nt, hsa
uuuuugugugaaguaaauuaaucaacuagagaggugcaaaacguucucaguugauaucugagu

SEQ ID NO: 582705 - RNA, 63 nt, hsa
ucuaacagauuuuccaucaacaaauauuguuaugugcaaaaguauugccuauguuguuuuaca

SEQ ID NO: 582706 - RNA, 63 nt, hsa
uuaccagcuccuaccaguccagugugcuuauaagugcaaaagaaaguaaaggcaaccccagau

SEQ ID NO: 582707 - RNA, 63 nt, hsa
guauauagguguacuuugcuucucacaaugauugugcaaaaagucacguguaaauugaacuuu

SEQ ID NO: 582708 - RNA, 63 nt, hsa
uggccucgcugaugucugauaaguauugucagugugcaaaaggcuuuacuucagaaugguuua

SEQ ID NO: 582709 - RNA, 63 nt, hsa
uuucaacgccugccuuuggcacucugacuuaaagugcaaaaagcuucuguggcgaggcaugcu

SEQ ID NO: 582710 - RNA, 63 nt, hsa
gagcacugccuauuugguauccaguuucugaaugugcaaaaugguuaacguccaaaacgcuua

SEQ ID NO: 582711 - RNA, 63 nt, hsa
gugccgcuggaauuggcuugugggucacuuguugugcaaaagugaauuaauuucaaauaggaa

SEQ ID NO: 582712 - RNA, 63 nt, hsa
gaauuuaaaacuguuauuuuuacagcaaaagaugugcaaaaucacuggauuauaaguucuauu

SEQ ID NO: 582713 - RNA, 64 nt, hsa; identical to SEQ ID NO: 312521

SEQ ID NO: 582714 - RNA, 64 nt, hsa; identical to SEQ ID NO: 312522

SEQ ID NO: 582715 - RNA, 64 nt, hsa; identical to SEQ ID NO: 312523

SEQ ID NO: 582716 - RNA, 64 nt, hsa; identical to SEQ ID NO: 312524

SEQ ID NO: 582717 - RNA, 64 nt, hsa; identical to SEQ ID NO: 312525

SEQ ID NO: 582718 - RNA, 64 nt, hsa; identical to SEQ ID NO: 312526

SEQ ID NO: 582719 - RNA, 64 nt, hsa; identical to SEQ ID NO: 312527

SEQ ID NO: 582720 - RNA, 64 nt, hsa; identical to SEQ ID NO: 312528

SEQ ID NO: 582721 - RNA, 64 nt, hsa; identical to SEQ ID NO: 312529

SEQ ID NO: 582722 - RNA, 64 nt, hsa; identical to SEQ ID NO: 312530

SEQ ID NO: 582723 - RNA, 64 nt, hsa; identical to SEQ ID NO: 312531

SEQ ID NO: 582724 - RNA, 64 nt, hsa; identical to SEQ ID NO: 312532

SEQ ID NO: 582725 - RNA, 64 nt, hsa; identical to SEQ ID NO: 312533

SEQ ID NO: 582726 - RNA, 64 nt, hsa; identical to SEQ ID NO: 312534

SEQ ID NO: 582727 - RNA, 64 nt, hsa; identical to SEQ ID NO: 312535

SEQ ID NO: 582728 - RNA, 64 nt, hsa; identical to SEQ ID NO: 312536

SEQ ID NO: 582729 - RNA, 64 nt, hsa; identical to SEQ ID NO: 312537

SEQ ID NO: 582730 - RNA, 64 nt, hsa; identical to SEQ ID NO: 312538

SEQ ID NO: 582731 - RNA, 64 nt, hsa; identical to SEQ ID NO: 312539

SEQ ID NO: 582732 - RNA, 64 nt, hsa; identical to SEQ ID NO: 312540

SEQ ID NO: 582733 - RNA, 64 nt, hsa; identical to SEQ ID NO: 312541

SEQ ID NO: 582734 - RNA, 64 nt, hsa; identical to SEQ ID NO: 312542

SEQ ID NO: 582735 - RNA, 64 nt, hsa; identical to SEQ ID NO: 312543

SEQ ID NO: 582736 - RNA, 64 nt, hsa; identical to SEQ ID NO: 312544

SEQ ID NO: 582737 - RNA, 64 nt, hsa; identical to SEQ ID NO: 312545

SEQ ID NO: 582738 - RNA, 64 nt, hsa; identical to SEQ ID NO: 312546

SEQ ID NO: 582739 - RNA, 64 nt, hsa; identical to SEQ ID NO: 312547

SEQ ID NO: 582740 - RNA, 64 nt, hsa; identical to SEQ ID NO: 312548

SEQ ID NO: 582741 - RNA, 64 nt, hsa; identical to SEQ ID NO: 312549

SEQ ID NO: 582742 - RNA, 64 nt, hsa; identical to SEQ ID NO: 312550

SEQ ID NO: 582743 - RNA, 64 nt, hsa; identical to SEQ ID NO: 312551

SEQ ID NO: 582744 - RNA, 64 nt, hsa; identical to SEQ ID NO: 312552

SEQ ID NO: 582745 - RNA, 64 nt, hsa; identical to SEQ ID NO: 312553

SEQ ID NO: 582746 - RNA, 64 nt, hsa; identical to SEQ ID NO: 312554

SEQ ID NO: 582747 - RNA, 64 nt, hsa; identical to SEQ ID NO: 312555

SEQ ID NO: 582748 - RNA, 64 nt, hsa; identical to SEQ ID NO: 312556

SEQ ID NO: 582749 - RNA, 64 nt, hsa; identical to SEQ ID NO: 312557

SEQ ID NO: 582750 - RNA, 64 nt, hsa; identical to SEQ ID NO: 312558

SEQ ID NO: 582751 - RNA, 64 nt, hsa; identical to SEQ ID NO: 312559

SEQ ID NO: 582752 - RNA, 64 nt, hsa; identical to SEQ ID NO: 312560

SEQ ID NO: 582753 - RNA, 64 nt, hsa; identical to SEQ ID NO: 312561

SEQ ID NO: 582754 - RNA, 64 nt, hsa; identical to SEQ ID NO: 312562

SEQ ID NO: 582755 - RNA, 64 nt, hsa; identical to SEQ ID NO: 312563

SEQ ID NO: 582756 - RNA, 64 nt, hsa; identical to SEQ ID NO: 312564

SEQ ID NO: 582757 - RNA, 64 nt, hsa; identical to SEQ ID NO: 312565

SEQ ID NO: 582758 - RNA, 64 nt, hsa; identical to SEQ ID NO: 312566

SEQ ID NO: 582759 - RNA, 64 nt, hsa; identical to SEQ ID NO: 312567

SEQ ID NO: 582760 - RNA, 64 nt, hsa; identical to SEQ ID NO: 312568

SEQ ID NO: 582761 - RNA, 62 nt, hsa
augauuguaugaaguuuuaaaaaaaacuacagcagccaaagaaacuauauauauauauauau

SEQ ID NO: 582762 - RNA, 62 nt, hsa
ucugggaauaucauagaguaacaagugcuggucagccaaagaaacauucacugcuggugaac

SEQ ID NO: 582763 - RNA, 62 nt, hsa
augcugggauuacaggcaugagccacuguacccagccaaaauuguuuucuuuuuuaagugaa

SEQ ID NO: 582764 - RNA, 62 nt, hsa
gagcuuacagucuguucuggggaacagagauucagccaaagucaagaaacacuggaugccag

SEQ ID NO: 582765 - RNA, 62 nt, hsa
cugguguuauucugucuccucuucuuugucaucagccaaaacgugguuuuuaaagagaguca

SEQ ID NO: 582766 - RNA, 62 nt, hsa
ccuaguguuccuauagugaaauaaguaggguucagccaaagcuuucuuuguuuuguaccuua

SEQ ID NO: 582767 - RNA, 62 nt, hsa
ucacagauggcuucucacagaugcccuccugccagccaaaccggacuuguucuuccugccuc

SEQ ID NO: 582768 - RNA, 62 nt, hsa
gaauuaguguguuauguggauaauguuauauacagccaaaguggauguuucuauuuggcaag

SEQ ID NO: 582769 - RNA, 62 nt, hsa
acgggcagccacaggacugagcccucucacuccagccaaagaaaugggccugccugccucca

SEQ ID NO: 582770 - RNA, 62 nt, hsa
gaagaagugggagcagcuucuugggcugagugcagccaaaggggagccagaaaugggcaguu

SEQ ID NO: 582771 - RNA, 62 nt, hsa
ucacucagauuguccguuugcuaugccgaaugcagccaaaauuccuuuuuacaauuugugau

SEQ ID NO: 582772 - RNA, 62 nt, hsa
uagcggaaacuacuaaauuauuuugggugguucagccaaaccucaaaacaguuaaucucccu

SEQ ID NO: 582773 - RNA, 62 nt, hsa
uccuguagcaguagggcccccagccagcgcuccagccaaagcggcggccccaggguuaauug

SEQ ID NO: 582774 - RNA, 62 nt, hsa
gcggcuggcaggcaggauguuuugaaauggugcagccaaaggccccgucuagcuuggcuggc

SEQ ID NO: 582775 - RNA, 62 nt, hsa
uggggcacccccaaauuugacucugggagacucagccaaauccuaucugguaauaaaauuuc

SEQ ID NO: 582776 - RNA, 62 nt, hsa
uucuuuuuacauaaaggaauuuguaggaaaugcagccaaaggugcagucggaaaagaugcag

SEQ ID NO: 582777 - RNA, 62 nt, hsa
ccuucauggagggugguaacagcaccucaguccagccaaaauguuuagaaacacucagucuc

SEQ ID NO: 582778 - RNA, 62 nt, hsa
ugggcucuguuuaggagggcagugagaccacccagccaaauugcuucucaacccuagacaaa

SEQ ID NO: 582779 - RNA, 62 nt, hsa
gggaucccugcacccaggaggccuccugacaccagccaaaauccugacagcagggucugccc

SEQ ID NO: 582780 - RNA, 62 nt, hsa
ugacucuccuuucugggaugacaucucagaaucagccaaagacuucauccggcaccuucugg

SEQ ID NO: 582781 - RNA, 62 nt, hsa
guggggcugaaggccaggcugagugccugggucagccaaaccccuggcacccccagggugac

SEQ ID NO: 582782 - RNA, 64 nt, hsa; identical to SEQ ID NO: 497835

SEQ ID NO: 582783 - RNA, 64 nt, hsa; identical to SEQ ID NO: 497836

SEQ ID NO: 582784 - RNA, 64 nt, hsa; identical to SEQ ID NO: 497837

SEQ ID NO: 582785 - RNA, 64 nt, hsa; identical to SEQ ID NO: 497838

SEQ ID NO: 582786 - RNA, 64 nt, hsa; identical to SEQ ID NO: 497839

SEQ ID NO: 582787 - RNA, 64 nt, hsa; identical to SEQ ID NO: 497840

SEQ ID NO: 582788 - RNA, 64 nt, hsa; identical to SEQ ID NO: 497841

SEQ ID NO: 582789 - RNA, 64 nt, hsa; identical to SEQ ID NO: 497842

SEQ ID NO: 582790 - RNA, 64 nt, hsa; identical to SEQ ID NO: 497843

SEQ ID NO: 582791 - RNA, 64 nt, hsa; identical to SEQ ID NO: 497844

SEQ ID NO: 582792 - RNA, 64 nt, hsa; identical to SEQ ID NO: 497845

SEQ ID NO: 582793 - RNA, 64 nt, hsa; identical to SEQ ID NO: 497846

SEQ ID NO: 582794 - RNA, 64 nt, hsa; identical to SEQ ID NO: 497847

SEQ ID NO: 582795 - RNA, 64 nt, hsa; identical to SEQ ID NO: 497848

SEQ ID NO: 582796 - RNA, 64 nt, hsa; identical to SEQ ID NO: 497849

SEQ ID NO: 582797 - RNA, 64 nt, hsa; identical to SEQ ID NO: 497850

SEQ ID NO: 582798 - RNA, 64 nt, hsa; identical to SEQ ID NO: 57590

SEQ ID NO: 582799 - RNA, 64 nt, hsa; identical to SEQ ID NO: 57591

SEQ ID NO: 582800 - RNA, 64 nt, hsa
uucagagcaccuucacucacauaaugucauuugaaccucacaauguucuugggauggagucagu

SEQ ID NO: 582801 - RNA, 64 nt, hsa
ugucggguacacagugugaacccccgaagacggaaccucacagucuuccauguucccuucuuaa

SEQ ID NO: 582802 - RNA, 64 nt, hsa
cacauuuuuuguuuccauuaguaauauucuagguaccucacaaaauguauuauggugccauggc

SEQ ID NO: 582803 - RNA, 64 nt, hsa
cuggcuucaaaguuucuuggggaaaggucgguuuaccucacauuuuuuguuuccauuaguaaua

SEQ ID NO: 582804 - RNA, 64 nt, hsa
gagaauugacgagaagccagcucacccaucccagaccucacagucccucagguucuacugggau

SEQ ID NO: 582805 - RNA, 64 nt, hsa
ccucaucuguaaaugaagaaaguaggcccugucuaccucacaugcaggucuagggugaggauug

SEQ ID NO: 582806 - RNA, 64 nt, hsa
uuuaagaauuuuuuaagaaguaauaauuaaaauaaccucacaagaaguuguaaugaguacagag

SEQ ID NO: 582807 - RNA, 64 nt, hsa
cuguugaauaucagaugguuaauacuggcauaaaaccucacagauuuuuuugaauuugugaaag

SEQ ID NO: 582808 - RNA, 64 nt, hsa
guuuugcuuuguagcccucacuacuggccaccugaccucacaccugacccugaccccuccucac

SEQ ID NO: 582809 - RNA, 64 nt, hsa
uuaaagaaaaaaaaaaguaaaaaccaaacacaacaccucacaaguuguaacucuugguccuucu

SEQ ID NO: 582810 - RNA, 64 nt, hsa
acaggugggguagagagugggucagcagccuggcaccucacagaggugggaccuaagaggacuc

SEQ ID NO: 582811 - RNA, 64 nt, hsa
ggaagauguuugacuauugcugcucuucaccagaaccucacaccucuccugggacuggaacccu

SEQ ID NO: 582812 - RNA, 64 nt, hsa
uguugggcuaacagucaauuggauauauuccuuuaccucacaugaccccagcaacugugguggu

SEQ ID NO: 582813 - RNA, 52 nt, hsa
uuuccaaacaucuucuguagcgaccucacacagccucugcagauggaucccu

SEQ ID NO: 582814 - RNA, 64 nt, hsa
caaccuggugcuaggucauuucacuuuucugaaaaccucacaucaggcugcauccucuucuguc

SEQ ID NO: 582815 - RNA, 64 nt, hsa
ugccccccaccaguggcuucuagggaaagcaaggaccucacaugccaggugcccuaguacuugc

SEQ ID NO: 582816 - RNA, 64 nt, hsa
uucccaaucauugucuucauuccacuacaaagucaccucacagcaucuugcuccacucggcauc

SEQ ID NO: 582817 - RNA, 64 nt, hsa
agguuacaugugagucaaaauuuuguaaaauauaaccucacauaagaaccauggccuuggauua

SEQ ID NO: 582818 - RNA, 64 nt, hsa
aaacaggaaauuggaauuccuuuguccaggagaaaccucacaaaccuucuuuaaggcauaguuu

SEQ ID NO: 582819 - RNA, 64 nt, hsa
aaccucuuaaaucauagcugucugaccucuacggaccucacauccaucugaggcuucauggaca

SEQ ID NO: 582820 - RNA, 64 nt, hsa
caucuguggcugggacagcccagggggugugcccacggcugacccaggggugugcacacggcug

SEQ ID NO: 582821 - RNA, 64 nt, hsa
ggggugugcccacggcugacccaggggugugcacacggcugagcugggagucccgcuggucucc

SEQ ID NO: 582822 - RNA, 64 nt, hsa; identical to SEQ ID NO: 244040

SEQ ID NO: 582823 - RNA, 64 nt, hsa; identical to SEQ ID NO: 244041

SEQ ID NO: 582824 - RNA, 64 nt, hsa; identical to SEQ ID NO: 244042

SEQ ID NO: 582825 - RNA, 64 nt, hsa; identical to SEQ ID NO: 244043

SEQ ID NO: 582826 - RNA, 64 nt, hsa; identical to SEQ ID NO: 244044

SEQ ID NO: 582827 - RNA, 64 nt, hsa; identical to SEQ ID NO: 244045

SEQ ID NO: 582828 - RNA, 64 nt, hsa; identical to SEQ ID NO: 244046

SEQ ID NO: 582829 - RNA, 64 nt, hsa; identical to SEQ ID NO: 244047

SEQ ID NO: 582830 - RNA, 64 nt, hsa; identical to SEQ ID NO: 244048

SEQ ID NO: 582831 - RNA, 64 nt, hsa; identical to SEQ ID NO: 244049

SEQ ID NO: 582832 - RNA, 64 nt, hsa; identical to SEQ ID NO: 244050

SEQ ID NO: 582833 - RNA, 64 nt, hsa; identical to SEQ ID NO: 244051

SEQ ID NO: 582834 - RNA, 64 nt, hsa; identical to SEQ ID NO: 244052

SEQ ID NO: 582835 - RNA, 64 nt, hsa; identical to SEQ ID NO: 244053

SEQ ID NO: 582836 - RNA, 64 nt, hsa; identical to SEQ ID NO: 244054

SEQ ID NO: 582837 - RNA, 64 nt, hsa; identical to SEQ ID NO: 244055

SEQ ID NO: 582838 - RNA, 64 nt, hsa
gauuaucuugugaaacgaugagaguaaguugcaaccuugugacugaaaacuugaaaagagugga

SEQ ID NO: 582839 - RNA, 64 nt, hsa
ccaggaauuagauuucuguacaccccuaaucuagccuugugagcuucgcuaguuaaugugugcu

SEQ ID NO: 582840 - RNA, 64 nt, hsa
ugcauugacuuuccccaccagaugcugaaaauguccuugugaugugcacguaaaguacuuguag

SEQ ID NO: 582841 - RNA, 64 nt, hsa
aacuccuaguucuagaaaaacaggcacuuggcagccuugugaugucauacagagaagucacagg

SEQ ID NO: 582842 - RNA, 64 nt, hsa
ggcucacucccuugccucucccccuccaccaccaccuugugacugaugguuugguuuccucucu

SEQ ID NO: 582843 - RNA, 64 nt, hsa
guuguaagugcaaugacccgaguccuccacaugaccuugugaauugugugcuguccuucugugc

SEQ ID NO: 582844 - RNA, 64 nt, hsa
uguuuucauucaucucaaaguauuuucuaauuucccuugugauuucuucuuugaccccuugauu

SEQ ID NO: 582845 - RNA, 64 nt, hsa
aaccacauaaugagaacauuauucucuuuuuaguccuugugagacaaggaugaagucucaguug

SEQ ID NO: 582846 - RNA, 64 nt, hsa
cacgugcaauacggaacacugucaauggacugcaccuugugaaggaaaaacaugcuuaaggggg

SEQ ID NO: 582847 - RNA, 64 nt, hsa
ucuccacgcacucagcuauaccucauucacagcuccuugugagugugugcacaggaaauaagcc

SEQ ID NO: 582848 - RNA, 64 nt, hsa
gcccugccuccacuugccuugugauauucuauuaccuugugaaguaggugaucuuugugaccca

SEQ ID NO: 582849 - RNA, 64 nt, hsa
cuguguuccugugaucucgcccugccuccacuugccuugugauauucuauuaccuugugaagua

SEQ ID NO: 582850 - RNA, 64 nt, hsa
uuucauggacacugaucacuuccccaaucaauacccuugugauuucuuaugccugucuuuacuu

SEQ ID NO: 582851 - RNA, 64 nt, hsa
gcuuguucccauugccaaauggauuuagaaauucccuugugagugccugguagcuaauacacug

SEQ ID NO: 582852 - RNA, 64 nt, hsa
uuaguaucaacauuuuagaaugucaaauuugaugccuugugaacaaguaauuuuauauugugcu

SEQ ID NO: 582853 - RNA, 64 nt, hsa; identical to SEQ ID NO: 244040

SEQ ID NO: 582854 - RNA, 64 nt, hsa; identical to SEQ ID NO: 244041

SEQ ID NO: 582855 - RNA, 64 nt, hsa; identical to SEQ ID NO: 244042

SEQ ID NO: 582856 - RNA, 64 nt, hsa; identical to SEQ ID NO: 244043

SEQ ID NO: 582857 - RNA, 64 nt, hsa; identical to SEQ ID NO: 244044

SEQ ID NO: 582858 - RNA, 64 nt, hsa; identical to SEQ ID NO: 244045

SEQ ID NO: 582859 - RNA, 64 nt, hsa; identical to SEQ ID NO: 244046

SEQ ID NO: 582860 - RNA, 64 nt, hsa; identical to SEQ ID NO: 244047

SEQ ID NO: 582861 - RNA, 64 nt, hsa; identical to SEQ ID NO: 244048

SEQ ID NO: 582862 - RNA, 64 nt, hsa; identical to SEQ ID NO: 244049

SEQ ID NO: 582863 - RNA, 64 nt, hsa; identical to SEQ ID NO: 244050

SEQ ID NO: 582864 - RNA, 64 nt, hsa; identical to SEQ ID NO: 244051

SEQ ID NO: 582865 - RNA, 64 nt, hsa; identical to SEQ ID NO: 244052

SEQ ID NO: 582866 - RNA, 64 nt, hsa; identical to SEQ ID NO: 244053

SEQ ID NO: 582867 - RNA, 64 nt, hsa; identical to SEQ ID NO: 244054

SEQ ID NO: 582868 - RNA, 64 nt, hsa; identical to SEQ ID NO: 244055

SEQ ID NO: 582869 - RNA, 64 nt, hsa; identical to SEQ ID NO: 582838

SEQ ID NO: 582870 - RNA, 64 nt, hsa; identical to SEQ ID NO: 582839

SEQ ID NO: 582871 - RNA, 64 nt, hsa; identical to SEQ ID NO: 582840

SEQ ID NO: 582872 - RNA, 64 nt, hsa; identical to SEQ ID NO: 582841

SEQ ID NO: 582873 - RNA, 64 nt, hsa; identical to SEQ ID NO: 582842

SEQ ID NO: 582874 - RNA, 64 nt, hsa; identical to SEQ ID NO: 582843

SEQ ID NO: 582875 - RNA, 64 nt, hsa; identical to SEQ ID NO: 582844

SEQ ID NO: 582876 - RNA, 64 nt, hsa; identical to SEQ ID NO: 582845

SEQ ID NO: 582877 - RNA, 64 nt, hsa; identical to SEQ ID NO: 582846

SEQ ID NO: 582878 - RNA, 64 nt, hsa; identical to SEQ ID NO: 582847

SEQ ID NO: 582879 - RNA, 64 nt, hsa; identical to SEQ ID NO: 582848

SEQ ID NO: 582880 - RNA, 64 nt, hsa; identical to SEQ ID NO: 582849

SEQ ID NO: 582881 - RNA, 64 nt, hsa; identical to SEQ ID NO: 582850

SEQ ID NO: 582882 - RNA, 64 nt, hsa; identical to SEQ ID NO: 582851

SEQ ID NO: 582883 - RNA, 64 nt, hsa; identical to SEQ ID NO: 582852

SEQ ID NO: 582884 - RNA, 64 nt, hsa; identical to SEQ ID NO: 244040

SEQ ID NO: 582885 - RNA, 64 nt, hsa; identical to SEQ ID NO: 244041

SEQ ID NO: 582886 - RNA, 64 nt, hsa; identical to SEQ ID NO: 244042

SEQ ID NO: 582887 - RNA, 64 nt, hsa; identical to SEQ ID NO: 244043

SEQ ID NO: 582888 - RNA, 64 nt, hsa; identical to SEQ ID NO: 244044

SEQ ID NO: 582889 - RNA, 64 nt, hsa; identical to SEQ ID NO: 244045

SEQ ID NO: 582890 - RNA, 64 nt, hsa; identical to SEQ ID NO: 244046

SEQ ID NO: 582891 - RNA, 64 nt, hsa; identical to SEQ ID NO: 244047

SEQ ID NO: 582892 - RNA, 64 nt, hsa; identical to SEQ ID NO: 244048

SEQ ID NO: 582893 - RNA, 64 nt, hsa; identical to SEQ ID NO: 244049

SEQ ID NO: 582894 - RNA, 64 nt, hsa; identical to SEQ ID NO: 244050

SEQ ID NO: 582895 - RNA, 64 nt, hsa; identical to SEQ ID NO: 244051

SEQ ID NO: 582896 - RNA, 64 nt, hsa; identical to SEQ ID NO: 244052

SEQ ID NO: 582897 - RNA, 64 nt, hsa; identical to SEQ ID NO: 244053

SEQ ID NO: 582898 - RNA, 64 nt, hsa; identical to SEQ ID NO: 244054

SEQ ID NO: 582899 - RNA, 64 nt, hsa; identical to SEQ ID NO: 244055

SEQ ID NO: 582900 - RNA, 64 nt, hsa; identical to SEQ ID NO: 582838

SEQ ID NO: 582901 - RNA, 64 nt, hsa; identical to SEQ ID NO: 582839

SEQ ID NO: 582902 - RNA, 64 nt, hsa; identical to SEQ ID NO: 582840

SEQ ID NO: 582903 - RNA, 64 nt, hsa; identical to SEQ ID NO: 582841

SEQ ID NO: 582904 - RNA, 64 nt, hsa; identical to SEQ ID NO: 582842

SEQ ID NO: 582905 - RNA, 64 nt, hsa; identical to SEQ ID NO: 582843

SEQ ID NO: 582906 - RNA, 64 nt, hsa; identical to SEQ ID NO: 582844

SEQ ID NO: 582907 - RNA, 64 nt, hsa; identical to SEQ ID NO: 582845

SEQ ID NO: 582908 - RNA, 64 nt, hsa; identical to SEQ ID NO: 582846

SEQ ID NO: 582909 - RNA, 64 nt, hsa; identical to SEQ ID NO: 582847

SEQ ID NO: 582910 - RNA, 64 nt, hsa; identical to SEQ ID NO: 582848

SEQ ID NO: 582911 - RNA, 64 nt, hsa; identical to SEQ ID NO: 582849

SEQ ID NO: 582912 - RNA, 64 nt, hsa; identical to SEQ ID NO: 582850

SEQ ID NO: 582913 - RNA, 64 nt, hsa; identical to SEQ ID NO: 582851

SEQ ID NO: 582914 - RNA, 64 nt, hsa; identical to SEQ ID NO: 582852

SEQ ID NO: 582915 - RNA, 64 nt, hsa; identical to SEQ ID NO: 244040

SEQ ID NO: 582916 - RNA, 64 nt, hsa; identical to SEQ ID NO: 244041

SEQ ID NO: 582917 - RNA, 64 nt, hsa; identical to SEQ ID NO: 244042

SEQ ID NO: 582918 - RNA, 64 nt, hsa; identical to SEQ ID NO: 244043

SEQ ID NO: 582919 - RNA, 64 nt, hsa; identical to SEQ ID NO: 244044

SEQ ID NO: 582920 - RNA, 64 nt, hsa; identical to SEQ ID NO: 244045

SEQ ID NO: 582921 - RNA, 64 nt, hsa; identical to SEQ ID NO: 244046

SEQ ID NO: 582922 - RNA, 64 nt, hsa; identical to SEQ ID NO: 244047

SEQ ID NO: 582923 - RNA, 64 nt, hsa; identical to SEQ ID NO: 244048

SEQ ID NO: 582924 - RNA, 64 nt, hsa; identical to SEQ ID NO: 244049

SEQ ID NO: 582925 - RNA, 64 nt, hsa; identical to SEQ ID NO: 244050

SEQ ID NO: 582926 - RNA, 64 nt, hsa; identical to SEQ ID NO: 244051

SEQ ID NO: 582927 - RNA, 64 nt, hsa; identical to SEQ ID NO: 244052

SEQ ID NO: 582928 - RNA, 64 nt, hsa; identical to SEQ ID NO: 244053

SEQ ID NO: 582929 - RNA, 64 nt, hsa; identical to SEQ ID NO: 244054

SEQ ID NO: 582930 - RNA, 64 nt, hsa; identical to SEQ ID NO: 244055

SEQ ID NO: 582931 - RNA, 64 nt, hsa; identical to SEQ ID NO: 582838

SEQ ID NO: 582932 - RNA, 64 nt, hsa; identical to SEQ ID NO: 582839

SEQ ID NO: 582933 - RNA, 64 nt, hsa; identical to SEQ ID NO: 582840

SEQ ID NO: 582934 - RNA, 64 nt, hsa; identical to SEQ ID NO: 582841

SEQ ID NO: 582935 - RNA, 64 nt, hsa; identical to SEQ ID NO: 582842

SEQ ID NO: 582936 - RNA, 64 nt, hsa; identical to SEQ ID NO: 582843

SEQ ID NO: 582937 - RNA, 64 nt, hsa; identical to SEQ ID NO: 582844

SEQ ID NO: 582938 - RNA, 64 nt, hsa; identical to SEQ ID NO: 582845

SEQ ID NO: 582939 - RNA, 64 nt, hsa; identical to SEQ ID NO: 582846

SEQ ID NO: 582940 - RNA, 64 nt, hsa; identical to SEQ ID NO: 582847

SEQ ID NO: 582941 - RNA, 64 nt, hsa; identical to SEQ ID NO: 582848

SEQ ID NO: 582942 - RNA, 64 nt, hsa; identical to SEQ ID NO: 582849

SEQ ID NO: 582943 - RNA, 64 nt, hsa; identical to SEQ ID NO: 582850

SEQ ID NO: 582944 - RNA, 64 nt, hsa; identical to SEQ ID NO: 582851

SEQ ID NO: 582945 - RNA, 64 nt, hsa; identical to SEQ ID NO: 582852

SEQ ID NO: 582946 - RNA, 64 nt, hsa; identical to SEQ ID NO: 244040

SEQ ID NO: 582947 - RNA, 64 nt, hsa; identical to SEQ ID NO: 244041

SEQ ID NO: 582948 - RNA, 64 nt, hsa; identical to SEQ ID NO: 244042

SEQ ID NO: 582949 - RNA, 64 nt, hsa; identical to SEQ ID NO: 244043

SEQ ID NO: 582950 - RNA, 64 nt, hsa; identical to SEQ ID NO: 244044

SEQ ID NO: 582951 - RNA, 64 nt, hsa; identical to SEQ ID NO: 244045

SEQ ID NO: 582952 - RNA, 64 nt, hsa; identical to SEQ ID NO: 244046

SEQ ID NO: 582953 - RNA, 64 nt, hsa; identical to SEQ ID NO: 244047

SEQ ID NO: 582954 - RNA, 64 nt, hsa; identical to SEQ ID NO: 244048

SEQ ID NO: 582955 - RNA, 64 nt, hsa; identical to SEQ ID NO: 244049

SEQ ID NO: 582956 - RNA, 64 nt, hsa; identical to SEQ ID NO: 244050

SEQ ID NO: 582957 - RNA, 64 nt, hsa; identical to SEQ ID NO: 244051

SEQ ID NO: 582958 - RNA, 64 nt, hsa; identical to SEQ ID NO: 244052

SEQ ID NO: 582959 - RNA, 64 nt, hsa; identical to SEQ ID NO: 244053

SEQ ID NO: 582960 - RNA, 64 nt, hsa; identical to SEQ ID NO: 244054

SEQ ID NO: 582961 - RNA, 64 nt, hsa; identical to SEQ ID NO: 244055

SEQ ID NO: 582962 - RNA, 64 nt, hsa; identical to SEQ ID NO: 582838

SEQ ID NO: 582963 - RNA, 64 nt, hsa; identical to SEQ ID NO: 582839

SEQ ID NO: 582964 - RNA, 64 nt, hsa; identical to SEQ ID NO: 582840

SEQ ID NO: 582965 - RNA, 64 nt, hsa; identical to SEQ ID NO: 582841

SEQ ID NO: 582966 - RNA, 64 nt, hsa; identical to SEQ ID NO: 582842

SEQ ID NO: 582967 - RNA, 64 nt, hsa; identical to SEQ ID NO: 582843

SEQ ID NO: 582968 - RNA, 64 nt, hsa; identical to SEQ ID NO: 582844

SEQ ID NO: 582969 - RNA, 64 nt, hsa; identical to SEQ ID NO: 582845

SEQ ID NO: 582970 - RNA, 64 nt, hsa; identical to SEQ ID NO: 582846

SEQ ID NO: 582971 - RNA, 64 nt, hsa; identical to SEQ ID NO: 582847

SEQ ID NO: 582972 - RNA, 64 nt, hsa; identical to SEQ ID NO: 582848

SEQ ID NO: 582973 - RNA, 64 nt, hsa; identical to SEQ ID NO: 582849

SEQ ID NO: 582974 - RNA, 64 nt, hsa; identical to SEQ ID NO: 582850

SEQ ID NO: 582975 - RNA, 64 nt, hsa; identical to SEQ ID NO: 582851

SEQ ID NO: 582976 - RNA, 64 nt, hsa; identical to SEQ ID NO: 582852

SEQ ID NO: 582977 - RNA, 64 nt, hsa; identical to SEQ ID NO: 411244

SEQ ID NO: 582978 - RNA, 64 nt, hsa; identical to SEQ ID NO: 411245

SEQ ID NO: 582979 - RNA, 64 nt, hsa; identical to SEQ ID NO: 411246

SEQ ID NO: 582980 - RNA, 64 nt, hsa; identical to SEQ ID NO: 411247

SEQ ID NO: 582981 - RNA, 64 nt, hsa; identical to SEQ ID NO: 411248

SEQ ID NO: 582982 - RNA, 64 nt, hsa; identical to SEQ ID NO: 411249

SEQ ID NO: 582983 - RNA, 64 nt, hsa; identical to SEQ ID NO: 411250

SEQ ID NO: 582984 - RNA, 64 nt, hsa; identical to SEQ ID NO: 411251

SEQ ID NO: 582985 - RNA, 64 nt, hsa; identical to SEQ ID NO: 411252

SEQ ID NO: 582986 - RNA, 64 nt, hsa; identical to SEQ ID NO: 411253

SEQ ID NO: 582987 - RNA, 64 nt, hsa; identical to SEQ ID NO: 411254

SEQ ID NO: 582988 - RNA, 64 nt, hsa; identical to SEQ ID NO: 411255

SEQ ID NO: 582989 - RNA, 64 nt, hsa; identical to SEQ ID NO: 209175

SEQ ID NO: 582990 - RNA, 64 nt, hsa; identical to SEQ ID NO: 209176

SEQ ID NO: 582991 - RNA, 64 nt, hsa; identical to SEQ ID NO: 209177

SEQ ID NO: 582992 - RNA, 64 nt, hsa; identical to SEQ ID NO: 209178

SEQ ID NO: 582993 - RNA, 64 nt, hsa; identical to SEQ ID NO: 88616

SEQ ID NO: 582994 - RNA, 64 nt, hsa; identical to SEQ ID NO: 88617

SEQ ID NO: 582995 - RNA, 64 nt, hsa; identical to SEQ ID NO: 88618

SEQ ID NO: 582996 - RNA, 64 nt, hsa; identical to SEQ ID NO: 88619

SEQ ID NO: 582997 - RNA, 64 nt, hsa; identical to SEQ ID NO: 88620

SEQ ID NO: 582998 - RNA, 64 nt, hsa; identical to SEQ ID NO: 88621

SEQ ID NO: 582999 - RNA, 64 nt, hsa; identical to SEQ ID NO: 88622

SEQ ID NO: 583000 - RNA, 64 nt, hsa; identical to SEQ ID NO: 88623

SEQ ID NO: 583001 - RNA, 64 nt, hsa
gccauaguucuuccuuuucuagaaugucauauuggaaucauauaguauguagccuuuucagacu

SEQ ID NO: 583002 - RNA, 64 nt, hsa
cuuagacaaauguaugaugauaucuacaauuauagaaucauacagaauaguuucacugcccuaa

SEQ ID NO: 583003 - RNA, 64 nt, hsa
gcagugggagacuaagauguauuaaccuaccugugaaucauauguuguaggaaaagcuguuccc

SEQ ID NO: 583004 - RNA, 64 nt, hsa
cuguuguuucuuuuauguggugguuucuauacaugaaucauagccaaaaacuuuuuuggaaacu

SEQ ID NO: 583005 - RNA, 64 nt, hsa
cuggguggcaucuggcagucauggguaacacuugcuuuuccaguuaauguggccaugugauucc

SEQ ID NO: 583006 - RNA, 64 nt, hsa
cugaugcgugauagcuuaagcuuggggagaaggucuuuuccacugccuagcuaagcagucuggg

SEQ ID NO: 583007 - RNA, 64 nt, hsa
cauuuccucacauguccacgagaugcuuggguugcuuuuccaggggcuaguuuggcuuuuccaa

SEQ ID NO: 583008 - RNA, 64 nt, hsa
gaugcuuggguugcuuuuccaggggcuaguuuggcuuuuccaaguggguuuucuuuggagaauc

SEQ ID NO: 583009 - RNA, 64 nt, hsa
aaagaaagggacagcauuugcugcccccaccccucuuuuccaguccuugccuuccaaccaaaag

SEQ ID NO: 583010 - RNA, 64 nt, hsa
aagaaaauuggauuauuaggaauacaucuugacccuuuuccacucaauagaccagggaaagggg

SEQ ID NO: 583011 - RNA, 64 nt, hsa
ggggcuaaaguuuguuuuuccagggcugcugauccuuuuccagauagcuccagaguaugaugac

SEQ ID NO: 583012 - RNA, 64 nt, hsa
uaugguauuuauuggcauguccaauuugcuugcacuuuuccacaucagaccuuccacuuaaggg

SEQ ID NO: 583013 - RNA, 64 nt, hsa
ucaauacaaaagagaaaagaagaaccucucagugcuuuuccaacgaauguaaaguggguuuaaa

SEQ ID NO: 583014 - RNA, 64 nt, hsa
agguaugaaugugauuugucuguacaucuuguaucuuuuccaaaaaaugauucuguaucuuuug

SEQ ID NO: 583015 - RNA, 64 nt, hsa
ggaagugaugaaauuauauuuauuucagugggcacuuuuccauuuuaccacuguaccauuauuu

SEQ ID NO: 583016 - RNA, 64 nt, hsa
aaauaucuuuuauuggaaauaugcaaauucaauacuuuuccauuauagucuauagaacuggaga

SEQ ID NO: 583017 - RNA, 64 nt, hsa
aagcgaaugaaugguguuuccggaggagcaaguccuuuuccaacugggugugcaugcuaaaaac

SEQ ID NO: 583018 - RNA, 64 nt, hsa
aaucaauuauuacauuuauacaucaccuuuuugacuuuuccaagcccuuuuacagcucuuggca

SEQ ID NO: 583019 - RNA, 64 nt, hsa
auauuuuagggcuguagacuuacuuuccuauuuucuuuuccauugcuuauucuugagcacaaaa

SEQ ID NO: 583020 - RNA, 64 nt, hsa
aagauuuggcaacucgauaaauuuuuuucauuuucuuuuccaaucuguaacuauaguuacugaa

SEQ ID NO: 583021 - RNA, 64 nt, hsa
ugugcaauauauuacuaaaucaguuauuauuuuacuuuuccaaauucagagaaagaaaacagau

SEQ ID NO: 583022 - RNA, 64 nt, hsa
aucauuugggcagcuuggguaaguacgcaacuuacuuuuccaccaaagaacugucagcagcugc

SEQ ID NO: 583023 - RNA, 64 nt, hsa
ugccugcuuuucugugauguauguauccuguugacuuuuccagaaauuuuuuaagaguuugagu

SEQ ID NO: 583024 - RNA, 64 nt, hsa
uaaaguacacaaguccaagucuaaaacuuuaguacuuuuccaugcagauuugugcacaugugag

SEQ ID NO: 583025 - RNA, 64 nt, hsa
ccuuacucuucggggguuuccuuucaguaagcaacuuuuccaugcucuuaauguauuccuuuuu

SEQ ID NO: 583026 - RNA, 64 nt, hsa
aaugccuuuguauuaaaauuauuuuuaacaugugcuuuuccaaauuaaaaaugaaguagaguau

SEQ ID NO: 583027 - RNA, 64 nt, hsa
uaaaaguuugagcaccugauuauauuuaguuuugcuuuuccagauauuacauucuauaguuacc

SEQ ID NO: 583028 - RNA, 64 nt, hsa
cgugccgcuucauggaagcuugaguauguucucccuuuuccauuuuggauuuaucucuuuacug

SEQ ID NO: 583029 - RNA, 64 nt, hsa
gagcuagauacaagcaagaauaguauuugaaagacuuuuccagcauacuucucaauucuuugcu

SEQ ID NO: 583030 - RNA, 64 nt, hsa
uaaauauuuugcaugaugaaauuccagggucacacuuuuccaaguuuaucagugaaguagugau

SEQ ID NO: 583031 - RNA, 64 nt, hsa
aaaaaaaaaaaaaaaaaaaaaaaaaaaaaaaaaacuuuuccaggcagcuucaugaugugcaggc

SEQ ID NO: 583032 - RNA, 64 nt, hsa
ggugucuuuuccauaauuguguuaaagaacauuucuuuuccauucaauuuguuuauuaaacucc

SEQ ID NO: 583033 - RNA, 64 nt, hsa
auuggauguauuucaauaauaaauagaguggugucuuuuccauaauuguguuaaagaacauuuc

SEQ ID NO: 583034 - RNA, 64 nt, hsa
ugauguacacaaauaacugacuuccacaagagggcuuuuccacacucggugugugcauacaguu

SEQ ID NO: 583035 - RNA, 64 nt, hsa
uggugugcagugcgcucuggcuucuagcugaaaacuuuuccacaguuuuacauucaugugguuu

SEQ ID NO: 583036 - RNA, 64 nt, hsa
cacacucugcauccuaccccaccuacccaacacacuuuuccaccugggagccugugcccucaga

SEQ ID NO: 583037 - RNA, 64 nt, hsa
guaaccucagcaaaaacgaggccucugcaagccacuuuuccaugccaagcauccacccggccca

SEQ ID NO: 583038 - RNA, 64 nt, hsa
ggaggugccucugauagaacaugcuagaaauggucuuuuccacagcauagucugggacuggaaa

SEQ ID NO: 583039 - RNA, 64 nt, hsa
cguguggaaguaaagacuuuggagcuagagaagccuuuuccagcaaugauuauugacuucacca

SEQ ID NO: 583040 - RNA, 64 nt, hsa
gcaucauuuaaaaaaaaaugacaugccugaacaacuuuuccacuuuccacgugcuucccuccca

SEQ ID NO: 583041 - RNA, 64 nt, hsa
ucuagccaccaaaacggguuaaucaaaagacguccuuuuccauuuuuuuuugcuuuuauuuucu

SEQ ID NO: 583042 - RNA, 64 nt, hsa
gagugugguuuggcagaacaacugcauuucacagcuuuuccaguuaaauuggagcacugaacgu

SEQ ID NO: 583043 - RNA, 64 nt, hsa
ugucuccuuuuauaugcagcucuuacgugggagacuuuuccacuuaaaggagacauagaaugug

SEQ ID NO: 583044 - RNA, 64 nt, hsa
ugggggccauuuucucuacaggcaaauggaauugcuuuuccauaacauccaaauuguaaugugg

SEQ ID NO: 583045 - RNA, 64 nt, hsa
auaaccagcucuuaguuguucccuuucccuggggcuuuuccauuuaacacauggagcccuuccc

SEQ ID NO: 583046 - RNA, 64 nt, hsa
ucaaaauguaaauuauguauaccugccaagauaccuuuuccagggugucugcgcacauuuuaag

SEQ ID NO: 583047 - RNA, 64 nt, hsa
aaaacaaaaacaaaacacacaccacacacacgcgcuuuuccagucacacaccccugauguugga

SEQ ID NO: 583048 - RNA, 64 nt, hsa
aaaucuuguaaaagguguccaaauacauaguaaucuuuuccaguuaugucugauuaagauuuaa

SEQ ID NO: 583049 - RNA, 64 nt, hsa
cauuuauuaaucuuuuuaucugaaacuuuguacacuuuuccacuuucaaaaccuauuuuaagua

SEQ ID NO: 583050 - RNA, 64 nt, hsa
gaccuuggaaaaucuggccaagccuagggguuuccuuuuccauuugccaaguuccauugugcca

SEQ ID NO: 583051 - RNA, 64 nt, hsa
aaggaguggguuguuuuucauagcuagauaagaucuuuuccaaaguuuuucuuagaaccaacca

SEQ ID NO: 583052 - RNA, 64 nt, hsa
agccccggucgcgcgcuggccccgcaggaccuuccuuuuccaggaagagccagcuuuucucgga

SEQ ID NO: 583053 - RNA, 64 nt, hsa
gcugccaggaaacgauuugggccucugucaguuucuuuuccauguaugaggagggggaaauuug

SEQ ID NO: 583054 - RNA, 64 nt, hsa
ggacauuuaaaaauauauuuuucuugaguuuaggcuuuuccauaugugcagcuguguuuaccua

SEQ ID NO: 583055 - RNA, 64 nt, hsa
aucuucucgucccuuucuuacagccauuuucuugcuuuuccacaaagauauuauuuaaagugga

SEQ ID NO: 583056 - RNA, 64 nt, hsa
uaucaaagacaagaggauaaaagacugggauagucuuuuccaaggacccucuuuagagggcccu

SEQ ID NO: 583057 - RNA, 64 nt, hsa
ugcggguuuuguuggggugucuuaauguucaucucuuuuccacugcccauccucugugaaccca

SEQ ID NO: 583058 - RNA, 64 nt, hsa
uguuuuaaccuaaagcuuaucuguaauucaccuccuuuuccaccacugcuaccuuaugugagcc

SEQ ID NO: 583059 - RNA, 64 nt, hsa
ccuuguuuuacuuauuugcuccuuguagagcugccuuuuccaaggauaccauaaacuccugaga

SEQ ID NO: 583060 - RNA, 64 nt, hsa
aauuuauaauccguuccccauuaacuuaauuuagcuuuuccaucacuguuaaugaucagaguaa

SEQ ID NO: 583061 - RNA, 64 nt, hsa
agaguuuuaauggucuuuguguaaauuuuaauggcuuuuccauuguuuuugcuucucuuaaaaa

SEQ ID NO: 583062 - RNA, 64 nt, hsa
cuuuguuauaggcagucuucucuuuaagacaauacuuuuccacuuguuuuccuuuuccauauua

SEQ ID NO: 583063 - RNA, 64 nt, hsa
uucucuuuaagacaauacuuuuccacuuguuuuccuuuuccauauuauauauguguauucauau

SEQ ID NO: 583064 - RNA, 64 nt, hsa
auuuuucuuuccugucccccuacucccucccuaccuuuuccauccuccuccucugccuucaaaa

SEQ ID NO: 583065 - RNA, 64 nt, hsa
acacaguuugaacguggugaaacaggguguaguucuuuuccacauucugugucaucuagucgug

SEQ ID NO: 583066 - RNA, 64 nt, hsa; identical to SEQ ID NO: 353564

SEQ ID NO: 583067 - RNA, 64 nt, hsa; identical to SEQ ID NO: 353565

SEQ ID NO: 583068 - RNA, 64 nt, hsa; identical to SEQ ID NO: 353566

SEQ ID NO: 583069 - RNA, 64 nt, hsa; identical to SEQ ID NO: 353567

SEQ ID NO: 583070 - RNA, 64 nt, hsa; identical to SEQ ID NO: 353568

SEQ ID NO: 583071 - RNA, 64 nt, hsa; identical to SEQ ID NO: 353569

SEQ ID NO: 583072 - RNA, 64 nt, hsa; identical to SEQ ID NO: 353570

SEQ ID NO: 583073 - RNA, 64 nt, hsa; identical to SEQ ID NO: 353571

SEQ ID NO: 583074 - RNA, 64 nt, hsa; identical to SEQ ID NO: 353572

SEQ ID NO: 583075 - RNA, 64 nt, hsa; identical to SEQ ID NO: 353573

SEQ ID NO: 583076 - RNA, 64 nt, hsa; identical to SEQ ID NO: 353574

SEQ ID NO: 583077 - RNA, 64 nt, hsa
aaucacuacagcugcucugcuucugcuuuccaaaguagcccagguccugggccagaugcagggg

SEQ ID NO: 583078 - RNA, 64 nt, hsa
ccgcgugguagggcugcuggcaggcacacuggguguagcccaacaccgugaggcacuggcccac

SEQ ID NO: 583079 - RNA, 64 nt, hsa
ggguucugugcugguuguuagaacucaucuccagguagcccacggauacgugguuggcacagac

SEQ ID NO: 583080 - RNA, 64 nt, hsa
aacccucuagcucccauuggcugaagacacugaaguagcccaccccugcaggcagguccugauu

SEQ ID NO: 583081 - RNA, 64 nt, hsa
guuuugaaaguccugcccugccuuccuccugccuguagcccagcccaucuaaauggaagcuggg

SEQ ID NO: 583082 - RNA, 64 nt, hsa
aaacaaaaccaaacuggacucucgugcagaaaauguagcccauuaccacauguagccuuggaga

SEQ ID NO: 583083 - RNA, 64 nt, hsa
ucucaaaaauaaaaauaaaaauugcuuucagagaguagcccaugaaauuucccauucuucaagg

SEQ ID NO: 583084 - RNA, 64 nt, hsa
agaggauauugauaggugugaacuaguucaucaaguagcccaaguaggagagaaucauaggcaa

SEQ ID NO: 583085 - RNA, 64 nt, hsa
acagucugaagaggaaggaagcagcaguaucugcguagcccacagagggcccaggccccugccc

SEQ ID NO: 583086 - RNA, 64 nt, hsa
cgggggcugcugugagggaucuuggagcuucccuguagcccaccuuccccuugcuucauguuug

SEQ ID NO: 583087 - RNA, 64 nt, hsa
cgguuuaaaacaugcuauauguacuguauguccuguagcccagugcggcuccacagcauggaau

SEQ ID NO: 583088 - RNA, 64 nt, hsa
uguacuuuuuuuuuugagacggaguuuugcucuuguagcccaggcuggagugcaauggcaggau

SEQ ID NO: 583089 - RNA, 64 nt, hsa
augaccacuguuuuuuuccuauuuauaucaccagguagcccacugaguuaauauuuaaguuguc

SEQ ID NO: 583090 - RNA, 64 nt, hsa
uuucacuuaugugagucaucaugguguuggucuuguagcccauuauuuuuccugugcuucccca

SEQ ID NO: 583091 - RNA, 64 nt, hsa
augaaaauaaaauauaaagucaauaauaguccuuguagcccaaugggaauugauucuguuuauu

SEQ ID NO: 583092 - RNA, 64 nt, hsa
gccgagagccccacgcucccgcccaccuuccccaguagcccaggccugggcagcaagcgcagcc

SEQ ID NO: 583093 - RNA, 64 nt, hsa
uaugguuacggagcugugcaucuugggacauguaguagcccaggucggcuugucacucgcugug

SEQ ID NO: 583094 - RNA, 64 nt, hsa
uuccgaggcugcagggccaggcgcgggaccgcagguagcccaggguguuguggguggcagcacu

SEQ ID NO: 583095 - RNA, 64 nt, hsa
auuacugaaaagcugaaauuuaauggguggugauguagcccaaugagggcgaaugacauuacag

SEQ ID NO: 583096 - RNA, 63 nt, hsa
aggaggauggagcuaguuagcugucuguugucuguagcccagcuugauaauggaacuauacag

SEQ ID NO: 583097 - RNA, 64 nt, hsa
ggugugugacguuuuuccaguucacauuuauuugguagcccaccuggguuggaggaagggcacg

SEQ ID NO: 583098 - RNA, 64 nt, hsa
ucauaugucacucauagcauuucuauauuugaaaguagcccaauauaaaacuuuugauucuaaa

SEQ ID NO: 583099 - RNA, 64 nt, hsa
aguuaacacacuggagugugcuccaguuugcaggguagcccagugcaagguucagauccaugua

SEQ ID NO: 583100 - RNA, 64 nt, hsa
gaucacaagccugccacgauggcugcugcuccuuguagcccacccaugagaagcaagagaccuu

SEQ ID NO: 583101 - RNA, 64 nt, hsa
cauuauacccaguuugcacuaacaugggccauuuguagcccaaccuucucuuccaucuaccugu

SEQ ID NO: 583102 - RNA, 64 nt, hsa
cucuaguuuccaucucuaucauuuuauaauaaccguagcccacauuguaguaguuuuucagcuc

SEQ ID NO: 583103 - RNA, 64 nt, hsa
gguucaucugcuuccaucccagugaaauuuaccuguagcccagugaaggguguguuuggaacau

SEQ ID NO: 583104 - RNA, 64 nt, hsa
cagugggaaauggugguggaugauauggacauauguagcccaguggcauuguacuuucugcuga

SEQ ID NO: 583105 - RNA, 64 nt, hsa
ggguccugagcaccugcuucaugaaggaagauagguagcccagagaagaaguuuuggacuuaac

SEQ ID NO: 583106 - RNA, 64 nt, hsa
aagcagaaggugugcuauucacaguaccaugcgaguagcccacaguuaauucccggcagauucu

SEQ ID NO: 583107 - RNA, 64 nt, hsa
aguggagcuuuuguaucuucugcagacacuguggguagcccaucaaaauguaagcugugcuccu

SEQ ID NO: 583108 - RNA, 64 nt, hsa
uauaagcuaauguuuaaaagcaaaacugcaaauuguagcccaguuggucaaacuuguuuucuuu

SEQ ID NO: 583109 - RNA, 64 nt, hsa
ccccagucuccucuccugaucuccuccaaucucuguagcccaagaugugaaagccagacaagaa

SEQ ID NO: 583110 - RNA, 64 nt, hsa
ugguguauuaauuuuaucuuuguuagagaugaaaguagcccacuuuauguuaaagaucuuacua

SEQ ID NO: 583111 - RNA, 64 nt, hsa
uaauuguuaauaagaaaaccaaaugugaugaacuguagcccaagcccuauucugcacuguucag

SEQ ID NO: 583112 - RNA, 64 nt, hsa
ccccgccacaucccaacuucauuucccccucacuguagcccauuuccaccccaccacaaaguug

SEQ ID NO: 583113 - RNA, 64 nt, hsa
cauuuugauuguaaaccauaaaauaguucagcaaguagcccacaguucuggccuaacagcagac

SEQ ID NO: 583114 - RNA, 64 nt, hsa
uauauuugaauaguuaauuugcuuuguuuuacacguagcccacugccucauuauagguaaaagg

SEQ ID NO: 583115 - RNA, 64 nt, hsa
uugacuagcaaacagcacuuuaggaaaagucaccguagcccacuguggcaucagaaaauucuug

SEQ ID NO: 583116 - RNA, 64 nt, hsa
cacaagccccaggaagaacucagagccgucauggguagcccacgccguccuuuccccuccccaa

SEQ ID NO: 583117 - RNA, 64 nt, hsa
auugggcaaacaguagacuuauaguaggguugggguagcccauguuaugugacuaucuuuauga

SEQ ID NO: 583118 - RNA, 64 nt, hsa
augaugucaucuaaaggccaccaggaacacaccuguagcccagcaaaguugaggccaucgacug

SEQ ID NO: 583119 - RNA, 64 nt, hsa
cauuccauccauuuccucagguuucugugguucaguagcccagaccuguuuggcagccauuucu

SEQ ID NO: 583120 - RNA, 64 nt, hsa
accacaccuggcugaacaucagauauuuuaaaguguagcccagagucuaguugguaaauguuac

SEQ ID NO: 583121 - RNA, 64 nt, hsa
cuccucgcccuucaguuuuugccugaggugcuggguagcccauccuuuccucugucccagauuc

SEQ ID NO: 583122 - RNA, 64 nt, hsa
cuguuccagguccucccaaccucugaagugcucaguagcccaacaacaaggcugcugggggccu

SEQ ID NO: 583123 - RNA, 64 nt, hsa
uccaggcauuguuuaccugcucuugcuccccgcuguagcccacagccauaucugucaugcuucc

SEQ ID NO: 583124 - RNA, 64 nt, hsa
gggcgagggagagaugagcggaagguggagguggguagcccagguucagggagcuggcuuucuc

SEQ ID NO: 583125 - RNA, 64 nt, hsa
guuuuagcuucuuuccagcaaacucuucuccacaguagcccagucgugguaggauaaauuacgg

SEQ ID NO: 583126 - RNA, 64 nt, hsa
ggcugacacggaggugcauuagcccaggcuggagguagcccacccaaaugcccuuucugauucu

SEQ ID NO: 583127 - RNA, 64 nt, hsa
gggucuguuuggacugcagaagcaagggggugauguagcccauccuucccuuuggagaugcuga

SEQ ID NO: 583128 - RNA, 64 nt, hsa
augccuauggcgccucaucuuuaaacuguccuuaguagcccaggggagccacacccucacuccc

SEQ ID NO: 583129 - RNA, 64 nt, hsa
ccaccacacacugaaucuguagcuuccggauaccguagcccaugggcaccagcuuggaggcccc

SEQ ID NO: 583130 - RNA, 64 nt, hsa
uucagagcaauaggaggaaaaggaaagcguuuuuguagcccaccaucuacagcuuuacuguaaa

SEQ ID NO: 583131 - RNA, 64 nt, hsa
acagccagcgguggaggugucuugcuccgggcccguagcccacgcccucucuggguggcagggc

SEQ ID NO: 583132 - RNA, 64 nt, hsa
uuuuuaguacuaagcaaaauucucaucacagaauguagcccaggccaauuuauaacuaaaucuc

SEQ ID NO: 583133 - RNA, 64 nt, hsa
aaugggguuuauauuuacauuaucucucaacuauguagcccauauuacucacccuaugagugaa

SEQ ID NO: 583134 - RNA, 64 nt, hsa
auaguaccuuuuugcguaauguuugggauauucaguagcccaggauugcuacaaaaagguccuu

SEQ ID NO: 583135 - RNA, 64 nt, hsa
caugucuucuuguuauuguuuacacacuugcaguguagcccaguuugaaauauuuauuugguua

SEQ ID NO: 583136 - RNA, 64 nt, hsa
ccggcagccgcuccgagccucggcccugccccaaguagcccagaagccuccggcggcccaggau

SEQ ID NO: 583137 - RNA, 64 nt, hsa
cucugacuugguauuuccagguccguauuucucuguagcccagggucugggguagagcugacug

SEQ ID NO: 583138 - RNA, 64 nt, hsa
ucauaaacaugcauugugaaacuguagagagcagguagcccaaaauagagaaagauuagauaaa

SEQ ID NO: 583139 - RNA, 64 nt, hsa
caauucaaauucuaguuguuauuugguggaagcaguagcccaaccccaguuuaggggaagguag

SEQ ID NO: 583140 - RNA, 64 nt, hsa
ucguccaucccugucccuuucuggcccucuuccuguagcccagucucaggcuuuccucuuccug

SEQ ID NO: 583141 - RNA, 64 nt, hsa
gcauccuugcacgccccgcggagcucucuccaugguagcccagggcgcuggcagaccaugcucc

SEQ ID NO: 583142 - RNA, 64 nt, hsa
cuacacagccuggacuuugguucucuccaggaagguagcccagcacugugaagacccagcagga

SEQ ID NO: 583143 - RNA, 64 nt, hsa
uaaacuuuuuuuuuuugagaugguaucucacucuguagcccagucuggagugcaguggugugau

SEQ ID NO: 583144 - RNA, 64 nt, hsa
agaaauguguuaucuguaaucuuuccuaaacagaguagcccacaagaaucaugcacuuuuuaaa

SEQ ID NO: 583145 - RNA, 64 nt, hsa
caauucaggggauuuguauagugucuauaggaaaguagcccaugucuugaaauaugaaaaggaa

SEQ ID NO: 583146 - RNA, 64 nt, hsa
cauaguuguguccuauacuugaagaggcuggaaaguagcccauaaccauaauugcaguauuucu

SEQ ID NO: 583147 - RNA, 64 nt, hsa
auacauuucugaaugggcaauuccagaaaucuuaguagcccauguuaagcuucuauuuuuuacu

SEQ ID NO: 583148 - RNA, 64 nt, hsa
gcuggggacucccagcucugaaauuugggaaaaaguagcccaugggccuuuagaaugcuuuaau

SEQ ID NO: 583149 - RNA, 64 nt, hsa
gcccuaaggaaugaaaagcaagggccaggugggaguagcccagcgaaggcacuugggcugccag

SEQ ID NO: 583150 - RNA, 64 nt, hsa
cgcucuccacauuguacagagcuucagguuuaauguagcccagcugagucagaaagguugugac

SEQ ID NO: 583151 - RNA, 64 nt, hsa
gaaacagaaaguauccauaccuauugccuuucuuguagcccagcuugccagagguccaaauauu

SEQ ID NO: 583152 - RNA, 64 nt, hsa
uccggcaaaugccuccuucgccagguguguccugguagcccagguucagggcuggggaggagcc

SEQ ID NO: 583153 - RNA, 64 nt, hsa
aaccagguuuagacaguaugagucaaugugcaguguagcccacacuugagaggaugaauguaug

SEQ ID NO: 583154 - RNA, 64 nt, hsa
aggaaagucggggcuuugaccacuaccauaucugguagcccauuuucuaggcauugugaauagg

SEQ ID NO: 583155 - RNA, 64 nt, hsa
gaguucagggugacacauuuugggacaucugcugguagcccagugcugaaggacuugcuuuucc

SEQ ID NO: 583156 - RNA, 64 nt, hsa
cugcuguuccugcucccaccuuuuuggaagaucgguagcccagggugagcacaaacauuccagu

SEQ ID NO: 583157 - RNA, 64 nt, hsa
accuugucucuugcaguuuaagguaauggauauuguagcccauuugaauuuucuucacucuuau

SEQ ID NO: 583158 - RNA, 64 nt, hsa
acaucuguacgucugucaucauugugacuuccugguagcccaagaagaacaacaacaaaacaau

SEQ ID NO: 583159 - RNA, 64 nt, hsa
cccacuaacggcuuauaugaacagaaaguacuguguagcccaggaguuuauuuagcaagauaaa

SEQ ID NO: 583160 - RNA, 64 nt, hsa
uuucaauaagguuuaaccuuagucuuguugacauguagcccagucauucacucuuuaaggauua

SEQ ID NO: 583161 - RNA, 64 nt, hsa
ucuguuuccacccacccugggauccuuuuuacuuguagcccauuccugcccucuaaaagaaucc

SEQ ID NO: 583162 - RNA, 64 nt, hsa
guucugggcccugauuuugccacaccuccauccuguagcccauucucugaccccaaggaguggc

SEQ ID NO: 583163 - RNA, 64 nt, hsa
uccaucugugucugucuguuggccuguaucuguuguagcccaggcuccccaagcuucccugcau

SEQ ID NO: 583164 - RNA, 64 nt, hsa
uuuaacagauagaguguggcuucauuuguccaugguagcccaucucuccuaagaccuuuucuag

SEQ ID NO: 583165 - RNA, 64 nt, hsa
gaugagcucuacccagggccugcaggaccugccuguagcccacucugcucgccuuagcacuacc

SEQ ID NO: 583166 - RNA, 64 nt, hsa
aaaaauguguguacagacucacugaugcagcacuguagcccaucaccuuggagcacugacugua

SEQ ID NO: 583167 - RNA, 64 nt, hsa
gaaagugcguggucacaaaauaucagaaaugccaguagcccagagggacuugcaggaaaagcgu

SEQ ID NO: 583168 - RNA, 64 nt, hsa
aauauaacaggaauuaaugaucauuccacguuuuguagcccacugcaucuggauauauaccagu

SEQ ID NO: 583169 - RNA, 64 nt, hsa
cucuccuaggucacagccugcugggcugggucgcguagcccaggguggaggcagaacgaugcug

SEQ ID NO: 583170 - RNA, 64 nt, hsa
gauauuggacuuacugcuauacuugugauacuggguagcccagacuuugaaggugcuuugugag

SEQ ID NO: 583171 - RNA, 64 nt, hsa
uugcauucgcuucuguucuugcuagaaacccaguguagcccagggcagaugucaauaaaugcau

SEQ ID NO: 583172 - RNA, 64 nt, hsa
gaacccugcugaugagcccacucuaggagccccaguagcccaggagcuugggugugcugacgag

SEQ ID NO: 583173 - RNA, 64 nt, hsa
gugcucccaagacuuccauagaccaucuggaccaguagcccaucccgcaguuuucuugggggca

SEQ ID NO: 583174 - RNA, 64 nt, hsa
agccgagcagcugugagguggguggggcagggcuguagcccacgccgggugcuauuccaggcuc

SEQ ID NO: 583175 - RNA, 64 nt, hsa
cuugcguuaucauaaagaaaaagagguuguugcuguagcccaugcuguuuaucaagcaaugcuc

SEQ ID NO: 583176 - RNA, 64 nt, hsa
aauguuuuaaaagcuuaauagguuggcaucaguuguagcccacaaacauggcuagggcuuuggg

SEQ ID NO: 583177 - RNA, 64 nt, hsa
aauccucagacguucugguuugauuguuguggguguagcccaggcaugggauuuuuuaaagagc

SEQ ID NO: 583178 - RNA, 64 nt, hsa
agccaaggcugcagcauauagaccaggaaaucagguagcccagacuggugauggagcagagucu

SEQ ID NO: 583179 - RNA, 64 nt, hsa
uguccaugugggagagagagagcaugagagcacaguagcccagccugcuggucagcaggcucau

SEQ ID NO: 583180 - RNA, 64 nt, hsa
cuccccuggggcaucccuuugccuuggcaucccuguagcccagcaacccugccccuccccagca

SEQ ID NO: 583181 - RNA, 64 nt, hsa
ggccugcuggacagcgaggacagcaggcuuuccuguagcccauguucgaccacaugcaccucga

SEQ ID NO: 583182 - RNA, 64 nt, hsa
gcuugaacuuggccucuacccaaacuuaacccuuguagcccaauccccucucuucgcgcagagc

SEQ ID NO: 583183 - RNA, 64 nt, hsa
ugguccauuugguuuucugucuagccagguccagguagcccacuugcaucagggcugcuggguu

SEQ ID NO: 583184 - RNA, 64 nt, hsa
aagguauuuugcuguuaccucaauucuuacuguaguagcccaucugaugcuucuauaguuaaga

SEQ ID NO: 583185 - RNA, 64 nt, hsa
aacuuugcccgcucaccaugucccuugcccccauguagcccauuucccagguuaugcucuuuuc

SEQ ID NO: 583186 - RNA, 64 nt, hsa
gaauauucagacaaaauggauacauaaagacuaaguagcccauaaggggucaaaauuugcugcc

SEQ ID NO: 583187 - RNA, 64 nt, hsa
cugcuauguggacaguuguuuucuaguguggucuguagcccaauaacuggggaacgaguuacag

SEQ ID NO: 583188 - RNA, 64 nt, hsa
cuugcuuaaagaaaaucccucuuggccgggugugguagcccacgccucuaaucccagcacuuug

SEQ ID NO: 583189 - RNA, 64 nt, hsa
ccaacuuugaccaagaagagcaaucuggauucuuguagcccauggagguuuaccuucuucauag

SEQ ID NO: 583190 - RNA, 64 nt, hsa
acugucauuugacagcauucagaaauaaaugccaguagcccaggagcaaaaauuuuugggagua

SEQ ID NO: 583191 - RNA, 64 nt, hsa
accaagagucccagccccaccaguaucugcuucuguagcccacggcaccccaaacuuggaggga

SEQ ID NO: 583192 - RNA, 64 nt, hsa
uauuuauuuauuuauugagacggagucuugcucuguagcccaggccagagugcaguggcgcgau

SEQ ID NO: 583193 - RNA, 64 nt, hsa
cuaauggccccccaaaagaugggcaggacaagcuguagcccaucugagagguugggaaacugag

SEQ ID NO: 583194 - RNA, 64 nt, hsa
uccuuucucaacguuccuaauccuuugcaucauaguagcccagacacauuuucuggguccugaa

SEQ ID NO: 583195 - RNA, 64 nt, hsa
ggcggguccccacuguggcgacggagagcugacaguagcccagggcuuuccaccugcauggaac

SEQ ID NO: 583196 - RNA, 64 nt, hsa
uagugguagugacuugcuuuuccugugcacacauguagcccaucaggacagcgagccgacgggu

SEQ ID NO: 583197 - RNA, 64 nt, hsa
ggacuuguugaaacaggaagcaagggccuucaguguagcccauucuugauccagagcuguugcc

SEQ ID NO: 583198 - RNA, 64 nt, hsa
cacuacagcaucaaaguaaaucuuuggggacaguguagcccaucugcauccuauuuaauuucuu

SEQ ID NO: 583199 - RNA, 64 nt, hsa
ccuucuucccagccagagagggcagaagcagaccguagcccauuggccuuaugugcgugugugc

SEQ ID NO: 583200 - RNA, 64 nt, hsa
gucucaccauucccuuuuuuagagaaaagguauuguagcccacccuccaccccgcuguuuuucu

SEQ ID NO: 583201 - RNA, 64 nt, hsa
gcuaaccuaaauauucuagaacuuucccagccucguagcccagcacuucucaaacuuggaaaug

SEQ ID NO: 583202 - RNA, 64 nt, hsa
ggcaggggaagggcacacccccugcccaugcaugguagcccacugggugguuucuggaaagccc

SEQ ID NO: 583203 - RNA, 64 nt, hsa
cagaccucaccaucuuugacagcccuugaaggugguagcccagcuccuguuccugugccuucaa

SEQ ID NO: 583204 - RNA, 64 nt, hsa
uaacauacaugccuauauauuuuauacacugaggguagcccauuuauaaauuaagagcacauua

SEQ ID NO: 583205 - RNA, 64 nt, hsa
ggcaggcaagagaauugaaaugaggugccacccaguagcccagagugagcuuuagcucucucua

SEQ ID NO: 583206 - RNA, 64 nt, hsa
uaggucugaguccuagagauuacauaaauaguguguagcccagaaaaguaaaauaggugucacg

SEQ ID NO: 583207 - RNA, 64 nt, hsa
ucauguaaccgaguguccucuugcguguccaaaaguagcccagggcuguagcacaggcuucaca

SEQ ID NO: 583208 - RNA, 64 nt, hsa; identical to SEQ ID NO: 225748

SEQ ID NO: 583209 - RNA, 64 nt, hsa; identical to SEQ ID NO: 225749

SEQ ID NO: 583210 - RNA, 64 nt, hsa; identical to SEQ ID NO: 225750

SEQ ID NO: 583211 - RNA, 64 nt, hsa; identical to SEQ ID NO: 225751

SEQ ID NO: 583212 - RNA, 64 nt, hsa; identical to SEQ ID NO: 225752

SEQ ID NO: 583213 - RNA, 64 nt, hsa; identical to SEQ ID NO: 225753

SEQ ID NO: 583214 - RNA, 64 nt, hsa; identical to SEQ ID NO: 225754

SEQ ID NO: 583215 - RNA, 64 nt, hsa; identical to SEQ ID NO: 225755

SEQ ID NO: 583216 - RNA, 57 nt, hsa; identical to SEQ ID NO: 225756

SEQ ID NO: 583217 - RNA, 64 nt, hsa; identical to SEQ ID NO: 225757

SEQ ID NO: 583218 - RNA, 64 nt, hsa; identical to SEQ ID NO: 225758

SEQ ID NO: 583219 - RNA, 64 nt, hsa; identical to SEQ ID NO: 225759

SEQ ID NO: 583220 - RNA, 64 nt, hsa; identical to SEQ ID NO: 225760

SEQ ID NO: 583221 - RNA, 64 nt, hsa; identical to SEQ ID NO: 225761

SEQ ID NO: 583222 - RNA, 64 nt, hsa; identical to SEQ ID NO: 225762

SEQ ID NO: 583223 - RNA, 64 nt, hsa; identical to SEQ ID NO: 225763

SEQ ID NO: 583224 - RNA, 64 nt, hsa; identical to SEQ ID NO: 225764

SEQ ID NO: 583225 - RNA, 64 nt, hsa; identical to SEQ ID NO: 225765

SEQ ID NO: 583226 - RNA, 53 nt, hsa; identical to SEQ ID NO: 225766

SEQ ID NO: 583227 - RNA, 64 nt, hsa; identical to SEQ ID NO: 225767

SEQ ID NO: 583228 - RNA, 64 nt, hsa
agcugcuuuuaucauacucuccuaguugugggccacgauuuaaaccaucagagaugacaagcca

SEQ ID NO: 583229 - RNA, 64 nt, hsa
uaguauuugcuuuuuaguccauuuuguuuucaauacgauuuaauaucgaucagaguaauucuuu

SEQ ID NO: 583230 - RNA, 64 nt, hsa
cccauuucuauuuauuuacugagcuucucugugaacgauuuagaaagaagcccaauauuauaau

SEQ ID NO: 583231 - RNA, 64 nt, hsa
ucgguucccauggacccggcaccccaccugcaugacgauuuauuuguaucugggaaaauauucu

SEQ ID NO: 583232 - RNA, 64 nt, hsa
gugaaugaaacugcccacaugaacuuuaugugcuacgauuuaacugcagccuugaacacacaca

SEQ ID NO: 583233 - RNA, 64 nt, hsa
gugauauauagagugucuaauuacaaaaucauauacgauuuauuuaauucucuucuguauugua

SEQ ID NO: 583234 - RNA, 64 nt, hsa
gguuucaacucaaaaccacccaacccggugguuaacgauuuaauacauauaaccaaaccggcag

SEQ ID NO: 583235 - RNA, 64 nt, hsa
gcuuuacuccaccuccuuacuuagaaaucacuuuacgauuuauuuccauuuuccacuuuuauag

SEQ ID NO: 583236 - RNA, 64 nt, hsa
uucugaaaaagccuucaaauaaagguauugcaacacgauuuauacauugcauaaaaucugucuu

SEQ ID NO: 583237 - RNA, 64 nt, hsa
ugucauacguuucuacuuaaauuauuaagcacuuacgauuuagauguaauaauuauauguaagg

SEQ ID NO: 583238 - RNA, 64 nt, hsa
gcugucaggucugauaguccucugcuaaaacaacacgauuuacauaaaaaaucuuacacaucug

SEQ ID NO: 583239 - RNA, 64 nt, hsa
aaagcaugaaaugugaauuuuuauuguuguacauacgauuuaagguauuuaaaguauuuucuuc

SEQ ID NO: 583240 - RNA, 64 nt, hsa
guuuuucauuuuuaaagaauauuauuauggaagcacgauuuauuuaaauagguacauugagacu

SEQ ID NO: 583241 - RNA, 64 nt, hsa
uguccucucuuucucuuccuuuuucucuuuauuaacgauuuaaauguaacuuucugaacacauu

SEQ ID NO: 583242 - RNA, 64 nt, hsa
uuucuucaagaauuuuaaacacuuuuauuuuuaaacgauuuaucaaaauucaucucuaaauuuu

SEQ ID NO: 583243 - RNA, 64 nt, hsa
ccagcucugaugcaaagagauauaauuuuaaugaacgauuuauccagcaguguguuccaggggu

SEQ ID NO: 583244 - RNA, 64 nt, hsa
ucccuuauuacagcacaacuguguaucuaaucuuacgauuuaggagaauguuaccuaggacauu

SEQ ID NO: 583245 - RNA, 64 nt, hsa
aguugaauuucugcagguguugcaaguauguucaacgauuuaaauuuuuuuuuauuuuucaaag

SEQ ID NO: 583246 - RNA, 64 nt, hsa
ucauccaugcugucccacaaauaguuuuuuguuuacgauuuaugacagguuuauguuacuucua

SEQ ID NO: 583247 - RNA, 64 nt, hsa
uuaagugggagaauaaguaaaugcauuauuauucacgauuuaaugagagaaagagaggaagaug

SEQ ID NO: 583248 - RNA, 64 nt, hsa
uuucaaagacucauguuucugcuaugaccaugacacgauuuaaaucuuuucaaauguuuuuagg

SEQ ID NO: 583249 - RNA, 64 nt, hsa
aaucaguaaaaucacaaaggucuauuuaaugaaaacgauuuaccaauguuguuuuuuuuuaaca

SEQ ID NO: 583250 - RNA, 64 nt, hsa
ggaaaagaaaaacccaguuucuuaggaaacgcaaacgauuuauuauccagauuauuuggauaag

SEQ ID NO: 583251 - RNA, 64 nt, hsa
gaaaagaaugaauggauucuaggaauguuagggaacgauuuacuuuacccgauggcuguaucaa

SEQ ID NO: 583252 - RNA, 64 nt, hsa
cuucaaacacccauuuuugcucuaugggaaaaaaacgauuuaccaauuaauauuacucagcaca

SEQ ID NO: 583253 - RNA, 64 nt, hsa
acugucuggcuucuuuugcauuuuuaaaaauaagacgauuuaauuuuaauuucauaggauuuua

SEQ ID NO: 583254 - RNA, 64 nt, hsa
cccuuucuuggugcugcuuuuuggguaggaccccacgauuuaggguaacuguuaucaucagcug

SEQ ID NO: 583255 - RNA, 64 nt, hsa
agcuuguguauccauuaucauguguaaucaauaaacgauuuaauucucuugaaugaaaugacaa

SEQ ID NO: 583256 - RNA, 64 nt, hsa
gccaaagccccuuccaggccugaauuccacaaguacgauuuacuguagugucuuaucacucuuu

SEQ ID NO: 583257 - RNA, 64 nt, hsa
gauucagcugaaccaccaggaaccuggcaacaucacgauuuaagcuaagguugggaggcuaacg

SEQ ID NO: 583258 - RNA, 64 nt, hsa
aauuuuucucucuaacacugucaauuaaauaaagacgauuuaauuuuagguuuggcuucauugu

SEQ ID NO: 583259 - RNA, 64 nt, hsa
uaaccugagacuugggaugaaauuuaaaccagauacgauuuacuuugcagaucauaaggcuuuu

SEQ ID NO: 583260 - RNA, 64 nt, hsa
agaauccagcaggucacacugggggcuucaggugacgauuuagcuguggcucccuccuccuguc

SEQ ID NO: 583261 - RNA, 64 nt, hsa
gucuaauguuuuuuaaaauuggugccagcaauucacgauuuauauuuuuugaauuaccaaauau

SEQ ID NO: 583262 - RNA, 64 nt, hsa
guguccagagaucuuggaaaauauuuuuucacccacgauuuauuuuguuauugaugauuuuuuu

SEQ ID NO: 583263 - RNA, 64 nt, hsa
gcaggagaugagaccagccuucuguguucaccuaacgauuuauacuguguaucugucuuugaug

SEQ ID NO: 583264 - RNA, 64 nt, hsa
gaucgggucuccacuccagcuuucucaauuaaagacgauuuauacaacugaagugcugucuguc

SEQ ID NO: 583265 - RNA, 64 nt, hsa
agagauggaggcuguggcggacuccuuccaacucacgauuuauccucagcucagaguguauuuu

SEQ ID NO: 583266 - RNA, 64 nt, hsa
accagcgcagccagcaggagccuggccugggaggacgauuuauuauuacacuggggguuuccuu

SEQ ID NO: 583267 - RNA, 64 nt, hsa
uaucuuuuuuaaaagaugugcuauuuauucuugcacgauuuaggcaauuaucucucuuccaggg

SEQ ID NO: 583268 - RNA, 64 nt, hsa
cuuuaucuaccagagccuuuuugguuugaccgccacgauuuagguuagucaguuuaaaaauugu

SEQ ID NO: 583269 - RNA, 64 nt, hsa
uuaacuuauuaaaaaaaaaaaaagaaaaagaaaaacgauuuaaaaaaaaaaaaaaaagcaacca

SEQ ID NO: 583270 - RNA, 64 nt, hsa
gacuaauggcaucagggcaaaaauauguuacuuuacgauuuaccuguuagcagguucuuguuuc

SEQ ID NO: 583271 - RNA, 64 nt, hsa
aguuuguuacguugacuauguucuucaaauugccacgauuuacaaauauugucauccgcuugcu

SEQ ID NO: 583272 - RNA, 64 nt, hsa
ucugcaucaggacauggccucguccacugagggcacgauuuaaacauuugacaucagaagcuuu

SEQ ID NO: 583273 - RNA, 64 nt, hsa
augcagcaaaaaccaauacaacaaaacgaguggcacgauuuauuucaaacuaggccagcuggga

SEQ ID NO: 583274 - RNA, 64 nt, hsa
cucaugugauuuacccuuuucaacuuuuuggaaaacgauuuaauuuauucuaauuagauuaacc

SEQ ID NO: 583275 - RNA, 64 nt, hsa
gagugcagauagcuacagagaggagggucaaagcacgauuuaaucaaggccugauucccaaguc

SEQ ID NO: 583276 - RNA, 64 nt, hsa
uugauacauucagcuuccugcugcuagcaaugccacgauuuagauuuaaugaugcuucagugga

SEQ ID NO: 583277 - RNA, 64 nt, hsa; identical to SEQ ID NO: 212069

SEQ ID NO: 583278 - RNA, 64 nt, hsa; identical to SEQ ID NO: 212070

SEQ ID NO: 583279 - RNA, 64 nt, hsa; identical to SEQ ID NO: 212071

SEQ ID NO: 583280 - RNA, 64 nt, hsa; identical to SEQ ID NO: 212072

SEQ ID NO: 583281 - RNA, 64 nt, hsa; identical to SEQ ID NO: 212073

SEQ ID NO: 583282 - RNA, 64 nt, hsa; identical to SEQ ID NO: 212074

SEQ ID NO: 583283 - RNA, 64 nt, hsa; identical to SEQ ID NO: 212075

SEQ ID NO: 583284 - RNA, 64 nt, hsa; identical to SEQ ID NO: 212076

SEQ ID NO: 583285 - RNA, 64 nt, hsa; identical to SEQ ID NO: 212077

SEQ ID NO: 583286 - RNA, 64 nt, hsa; identical to SEQ ID NO: 212078

SEQ ID NO: 583287 - RNA, 64 nt, hsa; identical to SEQ ID NO: 212079

SEQ ID NO: 583288 - RNA, 64 nt, hsa; identical to SEQ ID NO: 212080

SEQ ID NO: 583289 - RNA, 64 nt, hsa; identical to SEQ ID NO: 212081

SEQ ID NO: 583290 - RNA, 64 nt, hsa; identical to SEQ ID NO: 212082

SEQ ID NO: 583291 - RNA, 64 nt, hsa; identical to SEQ ID NO: 212083

SEQ ID NO: 583292 - RNA, 64 nt, hsa; identical to SEQ ID NO: 212084

SEQ ID NO: 583293 - RNA, 64 nt, hsa; identical to SEQ ID NO: 212085

SEQ ID NO: 583294 - RNA, 64 nt, hsa; identical to SEQ ID NO: 212086

SEQ ID NO: 583295 - RNA, 64 nt, hsa; identical to SEQ ID NO: 212087

SEQ ID NO: 583296 - RNA, 64 nt, hsa; identical to SEQ ID NO: 212088

SEQ ID NO: 583297 - RNA, 64 nt, hsa; identical to SEQ ID NO: 212089

SEQ ID NO: 583298 - RNA, 64 nt, hsa; identical to SEQ ID NO: 212090

SEQ ID NO: 583299 - RNA, 64 nt, hsa; identical to SEQ ID NO: 212091

SEQ ID NO: 583300 - RNA, 64 nt, hsa; identical to SEQ ID NO: 212092

SEQ ID NO: 583301 - RNA, 64 nt, hsa; identical to SEQ ID NO: 212093

SEQ ID NO: 583302 - RNA, 64 nt, hsa; identical to SEQ ID NO: 212094

SEQ ID NO: 583303 - RNA, 64 nt, hsa; identical to SEQ ID NO: 212095

SEQ ID NO: 583304 - RNA, 64 nt, hsa; identical to SEQ ID NO: 212096

SEQ ID NO: 583305 - RNA, 64 nt, hsa; identical to SEQ ID NO: 212097

SEQ ID NO: 583306 - RNA, 64 nt, hsa; identical to SEQ ID NO: 212098

SEQ ID NO: 583307 - RNA, 64 nt, hsa; identical to SEQ ID NO: 212099

SEQ ID NO: 583308 - RNA, 64 nt, hsa; identical to SEQ ID NO: 212100

SEQ ID NO: 583309 - RNA, 64 nt, hsa; identical to SEQ ID NO: 212101

SEQ ID NO: 583310 - RNA, 64 nt, hsa; identical to SEQ ID NO: 212102

SEQ ID NO: 583311 - RNA, 64 nt, hsa; identical to SEQ ID NO: 212103

SEQ ID NO: 583312 - RNA, 64 nt, hsa; identical to SEQ ID NO: 212104

SEQ ID NO: 583313 - RNA, 64 nt, hsa; identical to SEQ ID NO: 212105

SEQ ID NO: 583314 - RNA, 64 nt, hsa; identical to SEQ ID NO: 212106

SEQ ID NO: 583315 - RNA, 64 nt, hsa; identical to SEQ ID NO: 212107

SEQ ID NO: 583316 - RNA, 64 nt, hsa; identical to SEQ ID NO: 212108

SEQ ID NO: 583317 - RNA, 64 nt, hsa; identical to SEQ ID NO: 212109

SEQ ID NO: 583318 - RNA, 64 nt, hsa; identical to SEQ ID NO: 212110

SEQ ID NO: 583319 - RNA, 64 nt, hsa; identical to SEQ ID NO: 212111

SEQ ID NO: 583320 - RNA, 64 nt, hsa; identical to SEQ ID NO: 212112

SEQ ID NO: 583321 - RNA, 64 nt, hsa; identical to SEQ ID NO: 212113

SEQ ID NO: 583322 - RNA, 64 nt, hsa; identical to SEQ ID NO: 212114

SEQ ID NO: 583323 - RNA, 64 nt, hsa; identical to SEQ ID NO: 212115

SEQ ID NO: 583324 - RNA, 64 nt, hsa; identical to SEQ ID NO: 212116

SEQ ID NO: 583325 - RNA, 64 nt, hsa; identical to SEQ ID NO: 212117

SEQ ID NO: 583326 - RNA, 64 nt, hsa; identical to SEQ ID NO: 212118

SEQ ID NO: 583327 - RNA, 64 nt, hsa; identical to SEQ ID NO: 212119

SEQ ID NO: 583328 - RNA, 64 nt, hsa; identical to SEQ ID NO: 212120

SEQ ID NO: 583329 - RNA, 64 nt, hsa; identical to SEQ ID NO: 212121

SEQ ID NO: 583330 - RNA, 64 nt, hsa; identical to SEQ ID NO: 212122

SEQ ID NO: 583331 - RNA, 64 nt, hsa; identical to SEQ ID NO: 212123

SEQ ID NO: 583332 - RNA, 64 nt, hsa; identical to SEQ ID NO: 212124

SEQ ID NO: 583333 - RNA, 64 nt, hsa; identical to SEQ ID NO: 212125

SEQ ID NO: 583334 - RNA, 64 nt, hsa; identical to SEQ ID NO: 212126

SEQ ID NO: 583335 - RNA, 64 nt, hsa; identical to SEQ ID NO: 212127

SEQ ID NO: 583336 - RNA, 64 nt, hsa; identical to SEQ ID NO: 212128

SEQ ID NO: 583337 - RNA, 64 nt, hsa; identical to SEQ ID NO: 212129

SEQ ID NO: 583338 - RNA, 64 nt, hsa; identical to SEQ ID NO: 212130

SEQ ID NO: 583339 - RNA, 64 nt, hsa; identical to SEQ ID NO: 212131

SEQ ID NO: 583340 - RNA, 64 nt, hsa; identical to SEQ ID NO: 212132

SEQ ID NO: 583341 - RNA, 64 nt, hsa; identical to SEQ ID NO: 212133

SEQ ID NO: 583342 - RNA, 64 nt, hsa; identical to SEQ ID NO: 212134

SEQ ID NO: 583343 - RNA, 64 nt, hsa; identical to SEQ ID NO: 212135

SEQ ID NO: 583344 - RNA, 64 nt, hsa; identical to SEQ ID NO: 212136

SEQ ID NO: 583345 - RNA, 64 nt, hsa; identical to SEQ ID NO: 212137

SEQ ID NO: 583346 - RNA, 64 nt, hsa; identical to SEQ ID NO: 212138

SEQ ID NO: 583347 - RNA, 64 nt, hsa; identical to SEQ ID NO: 212139

SEQ ID NO: 583348 - RNA, 64 nt, hsa; identical to SEQ ID NO: 212140

SEQ ID NO: 583349 - RNA, 64 nt, hsa; identical to SEQ ID NO: 212141

SEQ ID NO: 583350 - RNA, 64 nt, hsa; identical to SEQ ID NO: 212142

SEQ ID NO: 583351 - RNA, 64 nt, hsa; identical to SEQ ID NO: 212143

SEQ ID NO: 583352 - RNA, 64 nt, hsa; identical to SEQ ID NO: 212144

SEQ ID NO: 583353 - RNA, 64 nt, hsa; identical to SEQ ID NO: 212145

SEQ ID NO: 583354 - RNA, 64 nt, hsa; identical to SEQ ID NO: 432758

SEQ ID NO: 583355 - RNA, 64 nt, hsa; identical to SEQ ID NO: 432759

SEQ ID NO: 583356 - RNA, 64 nt, hsa; identical to SEQ ID NO: 432760

SEQ ID NO: 583357 - RNA, 64 nt, hsa; identical to SEQ ID NO: 432761

SEQ ID NO: 583358 - RNA, 64 nt, hsa; identical to SEQ ID NO: 173045

SEQ ID NO: 583359 - RNA, 64 nt, hsa; identical to SEQ ID NO: 173046

SEQ ID NO: 583360 - RNA, 64 nt, hsa; identical to SEQ ID NO: 173047

SEQ ID NO: 583361 - RNA, 64 nt, hsa; identical to SEQ ID NO: 173048

SEQ ID NO: 583362 - RNA, 64 nt, hsa; identical to SEQ ID NO: 173049

SEQ ID NO: 583363 - RNA, 64 nt, hsa; identical to SEQ ID NO: 173050

SEQ ID NO: 583364 - RNA, 64 nt, hsa; identical to SEQ ID NO: 173051

SEQ ID NO: 583365 - RNA, 64 nt, hsa; identical to SEQ ID NO: 173052

SEQ ID NO: 583366 - RNA, 64 nt, hsa; identical to SEQ ID NO: 173053

SEQ ID NO: 583367 - RNA, 64 nt, hsa; identical to SEQ ID NO: 173054

SEQ ID NO: 583368 - RNA, 64 nt, hsa; identical to SEQ ID NO: 173055

SEQ ID NO: 583369 - RNA, 64 nt, hsa; identical to SEQ ID NO: 173056

SEQ ID NO: 583370 - RNA, 64 nt, hsa; identical to SEQ ID NO: 173057

SEQ ID NO: 583371 - RNA, 64 nt, hsa; identical to SEQ ID NO: 173058

SEQ ID NO: 583372 - RNA, 59 nt, hsa; identical to SEQ ID NO: 173059

SEQ ID NO: 583373 - RNA, 64 nt, hsa; identical to SEQ ID NO: 173060

SEQ ID NO: 583374 - RNA, 64 nt, hsa; identical to SEQ ID NO: 173061

SEQ ID NO: 583375 - RNA, 64 nt, hsa; identical to SEQ ID NO: 173062

SEQ ID NO: 583376 - RNA, 64 nt, hsa; identical to SEQ ID NO: 173063

SEQ ID NO: 583377 - RNA, 53 nt, hsa; identical to SEQ ID NO: 173064

SEQ ID NO: 583378 - RNA, 64 nt, hsa; identical to SEQ ID NO: 173065

SEQ ID NO: 583379 - RNA, 64 nt, hsa; identical to SEQ ID NO: 173066

SEQ ID NO: 583380 - RNA, 64 nt, hsa; identical to SEQ ID NO: 173067

SEQ ID NO: 583381 - RNA, 64 nt, hsa; identical to SEQ ID NO: 173068

SEQ ID NO: 583382 - RNA, 64 nt, hsa; identical to SEQ ID NO: 173069

SEQ ID NO: 583383 - RNA, 64 nt, hsa; identical to SEQ ID NO: 173070

SEQ ID NO: 583384 - RNA, 64 nt, hsa; identical to SEQ ID NO: 173071

SEQ ID NO: 583385 - RNA, 64 nt, hsa; identical to SEQ ID NO: 173072

SEQ ID NO: 583386 - RNA, 64 nt, hsa; identical to SEQ ID NO: 173073

SEQ ID NO: 583387 - RNA, 64 nt, hsa; identical to SEQ ID NO: 173074

SEQ ID NO: 583388 - RNA, 64 nt, hsa; identical to SEQ ID NO: 173075

SEQ ID NO: 583389 - RNA, 64 nt, hsa; identical to SEQ ID NO: 173076

SEQ ID NO: 583390 - RNA, 64 nt, hsa; identical to SEQ ID NO: 173077

SEQ ID NO: 583391 - RNA, 64 nt, hsa; identical to SEQ ID NO: 173078

SEQ ID NO: 583392 - RNA, 64 nt, hsa; identical to SEQ ID NO: 514707

SEQ ID NO: 583393 - RNA, 64 nt, hsa; identical to SEQ ID NO: 514708

SEQ ID NO: 583394 - RNA, 64 nt, hsa; identical to SEQ ID NO: 514709

SEQ ID NO: 583395 - RNA, 64 nt, hsa; identical to SEQ ID NO: 514710

SEQ ID NO: 583396 - RNA, 64 nt, hsa; identical to SEQ ID NO: 514711

SEQ ID NO: 583397 - RNA, 64 nt, hsa; identical to SEQ ID NO: 514712

SEQ ID NO: 583398 - RNA, 64 nt, hsa; identical to SEQ ID NO: 514713

SEQ ID NO: 583399 - RNA, 64 nt, hsa; identical to SEQ ID NO: 514714

SEQ ID NO: 583400 - RNA, 64 nt, hsa; identical to SEQ ID NO: 53480

SEQ ID NO: 583401 - RNA, 64 nt, hsa; identical to SEQ ID NO: 53481

SEQ ID NO: 583402 - RNA, 64 nt, hsa; identical to SEQ ID NO: 53482

SEQ ID NO: 583403 - RNA, 64 nt, hsa; identical to SEQ ID NO: 53483

SEQ ID NO: 583404 - RNA, 64 nt, hsa; identical to SEQ ID NO: 53484

SEQ ID NO: 583405 - RNA, 64 nt, hsa; identical to SEQ ID NO: 53485

SEQ ID NO: 583406 - RNA, 64 nt, hsa; identical to SEQ ID NO: 53486

SEQ ID NO: 583407 - RNA, 64 nt, hsa; identical to SEQ ID NO: 53487

SEQ ID NO: 583408 - RNA, 64 nt, hsa; identical to SEQ ID NO: 53488

SEQ ID NO: 583409 - RNA, 64 nt, hsa; identical to SEQ ID NO: 53489

SEQ ID NO: 583410 - RNA, 64 nt, hsa; identical to SEQ ID NO: 53490

SEQ ID NO: 583411 - RNA, 64 nt, hsa; identical to SEQ ID NO: 53491

SEQ ID NO: 583412 - RNA, 64 nt, hsa; identical to SEQ ID NO: 53492

SEQ ID NO: 583413 - RNA, 64 nt, hsa; identical to SEQ ID NO: 53493

SEQ ID NO: 583414 - RNA, 64 nt, hsa; identical to SEQ ID NO: 53494

SEQ ID NO: 583415 - RNA, 64 nt, hsa; identical to SEQ ID NO: 53495

SEQ ID NO: 583416 - RNA, 64 nt, hsa; identical to SEQ ID NO: 53496

SEQ ID NO: 583417 - RNA, 64 nt, hsa; identical to SEQ ID NO: 53497

SEQ ID NO: 583418 - RNA, 64 nt, hsa; identical to SEQ ID NO: 53498

SEQ ID NO: 583419 - RNA, 64 nt, hsa; identical to SEQ ID NO: 53499

SEQ ID NO: 583420 - RNA, 64 nt, hsa; identical to SEQ ID NO: 342523

SEQ ID NO: 583421 - RNA, 64 nt, hsa; identical to SEQ ID NO: 342524

SEQ ID NO: 583422 - RNA, 64 nt, hsa; identical to SEQ ID NO: 342525

SEQ ID NO: 583423 - RNA, 64 nt, hsa; identical to SEQ ID NO: 342526

SEQ ID NO: 583424 - RNA, 64 nt, hsa; identical to SEQ ID NO: 342527

SEQ ID NO: 583425 - RNA, 64 nt, hsa; identical to SEQ ID NO: 342528

SEQ ID NO: 583426 - RNA, 64 nt, hsa; identical to SEQ ID NO: 342529

SEQ ID NO: 583427 - RNA, 64 nt, hsa; identical to SEQ ID NO: 342530

SEQ ID NO: 583428 - RNA, 61 nt, hsa
agauuaauuauauuucucucacuuucuuagcugguccuauuuuuucacauucuggcaugug

SEQ ID NO: 583429 - RNA, 61 nt, hsa
cucuucaaugauauuucagcaguuucccucuugguccuaguuuugugcacauuuuuuugaa

SEQ ID NO: 583430 - RNA, 64 nt, hsa; identical to SEQ ID NO: 270631

SEQ ID NO: 583431 - RNA, 64 nt, hsa; identical to SEQ ID NO: 270632

SEQ ID NO: 583432 - RNA, 64 nt, hsa; identical to SEQ ID NO: 270633

SEQ ID NO: 583433 - RNA, 64 nt, hsa; identical to SEQ ID NO: 270634

SEQ ID NO: 583434 - RNA, 64 nt, hsa; identical to SEQ ID NO: 270635

SEQ ID NO: 583435 - RNA, 64 nt, hsa; identical to SEQ ID NO: 270636

SEQ ID NO: 583436 - RNA, 64 nt, hsa; identical to SEQ ID NO: 270637

SEQ ID NO: 583437 - RNA, 64 nt, hsa; identical to SEQ ID NO: 270638

SEQ ID NO: 583438 - RNA, 64 nt, hsa; identical to SEQ ID NO: 270639

SEQ ID NO: 583439 - RNA, 64 nt, hsa; identical to SEQ ID NO: 270640

SEQ ID NO: 583440 - RNA, 64 nt, hsa; identical to SEQ ID NO: 270641

SEQ ID NO: 583441 - RNA, 64 nt, hsa; identical to SEQ ID NO: 270642

SEQ ID NO: 583442 - RNA, 64 nt, hsa; identical to SEQ ID NO: 270643

SEQ ID NO: 583443 - RNA, 64 nt, hsa; identical to SEQ ID NO: 270644

SEQ ID NO: 583444 - RNA, 64 nt, hsa; identical to SEQ ID NO: 270645

SEQ ID NO: 583445 - RNA, 64 nt, hsa; identical to SEQ ID NO: 270646

SEQ ID NO: 583446 - RNA, 64 nt, hsa; identical to SEQ ID NO: 270647

SEQ ID NO: 583447 - RNA, 64 nt, hsa; identical to SEQ ID NO: 270648

SEQ ID NO: 583448 - RNA, 64 nt, hsa; identical to SEQ ID NO: 270649

SEQ ID NO: 583449 - RNA, 64 nt, hsa; identical to SEQ ID NO: 270650

SEQ ID NO: 583450 - RNA, 64 nt, hsa; identical to SEQ ID NO: 270651

SEQ ID NO: 583451 - RNA, 64 nt, hsa; identical to SEQ ID NO: 270652

SEQ ID NO: 583452 - RNA, 64 nt, hsa; identical to SEQ ID NO: 270653

SEQ ID NO: 583453 - RNA, 64 nt, hsa; identical to SEQ ID NO: 270654

SEQ ID NO: 583454 - RNA, 64 nt, hsa; identical to SEQ ID NO: 270655

SEQ ID NO: 583455 - RNA, 64 nt, hsa; identical to SEQ ID NO: 270656

SEQ ID NO: 583456 - RNA, 64 nt, hsa; identical to SEQ ID NO: 270657

SEQ ID NO: 583457 - RNA, 62 nt, hsa; identical to SEQ ID NO: 270658

SEQ ID NO: 583458 - RNA, 64 nt, hsa; identical to SEQ ID NO: 270659

SEQ ID NO: 583459 - RNA, 64 nt, hsa; identical to SEQ ID NO: 270660

SEQ ID NO: 583460 - RNA, 64 nt, hsa; identical to SEQ ID NO: 270661

SEQ ID NO: 583461 - RNA, 64 nt, hsa; identical to SEQ ID NO: 197032

SEQ ID NO: 583462 - RNA, 64 nt, hsa; identical to SEQ ID NO: 197033

SEQ ID NO: 583463 - RNA, 64 nt, hsa; identical to SEQ ID NO: 197034

SEQ ID NO: 583464 - RNA, 64 nt, hsa; identical to SEQ ID NO: 197035

SEQ ID NO: 583465 - RNA, 64 nt, hsa; identical to SEQ ID NO: 197036

SEQ ID NO: 583466 - RNA, 64 nt, hsa; identical to SEQ ID NO: 197037

SEQ ID NO: 583467 - RNA, 64 nt, hsa; identical to SEQ ID NO: 197038

SEQ ID NO: 583468 - RNA, 64 nt, hsa; identical to SEQ ID NO: 197039

SEQ ID NO: 583469 - RNA, 64 nt, hsa; identical to SEQ ID NO: 197040

SEQ ID NO: 583470 - RNA, 64 nt, hsa; identical to SEQ ID NO: 197041

SEQ ID NO: 583471 - RNA, 64 nt, hsa; identical to SEQ ID NO: 197042

SEQ ID NO: 583472 - RNA, 64 nt, hsa; identical to SEQ ID NO: 197043

SEQ ID NO: 583473 - RNA, 64 nt, hsa; identical to SEQ ID NO: 197044

SEQ ID NO: 583474 - RNA, 64 nt, hsa; identical to SEQ ID NO: 197045

SEQ ID NO: 583475 - RNA, 64 nt, hsa; identical to SEQ ID NO: 197046

SEQ ID NO: 583476 - RNA, 64 nt, hsa; identical to SEQ ID NO: 197047

SEQ ID NO: 583477 - RNA, 64 nt, hsa; identical to SEQ ID NO: 197048

SEQ ID NO: 583478 - RNA, 64 nt, hsa; identical to SEQ ID NO: 197049

SEQ ID NO: 583479 - RNA, 64 nt, hsa; identical to SEQ ID NO: 197050

SEQ ID NO: 583480 - RNA, 64 nt, hsa; identical to SEQ ID NO: 197051

SEQ ID NO: 583481 - RNA, 64 nt, hsa; identical to SEQ ID NO: 197052

SEQ ID NO: 583482 - RNA, 64 nt, hsa; identical to SEQ ID NO: 197053

SEQ ID NO: 583483 - RNA, 64 nt, hsa; identical to SEQ ID NO: 197054

SEQ ID NO: 583484 - RNA, 64 nt, hsa; identical to SEQ ID NO: 197055

SEQ ID NO: 583485 - RNA, 64 nt, hsa; identical to SEQ ID NO: 197056

SEQ ID NO: 583486 - RNA, 64 nt, hsa; identical to SEQ ID NO: 197057

SEQ ID NO: 583487 - RNA, 64 nt, hsa; identical to SEQ ID NO: 197058

SEQ ID NO: 583488 - RNA, 64 nt, hsa; identical to SEQ ID NO: 197059

SEQ ID NO: 583489 - RNA, 64 nt, hsa; identical to SEQ ID NO: 197060

SEQ ID NO: 583490 - RNA, 64 nt, hsa; identical to SEQ ID NO: 197061

SEQ ID NO: 583491 - RNA, 64 nt, hsa; identical to SEQ ID NO: 197062

SEQ ID NO: 583492 - RNA, 64 nt, hsa; identical to SEQ ID NO: 197063

SEQ ID NO: 583493 - RNA, 64 nt, hsa; identical to SEQ ID NO: 197064

SEQ ID NO: 583494 - RNA, 64 nt, hsa; identical to SEQ ID NO: 197065

SEQ ID NO: 583495 - RNA, 64 nt, hsa; identical to SEQ ID NO: 197066

SEQ ID NO: 583496 - RNA, 64 nt, hsa; identical to SEQ ID NO: 197067

SEQ ID NO: 583497 - RNA, 64 nt, hsa; identical to SEQ ID NO: 197068

SEQ ID NO: 583498 - RNA, 64 nt, hsa; identical to SEQ ID NO: 197069

SEQ ID NO: 583499 - RNA, 64 nt, hsa; identical to SEQ ID NO: 197070

SEQ ID NO: 583500 - RNA, 64 nt, hsa; identical to SEQ ID NO: 197071

SEQ ID NO: 583501 - RNA, 64 nt, hsa; identical to SEQ ID NO: 197072

SEQ ID NO: 583502 - RNA, 63 nt, hsa; identical to SEQ ID NO: 197073

SEQ ID NO: 583503 - RNA, 64 nt, hsa; identical to SEQ ID NO: 197074

SEQ ID NO: 583504 - RNA, 64 nt, hsa; identical to SEQ ID NO: 197075

SEQ ID NO: 583505 - RNA, 64 nt, hsa; identical to SEQ ID NO: 197076

SEQ ID NO: 583506 - RNA, 64 nt, hsa; identical to SEQ ID NO: 197077

SEQ ID NO: 583507 - RNA, 64 nt, hsa; identical to SEQ ID NO: 197078

SEQ ID NO: 583508 - RNA, 64 nt, hsa; identical to SEQ ID NO: 197079

SEQ ID NO: 583509 - RNA, 64 nt, hsa; identical to SEQ ID NO: 197080

SEQ ID NO: 583510 - RNA, 64 nt, hsa; identical to SEQ ID NO: 197081

SEQ ID NO: 583511 - RNA, 64 nt, hsa; identical to SEQ ID NO: 197082

SEQ ID NO: 583512 - RNA, 64 nt, hsa; identical to SEQ ID NO: 197083

SEQ ID NO: 583513 - RNA, 64 nt, hsa; identical to SEQ ID NO: 197084

SEQ ID NO: 583514 - RNA, 64 nt, hsa; identical to SEQ ID NO: 197085

SEQ ID NO: 583515 - RNA, 64 nt, hsa; identical to SEQ ID NO: 197086

SEQ ID NO: 583516 - RNA, 64 nt, hsa; identical to SEQ ID NO: 197087

SEQ ID NO: 583517 - RNA, 64 nt, hsa; identical to SEQ ID NO: 197088

SEQ ID NO: 583518 - RNA, 64 nt, hsa; identical to SEQ ID NO: 197089

SEQ ID NO: 583519 - RNA, 64 nt, hsa; identical to SEQ ID NO: 197090

SEQ ID NO: 583520 - RNA, 64 nt, hsa; identical to SEQ ID NO: 197091

SEQ ID NO: 583521 - RNA, 64 nt, hsa; identical to SEQ ID NO: 197092

SEQ ID NO: 583522 - RNA, 64 nt, hsa; identical to SEQ ID NO: 197093

SEQ ID NO: 583523 - RNA, 64 nt, hsa; identical to SEQ ID NO: 197094

SEQ ID NO: 583524 - RNA, 64 nt, hsa; identical to SEQ ID NO: 61460

SEQ ID NO: 583525 - RNA, 64 nt, hsa; identical to SEQ ID NO: 61461

SEQ ID NO: 583526 - RNA, 64 nt, hsa; identical to SEQ ID NO: 61462

SEQ ID NO: 583527 - RNA, 64 nt, hsa; identical to SEQ ID NO: 61463

SEQ ID NO: 583528 - RNA, 64 nt, hsa; identical to SEQ ID NO: 61464

SEQ ID NO: 583529 - RNA, 64 nt, hsa; identical to SEQ ID NO: 61465

SEQ ID NO: 583530 - RNA, 64 nt, hsa; identical to SEQ ID NO: 61466

SEQ ID NO: 583531 - RNA, 64 nt, hsa; identical to SEQ ID NO: 61467

SEQ ID NO: 583532 - RNA, 64 nt, hsa; identical to SEQ ID NO: 61468

SEQ ID NO: 583533 - RNA, 64 nt, hsa; identical to SEQ ID NO: 61469

SEQ ID NO: 583534 - RNA, 64 nt, hsa; identical to SEQ ID NO: 61470

SEQ ID NO: 583535 - RNA, 64 nt, hsa; identical to SEQ ID NO: 61471

SEQ ID NO: 583536 - RNA, 64 nt, hsa; identical to SEQ ID NO: 61472

SEQ ID NO: 583537 - RNA, 64 nt, hsa; identical to SEQ ID NO: 61473

SEQ ID NO: 583538 - RNA, 64 nt, hsa; identical to SEQ ID NO: 61474

SEQ ID NO: 583539 - RNA, 64 nt, hsa; identical to SEQ ID NO: 61475

SEQ ID NO: 583540 - RNA, 64 nt, hsa; identical to SEQ ID NO: 61476

SEQ ID NO: 583541 - RNA, 64 nt, hsa; identical to SEQ ID NO: 61477

SEQ ID NO: 583542 - RNA, 64 nt, hsa; identical to SEQ ID NO: 61478

SEQ ID NO: 583543 - RNA, 64 nt, hsa; identical to SEQ ID NO: 61479

SEQ ID NO: 583544 - RNA, 64 nt, hsa; identical to SEQ ID NO: 61480

SEQ ID NO: 583545 - RNA, 64 nt, hsa; identical to SEQ ID NO: 61481

SEQ ID NO: 583546 - RNA, 64 nt, hsa; identical to SEQ ID NO: 61482

SEQ ID NO: 583547 - RNA, 64 nt, hsa; identical to SEQ ID NO: 61483

SEQ ID NO: 583548 - RNA, 64 nt, hsa; identical to SEQ ID NO: 61484

SEQ ID NO: 583549 - RNA, 64 nt, hsa; identical to SEQ ID NO: 61485

SEQ ID NO: 583550 - RNA, 64 nt, hsa; identical to SEQ ID NO: 61486

SEQ ID NO: 583551 - RNA, 64 nt, hsa; identical to SEQ ID NO: 61487

SEQ ID NO: 583552 - RNA, 64 nt, hsa; identical to SEQ ID NO: 61488

SEQ ID NO: 583553 - RNA, 64 nt, hsa; identical to SEQ ID NO: 61489

SEQ ID NO: 583554 - RNA, 64 nt, hsa; identical to SEQ ID NO: 61490

SEQ ID NO: 583555 - RNA, 64 nt, hsa; identical to SEQ ID NO: 61491

SEQ ID NO: 583556 - RNA, 64 nt, hsa; identical to SEQ ID NO: 61492

SEQ ID NO: 583557 - RNA, 64 nt, hsa; identical to SEQ ID NO: 61493

SEQ ID NO: 583558 - RNA, 64 nt, hsa; identical to SEQ ID NO: 61494

SEQ ID NO: 583559 - RNA, 64 nt, hsa; identical to SEQ ID NO: 556838

SEQ ID NO: 583560 - RNA, 64 nt, hsa; identical to SEQ ID NO: 556839

SEQ ID NO: 583561 - RNA, 64 nt, hsa; identical to SEQ ID NO: 556840

SEQ ID NO: 583562 - RNA, 64 nt, hsa; identical to SEQ ID NO: 556841

SEQ ID NO: 583563 - RNA, 64 nt, hsa; identical to SEQ ID NO: 556842

SEQ ID NO: 583564 - RNA, 64 nt, hsa; identical to SEQ ID NO: 556843

SEQ ID NO: 583565 - RNA, 64 nt, hsa; identical to SEQ ID NO: 556844

SEQ ID NO: 583566 - RNA, 64 nt, hsa; identical to SEQ ID NO: 556845

SEQ ID NO: 583567 - RNA, 64 nt, hsa; identical to SEQ ID NO: 556846

SEQ ID NO: 583568 - RNA, 64 nt, hsa; identical to SEQ ID NO: 556847

SEQ ID NO: 583569 - RNA, 64 nt, hsa; identical to SEQ ID NO: 556848

SEQ ID NO: 583570 - RNA, 64 nt, hsa; identical to SEQ ID NO: 556849

SEQ ID NO: 583571 - RNA, 64 nt, hsa; identical to SEQ ID NO: 556850

SEQ ID NO: 583572 - RNA, 64 nt, hsa; identical to SEQ ID NO: 556851

SEQ ID NO: 583573 - RNA, 64 nt, hsa; identical to SEQ ID NO: 556852

SEQ ID NO: 583574 - RNA, 64 nt, hsa; identical to SEQ ID NO: 556853

SEQ ID NO: 583575 - RNA, 64 nt, hsa; identical to SEQ ID NO: 556854

SEQ ID NO: 583576 - RNA, 64 nt, hsa; identical to SEQ ID NO: 556855

SEQ ID NO: 583577 - RNA, 64 nt, hsa; identical to SEQ ID NO: 556856

SEQ ID NO: 583578 - RNA, 64 nt, hsa; identical to SEQ ID NO: 556857

SEQ ID NO: 583579 - RNA, 64 nt, hsa; identical to SEQ ID NO: 556858

SEQ ID NO: 583580 - RNA, 64 nt, hsa; identical to SEQ ID NO: 556859

SEQ ID NO: 583581 - RNA, 64 nt, hsa; identical to SEQ ID NO: 556860

SEQ ID NO: 583582 - RNA, 64 nt, hsa; identical to SEQ ID NO: 556861

SEQ ID NO: 583583 - RNA, 64 nt, hsa; identical to SEQ ID NO: 71120

SEQ ID NO: 583584 - RNA, 64 nt, hsa; identical to SEQ ID NO: 71121

SEQ ID NO: 583585 - RNA, 64 nt, hsa; identical to SEQ ID NO: 71122

SEQ ID NO: 583586 - RNA, 64 nt, hsa; identical to SEQ ID NO: 71123

SEQ ID NO: 583587 - RNA, 64 nt, hsa; identical to SEQ ID NO: 71124

SEQ ID NO: 583588 - RNA, 64 nt, hsa; identical to SEQ ID NO: 71125

SEQ ID NO: 583589 - RNA, 64 nt, hsa; identical to SEQ ID NO: 71126

SEQ ID NO: 583590 - RNA, 64 nt, hsa; identical to SEQ ID NO: 71127

SEQ ID NO: 583591 - RNA, 64 nt, hsa; identical to SEQ ID NO: 71128

SEQ ID NO: 583592 - RNA, 64 nt, hsa; identical to SEQ ID NO: 71129

SEQ ID NO: 583593 - RNA, 64 nt, hsa; identical to SEQ ID NO: 71130

SEQ ID NO: 583594 - RNA, 64 nt, hsa; identical to SEQ ID NO: 71131

SEQ ID NO: 583595 - RNA, 64 nt, hsa; identical to SEQ ID NO: 71132

SEQ ID NO: 583596 - RNA, 64 nt, hsa; identical to SEQ ID NO: 71133

SEQ ID NO: 583597 - RNA, 64 nt, hsa; identical to SEQ ID NO: 71134

SEQ ID NO: 583598 - RNA, 64 nt, hsa; identical to SEQ ID NO: 71135

SEQ ID NO: 583599 - RNA, 64 nt, hsa; identical to SEQ ID NO: 71136

SEQ ID NO: 583600 - RNA, 64 nt, hsa; identical to SEQ ID NO: 71137

SEQ ID NO: 583601 - RNA, 64 nt, hsa; identical to SEQ ID NO: 71138

SEQ ID NO: 583602 - RNA, 64 nt, hsa; identical to SEQ ID NO: 71139

SEQ ID NO: 583603 - RNA, 64 nt, hsa; identical to SEQ ID NO: 71140

SEQ ID NO: 583604 - RNA, 64 nt, hsa; identical to SEQ ID NO: 71141

SEQ ID NO: 583605 - RNA, 64 nt, hsa; identical to SEQ ID NO: 71142

SEQ ID NO: 583606 - RNA, 64 nt, hsa; identical to SEQ ID NO: 71143

SEQ ID NO: 583607 - RNA, 64 nt, hsa; identical to SEQ ID NO: 71144

SEQ ID NO: 583608 - RNA, 64 nt, hsa; identical to SEQ ID NO: 71145

SEQ ID NO: 583609 - RNA, 64 nt, hsa; identical to SEQ ID NO: 71146

SEQ ID NO: 583610 - RNA, 62 nt, hsa; identical to SEQ ID NO: 71147

SEQ ID NO: 583611 - RNA, 64 nt, hsa; identical to SEQ ID NO: 71148

SEQ ID NO: 583612 - RNA, 64 nt, hsa; identical to SEQ ID NO: 71149

SEQ ID NO: 583613 - RNA, 64 nt, hsa; identical to SEQ ID NO: 71150

SEQ ID NO: 583614 - RNA, 64 nt, hsa; identical to SEQ ID NO: 71151

SEQ ID NO: 583615 - RNA, 64 nt, hsa; identical to SEQ ID NO: 71152

SEQ ID NO: 583616 - RNA, 64 nt, hsa; identical to SEQ ID NO: 71153

SEQ ID NO: 583617 - RNA, 64 nt, hsa; identical to SEQ ID NO: 71154

SEQ ID NO: 583618 - RNA, 64 nt, hsa; identical to SEQ ID NO: 71155

SEQ ID NO: 583619 - RNA, 64 nt, hsa; identical to SEQ ID NO: 71156

SEQ ID NO: 583620 - RNA, 64 nt, hsa; identical to SEQ ID NO: 71157

SEQ ID NO: 583621 - RNA, 64 nt, hsa; identical to SEQ ID NO: 71158

SEQ ID NO: 583622 - RNA, 64 nt, hsa; identical to SEQ ID NO: 71159

SEQ ID NO: 583623 - RNA, 64 nt, hsa; identical to SEQ ID NO: 71160

SEQ ID NO: 583624 - RNA, 64 nt, hsa; identical to SEQ ID NO: 71161

SEQ ID NO: 583625 - RNA, 64 nt, hsa; identical to SEQ ID NO: 71162

SEQ ID NO: 583626 - RNA, 64 nt, hsa; identical to SEQ ID NO: 71163

SEQ ID NO: 583627 - RNA, 64 nt, hsa; identical to SEQ ID NO: 71164

SEQ ID NO: 583628 - RNA, 64 nt, hsa; identical to SEQ ID NO: 71165

SEQ ID NO: 583629 - RNA, 64 nt, hsa; identical to SEQ ID NO: 71166

SEQ ID NO: 583630 - RNA, 64 nt, hsa; identical to SEQ ID NO: 71167

SEQ ID NO: 583631 - RNA, 64 nt, hsa; identical to SEQ ID NO: 71168

SEQ ID NO: 583632 - RNA, 64 nt, hsa; identical to SEQ ID NO: 71169

SEQ ID NO: 583633 - RNA, 64 nt, hsa; identical to SEQ ID NO: 71170

SEQ ID NO: 583634 - RNA, 64 nt, hsa; identical to SEQ ID NO: 71171

SEQ ID NO: 583635 - RNA, 64 nt, hsa; identical to SEQ ID NO: 71172

SEQ ID NO: 583636 - RNA, 64 nt, hsa; identical to SEQ ID NO: 71173

SEQ ID NO: 583637 - RNA, 64 nt, hsa; identical to SEQ ID NO: 71174

SEQ ID NO: 583638 - RNA, 64 nt, hsa; identical to SEQ ID NO: 71175

SEQ ID NO: 583639 - RNA, 64 nt, hsa; identical to SEQ ID NO: 71176

SEQ ID NO: 583640 - RNA, 64 nt, hsa; identical to SEQ ID NO: 71177

SEQ ID NO: 583641 - RNA, 64 nt, hsa; identical to SEQ ID NO: 71178

SEQ ID NO: 583642 - RNA, 64 nt, hsa; identical to SEQ ID NO: 71179

SEQ ID NO: 583643 - RNA, 64 nt, hsa; identical to SEQ ID NO: 71180

SEQ ID NO: 583644 - RNA, 64 nt, hsa; identical to SEQ ID NO: 71181

SEQ ID NO: 583645 - RNA, 64 nt, hsa; identical to SEQ ID NO: 71182

SEQ ID NO: 583646 - RNA, 64 nt, hsa; identical to SEQ ID NO: 71183

SEQ ID NO: 583647 - RNA, 64 nt, hsa; identical to SEQ ID NO: 71184

SEQ ID NO: 583648 - RNA, 64 nt, hsa; identical to SEQ ID NO: 71185

SEQ ID NO: 583649 - RNA, 64 nt, hsa; identical to SEQ ID NO: 71186

SEQ ID NO: 583650 - RNA, 64 nt, hsa; identical to SEQ ID NO: 71187

SEQ ID NO: 583651 - RNA, 64 nt, hsa; identical to SEQ ID NO: 71188

SEQ ID NO: 583652 - RNA, 64 nt, hsa; identical to SEQ ID NO: 71189

SEQ ID NO: 583653 - RNA, 64 nt, hsa; identical to SEQ ID NO: 71190

SEQ ID NO: 583654 - RNA, 64 nt, hsa; identical to SEQ ID NO: 71191

SEQ ID NO: 583655 - RNA, 64 nt, hsa; identical to SEQ ID NO: 71192

SEQ ID NO: 583656 - RNA, 64 nt, hsa; identical to SEQ ID NO: 71193

SEQ ID NO: 583657 - RNA, 64 nt, hsa; identical to SEQ ID NO: 71194

SEQ ID NO: 583658 - RNA, 64 nt, hsa; identical to SEQ ID NO: 71195

SEQ ID NO: 583659 - RNA, 64 nt, hsa; identical to SEQ ID NO: 71196

SEQ ID NO: 583660 - RNA, 64 nt, hsa; identical to SEQ ID NO: 71197

SEQ ID NO: 583661 - RNA, 64 nt, hsa; identical to SEQ ID NO: 71198

SEQ ID NO: 583662 - RNA, 64 nt, hsa; identical to SEQ ID NO: 71199

SEQ ID NO: 583663 - RNA, 64 nt, hsa; identical to SEQ ID NO: 71200

SEQ ID NO: 583664 - RNA, 64 nt, hsa; identical to SEQ ID NO: 71201

SEQ ID NO: 583665 - RNA, 64 nt, hsa; identical to SEQ ID NO: 71202

SEQ ID NO: 583666 - RNA, 64 nt, hsa; identical to SEQ ID NO: 71203

SEQ ID NO: 583667 - RNA, 64 nt, hsa; identical to SEQ ID NO: 71204

SEQ ID NO: 583668 - RNA, 64 nt, hsa; identical to SEQ ID NO: 71205

SEQ ID NO: 583669 - RNA, 64 nt, hsa; identical to SEQ ID NO: 71206

SEQ ID NO: 583670 - RNA, 64 nt, hsa; identical to SEQ ID NO: 71207

SEQ ID NO: 583671 - RNA, 64 nt, hsa; identical to SEQ ID NO: 71208

SEQ ID NO: 583672 - RNA, 64 nt, hsa
aaugaagcaacacuugagcuguucaggccaguucccuguugaagaaacaguucccuguugaaga

SEQ ID NO: 583673 - RNA, 64 nt, hsa
uguucaggccaguucccuguugaagaaacaguucccuguugaagaaaguagagccugacacugc

SEQ ID NO: 583674 - RNA, 64 nt, hsa
gguugcacuuucauuugcuuuaguucuagaaucaccuguugacuccucagacuucaccuaacuu

SEQ ID NO: 583675 - RNA, 64 nt, hsa
ccuaacaaagaagucugucuaagacaguacaucuccuguugaacuugcaucuuuccacaggacu

SEQ ID NO: 583676 - RNA, 64 nt, hsa
ggcaaucauaaaaaguaauaaagguucuuuuugaccuguugacaaauguauuuaagccuuugga

SEQ ID NO: 583677 - RNA, 64 nt, hsa
guugacaaauguauuuaagccuuuggauuuaaagccuguugaggcuggaguuaggaggcagauu

SEQ ID NO: 583678 - RNA, 64 nt, hsa
acuuuuuguuguuuaauguguagcuuguuugugcccuguugacauaaauguuuccuggguuugc

SEQ ID NO: 583679 - RNA, 64 nt, hsa
cccauugaucaccuugugcccucuuuuggggcagccuguugaaacugaagcacagucugaccac

SEQ ID NO: 583680 - RNA, 64 nt, hsa
ugagucuucagggcagugucuccaugaggguuuuccuguugaggggcaccacauacaauagugu

SEQ ID NO: 583681 - RNA, 64 nt, hsa
uguuuugugcaugaguaguacuuguguugauacuccuguugauguuaaauuacuauauaauaua

SEQ ID NO: 583682 - RNA, 64 nt, hsa
acacagauuauguuccugcuguauuuccugcuucccuguugaauuggugaauaaaaccuugcuc

SEQ ID NO: 583683 - RNA, 64 nt, hsa
auugugcccacccagggaaggugcugaaugggacccuguugauggccccaucuggauguaaauc

SEQ ID NO: 583684 - RNA, 64 nt, hsa
uucuguacuaagaaaaauucuucugccuugggauccuguugaucuaugaccuuacccccaaccu

SEQ ID NO: 583685 - RNA, 64 nt, hsa
acaagcuagucuagcucacugcagccaagcaaacccuguugauggcugaugggccuuuccauua

SEQ ID NO: 583686 - RNA, 64 nt, hsa
uagugagagaggaggccuggaccgagaugugaguccuguugaagacuuccucucuaccccccac

SEQ ID NO: 583687 - RNA, 64 nt, hsa
gugugugaacugggcacagauugaagaaucugccccuguugaggugggugggccugacuguugc

SEQ ID NO: 583688 - RNA, 64 nt, hsa
gccuggggcucuggggguccccgcugaccuggccccuguugacgucgaguucuccuuucccaag

SEQ ID NO: 583689 - RNA, 64 nt, hsa
ggaucuagaagucuuggguccccgucccuacacuccuguugacucauuuggagauccuagaugg

SEQ ID NO: 583690 - RNA, 64 nt, hsa
uaguccagucuucauuuuacauacacacacauauuuuacacacacacacauuuuacacacacac

SEQ ID NO: 583691 - RNA, 64 nt, hsa
uacauacacacacauauuuuacacacacacacauuuuacacacacacacacacacacacacaua

SEQ ID NO: 583692 - RNA, 64 nt, hsa
uaguuagggaaucuugugugaaaaucagcuuguauuuacacaaacccagaugguagagccuauu

SEQ ID NO: 583693 - RNA, 64 nt, hsa
uuuaacaccccacaccaauuuuaguuucauuacuuuuacacacaccauuuuaucacaaaugacu

SEQ ID NO: 583694 - RNA, 64 nt, hsa
uuucuguaaaaauuguauuguauauaaugugauuuuuacacauacauacacacacaaauacaca

SEQ ID NO: 583695 - RNA, 64 nt, hsa
gcaauauaaaauucauaggaguauuaauagcccauuuacacaucuauaaaauguaaugggauug

SEQ ID NO: 583696 - RNA, 64 nt, hsa
acaucaagaaacagacacacauaccuaggaaagauuuacacaauagauaaucaucuuaauguga

SEQ ID NO: 583697 - RNA, 64 nt, hsa
aaaguuagaucaagagaauauuucagaguuuugguuuacacaucaagaaacagacacacauacc

SEQ ID NO: 583698 - RNA, 64 nt, hsa
guugggaguaguuaauaguaaauaagacucugacuuuacacaagcuacacauuuuauacuuuuc

SEQ ID NO: 583699 - RNA, 64 nt, hsa
uucuaugaaauuccauauaaagaaugaugauaaguuuacacacugugcaaucucacaaucugaa

SEQ ID NO: 583700 - RNA, 64 nt, hsa
cauuucgaaucuguuuuucaugauuuauagaggguuuacacaaagugccacuuauuaaagagcu

SEQ ID NO: 583701 - RNA, 64 nt, hsa
aaauguugugauggcaagccuuacccaaauaucguuuacacagagagaugacuauggcagugau

SEQ ID NO: 583702 - RNA, 64 nt, hsa
auaaaucaucaaauauaucagauuaagaccaggguuuacacacuuaggcaauaguccuuuccaa

SEQ ID NO: 583703 - RNA, 64 nt, hsa
gcacagaguugaccaaacacuggcguaaguucaauuuacacagaauauuugaauugaaacaaua

SEQ ID NO: 583704 - RNA, 64 nt, hsa
cauauguaaaauauguuuugcuuaauguggacaauuuacacacccaacacauacuguuuccaaa

SEQ ID NO: 583705 - RNA, 64 nt, hsa
agccuuugguggauguuauggggcaaaguuaugauuuacacagaagcaacugccaaaucugugg

SEQ ID NO: 583706 - RNA, 64 nt, hsa
uaguaaacaauauuucuacuucccacaucuuugcuuuacacagucaccuugcccuuccuuccac

SEQ ID NO: 583707 - RNA, 64 nt, hsa
aauuaccaggcacagauuuagucuugucauuuuguuuacacauuggggaaaacaauucaguuua

SEQ ID NO: 583708 - RNA, 64 nt, hsa
cccugcccaagacuuuauuuaacccuggacuccguuuacacagacaaagugacaucagaaggcu

SEQ ID NO: 583709 - RNA, 64 nt, hsa
ugaguguuuuuaauuuaaagauaaaagccuguguuuuacacauucuuuuuugguguucauagcu

SEQ ID NO: 583710 - RNA, 64 nt, hsa
gcuguuagccuuagagugauugcagugaacacuguuuacacaccgugaauccauucccaucagu

SEQ ID NO: 583711 - RNA, 64 nt, hsa
cguuuucagucaguguuguccagcaacgguaccguuuacacagucaccucagacacaccauuuc

SEQ ID NO: 583712 - RNA, 64 nt, hsa; identical to SEQ ID NO: 216241

SEQ ID NO: 583713 - RNA, 64 nt, hsa; identical to SEQ ID NO: 216242

SEQ ID NO: 583714 - RNA, 64 nt, hsa; identical to SEQ ID NO: 216243

SEQ ID NO: 583715 - RNA, 64 nt, hsa; identical to SEQ ID NO: 216244

SEQ ID NO: 583716 - RNA, 64 nt, hsa
uaaaagaaauaguaaagauaaguuauccucacuuaggcaaaagcacagguccuuuccauaucaa

SEQ ID NO: 583717 - RNA, 64 nt, hsa
uuuaaauuauaaaacacuuuuaauuauauauaugaggcaaaagaacuaagacuuuuuucaaacu

SEQ ID NO: 583718 - RNA, 64 nt, hsa
uugagaaacuucugcauuuaguuucuaucuuuccaggcaaaacaaauggguauucuuuucauac

SEQ ID NO: 583719 - RNA, 64 nt, hsa
aaaaugaguaacuuugauaaaguuuuucaugcacaggcaaaauguauucacuagauuucuacgu

SEQ ID NO: 583720 - RNA, 64 nt, hsa
augcagagugcuugugaggguuucacuaaaacagaggcaaaacuguccauugaauucaguaaca

SEQ ID NO: 583721 - RNA, 64 nt, hsa
uuuggaaauugagagguggagcaaucucagguaaaggcaaaauagaggguaugaccugggguug

SEQ ID NO: 583722 - RNA, 64 nt, hsa
agauacucccagauccuaaauccaguagccucccaggcaaaauauagcaaucugccacaacugc

SEQ ID NO: 583723 - RNA, 64 nt, hsa
ccagcagccccaaccacagcauucccuaacauggaggcaaaauaccacauggcuucucccgcau

SEQ ID NO: 583724 - RNA, 64 nt, hsa
acuuguuucuuaagacuauuucacaaguccugugaggcaaaaaaacaaaacaaaacaaaacaac

SEQ ID NO: 583725 - RNA, 64 nt, hsa
guuucauccuauccgagggaugagauuaaggcagaggcaaaaguuucacacaaaguuucugcaa

SEQ ID NO: 583726 - RNA, 64 nt, hsa
uauuuccccgucccuuaaaaagacaaaaaaaauaaggcaaaaggaaagcaacuaagacacugga

SEQ ID NO: 583727 - RNA, 64 nt, hsa
ggaaagaggaaaaaauacacauguucuuucauauaggcaaaauuuaaccacauaaauuugcacu

SEQ ID NO: 583728 - RNA, 64 nt, hsa
guugauauagguggacuuuuuuacaggucaguugaggcaaaaaacuauggguuuuuucagguga

SEQ ID NO: 583729 - RNA, 64 nt, hsa
auaguauuuggaaugaauggaagaauauggguuaaggcaaaaaccauccagcagacuuuaauuu

SEQ ID NO: 583730 - RNA, 64 nt, hsa
cauauucaauauuaaaauaguuuuauauuugggaaggcaaaaaugaaucuauuguuuugcaaua

SEQ ID NO: 583731 - RNA, 64 nt, hsa
augaaucuauuguuuugcaauauagguuauaaacaggcaaaaugcaauaaaauauauaucuggu

SEQ ID NO: 583732 - RNA, 64 nt, hsa
cacaugacuggggaggccucagaaucauggugggaggcaaaaagcacuucuuacauggcggcag

SEQ ID NO: 583733 - RNA, 64 nt, hsa
guuguaugauugcaauuauaugacauucugggagaggcaaaacuaucgagcgagucaaaggacc

SEQ ID NO: 583734 - RNA, 64 nt, hsa
uuugugaggccaggauuacccuaauaccaaagccaggcaaaaacauuacaagaaaggaaaacua

SEQ ID NO: 583735 - RNA, 64 nt, hsa
gaccauugucccaaagucuagagucuuuacagguaggcaaaauuuguuuucaaugccugugccu

SEQ ID NO: 583736 - RNA, 64 nt, hsa
cacucaaccugcugagguguggauggggaaacagaggcaaaacugaggcaccugaugcauucag

SEQ ID NO: 583737 - RNA, 64 nt, hsa
uccagauuucccuccaugauuugggaaccagcuuaggcaaaagaguccccacaagaugaaaaua

SEQ ID NO: 583738 - RNA, 64 nt, hsa
aaucuccuacuuaauauaugaccaugacuuugaaaggcaaaagaggaaucaagaauaaauaaaa

SEQ ID NO: 583739 - RNA, 64 nt, hsa
gcacaggccaagguaggggaguaaaaaggaggucaggcaaaagggaggaguuuucuguccuuuc

SEQ ID NO: 583740 - RNA, 64 nt, hsa
ucagguguuuuaagaugucucugagaagccaucaaggcaaaagagaacuuuaaguuccuuguuc

SEQ ID NO: 583741 - RNA, 64 nt, hsa
ugaauagaacugagauuuuuauguaauuaguuauaggcaaaauacuuucauauuuuuagauuag

SEQ ID NO: 583742 - RNA, 64 nt, hsa
acuucuucuuguaaaaauaaguaauuuacaggaaaggcaaaaugcuaauacuaacauuuguagc

SEQ ID NO: 583743 - RNA, 64 nt, hsa
uguaaaacaaucaaaaguaggcguaagcagaauaaggcaaaagggaaaguguucuagguuccag

SEQ ID NO: 583744 - RNA, 64 nt, hsa
gacaauguuuuuaauuacaaauccagaauucuguaggcaaaaugcuacaguucauaucuuccuu

SEQ ID NO: 583745 - RNA, 64 nt, hsa
aauaugaaagaaaaauggaucccaaucugagaaaaggcaaaagaauggcuacuuuuuucuaugc

SEQ ID NO: 583746 - RNA, 64 nt, hsa
ugcucccagauuacuccuuccuuccaauauaacuaggcaaaaagaagugaggagaaaccugcau

SEQ ID NO: 583747 - RNA, 64 nt, hsa
uuugaaggcaaaauugcaaaucuugaaauuaagaaggcaaaaauguaaaggagucaaaacuaca

SEQ ID NO: 583748 - RNA, 64 nt, hsa
acuuuuuacaauuaaaaaaaaagaucuguuuugaaggcaaaauugcaaaucuugaaauuaagaa

SEQ ID NO: 583749 - RNA, 64 nt, hsa; identical to SEQ ID NO: 60569

SEQ ID NO: 583750 - RNA, 64 nt, hsa; identical to SEQ ID NO: 60570

SEQ ID NO: 583751 - RNA, 64 nt, hsa; identical to SEQ ID NO: 60571

SEQ ID NO: 583752 - RNA, 64 nt, hsa; identical to SEQ ID NO: 60572

SEQ ID NO: 583753 - RNA, 64 nt, hsa; identical to SEQ ID NO: 60573

SEQ ID NO: 583754 - RNA, 64 nt, hsa; identical to SEQ ID NO: 60574

SEQ ID NO: 583755 - RNA, 64 nt, hsa; identical to SEQ ID NO: 60575

SEQ ID NO: 583756 - RNA, 64 nt, hsa; identical to SEQ ID NO: 60576

SEQ ID NO: 583757 - RNA, 64 nt, hsa; identical to SEQ ID NO: 60577

SEQ ID NO: 583758 - RNA, 64 nt, hsa; identical to SEQ ID NO: 60578

SEQ ID NO: 583759 - RNA, 64 nt, hsa; identical to SEQ ID NO: 60579

SEQ ID NO: 583760 - RNA, 64 nt, hsa; identical to SEQ ID NO: 60580

SEQ ID NO: 583761 - RNA, 64 nt, hsa
uguuuuaaaaucuuauuuaaauuuaaaccagaagcugaaaaauagaucagcuuuauuauacaca

SEQ ID NO: 583762 - RNA, 64 nt, hsa
guaauaccaacauaugggccccaucugcacacuccugaaaaacagaaaguguauucaaauuuua

SEQ ID NO: 583763 - RNA, 64 nt, hsa
ccaaaaaaaucaagauuuaauuuuuuuauuuguacugaaaaacuaaucauaacuguuaauucuc

SEQ ID NO: 583764 - RNA, 64 nt, hsa
ccuauuuaugaauccugucgguauuccuugguaucugaaaaaaauaccaaauaguaccauacau

SEQ ID NO: 583765 - RNA, 64 nt, hsa
auguuagcuacuaugaauggugccagugaagacacugaaaaauaagugauuucaguaaccuucu

SEQ ID NO: 583766 - RNA, 64 nt, hsa
aaggccccacugauaagguaacauuugagcaagucugaaaaaggcaaggggaucuuuggggcua

SEQ ID NO: 583767 - RNA, 64 nt, hsa
caggucuauacuuaagggaaaaguugcaagaaugcugaaaaaaaauugaacacaaucucauuga

SEQ ID NO: 583768 - RNA, 64 nt, hsa
uuggauuaacccucuauagacagaauagauagcacugaaaaaaaaucucuaugagcuaaauguc

SEQ ID NO: 583769 - RNA, 64 nt, hsa
agaucuagugguucacacagagagagagagaguacugaaaaagcaacuccucuucuuagucuua

SEQ ID NO: 583770 - RNA, 64 nt, hsa
gccuuccaagucaguccuuuggaaaccagcaggucugaaaaagaggcugcaucaaugcaagccu

SEQ ID NO: 583771 - RNA, 64 nt, hsa
uagacauuauuggcaaaauugcucaucccuaauccugaaaaacaggccagaauggguaaagacu

SEQ ID NO: 583772 - RNA, 64 nt, hsa
ucccuuccuuaacucucccccuuugcccuccgcccugaaaaagguguccuugaagucccuucca

SEQ ID NO: 583773 - RNA, 64 nt, hsa
uucaguaccuucaccugucucagucucuagagcccugaaaaauaaaaacaaacuuauuuuuauc

SEQ ID NO: 583774 - RNA, 56 nt, hsa
uuugcaaguucaaaaacuagaggaagcugaaaaauggaugucuagaacugguccug

SEQ ID NO: 583775 - RNA, 64 nt, hsa
aaaaauaaggcuaguguacuacaaaagagacuaucugaaaaagaagaaauaaaaucgcaguuaa

SEQ ID NO: 583776 - RNA, 64 nt, hsa
ucacugugagcaacuuagaguaaaaauucgaaaacugaaaaauaaggcuaguguacuacaaaag

SEQ ID NO: 583777 - RNA, 64 nt, hsa
uuugauaaugaaaaaaaucuuugcuuguuuauuucugaaaaagaacuguauuuagugauuauuu

SEQ ID NO: 583778 - RNA, 64 nt, hsa
accuguagacuguggaacuauuuuaccuuaagaccugaaaaaguuuuguggauuauaaauuucu

SEQ ID NO: 583779 - RNA, 64 nt, hsa
cgagccuuuaaacagcaguuuguaaacuaugcaacugaaaaacugaggaugauuguuagcucca

SEQ ID NO: 583780 - RNA, 64 nt, hsa
gguggggcugugagcucuuaauuuguuuuugauucugaaaaacucugcuuccuggcauccagga

SEQ ID NO: 583781 - RNA, 64 nt, hsa
gcaucagcaaggcauugacuucugaaaaaaugaucugaaaaaaguuucaccguuugucuucuua

SEQ ID NO: 583782 - RNA, 64 nt, hsa
cauguugcgcuuugcaucagcaaggcauugacuucugaaaaaaugaucugaaaaaaguuucacc

SEQ ID NO: 583783 - RNA, 64 nt, hsa
cuuugcagguaucacagccuugcagaagaaccaacugaaaaaaaaauucucaggcuuuacagca

SEQ ID NO: 583784 - RNA, 64 nt, hsa
cacauucuaccagcacaaggaaacauaggcagcacugaaaaaaaaaaaaaagcucauauuaauu

SEQ ID NO: 583785 - RNA, 64 nt, hsa
uugucuguuaaauuuauuaugcccaaaucaaccucugaaaaaagguuuuuccaggaagauuuac

SEQ ID NO: 583786 - RNA, 64 nt, hsa
uauagaaccugucauacauucaugauaaguagcacugaaaaauuacucauucaaauuuccccug

SEQ ID NO: 583787 - RNA, 64 nt, hsa
agucagcacucguaaaugccaagaaaagaauuaccugaaaaagaucauuucucccuauucaaau

SEQ ID NO: 583788 - RNA, 64 nt, hsa
ugauauugagcucuaaaugcaaaacucuuuuauacugaaaaaacacuuaaaguaguuuugugug

SEQ ID NO: 583789 - RNA, 64 nt, hsa
auaguuuaaaagcacaucuauguucacugccacucugaaaaagggaauuauuucucagucuuuc

SEQ ID NO: 583790 - RNA, 64 nt, hsa
gaaacccaagguuggagggugggaugaguacccucugaaaaagggaauuugcuggugaaaagag

SEQ ID NO: 583791 - RNA, 64 nt, hsa
caauuucaauauaauguagaaguaguagugugcccugaaaaauguacacguuuuuucuuauugu

SEQ ID NO: 583792 - RNA, 64 nt, hsa
augauauuccuuuuuaucuuuucaguacauagugcugaaaaaucugcaacuucuuggaucauau

SEQ ID NO: 583793 - RNA, 64 nt, hsa
uuuuuaagauuaaaaaauuuuuaaaccucuaugucugaaaaaaaaaaugacacuccuggaagau

SEQ ID NO: 583794 - RNA, 64 nt, hsa
guuugaauaugguuugaaauauuucacuaccgugcugaaaaagguugguugauagcagcuugga

SEQ ID NO: 583795 - RNA, 64 nt, hsa
ucugaaucucguugaggccaaggaaugauccauacugaaaaaaugcugagccagccaucuuugg

SEQ ID NO: 583796 - RNA, 64 nt, hsa
uccaaagugucacuuggugcauaagcacagaaaucugaaaaauggccauguugucuuuuuuuuu

SEQ ID NO: 583797 - RNA, 64 nt, hsa
aaguagcugaugugcaguugagaaaacuagaggacugaaaaaacaaauuuuaacuagcaaaugc

SEQ ID NO: 583798 - RNA, 64 nt, hsa
aaucuagcuuauauaaggucauuacauuuuuuaacugaaaaaccuaguuaccugauuauugcac

SEQ ID NO: 583799 - RNA, 64 nt, hsa
cagcuuauuuuuuaugucuaaagcaacagcuguucugaaaaaucaccaaaagaaaugcacuuug

SEQ ID NO: 583800 - RNA, 64 nt, hsa
caugaguagauccaugauggauuaauaaagcuugcugaaaaaaaaaaucuguguaucaauuaga

SEQ ID NO: 583801 - RNA, 64 nt, hsa
auaaaaauugaauucguuucugacauaccuuagacugaaaaacuguugguucauccagaagugu

SEQ ID NO: 583802 - RNA, 64 nt, hsa
uuaguuuucuguauaugauauauauuaucuuauacugaaaaaaaauuccuuucagauuggggug

SEQ ID NO: 583803 - RNA, 64 nt, hsa
uuuuggcagguuucugugccuuuauuucccucuucugaaaaaaagucuguguuuucauaguuug

SEQ ID NO: 583804 - RNA, 64 nt, hsa
auaucaauaauuaaucaggaauggguuuuggugccugaaaaauuggccauggaggcacaccaaa

SEQ ID NO: 583805 - RNA, 64 nt, hsa
uuuuuaaauuuacagaauauuauauaacccacugcugaaaaagaaaaaaaugauuguuuuagaa

SEQ ID NO: 583806 - RNA, 64 nt, hsa
cuucaacagggaaaacagcuagcuugaaaacuugcugaaaaacacaacuuguguuuauggcauu

SEQ ID NO: 583807 - RNA, 64 nt, hsa
uuuugcuauagaugaagguagagggcugucagcccugaaaaacacacaggucagacauuuaaaa

SEQ ID NO: 583808 - RNA, 64 nt, hsa
ccugcugauggaaaugggaaugaaguuaaguggucugaaaaacuugaaucguucacauuucuca

SEQ ID NO: 583809 - RNA, 64 nt, hsa
acccuccuggggcucugggguagaugagagaagccugaaaaaggcagaguuugaaagcucccau

SEQ ID NO: 583810 - RNA, 64 nt, hsa
ggagaugcaggagcugcgggagccgaauucgguccugaaaaacacuaauuugcugcuuucugac

SEQ ID NO: 583811 - RNA, 64 nt, hsa
cacgggacuucccgaacuaauuuuuuuaaggauacugaaaaaugagagagaguggucgaaugcc

SEQ ID NO: 583812 - RNA, 64 nt, hsa
uuaaugaucacuuaaaguaguuuccuucuuuauucugaaaaaaugaggaaaaaauaacaacagu

SEQ ID NO: 583813 - RNA, 64 nt, hsa
cuugcacaaggaaggaucuucagauauucaugcacugaaaaaugcuguuaucuuuuguuuuuaa

SEQ ID NO: 583814 - RNA, 64 nt, hsa
accuagggguaagagaaaaaccacaacauaagaccugaaaaacagaagcaaaauuguugcacuc

SEQ ID NO: 583815 - RNA, 64 nt, hsa
gauuucuuuuuaaaguuuuaaacgaauauuuugacugaaaaauuuuggcagucuuguaugcaaa

SEQ ID NO: 583816 - RNA, 64 nt, hsa
guccugauagucucuuugggguuuuaauaaauggcugaaaaaauuguugugggguuucaacagg

SEQ ID NO: 583817 - RNA, 64 nt, hsa
cacucauuuucaauuucuaaauuugcaggggauacugaaaaauacggcagguggccuaaggcug

SEQ ID NO: 583818 - RNA, 64 nt, hsa
auguauuauacaucuguauuuuuaaauucugcuccugaaaaaugacugucccauucuccacuca

SEQ ID NO: 583819 - RNA, 64 nt, hsa
gcugacuucauggaauggacauccuguauaagcacugaaaaacaacaacacaauaacacuaaaa

SEQ ID NO: 583820 - RNA, 64 nt, hsa
gaaguguaccuguguacauaacucuguaaaaacacugaaaaauuauacuaacuuauuuauguua

SEQ ID NO: 583821 - RNA, 64 nt, hsa
uaaccuuagcaucuaagugucgaucuugaauucccugaaaaaauuucuauaggaaaugaagcuu

SEQ ID NO: 583822 - RNA, 64 nt, hsa
ugggauuugugucccuuaaaccagacucacuuuucugaaaaaucuccauuguugaggagaggcu

SEQ ID NO: 583823 - RNA, 64 nt, hsa
uuuuauaaaacuauuacauuuaaaauauggacgucugaaaaauaaaauauucaucauuuuuaug

SEQ ID NO: 583824 - RNA, 64 nt, hsa
acaugugauaacuauggaaaucaagauuaugugacugaaaaacauaaaggaagagacccaucua

SEQ ID NO: 583825 - RNA, 64 nt, hsa
cuuuugaacguaugugcucuuauaaaguggacuucugaaaaaugaauguaaaagacacuggugu

SEQ ID NO: 583826 - RNA, 64 nt, hsa
gaccauccaaauuuauggccguaucaaaugguagcugaaaaaacuauauuugagcacuggucuc

SEQ ID NO: 583827 - RNA, 64 nt, hsa
auuuaaaaaugcagaacugcuuuauccaagaaugcugaaaaauacuguucuauccagguuuccu

SEQ ID NO: 583828 - RNA, 64 nt, hsa
uggcacaugacuuuacauaaugacuuucuagacucugaaaaaaaugcuuuuaucauuuuugcaa

SEQ ID NO: 583829 - RNA, 64 nt, hsa
guuauaaaauauguugaaaggcacaaaagaacaccugaaaaaugauauuuugucugaaaagacu

SEQ ID NO: 583830 - RNA, 64 nt, hsa
ccagaguagaaaacuaugaaugugggauagccuucugaaaaagccacaaauuuaugaaacauua

SEQ ID NO: 583831 - RNA, 64 nt, hsa
auucuuuauuucugucauucaaaugggugauauccugaaaaaaaaaaaaaaaaaaaaacuggga

SEQ ID NO: 583832 - RNA, 64 nt, hsa
aaagaauauucagagaauaucaagaugauucuggcugaaaaaggccaguggaaauucaggugaa

SEQ ID NO: 583833 - RNA, 64 nt, hsa; identical to SEQ ID NO: 360905

SEQ ID NO: 583834 - RNA, 64 nt, hsa; identical to SEQ ID NO: 360906

SEQ ID NO: 583835 - RNA, 64 nt, hsa; identical to SEQ ID NO: 360907

SEQ ID NO: 583836 - RNA, 64 nt, hsa; identical to SEQ ID NO: 360908

SEQ ID NO: 583837 - RNA, 64 nt, hsa; identical to SEQ ID NO: 360909

SEQ ID NO: 583838 - RNA, 64 nt, hsa; identical to SEQ ID NO: 360910

SEQ ID NO: 583839 - RNA, 64 nt, hsa
guaaacuguauuuaaaaccuuugacuugagucugcugguaaagcuucugaauauugaguuugcu

SEQ ID NO: 583840 - RNA, 64 nt, hsa
uuugcugagaaauaaaaaucaaaacuucuuuaagcugguaaagugaggggcccaccagcaguga

SEQ ID NO: 583841 - RNA, 64 nt, hsa
aaguaugacaugagcuucaaccagaauucagccucugguaaacaugaacacuuaaaucuaacag

SEQ ID NO: 583842 - RNA, 64 nt, hsa
gagacaguauuucaagagaguggcaggucuguuccugguaaaauuuuaaccauuaggauugcag

SEQ ID NO: 583843 - RNA, 64 nt, hsa
cucucccugauaguuuaguuuuugauaaagcaugcugguaaaaccacuacccucagagagagcc

SEQ ID NO: 583844 - RNA, 64 nt, hsa
uucuucugagaaaugcugcagucagaagggugugcugguaaaguauuuugguggcagcugccau

SEQ ID NO: 583845 - RNA, 64 nt, hsa
ggcugagugcguuuuguccuucacguaaccuucgcugguaaaaauaagcccaugugauguccac

SEQ ID NO: 583846 - RNA, 64 nt, hsa
aaaagcauauaccaccuuaguucauucauguauccugguaaagcaucuuaaucagacuuauuuu

SEQ ID NO: 583847 - RNA, 64 nt, hsa; identical to SEQ ID NO: 110917

SEQ ID NO: 583848 - RNA, 64 nt, hsa; identical to SEQ ID NO: 110918

SEQ ID NO: 583849 - RNA, 64 nt, hsa; identical to SEQ ID NO: 110919

SEQ ID NO: 583850 - RNA, 64 nt, hsa; identical to SEQ ID NO: 110920

SEQ ID NO: 583851 - RNA, 64 nt, hsa; identical to SEQ ID NO: 110921

SEQ ID NO: 583852 - RNA, 64 nt, hsa; identical to SEQ ID NO: 110922

SEQ ID NO: 583853 - RNA, 64 nt, hsa; identical to SEQ ID NO: 110923

SEQ ID NO: 583854 - RNA, 64 nt, hsa; identical to SEQ ID NO: 110924

SEQ ID NO: 583855 - RNA, 64 nt, hsa; identical to SEQ ID NO: 110925

SEQ ID NO: 583856 - RNA, 64 nt, hsa; identical to SEQ ID NO: 110926

SEQ ID NO: 583857 - RNA, 64 nt, hsa; identical to SEQ ID NO: 110927

SEQ ID NO: 583858 - RNA, 64 nt, hsa; identical to SEQ ID NO: 110928

SEQ ID NO: 583859 - RNA, 61 nt, hsa; identical to SEQ ID NO: 110929

SEQ ID NO: 583860 - RNA, 64 nt, hsa; identical to SEQ ID NO: 110930

SEQ ID NO: 583861 - RNA, 64 nt, hsa; identical to SEQ ID NO: 110931

SEQ ID NO: 583862 - RNA, 64 nt, hsa; identical to SEQ ID NO: 110932

SEQ ID NO: 583863 - RNA, 64 nt, hsa; identical to SEQ ID NO: 110933

SEQ ID NO: 583864 - RNA, 64 nt, hsa; identical to SEQ ID NO: 110934

SEQ ID NO: 583865 - RNA, 64 nt, hsa; identical to SEQ ID NO: 110935

SEQ ID NO: 583866 - RNA, 64 nt, hsa; identical to SEQ ID NO: 110936

SEQ ID NO: 583867 - RNA, 64 nt, hsa; identical to SEQ ID NO: 110937

SEQ ID NO: 583868 - RNA, 64 nt, hsa; identical to SEQ ID NO: 110938

SEQ ID NO: 583869 - RNA, 64 nt, hsa; identical to SEQ ID NO: 110939

SEQ ID NO: 583870 - RNA, 64 nt, hsa; identical to SEQ ID NO: 110940

SEQ ID NO: 583871 - RNA, 64 nt, hsa; identical to SEQ ID NO: 110941

SEQ ID NO: 583872 - RNA, 64 nt, hsa; identical to SEQ ID NO: 110942

SEQ ID NO: 583873 - RNA, 64 nt, hsa; identical to SEQ ID NO: 110943

SEQ ID NO: 583874 - RNA, 64 nt, hsa; identical to SEQ ID NO: 110944

SEQ ID NO: 583875 - RNA, 64 nt, hsa; identical to SEQ ID NO: 110945

SEQ ID NO: 583876 - RNA, 64 nt, hsa; identical to SEQ ID NO: 110946

SEQ ID NO: 583877 - RNA, 64 nt, hsa; identical to SEQ ID NO: 110947

SEQ ID NO: 583878 - RNA, 64 nt, hsa; identical to SEQ ID NO: 110948

SEQ ID NO: 583879 - RNA, 64 nt, hsa; identical to SEQ ID NO: 110949

SEQ ID NO: 583880 - RNA, 64 nt, hsa; identical to SEQ ID NO: 110950

SEQ ID NO: 583881 - RNA, 64 nt, hsa; identical to SEQ ID NO: 110951

SEQ ID NO: 583882 - RNA, 64 nt, hsa; identical to SEQ ID NO: 110952

SEQ ID NO: 583883 - RNA, 64 nt, hsa; identical to SEQ ID NO: 110953

SEQ ID NO: 583884 - RNA, 64 nt, hsa; identical to SEQ ID NO: 110954

SEQ ID NO: 583885 - RNA, 64 nt, hsa; identical to SEQ ID NO: 110955

SEQ ID NO: 583886 - RNA, 64 nt, hsa; identical to SEQ ID NO: 110956

SEQ ID NO: 583887 - RNA, 64 nt, hsa; identical to SEQ ID NO: 110957

SEQ ID NO: 583888 - RNA, 64 nt, hsa; identical to SEQ ID NO: 110958

SEQ ID NO: 583889 - RNA, 64 nt, hsa; identical to SEQ ID NO: 324299

SEQ ID NO: 583890 - RNA, 64 nt, hsa; identical to SEQ ID NO: 324300

SEQ ID NO: 583891 - RNA, 64 nt, hsa; identical to SEQ ID NO: 324301

SEQ ID NO: 583892 - RNA, 64 nt, hsa; identical to SEQ ID NO: 324302

SEQ ID NO: 583893 - RNA, 64 nt, hsa; identical to SEQ ID NO: 324303

SEQ ID NO: 583894 - RNA, 64 nt, hsa; identical to SEQ ID NO: 324304

SEQ ID NO: 583895 - RNA, 64 nt, hsa; identical to SEQ ID NO: 324305

SEQ ID NO: 583896 - RNA, 64 nt, hsa; identical to SEQ ID NO: 324306

SEQ ID NO: 583897 - RNA, 64 nt, hsa; identical to SEQ ID NO: 324307

SEQ ID NO: 583898 - RNA, 64 nt, hsa; identical to SEQ ID NO: 324308

SEQ ID NO: 583899 - RNA, 64 nt, hsa; identical to SEQ ID NO: 324309

SEQ ID NO: 583900 - RNA, 64 nt, hsa; identical to SEQ ID NO: 324310

SEQ ID NO: 583901 - RNA, 54 nt, hsa; identical to SEQ ID NO: 324311

SEQ ID NO: 583902 - RNA, 64 nt, hsa; identical to SEQ ID NO: 324312

SEQ ID NO: 583903 - RNA, 64 nt, hsa; identical to SEQ ID NO: 324313

SEQ ID NO: 583904 - RNA, 64 nt, hsa; identical to SEQ ID NO: 324314

SEQ ID NO: 583905 - RNA, 64 nt, hsa; identical to SEQ ID NO: 324315

SEQ ID NO: 583906 - RNA, 64 nt, hsa; identical to SEQ ID NO: 324316

SEQ ID NO: 583907 - RNA, 64 nt, hsa; identical to SEQ ID NO: 324317

SEQ ID NO: 583908 - RNA, 64 nt, hsa; identical to SEQ ID NO: 324318

SEQ ID NO: 583909 - RNA, 63 nt, hsa
uguuacacacuguccgcucucagcccacucucccuguuacacacugcccacacucagagcaag

SEQ ID NO: 583910 - RNA, 63 nt, hsa
cucauuguggccccacacccagucugcuucucccuguuacacacuguccgcucucagcccacu

SEQ ID NO: 583911 - RNA, 63 nt, hsa
agaguauuaacguuuuuguucuccuccggcccccuguuacaaugaaggggcaaaaguauuugc

SEQ ID NO: 583912 - RNA, 63 nt, hsa
ucgacaucaaacugccuggauuuuucuaccacccuguuacaucauaacaacuucugaaacaca

SEQ ID NO: 583913 - RNA, 63 nt, hsa
cucuuccuuuugcuucuagucaaccuuaaugggcuguuacagaaacuaguucguguuuauaua

SEQ ID NO: 583914 - RNA, 63 nt, hsa
uguaacuaucagcugcaauaccauggugaccagcuguuacaaaagauuuuuuccuguuuuauc

SEQ ID NO: 583915 - RNA, 63 nt, hsa
ccugccuucuuacccccaacucuagggaugggacuguuacaauacuucaagaucacucuuuac

SEQ ID NO: 583916 - RNA, 63 nt, hsa
aggacauccaugccaggugaggugccugggucccuguuacaagucaggagcccuguagggaga

SEQ ID NO: 583917 - RNA, 63 nt, hsa
auaaccuuauuugaaaugaauugcaauaaagcucuguuacaacguaaguggauggaugacaca

SEQ ID NO: 583918 - RNA, 63 nt, hsa
cagugggaacaaguuucuauuaaaaggcaaaugcuguuacaaauuuuuggcaucugguaauau

SEQ ID NO: 583919 - RNA, 63 nt, hsa
cuugacugugaggcaggacuucccucgcuugaacuguuacacauacgaugugugugucacauc

SEQ ID NO: 583920 - RNA, 63 nt, hsa
uucucaucugggaauuugaaaucucggugcuuacuguuacaccaauuuguccaaagaguugaa

SEQ ID NO: 583921 - RNA, 64 nt, hsa; identical to SEQ ID NO: 354645

SEQ ID NO: 583922 - RNA, 64 nt, hsa; identical to SEQ ID NO: 354646

SEQ ID NO: 583923 - RNA, 64 nt, hsa; identical to SEQ ID NO: 354647

SEQ ID NO: 583924 - RNA, 64 nt, hsa; identical to SEQ ID NO: 354648

SEQ ID NO: 583925 - RNA, 64 nt, hsa; identical to SEQ ID NO: 354649

SEQ ID NO: 583926 - RNA, 64 nt, hsa; identical to SEQ ID NO: 354650

SEQ ID NO: 583927 - RNA, 64 nt, hsa; identical to SEQ ID NO: 354651

SEQ ID NO: 583928 - RNA, 64 nt, hsa; identical to SEQ ID NO: 354652

SEQ ID NO: 583929 - RNA, 64 nt, hsa; identical to SEQ ID NO: 354653

SEQ ID NO: 583930 - RNA, 64 nt, hsa; identical to SEQ ID NO: 354654

SEQ ID NO: 583931 - RNA, 64 nt, hsa; identical to SEQ ID NO: 354655

SEQ ID NO: 583932 - RNA, 64 nt, hsa; identical to SEQ ID NO: 354656

SEQ ID NO: 583933 - RNA, 64 nt, hsa; identical to SEQ ID NO: 354657

SEQ ID NO: 583934 - RNA, 64 nt, hsa; identical to SEQ ID NO: 354658

SEQ ID NO: 583935 - RNA, 64 nt, hsa; identical to SEQ ID NO: 354659

SEQ ID NO: 583936 - RNA, 64 nt, hsa; identical to SEQ ID NO: 354660

SEQ ID NO: 583937 - RNA, 64 nt, hsa; identical to SEQ ID NO: 354661

SEQ ID NO: 583938 - RNA, 64 nt, hsa; identical to SEQ ID NO: 354662

SEQ ID NO: 583939 - RNA, 64 nt, hsa; identical to SEQ ID NO: 354663

SEQ ID NO: 583940 - RNA, 64 nt, hsa; identical to SEQ ID NO: 354664

SEQ ID NO: 583941 - RNA, 64 nt, hsa; identical to SEQ ID NO: 354665

SEQ ID NO: 583942 - RNA, 64 nt, hsa; identical to SEQ ID NO: 354666

SEQ ID NO: 583943 - RNA, 64 nt, hsa
guuggagaccagccuggaugacauaaugagauucugucucuacuggaaaaaaaaaaaauuagcu

SEQ ID NO: 583944 - RNA, 64 nt, hsa
acuguacuccagccugggugacaaaaugagacauugucucuaaaauacauaaguaaauuuaaaa

SEQ ID NO: 583945 - RNA, 64 nt, hsa
gaucaagacuguccuggacaacauggugaaacccugucucuacugucucuaacauuuguaaacc

SEQ ID NO: 583946 - RNA, 64 nt, hsa
uguccuggacaacauggugaaacccugucucuacugucucuaacauuuguaaaccugucucuaa

SEQ ID NO: 583947 - RNA, 64 nt, hsa
acccugucucuacugucucuaacauuuguaaaccugucucuaauuuguaauuuguaaacccugu

SEQ ID NO: 583948 - RNA, 64 nt, hsa
aaugcauagaaauuuguaacacuuuggucacaucugucucuagauggucauugaauuuguuuaa

SEQ ID NO: 583949 - RNA, 64 nt, hsa
guuugaaaccagccuggccaacauggugaaaaccugucucuacuaaaaauacaaaaauuagccg

SEQ ID NO: 583950 - RNA, 64 nt, hsa
uuuggagaggccaaauggucuuagccucagucucugucucuaaauauuccaccauaaaacagcu

SEQ ID NO: 583951 - RNA, 64 nt, hsa
guucgagacuagccugggcaacauggagaagcccugucucuacaaaauacagagagaaaaaauc

SEQ ID NO: 583952 - RNA, 64 nt, hsa
gaguaauaggagcuuccagcucuaauaaaacagcugucucuaacuuauuuuauuuccaucaugu

SEQ ID NO: 583953 - RNA, 64 nt, hsa
ugguacucuuguugaguucuguagagccuucugaugucucuaaagcacuaccgauucuuuggag

SEQ ID NO: 583954 - RNA, 64 nt, hsa
ugagacucugucucuaaaaagcauauugagacucugucucuacaaaaaaauuuuaaaaaguaaa

SEQ ID NO: 583955 - RNA, 64 nt, hsa
agaaguuugagaucugggcaacauauugagacucugucucuaaaaagcauauugagacucuguc

SEQ ID NO: 583956 - RNA, 64 nt, hsa
acagauagagauucugccugugcuuuuguuugacugucucuagauuuugaaaccaaaaaacuga

SEQ ID NO: 583957 - RNA, 64 nt, hsa
cagauuggaaauuacucuuguauuuguagaagauugucucuaaaauugugguuuaacucacgca

SEQ ID NO: 583958 - RNA, 64 nt, hsa
guuugagaccaaucuaggcaauguagugagacccugucucuaauuuaaaaaagaaaaagaaaaa

SEQ ID NO: 583959 - RNA, 64 nt, hsa
gaucgagaccauccuggccaacauggugaaacccugucucuauuaaaaauacaaaaauuagcug

SEQ ID NO: 583960 - RNA, 64 nt, hsa
guggcaugacugacauacauacucaaauauaggcugucucuaguaaaucuuaaaaucuugaagc

SEQ ID NO: 583961 - RNA, 64 nt, hsa
cuacaauuauuauaauggacaauacuuuuaccuuugucucuaaagaucagauuaguuuuauuug

SEQ ID NO: 583962 - RNA, 64 nt, hsa
guuugagaccagccuggccaacauggcaaaacccugucucuacuaaaaacauaaaaauuagcug

SEQ ID NO: 583963 - RNA, 64 nt, hsa
uaauacauuuccuauuuucgcauuuucaauaaaaugucucuaauacaauacggugauugcuugu

SEQ ID NO: 583964 - RNA, 64 nt, hsa
ggauauagaauauuacaucuuuugagaauguaugugucucuaaguaaguaaaaucuaaugcgua

SEQ ID NO: 583965 - RNA, 64 nt, hsa
caugaauauauuauuuugcuauuaaugugaaaguugucucuaaauauuuuuuaauuuucaaacu

SEQ ID NO: 583966 - RNA, 64 nt, hsa
cucacacuacacuuacaacuugcuucuugagcuaugucucuacuccaggcucuguuuuguguau

SEQ ID NO: 583967 - RNA, 64 nt, hsa
uugcugcuggaugaugcccuuuuugggagcaucuugucucuaaccuuuaaaagaggggucaauc

SEQ ID NO: 583968 - RNA, 64 nt, hsa
ugucuccuagucacuuucuuucucacucugucucugucucuauuucugucucuccucugcugug

SEQ ID NO: 583969 - RNA, 64 nt, hsa
aggcucuauuucugucucugaugcucuucuucugugucucuauuucucuuccugucacuuaauc

SEQ ID NO: 583970 - RNA, 64 nt, hsa
gauaauaucccuauccagugcuugcccuuggaauugucucuaaaugcaucaagcauacaauaaa

SEQ ID NO: 583971 - RNA, 64 nt, hsa
uggccucccgugagugcaugccuguagugcacagugucucuacaggugucuucuggggggcaga

SEQ ID NO: 583972 - RNA, 64 nt, hsa
aguuacccugaucuggacccuuggccuccauuucugucucuaaccauucaaaugacgccugaug

SEQ ID NO: 583973 - RNA, 64 nt, hsa
auaucauucagcaucuacucuaaagaaaaaugccugucucuagcuguucuggacuacacccaag

SEQ ID NO: 583974 - RNA, 64 nt, hsa
guuccagaccagccuggccaacaugaugaaacccugucucuacuaaaaauacaaaaauuagccg

SEQ ID NO: 583975 - RNA, 64 nt, hsa
gaguuugagaccagccugggcaacauggcacaauugucucuacaaaaaauacaaaaauuagcca

SEQ ID NO: 583976 - RNA, 64 nt, hsa
gagcucaggaguucgugaccagccugggcaacccugucucuacaaaaaauacaaaaauuaacca

SEQ ID NO: 583977 - RNA, 64 nt, hsa
gaucaagaccauccuggccaacauggugaaacccugucucuacuaaaaauacaaaaauagcugg

SEQ ID NO: 583978 - RNA, 64 nt, hsa
agcagaugguuucugggcaaaaucaaaugauuucugucucuauuuucuugaguaccaauuguaa

SEQ ID NO: 583979 - RNA, 64 nt, hsa
guucgagaccaacuugggcaacauggugaaacacugucucuacauaaaauacaaaaauuagcug

SEQ ID NO: 583980 - RNA, 64 nt, hsa
cccaagaaaauacaggccugaagggauaagauugugucucuauagagcuucaaagcauacaggu

SEQ ID NO: 583981 - RNA, 64 nt, hsa
guucaaaaccagccugaccaacauggugaaacccugucucuacuaaauauuagcgggguguggu

SEQ ID NO: 583982 - RNA, 64 nt, hsa
gaucgagaccauccuggcuaacacggugaaacccugucucuacuaaaaauacaaaaaacuagcc

SEQ ID NO: 583983 - RNA, 64 nt, hsa
cugcauuccagccuggguggacagaacaaggcccugucucuauuuuaaaauaauaauaacacaa

SEQ ID NO: 583984 - RNA, 64 nt, hsa
cauuucugccuucucucuuuucuucauguguuuuugucucuagccuauguguauuuguguagaa

SEQ ID NO: 583985 - RNA, 64 nt, hsa
guucgagaccaaccuggccgacauggugaaacgcugucucuacuaaaaauauaaaaaauuagcc

SEQ ID NO: 583986 - RNA, 64 nt, hsa
gaguucaagacaauccuggccaacggcgaaacucugucucuacaaaaaauauacaggcguguua

SEQ ID NO: 583987 - RNA, 64 nt, hsa
ccauugcacuccagccuggcugacagagcgagacugucucuaaaaaaaaaagacucaaguggac

SEQ ID NO: 583988 - RNA, 64 nt, hsa
guuugagaccagcccgaccaacauggagaaacccugucucuacuaaaaauacaaaauuagccag

SEQ ID NO: 583989 - RNA, 64 nt, hsa
guuugagaccagccugggcaacauagugagacccugucucuaaaaaaauaaaaauagaaauaaa

SEQ ID NO: 583990 - RNA, 64 nt, hsa
guucaagaccagccugggcaacauggcaagacccugucucuacuaaaaauacaaaaaaaaaaaa

SEQ ID NO: 583991 - RNA, 64 nt, hsa
uucuggacugaagcuauuuucuucuccaaacugcugucucuaauuuggccucuguggcaagacc

SEQ ID NO: 583992 - RNA, 64 nt, hsa
gucugagacaagccuaggcaacaaaacaagacucugucucuacaaaaaguuuaagaaaugagcc

SEQ ID NO: 583993 - RNA, 64 nt, hsa
acggcacucaagccugggcaauguagcaagauccugucucuacaagaaauuuuuuaaaaaugag

SEQ ID NO: 583994 - RNA, 64 nt, hsa
aaguuugagaccagccuggcaaacauggcaaaacugucucuauuaaaaauacaggccaggggcc

SEQ ID NO: 583995 - RNA, 64 nt, hsa
gauugagaccauccuggcuaauauggugaaacccugucucuacuaaaaauacaaaaaaauuagc

SEQ ID NO: 583996 - RNA, 64 nt, hsa
acugcaccccagcccaggcaacaaagugagccccugucucuaaauaaauaaagagacaauaagc

SEQ ID NO: 583997 - RNA, 64 nt, hsa
aaaaaugaccagccugggcagcauagcaagacccugucucuaaaaaaaauaauaaaaacuuagc

SEQ ID NO: 583998 - RNA, 64 nt, hsa; identical to SEQ ID NO: 481838

SEQ ID NO: 583999 - RNA, 64 nt, hsa; identical to SEQ ID NO: 481839

SEQ ID NO: 584000 - RNA, 64 nt, hsa; identical to SEQ ID NO: 481840

SEQ ID NO: 584001 - RNA, 64 nt, hsa; identical to SEQ ID NO: 481841

SEQ ID NO: 584002 - RNA, 64 nt, hsa; identical to SEQ ID NO: 361028

SEQ ID NO: 584003 - RNA, 64 nt, hsa; identical to SEQ ID NO: 361029

SEQ ID NO: 584004 - RNA, 64 nt, hsa
guugacuuuuuuccaggauaaauuaucucugaugcuucuuuagauuuaagaguucauaauucca

SEQ ID NO: 584005 - RNA, 64 nt, hsa
ucccuacugcaaaacccuauuguaguaaaaaagucuucuuuacuaucuuaauaaaacagauauu

SEQ ID NO: 584006 - RNA, 64 nt, hsa
uuccauuuucaucaauaacauauguuuuaugcaccuucuuuaccugaaacuuacuaagaaucua

SEQ ID NO: 584007 - RNA, 64 nt, hsa
uuguuggauauuuuaguucauacaaagcagaguacuucuuuagggcugguuaauugguucaaau

SEQ ID NO: 584008 - RNA, 64 nt, hsa
ucaguucucuucuuucuuuagcaaaucagagugacuucuuuaaaccacagguuguugaaauggc

SEQ ID NO: 584009 - RNA, 64 nt, hsa
uguuuacugauggggauacaagaugugacacacccuucuuuauuugaaacaaacaaacauuuag

SEQ ID NO: 584010 - RNA, 64 nt, hsa
gugugcaugacacuaagauuuuauguuggagauacuucuuuaaauaaccuacagcuugggucua

SEQ ID NO: 584011 - RNA, 64 nt, hsa
ucugacuuuauccccacgucagccuuaauaaagucuucuuuaccuucucuaugaagacuuuaaa

SEQ ID NO: 584012 - RNA, 64 nt, hsa
ucgauccauaagcauaucuugcagaggggaacuacuucuuuaaacacauggagggaaagaagau

SEQ ID NO: 584013 - RNA, 64 nt, hsa
cugggaugacaauaauugcuauuugaaauauaugcuucuuuauuucuugcaaggggcaaguuuc

SEQ ID NO: 584014 - RNA, 64 nt, hsa
auuuugaaacauauaauaaugauuuucuuguucccuucuuuaacuagcugccuuuagauuuuga

SEQ ID NO: 584015 - RNA, 64 nt, hsa
ucuccuuuaguggacaccuagagccacagauucccuucuuuacuaaacaaaucccauggauucu

SEQ ID NO: 584016 - RNA, 64 nt, hsa
uucuuuuuauauacuuuuucagauuuuuuauaugcuucuuuacuacuuacaucauaaugcacaa

SEQ ID NO: 584017 - RNA, 64 nt, hsa
aaagaguuagcugccagcucuguuauuucugccccuucuuuacccuucuuccaauuuuuauuau

SEQ ID NO: 584018 - RNA, 64 nt, hsa
acccuacuaagaauuggcagaaauguuuuaaccucuucuuuaggcaucuggugaguauugcaga

SEQ ID NO: 584019 - RNA, 64 nt, hsa
caccuugcgugcaugcagcaggcaacaacugccccuucuuuaugcagaggugcagaaccaggga

SEQ ID NO: 584020 - RNA, 64 nt, hsa
cuuuguaaagugugaucuaugagaauuggagacacuucuuuacuguucaccaaagaaaugggua

SEQ ID NO: 584021 - RNA, 64 nt, hsa
gcucugagaaauguguucaauugugggauuauaacuucuuuacacuucggaaagauuagccuag

SEQ ID NO: 584022 - RNA, 64 nt, hsa
auuuucauguguuagauguguguaaauaugcuaucuucuuuaagaaauuauauuacucuaauaa

SEQ ID NO: 584023 - RNA, 64 nt, hsa
augcucuuaaauaugcauauuuucugccaacucacuucuuuaaacaucuuucagcccagcgcug

SEQ ID NO: 584024 - RNA, 64 nt, hsa
ugaugucagaaucaaaccagauaauucucuaauucuucuuuaaucuaaaguagauagcuuccca

SEQ ID NO: 584025 - RNA, 64 nt, hsa
cuaaacauaaguaacuuuaaggugaaugaaagaucuucuuuaggaauaauagaugaugguaagu

SEQ ID NO: 584026 - RNA, 64 nt, hsa
uggaauuccuuuguccaggagaaaccucacaaaccuucuuuaaggcauaguuuuguuguuuguu

SEQ ID NO: 584027 - RNA, 63 nt, hsa
ccacuuucugcuacccuagggaggccaggaggagcuucggaggaccaucgccccacuggucua

SEQ ID NO: 584028 - RNA, 63 nt, hsa
ccggcccgccuccauccaaaaucacgcucgcgugcuucggaagcauccgggucacuccuucuc

SEQ ID NO: 584029 - RNA, 63 nt, hsa
gcagccgagagugagaaccaagugacucucuaggcuucggacacaaauaggcuccucuacacc

SEQ ID NO: 584030 - RNA, 63 nt, hsa
aaaaggaaguccucagcugugccagcucccagagcuucggaagaaagagcagcagcucucucc

SEQ ID NO: 584031 - RNA, 63 nt, hsa
caaaggaaguccugggcugugccagcucccagagcuucggaagaaagagcagcagcucucucc

SEQ ID NO: 584032 - RNA, 63 nt, hsa
cugguccgcagagaaagcacccaggagcagagcgcuucggagcgguccucaguggcgccaccu

SEQ ID NO: 584033 - RNA, 63 nt, hsa
uguucauggagagcuguucgcuccucccagauggcuucggagggccgcagggcccaccuugga

SEQ ID NO: 584034 - RNA, 63 nt, hsa
uauauauauaaaacauuccccucuguccccuuggcuucggauggaggccuuucuguugagcug

SEQ ID NO: 584035 - RNA, 63 nt, hsa
gcugccucguugucuauccugggaggguguggugcuucggacacguugaggggcuuugucagc

SEQ ID NO: 584036 - RNA, 63 nt, hsa
uaauuuuugugcaaaaacaaaccugaaaaauaugcuucggaaacugugcauaguucuaauugu

SEQ ID NO: 584037 - RNA, 63 nt, hsa
acuaauuuccagccaucaccuuugguggggugggcuucggaggacagucugucugaaccugcc

SEQ ID NO: 584038 - RNA, 63 nt, hsa
gcuccuucccgcuucccccgacuucacacggcggcuucggaccaacucccucacucccgcccg

SEQ ID NO: 584039 - RNA, 63 nt, hsa
ucugcaaggucacuuacauagccccacucagcugcuucggaaagcgugacgaagcaguagucc

SEQ ID NO: 584040 - RNA, 63 nt, hsa
aaaacauuuuauuuuuaaaauauuacacaggaggcuucggaguuucuuagucauuacuguccu

SEQ ID NO: 584041 - RNA, 63 nt, hsa
ggcauuuuuauuugaauaugaugaguauauuuugcuucggaaauaauauaggaaggaaaugua

SEQ ID NO: 584042 - RNA, 63 nt, hsa
ugaccuugcuagucugcccacucccuacccccagcuucggaaaauacagagaccaccaccacg

SEQ ID NO: 584043 - RNA, 63 nt, hsa
acuuuuuuuaguaaguuaauguauauaaaaauggcuucggacaaaauaucucugaguucugug

SEQ ID NO: 584044 - RNA, 63 nt, hsa
cuugguuccagagccgcuguacugagcaccucggcuucggagcacccugccaggccccugggc

SEQ ID NO: 584045 - RNA, 63 nt, hsa
guggccccugguggagcugcgcuagaaugcgcggcuucggacucagaauuccaugcccuuugc

SEQ ID NO: 584046 - RNA, 63 nt, hsa
gggaguccccuccuccgccaccgagaguccugugcuucggaaugaagggagggcgaccuccuu

SEQ ID NO: 584047 - RNA, 63 nt, hsa
cagcccuacugucccuuacuggggcagcagagggcuucggaggcagaagugaggccugggguu

SEQ ID NO: 584048 - RNA, 63 nt, hsa
caggcacgggcagcuccuguucugccuuucccagcuucggagacgcaggcucagcugcuccga

SEQ ID NO: 584049 - RNA, 54 nt, hsa
acagcagugacucagaaugaacuggcuucggacagaacaggacagauggauguc

SEQ ID NO: 584050 - RNA, 63 nt, hsa
cguuaaaaaaauauguacgucuagcuccucagggcuucggaucgcagcucacucgaggccugg

SEQ ID NO: 584051 - RNA, 63 nt, hsa
ggcuccuaaucuccagcuuuccugucauugaaagcuucggaaguuuacuggcucugcucccgc

SEQ ID NO: 584052 - RNA, 63 nt, hsa
cccagugcaccaucacccugcccugcccucguggcuucggagagcagaggggucaggcccagg

SEQ ID NO: 584053 - RNA, 63 nt, hsa
gacuguuccagggaagggaugggggcagcagcugcuucggauccacacuguaucugugucauc

SEQ ID NO: 584054 - RNA, 63 nt, hsa
cagauugagcaggaaguaaaaacaaauggaaaugcuucggauaguggcagggguggggguugc

SEQ ID NO: 584055 - RNA, 63 nt, hsa
ccaggcuuuuagaggaccuucccuaagggcgcagcuucggagcaggaucuguccagcucauac

SEQ ID NO: 584056 - RNA, 63 nt, hsa
cuucaucugugggaugcugaaggagaugagugggcuucggagugaauguggcaguuuaaaaaa

SEQ ID NO: 584057 - RNA, 63 nt, hsa
aagcaggagcucagacucuuagagccagcuguggcuucggacccaaggccugaccuaggcugc

SEQ ID NO: 584058 - RNA, 63 nt, hsa
uugcugucccuuuuguguaucugucauccggaugcuucggaccccacgccucugcaaguggga

SEQ ID NO: 584059 - RNA, 63 nt, hsa
cacgaacaaaggcaacaagcaugcagccagcaagcuucggaaaaccacagcaucaaagacauc

SEQ ID NO: 584060 - RNA, 63 nt, hsa
acuuccucagcagaaacccgucaugacgcggcugcuucggaagcagacaucuggggacacagc

SEQ ID NO: 584061 - RNA, 63 nt, hsa
gauagugaugccacacauucucucucaauuucagcuucggaacgcuaugaaaauaauacauga

SEQ ID NO: 584062 - RNA, 63 nt, hsa
guuggaaccacagcucugggaacugggaaaagugcuucggaaggcuggguaaguggucuugga

SEQ ID NO: 584063 - RNA, 63 nt, hsa
uccaccugaagagaaccugcgugcugcuccuuugcuucggaccuccgccucugcccgggagaa

SEQ ID NO: 584064 - RNA, 63 nt, hsa
gcaggacccgcacgccucuucccacaccugucagcuucggaagcaucucucgaggacucuggu

SEQ ID NO: 584065 - RNA, 63 nt, hsa
acccuaugugugccacaauggacguuagcagcugcuucggaacaccgucccuccuaugcaccc

SEQ ID NO: 584066 - RNA, 63 nt, hsa
gggguagugccgcaguggggucaagcugagcuggcuucggagauggagucccuuuucauucuc

SEQ ID NO: 584067 - RNA, 63 nt, hsa
gaccugggugcaggcucccuggccucagugacugcuucggagcugccuggcucauggcccaac

SEQ ID NO: 584068 - RNA, 59 nt, hsa
uggacguuggccugggcuagggcugagacgcuucggaccccgggaaaggccauacgaag

SEQ ID NO: 584069 - RNA, 63 nt, hsa
aucaacugccugagaggacacaaugggggaggggcuucggaccacagcaggagccccgacugc

SEQ ID NO: 584070 - RNA, 63 nt, hsa
gcccugcagagccagccgccaagguugaccucagcuucggagccaccucuggaugaacugccc

SEQ ID NO: 584071 - RNA, 63 nt, hsa
gagguuuuaagaagcgucugccgugaucauggagcuucggaagcgggaaugguucuuccgggu

SEQ ID NO: 584072 - RNA, 63 nt, hsa
cucccccagcagguuacgggcaggacuugaguggcuucggacagggcuucucagaccccagcc

SEQ ID NO: 584073 - RNA, 63 nt, hsa
uuuauauauuuauucaucugggaggcagaacaggcuucggacagugcccaugcaauggcuugg

SEQ ID NO: 584074 - RNA, 63 nt, hsa
ccagacuggcgagauucaaauccuggcucuaucgcuucggagccaggugggccugggggggcg

SEQ ID NO: 584075 - RNA, 63 nt, hsa
ggcccggggccaagccugcauucuggcugcccagcuucggacagcgggaacuccucaggcagc

SEQ ID NO: 584076 - RNA, 63 nt, hsa
ugguagguuucuuccucgcuguacuccaggcuugcuucggagucauagucaucccuccugcac

SEQ ID NO: 584077 - RNA, 63 nt, hsa
gggagggaggaauuacacagcugaccgaauccggcuucggaugaggugagggaggagcagguc

SEQ ID NO: 584078 - RNA, 63 nt, hsa
uggggguucugagaaggaaaguacccaacauuggcuucggaguauuugacuuuggggaaaagg

SEQ ID NO: 584079 - RNA, 63 nt, hsa
ggucuccccggcugcucugcgggggcuucacuggcuucggagugagcgcgaagugcuggugag

SEQ ID NO: 584080 - RNA, 63 nt, hsa
agaguacagaagcuuuagcaagugugcacuccagcuucggagggccccugugugggggccagu

SEQ ID NO: 584081 - RNA, 63 nt, hsa
gguuuggggaggagagugacauuuucaucauuagcuucggagaagcuucaagcccauccuguc

SEQ ID NO: 584082 - RNA, 63 nt, hsa
aggcccaggauccucagaggaagauggagaggagcuucggaccaagaucaaaccaaacagugg

SEQ ID NO: 584083 - RNA, 56 nt, hsa
aaguugugcaaaacugguaaacgucugcuucggagcuugcugcuuaauaaauguug

SEQ ID NO: 584084 - RNA, 63 nt, hsa
gcacaggacugcgugggcgcgggagccucagcugcuucggacccaaccacacgcuguacccca

SEQ ID NO: 584085 - RNA, 63 nt, hsa
ugguaggcaacaagcgggacaggcagcggcugcgcuucggaccgcggcgcgcgcuggccgccc

SEQ ID NO: 584086 - RNA, 63 nt, hsa
uuccucucacaggccuuggcuuggaaggcuggagcuucggaccaaggcccagcccugucaccu

SEQ ID NO: 584087 - RNA, 63 nt, hsa
uugggcagccuugccuccagagagcagauuccagcuucggaagccccuggucuaacuugggau

SEQ ID NO: 584088 - RNA, 63 nt, hsa
cuuuuauaaucccccuuuuucccugcccccugggcuucggaggggggugcuugugccccuaac

SEQ ID NO: 584089 - RNA, 63 nt, hsa
uaaaugauuguuagcaaguuagauuuuccuggagcuucggaagaaaugaaaauggaaacauga

SEQ ID NO: 584090 - RNA, 63 nt, hsa
ugggcgccacagacgagcuccgagccaggucaggcuucggaggccacaagcucagccucaggc

SEQ ID NO: 584091 - RNA, 64 nt, hsa; identical to SEQ ID NO: 213179

SEQ ID NO: 584092 - RNA, 64 nt, hsa; identical to SEQ ID NO: 213180

SEQ ID NO: 584093 - RNA, 64 nt, hsa; identical to SEQ ID NO: 213181

SEQ ID NO: 584094 - RNA, 64 nt, hsa; identical to SEQ ID NO: 213182

SEQ ID NO: 584095 - RNA, 64 nt, hsa; identical to SEQ ID NO: 213183

SEQ ID NO: 584096 - RNA, 64 nt, hsa; identical to SEQ ID NO: 213184

SEQ ID NO: 584097 - RNA, 64 nt, hsa; identical to SEQ ID NO: 213185

SEQ ID NO: 584098 - RNA, 64 nt, hsa; identical to SEQ ID NO: 213186

SEQ ID NO: 584099 - RNA, 64 nt, hsa; identical to SEQ ID NO: 213187

SEQ ID NO: 584100 - RNA, 64 nt, hsa; identical to SEQ ID NO: 213188

SEQ ID NO: 584101 - RNA, 64 nt, hsa; identical to SEQ ID NO: 213189

SEQ ID NO: 584102 - RNA, 64 nt, hsa; identical to SEQ ID NO: 213190

SEQ ID NO: 584103 - RNA, 64 nt, hsa; identical to SEQ ID NO: 213191

SEQ ID NO: 584104 - RNA, 64 nt, hsa; identical to SEQ ID NO: 213192

SEQ ID NO: 584105 - RNA, 64 nt, hsa; identical to SEQ ID NO: 213193

SEQ ID NO: 584106 - RNA, 64 nt, hsa; identical to SEQ ID NO: 213194

SEQ ID NO: 584107 - RNA, 64 nt, hsa; identical to SEQ ID NO: 213195

SEQ ID NO: 584108 - RNA, 64 nt, hsa; identical to SEQ ID NO: 213196

SEQ ID NO: 584109 - RNA, 64 nt, hsa; identical to SEQ ID NO: 213197

SEQ ID NO: 584110 - RNA, 64 nt, hsa; identical to SEQ ID NO: 213198

SEQ ID NO: 584111 - RNA, 64 nt, hsa; identical to SEQ ID NO: 293103

SEQ ID NO: 584112 - RNA, 64 nt, hsa; identical to SEQ ID NO: 293104

SEQ ID NO: 584113 - RNA, 64 nt, hsa; identical to SEQ ID NO: 293105

SEQ ID NO: 584114 - RNA, 64 nt, hsa; identical to SEQ ID NO: 293106

SEQ ID NO: 584115 - RNA, 64 nt, hsa; identical to SEQ ID NO: 293107

SEQ ID NO: 584116 - RNA, 64 nt, hsa; identical to SEQ ID NO: 293108

SEQ ID NO: 584117 - RNA, 64 nt, hsa; identical to SEQ ID NO: 293109

SEQ ID NO: 584118 - RNA, 64 nt, hsa; identical to SEQ ID NO: 293110

SEQ ID NO: 584119 - RNA, 64 nt, hsa; identical to SEQ ID NO: 293111

SEQ ID NO: 584120 - RNA, 64 nt, hsa; identical to SEQ ID NO: 293112

SEQ ID NO: 584121 - RNA, 64 nt, hsa; identical to SEQ ID NO: 293113

SEQ ID NO: 584122 - RNA, 64 nt, hsa; identical to SEQ ID NO: 293114

SEQ ID NO: 584123 - RNA, 64 nt, hsa; identical to SEQ ID NO: 293115

SEQ ID NO: 584124 - RNA, 64 nt, hsa; identical to SEQ ID NO: 293116

SEQ ID NO: 584125 - RNA, 64 nt, hsa; identical to SEQ ID NO: 293117

SEQ ID NO: 584126 - RNA, 64 nt, hsa; identical to SEQ ID NO: 293118

SEQ ID NO: 584127 - RNA, 64 nt, hsa; identical to SEQ ID NO: 293119

SEQ ID NO: 584128 - RNA, 64 nt, hsa; identical to SEQ ID NO: 293120

SEQ ID NO: 584129 - RNA, 64 nt, hsa; identical to SEQ ID NO: 293121

SEQ ID NO: 584130 - RNA, 64 nt, hsa; identical to SEQ ID NO: 293122

SEQ ID NO: 584131 - RNA, 64 nt, hsa; identical to SEQ ID NO: 293123

SEQ ID NO: 584132 - RNA, 64 nt, hsa; identical to SEQ ID NO: 293124

SEQ ID NO: 584133 - RNA, 64 nt, hsa; identical to SEQ ID NO: 293125

SEQ ID NO: 584134 - RNA, 64 nt, hsa; identical to SEQ ID NO: 293126

SEQ ID NO: 584135 - RNA, 64 nt, hsa; identical to SEQ ID NO: 293127

SEQ ID NO: 584136 - RNA, 64 nt, hsa; identical to SEQ ID NO: 293128

SEQ ID NO: 584137 - RNA, 64 nt, hsa; identical to SEQ ID NO: 293129

SEQ ID NO: 584138 - RNA, 64 nt, hsa; identical to SEQ ID NO: 293130

SEQ ID NO: 584139 - RNA, 64 nt, hsa; identical to SEQ ID NO: 293131

SEQ ID NO: 584140 - RNA, 64 nt, hsa; identical to SEQ ID NO: 293132

SEQ ID NO: 584141 - RNA, 64 nt, hsa; identical to SEQ ID NO: 293133

SEQ ID NO: 584142 - RNA, 64 nt, hsa; identical to SEQ ID NO: 293134

SEQ ID NO: 584143 - RNA, 64 nt, hsa; identical to SEQ ID NO: 293135

SEQ ID NO: 584144 - RNA, 64 nt, hsa; identical to SEQ ID NO: 293136

SEQ ID NO: 584145 - RNA, 64 nt, hsa; identical to SEQ ID NO: 293137

SEQ ID NO: 584146 - RNA, 64 nt, hsa; identical to SEQ ID NO: 293138

SEQ ID NO: 584147 - RNA, 64 nt, hsa; identical to SEQ ID NO: 293139

SEQ ID NO: 584148 - RNA, 64 nt, hsa; identical to SEQ ID NO: 293140

SEQ ID NO: 584149 - RNA, 64 nt, hsa; identical to SEQ ID NO: 293141

SEQ ID NO: 584150 - RNA, 64 nt, hsa; identical to SEQ ID NO: 293142

SEQ ID NO: 584151 - RNA, 63 nt, hsa
uuuacccuaagucgaacugaguauaaggugugacuauuggauucuugaacuaaaauuugaccc

SEQ ID NO: 584152 - RNA, 64 nt, hsa
gccuauaaucuguugcuuuuucucaauauguguccuauuggaaauuccucaaaucguuggugcc

SEQ ID NO: 584153 - RNA, 64 nt, hsa
ugaaauacgaaguccuuggucugauauaaagccccuauuggauucuucggaugcguaaaagaaa

SEQ ID NO: 584154 - RNA, 64 nt, hsa
ggggguggaauuuuuuucucacucuaaugacuuccuauuggaaaggcauugacagccagggaca

SEQ ID NO: 584155 - RNA, 64 nt, hsa; identical to SEQ ID NO: 282605

SEQ ID NO: 584156 - RNA, 64 nt, hsa; identical to SEQ ID NO: 282606

SEQ ID NO: 584157 - RNA, 64 nt, hsa; identical to SEQ ID NO: 282607

SEQ ID NO: 584158 - RNA, 64 nt, hsa; identical to SEQ ID NO: 282608

SEQ ID NO: 584159 - RNA, 64 nt, hsa; identical to SEQ ID NO: 76340

SEQ ID NO: 584160 - RNA, 64 nt, hsa; identical to SEQ ID NO: 76341

SEQ ID NO: 584161 - RNA, 64 nt, hsa; identical to SEQ ID NO: 76342

SEQ ID NO: 584162 - RNA, 64 nt, hsa; identical to SEQ ID NO: 76343

SEQ ID NO: 584163 - RNA, 64 nt, hsa; identical to SEQ ID NO: 76344

SEQ ID NO: 584164 - RNA, 64 nt, hsa; identical to SEQ ID NO: 76345

SEQ ID NO: 584165 - RNA, 64 nt, hsa; identical to SEQ ID NO: 76346

SEQ ID NO: 584166 - RNA, 64 nt, hsa; identical to SEQ ID NO: 76347

SEQ ID NO: 584167 - RNA, 64 nt, hsa; identical to SEQ ID NO: 76348

SEQ ID NO: 584168 - RNA, 64 nt, hsa; identical to SEQ ID NO: 76349

SEQ ID NO: 584169 - RNA, 64 nt, hsa; identical to SEQ ID NO: 76350

SEQ ID NO: 584170 - RNA, 64 nt, hsa; identical to SEQ ID NO: 76351

SEQ ID NO: 584171 - RNA, 64 nt, hsa; identical to SEQ ID NO: 76352

SEQ ID NO: 584172 - RNA, 64 nt, hsa; identical to SEQ ID NO: 76353

SEQ ID NO: 584173 - RNA, 64 nt, hsa; identical to SEQ ID NO: 76354

SEQ ID NO: 584174 - RNA, 64 nt, hsa; identical to SEQ ID NO: 76355

SEQ ID NO: 584175 - RNA, 64 nt, hsa; identical to SEQ ID NO: 76356

SEQ ID NO: 584176 - RNA, 64 nt, hsa; identical to SEQ ID NO: 76357

SEQ ID NO: 584177 - RNA, 64 nt, hsa; identical to SEQ ID NO: 76358

SEQ ID NO: 584178 - RNA, 64 nt, hsa; identical to SEQ ID NO: 76359

SEQ ID NO: 584179 - RNA, 64 nt, hsa; identical to SEQ ID NO: 76360

SEQ ID NO: 584180 - RNA, 64 nt, hsa; identical to SEQ ID NO: 76361

SEQ ID NO: 584181 - RNA, 64 nt, hsa; identical to SEQ ID NO: 76362

SEQ ID NO: 584182 - RNA, 64 nt, hsa; identical to SEQ ID NO: 76363

SEQ ID NO: 584183 - RNA, 64 nt, hsa; identical to SEQ ID NO: 76364

SEQ ID NO: 584184 - RNA, 64 nt, hsa; identical to SEQ ID NO: 76365

SEQ ID NO: 584185 - RNA, 64 nt, hsa; identical to SEQ ID NO: 76366

SEQ ID NO: 584186 - RNA, 64 nt, hsa; identical to SEQ ID NO: 76367

SEQ ID NO: 584187 - RNA, 64 nt, hsa; identical to SEQ ID NO: 76368

SEQ ID NO: 584188 - RNA, 64 nt, hsa; identical to SEQ ID NO: 76369

SEQ ID NO: 584189 - RNA, 64 nt, hsa; identical to SEQ ID NO: 76370

SEQ ID NO: 584190 - RNA, 64 nt, hsa; identical to SEQ ID NO: 76371

SEQ ID NO: 584191 - RNA, 64 nt, hsa; identical to SEQ ID NO: 76372

SEQ ID NO: 584192 - RNA, 64 nt, hsa; identical to SEQ ID NO: 76373

SEQ ID NO: 584193 - RNA, 64 nt, hsa; identical to SEQ ID NO: 76374

SEQ ID NO: 584194 - RNA, 64 nt, hsa; identical to SEQ ID NO: 76375

SEQ ID NO: 584195 - RNA, 64 nt, hsa; identical to SEQ ID NO: 76376

SEQ ID NO: 584196 - RNA, 64 nt, hsa; identical to SEQ ID NO: 76377

SEQ ID NO: 584197 - RNA, 64 nt, hsa; identical to SEQ ID NO: 76378

SEQ ID NO: 584198 - RNA, 64 nt, hsa; identical to SEQ ID NO: 76379

SEQ ID NO: 584199 - RNA, 64 nt, hsa; identical to SEQ ID NO: 76380

SEQ ID NO: 584200 - RNA, 64 nt, hsa; identical to SEQ ID NO: 76381

SEQ ID NO: 584201 - RNA, 64 nt, hsa; identical to SEQ ID NO: 153628

SEQ ID NO: 584202 - RNA, 64 nt, hsa; identical to SEQ ID NO: 153629

SEQ ID NO: 584203 - RNA, 64 nt, hsa; identical to SEQ ID NO: 153630

SEQ ID NO: 584204 - RNA, 64 nt, hsa; identical to SEQ ID NO: 153631

SEQ ID NO: 584205 - RNA, 64 nt, hsa; identical to SEQ ID NO: 153632

SEQ ID NO: 584206 - RNA, 64 nt, hsa; identical to SEQ ID NO: 153633

SEQ ID NO: 584207 - RNA, 64 nt, hsa; identical to SEQ ID NO: 153634

SEQ ID NO: 584208 - RNA, 64 nt, hsa; identical to SEQ ID NO: 153635

SEQ ID NO: 584209 - RNA, 64 nt, hsa; identical to SEQ ID NO: 153636

SEQ ID NO: 584210 - RNA, 64 nt, hsa; identical to SEQ ID NO: 153637

SEQ ID NO: 584211 - RNA, 64 nt, hsa; identical to SEQ ID NO: 110389

SEQ ID NO: 584212 - RNA, 64 nt, hsa; identical to SEQ ID NO: 110390

SEQ ID NO: 584213 - RNA, 64 nt, hsa; identical to SEQ ID NO: 110391

SEQ ID NO: 584214 - RNA, 64 nt, hsa; identical to SEQ ID NO: 110392

SEQ ID NO: 584215 - RNA, 64 nt, hsa; identical to SEQ ID NO: 110393

SEQ ID NO: 584216 - RNA, 63 nt, hsa; identical to SEQ ID NO: 110394

SEQ ID NO: 584217 - RNA, 60 nt, hsa; identical to SEQ ID NO: 110395

SEQ ID NO: 584218 - RNA, 64 nt, hsa; identical to SEQ ID NO: 110396

SEQ ID NO: 584219 - RNA, 64 nt, hsa; identical to SEQ ID NO: 110397

SEQ ID NO: 584220 - RNA, 64 nt, hsa; identical to SEQ ID NO: 110398

SEQ ID NO: 584221 - RNA, 64 nt, hsa; identical to SEQ ID NO: 110399

SEQ ID NO: 584222 - RNA, 64 nt, hsa; identical to SEQ ID NO: 110400

SEQ ID NO: 584223 - RNA, 64 nt, hsa; identical to SEQ ID NO: 110401

SEQ ID NO: 584224 - RNA, 58 nt, hsa; identical to SEQ ID NO: 110402

SEQ ID NO: 584225 - RNA, 64 nt, hsa; identical to SEQ ID NO: 110403

SEQ ID NO: 584226 - RNA, 64 nt, hsa; identical to SEQ ID NO: 110404

SEQ ID NO: 584227 - RNA, 64 nt, hsa; identical to SEQ ID NO: 110405

SEQ ID NO: 584228 - RNA, 64 nt, hsa; identical to SEQ ID NO: 110406

SEQ ID NO: 584229 - RNA, 64 nt, hsa; identical to SEQ ID NO: 110407

SEQ ID NO: 584230 - RNA, 64 nt, hsa; identical to SEQ ID NO: 110408

SEQ ID NO: 584231 - RNA, 64 nt, hsa; identical to SEQ ID NO: 110409

SEQ ID NO: 584232 - RNA, 64 nt, hsa; identical to SEQ ID NO: 110410

SEQ ID NO: 584233 - RNA, 64 nt, hsa; identical to SEQ ID NO: 110411

SEQ ID NO: 584234 - RNA, 64 nt, hsa; identical to SEQ ID NO: 110412

SEQ ID NO: 584235 - RNA, 64 nt, hsa; identical to SEQ ID NO: 110413

SEQ ID NO: 584236 - RNA, 64 nt, hsa; identical to SEQ ID NO: 110414

SEQ ID NO: 584237 - RNA, 64 nt, hsa; identical to SEQ ID NO: 110415

SEQ ID NO: 584238 - RNA, 64 nt, hsa; identical to SEQ ID NO: 110416

SEQ ID NO: 584239 - RNA, 64 nt, hsa; identical to SEQ ID NO: 110417

SEQ ID NO: 584240 - RNA, 64 nt, hsa; identical to SEQ ID NO: 110418

SEQ ID NO: 584241 - RNA, 64 nt, hsa; identical to SEQ ID NO: 110419

SEQ ID NO: 584242 - RNA, 64 nt, hsa; identical to SEQ ID NO: 110420

SEQ ID NO: 584243 - RNA, 64 nt, hsa; identical to SEQ ID NO: 110421

SEQ ID NO: 584244 - RNA, 64 nt, hsa; identical to SEQ ID NO: 110422

SEQ ID NO: 584245 - RNA, 64 nt, hsa; identical to SEQ ID NO: 110423

SEQ ID NO: 584246 - RNA, 64 nt, hsa; identical to SEQ ID NO: 110424

SEQ ID NO: 584247 - RNA, 64 nt, hsa; identical to SEQ ID NO: 110425

SEQ ID NO: 584248 - RNA, 64 nt, hsa; identical to SEQ ID NO: 110426

SEQ ID NO: 584249 - RNA, 64 nt, hsa; identical to SEQ ID NO: 110427

SEQ ID NO: 584250 - RNA, 64 nt, hsa; identical to SEQ ID NO: 110428

SEQ ID NO: 584251 - RNA, 64 nt, hsa; identical to SEQ ID NO: 110429

SEQ ID NO: 584252 - RNA, 64 nt, hsa; identical to SEQ ID NO: 110430

SEQ ID NO: 584253 - RNA, 64 nt, hsa; identical to SEQ ID NO: 110431

SEQ ID NO: 584254 - RNA, 64 nt, hsa; identical to SEQ ID NO: 110432

SEQ ID NO: 584255 - RNA, 64 nt, hsa; identical to SEQ ID NO: 110433

SEQ ID NO: 584256 - RNA, 64 nt, hsa; identical to SEQ ID NO: 110434

SEQ ID NO: 584257 - RNA, 64 nt, hsa; identical to SEQ ID NO: 110435

SEQ ID NO: 584258 - RNA, 64 nt, hsa; identical to SEQ ID NO: 110436

SEQ ID NO: 584259 - RNA, 64 nt, hsa; identical to SEQ ID NO: 110437

SEQ ID NO: 584260 - RNA, 64 nt, hsa; identical to SEQ ID NO: 110438

SEQ ID NO: 584261 - RNA, 64 nt, hsa; identical to SEQ ID NO: 110439

SEQ ID NO: 584262 - RNA, 64 nt, hsa; identical to SEQ ID NO: 56439

SEQ ID NO: 584263 - RNA, 64 nt, hsa; identical to SEQ ID NO: 56440

SEQ ID NO: 584264 - RNA, 64 nt, hsa; identical to SEQ ID NO: 56441

SEQ ID NO: 584265 - RNA, 64 nt, hsa; identical to SEQ ID NO: 56442

SEQ ID NO: 584266 - RNA, 64 nt, hsa; identical to SEQ ID NO: 56443

SEQ ID NO: 584267 - RNA, 64 nt, hsa; identical to SEQ ID NO: 56444

SEQ ID NO: 584268 - RNA, 64 nt, hsa; identical to SEQ ID NO: 56445

SEQ ID NO: 584269 - RNA, 64 nt, hsa; identical to SEQ ID NO: 56446

SEQ ID NO: 584270 - RNA, 64 nt, hsa; identical to SEQ ID NO: 56447

SEQ ID NO: 584271 - RNA, 64 nt, hsa; identical to SEQ ID NO: 56448

SEQ ID NO: 584272 - RNA, 64 nt, hsa; identical to SEQ ID NO: 56449

SEQ ID NO: 584273 - RNA, 64 nt, hsa; identical to SEQ ID NO: 56450

SEQ ID NO: 584274 - RNA, 64 nt, hsa; identical to SEQ ID NO: 56451

SEQ ID NO: 584275 - RNA, 64 nt, hsa; identical to SEQ ID NO: 56452

SEQ ID NO: 584276 - RNA, 64 nt, hsa; identical to SEQ ID NO: 56453

SEQ ID NO: 584277 - RNA, 64 nt, hsa; identical to SEQ ID NO: 56454

SEQ ID NO: 584278 - RNA, 64 nt, hsa; identical to SEQ ID NO: 56455

SEQ ID NO: 584279 - RNA, 64 nt, hsa; identical to SEQ ID NO: 56456

SEQ ID NO: 584280 - RNA, 64 nt, hsa; identical to SEQ ID NO: 56457

SEQ ID NO: 584281 - RNA, 64 nt, hsa; identical to SEQ ID NO: 56458

SEQ ID NO: 584282 - RNA, 64 nt, hsa; identical to SEQ ID NO: 56459

SEQ ID NO: 584283 - RNA, 64 nt, hsa; identical to SEQ ID NO: 56460

SEQ ID NO: 584284 - RNA, 64 nt, hsa; identical to SEQ ID NO: 56461

SEQ ID NO: 584285 - RNA, 64 nt, hsa; identical to SEQ ID NO: 56462

SEQ ID NO: 584286 - RNA, 64 nt, hsa; identical to SEQ ID NO: 56463

SEQ ID NO: 584287 - RNA, 64 nt, hsa; identical to SEQ ID NO: 56464

SEQ ID NO: 584288 - RNA, 64 nt, hsa; identical to SEQ ID NO: 56465

SEQ ID NO: 584289 - RNA, 64 nt, hsa; identical to SEQ ID NO: 56466

SEQ ID NO: 584290 - RNA, 64 nt, hsa; identical to SEQ ID NO: 56467

SEQ ID NO: 584291 - RNA, 50 nt, hsa; identical to SEQ ID NO: 56468

SEQ ID NO: 584292 - RNA, 64 nt, hsa; identical to SEQ ID NO: 56469

SEQ ID NO: 584293 - RNA, 64 nt, hsa; identical to SEQ ID NO: 56470

SEQ ID NO: 584294 - RNA, 64 nt, hsa; identical to SEQ ID NO: 56471

SEQ ID NO: 584295 - RNA, 64 nt, hsa; identical to SEQ ID NO: 56472

SEQ ID NO: 584296 - RNA, 64 nt, hsa; identical to SEQ ID NO: 56473

SEQ ID NO: 584297 - RNA, 64 nt, hsa; identical to SEQ ID NO: 56474

SEQ ID NO: 584298 - RNA, 64 nt, hsa; identical to SEQ ID NO: 56475

SEQ ID NO: 584299 - RNA, 64 nt, hsa; identical to SEQ ID NO: 56476

SEQ ID NO: 584300 - RNA, 64 nt, hsa; identical to SEQ ID NO: 56477

SEQ ID NO: 584301 - RNA, 64 nt, hsa; identical to SEQ ID NO: 56478

SEQ ID NO: 584302 - RNA, 64 nt, hsa; identical to SEQ ID NO: 56479

SEQ ID NO: 584303 - RNA, 64 nt, hsa; identical to SEQ ID NO: 56480

SEQ ID NO: 584304 - RNA, 64 nt, hsa; identical to SEQ ID NO: 56481

SEQ ID NO: 584305 - RNA, 64 nt, hsa; identical to SEQ ID NO: 56482

SEQ ID NO: 584306 - RNA, 64 nt, hsa; identical to SEQ ID NO: 56483

SEQ ID NO: 584307 - RNA, 64 nt, hsa; identical to SEQ ID NO: 56484

SEQ ID NO: 584308 - RNA, 64 nt, hsa; identical to SEQ ID NO: 56485

SEQ ID NO: 584309 - RNA, 64 nt, hsa; identical to SEQ ID NO: 56486

SEQ ID NO: 584310 - RNA, 64 nt, hsa; identical to SEQ ID NO: 56487

SEQ ID NO: 584311 - RNA, 64 nt, hsa; identical to SEQ ID NO: 56488

SEQ ID NO: 584312 - RNA, 64 nt, hsa; identical to SEQ ID NO: 56489

SEQ ID NO: 584313 - RNA, 64 nt, hsa; identical to SEQ ID NO: 56490

SEQ ID NO: 584314 - RNA, 64 nt, hsa; identical to SEQ ID NO: 56491

SEQ ID NO: 584315 - RNA, 64 nt, hsa; identical to SEQ ID NO: 56492

SEQ ID NO: 584316 - RNA, 64 nt, hsa; identical to SEQ ID NO: 56493

SEQ ID NO: 584317 - RNA, 64 nt, hsa; identical to SEQ ID NO: 56494

SEQ ID NO: 584318 - RNA, 64 nt, hsa; identical to SEQ ID NO: 56495

SEQ ID NO: 584319 - RNA, 64 nt, hsa; identical to SEQ ID NO: 56496

SEQ ID NO: 584320 - RNA, 64 nt, hsa; identical to SEQ ID NO: 56497

SEQ ID NO: 584321 - RNA, 64 nt, hsa; identical to SEQ ID NO: 56498

SEQ ID NO: 584322 - RNA, 64 nt, hsa; identical to SEQ ID NO: 56499

SEQ ID NO: 584323 - RNA, 64 nt, hsa; identical to SEQ ID NO: 56500

SEQ ID NO: 584324 - RNA, 64 nt, hsa; identical to SEQ ID NO: 56501

SEQ ID NO: 584325 - RNA, 64 nt, hsa; identical to SEQ ID NO: 56502

SEQ ID NO: 584326 - RNA, 64 nt, hsa; identical to SEQ ID NO: 56503

SEQ ID NO: 584327 - RNA, 64 nt, hsa; identical to SEQ ID NO: 56504

SEQ ID NO: 584328 - RNA, 64 nt, hsa; identical to SEQ ID NO: 56505

SEQ ID NO: 584329 - RNA, 64 nt, hsa; identical to SEQ ID NO: 56506

SEQ ID NO: 584330 - RNA, 64 nt, hsa; identical to SEQ ID NO: 56507

SEQ ID NO: 584331 - RNA, 64 nt, hsa; identical to SEQ ID NO: 56508

SEQ ID NO: 584332 - RNA, 64 nt, hsa; identical to SEQ ID NO: 56509

SEQ ID NO: 584333 - RNA, 64 nt, hsa; identical to SEQ ID NO: 56510

SEQ ID NO: 584334 - RNA, 64 nt, hsa; identical to SEQ ID NO: 56511

SEQ ID NO: 584335 - RNA, 64 nt, hsa; identical to SEQ ID NO: 56512

SEQ ID NO: 584336 - RNA, 64 nt, hsa; identical to SEQ ID NO: 56513

SEQ ID NO: 584337 - RNA, 64 nt, hsa; identical to SEQ ID NO: 56514

SEQ ID NO: 584338 - RNA, 64 nt, hsa; identical to SEQ ID NO: 56515

SEQ ID NO: 584339 - RNA, 64 nt, hsa; identical to SEQ ID NO: 56516

SEQ ID NO: 584340 - RNA, 64 nt, hsa; identical to SEQ ID NO: 56517

SEQ ID NO: 584341 - RNA, 64 nt, hsa; identical to SEQ ID NO: 56518

SEQ ID NO: 584342 - RNA, 64 nt, hsa; identical to SEQ ID NO: 56519

SEQ ID NO: 584343 - RNA, 64 nt, hsa; identical to SEQ ID NO: 56520

SEQ ID NO: 584344 - RNA, 64 nt, hsa; identical to SEQ ID NO: 56521

SEQ ID NO: 584345 - RNA, 64 nt, hsa; identical to SEQ ID NO: 56522

SEQ ID NO: 584346 - RNA, 64 nt, hsa; identical to SEQ ID NO: 56523

SEQ ID NO: 584347 - RNA, 64 nt, hsa; identical to SEQ ID NO: 56524

SEQ ID NO: 584348 - RNA, 64 nt, hsa; identical to SEQ ID NO: 56525

SEQ ID NO: 584349 - RNA, 64 nt, hsa; identical to SEQ ID NO: 56526

SEQ ID NO: 584350 - RNA, 64 nt, hsa; identical to SEQ ID NO: 56527

SEQ ID NO: 584351 - RNA, 64 nt, hsa; identical to SEQ ID NO: 56528

SEQ ID NO: 584352 - RNA, 64 nt, hsa; identical to SEQ ID NO: 56529

SEQ ID NO: 584353 - RNA, 64 nt, hsa; identical to SEQ ID NO: 56530

SEQ ID NO: 584354 - RNA, 64 nt, hsa; identical to SEQ ID NO: 56531

SEQ ID NO: 584355 - RNA, 64 nt, hsa; identical to SEQ ID NO: 56532

SEQ ID NO: 584356 - RNA, 64 nt, hsa; identical to SEQ ID NO: 56533

SEQ ID NO: 584357 - RNA, 64 nt, hsa; identical to SEQ ID NO: 56534

SEQ ID NO: 584358 - RNA, 59 nt, hsa; identical to SEQ ID NO: 56535

SEQ ID NO: 584359 - RNA, 64 nt, hsa; identical to SEQ ID NO: 56536

SEQ ID NO: 584360 - RNA, 64 nt, hsa; identical to SEQ ID NO: 56537

SEQ ID NO: 584361 - RNA, 64 nt, hsa; identical to SEQ ID NO: 56538

SEQ ID NO: 584362 - RNA, 64 nt, hsa; identical to SEQ ID NO: 56539

SEQ ID NO: 584363 - RNA, 64 nt, hsa; identical to SEQ ID NO: 56540

SEQ ID NO: 584364 - RNA, 64 nt, hsa; identical to SEQ ID NO: 56541

SEQ ID NO: 584365 - RNA, 64 nt, hsa; identical to SEQ ID NO: 56542

SEQ ID NO: 584366 - RNA, 64 nt, hsa; identical to SEQ ID NO: 56543

SEQ ID NO: 584367 - RNA, 64 nt, hsa; identical to SEQ ID NO: 56544

SEQ ID NO: 584368 - RNA, 64 nt, hsa; identical to SEQ ID NO: 56545

SEQ ID NO: 584369 - RNA, 64 nt, hsa; identical to SEQ ID NO: 56546

SEQ ID NO: 584370 - RNA, 64 nt, hsa; identical to SEQ ID NO: 56547

SEQ ID NO: 584371 - RNA, 64 nt, hsa; identical to SEQ ID NO: 56548

SEQ ID NO: 584372 - RNA, 64 nt, hsa; identical to SEQ ID NO: 56549

SEQ ID NO: 584373 - RNA, 64 nt, hsa; identical to SEQ ID NO: 56550

SEQ ID NO: 584374 - RNA, 64 nt, hsa; identical to SEQ ID NO: 56551

SEQ ID NO: 584375 - RNA, 64 nt, hsa; identical to SEQ ID NO: 56552

SEQ ID NO: 584376 - RNA, 64 nt, hsa; identical to SEQ ID NO: 56553

SEQ ID NO: 584377 - RNA, 64 nt, hsa; identical to SEQ ID NO: 56554

SEQ ID NO: 584378 - RNA, 64 nt, hsa; identical to SEQ ID NO: 56555

SEQ ID NO: 584379 - RNA, 64 nt, hsa; identical to SEQ ID NO: 56556

SEQ ID NO: 584380 - RNA, 62 nt, hsa; identical to SEQ ID NO: 56557

SEQ ID NO: 584381 - RNA, 58 nt, hsa; identical to SEQ ID NO: 56558

SEQ ID NO: 584382 - RNA, 64 nt, hsa; identical to SEQ ID NO: 56559

SEQ ID NO: 584383 - RNA, 64 nt, hsa; identical to SEQ ID NO: 56560

SEQ ID NO: 584384 - RNA, 64 nt, hsa; identical to SEQ ID NO: 56561

SEQ ID NO: 584385 - RNA, 64 nt, hsa; identical to SEQ ID NO: 56562

SEQ ID NO: 584386 - RNA, 64 nt, hsa; identical to SEQ ID NO: 56563

SEQ ID NO: 584387 - RNA, 64 nt, hsa; identical to SEQ ID NO: 56564

SEQ ID NO: 584388 - RNA, 64 nt, hsa; identical to SEQ ID NO: 56565

SEQ ID NO: 584389 - RNA, 64 nt, hsa; identical to SEQ ID NO: 56566

SEQ ID NO: 584390 - RNA, 64 nt, hsa; identical to SEQ ID NO: 56567

SEQ ID NO: 584391 - RNA, 64 nt, hsa; identical to SEQ ID NO: 56568

SEQ ID NO: 584392 - RNA, 64 nt, hsa; identical to SEQ ID NO: 56569

SEQ ID NO: 584393 - RNA, 64 nt, hsa; identical to SEQ ID NO: 56570

SEQ ID NO: 584394 - RNA, 64 nt, hsa; identical to SEQ ID NO: 56571

SEQ ID NO: 584395 - RNA, 64 nt, hsa; identical to SEQ ID NO: 56572

SEQ ID NO: 584396 - RNA, 64 nt, hsa; identical to SEQ ID NO: 56573

SEQ ID NO: 584397 - RNA, 64 nt, hsa; identical to SEQ ID NO: 56574

SEQ ID NO: 584398 - RNA, 64 nt, hsa; identical to SEQ ID NO: 56575

SEQ ID NO: 584399 - RNA, 64 nt, hsa; identical to SEQ ID NO: 56576

SEQ ID NO: 584400 - RNA, 64 nt, hsa; identical to SEQ ID NO: 56577

SEQ ID NO: 584401 - RNA, 64 nt, hsa; identical to SEQ ID NO: 56578

SEQ ID NO: 584402 - RNA, 64 nt, hsa; identical to SEQ ID NO: 56579

SEQ ID NO: 584403 - RNA, 64 nt, hsa; identical to SEQ ID NO: 56580

SEQ ID NO: 584404 - RNA, 64 nt, hsa; identical to SEQ ID NO: 56581

SEQ ID NO: 584405 - RNA, 64 nt, hsa; identical to SEQ ID NO: 56582

SEQ ID NO: 584406 - RNA, 64 nt, hsa; identical to SEQ ID NO: 290771

SEQ ID NO: 584407 - RNA, 64 nt, hsa; identical to SEQ ID NO: 290772

SEQ ID NO: 584408 - RNA, 64 nt, hsa; identical to SEQ ID NO: 290773

SEQ ID NO: 584409 - RNA, 64 nt, hsa; identical to SEQ ID NO: 290774

SEQ ID NO: 584410 - RNA, 64 nt, hsa; identical to SEQ ID NO: 290775

SEQ ID NO: 584411 - RNA, 64 nt, hsa; identical to SEQ ID NO: 290776

SEQ ID NO: 584412 - RNA, 64 nt, hsa
uuuggaugugugauuaauuuucaaaucaucuaaaguuuaaaaguaguauucaugauuucuggcu

SEQ ID NO: 584413 - RNA, 64 nt, hsa
ccauuauuucaaguaauaaaucugaauucuauuaguuuaaaaauuguaaaauucaaguuaaaug

SEQ ID NO: 584414 - RNA, 64 nt, hsa
aggauauugcagcuucagcaguguugaacuguguguuuaaaaaugugaauuacuguuauuguau

SEQ ID NO: 584415 - RNA, 64 nt, hsa
gucuuuguuugcauuguauaacuuuaacgagugaguuuaaaauuauuuaauuuccuuagaaaaa

SEQ ID NO: 584416 - RNA, 64 nt, hsa
uugcuguuuuucccuuuuuuuuuuaauugcuuuuguuuaaaauuugaucgccuuaacuacugua

SEQ ID NO: 584417 - RNA, 64 nt, hsa
aguauuuuauucacauuauuugcaauauccaaauguuuaaaaauucccagauaauuaacuagcu

SEQ ID NO: 584418 - RNA, 64 nt, hsa
guuuccauuuucaaauuauuuagaauucuuaugaguuuaaaauuuguaaauuucuaaauccaau

SEQ ID NO: 584419 - RNA, 64 nt, hsa
ugcugauucuauaagauuauuuauauauguaaguguuuaaaaagauuauuuuccagaaaguuug

SEQ ID NO: 584420 - RNA, 64 nt, hsa
ccuuccccuuuuuucuaaauuugaaauagcuuuaguuuaaaaaaaaauccucccuucccccuuu

SEQ ID NO: 584421 - RNA, 64 nt, hsa
uuagcaugcaaguauguugguacguuauguccugguuuaaaaaggauuaaaauuuuaaaauaau

SEQ ID NO: 584422 - RNA, 64 nt, hsa
uuuuaaaauaauccuugcaucuaaaggccuugugguuuaaaaaaaaaaagcaaacuuuuuuuug

SEQ ID NO: 584423 - RNA, 64 nt, hsa
auuuuuagcaaaaaagaaaaaaaaaaggcacauaguuuaaaaaguuucucauuuugugcaauau

SEQ ID NO: 584424 - RNA, 64 nt, hsa
uuuagacuugaaagaaagagccacuuaaauucuuguuuaaaaauaccaauuugccuccuccuuc

SEQ ID NO: 584425 - RNA, 64 nt, hsa
uauauacuguauuuucuucuaaauuaacccuaauguuuaaaaacucacuuucccccuuuaauug

SEQ ID NO: 584426 - RNA, 64 nt, hsa
acaaauaauuacuggcaguagguuauaauuggugguuuaaaaauaacauuggaauacaggacuu

SEQ ID NO: 584427 - RNA, 64 nt, hsa
gauuugaaaccuggaaauacaguaaaauuugacuguuuaaaauguuggccaaaaaaaucaagau

SEQ ID NO: 584428 - RNA, 64 nt, hsa
aaagaaccugcauugcacuaggaauucuguguuaguuuaaaagagaucucuaaaacuuccccau

SEQ ID NO: 584429 - RNA, 64 nt, hsa
agcccugauaggggaagugggaguugacaggaugguuuaaaauaagacgugaagguuucaguua

SEQ ID NO: 584430 - RNA, 64 nt, hsa
ugcagucucauuuugauaaucauuugcuuccaguguuuaaaaauuaaaaaaagaauggggagaa

SEQ ID NO: 584431 - RNA, 64 nt, hsa
aauuauaugagacuugccagucaaaugcuauuugguuuaaaaaaauuauugcaaucucaaguua

SEQ ID NO: 584432 - RNA, 64 nt, hsa
aguuaauggaauauuuuuaaaucccacauucagaguuuaaaacacugguuuucaauguguuuuu

SEQ ID NO: 584433 - RNA, 64 nt, hsa
auuauuuuuugcaucauuuaaacaugcagaagauguuuaaaaauaaaaaaaaaacugcuuuauc

SEQ ID NO: 584434 - RNA, 64 nt, hsa
aauaacugaauaguuuacuauuucauucaagcauguuuaaaacaaauaauuuccuuucaccagu

SEQ ID NO: 584435 - RNA, 64 nt, hsa
acgaaguugggcaauauaaccaauguuuaaaaaaguuuaaaauguauaaguugaggcauuuggg

SEQ ID NO: 584436 - RNA, 64 nt, hsa
ucuuucaauaacgaaguugggcaauauaaccaauguuuaaaaaaguuuaaaauguauaaguuga

SEQ ID NO: 584437 - RNA, 64 nt, hsa
aaaauauuuccacuuagauauuuuacaugguuuuguuuaaaauuaccauuacuuguuuuuuaaa

SEQ ID NO: 584438 - RNA, 64 nt, hsa
gucuggaagauggaagcuagugcagaaaccucuuguuuaaaaaacaaaaaaggcaagaugggcu

SEQ ID NO: 584439 - RNA, 64 nt, hsa
agggacauuuuccuguacuuuuucaaauaaugauguuuaaaaauuaucuugacauaagcgucau

SEQ ID NO: 584440 - RNA, 64 nt, hsa
guggcuucaaaucugaaaauuaauaagccugcucguuuaaaaguuguuuguuguugcuguuuuu

SEQ ID NO: 584441 - RNA, 64 nt, hsa
gucuuuucacuaaauuguacaguauucuacuucuguuuaaaaaggggagaugagaaagggaaua

SEQ ID NO: 584442 - RNA, 64 nt, hsa
uaugaauauaaccaucuguuacuguucuaaaaauguuuaaaagaaacucaauacagauaaagau

SEQ ID NO: 584443 - RNA, 64 nt, hsa
aaaacacaagucuguggcuagaaccugaugugguguuuaaaagagaagaaacacugaagauguc

SEQ ID NO: 584444 - RNA, 64 nt, hsa
uggcaucggaaacuccccuaugcacuugaagaugguuuaaaagauuaaagaaacgauuaagaga

SEQ ID NO: 584445 - RNA, 64 nt, hsa
uuauguaaagucccucuaagacuacauacuuuuuguuuaaaacaaaauuggaauuuguuuuccc

SEQ ID NO: 584446 - RNA, 64 nt, hsa
guagugcguuuuauuuuauaugccaaucuacuuuguuuaaaaaaggucugaaucaggacuugug

SEQ ID NO: 584447 - RNA, 64 nt, hsa
cagauauuccuuacauuuuucaaaacuacugcauguuuaaaacuucaacaaaaaaagagagaaa

SEQ ID NO: 584448 - RNA, 64 nt, hsa
cacucaaaaaugcaaaaugugauaaugggcacuuguuuaaaagaauuaguguauccagccuuca

SEQ ID NO: 584449 - RNA, 64 nt, hsa
aggccuacagaugaguaaugaaguuaucuuuuuuguuuaaaaaaaaaaaaaacacugcauuaaa

SEQ ID NO: 584450 - RNA, 64 nt, hsa
uuuuauauuaccuauuaguuuuggaguucuuuauguuuaaaaauucagguguaaauuuuauugc

SEQ ID NO: 584451 - RNA, 64 nt, hsa
auuuuggaaugugaaauaaucaccuaggaaguugguuuaaaaugcacacuagugagcccaccuu

SEQ ID NO: 584452 - RNA, 64 nt, hsa
agaagaaaauuauucaaauuuggacauuuuaauuguuuaaaaauuguacaaaaggaaaaaauua

SEQ ID NO: 584453 - RNA, 64 nt, hsa
agaauaaguacuggcgaaccaucucuguggucuuguuuaaaaagggcaaaaguuuuagacugua

SEQ ID NO: 584454 - RNA, 64 nt, hsa
gugggauaugcuagaaaaggcauuuugggguuauguuuaaaaaaacauuauugucccacaauau

SEQ ID NO: 584455 - RNA, 64 nt, hsa
aaaccaaauuagccagacaugguggcaugcgcuuguuuaaaaaaacaaauaaauaaauaaucga

SEQ ID NO: 584456 - RNA, 64 nt, hsa
caagacugaagacauugauuagauauaaaauucaguuuaaaaagaacaugcuauuuuuuaaaug

SEQ ID NO: 584457 - RNA, 64 nt, hsa
uuucccuauuuuguuuaguagugaugaaagauggguuuaaaauauacagaaaugggagaaaauu

SEQ ID NO: 584458 - RNA, 64 nt, hsa
uuccacaaaaaaacagcagaccaacauauagaguguuuaaaauagcauuucugggcaaauucaa

SEQ ID NO: 584459 - RNA, 64 nt, hsa
uauuucugucuugcgugauuuguauauuucacugguuuaaaaaacaaacaucgaaaggcuuaug

SEQ ID NO: 584460 - RNA, 64 nt, hsa
agcaaaagaucuugaaagcaaaaagcacuaauuaguuuaaaaugucacuuuuuugguuuuuauu

SEQ ID NO: 584461 - RNA, 64 nt, hsa
uguaauuuagcauaauauucugaauucauuccaaguuuaaaauccugucauucucuggcucuuc

SEQ ID NO: 584462 - RNA, 64 nt, hsa
aagaacuugcucucagagaagcacuggcaaaaauguuuaaaaugcuuaucucuaagaugucuau

SEQ ID NO: 584463 - RNA, 64 nt, hsa
cuuugagaugggguggacuaagaccacccccaaaguuuaaaaauaugcucauucaacuugaauc

SEQ ID NO: 584464 - RNA, 64 nt, hsa
uuucauuuuuaaguuaucaggcacuuuucaugcuguuuaaaagacuguguaucaaauugugcac

SEQ ID NO: 584465 - RNA, 64 nt, hsa
ugcagcauuccuugucaucagaaacaugguuaaaguuuaaaacuagaagcagcagaaaacuagc

SEQ ID NO: 584466 - RNA, 64 nt, hsa
gauuagccaccauuagcaucuauaucuacuuuguguuuaaaaaucaacugguaauucugaaaca

SEQ ID NO: 584467 - RNA, 64 nt, hsa
uggagguccacaucugugguugaccucuguuauuguuuaaaaaaaauaaauaaaaauuaaaaaa

SEQ ID NO: 584468 - RNA, 64 nt, hsa
acugccauuacauggcaaaauguuugcuaccuuaguuuaaaaaacaaucucaaacaaaagacuu

SEQ ID NO: 584469 - RNA, 64 nt, hsa
gaaacauaccauacuuauauaccugcaacuaaguguuuaaaauuaugcucuguaacucuguacu

SEQ ID NO: 584470 - RNA, 64 nt, hsa
uauuguuugugggcaauauuuuuuauugucucuuguuuaaaaagugaacagugccuagugaagu

SEQ ID NO: 584471 - RNA, 64 nt, hsa
ugaaucuagguagcaugaacaaauuauaaaauuuguuuaaaaaagcaaacuugcaugcauuauu

SEQ ID NO: 584472 - RNA, 64 nt, hsa
aaaagcaaacuugcaugcauuauugugacuucaaguuuaaaaaaucgucuuacauguguacaau

SEQ ID NO: 584473 - RNA, 64 nt, hsa
uuuuuaaacuuuauuuucauaauuucugcuuaauguuuaaaauugaagagccuuuucauguauu

SEQ ID NO: 584474 - RNA, 64 nt, hsa
gguuuuuaacaagcuguuuguucaucuauauuuaguuuaaaauagguaguauuaucuuucugua

SEQ ID NO: 584475 - RNA, 64 nt, hsa
aguaguuuaaucauuggucuuuucaaaacuagguguuuaaaaaaagagacauauaugauauugc

SEQ ID NO: 584476 - RNA, 64 nt, hsa
agauggcuguuugcaggaaggcagacgagacaguguuuaaaaaguccacaagaaugaucaagua

SEQ ID NO: 584477 - RNA, 64 nt, hsa
uguuuuuauucuuacagacaucacccguguucaaguuuaaaaguacacuuugcaacuauuuuuc

SEQ ID NO: 584478 - RNA, 64 nt, hsa
cuuaacaacugaaccauucaaaaggauuuuuuuuguuuaaaacuggauuucaauguaagcaaau

SEQ ID NO: 584479 - RNA, 64 nt, hsa
cugugacaaucauuuugcugacagaaugauggauguuuaaaauauugcacaaaguacuuuaaag

SEQ ID NO: 584480 - RNA, 64 nt, hsa
uugcuuccuacuuuaugucuaaaugcuauuguuuguuuaaaauccuaauaaugucucauuucca

SEQ ID NO: 584481 - RNA, 64 nt, hsa
uauugacugggguuugaucucagcuucugaaaauguuuaaaaauuggaaggaaauacuacucau

SEQ ID NO: 584482 - RNA, 64 nt, hsa
aaauuuuauaauugacuugaguacuuuaagccuuguuuaaaacauuucuuacuuaacuuuugca

SEQ ID NO: 584483 - RNA, 64 nt, hsa
uucaaacuaauaaaaucaugaauauuuuuaugaaguuuaaaaauagcucacuuuaaagcuaguu

SEQ ID NO: 584484 - RNA, 64 nt, hsa
ucaauauuuuaaauguccggauaauauucuagagguuuaaaaaauggaaauauuugaacuuucu

SEQ ID NO: 584485 - RNA, 64 nt, hsa
gagacuuucauucuuuaaauauuauugacuuacaguuuaaaaauaaauaaauaaaagcauacua

SEQ ID NO: 584486 - RNA, 64 nt, hsa
uggaaaauuugacaauuuugauucucacugguauguuuaaaaacugaauaaaaggaauagaauu

SEQ ID NO: 584487 - RNA, 64 nt, hsa
cuucuauuuaucuuugauuucagucuuggcaauuguuuaaaaaaaaaaucuagauuuguuuuau

SEQ ID NO: 584488 - RNA, 64 nt, hsa
uaguaauaguaugaaaauacuagauaaaauuaauguuuaaaauguuuuuguaacaauaauuuuu

SEQ ID NO: 584489 - RNA, 64 nt, hsa
cagccagaauuaggugaaguagcaugauagcaguguuuaaaaauacuuaggauuaaauaaauaa

SEQ ID NO: 584490 - RNA, 64 nt, hsa
cuggcagaauggcagaguagcugcgaaacaauuuguuuaaaaacuugcuuaagacaauugcauc

SEQ ID NO: 584491 - RNA, 64 nt, hsa
auaguuuguguuaagcaugucauucauauaaacuguuuaaaauuuuucagauggccuaguuuca

SEQ ID NO: 584492 - RNA, 64 nt, hsa
uuuauaacagggcggcugguuaauaucucacacaguuuaaaaaaucagccccuaauuucuccau

SEQ ID NO: 584493 - RNA, 64 nt, hsa
ugauagcauauguguucagguuuauagcuguuguguuuaaaaauugaaaaaaguggaaaacauc

SEQ ID NO: 584494 - RNA, 64 nt, hsa
guacauauacuuaauguuuucaagugccuuaauuguuuaaaaucucuggcuucaaaguuucuug

SEQ ID NO: 584495 - RNA, 64 nt, hsa
uugacucauuggacuagugcagaggcuuuaaguaguuuaaaaugggcuuuugcuuuucuagguc

SEQ ID NO: 584496 - RNA, 64 nt, hsa
caaaaguuuuuuucaagaauugaaauaaguaucaguuuaaaaauuuauauuaaauuuauuaaaa

SEQ ID NO: 584497 - RNA, 64 nt, hsa
uuuuucaacagaaggcuaucaaaauuuuaauuaaguuuaaaauacaaaauuggaucaagacauu

SEQ ID NO: 584498 - RNA, 64 nt, hsa
aaagauuuagauuguuuauucuucuguggacacaguuuaaaaucuuaaacuugucuuuuuccuc

SEQ ID NO: 584499 - RNA, 64 nt, hsa
cugauuucacauauugcaaccuaguacuuuauuaguuuaaaaagaaauugagguuguucaaagu

SEQ ID NO: 584500 - RNA, 64 nt, hsa
aaccaaauuuuaauuuuugcuuuuagaaaagggaguuuaaaaaugguaucaaaauuacauauac

SEQ ID NO: 584501 - RNA, 64 nt, hsa
uuaaucacccuaccaacuuuacuguccuaacaugguuuaaaagaaaaaaugacaccaucuuuua

SEQ ID NO: 584502 - RNA, 64 nt, hsa
guucuaggucaguuauacccaagcacuucuggugguuuaaaaugugauucuguaacuuuuuuau

SEQ ID NO: 584503 - RNA, 64 nt, hsa
gcccaguaguaacuuagguuuaauuuuuuuucagguuuaaaauuuuucucauuuauuuuuucug

SEQ ID NO: 584504 - RNA, 64 nt, hsa
aaaaaaaacacacacgaaaaacaaaaguuugcuuguuuaaaaugacaguugugauguaaaaagu

SEQ ID NO: 584505 - RNA, 64 nt, hsa
gaacuguuuaugauaccaaaaaaauuacaguuuuguuuaaaaggaaauguugauguuuucaacu

SEQ ID NO: 584506 - RNA, 64 nt, hsa
ggagacagcuaaucucucuagggacuauuuggugguuuaaaaaaagggucagacuuuuaaacac

SEQ ID NO: 584507 - RNA, 64 nt, hsa
gaagaaagcaagcagaaauaguaaaauucaguagguuuaaaacaaucuauaaauguauuuuauu

SEQ ID NO: 584508 - RNA, 64 nt, hsa
aagauuuuuuuauuuguauuaaugaaaagcuuuaguuuaaaauaaggagauccagaauaaaaag

SEQ ID NO: 584509 - RNA, 64 nt, hsa
cuccauuuagacauaggucaauuaaaauauuuggguuuaaaaugacuaaaugcuuuaaacauau

SEQ ID NO: 584510 - RNA, 64 nt, hsa
ugcuuuaauuuauuaaauguauuuuccauacugaguuuaaaauuuauuaauuuguaccuuaagc

SEQ ID NO: 584511 - RNA, 64 nt, hsa
gcacuuuguacaguacaaaauaaagucuacauuuguuuaaaacacugaaccuuuugcugaugug

SEQ ID NO: 584512 - RNA, 64 nt, hsa
aucacugcauaacaaaccacaccaaaacucagugguuuaaaacaaggacuuuuauuauuuuuca

SEQ ID NO: 584513 - RNA, 64 nt, hsa
ucucauguuuuauaugaaagauguacaauucaguguuuaaaaauaaaaauauuuauuguguacu

SEQ ID NO: 584514 - RNA, 64 nt, hsa
auaaauguugacuuaaucagcauaguaaacugauguuuaaaauuccauacuucaugcccacacu

SEQ ID NO: 584515 - RNA, 64 nt, hsa
ugaaauugcaucgaggguaagacuguguccacagguuuaaaauucucucuucugaguaauagug

SEQ ID NO: 584516 - RNA, 64 nt, hsa
aauguauuuaaacaauuuccgaugcccaugaugaguuuaaaaaccagcauugacaccaucccca

SEQ ID NO: 584517 - RNA, 64 nt, hsa
ccucuacgauuuuuaaguaaguuggggaccaucaguuuaaaauaaaugcaauacuauuucauga

SEQ ID NO: 584518 - RNA, 64 nt, hsa
agugaguggauuuuauuuuucguuauuguuggugguuuaaaaaauuccccccauguaauuauug

SEQ ID NO: 584519 - RNA, 64 nt, hsa
ggaguccugcaucuuuuuuuuuuuaucugcuucuguuuaaaaagccaacauuccucugcuucau

SEQ ID NO: 584520 - RNA, 64 nt, hsa
uuggauagauuugucaaaacgacauuuaagucauguuuaaaaagucauuugggcaguucuggaa

SEQ ID NO: 584521 - RNA, 64 nt, hsa
aaauuguccaaucuggugaaugucuaacccuaaaguuuaaaaauuucugccuccuaaguuuaug

SEQ ID NO: 584522 - RNA, 64 nt, hsa
uacauuuaagaaaaaaaaaaaagaaaaaaagauuguuuaaaaaaaaaaggaauccauaccauga

SEQ ID NO: 584523 - RNA, 64 nt, hsa
gccugagugacagcggcaguccuguuuguuugagguuuaaaacaauucaauuacaaaagcggca

SEQ ID NO: 584524 - RNA, 64 nt, hsa
aguauugugaauacaauguauguccaauuggauuguuuaaaaacuacuuauaauuaaucacuag

SEQ ID NO: 584525 - RNA, 64 nt, hsa
gugagagggcagucauucuucucacugaguuuuuguuuaaaaaccaggaaauuucuacaaucau

SEQ ID NO: 584526 - RNA, 64 nt, hsa
uccuguggcaccaaccaguggugcucauucuauuguuuaaaaauggccuucuuggcugggcgcg

SEQ ID NO: 584527 - RNA, 64 nt, hsa
uaugagguuuccuaaauaaaugaggaguagcauaguuuaaaauauauauaucuuauaacuuucu

SEQ ID NO: 584528 - RNA, 64 nt, hsa
augacaagauguaaaauaauauguuuuucaugcaguuuaaaauauuacuaacuuaaggguuucu

SEQ ID NO: 584529 - RNA, 64 nt, hsa
ccuucuuugauguugacaucaaauaaaguaugugguuuaaaaaaaucuccaaauaccuuuuuuu

SEQ ID NO: 584530 - RNA, 64 nt, hsa
aaaaaugaagcuuauauuaauuguugcuucaauaguuuaaaaaauuuauggagauagguagguc

SEQ ID NO: 584531 - RNA, 64 nt, hsa
gccuguucugaaacuuauaggaaauuggaauuuuguuuaaaauuuuacacuuuaagguagcaaa

SEQ ID NO: 584532 - RNA, 64 nt, hsa
acaugaggaccaaaccaugcacauaaagcuuguaguuuaaaaaagaaaagcaaaaaaauaauua

SEQ ID NO: 584533 - RNA, 64 nt, hsa
acaggauuuuuugaugcuuugcucuaauggaacuguuuaaaaaauuuuuuuuucuuuuuaauau

SEQ ID NO: 584534 - RNA, 64 nt, hsa
uguagaacauuugauucacauugugaagaaugcaguuuaaaauauacugaaugcaaucuagaug

SEQ ID NO: 584535 - RNA, 64 nt, hsa
uuaugcuuggcaugaauaaggugccaggaaaacaguuuaaaauuauacaucagcauacagacug

SEQ ID NO: 584536 - RNA, 64 nt, hsa
auuguuaauuuaaggauauauauuaauagaguauguuuaaaauaaauauuguuuucaucacuga

SEQ ID NO: 584537 - RNA, 64 nt, hsa
aacagaauggaauaucagaguacauuuucaugaaguuuaaaaaucaaggacuguuccugauuag

SEQ ID NO: 584538 - RNA, 64 nt, hsa
uucugccuuccaagaguauauguuucuuuaaucaguuuaaaagauaaaggcauuuuggguuuua

SEQ ID NO: 584539 - RNA, 64 nt, hsa
gaauucagccuguuucuaaaagcugaaaaucucaguuuaaaaaucaaaauguuaacacaaagcu

SEQ ID NO: 584540 - RNA, 64 nt, hsa
uguccucuguucuuccaguucacgagggcaggggguuuaaaacaagaaugauaggccaggaagg

SEQ ID NO: 584541 - RNA, 64 nt, hsa
ucuucaugacaagaguauuugguagggaaagcagguuuaaaauaaaaagacaacccacccccug

SEQ ID NO: 584542 - RNA, 64 nt, hsa
ccaaguaccuguuuucauucccauuuuucccauuguuuaaaaccaucacuuuuuugucuuuggg

SEQ ID NO: 584543 - RNA, 64 nt, hsa
ucugauuagaugaucauuggugucuugccacaauguuuaaaaauuacuguacaggaaagucaca

SEQ ID NO: 584544 - RNA, 64 nt, hsa
gaggcuagaaguaucaucuggauuguugugaaacguuuaaaagcaguggccccucccugcuuuu

SEQ ID NO: 584545 - RNA, 64 nt, hsa
uguuuuaaaaauuaggcuuauugcuagacuguaaguuuaaaaacaauucauguucaaaggagcu

SEQ ID NO: 584546 - RNA, 64 nt, hsa
acacauuaaagagaaaauuucacauuaaaggaagguuuaaaaaucuauuuucagauuauaaaag

SEQ ID NO: 584547 - RNA, 64 nt, hsa
uugcuuaccugaccacuuuuuauuaagcuguuuuguuuaaaagcuuuugguuauaggcaugaau

SEQ ID NO: 584548 - RNA, 64 nt, hsa
uuaaaaauugcauuguuauuuuuuuuuaaacucaguuuaaaaagacuaaaacguucuuucaaaa

SEQ ID NO: 584549 - RNA, 64 nt, hsa
guauauugcugcacuuuuaaguuuucaaaacaguguuuaaaaauugcauuguuauuuuuuuuua

SEQ ID NO: 584550 - RNA, 64 nt, hsa
aaacaagaaacuugguuauugaauaaacagauaaguuuaaaaaaaaaaaaaaacuacuucaucu

SEQ ID NO: 584551 - RNA, 64 nt, hsa
gaucagaaauggcaagcccuugugaaggcauggaguuuaaaauuggaaugcaaaaauuagcaga

SEQ ID NO: 584552 - RNA, 64 nt, hsa
agguuuauaucuuguuuuaccuuggcucauuaguguuuaaaaauguacugaugaugugcuuaga

SEQ ID NO: 584553 - RNA, 64 nt, hsa
caauauuuuacugcuagcuugcaaaguuaugagaguuuaaaaaauaaaauauaugaaaauaugu

SEQ ID NO: 584554 - RNA, 64 nt, hsa
gugugauauuuuccagauuuguuggaucuauuugguuuaaaaaguauucuaucuuaaggccaac

SEQ ID NO: 584555 - RNA, 64 nt, hsa
aauuuauuguuugagggaaauacgagguuucauuguuuaaaaucaagaguguauuguuuacugu

SEQ ID NO: 584556 - RNA, 64 nt, hsa
guuucugagucauuugggaccaacugcagugguuguuuaaaaugcugguuccugcacacaauuc

SEQ ID NO: 584557 - RNA, 64 nt, hsa
gaauucugguuagcuaauugaacuuuugugaccuguuuaaaaacaaaucaaauuuauugaacaa

SEQ ID NO: 584558 - RNA, 64 nt, hsa
auauuuaucuuucaguuuauuugaaagaggucugguuuaaaauuuguagccuacauuuguuuua

SEQ ID NO: 584559 - RNA, 64 nt, hsa
cucaaaacgauuuggucagguucugguuggacaaguuuaaaaucaaaguagugcccggaauucc

SEQ ID NO: 584560 - RNA, 64 nt, hsa
uuaaucuuugaaaacucauacagugguauugcuaguuuaaaaugagucacuuacuucauauccu

SEQ ID NO: 584561 - RNA, 64 nt, hsa
augugucuuguauuaucauaaguuagauguuuuaguuuaaaaaucagaaagacauucuuaguua

SEQ ID NO: 584562 - RNA, 64 nt, hsa
cugaaauaaaacauuuuaaaauauaaauccuguaguuuaaaaggaagaaauggugggaaggaaa

SEQ ID NO: 584563 - RNA, 64 nt, hsa
gcuaauuaacagucguaugauuucuagcccauggguuuaaaacuguaucuuaaagagucauuuu

SEQ ID NO: 584564 - RNA, 64 nt, hsa
guuacuugagcuuaaauguacuuuacugagcaaaguuuaaaaaacaaaguauauuuuauuuuau

SEQ ID NO: 584565 - RNA, 64 nt, hsa
agaaacuguaacauaucucuuauauauuaaaaacguuuaaaaguuuuaaagagaaauugcauua

SEQ ID NO: 584566 - RNA, 64 nt, hsa
cuugauguugccuaccuuauugugguaucguggaguuuaaaagaucaaguuaggaugcugacuu

SEQ ID NO: 584567 - RNA, 64 nt, hsa
aaagagcaugguucucaggaaaaccaguuccccaguuuaaaaaaaaaaaaaaaaauuccuugua

SEQ ID NO: 584568 - RNA, 64 nt, hsa
cuuucuaauaaaugcagaaucugaagguaaauagguuuaaaacaaaacaaaaacccaccccuuu

SEQ ID NO: 584569 - RNA, 64 nt, hsa
uagaggccccucgugcuaccaacacuuacccuguguuuaaaaagaucuuguaccaagccaacgg

SEQ ID NO: 584570 - RNA, 64 nt, hsa
uuagcagauagcugcuucgauaaaggaauuuggaguuuaaaaaucaacuugugaaaacaagguu

SEQ ID NO: 584571 - RNA, 64 nt, hsa
ucucaugguggauuugugacugugagaguuuccgguuuaaaaucugaaaagccagauaugccug

SEQ ID NO: 584572 - RNA, 64 nt, hsa
augcacaguauuuguaauuaaaagcaaaucauuuguuuaaaaaggcaguuugcaaaaaauguuu

SEQ ID NO: 584573 - RNA, 64 nt, hsa
uguugaaauggcaaucaaacauuuucuggccaguguuuaaaacuucaguuucacagaaaauaag

SEQ ID NO: 584574 - RNA, 64 nt, hsa
auccaguauuaaguucuuagucauugauuuuuguguuuaaaaaaaaauaggaaagagggaaacu

SEQ ID NO: 584575 - RNA, 64 nt, hsa
auuugaaugguacaguagauguaaaaaaaauucaguuuaaaagaacauuuguuuuuacauuaaa

SEQ ID NO: 584576 - RNA, 64 nt, hsa
uaacaagccagcuggcuuaugcugguucucagcuguuuaaaaaaaaaaaaaaaaaggaauagaa

SEQ ID NO: 584577 - RNA, 64 nt, hsa
acugugaucugggaacuuuuugcuguacaaaucuguuuaaaaaaaaaaaaaaguaacucauuga

SEQ ID NO: 584578 - RNA, 64 nt, hsa
cccgucccccagucugacauauuucauacagaauguuuaaaagaaaaacucugcuagucuuggc

SEQ ID NO: 584579 - RNA, 64 nt, hsa
augcuuucuaugugaauauaagcuugugcacaauguuuaaaagaaaaacaaugaauuagaagag

SEQ ID NO: 584580 - RNA, 64 nt, hsa
gaugguaaacauuuaaaggggaaaggggggguuuguuuaaaauaguaaaucaguaagucacuuc

SEQ ID NO: 584581 - RNA, 64 nt, hsa
ccccuuuaaacuaauauucauaauugguucauauguuuaaaagacuuuaauuuacaaauuaaau

SEQ ID NO: 584582 - RNA, 64 nt, hsa
acacagaguuaucagacauuauuuauaaaacuuaguuuaaaaaaaagacaaaaaaaaaaaagcc

SEQ ID NO: 584583 - RNA, 64 nt, hsa
aguuccuuuuacaaaguuauuaaauuaauuauauguuuaaaaguuaaagaaaaaagagcugcag

SEQ ID NO: 584584 - RNA, 64 nt, hsa
auucaaauacauaccuuauuuuaugcaauaaauuguuuaaaaugcaaggugguuauucugcaua

SEQ ID NO: 584585 - RNA, 64 nt, hsa
aaggucuucgaggcuggggcucuguaaugaauuaguuuaaaagccaaggucauaacaugaauug

SEQ ID NO: 584586 - RNA, 64 nt, hsa
caagcaauaggggguugaaguguuuaucugauuuguuuaaaauuuuguauaucaccaaauuuuu

SEQ ID NO: 584587 - RNA, 64 nt, hsa
uuuuaucugagaauuucucaguaugaaaaugauuguuuaaaauuuccccucuuuuugucagugc

SEQ ID NO: 584588 - RNA, 64 nt, hsa
ugaguuaauuuuaccaagaguaacuuuacucuguguuuaaaaaguaaguuaauaauguauugua

SEQ ID NO: 584589 - RNA, 64 nt, hsa
gguauaauguuuaaaucauguauguuaugauauuguuuaaaauucaguuuuuguaucuuggggc

SEQ ID NO: 584590 - RNA, 64 nt, hsa
aaauuuaagagcaguuacagugugacucacucauguuuaaaaaaaaucgaagagcuaaaaaaua

SEQ ID NO: 584591 - RNA, 64 nt, hsa
caaaagguaauaucaaccgucagcaaacaugucaguuuaaaaauaaguucgguuaacaaggaag

SEQ ID NO: 584592 - RNA, 64 nt, hsa
ugaggaaauaguuccuguccaauuuguguaauuuguuuaaaauuguaaauaaauuaaacuuuuc

SEQ ID NO: 584593 - RNA, 64 nt, hsa
auaucacauuauuauguauucacuuuaagugauaguuuaaaaaauaaacaagaaauauugagua

SEQ ID NO: 584594 - RNA, 64 nt, hsa
uauucuuuuuugaaaauuagcaauuauaaagauuguuuaaaauaucuugauauuuucacaaauu

SEQ ID NO: 584595 - RNA, 64 nt, hsa
guauauaugugauauaaauuaaugugugcaaauuguuuaaaaauuagauguguugcaguuuugc

SEQ ID NO: 584596 - RNA, 64 nt, hsa
cucgagacgucauuucuguuugacuacuccagcaguuuaaaaccccaucucccugcccuuuugu

SEQ ID NO: 584597 - RNA, 64 nt, hsa
cucaagaauuagaaaacuuugcaagauuugacuuguuuaaaaaucacauuuauaagugaaccgu

SEQ ID NO: 584598 - RNA, 64 nt, hsa
cuuuuguauguguuugaaauuucaauaauaaaauguuuaaaaucaaaaccaaaauuauagacua

SEQ ID NO: 584599 - RNA, 64 nt, hsa
gcaaaaggcuuacaaucccuguugucugaccacaguuuaaaauuaauuagaaacuaucaaaaau

SEQ ID NO: 584600 - RNA, 64 nt, hsa
cugaauuucauauguucuaaaaugacuagcaaugguuuaaaaaggaagaagaguggaagugaag

SEQ ID NO: 584601 - RNA, 64 nt, hsa
agaaugucauuaguaaaaauucuaacuucguuuuguuuaaaagacauguggaugcuccaugccc

SEQ ID NO: 584602 - RNA, 64 nt, hsa
ugauuucuacaaaucuuaacauuuaaccauguugguuuaaaaauauuauugcuugcuacuugga

SEQ ID NO: 584603 - RNA, 64 nt, hsa
cauuaccacggaagauauauuagcuucaacuuuaguuuaaaauuaugugaauaaauauuuugau

SEQ ID NO: 584604 - RNA, 64 nt, hsa
uucuucuuaccagaugcuuuccuguucuuuaagaguuuaaaaucaucagaaaggaaaaacaaac

SEQ ID NO: 584605 - RNA, 64 nt, hsa
gcuguuccagugguaagcuaugucccaggaaucaguuuaaaagcacgacaguggaugcuggguc

SEQ ID NO: 584606 - RNA, 64 nt, hsa
ucuaucuuaauacuaaggaaccaacaaucuuccuguuuaaaaaaccacauggcacagagauucu

SEQ ID NO: 584607 - RNA, 64 nt, hsa
uaauaauuuaccaggaagcagaggagagcuacuuguuuaaaaauccacauucuuggacccaauc

SEQ ID NO: 584608 - RNA, 64 nt, hsa
cauuccuaugauuguuacuaaaauguauuuucauguuuaaaauguuuuuggauauuuuuggguu

SEQ ID NO: 584609 - RNA, 64 nt, hsa
aacaucuaguuuuagaagggaaacaguugaaacuguuuaaaaauagaugugccuuauuuauugc

SEQ ID NO: 584610 - RNA, 64 nt, hsa
ugacgcuuuuuagcuaaauauauacucuucucuaguuuaaaacauuugaacuugccuaguuagu

SEQ ID NO: 584611 - RNA, 64 nt, hsa
uucuuagagaauaguuauauuuucuauuacacaaguuuaaaaauauuauuaacuuguauuuucu

SEQ ID NO: 584612 - RNA, 64 nt, hsa
gaggacuguaguuuaauacuuuuuacccaaauauguuuaaaaacuucgugcauuuguuacagcu

SEQ ID NO: 584613 - RNA, 64 nt, hsa
ugagguuucagaaauauauugaaaguuuaacaauguuuaaaaauagaaaagcaugaguguucau

SEQ ID NO: 584614 - RNA, 64 nt, hsa
aaacuucauuuuauguccuuucacaaauaaauuaguuuaaaacagaaaguggcuacuugccauu

SEQ ID NO: 584615 - RNA, 64 nt, hsa
aacucauuuugcgaggcuuaggcagcuagacaucguuuaaaacaaaauauuaacuuauauuaca

SEQ ID NO: 584616 - RNA, 64 nt, hsa
uagccacaaacuggacaagaagcuggguauuuggguuuaaaauagauuuucuugacucugagcu

SEQ ID NO: 584617 - RNA, 64 nt, hsa
aagaacaggacucauaucuugauauuuaagagauguuuaaaauuuuaaacuuuuucuaccuucu

SEQ ID NO: 584618 - RNA, 64 nt, hsa; identical to SEQ ID NO: 312521

SEQ ID NO: 584619 - RNA, 64 nt, hsa; identical to SEQ ID NO: 312522

SEQ ID NO: 584620 - RNA, 64 nt, hsa; identical to SEQ ID NO: 312523

SEQ ID NO: 584621 - RNA, 64 nt, hsa; identical to SEQ ID NO: 312524

SEQ ID NO: 584622 - RNA, 64 nt, hsa; identical to SEQ ID NO: 312525

SEQ ID NO: 584623 - RNA, 64 nt, hsa; identical to SEQ ID NO: 312526

SEQ ID NO: 584624 - RNA, 64 nt, hsa; identical to SEQ ID NO: 312527

SEQ ID NO: 584625 - RNA, 64 nt, hsa; identical to SEQ ID NO: 312528

SEQ ID NO: 584626 - RNA, 64 nt, hsa; identical to SEQ ID NO: 312529

SEQ ID NO: 584627 - RNA, 64 nt, hsa; identical to SEQ ID NO: 312530

SEQ ID NO: 584628 - RNA, 64 nt, hsa; identical to SEQ ID NO: 312531

SEQ ID NO: 584629 - RNA, 64 nt, hsa; identical to SEQ ID NO: 312532

SEQ ID NO: 584630 - RNA, 64 nt, hsa; identical to SEQ ID NO: 312533

SEQ ID NO: 584631 - RNA, 64 nt, hsa; identical to SEQ ID NO: 312534

SEQ ID NO: 584632 - RNA, 64 nt, hsa; identical to SEQ ID NO: 312535

SEQ ID NO: 584633 - RNA, 64 nt, hsa; identical to SEQ ID NO: 312536

SEQ ID NO: 584634 - RNA, 64 nt, hsa; identical to SEQ ID NO: 312537

SEQ ID NO: 584635 - RNA, 64 nt, hsa; identical to SEQ ID NO: 312538

SEQ ID NO: 584636 - RNA, 64 nt, hsa; identical to SEQ ID NO: 312539

SEQ ID NO: 584637 - RNA, 64 nt, hsa; identical to SEQ ID NO: 312540

SEQ ID NO: 584638 - RNA, 64 nt, hsa; identical to SEQ ID NO: 312541

SEQ ID NO: 584639 - RNA, 64 nt, hsa; identical to SEQ ID NO: 312542

SEQ ID NO: 584640 - RNA, 64 nt, hsa; identical to SEQ ID NO: 312543

SEQ ID NO: 584641 - RNA, 64 nt, hsa; identical to SEQ ID NO: 312544

SEQ ID NO: 584642 - RNA, 64 nt, hsa; identical to SEQ ID NO: 312545

SEQ ID NO: 584643 - RNA, 64 nt, hsa; identical to SEQ ID NO: 312546

SEQ ID NO: 584644 - RNA, 64 nt, hsa; identical to SEQ ID NO: 312547

SEQ ID NO: 584645 - RNA, 64 nt, hsa; identical to SEQ ID NO: 312548

SEQ ID NO: 584646 - RNA, 64 nt, hsa; identical to SEQ ID NO: 312549

SEQ ID NO: 584647 - RNA, 64 nt, hsa; identical to SEQ ID NO: 312550

SEQ ID NO: 584648 - RNA, 64 nt, hsa; identical to SEQ ID NO: 312551

SEQ ID NO: 584649 - RNA, 64 nt, hsa; identical to SEQ ID NO: 312552

SEQ ID NO: 584650 - RNA, 64 nt, hsa; identical to SEQ ID NO: 312553

SEQ ID NO: 584651 - RNA, 64 nt, hsa; identical to SEQ ID NO: 312554

SEQ ID NO: 584652 - RNA, 64 nt, hsa; identical to SEQ ID NO: 312555

SEQ ID NO: 584653 - RNA, 64 nt, hsa; identical to SEQ ID NO: 312556

SEQ ID NO: 584654 - RNA, 64 nt, hsa; identical to SEQ ID NO: 312557

SEQ ID NO: 584655 - RNA, 64 nt, hsa; identical to SEQ ID NO: 312558

SEQ ID NO: 584656 - RNA, 64 nt, hsa; identical to SEQ ID NO: 312559

SEQ ID NO: 584657 - RNA, 64 nt, hsa; identical to SEQ ID NO: 312560

SEQ ID NO: 584658 - RNA, 64 nt, hsa; identical to SEQ ID NO: 312561

SEQ ID NO: 584659 - RNA, 64 nt, hsa; identical to SEQ ID NO: 312562

SEQ ID NO: 584660 - RNA, 64 nt, hsa; identical to SEQ ID NO: 312563

SEQ ID NO: 584661 - RNA, 64 nt, hsa; identical to SEQ ID NO: 312564

SEQ ID NO: 584662 - RNA, 64 nt, hsa; identical to SEQ ID NO: 312565

SEQ ID NO: 584663 - RNA, 64 nt, hsa; identical to SEQ ID NO: 312566

SEQ ID NO: 584664 - RNA, 64 nt, hsa; identical to SEQ ID NO: 312567

SEQ ID NO: 584665 - RNA, 64 nt, hsa; identical to SEQ ID NO: 312568

SEQ ID NO: 584666 - RNA, 64 nt, hsa
auagugucagacggaaguuauaaucaucuuggaggaaccauaagaaaagguguccaggguaucu

SEQ ID NO: 584667 - RNA, 64 nt, hsa
ucuaucccauagaacacucuuuuuuaucuucccugaaccauauugaugagauaaauagggcugg

SEQ ID NO: 584668 - RNA, 64 nt, hsa; identical to SEQ ID NO: 584667

SEQ ID NO: 584669 - RNA, 64 nt, hsa
auagugucagacggaaguuauaaucaucuuggaggaaccauaagaaaaaguguccaggguaucu

SEQ ID NO: 584670 - RNA, 64 nt, hsa; identical to SEQ ID NO: 199847

SEQ ID NO: 584671 - RNA, 64 nt, hsa; identical to SEQ ID NO: 199848

SEQ ID NO: 584672 - RNA, 64 nt, hsa; identical to SEQ ID NO: 199849

SEQ ID NO: 584673 - RNA, 64 nt, hsa; identical to SEQ ID NO: 199850

SEQ ID NO: 584674 - RNA, 64 nt, hsa; identical to SEQ ID NO: 199851

SEQ ID NO: 584675 - RNA, 64 nt, hsa; identical to SEQ ID NO: 199852

SEQ ID NO: 584676 - RNA, 64 nt, hsa; identical to SEQ ID NO: 199853

SEQ ID NO: 584677 - RNA, 64 nt, hsa; identical to SEQ ID NO: 199854

SEQ ID NO: 584678 - RNA, 55 nt, hsa; identical to SEQ ID NO: 199855

SEQ ID NO: 584679 - RNA, 64 nt, hsa; identical to SEQ ID NO: 199856

SEQ ID NO: 584680 - RNA, 64 nt, hsa; identical to SEQ ID NO: 199857

SEQ ID NO: 584681 - RNA, 64 nt, hsa; identical to SEQ ID NO: 199858

SEQ ID NO: 584682 - RNA, 64 nt, hsa; identical to SEQ ID NO: 199859

SEQ ID NO: 584683 - RNA, 64 nt, hsa; identical to SEQ ID NO: 199860

SEQ ID NO: 584684 - RNA, 64 nt, hsa; identical to SEQ ID NO: 199861

SEQ ID NO: 584685 - RNA, 64 nt, hsa; identical to SEQ ID NO: 199862

SEQ ID NO: 584686 - RNA, 64 nt, hsa; identical to SEQ ID NO: 199863

SEQ ID NO: 584687 - RNA, 64 nt, hsa; identical to SEQ ID NO: 199864

SEQ ID NO: 584688 - RNA, 64 nt, hsa; identical to SEQ ID NO: 199865

SEQ ID NO: 584689 - RNA, 64 nt, hsa; identical to SEQ ID NO: 199866

SEQ ID NO: 584690 - RNA, 64 nt, hsa
gccagggcuuacuccaggaaucuaaauagaugcccuaguccacuuuaucuuuguucccaaggca

SEQ ID NO: 584691 - RNA, 64 nt, hsa
gugauaaagaagggcccauccuauuuccccucaucuaguccauuuacgauucucacugacuccc

SEQ ID NO: 584692 - RNA, 64 nt, hsa; identical to SEQ ID NO: 266386

SEQ ID NO: 584693 - RNA, 64 nt, hsa; identical to SEQ ID NO: 266387

SEQ ID NO: 584694 - RNA, 64 nt, hsa; identical to SEQ ID NO: 266388

SEQ ID NO: 584695 - RNA, 64 nt, hsa; identical to SEQ ID NO: 266389

SEQ ID NO: 584696 - RNA, 64 nt, hsa; identical to SEQ ID NO: 266390

SEQ ID NO: 584697 - RNA, 64 nt, hsa; identical to SEQ ID NO: 266391

SEQ ID NO: 584698 - RNA, 64 nt, hsa; identical to SEQ ID NO: 266392

SEQ ID NO: 584699 - RNA, 64 nt, hsa; identical to SEQ ID NO: 266393

SEQ ID NO: 584700 - RNA, 64 nt, hsa; identical to SEQ ID NO: 266394

SEQ ID NO: 584701 - RNA, 64 nt, hsa; identical to SEQ ID NO: 266395

SEQ ID NO: 584702 - RNA, 64 nt, hsa; identical to SEQ ID NO: 266396

SEQ ID NO: 584703 - RNA, 64 nt, hsa; identical to SEQ ID NO: 266397

SEQ ID NO: 584704 - RNA, 64 nt, hsa; identical to SEQ ID NO: 266398

SEQ ID NO: 584705 - RNA, 64 nt, hsa; identical to SEQ ID NO: 266399

SEQ ID NO: 584706 - RNA, 64 nt, hsa; identical to SEQ ID NO: 266400

SEQ ID NO: 584707 - RNA, 64 nt, hsa; identical to SEQ ID NO: 266401

SEQ ID NO: 584708 - RNA, 64 nt, hsa; identical to SEQ ID NO: 266402

SEQ ID NO: 584709 - RNA, 64 nt, hsa; identical to SEQ ID NO: 266403

SEQ ID NO: 584710 - RNA, 64 nt, hsa; identical to SEQ ID NO: 266404

SEQ ID NO: 584711 - RNA, 64 nt, hsa; identical to SEQ ID NO: 266405

SEQ ID NO: 584712 - RNA, 64 nt, hsa; identical to SEQ ID NO: 266406

SEQ ID NO: 584713 - RNA, 64 nt, hsa; identical to SEQ ID NO: 266407

SEQ ID NO: 584714 - RNA, 64 nt, hsa; identical to SEQ ID NO: 266408

SEQ ID NO: 584715 - RNA, 64 nt, hsa; identical to SEQ ID NO: 266409

SEQ ID NO: 584716 - RNA, 64 nt, hsa; identical to SEQ ID NO: 266410

SEQ ID NO: 584717 - RNA, 64 nt, hsa; identical to SEQ ID NO: 266411

SEQ ID NO: 584718 - RNA, 64 nt, hsa; identical to SEQ ID NO: 266412

SEQ ID NO: 584719 - RNA, 64 nt, hsa; identical to SEQ ID NO: 266413

SEQ ID NO: 584720 - RNA, 64 nt, hsa; identical to SEQ ID NO: 266414

SEQ ID NO: 584721 - RNA, 64 nt, hsa; identical to SEQ ID NO: 266415

SEQ ID NO: 584722 - RNA, 64 nt, hsa; identical to SEQ ID NO: 266416

SEQ ID NO: 584723 - RNA, 64 nt, hsa; identical to SEQ ID NO: 266417

SEQ ID NO: 584724 - RNA, 64 nt, hsa; identical to SEQ ID NO: 266418

SEQ ID NO: 584725 - RNA, 64 nt, hsa; identical to SEQ ID NO: 266419

SEQ ID NO: 584726 - RNA, 64 nt, hsa; identical to SEQ ID NO: 266420

SEQ ID NO: 584727 - RNA, 64 nt, hsa; identical to SEQ ID NO: 266421

SEQ ID NO: 584728 - RNA, 64 nt, hsa; identical to SEQ ID NO: 266422

SEQ ID NO: 584729 - RNA, 64 nt, hsa; identical to SEQ ID NO: 266423

SEQ ID NO: 584730 - RNA, 64 nt, hsa; identical to SEQ ID NO: 266424

SEQ ID NO: 584731 - RNA, 64 nt, hsa; identical to SEQ ID NO: 144070

SEQ ID NO: 584732 - RNA, 64 nt, hsa; identical to SEQ ID NO: 144071

SEQ ID NO: 584733 - RNA, 64 nt, hsa; identical to SEQ ID NO: 144072

SEQ ID NO: 584734 - RNA, 64 nt, hsa; identical to SEQ ID NO: 144073

SEQ ID NO: 584735 - RNA, 64 nt, hsa; identical to SEQ ID NO: 144074

SEQ ID NO: 584736 - RNA, 64 nt, hsa; identical to SEQ ID NO: 144075

SEQ ID NO: 584737 - RNA, 64 nt, hsa; identical to SEQ ID NO: 144076

SEQ ID NO: 584738 - RNA, 64 nt, hsa; identical to SEQ ID NO: 144077

SEQ ID NO: 584739 - RNA, 64 nt, hsa; identical to SEQ ID NO: 144078

SEQ ID NO: 584740 - RNA, 64 nt, hsa; identical to SEQ ID NO: 144079

SEQ ID NO: 584741 - RNA, 64 nt, hsa; identical to SEQ ID NO: 144080

SEQ ID NO: 584742 - RNA, 64 nt, hsa; identical to SEQ ID NO: 144081

SEQ ID NO: 584743 - RNA, 64 nt, hsa; identical to SEQ ID NO: 144082

SEQ ID NO: 584744 - RNA, 64 nt, hsa; identical to SEQ ID NO: 144083

SEQ ID NO: 584745 - RNA, 64 nt, hsa; identical to SEQ ID NO: 144084

SEQ ID NO: 584746 - RNA, 64 nt, hsa; identical to SEQ ID NO: 144085

SEQ ID NO: 584747 - RNA, 64 nt, hsa; identical to SEQ ID NO: 144086

SEQ ID NO: 584748 - RNA, 64 nt, hsa; identical to SEQ ID NO: 144087

SEQ ID NO: 584749 - RNA, 64 nt, hsa; identical to SEQ ID NO: 144088

SEQ ID NO: 584750 - RNA, 64 nt, hsa; identical to SEQ ID NO: 144089

SEQ ID NO: 584751 - RNA, 64 nt, hsa; identical to SEQ ID NO: 144090

SEQ ID NO: 584752 - RNA, 64 nt, hsa; identical to SEQ ID NO: 144091

SEQ ID NO: 584753 - RNA, 64 nt, hsa; identical to SEQ ID NO: 144092

SEQ ID NO: 584754 - RNA, 64 nt, hsa; identical to SEQ ID NO: 144093

SEQ ID NO: 584755 - RNA, 64 nt, hsa; identical to SEQ ID NO: 144094

SEQ ID NO: 584756 - RNA, 64 nt, hsa; identical to SEQ ID NO: 144095

SEQ ID NO: 584757 - RNA, 64 nt, hsa; identical to SEQ ID NO: 144096

SEQ ID NO: 584758 - RNA, 64 nt, hsa; identical to SEQ ID NO: 144097

SEQ ID NO: 584759 - RNA, 64 nt, hsa; identical to SEQ ID NO: 144098

SEQ ID NO: 584760 - RNA, 64 nt, hsa; identical to SEQ ID NO: 144099

SEQ ID NO: 584761 - RNA, 64 nt, hsa; identical to SEQ ID NO: 144100

SEQ ID NO: 584762 - RNA, 64 nt, hsa; identical to SEQ ID NO: 144101

SEQ ID NO: 584763 - RNA, 64 nt, hsa; identical to SEQ ID NO: 144102

SEQ ID NO: 584764 - RNA, 64 nt, hsa; identical to SEQ ID NO: 144103

SEQ ID NO: 584765 - RNA, 64 nt, hsa; identical to SEQ ID NO: 144104

SEQ ID NO: 584766 - RNA, 64 nt, hsa; identical to SEQ ID NO: 144105

SEQ ID NO: 584767 - RNA, 64 nt, hsa; identical to SEQ ID NO: 144106

SEQ ID NO: 584768 - RNA, 64 nt, hsa; identical to SEQ ID NO: 144107

SEQ ID NO: 584769 - RNA, 64 nt, hsa; identical to SEQ ID NO: 144108

SEQ ID NO: 584770 - RNA, 64 nt, hsa; identical to SEQ ID NO: 144109

SEQ ID NO: 584771 - RNA, 64 nt, hsa; identical to SEQ ID NO: 144110

SEQ ID NO: 584772 - RNA, 64 nt, hsa; identical to SEQ ID NO: 144111

SEQ ID NO: 584773 - RNA, 64 nt, hsa; identical to SEQ ID NO: 144112

SEQ ID NO: 584774 - RNA, 64 nt, hsa; identical to SEQ ID NO: 144113

SEQ ID NO: 584775 - RNA, 64 nt, hsa; identical to SEQ ID NO: 144114

SEQ ID NO: 584776 - RNA, 64 nt, hsa; identical to SEQ ID NO: 144115

SEQ ID NO: 584777 - RNA, 64 nt, hsa; identical to SEQ ID NO: 144116

SEQ ID NO: 584778 - RNA, 64 nt, hsa; identical to SEQ ID NO: 144117

SEQ ID NO: 584779 - RNA, 64 nt, hsa; identical to SEQ ID NO: 144118

SEQ ID NO: 584780 - RNA, 64 nt, hsa; identical to SEQ ID NO: 144119

SEQ ID NO: 584781 - RNA, 64 nt, hsa; identical to SEQ ID NO: 144120

SEQ ID NO: 584782 - RNA, 64 nt, hsa; identical to SEQ ID NO: 144121

SEQ ID NO: 584783 - RNA, 64 nt, hsa; identical to SEQ ID NO: 144122

SEQ ID NO: 584784 - RNA, 64 nt, hsa; identical to SEQ ID NO: 144123

SEQ ID NO: 584785 - RNA, 64 nt, hsa; identical to SEQ ID NO: 144124

SEQ ID NO: 584786 - RNA, 64 nt, hsa; identical to SEQ ID NO: 144125

SEQ ID NO: 584787 - RNA, 64 nt, hsa; identical to SEQ ID NO: 144126

SEQ ID NO: 584788 - RNA, 64 nt, hsa; identical to SEQ ID NO: 144127

SEQ ID NO: 584789 - RNA, 64 nt, hsa; identical to SEQ ID NO: 144128

SEQ ID NO: 584790 - RNA, 64 nt, hsa; identical to SEQ ID NO: 144129

SEQ ID NO: 584791 - RNA, 64 nt, hsa; identical to SEQ ID NO: 144130

SEQ ID NO: 584792 - RNA, 64 nt, hsa; identical to SEQ ID NO: 144131

SEQ ID NO: 584793 - RNA, 64 nt, hsa; identical to SEQ ID NO: 144132

SEQ ID NO: 584794 - RNA, 64 nt, hsa; identical to SEQ ID NO: 144133

SEQ ID NO: 584795 - RNA, 64 nt, hsa; identical to SEQ ID NO: 144134

SEQ ID NO: 584796 - RNA, 64 nt, hsa; identical to SEQ ID NO: 144135

SEQ ID NO: 584797 - RNA, 64 nt, hsa; identical to SEQ ID NO: 144136

SEQ ID NO: 584798 - RNA, 64 nt, hsa; identical to SEQ ID NO: 144137

SEQ ID NO: 584799 - RNA, 64 nt, hsa; identical to SEQ ID NO: 144138

SEQ ID NO: 584800 - RNA, 64 nt, hsa; identical to SEQ ID NO: 144139

SEQ ID NO: 584801 - RNA, 64 nt, hsa; identical to SEQ ID NO: 144140

SEQ ID NO: 584802 - RNA, 64 nt, hsa; identical to SEQ ID NO: 144141

SEQ ID NO: 584803 - RNA, 64 nt, hsa; identical to SEQ ID NO: 144142

SEQ ID NO: 584804 - RNA, 64 nt, hsa; identical to SEQ ID NO: 144143

SEQ ID NO: 584805 - RNA, 64 nt, hsa; identical to SEQ ID NO: 144144

SEQ ID NO: 584806 - RNA, 64 nt, hsa; identical to SEQ ID NO: 144145

SEQ ID NO: 584807 - RNA, 64 nt, hsa; identical to SEQ ID NO: 144146

SEQ ID NO: 584808 - RNA, 64 nt, hsa; identical to SEQ ID NO: 144147

SEQ ID NO: 584809 - RNA, 64 nt, hsa; identical to SEQ ID NO: 144148

SEQ ID NO: 584810 - RNA, 64 nt, hsa; identical to SEQ ID NO: 144149

SEQ ID NO: 584811 - RNA, 64 nt, hsa; identical to SEQ ID NO: 144150

SEQ ID NO: 584812 - RNA, 64 nt, hsa; identical to SEQ ID NO: 144151

SEQ ID NO: 584813 - RNA, 64 nt, hsa; identical to SEQ ID NO: 144152

SEQ ID NO: 584814 - RNA, 64 nt, hsa; identical to SEQ ID NO: 144153

SEQ ID NO: 584815 - RNA, 64 nt, hsa; identical to SEQ ID NO: 144154

SEQ ID NO: 584816 - RNA, 64 nt, hsa; identical to SEQ ID NO: 144155

SEQ ID NO: 584817 - RNA, 64 nt, hsa
agcauguguagcaccaguugauaauuggucucuaguagcuuacugucaaaauguucaaugaagu

SEQ ID NO: 584818 - RNA, 64 nt, hsa
cacugaugcguguauggaugugugugagucagugguagcuuauuuaaaaagcaccuuauccuuu

SEQ ID NO: 584819 - RNA, 64 nt, hsa
uuuguucuagucauuuuuauucaggcuauauauuguagcuuaauuuuuauuugcaauuaauuua

SEQ ID NO: 584820 - RNA, 64 nt, hsa
ugguaacgauggugucacacccuuggugugaaugguagcuuagugagcaaccuagcucaaggau

SEQ ID NO: 584821 - RNA, 64 nt, hsa; identical to SEQ ID NO: 309737

SEQ ID NO: 584822 - RNA, 64 nt, hsa; identical to SEQ ID NO: 309738

SEQ ID NO: 584823 - RNA, 64 nt, hsa; identical to SEQ ID NO: 309739

SEQ ID NO: 584824 - RNA, 64 nt, hsa; identical to SEQ ID NO: 309740

SEQ ID NO: 584825 - RNA, 64 nt, hsa; identical to SEQ ID NO: 309741

SEQ ID NO: 584826 - RNA, 64 nt, hsa; identical to SEQ ID NO: 309742

SEQ ID NO: 584827 - RNA, 64 nt, hsa
guaacaaaucguggaauauuuuuaaggaaaacuguuguauaaaacuuuaccauaguaaccuuag

SEQ ID NO: 584828 - RNA, 64 nt, hsa
aguguaauaguccccacuauacgaauuuuaugguuuguauaaacacuaacauuuuccccuucug

SEQ ID NO: 584829 - RNA, 64 nt, hsa
acucuuuuuggcaagcacuuaaauguucugaaauuuguauaagacauuuauuauauuuuuuucu

SEQ ID NO: 584830 - RNA, 64 nt, hsa
gguuuggaaugauugugugcaugaauuugggagauuguauaaaacaaaacuagcagaauguuuu

SEQ ID NO: 584831 - RNA, 64 nt, hsa
uaugguuuuguagauauggugacuccagucuuuguuguauaaagguugggggagcugauaaggu

SEQ ID NO: 584832 - RNA, 64 nt, hsa
uuguacaguauuuucuccuucguuguauugauuuuuguauaaaaauguaacuucuacgugucua

SEQ ID NO: 584833 - RNA, 64 nt, hsa
uaaugggggugguaggccuauaaaauuaaaugccuuguauaaaauccaaaaugaaugcaaaauu

SEQ ID NO: 584834 - RNA, 64 nt, hsa
uuuuuuaaagcaagucaccuuaggguggcuuuaauuguauaagucaagcacauguaauaaauuc

SEQ ID NO: 584835 - RNA, 64 nt, hsa
accuauagcaaucauuucaaaucuauucugcaaauuguauaagaauaaaguuagaauuaacaau

SEQ ID NO: 584836 - RNA, 64 nt, hsa
uaucaaaaaagggaaaugaaguauaaaucaauuuuuguauaaucuguuugaaacaugaguuuua

SEQ ID NO: 584837 - RNA, 64 nt, hsa
uauuaaauccacaauauuuuauuacauuuuuaacuuguauaaauuuuaggucaaauccuucaag

SEQ ID NO: 584838 - RNA, 64 nt, hsa
augauaucuuaaauuaccuuuaugaaauauaguuuuguauaauagcauagauuuuccuucaaaa

SEQ ID NO: 584839 - RNA, 64 nt, hsa
agaaagugcuuuguauuuuguugaagucaguauuuuguauaaacauuuauguugacccacuuau

SEQ ID NO: 584840 - RNA, 64 nt, hsa
acgucccugcccucuuugaccuggcaauauaguguuguauaauguaaauuuauuucuccaaauc

SEQ ID NO: 584841 - RNA, 64 nt, hsa
aauauuuugauuuguuuuccuuuaguuugaaaaguuguauaauacuuaacugacuguagcaaag

SEQ ID NO: 584842 - RNA, 64 nt, hsa
uuuugaaucaccuauccucagugcugaaauuguuuuguauaacugaggguacuguugguucaaa

SEQ ID NO: 584843 - RNA, 64 nt, hsa
ccugaugagagagaagauggugccaaggcugucuuuguauaaugggcucaaauucucuaccucu

SEQ ID NO: 584844 - RNA, 64 nt, hsa
uuugucuucccauuaaccuuugccaguguuaugauuguauaaauuuuuuuaaaugcugguuaaa

SEQ ID NO: 584845 - RNA, 64 nt, hsa
uuuaauagcuauuauaguuuaugaauaucaaaauuuguauaauuugcaucuuuacuaauguaug

SEQ ID NO: 584846 - RNA, 64 nt, hsa
uugugaugagugauguaucuguguuaacaaaaaauuguauaaucauuaccaauacuauuuauua

SEQ ID NO: 584847 - RNA, 64 nt, hsa
aaacuauuugucuuucaggaccuuuugaaguaguuuguauaacuucuuaaaaguugugauucca

SEQ ID NO: 584848 - RNA, 64 nt, hsa
guugccuuaaagaaagucgaauuaauagcuuuuauuguauaaacuaucaguuuguccuguagag

SEQ ID NO: 584849 - RNA, 64 nt, hsa
ucauuuaagauaaucauaaguuguaugaugauaauuguauaaaaauuuguaugaugauaauugu

SEQ ID NO: 584850 - RNA, 64 nt, hsa
gaugauaauuguauaaaaauuuguaugaugauaauuguauaauaauuauacaugaaagugccaa

SEQ ID NO: 584851 - RNA, 64 nt, hsa
uuaacuauaucuauaguauuuaacagugaauccuuuguauaaugaaagcaucaacagauaauuu

SEQ ID NO: 584852 - RNA, 64 nt, hsa
auuuauucauuuuccacacacuugaccaucuacuuuguauaacacauucugcuaaggcccaggg

SEQ ID NO: 584853 - RNA, 64 nt, hsa
agcacuuaaauuucgaaccuaaaguuuagaugcauuguauaaaaaaaccuaaaagcaguaucug

SEQ ID NO: 584854 - RNA, 64 nt, hsa
cuggauuuguguuagcuaugggaauaacuugauuuuguauaagcuauuuagagugaggcuggag

SEQ ID NO: 584855 - RNA, 64 nt, hsa
uggcucauuaaaaaauuuagcaauagaauguaaauuguauaaaaaguuugugaauaacucaagg

SEQ ID NO: 584856 - RNA, 64 nt, hsa
ugccuacuuuaaaacaguauaaaaauuucugcuuuuguauaauacaaauuuucauuaagccagu

SEQ ID NO: 584857 - RNA, 64 nt, hsa
cugccuacauuugcguugcuuucuacauagagacuuguauaauaguauuaauaguagcucauuc

SEQ ID NO: 584858 - RNA, 64 nt, hsa
uuaacaaauaugacacagaaaaggucagaugcuguuguauaaaauuuuuuacuagugugucuua

SEQ ID NO: 584859 - RNA, 64 nt, hsa
uauguugcugcugcuuaaauauuguauaauuuacuuguauaauucuaugcaaauauugcuuaug

SEQ ID NO: 584860 - RNA, 64 nt, hsa
uuaaauuucagcauauguugcugcugcuuaaauauuguauaauuuacuuguauaauucuaugca

SEQ ID NO: 584861 - RNA, 64 nt, hsa
guaauuugauaacauggguauuuuauuauguguuuuguauaaaucccuaauauuuaaaaaaaaa

SEQ ID NO: 584862 - RNA, 64 nt, hsa
uuuguuauuucucucugauguuuuuuguaagacauuguauaagugcccaugucccacuuuuuua

SEQ ID NO: 584863 - RNA, 64 nt, hsa
uauuuuugccauacauuuugcuguuuugcaaaguuuguauaagaacacauaacacuacugaauu

SEQ ID NO: 584864 - RNA, 64 nt, hsa
ugugugaguauaugugugcauguuuagcagauauuuguauaaaauauaaacacucuguugucau

SEQ ID NO: 584865 - RNA, 64 nt, hsa
uaaaacauguaugauuccagaauuuuaguauguuuuguauaaaacuauuuuucauuacggagac

SEQ ID NO: 584866 - RNA, 64 nt, hsa
ugcacagcuagaguguuuuuguaaauaaauguauuuguauaacacagucauguaauauacagaa

SEQ ID NO: 584867 - RNA, 64 nt, hsa
agaugagauccucaaaaaucaucaaaguguuuaauuguauaaaacaguguuuccagugacacaa

SEQ ID NO: 584868 - RNA, 64 nt, hsa
agccuuauaaagaaaaagaagcuuuucuagggguuuguauaaauaguguugaaacuuuauuuua

SEQ ID NO: 584869 - RNA, 63 nt, hsa
uucaaaaguauguaagcauuguauaaugugacaauuguauaauuuauguaaucugaugcauga

SEQ ID NO: 584870 - RNA, 64 nt, hsa
uuuuugcagguacaaauucaaaaguauguaagcauuguauaaugugacaauuguauaauuuaug

SEQ ID NO: 584871 - RNA, 64 nt, hsa
aggaaguucugaucuguuaauuuacuacaaguuuuuguauaaaaugaaaacucguauucuaccu

SEQ ID NO: 584872 - RNA, 64 nt, hsa
aaaugcaauaauaagcaaauaaauuacuuuguuuuuguauaaguauguauaggauugagcucua

SEQ ID NO: 584873 - RNA, 64 nt, hsa
auuagacugaugcuuuaucuaaaaugcuuugaguuuguauaauauaucuugacaaauuuuacua

SEQ ID NO: 584874 - RNA, 64 nt, hsa
uuaauaauaauagacaauaauuauuaugaccccuuuguauaagauaccugggagagguagcaua

SEQ ID NO: 584875 - RNA, 64 nt, hsa
guguguuuuugguuuuucuaaguauauagaaagcuuguauaauucagauuuaucaauuuccuga

SEQ ID NO: 584876 - RNA, 64 nt, hsa
aaauauuuuaaguacauuuauuuuugguguuuuauuguauaaaaccuuagacaaucaaucaguc

SEQ ID NO: 584877 - RNA, 64 nt, hsa
caaccaucucuuuaaaguuagccuauaaauauuguuguauaauuuucuuuggucagaaacacuu

SEQ ID NO: 584878 - RNA, 64 nt, hsa
gcacaugccauccaauuuucugucaaucacacuguuguauaaagcagcagaacugaaggggaaa

SEQ ID NO: 584879 - RNA, 64 nt, hsa
uugcugauggacagugaucauuagaaacugaauuuuguauaauacuaguuuuauaugaaacuag

SEQ ID NO: 584880 - RNA, 64 nt, hsa
ccaaaugaggccuacugauuacuugaggugugccuuguauaacugaauuuauggugcuauuuaa

SEQ ID NO: 584881 - RNA, 64 nt, hsa
uauuuaaaagggauacuuuuguaaaaguaaaaccuuguauaaagaacaaaauguuucuuaauuu

SEQ ID NO: 584882 - RNA, 64 nt, hsa
gaaagggggcuuagggaugagguccugguuuuucuuguauaaauaggagucaugggcguuaguu

SEQ ID NO: 584883 - RNA, 64 nt, hsa
aaaagcaaguuucuuuguauuccucacccuagauuuguauaaaugccuuuuuguccaucccuuu

SEQ ID NO: 584884 - RNA, 64 nt, hsa
uuguugaaaacaaacuggaaacuuguuucuuuuuuuguauaaaugagagauugcaaauguagug

SEQ ID NO: 584885 - RNA, 64 nt, hsa
gaaguaacugacagcugacaccauaugagaaccuuuguauaaaauauuggcauguaaacagcac

SEQ ID NO: 584886 - RNA, 64 nt, hsa
uuaacugcagagaaucacucugggcuggacuguuuuguauaacuguacaguguuuaauagaggu

SEQ ID NO: 584887 - RNA, 64 nt, hsa
cccuauuguauuuguauuuaaaauuuguacacauuuguauaauaaucuguaccuugugguauuu

SEQ ID NO: 584888 - RNA, 64 nt, hsa
aaauucuagugguuugauccaaaucccauuacaguuguauaaagaaauaaaauuuuguacuuau

SEQ ID NO: 584889 - RNA, 64 nt, hsa
guaccaacagaaauauuauuguaagaugccuuucuuguauaagauaugccaauauuugcuuuaa

SEQ ID NO: 584890 - RNA, 64 nt, hsa
ugucaguuuaucuccccuccucaguauaucugauuuguauaaguaaguugaugagcuucucucu

SEQ ID NO: 584891 - RNA, 64 nt, hsa; identical to SEQ ID NO: 97841

SEQ ID NO: 584892 - RNA, 64 nt, hsa; identical to SEQ ID NO: 97842

SEQ ID NO: 584893 - RNA, 64 nt, hsa; identical to SEQ ID NO: 97843

SEQ ID NO: 584894 - RNA, 64 nt, hsa; identical to SEQ ID NO: 97844

SEQ ID NO: 584895 - RNA, 64 nt, hsa; identical to SEQ ID NO: 97845

SEQ ID NO: 584896 - RNA, 64 nt, hsa; identical to SEQ ID NO: 97846

SEQ ID NO: 584897 - RNA, 64 nt, hsa; identical to SEQ ID NO: 97847

SEQ ID NO: 584898 - RNA, 64 nt, hsa; identical to SEQ ID NO: 97848

SEQ ID NO: 584899 - RNA, 64 nt, hsa; identical to SEQ ID NO: 50853

SEQ ID NO: 584900 - RNA, 64 nt, hsa; identical to SEQ ID NO: 50854

SEQ ID NO: 584901 - RNA, 64 nt, hsa; identical to SEQ ID NO: 50855

SEQ ID NO: 584902 - RNA, 64 nt, hsa; identical to SEQ ID NO: 50856

SEQ ID NO: 584903 - RNA, 64 nt, hsa; identical to SEQ ID NO: 50857

SEQ ID NO: 584904 - RNA, 64 nt, hsa; identical to SEQ ID NO: 50858

SEQ ID NO: 584905 - RNA, 64 nt, hsa; identical to SEQ ID NO: 50859

SEQ ID NO: 584906 - RNA, 64 nt, hsa; identical to SEQ ID NO: 50860

SEQ ID NO: 584907 - RNA, 64 nt, hsa; identical to SEQ ID NO: 50861

SEQ ID NO: 584908 - RNA, 64 nt, hsa; identical to SEQ ID NO: 50862

SEQ ID NO: 584909 - RNA, 64 nt, hsa; identical to SEQ ID NO: 50863

SEQ ID NO: 584910 - RNA, 64 nt, hsa; identical to SEQ ID NO: 50864

SEQ ID NO: 584911 - RNA, 64 nt, hsa; identical to SEQ ID NO: 50865

SEQ ID NO: 584912 - RNA, 64 nt, hsa; identical to SEQ ID NO: 50866

SEQ ID NO: 584913 - RNA, 64 nt, hsa; identical to SEQ ID NO: 50867

SEQ ID NO: 584914 - RNA, 64 nt, hsa; identical to SEQ ID NO: 50868

SEQ ID NO: 584915 - RNA, 64 nt, hsa; identical to SEQ ID NO: 50869

SEQ ID NO: 584916 - RNA, 64 nt, hsa; identical to SEQ ID NO: 50870

SEQ ID NO: 584917 - RNA, 64 nt, hsa; identical to SEQ ID NO: 50871

SEQ ID NO: 584918 - RNA, 64 nt, hsa; identical to SEQ ID NO: 50872

SEQ ID NO: 584919 - RNA, 64 nt, hsa; identical to SEQ ID NO: 50873

SEQ ID NO: 584920 - RNA, 64 nt, hsa; identical to SEQ ID NO: 50874

SEQ ID NO: 584921 - RNA, 64 nt, hsa; identical to SEQ ID NO: 50875

SEQ ID NO: 584922 - RNA, 64 nt, hsa; identical to SEQ ID NO: 50876

SEQ ID NO: 584923 - RNA, 64 nt, hsa; identical to SEQ ID NO: 50877

SEQ ID NO: 584924 - RNA, 64 nt, hsa; identical to SEQ ID NO: 50878

SEQ ID NO: 584925 - RNA, 64 nt, hsa; identical to SEQ ID NO: 50879

SEQ ID NO: 584926 - RNA, 64 nt, hsa; identical to SEQ ID NO: 50880

SEQ ID NO: 584927 - RNA, 64 nt, hsa; identical to SEQ ID NO: 50881

SEQ ID NO: 584928 - RNA, 64 nt, hsa; identical to SEQ ID NO: 50882

SEQ ID NO: 584929 - RNA, 64 nt, hsa; identical to SEQ ID NO: 50883

SEQ ID NO: 584930 - RNA, 64 nt, hsa; identical to SEQ ID NO: 50884

SEQ ID NO: 584931 - RNA, 64 nt, hsa; identical to SEQ ID NO: 50885

SEQ ID NO: 584932 - RNA, 64 nt, hsa; identical to SEQ ID NO: 50886

SEQ ID NO: 584933 - RNA, 64 nt, hsa; identical to SEQ ID NO: 50887

SEQ ID NO: 584934 - RNA, 64 nt, hsa; identical to SEQ ID NO: 50888

SEQ ID NO: 584935 - RNA, 64 nt, hsa; identical to SEQ ID NO: 50889

SEQ ID NO: 584936 - RNA, 64 nt, hsa; identical to SEQ ID NO: 50890

SEQ ID NO: 584937 - RNA, 64 nt, hsa; identical to SEQ ID NO: 50891

SEQ ID NO: 584938 - RNA, 64 nt, hsa; identical to SEQ ID NO: 50892

SEQ ID NO: 584939 - RNA, 64 nt, hsa; identical to SEQ ID NO: 50893

SEQ ID NO: 584940 - RNA, 64 nt, hsa; identical to SEQ ID NO: 50894

SEQ ID NO: 584941 - RNA, 64 nt, hsa; identical to SEQ ID NO: 50895

SEQ ID NO: 584942 - RNA, 64 nt, hsa; identical to SEQ ID NO: 50896

SEQ ID NO: 584943 - RNA, 64 nt, hsa; identical to SEQ ID NO: 50897

SEQ ID NO: 584944 - RNA, 64 nt, hsa; identical to SEQ ID NO: 50898

SEQ ID NO: 584945 - RNA, 64 nt, hsa; identical to SEQ ID NO: 50899

SEQ ID NO: 584946 - RNA, 64 nt, hsa; identical to SEQ ID NO: 50900

SEQ ID NO: 584947 - RNA, 64 nt, hsa; identical to SEQ ID NO: 50901

SEQ ID NO: 584948 - RNA, 64 nt, hsa; identical to SEQ ID NO: 50902

SEQ ID NO: 584949 - RNA, 64 nt, hsa; identical to SEQ ID NO: 50903

SEQ ID NO: 584950 - RNA, 64 nt, hsa; identical to SEQ ID NO: 50904

SEQ ID NO: 584951 - RNA, 64 nt, hsa; identical to SEQ ID NO: 50905

SEQ ID NO: 584952 - RNA, 64 nt, hsa; identical to SEQ ID NO: 50906

SEQ ID NO: 584953 - RNA, 64 nt, hsa; identical to SEQ ID NO: 50907

SEQ ID NO: 584954 - RNA, 64 nt, hsa; identical to SEQ ID NO: 50908

SEQ ID NO: 584955 - RNA, 64 nt, hsa; identical to SEQ ID NO: 50909

SEQ ID NO: 584956 - RNA, 64 nt, hsa; identical to SEQ ID NO: 50910

SEQ ID NO: 584957 - RNA, 64 nt, hsa; identical to SEQ ID NO: 50911

SEQ ID NO: 584958 - RNA, 64 nt, hsa; identical to SEQ ID NO: 50912

SEQ ID NO: 584959 - RNA, 64 nt, hsa; identical to SEQ ID NO: 50913

SEQ ID NO: 584960 - RNA, 64 nt, hsa; identical to SEQ ID NO: 50914

SEQ ID NO: 584961 - RNA, 64 nt, hsa; identical to SEQ ID NO: 50915

SEQ ID NO: 584962 - RNA, 64 nt, hsa; identical to SEQ ID NO: 50916

SEQ ID NO: 584963 - RNA, 64 nt, hsa; identical to SEQ ID NO: 50917

SEQ ID NO: 584964 - RNA, 64 nt, hsa; identical to SEQ ID NO: 50918

SEQ ID NO: 584965 - RNA, 64 nt, hsa; identical to SEQ ID NO: 50919

SEQ ID NO: 584966 - RNA, 64 nt, hsa; identical to SEQ ID NO: 50920

SEQ ID NO: 584967 - RNA, 64 nt, hsa; identical to SEQ ID NO: 50921

SEQ ID NO: 584968 - RNA, 64 nt, hsa; identical to SEQ ID NO: 50922

SEQ ID NO: 584969 - RNA, 64 nt, hsa; identical to SEQ ID NO: 50923

SEQ ID NO: 584970 - RNA, 64 nt, hsa; identical to SEQ ID NO: 50924

SEQ ID NO: 584971 - RNA, 64 nt, hsa; identical to SEQ ID NO: 50925

SEQ ID NO: 584972 - RNA, 64 nt, hsa; identical to SEQ ID NO: 50926

SEQ ID NO: 584973 - RNA, 64 nt, hsa; identical to SEQ ID NO: 50927

SEQ ID NO: 584974 - RNA, 64 nt, hsa; identical to SEQ ID NO: 50928

SEQ ID NO: 584975 - RNA, 64 nt, hsa
ugaugaagacugcucuucuuuuguucugugucugaccuacuaauuccugcccaugcuucaaacu

SEQ ID NO: 584976 - RNA, 64 nt, hsa
ggugauuuuaaaauauaauuuccuuuggguagauaccuacuagugggauugcuggaucgaaugg

SEQ ID NO: 584977 - RNA, 64 nt, hsa
uuagcacuuuacuuccauuagguuccuuuagcuuaccuacuaauguaacuaucuuaaguaauag

SEQ ID NO: 584978 - RNA, 64 nt, hsa
ucucuguucuguacauuauuguuuaauauaagaaaccuacuagcauucaaauaaucauucccua

SEQ ID NO: 584979 - RNA, 64 nt, hsa
auuuaucugugcaaauccuugauacugcucaucauuccuugagaaaaacaaugagcugagaggc

SEQ ID NO: 584980 - RNA, 64 nt, hsa
aguaacugccaucaagaugagagaacuggaggaguuccuugaucuguauauacaauaacauaau

SEQ ID NO: 584981 - RNA, 64 nt, hsa
ugagcgagucccuuccugcucuaacguccagugcuuccuugagaucauggaauucuggagaguu

SEQ ID NO: 584982 - RNA, 64 nt, hsa
aucuagccuacgugcacaucugggcacaguaccuuuccuugaacuuauucgugauacagauucc

SEQ ID NO: 584983 - RNA, 64 nt, hsa
ugguuugacuuacuaagacacaggaaucacuguuuuccuugaccagggucucacacccuggagg

SEQ ID NO: 584984 - RNA, 64 nt, hsa
ugugcuguaaucacaagaggagaaaauaacuuguuuccuugaucugucagaggucacaguaacc

SEQ ID NO: 584985 - RNA, 64 nt, hsa
uuccuugaaaauucauaucauaaagucaguuguauuccuugaagcuaucaucguguguacuugg

SEQ ID NO: 584986 - RNA, 56 nt, hsa
auucuucaaaauccauauaagauacguuccuugaaaauucauaucauaaagucagu

SEQ ID NO: 584987 - RNA, 64 nt, hsa
cuuuugucaucuucugacauaaguuuaccugaguuuccuugauuuggaagauuuguuucuuuua

SEQ ID NO: 584988 - RNA, 64 nt, hsa
cuuaauagaccaaaaauaucuauacagcacugauuuccuugaauauuguguguuaauugauaua

SEQ ID NO: 584989 - RNA, 64 nt, hsa
uguauaaguacuaggcagaagccaauuuuaaaauuuccuugaauaauccaugaaaggaauaauu

SEQ ID NO: 584990 - RNA, 64 nt, hsa
uuaagcauaaaaaaaaugcucaguuuugcuugcauuccuugagaauguauuuaucugaagauca

SEQ ID NO: 584991 - RNA, 64 nt, hsa
ggcuggcaugaaaaucugacuuugcccagcucuuuuccuugaugcaguuucccgguguggaagg

SEQ ID NO: 584992 - RNA, 64 nt, hsa
acccucaucagauucaucuccacugauaaccgguuuccuugaugcagacauaguuuagcuuucu

SEQ ID NO: 584993 - RNA, 64 nt, hsa
guggcuuagaaguguguguuaugguuuuacggauuuccuugaagccucucuccuucucugccua

SEQ ID NO: 584994 - RNA, 64 nt, hsa
cuuucuccaacucuuggugggaaaaguccuuuucuuccuugacaggccuuggcuccaucuccuu

SEQ ID NO: 584995 - RNA, 64 nt, hsa
acauuaagaaaaaguauugacuggagggguugaauuccuugagaauuuauuuuauagucuaaau

SEQ ID NO: 584996 - RNA, 64 nt, hsa
uucuacuuuuucaaaugauaugcuguagaaaauauuccuugaagaugugagauuuaaaaauuuu

SEQ ID NO: 584997 - RNA, 64 nt, hsa
aaccugauuggaccguguccaaugugcggaagauuuccuugaaaucuucucaagcucuuaugac

SEQ ID NO: 584998 - RNA, 64 nt, hsa
ugauacuggacuucuuaccaauccggagguuuccuuccuugaaugucaguguguaaaccuggcu

SEQ ID NO: 584999 - RNA, 64 nt, hsa
uuccuaauuauaaaagcugcuuuuuugcagaacauuccuugaaaauauaagguuuugaaaagac

SEQ ID NO: 585000 - RNA, 64 nt, hsa
uuaagccacagcgcccggcccaaaguguucuuuuuuccuugaaaagaaguacagauuuuuuaaa

SEQ ID NO: 585001 - RNA, 64 nt, hsa
uacauucaaaguauacuuuuuuuguuuguuuguuuuccuugagacagagucucucucugucguc

SEQ ID NO: 585002 - RNA, 64 nt, hsa
aauagauugcuuuuaaggucuuucugcucugugauuccuugauaauacauuucuuuccuugaaa

SEQ ID NO: 585003 - RNA, 64 nt, hsa
uuucugcucugugauuccuugauaauacauuucuuuccuugaaaaauaugaggacguuuuucag

SEQ ID NO: 585004 - RNA, 64 nt, hsa
aagacccauuuggcaagagguuguccgaaaauaauuccuugaucauaucugaagugguuauuua

SEQ ID NO: 585005 - RNA, 64 nt, hsa
cuuaaccuuuuugcuuugcuuuucucacccaugcuuccuugaagccccaggugccacuuugcug

SEQ ID NO: 585006 - RNA, 64 nt, hsa
gguuuucuuuuucagugucuaccauuguacuuauaacuguuauuaaauaccaaaucaaauaaua

SEQ ID NO: 585007 - RNA, 64 nt, hsa
uuuuucuccuuuaugauauuacauuaaaguugauaacuguuauugguacuuuugaaauauuugu

SEQ ID NO: 585008 - RNA, 64 nt, hsa
uuugcauuuuuguauuuuguacaaaguaaaaauaaacuguuaugaguaguaaaaauaaagcuau

SEQ ID NO: 585009 - RNA, 64 nt, hsa
cuuccagaugucuaaaagauucuuuaaacuacugaacuguuaccuagguuaacaacccuguuga

SEQ ID NO: 585010 - RNA, 64 nt, hsa
gguagaauuggcacagaguuaagguuccauaauaaacuguuaggugcucuugaagaagauguca

SEQ ID NO: 585011 - RNA, 64 nt, hsa
uuguaauauauuguacuuuauuaagauugccaaaaacuguuaaaauuuaaaaaaaauuuaaauc

SEQ ID NO: 585012 - RNA, 64 nt, hsa
ccucaaugcauugucaguaggauacauuauuagaaacuguuagggucuuucccaggacauuuuu

SEQ ID NO: 585013 - RNA, 64 nt, hsa
ccucaaugcauugucaguagaauacauuauuagaaacuguuaaggucuuucccgggacauuuuu

SEQ ID NO: 585014 - RNA, 64 nt, hsa
uaagcccacaguauauuuuauuucaauguaauuaaacuguuaacuuauucaaagagaaaacauc

SEQ ID NO: 585015 - RNA, 64 nt, hsa
aauauaaauguguguauguguguuucuguccuguaacuguuacaguaaugucauaaagugagaa

SEQ ID NO: 585016 - RNA, 64 nt, hsa
uacccuuuucaguucccuucauucuaauguccucaacuguuaccaaauacccuguugacuccca

SEQ ID NO: 585017 - RNA, 59 nt, hsa
ccacugaaagaaauucaugaaagagaaguaacuguuacucaagccaccacauuuuguaa

SEQ ID NO: 585018 - RNA, 64 nt, hsa
auaagagacaaaguuuggaaguacauaaaguaauaacuguuagaauuagguaauggauaugaaa

SEQ ID NO: 585019 - RNA, 64 nt, hsa
uucuuuuuucaauguacuguauugggacgcugguaacuguuaacccaguguucagcauagagcu

SEQ ID NO: 585020 - RNA, 64 nt, hsa
cauguuggcgcgugauugacauuacagcacagaaaacuguuagugacugguuuccuguuagaua

SEQ ID NO: 585021 - RNA, 64 nt, hsa
aucugcaucucaaaagaaaaugcuuacccacaggaacuguuaacucagggguucuuaacuuggg

SEQ ID NO: 585022 - RNA, 64 nt, hsa
gcugcuuuuuggguaggaccccacgauuuaggguaacuguuaucaucagcugccauuucugaua

SEQ ID NO: 585023 - RNA, 64 nt, hsa
ccucuuagaagcaccugugaaugggaauugagccaacuguuauagaaaauugguucagaaagug

SEQ ID NO: 585024 - RNA, 64 nt, hsa
aaauauucuuuguaaagaaaaucgcugcagcaaaaacuguuacuguguuuauuauauuuguaga

SEQ ID NO: 585025 - RNA, 64 nt, hsa
auuuguucuuagaaccugguugaaaauaccaggaaacuguuacagacgccauuuuuuuuuuuuu

SEQ ID NO: 585026 - RNA, 64 nt, hsa
cuaaguuaagcuuuggagauacauguuagugguuaacuguuaagagcuuugaaaacacugcaca

SEQ ID NO: 585027 - RNA, 62 nt, hsa
uuugucgauugcuuagauuuguuccuguugucaaaacuguuacccccaaaauuggugugaca

SEQ ID NO: 585028 - RNA, 64 nt, hsa
aucuugagauguucaaaaaauuugggguuagagcaacuguuagcgucucuaugagcaaucagua

SEQ ID NO: 585029 - RNA, 64 nt, hsa
agccuugacugugaggcaggacuucccucgcuugaacuguuacacauacgaugugugugucaca

SEQ ID NO: 585030 - RNA, 64 nt, hsa
augguuaagaauuuccaguaugaccacacccaauaacuguuauuagaguguuaauggauuauug

SEQ ID NO: 585031 - RNA, 64 nt, hsa
auguagcucuuggaguacagcuaugaaaauuaacaacuguuaaaggaaauaccuuuuuuuuuuu

SEQ ID NO: 585032 - RNA, 64 nt, hsa
ugguaaauuacuucuuuuuuuucuuuuuaauaaaaacuguuacucauuaacuuugcuuauaaug

SEQ ID NO: 585033 - RNA, 64 nt, hsa
uggaaaagagucuccaguucugcucuggccuacuaacuguuaccacugagagaacaacauguuc

SEQ ID NO: 585034 - RNA, 64 nt, hsa
uuugucauuguuuuucgcaauugagcuaucugaaaacuguuauuccuaaguaauguucaaaaau

SEQ ID NO: 585035 - RNA, 64 nt, hsa
uagaugcagaggaauucaucuacugucuguuauuaacuguuaguuuauucucauacuuacgaug

SEQ ID NO: 585036 - RNA, 64 nt, hsa
aacauuagauaguagaugguuuguugcaugcuagaacuguuaguauuguugaaucaauuacuuu

SEQ ID NO: 585037 - RNA, 64 nt, hsa
augcuuguagaguuguggguaucauuccaaauagaacuguuaugauuugggaaauauucuuuac

SEQ ID NO: 585038 - RNA, 64 nt, hsa
agacagauauaaaaguaucuauauaauaucuauaaacuguuaaugcugagguauagucugugaa

SEQ ID NO: 585039 - RNA, 64 nt, hsa
gauuuuccagacaaaugguaugguguugaaaaauaacuguuacuucuuaaagcagcauuuuauc

SEQ ID NO: 585040 - RNA, 64 nt, hsa
aaaucaaaagguggauuaucuucugaagaauggaaacuguuaguccagaaugauguguuuuucu

SEQ ID NO: 585041 - RNA, 64 nt, hsa
cccacuccauccuacccagggaccccaaguaggcaacuguuauggcaguggguccagcccaggc

SEQ ID NO: 585042 - RNA, 64 nt, hsa
gaaugaauauuguucaaagcaaggaguauguuaaaaugaccagacaccuguuugauaaauaguu

SEQ ID NO: 585043 - RNA, 64 nt, hsa
uggcagacuacuacuaaucacagaccacaaggguaaugaccaaauuuaugugguuguuacacuu

SEQ ID NO: 585044 - RNA, 64 nt, hsa
ugagaugcaaaaguucacuguugcaguguuuucaaaugaccaaucaaguacuacuucuugguua

SEQ ID NO: 585045 - RNA, 64 nt, hsa
gagccacgcccaaaagagagcucccuuagggaaaaaugaccaaaacacacacacacauuuacaa

SEQ ID NO: 585046 - RNA, 64 nt, hsa
aauacaacaguuuagguuuaagaugaccaaugacaaugaccaccuuugcagaaaguaaacugau

SEQ ID NO: 585047 - RNA, 64 nt, hsa
aagccaagacacaucgacaaugagcaccaccaucaaugaccaccgccauucacaagaacuuuga

SEQ ID NO: 585048 - RNA, 64 nt, hsa
uucuuguuaaauaaauuaaaucuuacuuucuuuuaaugaccaaccuuagguaaaacaaaaauau

SEQ ID NO: 585049 - RNA, 64 nt, hsa
auaauguaaaggccuuguuuugcuguagcaauaaaaugaccaagugcaaugacuugauuuaaua

SEQ ID NO: 585050 - RNA, 64 nt, hsa
uuuaauuagcuuuggauuuuaacauguuuuucugaaugaccagauguaggcuuagccaguuuau

SEQ ID NO: 585051 - RNA, 64 nt, hsa
gacauucugaaucuuagacuuucugaggggguuuaaugaccacuagagcuuguccucauauuca

SEQ ID NO: 585052 - RNA, 64 nt, hsa
caaaugguuauaaagucauauccacuucuuccacaaugaccacagcaaaugaccaagcaugaac

SEQ ID NO: 585053 - RNA, 64 nt, hsa
agucauauccacuucuuccacaaugaccacagcaaaugaccaagcaugaacuaaagguaaagau

SEQ ID NO: 585054 - RNA, 64 nt, hsa
cccuuuuagcucgguaaucucauguaccacagguaaugaccaagcaucucugcuagaggaugua

SEQ ID NO: 585055 - RNA, 64 nt, hsa
aaaauaaucucuaaaccauguuagguuaaaacaaaaugaccaucucacaaaaacgaguuuaguu

SEQ ID NO: 585056 - RNA, 64 nt, hsa
aauggaugaggagggaaaacucugccaaauggaaaaugaccaaauuuaagagggugggacaguc

SEQ ID NO: 585057 - RNA, 64 nt, hsa
guucuccauuuuuuguaguuuugucuaaauuuuuaaugaccauuuccuggaaucaguuuauuau

SEQ ID NO: 585058 - RNA, 64 nt, hsa
caggcugcacaucucaguauauguagggaccccaaaugaccacaacacaguacaauugcccuuu

SEQ ID NO: 585059 - RNA, 64 nt, hsa
agaaucccggugcccugagaggcuauacgugacaaaugaccaaaagcccaagguaggggaguuu

SEQ ID NO: 585060 - RNA, 64 nt, hsa; identical to SEQ ID NO: 389582

SEQ ID NO: 585061 - RNA, 64 nt, hsa; identical to SEQ ID NO: 389583

SEQ ID NO: 585062 - RNA, 64 nt, hsa; identical to SEQ ID NO: 389584

SEQ ID NO: 585063 - RNA, 64 nt, hsa; identical to SEQ ID NO: 389585

SEQ ID NO: 585064 - RNA, 64 nt, hsa; identical to SEQ ID NO: 389586

SEQ ID NO: 585065 - RNA, 64 nt, hsa; identical to SEQ ID NO: 389587

SEQ ID NO: 585066 - RNA, 64 nt, hsa; identical to SEQ ID NO: 180484

SEQ ID NO: 585067 - RNA, 64 nt, hsa; identical to SEQ ID NO: 180485

SEQ ID NO: 585068 - RNA, 64 nt, hsa; identical to SEQ ID NO: 180486

SEQ ID NO: 585069 - RNA, 64 nt, hsa; identical to SEQ ID NO: 180487

SEQ ID NO: 585070 - RNA, 64 nt, hsa; identical to SEQ ID NO: 180488

SEQ ID NO: 585071 - RNA, 64 nt, hsa; identical to SEQ ID NO: 180489

SEQ ID NO: 585072 - RNA, 64 nt, hsa; identical to SEQ ID NO: 180490

SEQ ID NO: 585073 - RNA, 64 nt, hsa; identical to SEQ ID NO: 180491

SEQ ID NO: 585074 - RNA, 64 nt, hsa; identical to SEQ ID NO: 180492

SEQ ID NO: 585075 - RNA, 64 nt, hsa; identical to SEQ ID NO: 180493

SEQ ID NO: 585076 - RNA, 64 nt, hsa; identical to SEQ ID NO: 180494

SEQ ID NO: 585077 - RNA, 64 nt, hsa; identical to SEQ ID NO: 180495

SEQ ID NO: 585078 - RNA, 64 nt, hsa; identical to SEQ ID NO: 180496

SEQ ID NO: 585079 - RNA, 64 nt, hsa; identical to SEQ ID NO: 180497

SEQ ID NO: 585080 - RNA, 64 nt, hsa; identical to SEQ ID NO: 180498

SEQ ID NO: 585081 - RNA, 64 nt, hsa; identical to SEQ ID NO: 180499

SEQ ID NO: 585082 - RNA, 64 nt, hsa; identical to SEQ ID NO: 180500

SEQ ID NO: 585083 - RNA, 64 nt, hsa; identical to SEQ ID NO: 180501

SEQ ID NO: 585084 - RNA, 64 nt, hsa; identical to SEQ ID NO: 180502

SEQ ID NO: 585085 - RNA, 64 nt, hsa; identical to SEQ ID NO: 180503

SEQ ID NO: 585086 - RNA, 64 nt, hsa; identical to SEQ ID NO: 180504

SEQ ID NO: 585087 - RNA, 64 nt, hsa; identical to SEQ ID NO: 180505

SEQ ID NO: 585088 - RNA, 64 nt, hsa
auggccccucccccuggggagugcccugugugauggaggcgauacagccccuaccuucagagag

SEQ ID NO: 585089 - RNA, 64 nt, hsa
gguacacaggguggaguagggagaagcugccccaggaggcgauguagugguggaaagaagaggc

SEQ ID NO: 585090 - RNA, 64 nt, hsa
ccuggccguccaaauagaucccccaggguaccacggaggcgaaggaguuggagguguuuuccag

SEQ ID NO: 585091 - RNA, 64 nt, hsa
uauuuauuuauugccuggccggugacucgggggaggaggcgacccugucaucugucccaccugc

SEQ ID NO: 585092 - RNA, 64 nt, hsa
ccuucugcugggaaagcagcccugaggaggaagaggaggcgagggaaucagaaauugaggacag

SEQ ID NO: 585093 - RNA, 64 nt, hsa
ugcgaggcugaggcaggagaauugcuugaaccugggaggcgaagguugcagugagccgagauug

SEQ ID NO: 585094 - RNA, 64 nt, hsa
cgugguggcgggcuccuguaaucccagcuacuuuggaggcgaggcacgagaaucgcuugaaccu

SEQ ID NO: 585095 - RNA, 64 nt, hsa
ugagcauggggcgcucccacucagaacucuccagggaggcgaugccagccuugggggguggggg

SEQ ID NO: 585096 - RNA, 64 nt, hsa
cuuggcuguguucucugaucuaggccuucccagaggaggcgagcagaagcugugccacuuggaa

SEQ ID NO: 585097 - RNA, 64 nt, hsa
ugcuuccgagagugugcagguggcccuuccccuuggaggcgagaagagagaaugugcugucuau

SEQ ID NO: 585098 - RNA, 64 nt, hsa
cucgcgcuacaagaggccacucccagggacccagggaggcgauggccaccccagaggccaccuu

SEQ ID NO: 585099 - RNA, 64 nt, hsa
cugcgagucuaauccgggagcggcugcugccagcggaggcgacagcagcguugggagcuccucg

SEQ ID NO: 585100 - RNA, 64 nt, hsa
gaucagccccccgcccggcuagccgccccguccgggaggcgaggggcgccucugcccggcugcc

SEQ ID NO: 585101 - RNA, 64 nt, hsa
cauaugcugacccugucucugugugguuggguugggaggcgaucagcagauaccauagugaacg

SEQ ID NO: 585102 - RNA, 64 nt, hsa
ugguggcacaagggauggggacgcgagggggaggggaggcgaggaacaaggagaaggggcaacu

SEQ ID NO: 585103 - RNA, 64 nt, hsa
guuucagcugaccagaaguggcaggaggacagguggaggcgagccagauuaggccuggaguugg

SEQ ID NO: 585104 - RNA, 64 nt, hsa
uauaaugaugucuuagagggacugaaagguuuaaggaggcgaucaaacuaaaaugucuuaaugg

SEQ ID NO: 585105 - RNA, 64 nt, hsa
guguaauccccaauguuagagguggggccggcugggaggcgacuggaucaugggugugaagccu

SEQ ID NO: 585106 - RNA, 64 nt, hsa
ggcuggcccagaauggccuguugccauagcaacuggaggcgauggggcagugaacagaauaaca

SEQ ID NO: 585107 - RNA, 64 nt, hsa
agcaauacaggagaggaugaagggaggagcuccaggaggcgagggaagagcccuagcagggcgg

SEQ ID NO: 585108 - RNA, 64 nt, hsa
ucuucuguagggguauggugcgccgcaugacaugggaggcgauggggacgauggacagagacag

SEQ ID NO: 585109 - RNA, 64 nt, hsa
cugcagcaacucccacgacuguuguacaagcucaggaggcgaauaaauguucaaacuguaugcu

SEQ ID NO: 585110 - RNA, 64 nt, hsa
ggccaggaauguuugcaugaccuaccucaggaggggaggcgaggaagaguaauauuuagcauuc

SEQ ID NO: 585111 - RNA, 64 nt, hsa
ugugggcagccccucccggcagccagggcuuccuggaggcgaugcagccaggccccugugggug

SEQ ID NO: 585112 - RNA, 64 nt, hsa
ucacauacuguguuuuuauuuuaacaugggugagggaggcgaccugaucaggggaggugggggu

SEQ ID NO: 585113 - RNA, 64 nt, hsa
aauaugcacagugauuacaaccuuuaaagcaagaggaggcgaguuaauuuggaugagugugauu

SEQ ID NO: 585114 - RNA, 64 nt, hsa
ugcgguggcuccggccgguuguccuggcacacaaggaggcgaggcuaugcguucgaggccaacc

SEQ ID NO: 585115 - RNA, 64 nt, hsa
uucccaagaacaaaccauuucugugcacauccuuggaggcgagaugagcuccuugcagagggcc

SEQ ID NO: 585116 - RNA, 64 nt, hsa
ugggaggcugaagcaggagaauugcucaaaccugggaggcgaagauugcagugagcugaaauca

SEQ ID NO: 585117 - RNA, 64 nt, hsa
gcacccugcaaaauuugaugccaggacacgcuuuggaggcgauuuaccuguuuucgcaccuacc

SEQ ID NO: 585118 - RNA, 64 nt, hsa
ggaaggaaagaucaaggaaccaagcgccuccacgggaggcgagggaggcucuguaugaaacaga

SEQ ID NO: 585119 - RNA, 64 nt, hsa
ugagagagaggaagacugcuggcagggaaaucgaggaggcgagacuagaacugcaccagcuucc

SEQ ID NO: 585120 - RNA, 64 nt, hsa
ccacccaccccucaccuugcaggcugccugcgugggaggcgaagucccaggacagcccagaggg

SEQ ID NO: 585121 - RNA, 64 nt, hsa
ugggaggcugaggcaggagaaucacuugaacucgggaggcgaagguugcagugagccgagauuu

SEQ ID NO: 585122 - RNA, 64 nt, hsa
aauuccaaaagccugagaagagagaaguggagggggaggcgagugugugaauaaaggcucccau

SEQ ID NO: 585123 - RNA, 64 nt, hsa
accggacgggugguccggagggaggcuggagcggggaggcgaggagggggcugugaguccucag

SEQ ID NO: 585124 - RNA, 64 nt, hsa
accuugacagaaaacuacuuugagucuacaaagaggaggcgacaaguccaucagcagaaaguca

SEQ ID NO: 585125 - RNA, 64 nt, hsa
agugaccccaagucuguuucccucagcugcauaaggaggcgauauaguuugaauauuugucccc

SEQ ID NO: 585126 - RNA, 64 nt, hsa
ugugguggcucaugccuguaaucccagcacuuugggaggcgaggcggggguggaucacaagguc

SEQ ID NO: 585127 - RNA, 64 nt, hsa
ggugcccaggcagacggguucagccugcagaacuggaggcgaccugugaaacccacccgggcac

SEQ ID NO: 585128 - RNA, 64 nt, hsa
cgucauccaggcugucaacaccagccccgagcggggaggcgaggaggcccugcaugccuuccug

SEQ ID NO: 585129 - RNA, 64 nt, hsa
cgccugcccaggggccguggugacucacgggcagggaggcgacaucaggcugguucugccacug

SEQ ID NO: 585130 - RNA, 64 nt, hsa
uggaaaggaguugccucuucuccaaucagagcguggaggcgaguugggcgacuucaagggccug

SEQ ID NO: 585131 - RNA, 64 nt, hsa
auuuuguuagauuuugccuuucuuuuggaaggaaggaggcgauauucuggauuauaaaaaugaa

SEQ ID NO: 585132 - RNA, 64 nt, hsa
cuggacaaccagaggagauacagcugcuuagaaaggaggcgacuccuagauccagggauagccc

SEQ ID NO: 585133 - RNA, 64 nt, hsa
ccugugacugcagcaucuucccaccagugcugcaggaggcgacagaagucaaauauauccugca

SEQ ID NO: 585134 - RNA, 64 nt, hsa
gguguguguuagggacccagggcauugggggaagggaggcgaaggccugagguuuuccaucuuc

SEQ ID NO: 585135 - RNA, 64 nt, hsa
cucaagccccgcuucuaccagccuguggaguucaggaggcgagacauccuggccuccuuugaga

SEQ ID NO: 585136 - RNA, 64 nt, hsa
ccuaagcccuuucuaacgagagucucaaacaagcggaggcgagggccaauucaaccccauucuu

SEQ ID NO: 585137 - RNA, 64 nt, hsa
aaaacaagcugauaugugccuguuucuggacaauggaggcgaaagaguggaauuucauucaaag

SEQ ID NO: 585138 - RNA, 63 nt, hsa
agcccucucaccccuacuaggcucagcccagguggaggcgagaugagcuggcgcagccccgcc

SEQ ID NO: 585139 - RNA, 64 nt, hsa
acauuugccgcaguggauguguacugagggggcuggaggcgaagggugggagcauagcauagga

SEQ ID NO: 585140 - RNA, 64 nt, hsa
ccauagagugggcuuugccaguugcuguugcacaggaggcgagaacagcacacuucaaccccag

SEQ ID NO: 585141 - RNA, 64 nt, hsa
accgcacugucugccccaaugucuaacaaaggccggaggcgacucuuccugcgaggucucagag

SEQ ID NO: 585142 - RNA, 64 nt, hsa
uagagcaggccccgaacuguggucgccaggcccaggaggcgacugcaugguggagagggagcug

SEQ ID NO: 585143 - RNA, 64 nt, hsa
aggguggggagagacgggcccuggugguggcucgggaggcgaagcguuguccucagccccgcgu

SEQ ID NO: 585144 - RNA, 64 nt, hsa
uuccagaugagccagugccucgcaugauaccagaggaggcgagggacagagacagcaaggcaga

SEQ ID NO: 585145 - RNA, 64 nt, hsa
cgucccggcgcuuuccaggagccccaggcccggaggaggcgaagcccgcagagcaaagguggaa

SEQ ID NO: 585146 - RNA, 64 nt, hsa
gagagaacccaguucuagguacugucugggccugggaggcgagagcagugcccaggggacuucu

SEQ ID NO: 585147 - RNA, 64 nt, hsa
uccauuuugagcaccucugccaggcugcagaccuggaggcgaagggaguguggaagaggagggu

SEQ ID NO: 585148 - RNA, 64 nt, hsa
caguggauucuuggucaggugugcccacagaugcggaggcgaggugagugauuccaucauuuca

SEQ ID NO: 585149 - RNA, 64 nt, hsa
cagcccagccugcucagagaagcuggcaggacugggaggcgacagaugggccccucuuggccuc

SEQ ID NO: 585150 - RNA, 64 nt, hsa
cgaggggccuuggccaggacuggcccuguggccaggaggcgagaagguggcuguucccggauug

SEQ ID NO: 585151 - RNA, 64 nt, hsa
cugcacacgacagcagauucgcuguccccucguuggaggcgaauggucggaccccgaguggcgg

SEQ ID NO: 585152 - RNA, 64 nt, hsa
gcacggucguauccaagggagggaucauggcaugggaggcgacucaaagacuggcgugugugga

SEQ ID NO: 585153 - RNA, 64 nt, hsa
ccauagucgagcucucccgcugggggcacugcggggaggcgaggccucgggaagcugaauuuuc

SEQ ID NO: 585154 - RNA, 64 nt, hsa
cgugggacagaacuccugcccacccuaccccgagggaggcgaacccgcacuuccaggcuuggga

SEQ ID NO: 585155 - RNA, 64 nt, hsa
aucaaagccuuaaccuuugcuuuaugcucuugugggaggcgacgggggggcaggcgggagcagg

SEQ ID NO: 585156 - RNA, 64 nt, hsa
guggaugugacaacaacuuccaaauuggcucuuuggaggcgagaggaaggggagaacuuggaga

SEQ ID NO: 585157 - RNA, 64 nt, hsa
cuuguuggcugccaguaggggcgggaggaaaggcggaggcgagcccuggaggagggaggccaca

SEQ ID NO: 585158 - RNA, 64 nt, hsa
ggcccaccccuccccacucccugaucccguagguggaggcgaugggucacgagccauguuaagc

SEQ ID NO: 585159 - RNA, 59 nt, hsa
cacuagagaagagucugugagucacuugaggaggcgagucuagcagauucuuucagagg

SEQ ID NO: 585160 - RNA, 64 nt, hsa
ccuggagggcuccagaccuuucugagcccugcuuggaggcgagcauuuucacugcuaggacaag

SEQ ID NO: 585161 - RNA, 64 nt, hsa
aauuuuucauggagggaaaauugcuuccucugugggaggcgaaucuggcugcaaaagccucagu

SEQ ID NO: 585162 - RNA, 64 nt, hsa
acauaaccuauauaccuccagcagcuggacauggggaggcgacaguccuaucuagacaucauac

SEQ ID NO: 585163 - RNA, 64 nt, hsa
acaauaaauugccuuuagcagcaguuuaaaauccuaucgugaacaaccuauauuuucgccauuu

SEQ ID NO: 585164 - RNA, 64 nt, hsa
uaauucugugcuugacaaaggacgauuucuccuuuaucgugaccagugcugccgauuuccugac

SEQ ID NO: 585165 - RNA, 64 nt, hsa; identical to SEQ ID NO: 218812

SEQ ID NO: 585166 - RNA, 64 nt, hsa; identical to SEQ ID NO: 218813

SEQ ID NO: 585167 - RNA, 64 nt, hsa; identical to SEQ ID NO: 218814

SEQ ID NO: 585168 - RNA, 64 nt, hsa; identical to SEQ ID NO: 218815

SEQ ID NO: 585169 - RNA, 64 nt, hsa; identical to SEQ ID NO: 218816

SEQ ID NO: 585170 - RNA, 64 nt, hsa; identical to SEQ ID NO: 218817

SEQ ID NO: 585171 - RNA, 64 nt, hsa; identical to SEQ ID NO: 218818

SEQ ID NO: 585172 - RNA, 64 nt, hsa; identical to SEQ ID NO: 218819

SEQ ID NO: 585173 - RNA, 64 nt, hsa; identical to SEQ ID NO: 218820

SEQ ID NO: 585174 - RNA, 64 nt, hsa; identical to SEQ ID NO: 218821

SEQ ID NO: 585175 - RNA, 64 nt, hsa; identical to SEQ ID NO: 218822

SEQ ID NO: 585176 - RNA, 64 nt, hsa; identical to SEQ ID NO: 218823

SEQ ID NO: 585177 - RNA, 64 nt, hsa; identical to SEQ ID NO: 218824

SEQ ID NO: 585178 - RNA, 64 nt, hsa; identical to SEQ ID NO: 218825

SEQ ID NO: 585179 - RNA, 64 nt, hsa; identical to SEQ ID NO: 218826

SEQ ID NO: 585180 - RNA, 64 nt, hsa; identical to SEQ ID NO: 218827

SEQ ID NO: 585181 - RNA, 64 nt, hsa; identical to SEQ ID NO: 218828

SEQ ID NO: 585182 - RNA, 64 nt, hsa; identical to SEQ ID NO: 218829

SEQ ID NO: 585183 - RNA, 64 nt, hsa; identical to SEQ ID NO: 218830

SEQ ID NO: 585184 - RNA, 64 nt, hsa; identical to SEQ ID NO: 218831

SEQ ID NO: 585185 - RNA, 64 nt, hsa; identical to SEQ ID NO: 218832

SEQ ID NO: 585186 - RNA, 64 nt, hsa; identical to SEQ ID NO: 218833

SEQ ID NO: 585187 - RNA, 64 nt, hsa; identical to SEQ ID NO: 218834

SEQ ID NO: 585188 - RNA, 64 nt, hsa; identical to SEQ ID NO: 218835

SEQ ID NO: 585189 - RNA, 64 nt, hsa; identical to SEQ ID NO: 218836

SEQ ID NO: 585190 - RNA, 64 nt, hsa; identical to SEQ ID NO: 137985

SEQ ID NO: 585191 - RNA, 64 nt, hsa; identical to SEQ ID NO: 137986

SEQ ID NO: 585192 - RNA, 64 nt, hsa; identical to SEQ ID NO: 137987

SEQ ID NO: 585193 - RNA, 64 nt, hsa; identical to SEQ ID NO: 137988

SEQ ID NO: 585194 - RNA, 64 nt, hsa; identical to SEQ ID NO: 137989

SEQ ID NO: 585195 - RNA, 64 nt, hsa; identical to SEQ ID NO: 137990

SEQ ID NO: 585196 - RNA, 64 nt, hsa; identical to SEQ ID NO: 137991

SEQ ID NO: 585197 - RNA, 64 nt, hsa; identical to SEQ ID NO: 137992

SEQ ID NO: 585198 - RNA, 64 nt, hsa; identical to SEQ ID NO: 137993

SEQ ID NO: 585199 - RNA, 64 nt, hsa; identical to SEQ ID NO: 137994

SEQ ID NO: 585200 - RNA, 64 nt, hsa; identical to SEQ ID NO: 137995

SEQ ID NO: 585201 - RNA, 64 nt, hsa; identical to SEQ ID NO: 137996

SEQ ID NO: 585202 - RNA, 64 nt, hsa; identical to SEQ ID NO: 137997

SEQ ID NO: 585203 - RNA, 64 nt, hsa; identical to SEQ ID NO: 137998

SEQ ID NO: 585204 - RNA, 64 nt, hsa; identical to SEQ ID NO: 137999

SEQ ID NO: 585205 - RNA, 64 nt, hsa; identical to SEQ ID NO: 138000

SEQ ID NO: 585206 - RNA, 64 nt, hsa; identical to SEQ ID NO: 138001

SEQ ID NO: 585207 - RNA, 64 nt, hsa; identical to SEQ ID NO: 138002

SEQ ID NO: 585208 - RNA, 64 nt, hsa; identical to SEQ ID NO: 138003

SEQ ID NO: 585209 - RNA, 64 nt, hsa; identical to SEQ ID NO: 138004

SEQ ID NO: 585210 - RNA, 64 nt, hsa; identical to SEQ ID NO: 138005

SEQ ID NO: 585211 - RNA, 64 nt, hsa; identical to SEQ ID NO: 138006

SEQ ID NO: 585212 - RNA, 64 nt, hsa; identical to SEQ ID NO: 138007

SEQ ID NO: 585213 - RNA, 64 nt, hsa; identical to SEQ ID NO: 138008

SEQ ID NO: 585214 - RNA, 64 nt, hsa; identical to SEQ ID NO: 138009

SEQ ID NO: 585215 - RNA, 64 nt, hsa; identical to SEQ ID NO: 138010

SEQ ID NO: 585216 - RNA, 64 nt, hsa
cugacuccugagcaggaccugggcccgguucagcuccccacaaggacuucucugucuggagaca

SEQ ID NO: 585217 - RNA, 64 nt, hsa
ugccacagcugcagacugagagggugggucugaguccccacaaugucugaagcugccccuggga

SEQ ID NO: 585218 - RNA, 64 nt, hsa
ccuguacauccaucccaggacacagcccagccccuccccacaccauacaagguaucagaaaagu

SEQ ID NO: 585219 - RNA, 64 nt, hsa
cugccuuugaaaaugcuuccaaaaguagacccuguccccacacaggucaagacuacagagaagg

SEQ ID NO: 585220 - RNA, 64 nt, hsa
aggucuccaugcagggggaggaggccugcuucuuuccccacagcucucacgucucccuucuccc

SEQ ID NO: 585221 - RNA, 64 nt, hsa
ggaccaccuccuuccugccucauuguaauaaaauuccccacacugaggccuucuugucuucaac

SEQ ID NO: 585222 - RNA, 64 nt, hsa
uccacaaaauuggaagcuuuuuuuaaaaauguuuuccccacaagucaucuugccuuguggcaug

SEQ ID NO: 585223 - RNA, 64 nt, hsa
aaaucaggcucaguuccccuacucuggccucuacuccccacaccccagugccacugugggugac

SEQ ID NO: 585224 - RNA, 64 nt, hsa
uagccacaauggccccccgcgaagugagucauacuccccacaagucucugggcugggcagccgg

SEQ ID NO: 585225 - RNA, 64 nt, hsa
gagcccuugggagaccagcuguugcucccaccuuuccccacagggugcccgguccccacggcgc

SEQ ID NO: 585226 - RNA, 64 nt, hsa
gggggucgaggguccugcauaugcaccuggggaguccccacacacccgcaccaaaggggaaaca

SEQ ID NO: 585227 - RNA, 64 nt, hsa
ugagcuccagcuucucugagcauccccucugcuguccccacauccugauagccccucugggagc

SEQ ID NO: 585228 - RNA, 64 nt, hsa
gcugugcuguagccuguaauuacugacaugaagguccccacacagagucuggauggaggcugcc

SEQ ID NO: 585229 - RNA, 64 nt, hsa
gccagcuuuuccucaccaggagcccggcuuccacuccccacauaggaauaguccauccccagau

SEQ ID NO: 585230 - RNA, 64 nt, hsa
gggcugaguguccagcacaccugccgucuucacuuccccacaggcuggcgcucggcuccacccc

SEQ ID NO: 585231 - RNA, 64 nt, hsa
aggacacggaggguucagaccccuccucagacccuccccacaucugaaacugccuccccccaac

SEQ ID NO: 585232 - RNA, 64 nt, hsa
cagcagcagcagggcccuccucccccaccagcucuccccacagggccccucagcaucauggaga

SEQ ID NO: 585233 - RNA, 64 nt, hsa
gguccugaauuuuacuuugccuuaagaagugcccuccccacaaugcaggagaggcacagagugc

SEQ ID NO: 585234 - RNA, 64 nt, hsa
uucuacuuuugccuucuagggggagcuuucuaaguccccacauuuaccccgagucaccggaaaa

SEQ ID NO: 585235 - RNA, 64 nt, hsa
cacuuccuucagcaucucacuucuucuucuagaauccccacagggaaauacuguauugaauauu

SEQ ID NO: 585236 - RNA, 64 nt, hsa
ggaaagcuaagucuugucucauuuaggacuggguuccccacagugacagucacuuccuucagca

SEQ ID NO: 585237 - RNA, 64 nt, hsa
ucccauccccacguccccucaucccgucaccucguccccacauccccuugccccgucaccucgu

SEQ ID NO: 585238 - RNA, 64 nt, hsa
ccucauccccacguccucucguccccuugucccguccccacauacccucguccccaugucccca

SEQ ID NO: 585239 - RNA, 64 nt, hsa
uguucuucaugagaguacuagccuccuccacuccuccccacagcgcagaggaaacaggccagcc

SEQ ID NO: 585240 - RNA, 64 nt, hsa
gcgagaugagcuggcgcagccccgcccuccauccuccccacaucccugcagccaccucccagca

SEQ ID NO: 585241 - RNA, 64 nt, hsa
gaaguagggauauuuuuauaaaacaauuguguccuccccacauuuugcuauguuaauauuugcu

SEQ ID NO: 585242 - RNA, 64 nt, hsa
agaagugauaaacaccuccagcuuucuaacauccuccccacaccaucucaccauauccaucucc

SEQ ID NO: 585243 - RNA, 64 nt, hsa
acgcccgagaaagccugggggacccagacaccuguccccacagucaaagccuggggacccagac

SEQ ID NO: 585244 - RNA, 64 nt, hsa
cccacagucaaagccuggggacccagacauccuguccccacagucagccuccugucccugcugg

SEQ ID NO: 585245 - RNA, 64 nt, hsa
cagcucagagagcaccaucccgggggucagggccuccccacaggagcccugcagugugguagcg

SEQ ID NO: 585246 - RNA, 64 nt, hsa
uccacuccggaucgaggccuguauagggcucguuuccccacacaugccuauuucugaagaggcu

SEQ ID NO: 585247 - RNA, 64 nt, hsa
cuuuaacaccagguuuauggaaaaugucaggccuuccccacaacuccugucuaacugcugucgc

SEQ ID NO: 585248 - RNA, 64 nt, hsa
ccacggggcuccuuucccuccgaagggcugcucuuccccacaggcgcggggacagcagcccgac

SEQ ID NO: 585249 - RNA, 64 nt, hsa
acacacaugcaggcggcguggucucccugcucuguccccacacguuccucacauacaggcaaga

SEQ ID NO: 585250 - RNA, 64 nt, hsa
gccccuuugcccgccuccugcaaaccucacaggguccccacacaacagugcccuccagaagcag

SEQ ID NO: 585251 - RNA, 64 nt, hsa
aggacagcugccuguuuccuccccaucagccuccuccccacauccccagcugccuggcuggguc

SEQ ID NO: 585252 - RNA, 64 nt, hsa
gccccccugggggggcugccuuccccucagccucuccccacaccacccacccagcugcugucau

SEQ ID NO: 585253 - RNA, 64 nt, hsa
gcugagauuuuucuaaauugaaaacacgccccccuccccacaccuccaggaacuccacucccag

SEQ ID NO: 585254 - RNA, 64 nt, hsa
cagucccauaaaccuggcccucuuuggggaaagauccccacagagcauccuccucucaucugug

SEQ ID NO: 585255 - RNA, 64 nt, hsa
ggcaccucagugggugggcagggcuuggucccccuccccacagcaagggaaggcagcuggcucu

SEQ ID NO: 585256 - RNA, 64 nt, hsa
aacugcccagccugcuccuggcccccuggaagccuccccacagcugguaaucuggacuuaagga

SEQ ID NO: 585257 - RNA, 64 nt, hsa
ccauggcugggaggggccucugaacggaacaguguccccacagagcgaauaaagccaaggcuuc

SEQ ID NO: 585258 - RNA, 64 nt, hsa
ugacguucgugauguccugcccgccgggagucuuuccccacaccccagccaucgccgcccgcuc

SEQ ID NO: 585259 - RNA, 64 nt, hsa
uacgagcaagugccggcuggacccaagcccugcauccccacaugcggggcagaggcccuucucu

SEQ ID NO: 585260 - RNA, 64 nt, hsa
cacagaaauuugugaucugaaaacccggcucccuuccccacaaggcuccugggccuccgggaag

SEQ ID NO: 585261 - RNA, 64 nt, hsa
uucuugguucuuugagcucguuucagaggcugaguccccacaucagcuuuaguucuuggacuuc

SEQ ID NO: 585262 - RNA, 64 nt, hsa
ggcccccgaagaauggaacccacacccauagcucuccccacagcugauacggcauccugcgaga

SEQ ID NO: 585263 - RNA, 64 nt, hsa
aauauucuaguacuuucugaacauucuggaauccuccccacauucuagaauucucccaacauuu

SEQ ID NO: 585264 - RNA, 64 nt, hsa
gaugacaacagcaucaugaccuucaaccucagucagcucccaggguugcuagagcuccuuguag

SEQ ID NO: 585265 - RNA, 64 nt, hsa
uggauccugggagguucagcaaggugucuaguccagcucccauggaggguggggaagaagaaga

SEQ ID NO: 585266 - RNA, 64 nt, hsa
gcucugagccaagggugaggauggggaaacucuaagcucccaccuaauaagaagcauaggcaga

SEQ ID NO: 585267 - RNA, 64 nt, hsa
uauugagcagaaaaugaguuggauggagauaaacagcucccaucccuggguaauggaugguaag

SEQ ID NO: 585268 - RNA, 64 nt, hsa
acuacggagcuggggagggcuguggcuuggggccagcucccagggaaauucccagaccuguacc

SEQ ID NO: 585269 - RNA, 64 nt, hsa
ccugaauucuccaaggacucggguuuccuggaagagcucccagaagauaaccucuccuccuggg

SEQ ID NO: 585270 - RNA, 64 nt, hsa
uguugugggugucucagcucugagggucuuugugagcucccacuguugugggugucucagcucu

SEQ ID NO: 585271 - RNA, 64 nt, hsa; identical to SEQ ID NO: 585270

SEQ ID NO: 585272 - RNA, 64 nt, hsa
cuucucagcucccauuucuacucuuaaguuucucagcucccauuucuacucucccauggcuuaa

SEQ ID NO: 585273 - RNA, 64 nt, hsa
cggguuugaggauaggaguucacuucaucuucucagcucccauuucuacucuuaaguuucucag

SEQ ID NO: 585274 - RNA, 64 nt, hsa
gccacaaacuccauccagauccggaacgucagccagcucccagccacauggcgcaugaaggaga

SEQ ID NO: 585275 - RNA, 64 nt, hsa
uucucacucucccuggagcugcucuccuaucagaagcucccagcugaccagacacugccugggg

SEQ ID NO: 585276 - RNA, 64 nt, hsa
ugccauuuggggucacagaugccuagcuggacacagcucccagaacuggcuccacccuggggcc

SEQ ID NO: 585277 - RNA, 64 nt, hsa
gacccacgagcagggcugcgucgguuuguggucuagcucccaggggcaggccaggcauggcuca

SEQ ID NO: 585278 - RNA, 64 nt, hsa
agcagggcugaacuggggagccccuuucccugggagcucccagaggaaacucuugaccaccagu

SEQ ID NO: 585279 - RNA, 64 nt, hsa
uggccggccggccccccucccccagccgccggccagcucccaaauggcccauuccagggccuca

SEQ ID NO: 585280 - RNA, 64 nt, hsa
guccaggacucagaccggggaggcccgggccagcagcucccagugugaccugacaaaaacacgu

SEQ ID NO: 585281 - RNA, 64 nt, hsa
uuuuccguacugugaagaaagaacucuccaccccagcucccacccugcccuggccuggguggag

SEQ ID NO: 585282 - RNA, 64 nt, hsa
ccggccccccacccgcagccggccacacuggagcagcucccagcacagccuuacgcgcccgacg

SEQ ID NO: 585283 - RNA, 64 nt, hsa
acagccuuugacguccaccccacgcugaugcagaagcucccagaacacucaggaaacuucuccg

SEQ ID NO: 585284 - RNA, 64 nt, hsa
aaaucucugcuguauccuuucggcuucccaguugagcucccaagaccaggacccacuggggcau

SEQ ID NO: 585285 - RNA, 64 nt, hsa
ccuucucugcuguguccuuucggcuucccaguugagcucccaagaccaggacccacuggggcau

SEQ ID NO: 585286 - RNA, 64 nt, hsa
ggaccugcuuuucaaaagacuucugccugaccagagcucccacuacaugcaguggcccagggca

SEQ ID NO: 585287 - RNA, 64 nt, hsa
ucgugguuuccuguuuucagcgaaauuuacucugagcucccaguuccaucuucauccauggcca

SEQ ID NO: 585288 - RNA, 64 nt, hsa
cgguuagaaaugugccaggguuaaaggaguccgcagcucccacggcugcugggaggacaugguc

SEQ ID NO: 585289 - RNA, 64 nt, hsa
agaugagagaagccugaaaaaggcagaguuugaaagcucccauuuaaaaacaaaauacuuuuua

SEQ ID NO: 585290 - RNA, 64 nt, hsa
cuaccagagcaccugucccucggccgccugguacagcucccacucucagcaggugacacucgcg

SEQ ID NO: 585291 - RNA, 64 nt, hsa
guguaaacacacgugcacacaucguacacaugugagcucccacacguacacacagaugcacaug

SEQ ID NO: 585292 - RNA, 64 nt, hsa
cuacacacaugcacacacguguacaccacaaacgagcucccagacauguaaacacacgucuccc

SEQ ID NO: 585293 - RNA, 64 nt, hsa
ucccagacauguaaacacacgucucccacacgugagcucccacacguacacaugcacauguacg

SEQ ID NO: 585294 - RNA, 64 nt, hsa
ugaccccagccccugccccuggacaccugcugacagcucccacacagaacagucugaggugaug

SEQ ID NO: 585295 - RNA, 64 nt, hsa
caguggacaggaagacuucucauccuugaauucuagcucccauuccaaacuguuaguccccaac

SEQ ID NO: 585296 - RNA, 64 nt, hsa
aagagaugccucauuuuagaaccaccaacaagcaagcucccaagggauggugcccuguucucua

SEQ ID NO: 585297 - RNA, 64 nt, hsa
ugaagccaaagccaauaacacacagcuaacacacagcucccauaaccgcugauucucagggucu

SEQ ID NO: 585298 - RNA, 64 nt, hsa
gugagagcuaguggccacagcugcagagcacugcagcucccagcuccuuuggaaagggacaggg

SEQ ID NO: 585299 - RNA, 64 nt, hsa
ccuuagcccccauaucuggcuguccuuggguaacagcucccagcaggcccuaagucuggcuuca

SEQ ID NO: 585300 - RNA, 64 nt, hsa; identical to SEQ ID NO: 239468

SEQ ID NO: 585301 - RNA, 64 nt, hsa; identical to SEQ ID NO: 239469

SEQ ID NO: 585302 - RNA, 64 nt, hsa; identical to SEQ ID NO: 239470

SEQ ID NO: 585303 - RNA, 64 nt, hsa; identical to SEQ ID NO: 239471

SEQ ID NO: 585304 - RNA, 64 nt, hsa; identical to SEQ ID NO: 239472

SEQ ID NO: 585305 - RNA, 64 nt, hsa; identical to SEQ ID NO: 239473

SEQ ID NO: 585306 - RNA, 64 nt, hsa; identical to SEQ ID NO: 239474

SEQ ID NO: 585307 - RNA, 64 nt, hsa; identical to SEQ ID NO: 239475

SEQ ID NO: 585308 - RNA, 64 nt, hsa; identical to SEQ ID NO: 239476

SEQ ID NO: 585309 - RNA, 64 nt, hsa; identical to SEQ ID NO: 239477

SEQ ID NO: 585310 - RNA, 64 nt, hsa; identical to SEQ ID NO: 239478

SEQ ID NO: 585311 - RNA, 64 nt, hsa; identical to SEQ ID NO: 239479

SEQ ID NO: 585312 - RNA, 64 nt, hsa; identical to SEQ ID NO: 239480

SEQ ID NO: 585313 - RNA, 64 nt, hsa; identical to SEQ ID NO: 239481

SEQ ID NO: 585314 - RNA, 64 nt, hsa; identical to SEQ ID NO: 239482

SEQ ID NO: 585315 - RNA, 64 nt, hsa; identical to SEQ ID NO: 239483

SEQ ID NO: 585316 - RNA, 64 nt, hsa; identical to SEQ ID NO: 239484

SEQ ID NO: 585317 - RNA, 64 nt, hsa; identical to SEQ ID NO: 239485

SEQ ID NO: 585318 - RNA, 64 nt, hsa; identical to SEQ ID NO: 239486

SEQ ID NO: 585319 - RNA, 64 nt, hsa; identical to SEQ ID NO: 239487

SEQ ID NO: 585320 - RNA, 64 nt, hsa; identical to SEQ ID NO: 239488

SEQ ID NO: 585321 - RNA, 64 nt, hsa; identical to SEQ ID NO: 239489

SEQ ID NO: 585322 - RNA, 64 nt, hsa; identical to SEQ ID NO: 239490

SEQ ID NO: 585323 - RNA, 64 nt, hsa; identical to SEQ ID NO: 239491

SEQ ID NO: 585324 - RNA, 64 nt, hsa; identical to SEQ ID NO: 239492

SEQ ID NO: 585325 - RNA, 64 nt, hsa; identical to SEQ ID NO: 239493

SEQ ID NO: 585326 - RNA, 64 nt, hsa; identical to SEQ ID NO: 239494

SEQ ID NO: 585327 - RNA, 64 nt, hsa; identical to SEQ ID NO: 239495

SEQ ID NO: 585328 - RNA, 64 nt, hsa; identical to SEQ ID NO: 239496

SEQ ID NO: 585329 - RNA, 64 nt, hsa; identical to SEQ ID NO: 239497

SEQ ID NO: 585330 - RNA, 64 nt, hsa; identical to SEQ ID NO: 239498

SEQ ID NO: 585331 - RNA, 64 nt, hsa; identical to SEQ ID NO: 239499

SEQ ID NO: 585332 - RNA, 64 nt, hsa; identical to SEQ ID NO: 239500

SEQ ID NO: 585333 - RNA, 64 nt, hsa; identical to SEQ ID NO: 239501

SEQ ID NO: 585334 - RNA, 64 nt, hsa; identical to SEQ ID NO: 239502

SEQ ID NO: 585335 - RNA, 64 nt, hsa; identical to SEQ ID NO: 239503

SEQ ID NO: 585336 - RNA, 64 nt, hsa; identical to SEQ ID NO: 239504

SEQ ID NO: 585337 - RNA, 64 nt, hsa; identical to SEQ ID NO: 239505

SEQ ID NO: 585338 - RNA, 64 nt, hsa; identical to SEQ ID NO: 239506

SEQ ID NO: 585339 - RNA, 64 nt, hsa; identical to SEQ ID NO: 239507

SEQ ID NO: 585340 - RNA, 64 nt, hsa; identical to SEQ ID NO: 239508

SEQ ID NO: 585341 - RNA, 64 nt, hsa; identical to SEQ ID NO: 239509

SEQ ID NO: 585342 - RNA, 64 nt, hsa; identical to SEQ ID NO: 239510

SEQ ID NO: 585343 - RNA, 64 nt, hsa; identical to SEQ ID NO: 239511

SEQ ID NO: 585344 - RNA, 64 nt, hsa; identical to SEQ ID NO: 239512

SEQ ID NO: 585345 - RNA, 64 nt, hsa; identical to SEQ ID NO: 239513

SEQ ID NO: 585346 - RNA, 64 nt, hsa; identical to SEQ ID NO: 239514

SEQ ID NO: 585347 - RNA, 64 nt, hsa; identical to SEQ ID NO: 257854

SEQ ID NO: 585348 - RNA, 64 nt, hsa; identical to SEQ ID NO: 257855

SEQ ID NO: 585349 - RNA, 64 nt, hsa; identical to SEQ ID NO: 257856

SEQ ID NO: 585350 - RNA, 64 nt, hsa; identical to SEQ ID NO: 257857

SEQ ID NO: 585351 - RNA, 64 nt, hsa; identical to SEQ ID NO: 257858

SEQ ID NO: 585352 - RNA, 64 nt, hsa; identical to SEQ ID NO: 257859

SEQ ID NO: 585353 - RNA, 64 nt, hsa; identical to SEQ ID NO: 257860

SEQ ID NO: 585354 - RNA, 64 nt, hsa; identical to SEQ ID NO: 257861

SEQ ID NO: 585355 - RNA, 64 nt, hsa; identical to SEQ ID NO: 257862

SEQ ID NO: 585356 - RNA, 64 nt, hsa; identical to SEQ ID NO: 257863

SEQ ID NO: 585357 - RNA, 64 nt, hsa; identical to SEQ ID NO: 257864

SEQ ID NO: 585358 - RNA, 64 nt, hsa; identical to SEQ ID NO: 257865

SEQ ID NO: 585359 - RNA, 64 nt, hsa; identical to SEQ ID NO: 257866

SEQ ID NO: 585360 - RNA, 64 nt, hsa; identical to SEQ ID NO: 257867

SEQ ID NO: 585361 - RNA, 64 nt, hsa; identical to SEQ ID NO: 257868

SEQ ID NO: 585362 - RNA, 64 nt, hsa; identical to SEQ ID NO: 257869

SEQ ID NO: 585363 - RNA, 64 nt, hsa; identical to SEQ ID NO: 257870

SEQ ID NO: 585364 - RNA, 64 nt, hsa; identical to SEQ ID NO: 257871

SEQ ID NO: 585365 - RNA, 64 nt, hsa; identical to SEQ ID NO: 257872

SEQ ID NO: 585366 - RNA, 64 nt, hsa; identical to SEQ ID NO: 257873

SEQ ID NO: 585367 - RNA, 64 nt, hsa; identical to SEQ ID NO: 257874

SEQ ID NO: 585368 - RNA, 64 nt, hsa; identical to SEQ ID NO: 257875

SEQ ID NO: 585369 - RNA, 64 nt, hsa; identical to SEQ ID NO: 257876

SEQ ID NO: 585370 - RNA, 64 nt, hsa; identical to SEQ ID NO: 257877

SEQ ID NO: 585371 - RNA, 64 nt, hsa; identical to SEQ ID NO: 257878

SEQ ID NO: 585372 - RNA, 64 nt, hsa; identical to SEQ ID NO: 257879

SEQ ID NO: 585373 - RNA, 64 nt, hsa; identical to SEQ ID NO: 257880

SEQ ID NO: 585374 - RNA, 64 nt, hsa; identical to SEQ ID NO: 257881

SEQ ID NO: 585375 - RNA, 64 nt, hsa; identical to SEQ ID NO: 257882

SEQ ID NO: 585376 - RNA, 64 nt, hsa; identical to SEQ ID NO: 257883

SEQ ID NO: 585377 - RNA, 64 nt, hsa; identical to SEQ ID NO: 360935

SEQ ID NO: 585378 - RNA, 64 nt, hsa; identical to SEQ ID NO: 360936

SEQ ID NO: 585379 - RNA, 64 nt, hsa; identical to SEQ ID NO: 360937

SEQ ID NO: 585380 - RNA, 64 nt, hsa; identical to SEQ ID NO: 360938

SEQ ID NO: 585381 - RNA, 64 nt, hsa; identical to SEQ ID NO: 360939

SEQ ID NO: 585382 - RNA, 64 nt, hsa; identical to SEQ ID NO: 360940

SEQ ID NO: 585383 - RNA, 64 nt, hsa; identical to SEQ ID NO: 360941

SEQ ID NO: 585384 - RNA, 64 nt, hsa; identical to SEQ ID NO: 360942

SEQ ID NO: 585385 - RNA, 64 nt, hsa; identical to SEQ ID NO: 360943

SEQ ID NO: 585386 - RNA, 64 nt, hsa; identical to SEQ ID NO: 360944

SEQ ID NO: 585387 - RNA, 64 nt, hsa; identical to SEQ ID NO: 360945

SEQ ID NO: 585388 - RNA, 64 nt, hsa; identical to SEQ ID NO: 360946

SEQ ID NO: 585389 - RNA, 64 nt, hsa; identical to SEQ ID NO: 360947

SEQ ID NO: 585390 - RNA, 64 nt, hsa; identical to SEQ ID NO: 360948

SEQ ID NO: 585391 - RNA, 64 nt, hsa; identical to SEQ ID NO: 360949

SEQ ID NO: 585392 - RNA, 64 nt, hsa; identical to SEQ ID NO: 360950

SEQ ID NO: 585393 - RNA, 64 nt, hsa; identical to SEQ ID NO: 360951

SEQ ID NO: 585394 - RNA, 64 nt, hsa; identical to SEQ ID NO: 360952

SEQ ID NO: 585395 - RNA, 64 nt, hsa; identical to SEQ ID NO: 360953

SEQ ID NO: 585396 - RNA, 64 nt, hsa; identical to SEQ ID NO: 360954

SEQ ID NO: 585397 - RNA, 64 nt, hsa; identical to SEQ ID NO: 360955

SEQ ID NO: 585398 - RNA, 64 nt, hsa; identical to SEQ ID NO: 360956

SEQ ID NO: 585399 - RNA, 64 nt, hsa; identical to SEQ ID NO: 360957

SEQ ID NO: 585400 - RNA, 64 nt, hsa; identical to SEQ ID NO: 360958

SEQ ID NO: 585401 - RNA, 52 nt, hsa; identical to SEQ ID NO: 360959

SEQ ID NO: 585402 - RNA, 64 nt, hsa; identical to SEQ ID NO: 360960

SEQ ID NO: 585403 - RNA, 64 nt, hsa; identical to SEQ ID NO: 360961

SEQ ID NO: 585404 - RNA, 64 nt, hsa; identical to SEQ ID NO: 360962

SEQ ID NO: 585405 - RNA, 64 nt, hsa; identical to SEQ ID NO: 360963

SEQ ID NO: 585406 - RNA, 64 nt, hsa; identical to SEQ ID NO: 360964

SEQ ID NO: 585407 - RNA, 64 nt, hsa; identical to SEQ ID NO: 360965

SEQ ID NO: 585408 - RNA, 64 nt, hsa; identical to SEQ ID NO: 360966

SEQ ID NO: 585409 - RNA, 64 nt, hsa; identical to SEQ ID NO: 360967

SEQ ID NO: 585410 - RNA, 64 nt, hsa; identical to SEQ ID NO: 360968

SEQ ID NO: 585411 - RNA, 64 nt, hsa; identical to SEQ ID NO: 360969

SEQ ID NO: 585412 - RNA, 64 nt, hsa; identical to SEQ ID NO: 360970

SEQ ID NO: 585413 - RNA, 64 nt, hsa; identical to SEQ ID NO: 360971

SEQ ID NO: 585414 - RNA, 64 nt, hsa; identical to SEQ ID NO: 360972

SEQ ID NO: 585415 - RNA, 64 nt, hsa; identical to SEQ ID NO: 360973

SEQ ID NO: 585416 - RNA, 64 nt, hsa; identical to SEQ ID NO: 360974

SEQ ID NO: 585417 - RNA, 64 nt, hsa; identical to SEQ ID NO: 360975

SEQ ID NO: 585418 - RNA, 64 nt, hsa; identical to SEQ ID NO: 360976

SEQ ID NO: 585419 - RNA, 64 nt, hsa; identical to SEQ ID NO: 360977

SEQ ID NO: 585420 - RNA, 64 nt, hsa; identical to SEQ ID NO: 360978

SEQ ID NO: 585421 - RNA, 64 nt, hsa; identical to SEQ ID NO: 360979

SEQ ID NO: 585422 - RNA, 64 nt, hsa; identical to SEQ ID NO: 360980

SEQ ID NO: 585423 - RNA, 64 nt, hsa; identical to SEQ ID NO: 360981

SEQ ID NO: 585424 - RNA, 64 nt, hsa; identical to SEQ ID NO: 360982

SEQ ID NO: 585425 - RNA, 64 nt, hsa; identical to SEQ ID NO: 360983

SEQ ID NO: 585426 - RNA, 64 nt, hsa; identical to SEQ ID NO: 360984

SEQ ID NO: 585427 - RNA, 64 nt, hsa; identical to SEQ ID NO: 360985

SEQ ID NO: 585428 - RNA, 64 nt, hsa; identical to SEQ ID NO: 360986

SEQ ID NO: 585429 - RNA, 64 nt, hsa; identical to SEQ ID NO: 360987

SEQ ID NO: 585430 - RNA, 64 nt, hsa; identical to SEQ ID NO: 360988

SEQ ID NO: 585431 - RNA, 64 nt, hsa; identical to SEQ ID NO: 360989

SEQ ID NO: 585432 - RNA, 64 nt, hsa; identical to SEQ ID NO: 360990

SEQ ID NO: 585433 - RNA, 64 nt, hsa; identical to SEQ ID NO: 360991

SEQ ID NO: 585434 - RNA, 64 nt, hsa; identical to SEQ ID NO: 360992

SEQ ID NO: 585435 - RNA, 64 nt, hsa; identical to SEQ ID NO: 360993

SEQ ID NO: 585436 - RNA, 64 nt, hsa; identical to SEQ ID NO: 360994

SEQ ID NO: 585437 - RNA, 64 nt, hsa; identical to SEQ ID NO: 360995

SEQ ID NO: 585438 - RNA, 64 nt, hsa; identical to SEQ ID NO: 528631

SEQ ID NO: 585439 - RNA, 64 nt, hsa; identical to SEQ ID NO: 528632

SEQ ID NO: 585440 - RNA, 64 nt, hsa; identical to SEQ ID NO: 528633

SEQ ID NO: 585441 - RNA, 64 nt, hsa; identical to SEQ ID NO: 528634

SEQ ID NO: 585442 - RNA, 64 nt, hsa; identical to SEQ ID NO: 528635

SEQ ID NO: 585443 - RNA, 64 nt, hsa; identical to SEQ ID NO: 528636

SEQ ID NO: 585444 - RNA, 64 nt, hsa; identical to SEQ ID NO: 528637

SEQ ID NO: 585445 - RNA, 64 nt, hsa; identical to SEQ ID NO: 528638

SEQ ID NO: 585446 - RNA, 64 nt, hsa; identical to SEQ ID NO: 528639

SEQ ID NO: 585447 - RNA, 64 nt, hsa; identical to SEQ ID NO: 528640

SEQ ID NO: 585448 - RNA, 64 nt, hsa; identical to SEQ ID NO: 528641

SEQ ID NO: 585449 - RNA, 64 nt, hsa; identical to SEQ ID NO: 528642

SEQ ID NO: 585450 - RNA, 64 nt, hsa; identical to SEQ ID NO: 528643

SEQ ID NO: 585451 - RNA, 64 nt, hsa; identical to SEQ ID NO: 528644

SEQ ID NO: 585452 - RNA, 64 nt, hsa; identical to SEQ ID NO: 528645

SEQ ID NO: 585453 - RNA, 64 nt, hsa; identical to SEQ ID NO: 528646

SEQ ID NO: 585454 - RNA, 64 nt, hsa; identical to SEQ ID NO: 528647

SEQ ID NO: 585455 - RNA, 64 nt, hsa; identical to SEQ ID NO: 528648

SEQ ID NO: 585456 - RNA, 64 nt, hsa; identical to SEQ ID NO: 528649

SEQ ID NO: 585457 - RNA, 64 nt, hsa; identical to SEQ ID NO: 528650

SEQ ID NO: 585458 - RNA, 64 nt, hsa; identical to SEQ ID NO: 528651

SEQ ID NO: 585459 - RNA, 64 nt, hsa; identical to SEQ ID NO: 528652

SEQ ID NO: 585460 - RNA, 64 nt, hsa; identical to SEQ ID NO: 528653

SEQ ID NO: 585461 - RNA, 64 nt, hsa; identical to SEQ ID NO: 528654

SEQ ID NO: 585462 - RNA, 57 nt, hsa; identical to SEQ ID NO: 528655

SEQ ID NO: 585463 - RNA, 64 nt, hsa; identical to SEQ ID NO: 528656

SEQ ID NO: 585464 - RNA, 64 nt, hsa; identical to SEQ ID NO: 528657

SEQ ID NO: 585465 - RNA, 64 nt, hsa; identical to SEQ ID NO: 528658

SEQ ID NO: 585466 - RNA, 64 nt, hsa; identical to SEQ ID NO: 528659

SEQ ID NO: 585467 - RNA, 64 nt, hsa; identical to SEQ ID NO: 528660

SEQ ID NO: 585468 - RNA, 64 nt, hsa
gugacuacacacaguacgaaccuacaguuuuaacuguggauauuguuacguagccuaaggcucc

SEQ ID NO: 585469 - RNA, 64 nt, hsa
gcauuguaaaauuauuucaugauuagaaauuaccuguggauauuuguauaaaagugugaaauaa

SEQ ID NO: 585470 - RNA, 64 nt, hsa
acaaaguaaaguuuucaauacaaauucuuugccuuguggauaucaagaaaucccaaaauauuuu

SEQ ID NO: 585471 - RNA, 64 nt, hsa
auuuuuuaagaaggcaguuugucaauuuuaaucuuguggauaccuuuauacucuuaggguauua

SEQ ID NO: 585472 - RNA, 64 nt, hsa
gcaucaauuuuauacagggauauaaaaaaguauauguggauaaauuuuuuguaaucuuuaggga

SEQ ID NO: 585473 - RNA, 64 nt, hsa
uuuuuuguaaucuuuagggauauaaaaaaguguauguggauaaauuuuuuguaaucuuuauuuu

SEQ ID NO: 585474 - RNA, 64 nt, hsa
ccaguguuuccucaucauugauuauugggcuagcuguggauagcuugcauuaauuguauauuuu

SEQ ID NO: 585475 - RNA, 64 nt, hsa
guaugguguuuuuacacuacaaagaagucccccauguggauauuucuuauacuaauuguaucau

SEQ ID NO: 585476 - RNA, 64 nt, hsa
uauacugcauccccuaccacaauuuacacaauccuguggauaguccuaccucacccuggucaac

SEQ ID NO: 585477 - RNA, 64 nt, hsa
ccacaaaguggcucaggcuuuaaaaaaaaaacacuguggauaaugacaaaaagcauaaguaaaa

SEQ ID NO: 585478 - RNA, 62 nt, hsa
uaagucuuuuaccaaaagugucuguacagcagccauccaaguugccccuacuuaguggcuug

SEQ ID NO: 585479 - RNA, 62 nt, hsa
aaguuggcugagccauugagugcugggggaggccauccaagauggcaugaaucgggcuaagg

SEQ ID NO: 585480 - RNA, 62 nt, hsa
cuccgcacucaccugccgggacccucccuauuccauccaagggaagcagaacugccaaagac

SEQ ID NO: 585481 - RNA, 62 nt, hsa
aggaacuaaccuaccccaacucugcccuucucccauccaagagaaaccagcaaaaugauaaa

SEQ ID NO: 585482 - RNA, 62 nt, hsa
gccugaugugguacgucccuccacccccggacccauccaagucaucugauugaagagcauga

SEQ ID NO: 585483 - RNA, 62 nt, hsa
uuaugaccuaaaucuaauuuacuuccacugaaccauccaagaccucuggcaggcagggaaau

SEQ ID NO: 585484 - RNA, 62 nt, hsa
auuuuuucuugguaggaaaaauuauacugaacccauccaaaccugaagucacagaugaugug

SEQ ID NO: 585485 - RNA, 62 nt, hsa
cuucaauccugaacgucacugacuugcugugaccauccaaauaauuuuccugucucugccuc

SEQ ID NO: 585486 - RNA, 62 nt, hsa
uuucugaaaaccuaccauguuucuuuacagagccauccaaaaauuuuuugucccuacauagc

SEQ ID NO: 585487 - RNA, 62 nt, hsa
ggucaguggucugugccaaccaaacgauagccccauccaagccagcugagaaccuaggaagg

SEQ ID NO: 585488 - RNA, 62 nt, hsa
guuaggacaugcuaucaguaauagucccaguuccauccaacuuucugaaauuucauuuuuuu

SEQ ID NO: 585489 - RNA, 62 nt, hsa
ccggcagcagcuaggcagucaccggcccgccuccauccaaaaucacgcucgcgugcuucgga

SEQ ID NO: 585490 - RNA, 62 nt, hsa
aucugcaguuucaucccuaccuuguucacauaccauccaagaggcacauaggcuacccaaga

SEQ ID NO: 585491 - RNA, 62 nt, hsa
ugguuaauugcuaagaguaaauacuacuuuagccauccaaggccaccuucugcagcaaaagg

SEQ ID NO: 585492 - RNA, 62 nt, hsa
agauuugauaagcuagaugcaguagaccgaaaccauccaaaaccuguuuagcuucuuccucc

SEQ ID NO: 585493 - RNA, 62 nt, hsa
ucugaaugccgagucccugaauucacccaggaccauccaaggggccaccgcagcauuggccc

SEQ ID NO: 585494 - RNA, 62 nt, hsa
ucucucuuaccuuuagcugcuugaucauuaagccauccaacuucaugccaguucccuucuuu

SEQ ID NO: 585495 - RNA, 62 nt, hsa
guugaaccuaaagaaauggaugacuggacaaaccauccaaauaaugauaaagucuauucauc

SEQ ID NO: 585496 - RNA, 62 nt, hsa
cuuucuuucuuuuuuuuuaaauuuuguauuuuccauccaacagcaguguguagagagaauau

SEQ ID NO: 585497 - RNA, 62 nt, hsa
aaugccagggacagugugcucaguaaagucuuccauccaaaaggggcagggcacgguggcuc

SEQ ID NO: 585498 - RNA, 62 nt, hsa
uaugguagaauuuuauaaacacauacaugauaccauccaaauucuugcuuuuaauaacaaag

SEQ ID NO: 585499 - RNA, 62 nt, hsa
ggugucuugggcagagcuggcucugagcgccuccauccaaggccagguucuccguuagcucc

SEQ ID NO: 585500 - RNA, 62 nt, hsa
gaccaugagugacaaccaucacgucaggcugcccauccaauagacuccugggauggggcagc

SEQ ID NO: 585501 - RNA, 62 nt, hsa
aguuaaguauagcaauucaaacugaccugcauccauccaaaacaaauuccuccuucaaccuu

SEQ ID NO: 585502 - RNA, 62 nt, hsa
gucuuguccuuggcagaacuggacacuauugaccauccaaauggaaauuccccuuucuuggu

SEQ ID NO: 585503 - RNA, 62 nt, hsa
cacuacaguuauaggaaguuucagucuacaguccauccaaaggaccaaccugccuuacacau

SEQ ID NO: 585504 - RNA, 62 nt, hsa
aagggggaauauaugcaaugguuggcauuuaaccauccaaacaaaucauacaagaaaguuuu

SEQ ID NO: 585505 - RNA, 62 nt, hsa
agauguuuggcaagaaauccccuaacugauuuccauccaaaccuaccuuauagagcacaaua

SEQ ID NO: 585506 - RNA, 62 nt, hsa
ggaaaugaaagcuaaaacaacccauuugcuacccauccaaagcacuuacaguuuagcaaaua

SEQ ID NO: 585507 - RNA, 62 nt, hsa
uuugcauauaucuagcuacucccuaaaugguuccauccaaggcuuagaguacccaaaggcua

SEQ ID NO: 585508 - RNA, 62 nt, hsa
aacgaagaaugaaaaaaagccuagucagacucccauccaaaguaggaacuaucucuuuaaca

SEQ ID NO: 585509 - RNA, 62 nt, hsa
ugcaucaagucugcguggccauccuccccccaccauccaagacuauuagguuuugucccugc

SEQ ID NO: 585510 - RNA, 62 nt, hsa
gacuggagcaucuucugcacaaccuugggagcccauccaaggguuggugaggacuggucucc

SEQ ID NO: 585511 - RNA, 62 nt, hsa
uauuucuugauauaacacucauuuaauuguggccauccaaaugaauauuauugcagaauuua

SEQ ID NO: 585512 - RNA, 62 nt, hsa
uuugccuagaggagacuaauucucuuucuagcccauccaaauuugauaaauggaaccagagg

SEQ ID NO: 585513 - RNA, 62 nt, hsa
ugcccucaucauaaauaucaucucuagcacugccauccaauuuaguucaauaaaauucaaau

SEQ ID NO: 585514 - RNA, 62 nt, hsa
gugaaaucaaugcguggauaaaggaacacaugccauccaagugaugauggcuuuuccuggag

SEQ ID NO: 585515 - RNA, 62 nt, hsa
cagcgauucugcagcaccggccucgggaagccccauccaacacuggauggucaucucggagu

SEQ ID NO: 585516 - RNA, 62 nt, hsa
uuauucuauuuuaagccuucuaucauauuuucccauccaauuguuugguuucagugguccag

SEQ ID NO: 585517 - RNA, 62 nt, hsa
auugguuacuccugcagaguguaaucagcaccccauccaacuggcccgaaagcccagaccug

SEQ ID NO: 585518 - RNA, 62 nt, hsa
gauacugcuguuucucgagguaagagauucagccauccaauugguuuuaggucuugcauauc

SEQ ID NO: 585519 - RNA, 62 nt, hsa
ugaaucuucucaggcaguucagauuuaaagcaccauccaaaccuuggaaauacgacagggug

SEQ ID NO: 585520 - RNA, 62 nt, hsa
guguucaugcacggaacugaugucauuagacaccauccaaggaugggcagccugcagugugg

SEQ ID NO: 585521 - RNA, 62 nt, hsa
cuaggacaccaaaagaccuagcugggcuaacuccauccaaaugauuuuacaguuuuauuuuu

SEQ ID NO: 585522 - RNA, 62 nt, hsa
caggucugcaaaaacaaaaauuauaaacuaguccauccaagaaccaaaguuuguauaaacag

SEQ ID NO: 585523 - RNA, 62 nt, hsa
uguuuauucccugugaugcccagaguaauggcccauccaaagauguccagauguccaugugc

SEQ ID NO: 585524 - RNA, 62 nt, hsa
guauuacuauuaacugacuucagaaguaccugccauccaauacggucauuagauugggucau

SEQ ID NO: 585525 - RNA, 62 nt, hsa
aaugcauugguguuuaacuaagggccauccaaccauccaaccuuuaaaaaacaaaacgaaag

SEQ ID NO: 585526 - RNA, 62 nt, hsa
accauuugaaugcauugguguuuaacuaagggccauccaaccauccaaccuuuaaaaaacaa

SEQ ID NO: 585527 - RNA, 61 nt, hsa
ggugcacauuccugccauagcgcagugaccaccauccaagcucagaucugugugucuacgc

SEQ ID NO: 585528 - RNA, 62 nt, hsa
cccaggagguuucuuucaaacaucauggccucccauccaaucaacaucaucaaauuacaugu

SEQ ID NO: 585529 - RNA, 62 nt, hsa
ucucaaacuaugacagaaaaguaauguaaaauccauccaaucuauuauuucucuaauuaugc

SEQ ID NO: 585530 - RNA, 62 nt, hsa
aaccuguacaaauauguuuauguauuaaaucaccauccaaaauauuuaaggaauauauaaaa

SEQ ID NO: 585531 - RNA, 62 nt, hsa
aaaaacucucauuauggugaucauagaauugaccauccaaacugggacacucuugagaguaa

SEQ ID NO: 585532 - RNA, 62 nt, hsa
gcuguucugcuucagcugguagcugauaaggaccauccaaaauucaaggaaauucagaaucu

SEQ ID NO: 585533 - RNA, 62 nt, hsa
aauucugggauuacaggcauaagccaaugugcccauccaaaguuuuauuuauuuauuuuuuu

SEQ ID NO: 585534 - RNA, 62 nt, hsa
ugaauaugcaaaagcaguuccgcugggaacccccauccaaucaacugcuguacccauggggg

SEQ ID NO: 585535 - RNA, 62 nt, hsa
auuuacuguuuuuuucuguagcaccagagaauccauccaaaguucccuaugaaaaauguguu

SEQ ID NO: 585536 - RNA, 62 nt, hsa
guucaccggacaccgcaccagacccucaaaacccauccaagacugugggaggaguaaacaac

SEQ ID NO: 585537 - RNA, 62 nt, hsa
gcuggaccuaaauagauugauuucauuucuaaccauccaauucugcauguauucauaauucu

SEQ ID NO: 585538 - RNA, 62 nt, hsa
acuuuggaauaaggaagagaagauugaccaaaccauccaaaugccaaaaagaaaaagaaaaa

SEQ ID NO: 585539 - RNA, 62 nt, hsa
cuuuccuuggacaguagcaacuagucagaagaccauccaagauagaugcagcugauacauuc

SEQ ID NO: 585540 - RNA, 62 nt, hsa
gccugggugaguucuguuugcuccuuguaccaccauccaaaugguguuaucaaaucucuuag

SEQ ID NO: 585541 - RNA, 62 nt, hsa
caugauaaggugguucuuucauaacucuaaugccauccaacauagcccugggagaggcaugu

SEQ ID NO: 585542 - RNA, 62 nt, hsa
uguuccccuggccccccacucucccuccauguccauccaaaaaccauaaaaucacuggguuc

SEQ ID NO: 585543 - RNA, 62 nt, hsa
cugucuccugucuucagagcaaaagacuugagccauccaaagaaacacuaagcucucugggc

SEQ ID NO: 585544 - RNA, 62 nt, hsa
ccugcgucacacugugugaggcugugucucugccauccaaaagggggccccuugagaauggu

SEQ ID NO: 585545 - RNA, 62 nt, hsa
guccaaaagugaucuggucggaucucacaaggccauccaaugagaccccgcacagcauuuuc

SEQ ID NO: 585546 - RNA, 62 nt, hsa
caaaugaagacaaaacauacauuuuguaccaaccauccaauuagcuuauguuaacugacaag

SEQ ID NO: 585547 - RNA, 62 nt, hsa
uggagagagggcgcagagcaaaccaugucacgccauccaaugacaccagcuggucagcucac

SEQ ID NO: 585548 - RNA, 62 nt, hsa
gucuucuguaccaaugcaccagagaaugccuaccauccaaaaaagcagucagcugauggaaa

SEQ ID NO: 585549 - RNA, 62 nt, hsa
auccaggacugcaccccacccccaccguccagccauccaaccucacuucgccuuacaggucu

SEQ ID NO: 585550 - RNA, 62 nt, hsa
ccccugacauuaucuuggauccuaugguuucuccauccaauucuuugaauuucccagucucc

SEQ ID NO: 585551 - RNA, 62 nt, hsa
uccagaccagaguuugaugccagcagcuucggccauccaaacagaggaugcucagauuucuc

SEQ ID NO: 585552 - RNA, 62 nt, hsa
cacgccuggugaaggagccugggugagaaacaccauccaaagcuggggcaaagaugauuacc

SEQ ID NO: 585553 - RNA, 62 nt, hsa
ccaucagggaaaugagcugaauggccccagcaccauccaaguugacacagcuaaaggaauaa

SEQ ID NO: 585554 - RNA, 62 nt, hsa
aaugaaaggcuuuaguuauuucuagaggagucccauccaacacuauuuggcgacuguuaaua

SEQ ID NO: 585555 - RNA, 62 nt, hsa
ccucuccaucuacuuuucccugugcauaauauccauccaaaggacaacaguggcaaagcuga

SEQ ID NO: 585556 - RNA, 62 nt, hsa
aguguuuuaaacucuccuagucaauauccaccccauccaauuuaucaaggaagaaaugguuc

SEQ ID NO: 585557 - RNA, 62 nt, hsa
gugcaaaaaagugguggaacaaauaccaacauccauccaaaaugaaaaagaacaggaaauuc

SEQ ID NO: 585558 - RNA, 62 nt, hsa
cauauuuuaaaucaacuacuccacguguuuuuccauccaaucacacugcugugauucaggga

SEQ ID NO: 585559 - RNA, 62 nt, hsa
gggcacaaaauccaagagaaggucugugagccccauccaacacccacaguaauuauuaucug

SEQ ID NO: 585560 - RNA, 62 nt, hsa
gccacagcugugagggccaagaugcuguccccccauccaaaacccgugcgccacugcaguga

SEQ ID NO: 585561 - RNA, 62 nt, hsa
auguuuuaaccucuuuuuuuuuucuaauuauuccauccaaaauuucuggugaauuacacaga

SEQ ID NO: 585562 - RNA, 62 nt, hsa
uuuaccauaguacucccacccacuuccaucacccauccaauaaaaugcagccagguuuagcc

SEQ ID NO: 585563 - RNA, 62 nt, hsa
uguuuuaaguuauauauacacaucuuauugaaccauccaaaaaucauugcuuuuaacuguuu

SEQ ID NO: 585564 - RNA, 55 nt, hsa
uugcagaagauguaaucuaauauugccauccaauuuagcauacauaaaauguugc

SEQ ID NO: 585565 - RNA, 62 nt, hsa
caaaugugggcccagccuaggucagccaacccccauccaacccuuagacucacgaacaaauc

SEQ ID NO: 585566 - RNA, 62 nt, hsa
uuuaacagcuguaaccaaugguacugaucuauccauccaauguugucauuauauuugacugu

SEQ ID NO: 585567 - RNA, 62 nt, hsa
ucccacccuaagucuuacauaaugccaccaguccauccaaaaccuauauaucaccuauacua

SEQ ID NO: 585568 - RNA, 62 nt, hsa
auucaaugugagacacuauccaugauuuaagcccauccaaaaagaagggaggaaacguccau

SEQ ID NO: 585569 - RNA, 62 nt, hsa
gccaaggaccugcaagggacugaaggcggagcccauccaacccucgcccgacccaaacaccu

SEQ ID NO: 585570 - RNA, 62 nt, hsa
ccucucaggcucaagcgauucucccaccucagccauccaaauagcugggaccacaggugugc

SEQ ID NO: 585571 - RNA, 62 nt, hsa
uugucacaugaccgguacuggaagaaacucucccauccaacaucacccaguggauggaacau

SEQ ID NO: 585572 - RNA, 62 nt, hsa
ugaguaaccagauagcaaaagaaaagggaaagccauccaaauuugaaagcuguugauagaaa

SEQ ID NO: 585573 - RNA, 62 nt, hsa
aacacaauguauagccagagaaggagaagcucccauccaaauccuacuaggaagagaguggg

SEQ ID NO: 585574 - RNA, 62 nt, hsa
ggcuuccuuguuuauggggcucucacagauacccauccaacuccucuagucagcacuagauc

SEQ ID NO: 585575 - RNA, 62 nt, hsa
ugagagacagaauucaaguggguauucuggggccauccaauuucucuuuacuugaaauuugg

SEQ ID NO: 585576 - RNA, 62 nt, hsa
accuucccugucgaucccuucugagguauggcccauccaagacuuuuaggccauucuugaug

SEQ ID NO: 585577 - RNA, 62 nt, hsa
gccuggcaccuccauccugaggugcugccccuccauccaaaacugccaagugacucauugcc

SEQ ID NO: 585578 - RNA, 62 nt, hsa
accuggauauaaauuaauugugccugccaccaccauccaacagaccuggugcucuaaugcca

SEQ ID NO: 585579 - RNA, 62 nt, hsa
cacaugucagggaagcacccagugucggcuccccauccaaauccacaccagcaccuuguuac

SEQ ID NO: 585580 - RNA, 62 nt, hsa
gaaaugauaaucagaaaagacuguaaauagauccauccaaaugauuucucuguacaaaugaa

SEQ ID NO: 585581 - RNA, 62 nt, hsa
ugggguaggguggaguggggagggauuaaaacccauccaaaaaauaaauaaaaacuauauag

SEQ ID NO: 585582 - RNA, 62 nt, hsa
aaaguacugaaaugaguauaaggcaguaucacccauccaaaagaaaggucuuuauagaccug

SEQ ID NO: 585583 - RNA, 62 nt, hsa
uaagucuguuucugaaauagucaauagucuucccauccaaacuauaagagaaugugaauuuc

SEQ ID NO: 585584 - RNA, 62 nt, hsa
aggggcugggacuggggagggggcagccaccuccauccaaggcucuuccuaggggcccugcu

SEQ ID NO: 585585 - RNA, 62 nt, hsa
ugugccuuggacauggugauggugauggguugccauccaagugaaagucuuuuccuugacca

SEQ ID NO: 585586 - RNA, 62 nt, hsa
gugcuaugccuggaggcucaacacaaaacuucccauccaaacauucagaugaacugagcguc

SEQ ID NO: 585587 - RNA, 62 nt, hsa
caagcuucucgcccacuccacggcucugagccccauccaagggcaagacuuggugcccagcu

SEQ ID NO: 585588 - RNA, 62 nt, hsa
uuaucuuaaaacuauacaguuacaucuuaauuccauccaaagaagauacaguuugaagacag

SEQ ID NO: 585589 - RNA, 62 nt, hsa
ggugcuuccguggggcaugagaauuucccgggccauccaagcccaaggaccugggauaaacu

SEQ ID NO: 585590 - RNA, 62 nt, hsa
uggggcuucugugaaaaaccugaugcagugcuccauccaaacucagaaggcuuugggauaug

SEQ ID NO: 585591 - RNA, 62 nt, hsa
cuuuuucucucaggguucugagucagaggacaccauccaagaauguuguuagcuuuucaguu

SEQ ID NO: 585592 - RNA, 62 nt, hsa
guggacucaacgcagaagaauggacgaaaugaccauccaacgugauuaaggauaggaaucgg

SEQ ID NO: 585593 - RNA, 62 nt, hsa
uagcacccuuuacugcuguguauggggcuucaccauccaagaggugguagguuggaguaaga

SEQ ID NO: 585594 - RNA, 62 nt, hsa
agacuccucuuccuccuggaccccauccucuaccauccaagcccugucccacuuuggcccua

SEQ ID NO: 585595 - RNA, 62 nt, hsa
cucccccaguguuggagugcaaggaggcggggccauccaaagcaacgcugaaggccuuuucc

SEQ ID NO: 585596 - RNA, 62 nt, hsa
cugaaggcuacugcaggucacugaguugccugccauccaaaggggaugggcgggauuggaag

SEQ ID NO: 585597 - RNA, 62 nt, hsa
agcagccaccugccugcuccuaugugcccucaccauccaauaaaggccccuuggcuguggca

SEQ ID NO: 585598 - RNA, 62 nt, hsa
aggaacaccaaggccauuucaauuuugcagcaccauccaagaaacuacuaccuaucaagaau

SEQ ID NO: 585599 - RNA, 62 nt, hsa
uuuuuuuguacugggccuuuaaaaaaauaaauccauccaacuuuaacacaacauuucucagu

SEQ ID NO: 585600 - RNA, 62 nt, hsa
cuaguguucauguguucuuuauaaaauuucucccauccaaguacuaaccaggcccgacccug

SEQ ID NO: 585601 - RNA, 62 nt, hsa
accuaggggaaaaccugccagagaagaauaaaccauccaagagacggcgcugcagggccuca

SEQ ID NO: 585602 - RNA, 62 nt, hsa
uacccaucuacucaaauaucugauuuaucucaccauccaauuaucuacccaccugucuuccu

SEQ ID NO: 585603 - RNA, 62 nt, hsa
uacagcccuggccuccacccccaccccgccgaccauccaagggagagugagaccuggcagcc

SEQ ID NO: 585604 - RNA, 62 nt, hsa
uagauuuggggcucagaaggcccugcucucucccauccaagugaccagaugcccuacucagc

SEQ ID NO: 585605 - RNA, 62 nt, hsa
auuggaucugugccuguaauaucaggauacuaccauccaaaucuaucuagauaucuugugca

SEQ ID NO: 585606 - RNA, 62 nt, hsa
cuaagucucuagccucuuucucccuucugcucccauccaagaaagacaguguauaaggaaca

SEQ ID NO: 585607 - RNA, 62 nt, hsa
gguaugauucuauuauauauuuuauauaaaauccauccaaauuaaguuuuggguaagugugu

SEQ ID NO: 585608 - RNA, 62 nt, hsa
uaaacagaugacauuuucugaccaggcacaugccauccaauuuucugucaaucacacuguug

SEQ ID NO: 585609 - RNA, 62 nt, hsa
caugaucauuugcaaaccucccccagccccuaccauccaauguggaaggaaaacaagaacug

SEQ ID NO: 585610 - RNA, 62 nt, hsa
aaaagcauggacugugccacacacccagugauccauccaaaaacaaggacugcagccuaaau

SEQ ID NO: 585611 - RNA, 62 nt, hsa
gaaguaaucccgccaccuaucucgugggagagccauccaaauaagaaaccuaaaauaauugg

SEQ ID NO: 585612 - RNA, 62 nt, hsa
uguugauagcagauggaucaauauuaguaaccccauccaagauugaacugugaaagagaggu

SEQ ID NO: 585613 - RNA, 62 nt, hsa
ggauuugagagcuggagcccaucuuucugccuccauccaaagaggccuuuuaacucagccuc

SEQ ID NO: 585614 - RNA, 62 nt, hsa
accagugagcagagcccucaugugacaugaacccauccaauggauugugcaaauccccuccc

SEQ ID NO: 585615 - RNA, 62 nt, hsa
gcucccuccagacaaugccagcauaaauccauccauccaaaggcagagaaccaaaggggcca

SEQ ID NO: 585616 - RNA, 62 nt, hsa
uggauucaguuuugugaaaauggauucuguggccauccaagggauguaucagggaugaucag

SEQ ID NO: 585617 - RNA, 62 nt, hsa
uuccuaccaguuucucagaauuacacgcacgaccauccaaacauuggcuccaugccagggcu

SEQ ID NO: 585618 - RNA, 62 nt, hsa
cucaccccugggcaagaggcuggaaguucacaccauccaaaauuuauccuuguuuuuuuucu

SEQ ID NO: 585619 - RNA, 62 nt, hsa
ugggcucuucucuggccucuucaccagggcacccauccaaggaaccuccgaacagccaggaa

SEQ ID NO: 585620 - RNA, 62 nt, hsa
agaucagagccagaucagccuuaagucaccucccauccaagaacuuggccuaaaaauacucc

SEQ ID NO: 585621 - RNA, 62 nt, hsa
gcagauaucaagaguuuguuauuuucaaauacccauccaacaagagagauggggagguuuuu

SEQ ID NO: 585622 - RNA, 62 nt, hsa
gcuaacacgggcaagagggaaagaaaggcuaaccauccaaacagggauacaggggaggcggu

SEQ ID NO: 585623 - RNA, 62 nt, hsa
ugugcuccucuggccaggaaagggaacagaguccauccaagcugccccccacucaucugcca

SEQ ID NO: 585624 - RNA, 62 nt, hsa
cagugacugggacccuacucuagaacuguguaccauccaauucgccaucauaaaggaaucuu

SEQ ID NO: 585625 - RNA, 62 nt, hsa
gccuguguugcagaccauuucugaggucuccaccauccaaggaggcacagccgucauuacug

SEQ ID NO: 585626 - RNA, 62 nt, hsa
ucuuuuuucauucagcauaauucccuugaaauccauccaaguuguugcauguaugaauaguu

SEQ ID NO: 585627 - RNA, 62 nt, hsa
acaaagagaaaucucuaaaagaauaugaucuuccauccaaguggagggaaacuuuaaaacaa

SEQ ID NO: 585628 - RNA, 62 nt, hsa
cuuauuuuauuuuaccuucaaaaacaaaaacgccauccaaaaccaaggaaguccuugguguu

SEQ ID NO: 585629 - RNA, 62 nt, hsa
cccacggggacaucaguaaccuucugcagccaccauccaaugccauuacugucaagugagac

SEQ ID NO: 585630 - RNA, 62 nt, hsa
aucaguuugaggaaguggcugucccuguggccccauccaaccacuguacacacccgccugac

SEQ ID NO: 585631 - RNA, 62 nt, hsa
acccaaacuuuacucugggagguaggcuaugcccauccaaauaaaucuccaugagaaacuug

SEQ ID NO: 585632 - RNA, 62 nt, hsa
cucuuuuucugcacugccauauucacccccaaccauccaaucuguggauaauuggauguuag

SEQ ID NO: 585633 - RNA, 62 nt, hsa
uacugagcucuccacucuguuucccgccugggccauccaaccuugaaguccuaaaccacacc

SEQ ID NO: 585634 - RNA, 62 nt, hsa
auccucccacccagucugccccuggucucugcccauccaaucagagcccacccuccuggaag

SEQ ID NO: 585635 - RNA, 62 nt, hsa
uccgauaacuuaaaaacguagcucaucccuuaccauccaaggggcacucccuugguuggauu

SEQ ID NO: 585636 - RNA, 62 nt, hsa
cacccaagacacaguacccagucaugguuuccccauccaacuauuaguuucauacuuugaaa

SEQ ID NO: 585637 - RNA, 62 nt, hsa
caagauccucuugccacaucuugaaaaugccaccauccaauaaaaaucaggagccugcuaag

SEQ ID NO: 585638 - RNA, 62 nt, hsa
auccagggacuugaagaaagacuaggugugucccauccaaguugagcacgcgccuuccccag

SEQ ID NO: 585639 - RNA, 62 nt, hsa
uggaugggccaccgccuugcccagccuggaugccauccaaguuguauauuuuuuuaaucucu

SEQ ID NO: 585640 - RNA, 62 nt, hsa
ucucagagaaucagcuaaguuuccuaacuuguccauccaaaugugaucaccacgauucaaca

SEQ ID NO: 585641 - RNA, 62 nt, hsa
aguggagaauuguggaaggauuguaacauggaccauccaaauuuauggccguaucaaauggu

SEQ ID NO: 585642 - RNA, 62 nt, hsa
gugugaagggacugcuguuugcaaugggcuuaccauccaaauaucccaaaggcuuugaccag

SEQ ID NO: 585643 - RNA, 62 nt, hsa
guucugcccaaauuccgauaucaccccuucccccauccaagcauccuucgauuagggaagug

SEQ ID NO: 585644 - RNA, 62 nt, hsa
auuuccaguacauucuuucagagucuguuuuuccauccaaauauaagccccaggccauucca

SEQ ID NO: 585645 - RNA, 62 nt, hsa
ccccagugcgcuuccucuguucccucccucagccauccaauucuugaguuuucucacugauu

SEQ ID NO: 585646 - RNA, 62 nt, hsa
guagggggaaaaucaguucuuucagcuaccacccauccaaccuuugggccuaugugaaaaga

SEQ ID NO: 585647 - RNA, 62 nt, hsa
cauggugucaggaaggcugagauguauugguuccauccaacaccugaaaagcaaauuuggca

SEQ ID NO: 585648 - RNA, 62 nt, hsa
cauggugucuggaaggcuuagaugcauuggcuccauccaacaccugaaaaacaaacuuggca

SEQ ID NO: 585649 - RNA, 62 nt, hsa
gaguaguggcaacagcccuuccguccacacucccauccaaggaggguucuuccuuccugugg

SEQ ID NO: 585650 - RNA, 62 nt, hsa
acuuuuagaaaucuucucugaccuagaagaauccauccaaaucccugccuuccucucugaac

SEQ ID NO: 585651 - RNA, 62 nt, hsa
agguccucaagugcucgugacacauaaucauuccauccaaugaucgccuuugcuuuaccacu

SEQ ID NO: 585652 - RNA, 62 nt, hsa
ugcaacucagagcugcugcacucaggagggccccauccaaucccgggccccugcagggaaaa

SEQ ID NO: 585653 - RNA, 62 nt, hsa
uccugcuguguguccuguuccauguuccgguuccauccaaauacacuuucuggaacaaaugc

SEQ ID NO: 585654 - RNA, 62 nt, hsa
augcaugccugaugaccaaacucucccuuuccccauccaaucgguccacacuccccgcccug

SEQ ID NO: 585655 - RNA, 62 nt, hsa
aaaagauuguggccaagaagagugaaugugucccauccaaaggugcauccagauaugucugu

SEQ ID NO: 585656 - RNA, 62 nt, hsa
gcuccauccaucccuccugggcgccagacccuccauccaagcccugugucuuuccauaguca

SEQ ID NO: 585657 - RNA, 62 nt, hsa
cacuaacaggagccaggguuaggauucaaaccccauccaacuggucccagagcuggagcuuc

SEQ ID NO: 585658 - RNA, 62 nt, hsa
agggcccugcugggacaugggggccugagugcccauccaagggcucucaaggacaccggcaa

SEQ ID NO: 585659 - RNA, 62 nt, hsa
augcgugccugaugaccaaacucucccuuucuccauccaaucgguccacacuccccgccccc

SEQ ID NO: 585660 - RNA, 62 nt, hsa
gcuauuucaacuaaagcagauuaaccugaaauccauccaaguuguucugcauaucauuguuc

SEQ ID NO: 585661 - RNA, 62 nt, hsa
agucccucaugcuaccuuuuuaugcuuacacuccauccaaaccuaacucugccaaccacuuu

SEQ ID NO: 585662 - RNA, 62 nt, hsa
ugcacuauguucacuuugggguugguucucagccauccaagggucuccagugagguggcugc

SEQ ID NO: 585663 - RNA, 62 nt, hsa
ucauggacccagauggggcuuucccuuuguagccauccaaugggcauugugugggugcuugg

SEQ ID NO: 585664 - RNA, 57 nt, hsa
acaaagcaagcaggcuuuagaccuccaccauccaaagcucaugcccggcaguggacu

SEQ ID NO: 585665 - RNA, 62 nt, hsa
uugguuuaguggauguucguggaauugcugacccauccaagggcguccuuuggagccagugg

SEQ ID NO: 585666 - RNA, 62 nt, hsa
aggagaccacaaagguuucacuucuuuuagauccauccaauaugcgaaaaaaggguacauuu

SEQ ID NO: 585667 - RNA, 62 nt, hsa
aauauggagugauauaguuuggcucugugucuccauccaaaucucaucuuaaauuguaaucu

SEQ ID NO: 585668 - RNA, 62 nt, hsa
aggacauauauuuuguauuuuccccucacccaccauccaauaaugaguaauagcacaaagua

SEQ ID NO: 585669 - RNA, 62 nt, hsa
aggcuuuccugagcaagugacaaucuaaccugccauccaaaugauaaauugcuaauuaagca

SEQ ID NO: 585670 - RNA, 62 nt, hsa
aaaucccuaguugauaggguuuggcuguguccccauccaaaucucaucuugaauuguucccg

SEQ ID NO: 585671 - RNA, 62 nt, hsa
cagaaugaauugucugguagcccuguccugacccauccaagcgcuguuggggcuggugguga

SEQ ID NO: 585672 - RNA, 62 nt, hsa
uauuuggacugcauuaauuggucauugacuggccauccaauuaccauuuuuucuuucagucc

SEQ ID NO: 585673 - RNA, 62 nt, hsa
cucugcuuccuguagacacgcacacguugucuccauccaauggccuuuucugaaguuacaga

SEQ ID NO: 585674 - RNA, 62 nt, hsa
aaaugcuggaaaacuguaaagacuuccaggucccauccaaggagauuuugcuucugauugac

SEQ ID NO: 585675 - RNA, 62 nt, hsa
auaaauugaguccuaaguauuaauuauugccaccauccaacucauugagucuuaugguucac

SEQ ID NO: 585676 - RNA, 62 nt, hsa
gauuauugagucguaaguauuaauuauugccaccauccaacucauugagucuuaugguucac

SEQ ID NO: 585677 - RNA, 62 nt, hsa
ccacagugccaguuccuugccccaaccuggccccauccaaguacagaagaccuuccuuuccu

SEQ ID NO: 585678 - RNA, 62 nt, hsa
caaguccuguaacuuccccaggcuccauucccccauccaagaguugggguaaugggaacugg

SEQ ID NO: 585679 - RNA, 62 nt, hsa
ccagcaggacuccaggaugguucagcccagcaccauccaaagggugggagcacaucugcccu

SEQ ID NO: 585680 - RNA, 62 nt, hsa
ugaggguccugguuccagcagagcacuggggcccauccaaguuuguucugccaccacuggau

SEQ ID NO: 585681 - RNA, 62 nt, hsa
gccccuuccuccuuccauucugcauccccuccccauccaaccuaaaugccacagcuggggcu

SEQ ID NO: 585682 - RNA, 62 nt, hsa
ccucugucacccagcuauccucgcacucaaagccauccaaccucagcaggccuucucgggcc

SEQ ID NO: 585683 - RNA, 62 nt, hsa
gcccucccagaaccucagcauuuccuuccagcccauccaaacacugaggcagccuuggggaa

SEQ ID NO: 585684 - RNA, 62 nt, hsa
aaaaugaucaaucaagauaaaaggugaucuauccauccaauggaauauuauuuggccuuaaa

SEQ ID NO: 585685 - RNA, 62 nt, hsa
ucaccucuuccuggaagccuuccucuuuuccaccauccaaaacccucuuaauacccugugua

SEQ ID NO: 585686 - RNA, 62 nt, hsa
agagggaaagaucguaaggaugagagaggagaccauccaagccagaaauuauuuaauaaauc

SEQ ID NO: 585687 - RNA, 62 nt, hsa
uguucagggagccuugcaguguuauacgcgugccauccaaauuaauccugcauuugcagaug

SEQ ID NO: 585688 - RNA, 62 nt, hsa
uauuuuuccgaacaauccuuguagaguauguaccauccaaaggcaggagggccucgccgugg

SEQ ID NO: 585689 - RNA, 62 nt, hsa
agcacaaaagucuugauagcacaacacaaauuccauccaagaggagaaucuuccccaggguu

SEQ ID NO: 585690 - RNA, 62 nt, hsa
aauccguuuauauuagcacuguaucccuugugccauccaacauuuuguauguuuuuguaaac

SEQ ID NO: 585691 - RNA, 62 nt, hsa
aaccaauagucucaaaguaaaaacaaccaccaccauccaacaaaaggauuacgucugcaucu

SEQ ID NO: 585692 - RNA, 62 nt, hsa
ugccauaaauuauguggcucauaguaggugcaccauccaaggagaaggucccuuuuuccaac

SEQ ID NO: 585693 - RNA, 62 nt, hsa
ugcuuuagucauauaugaauuuaaaccuaguaccauccaaaaccauguaauggauuuuaaga

SEQ ID NO: 585694 - RNA, 63 nt, hsa
uuaagucuuuuaccaaaagugucuguacagcagccauccaaguugccccuacuuaguggcuug

SEQ ID NO: 585695 - RNA, 63 nt, hsa
gaaguuggcugagccauugagugcugggggaggccauccaagauggcaugaaucgggcuaagg

SEQ ID NO: 585696 - RNA, 63 nt, hsa
ccuccgcacucaccugccgggacccucccuauuccauccaagggaagcagaacugccaaagac

SEQ ID NO: 585697 - RNA, 63 nt, hsa
uaggaacuaaccuaccccaacucugcccuucucccauccaagagaaaccagcaaaaugauaaa

SEQ ID NO: 585698 - RNA, 63 nt, hsa
ggccugaugugguacgucccuccacccccggacccauccaagucaucugauugaagagcauga

SEQ ID NO: 585699 - RNA, 63 nt, hsa
auuaugaccuaaaucuaauuuacuuccacugaaccauccaagaccucuggcaggcagggaaau

SEQ ID NO: 585700 - RNA, 63 nt, hsa
aauuuuuucuugguaggaaaaauuauacugaacccauccaaaccugaagucacagaugaugug

SEQ ID NO: 585701 - RNA, 63 nt, hsa
gcuucaauccugaacgucacugacuugcugugaccauccaaauaauuuuccugucucugccuc

SEQ ID NO: 585702 - RNA, 63 nt, hsa
auuucugaaaaccuaccauguuucuuuacagagccauccaaaaauuuuuugucccuacauagc

SEQ ID NO: 585703 - RNA, 63 nt, hsa
gggucaguggucugugccaaccaaacgauagccccauccaagccagcugagaaccuaggaagg

SEQ ID NO: 585704 - RNA, 63 nt, hsa
aguuaggacaugcuaucaguaauagucccaguuccauccaacuuucugaaauuucauuuuuuu

SEQ ID NO: 585705 - RNA, 63 nt, hsa
accggcagcagcuaggcagucaccggcccgccuccauccaaaaucacgcucgcgugcuucgga

SEQ ID NO: 585706 - RNA, 63 nt, hsa
caucugcaguuucaucccuaccuuguucacauaccauccaagaggcacauaggcuacccaaga

SEQ ID NO: 585707 - RNA, 63 nt, hsa
gugguuaauugcuaagaguaaauacuacuuuagccauccaaggccaccuucugcagcaaaagg

SEQ ID NO: 585708 - RNA, 63 nt, hsa
uagauuugauaagcuagaugcaguagaccgaaaccauccaaaaccuguuuagcuucuuccucc

SEQ ID NO: 585709 - RNA, 63 nt, hsa
gucugaaugccgagucccugaauucacccaggaccauccaaggggccaccgcagcauuggccc

SEQ ID NO: 585710 - RNA, 63 nt, hsa
gucucucuuaccuuuagcugcuugaucauuaagccauccaacuucaugccaguucccuucuuu

SEQ ID NO: 585711 - RNA, 63 nt, hsa
gguugaaccuaaagaaauggaugacuggacaaaccauccaaauaaugauaaagucuauucauc

SEQ ID NO: 585712 - RNA, 63 nt, hsa
ucuuucuuucuuuuuuuuuaaauuuuguauuuuccauccaacagcaguguguagagagaauau

SEQ ID NO: 585713 - RNA, 63 nt, hsa
gaaugccagggacagugugcucaguaaagucuuccauccaaaaggggcagggcacgguggcuc

SEQ ID NO: 585714 - RNA, 63 nt, hsa
auaugguagaauuuuauaaacacauacaugauaccauccaaauucuugcuuuuaauaacaaag

SEQ ID NO: 585715 - RNA, 63 nt, hsa
gggugucuugggcagagcuggcucugagcgccuccauccaaggccagguucuccguuagcucc

SEQ ID NO: 585716 - RNA, 63 nt, hsa
ggaccaugagugacaaccaucacgucaggcugcccauccaauagacuccugggauggggcagc

SEQ ID NO: 585717 - RNA, 63 nt, hsa
uaguuaaguauagcaauucaaacugaccugcauccauccaaaacaaauuccuccuucaaccuu

SEQ ID NO: 585718 - RNA, 63 nt, hsa
agucuuguccuuggcagaacuggacacuauugaccauccaaauggaaauuccccuuucuuggu

SEQ ID NO: 585719 - RNA, 63 nt, hsa
ucacuacaguuauaggaaguuucagucuacaguccauccaaaggaccaaccugccuuacacau

SEQ ID NO: 585720 - RNA, 63 nt, hsa
aaagggggaauauaugcaaugguuggcauuuaaccauccaaacaaaucauacaagaaaguuuu

SEQ ID NO: 585721 - RNA, 63 nt, hsa
gagauguuuggcaagaaauccccuaacugauuuccauccaaaccuaccuuauagagcacaaua

SEQ ID NO: 585722 - RNA, 63 nt, hsa
aggaaaugaaagcuaaaacaacccauuugcuacccauccaaagcacuuacaguuuagcaaaua

SEQ ID NO: 585723 - RNA, 63 nt, hsa
cuuugcauauaucuagcuacucccuaaaugguuccauccaaggcuuagaguacccaaaggcua

SEQ ID NO: 585724 - RNA, 63 nt, hsa
caacgaagaaugaaaaaaagccuagucagacucccauccaaaguaggaacuaucucuuuaaca

SEQ ID NO: 585725 - RNA, 63 nt, hsa
cugcaucaagucugcguggccauccuccccccaccauccaagacuauuagguuuugucccugc

SEQ ID NO: 585726 - RNA, 63 nt, hsa
ugacuggagcaucuucugcacaaccuugggagcccauccaaggguuggugaggacuggucucc

SEQ ID NO: 585727 - RNA, 63 nt, hsa
cuauuucuugauauaacacucauuuaauuguggccauccaaaugaauauuauugcagaauuua

SEQ ID NO: 585728 - RNA, 63 nt, hsa
guuugccuagaggagacuaauucucuuucuagcccauccaaauuugauaaauggaaccagagg

SEQ ID NO: 585729 - RNA, 63 nt, hsa
gugcccucaucauaaauaucaucucuagcacugccauccaauuuaguucaauaaaauucaaau

SEQ ID NO: 585730 - RNA, 63 nt, hsa
ugugaaaucaaugcguggauaaaggaacacaugccauccaagugaugauggcuuuuccuggag

SEQ ID NO: 585731 - RNA, 63 nt, hsa
acagcgauucugcagcaccggccucgggaagccccauccaacacuggauggucaucucggagu

SEQ ID NO: 585732 - RNA, 63 nt, hsa
uuuauucuauuuuaagccuucuaucauauuuucccauccaauuguuugguuucagugguccag

SEQ ID NO: 585733 - RNA, 63 nt, hsa
cauugguuacuccugcagaguguaaucagcaccccauccaacuggcccgaaagcccagaccug

SEQ ID NO: 585734 - RNA, 63 nt, hsa
cgauacugcuguuucucgagguaagagauucagccauccaauugguuuuaggucuugcauauc

SEQ ID NO: 585735 - RNA, 63 nt, hsa
cugaaucuucucaggcaguucagauuuaaagcaccauccaaaccuuggaaauacgacagggug

SEQ ID NO: 585736 - RNA, 63 nt, hsa
uguguucaugcacggaacugaugucauuagacaccauccaaggaugggcagccugcagugugg

SEQ ID NO: 585737 - RNA, 63 nt, hsa
gcuaggacaccaaaagaccuagcugggcuaacuccauccaaaugauuuuacaguuuuauuuuu

SEQ ID NO: 585738 - RNA, 63 nt, hsa
acaggucugcaaaaacaaaaauuauaaacuaguccauccaagaaccaaaguuuguauaaacag

SEQ ID NO: 585739 - RNA, 63 nt, hsa
cuguuuauucccugugaugcccagaguaauggcccauccaaagauguccagauguccaugugc

SEQ ID NO: 585740 - RNA, 63 nt, hsa
aguauuacuauuaacugacuucagaaguaccugccauccaauacggucauuagauugggucau

SEQ ID NO: 585741 - RNA, 63 nt, hsa
gaaugcauugguguuuaacuaagggccauccaaccauccaaccuuuaaaaaacaaaacgaaag

SEQ ID NO: 585742 - RNA, 63 nt, hsa
uaccauuugaaugcauugguguuuaacuaagggccauccaaccauccaaccuuuaaaaaacaa

SEQ ID NO: 585743 - RNA, 61 nt, hsa; identical to SEQ ID NO: 585527

SEQ ID NO: 585744 - RNA, 63 nt, hsa
gcccaggagguuucuuucaaacaucauggccucccauccaaucaacaucaucaaauuacaugu

SEQ ID NO: 585745 - RNA, 63 nt, hsa
aucucaaacuaugacagaaaaguaauguaaaauccauccaaucuauuauuucucuaauuaugc

SEQ ID NO: 585746 - RNA, 63 nt, hsa
aaaccuguacaaauauguuuauguauuaaaucaccauccaaaauauuuaaggaauauauaaaa

SEQ ID NO: 585747 - RNA, 63 nt, hsa
aaaaaacucucauuauggugaucauagaauugaccauccaaacugggacacucuugagaguaa

SEQ ID NO: 585748 - RNA, 63 nt, hsa
ggcuguucugcuucagcugguagcugauaaggaccauccaaaauucaaggaaauucagaaucu

SEQ ID NO: 585749 - RNA, 63 nt, hsa
aaauucugggauuacaggcauaagccaaugugcccauccaaaguuuuauuuauuuauuuuuuu

SEQ ID NO: 585750 - RNA, 63 nt, hsa
uugaauaugcaaaagcaguuccgcugggaacccccauccaaucaacugcuguacccauggggg

SEQ ID NO: 585751 - RNA, 63 nt, hsa
cauuuacuguuuuuuucuguagcaccagagaauccauccaaaguucccuaugaaaaauguguu

SEQ ID NO: 585752 - RNA, 63 nt, hsa
cguucaccggacaccgcaccagacccucaaaacccauccaagacugugggaggaguaaacaac

SEQ ID NO: 585753 - RNA, 63 nt, hsa
ggcuggaccuaaauagauugauuucauuucuaaccauccaauucugcauguauucauaauucu

SEQ ID NO: 585754 - RNA, 63 nt, hsa
aacuuuggaauaaggaagagaagauugaccaaaccauccaaaugccaaaaagaaaaagaaaaa

SEQ ID NO: 585755 - RNA, 63 nt, hsa
ucuuuccuuggacaguagcaacuagucagaagaccauccaagauagaugcagcugauacauuc

SEQ ID NO: 585756 - RNA, 63 nt, hsa
ggccugggugaguucuguuugcuccuuguaccaccauccaaaugguguuaucaaaucucuuag

SEQ ID NO: 585757 - RNA, 63 nt, hsa
acaugauaaggugguucuuucauaacucuaaugccauccaacauagcccugggagaggcaugu

SEQ ID NO: 585758 - RNA, 63 nt, hsa
uuguuccccuggccccccacucucccuccauguccauccaaaaaccauaaaaucacuggguuc

SEQ ID NO: 585759 - RNA, 63 nt, hsa
ucugucuccugucuucagagcaaaagacuugagccauccaaagaaacacuaagcucucugggc

SEQ ID NO: 585760 - RNA, 63 nt, hsa
cccugcgucacacugugugaggcugugucucugccauccaaaagggggccccuugagaauggu

SEQ ID NO: 585761 - RNA, 63 nt, hsa
uguccaaaagugaucuggucggaucucacaaggccauccaaugagaccccgcacagcauuuuc

SEQ ID NO: 585762 - RNA, 63 nt, hsa
acaaaugaagacaaaacauacauuuuguaccaaccauccaauuagcuuauguuaacugacaag

SEQ ID NO: 585763 - RNA, 63 nt, hsa
auggagagagggcgcagagcaaaccaugucacgccauccaaugacaccagcuggucagcucac

SEQ ID NO: 585764 - RNA, 63 nt, hsa
agucuucuguaccaaugcaccagagaaugccuaccauccaaaaaagcagucagcugauggaaa

SEQ ID NO: 585765 - RNA, 63 nt, hsa
gauccaggacugcaccccacccccaccguccagccauccaaccucacuucgccuuacaggucu

SEQ ID NO: 585766 - RNA, 63 nt, hsa
cccccugacauuaucuuggauccuaugguuucuccauccaauucuuugaauuucccagucucc

SEQ ID NO: 585767 - RNA, 63 nt, hsa
uuccagaccagaguuugaugccagcagcuucggccauccaaacagaggaugcucagauuucuc

SEQ ID NO: 585768 - RNA, 63 nt, hsa
ccacgccuggugaaggagccugggugagaaacaccauccaaagcuggggcaaagaugauuacc

SEQ ID NO: 585769 - RNA, 63 nt, hsa
uccaucagggaaaugagcugaauggccccagcaccauccaaguugacacagcuaaaggaauaa

SEQ ID NO: 585770 - RNA, 63 nt, hsa
aaaugaaaggcuuuaguuauuucuagaggagucccauccaacacuauuuggcgacuguuaaua

SEQ ID NO: 585771 - RNA, 63 nt, hsa
uccucuccaucuacuuuucccugugcauaauauccauccaaaggacaacaguggcaaagcuga

SEQ ID NO: 585772 - RNA, 63 nt, hsa
caguguuuuaaacucuccuagucaauauccaccccauccaauuuaucaaggaagaaaugguuc

SEQ ID NO: 585773 - RNA, 63 nt, hsa
ggugcaaaaaagugguggaacaaauaccaacauccauccaaaaugaaaaagaacaggaaauuc

SEQ ID NO: 585774 - RNA, 63 nt, hsa
ccauauuuuaaaucaacuacuccacguguuuuuccauccaaucacacugcugugauucaggga

SEQ ID NO: 585775 - RNA, 63 nt, hsa
agggcacaaaauccaagagaaggucugugagccccauccaacacccacaguaauuauuaucug

SEQ ID NO: 585776 - RNA, 63 nt, hsa
ugccacagcugugagggccaagaugcuguccccccauccaaaacccgugcgccacugcaguga

SEQ ID NO: 585777 - RNA, 63 nt, hsa
cauguuuuaaccucuuuuuuuuuucuaauuauuccauccaaaauuucuggugaauuacacaga

SEQ ID NO: 585778 - RNA, 63 nt, hsa
cuuuaccauaguacucccacccacuuccaucacccauccaauaaaaugcagccagguuuagcc

SEQ ID NO: 585779 - RNA, 63 nt, hsa
uuguuuuaaguuauauauacacaucuuauugaaccauccaaaaaucauugcuuuuaacuguuu

SEQ ID NO: 585780 - RNA, 55 nt, hsa; identical to SEQ ID NO: 585564

SEQ ID NO: 585781 - RNA, 63 nt, hsa
ucaaaugugggcccagccuaggucagccaacccccauccaacccuuagacucacgaacaaauc

SEQ ID NO: 585782 - RNA, 63 nt, hsa
guuuaacagcuguaaccaaugguacugaucuauccauccaauguugucauuauauuugacugu

SEQ ID NO: 585783 - RNA, 63 nt, hsa
cucccacccuaagucuuacauaaugccaccaguccauccaaaaccuauauaucaccuauacua

SEQ ID NO: 585784 - RNA, 63 nt, hsa
cauucaaugugagacacuauccaugauuuaagcccauccaaaaagaagggaggaaacguccau

SEQ ID NO: 585785 - RNA, 63 nt, hsa
cgccaaggaccugcaagggacugaaggcggagcccauccaacccucgcccgacccaaacaccu

SEQ ID NO: 585786 - RNA, 63 nt, hsa
accucucaggcucaagcgauucucccaccucagccauccaaauagcugggaccacaggugugc

SEQ ID NO: 585787 - RNA, 63 nt, hsa
auugucacaugaccgguacuggaagaaacucucccauccaacaucacccaguggauggaacau

SEQ ID NO: 585788 - RNA, 63 nt, hsa
gugaguaaccagauagcaaaagaaaagggaaagccauccaaauuugaaagcuguugauagaaa

SEQ ID NO: 585789 - RNA, 63 nt, hsa
aaacacaauguauagccagagaaggagaagcucccauccaaauccuacuaggaagagaguggg

SEQ ID NO: 585790 - RNA, 63 nt, hsa
uggcuuccuuguuuauggggcucucacagauacccauccaacuccucuagucagcacuagauc

SEQ ID NO: 585791 - RNA, 63 nt, hsa
cugagagacagaauucaaguggguauucuggggccauccaauuucucuuuacuugaaauuugg

SEQ ID NO: 585792 - RNA, 63 nt, hsa
caccuucccugucgaucccuucugagguauggcccauccaagacuuuuaggccauucuugaug

SEQ ID NO: 585793 - RNA, 63 nt, hsa
ggccuggcaccuccauccugaggugcugccccuccauccaaaacugccaagugacucauugcc

SEQ ID NO: 585794 - RNA, 63 nt, hsa
uaccuggauauaaauuaauugugccugccaccaccauccaacagaccuggugcucuaaugcca

SEQ ID NO: 585795 - RNA, 63 nt, hsa
gcacaugucagggaagcacccagugucggcuccccauccaaauccacaccagcaccuuguuac

SEQ ID NO: 585796 - RNA, 63 nt, hsa
ggaaaugauaaucagaaaagacuguaaauagauccauccaaaugauuucucuguacaaaugaa

SEQ ID NO: 585797 - RNA, 63 nt, hsa
uugggguaggguggaguggggagggauuaaaacccauccaaaaaauaaauaaaaacuauauag

SEQ ID NO: 585798 - RNA, 63 nt, hsa
aaaaguacugaaaugaguauaaggcaguaucacccauccaaaagaaaggucuuuauagaccug

SEQ ID NO: 585799 - RNA, 63 nt, hsa
auaagucuguuucugaaauagucaauagucuucccauccaaacuauaagagaaugugaauuuc

SEQ ID NO: 585800 - RNA, 63 nt, hsa
gaggggcugggacuggggagggggcagccaccuccauccaaggcucuuccuaggggcccugcu

SEQ ID NO: 585801 - RNA, 63 nt, hsa
cugugccuuggacauggugauggugauggguugccauccaagugaaagucuuuuccuugacca

SEQ ID NO: 585802 - RNA, 63 nt, hsa
agugcuaugccuggaggcucaacacaaaacuucccauccaaacauucagaugaacugagcguc

SEQ ID NO: 585803 - RNA, 63 nt, hsa
ucaagcuucucgcccacuccacggcucugagccccauccaagggcaagacuuggugcccagcu

SEQ ID NO: 585804 - RNA, 63 nt, hsa
uuuaucuuaaaacuauacaguuacaucuuaauuccauccaaagaagauacaguuugaagacag

SEQ ID NO: 585805 - RNA, 63 nt, hsa
gggugcuuccguggggcaugagaauuucccgggccauccaagcccaaggaccugggauaaacu

SEQ ID NO: 585806 - RNA, 63 nt, hsa
uuggggcuucugugaaaaaccugaugcagugcuccauccaaacucagaaggcuuugggauaug

SEQ ID NO: 585807 - RNA, 63 nt, hsa
gcuuuuucucucaggguucugagucagaggacaccauccaagaauguuguuagcuuuucaguu

SEQ ID NO: 585808 - RNA, 63 nt, hsa
aguggacucaacgcagaagaauggacgaaaugaccauccaacgugauuaaggauaggaaucgg

SEQ ID NO: 585809 - RNA, 63 nt, hsa
cuagcacccuuuacugcuguguauggggcuucaccauccaagaggugguagguuggaguaaga

SEQ ID NO: 585810 - RNA, 63 nt, hsa
uagacuccucuuccuccuggaccccauccucuaccauccaagcccugucccacuuuggcccua

SEQ ID NO: 585811 - RNA, 63 nt, hsa
ucucccccaguguuggagugcaaggaggcggggccauccaaagcaacgcugaaggccuuuucc

SEQ ID NO: 585812 - RNA, 63 nt, hsa
acugaaggcuacugcaggucacugaguugccugccauccaaaggggaugggcgggauuggaag

SEQ ID NO: 585813 - RNA, 63 nt, hsa
uagcagccaccugccugcuccuaugugcccucaccauccaauaaaggccccuuggcuguggca

SEQ ID NO: 585814 - RNA, 63 nt, hsa
aaggaacaccaaggccauuucaauuuugcagcaccauccaagaaacuacuaccuaucaagaau

SEQ ID NO: 585815 - RNA, 63 nt, hsa
auuuuuuuguacugggccuuuaaaaaaauaaauccauccaacuuuaacacaacauuucucagu

SEQ ID NO: 585816 - RNA, 63 nt, hsa
gcuaguguucauguguucuuuauaaaauuucucccauccaaguacuaaccaggcccgacccug

SEQ ID NO: 585817 - RNA, 63 nt, hsa
uaccuaggggaaaaccugccagagaagaauaaaccauccaagagacggcgcugcagggccuca

SEQ ID NO: 585818 - RNA, 63 nt, hsa
uuacccaucuacucaaauaucugauuuaucucaccauccaauuaucuacccaccugucuuccu

SEQ ID NO: 585819 - RNA, 63 nt, hsa
cuacagcccuggccuccacccccaccccgccgaccauccaagggagagugagaccuggcagcc

SEQ ID NO: 585820 - RNA, 63 nt, hsa
cuagauuuggggcucagaaggcccugcucucucccauccaagugaccagaugcccuacucagc

SEQ ID NO: 585821 - RNA, 63 nt, hsa
uauuggaucugugccuguaauaucaggauacuaccauccaaaucuaucuagauaucuugugca

SEQ ID NO: 585822 - RNA, 63 nt, hsa
acuaagucucuagccucuuucucccuucugcucccauccaagaaagacaguguauaaggaaca

SEQ ID NO: 585823 - RNA, 63 nt, hsa
ugguaugauucuauuauauauuuuauauaaaauccauccaaauuaaguuuuggguaagugugu

SEQ ID NO: 585824 - RNA, 63 nt, hsa
guaaacagaugacauuuucugaccaggcacaugccauccaauuuucugucaaucacacuguug

SEQ ID NO: 585825 - RNA, 63 nt, hsa
acaugaucauuugcaaaccucccccagccccuaccauccaauguggaaggaaaacaagaacug

SEQ ID NO: 585826 - RNA, 63 nt, hsa
uaaaagcauggacugugccacacacccagugauccauccaaaaacaaggacugcagccuaaau

SEQ ID NO: 585827 - RNA, 63 nt, hsa
ugaaguaaucccgccaccuaucucgugggagagccauccaaauaagaaaccuaaaauaauugg

SEQ ID NO: 585828 - RNA, 63 nt, hsa
uuguugauagcagauggaucaauauuaguaaccccauccaagauugaacugugaaagagaggu

SEQ ID NO: 585829 - RNA, 63 nt, hsa
aggauuugagagcuggagcccaucuuucugccuccauccaaagaggccuuuuaacucagccuc

SEQ ID NO: 585830 - RNA, 63 nt, hsa
uaccagugagcagagcccucaugugacaugaacccauccaauggauugugcaaauccccuccc

SEQ ID NO: 585831 - RNA, 63 nt, hsa
ggcucccuccagacaaugccagcauaaauccauccauccaaaggcagagaaccaaaggggcca

SEQ ID NO: 585832 - RNA, 63 nt, hsa
uuggauucaguuuugugaaaauggauucuguggccauccaagggauguaucagggaugaucag

SEQ ID NO: 585833 - RNA, 63 nt, hsa
cuuccuaccaguuucucagaauuacacgcacgaccauccaaacauuggcuccaugccagggcu

SEQ ID NO: 585834 - RNA, 63 nt, hsa
gcucaccccugggcaagaggcuggaaguucacaccauccaaaauuuauccuuguuuuuuuucu

SEQ ID NO: 585835 - RNA, 63 nt, hsa
cugggcucuucucuggccucuucaccagggcacccauccaaggaaccuccgaacagccaggaa

SEQ ID NO: 585836 - RNA, 63 nt, hsa
gagaucagagccagaucagccuuaagucaccucccauccaagaacuuggccuaaaaauacucc

SEQ ID NO: 585837 - RNA, 63 nt, hsa
ugcagauaucaagaguuuguuauuuucaaauacccauccaacaagagagauggggagguuuuu

SEQ ID NO: 585838 - RNA, 63 nt, hsa
ggcuaacacgggcaagagggaaagaaaggcuaaccauccaaacagggauacaggggaggcggu

SEQ ID NO: 585839 - RNA, 63 nt, hsa
uugugcuccucuggccaggaaagggaacagaguccauccaagcugccccccacucaucugcca

SEQ ID NO: 585840 - RNA, 63 nt, hsa
ccagugacugggacccuacucuagaacuguguaccauccaauucgccaucauaaaggaaucuu

SEQ ID NO: 585841 - RNA, 63 nt, hsa
ugccuguguugcagaccauuucugaggucuccaccauccaaggaggcacagccgucauuacug

SEQ ID NO: 585842 - RNA, 63 nt, hsa
aucuuuuuucauucagcauaauucccuugaaauccauccaaguuguugcauguaugaauaguu

SEQ ID NO: 585843 - RNA, 63 nt, hsa
uacaaagagaaaucucuaaaagaauaugaucuuccauccaaguggagggaaacuuuaaaacaa

SEQ ID NO: 585844 - RNA, 63 nt, hsa
ucuuauuuuauuuuaccuucaaaaacaaaaacgccauccaaaaccaaggaaguccuugguguu

SEQ ID NO: 585845 - RNA, 63 nt, hsa
gcccacggggacaucaguaaccuucugcagccaccauccaaugccauuacugucaagugagac

SEQ ID NO: 585846 - RNA, 63 nt, hsa
uaucaguuugaggaaguggcugucccuguggccccauccaaccacuguacacacccgccugac

SEQ ID NO: 585847 - RNA, 63 nt, hsa
gacccaaacuuuacucugggagguaggcuaugcccauccaaauaaaucuccaugagaaacuug

SEQ ID NO: 585848 - RNA, 63 nt, hsa
ccucuuuuucugcacugccauauucacccccaaccauccaaucuguggauaauuggauguuag

SEQ ID NO: 585849 - RNA, 63 nt, hsa
cuacugagcucuccacucuguuucccgccugggccauccaaccuugaaguccuaaaccacacc

SEQ ID NO: 585850 - RNA, 63 nt, hsa
gauccucccacccagucugccccuggucucugcccauccaaucagagcccacccuccuggaag

SEQ ID NO: 585851 - RNA, 63 nt, hsa
auccgauaacuuaaaaacguagcucaucccuuaccauccaaggggcacucccuugguuggauu

SEQ ID NO: 585852 - RNA, 63 nt, hsa
ccacccaagacacaguacccagucaugguuuccccauccaacuauuaguuucauacuuugaaa

SEQ ID NO: 585853 - RNA, 63 nt, hsa
ucaagauccucuugccacaucuugaaaaugccaccauccaauaaaaaucaggagccugcuaag

SEQ ID NO: 585854 - RNA, 63 nt, hsa
aauccagggacuugaagaaagacuaggugugucccauccaaguugagcacgcgccuuccccag

SEQ ID NO: 585855 - RNA, 63 nt, hsa
guggaugggccaccgccuugcccagccuggaugccauccaaguuguauauuuuuuuaaucucu

SEQ ID NO: 585856 - RNA, 63 nt, hsa
aucucagagaaucagcuaaguuuccuaacuuguccauccaaaugugaucaccacgauucaaca

SEQ ID NO: 585857 - RNA, 63 nt, hsa
aaguggagaauuguggaaggauuguaacauggaccauccaaauuuauggccguaucaaauggu

SEQ ID NO: 585858 - RNA, 63 nt, hsa
ggugugaagggacugcuguuugcaaugggcuuaccauccaaauaucccaaaggcuuugaccag

SEQ ID NO: 585859 - RNA, 63 nt, hsa
aguucugcccaaauuccgauaucaccccuucccccauccaagcauccuucgauuagggaagug

SEQ ID NO: 585860 - RNA, 63 nt, hsa
uauuuccaguacauucuuucagagucuguuuuuccauccaaauauaagccccaggccauucca

SEQ ID NO: 585861 - RNA, 63 nt, hsa
gccccagugcgcuuccucuguucccucccucagccauccaauucuugaguuuucucacugauu

SEQ ID NO: 585862 - RNA, 63 nt, hsa
gguagggggaaaaucaguucuuucagcuaccacccauccaaccuuugggccuaugugaaaaga

SEQ ID NO: 585863 - RNA, 63 nt, hsa
ucauggugucaggaaggcugagauguauugguuccauccaacaccugaaaagcaaauuuggca

SEQ ID NO: 585864 - RNA, 63 nt, hsa
ucauggugucuggaaggcuuagaugcauuggcuccauccaacaccugaaaaacaaacuuggca

SEQ ID NO: 585865 - RNA, 63 nt, hsa
ggaguaguggcaacagcccuuccguccacacucccauccaaggaggguucuuccuuccugugg

SEQ ID NO: 585866 - RNA, 63 nt, hsa
cacuuuuagaaaucuucucugaccuagaagaauccauccaaaucccugccuuccucucugaac

SEQ ID NO: 585867 - RNA, 63 nt, hsa
uagguccucaagugcucgugacacauaaucauuccauccaaugaucgccuuugcuuuaccacu

SEQ ID NO: 585868 - RNA, 63 nt, hsa
uugcaacucagagcugcugcacucaggagggccccauccaaucccgggccccugcagggaaaa

SEQ ID NO: 585869 - RNA, 63 nt, hsa
auccugcuguguguccuguuccauguuccgguuccauccaaauacacuuucuggaacaaaugc

SEQ ID NO: 585870 - RNA, 63 nt, hsa
aaugcaugccugaugaccaaacucucccuuuccccauccaaucgguccacacuccccgcccug

SEQ ID NO: 585871 - RNA, 63 nt, hsa
gaaaagauuguggccaagaagagugaaugugucccauccaaaggugcauccagauaugucugu

SEQ ID NO: 585872 - RNA, 63 nt, hsa
ugcuccauccaucccuccugggcgccagacccuccauccaagcccugugucuuuccauaguca

SEQ ID NO: 585873 - RNA, 63 nt, hsa
ccacuaacaggagccaggguuaggauucaaaccccauccaacuggucccagagcuggagcuuc

SEQ ID NO: 585874 - RNA, 63 nt, hsa
uagggcccugcugggacaugggggccugagugcccauccaagggcucucaaggacaccggcaa

SEQ ID NO: 585875 - RNA, 63 nt, hsa
aaugcgugccugaugaccaaacucucccuuucuccauccaaucgguccacacuccccgccccc

SEQ ID NO: 585876 - RNA, 63 nt, hsa
ggcuauuucaacuaaagcagauuaaccugaaauccauccaaguuguucugcauaucauuguuc

SEQ ID NO: 585877 - RNA, 63 nt, hsa
aagucccucaugcuaccuuuuuaugcuuacacuccauccaaaccuaacucugccaaccacuuu

SEQ ID NO: 585878 - RNA, 63 nt, hsa
uugcacuauguucacuuugggguugguucucagccauccaagggucuccagugagguggcugc

SEQ ID NO: 585879 - RNA, 63 nt, hsa
gucauggacccagauggggcuuucccuuuguagccauccaaugggcauugugugggugcuugg

SEQ ID NO: 585880 - RNA, 57 nt, hsa; identical to SEQ ID NO: 585664

SEQ ID NO: 585881 - RNA, 63 nt, hsa
guugguuuaguggauguucguggaauugcugacccauccaagggcguccuuuggagccagugg

SEQ ID NO: 585882 - RNA, 63 nt, hsa
caggagaccacaaagguuucacuucuuuuagauccauccaauaugcgaaaaaaggguacauuu

SEQ ID NO: 585883 - RNA, 63 nt, hsa
uaauauggagugauauaguuuggcucugugucuccauccaaaucucaucuuaaauuguaaucu

SEQ ID NO: 585884 - RNA, 63 nt, hsa
uaggacauauauuuuguauuuuccccucacccaccauccaauaaugaguaauagcacaaagua

SEQ ID NO: 585885 - RNA, 63 nt, hsa
aaggcuuuccugagcaagugacaaucuaaccugccauccaaaugauaaauugcuaauuaagca

SEQ ID NO: 585886 - RNA, 63 nt, hsa
caaaucccuaguugauaggguuuggcuguguccccauccaaaucucaucuugaauuguucccg

SEQ ID NO: 585887 - RNA, 63 nt, hsa
gcagaaugaauugucugguagcccuguccugacccauccaagcgcuguuggggcuggugguga

SEQ ID NO: 585888 - RNA, 63 nt, hsa
uuauuuggacugcauuaauuggucauugacuggccauccaauuaccauuuuuucuuucagucc

SEQ ID NO: 585889 - RNA, 63 nt, hsa
gcucugcuuccuguagacacgcacacguugucuccauccaauggccuuuucugaaguuacaga

SEQ ID NO: 585890 - RNA, 63 nt, hsa
aaaaugcuggaaaacuguaaagacuuccaggucccauccaaggagauuuugcuucugauugac

SEQ ID NO: 585891 - RNA, 63 nt, hsa
uauaaauugaguccuaaguauuaauuauugccaccauccaacucauugagucuuaugguucac

SEQ ID NO: 585892 - RNA, 63 nt, hsa
cgauuauugagucguaaguauuaauuauugccaccauccaacucauugagucuuaugguucac

SEQ ID NO: 585893 - RNA, 63 nt, hsa
uccacagugccaguuccuugccccaaccuggccccauccaaguacagaagaccuuccuuuccu

SEQ ID NO: 585894 - RNA, 63 nt, hsa
acaaguccuguaacuuccccaggcuccauucccccauccaagaguugggguaaugggaacugg

SEQ ID NO: 585895 - RNA, 63 nt, hsa
uccagcaggacuccaggaugguucagcccagcaccauccaaagggugggagcacaucugcccu

SEQ ID NO: 585896 - RNA, 63 nt, hsa
gugaggguccugguuccagcagagcacuggggcccauccaaguuuguucugccaccacuggau

SEQ ID NO: 585897 - RNA, 63 nt, hsa
agccccuuccuccuuccauucugcauccccuccccauccaaccuaaaugccacagcuggggcu

SEQ ID NO: 585898 - RNA, 63 nt, hsa
gccucugucacccagcuauccucgcacucaaagccauccaaccucagcaggccuucucgggcc

SEQ ID NO: 585899 - RNA, 63 nt, hsa
ggcccucccagaaccucagcauuuccuuccagcccauccaaacacugaggcagccuuggggaa

SEQ ID NO: 585900 - RNA, 63 nt, hsa
uaaaaugaucaaucaagauaaaaggugaucuauccauccaauggaauauuauuuggccuuaaa

SEQ ID NO: 585901 - RNA, 63 nt, hsa
aucaccucuuccuggaagccuuccucuuuuccaccauccaaaacccucuuaauacccugugua

SEQ ID NO: 585902 - RNA, 63 nt, hsa
gagagggaaagaucguaaggaugagagaggagaccauccaagccagaaauuauuuaauaaauc

SEQ ID NO: 585903 - RNA, 63 nt, hsa
auguucagggagccuugcaguguuauacgcgugccauccaaauuaauccugcauuugcagaug

SEQ ID NO: 585904 - RNA, 63 nt, hsa
cuauuuuuccgaacaauccuuguagaguauguaccauccaaaggcaggagggccucgccgugg

SEQ ID NO: 585905 - RNA, 63 nt, hsa
uagcacaaaagucuugauagcacaacacaaauuccauccaagaggagaaucuuccccaggguu

SEQ ID NO: 585906 - RNA, 63 nt, hsa
caauccguuuauauuagcacuguaucccuugugccauccaacauuuuguauguuuuuguaaac

SEQ ID NO: 585907 - RNA, 63 nt, hsa
gaaccaauagucucaaaguaaaaacaaccaccaccauccaacaaaaggauuacgucugcaucu

SEQ ID NO: 585908 - RNA, 63 nt, hsa
gugccauaaauuauguggcucauaguaggugcaccauccaaggagaaggucccuuuuuccaac

SEQ ID NO: 585909 - RNA, 63 nt, hsa
gugcuuuagucauauaugaauuuaaaccuaguaccauccaaaaccauguaauggauuuuaaga

SEQ ID NO: 585910 - RNA, 64 nt, hsa
acggucccacccaagccugucaccucugcucauccuccaagaccacccagcuuucucccagcca

SEQ ID NO: 585911 - RNA, 64 nt, hsa
uucuccucaggacaaggccuugcucacucacucacuccaagaccaccagggucccaggaagccg

SEQ ID NO: 585912 - RNA, 64 nt, hsa
uccccccucaauugagagcucuuguuauucagagcuccaagacuagaccuggcuaacaaacaua

SEQ ID NO: 585913 - RNA, 64 nt, hsa
uguuuucaaagcccccgauaaucgcucuuuuccacuccaagaugcccucauaaaccaauguggc

SEQ ID NO: 585914 - RNA, 64 nt, hsa
gggggcggcuugucuucgcuggcuccuaccccaucuccaagauaagccugagccuuagcuccca

SEQ ID NO: 585915 - RNA, 64 nt, hsa
auauuauuuaaauguugaaaucuuaaaaaccugccuccaagauuucagaagccaaguuuuucua

SEQ ID NO: 585916 - RNA, 64 nt, hsa
gaaagauauaauuugagcaguggcuuuaugcagacuccaagaacaaaaccaccagguauuuuuu

SEQ ID NO: 585917 - RNA, 64 nt, hsa
agaugagaccaaagaaucuggcaaacaucacagacuccaagaauuaccuaauaauccagaucac

SEQ ID NO: 585918 - RNA, 64 nt, hsa
cuacauuauaagaauaaguaaacauuuccuggaccuccaagaagauuuugauaaagcugcuuua

SEQ ID NO: 585919 - RNA, 64 nt, hsa
cccucacugcacuuuggaccccuggggccaacaucuccaagacaaaguuuuucagaaaagagga

SEQ ID NO: 585920 - RNA, 64 nt, hsa
cuguuuccuaauucaggaccccacucaucuagcccuccaagagccuccgccaaauuguagccau

SEQ ID NO: 585921 - RNA, 64 nt, hsa
guuguucacagauauuuuauguuuuuuuaauuuucuccaagaauauuuauagaauuccaaagaa

SEQ ID NO: 585922 - RNA, 64 nt, hsa
aaggcugggguuagaguggggagugggcuucuuccuccaagaucucagucucucagugcuuggc

SEQ ID NO: 585923 - RNA, 64 nt, hsa
cauugacccgucuccaucggaccccagccccuaucuccaagagacagaggaggggucaggaggc

SEQ ID NO: 585924 - RNA, 64 nt, hsa
aggcuugcccagauagacuaacaacccuuuagugcuccaagaagugagaauuuccgaaaaagau

SEQ ID NO: 585925 - RNA, 64 nt, hsa
cugagccuggucuuuuguccuuuuuuauuuuggucuccaagaugaaugcucaucuuuggagggu

SEQ ID NO: 585926 - RNA, 64 nt, hsa
acuaaagggcuugucuugguggggucucccaccccuccaagacccauucugcacagucccucca

SEQ ID NO: 585927 - RNA, 64 nt, hsa
auuugaucugcucaucuucaguugaaugcccucacuccaagacuggaugcuggaucucauagaa

SEQ ID NO: 585928 - RNA, 64 nt, hsa
auugaaacagaaggaaaugcuguggaccacagaacuccaagaauuguuuaaaaaaaaaaaagug

SEQ ID NO: 585929 - RNA, 64 nt, hsa
agcauuucaugggggcugaggcagaacccaggagcuccaagaaaggccacccauagagcucauc

SEQ ID NO: 585930 - RNA, 64 nt, hsa
aggcaccucagugggguuccgggccaccucaggacuccaagaggcuguguggagccaccacucc

SEQ ID NO: 585931 - RNA, 64 nt, hsa
gcagggagugauagccaaacuccuuggucaccugcuccaagaaggaagcaguagcugagcaccu

SEQ ID NO: 585932 - RNA, 64 nt, hsa
ugcccaugagcugacauuuuacucaucccucugccuccaagaaggccuguauuauacguguccu

SEQ ID NO: 585933 - RNA, 64 nt, hsa
uacaaacuugaagcaaguugccuucuaauuuuuacuccaagauuguuucauaucuauuccuuaa

SEQ ID NO: 585934 - RNA, 64 nt, hsa
cuggccggcuuuucuccaucuggggacaguccuacuccaagaacacugcacaccagcuccucac

SEQ ID NO: 585935 - RNA, 64 nt, hsa
ccucagauaagcccuuaggcaccagcuuagacaccuccaagaaccaggccccgcugaugcaaga

SEQ ID NO: 585936 - RNA, 64 nt, hsa
agguggcagggcggaggaccugcuugggaagaaacuccaagaagauuggaaugcuuccaaagca

SEQ ID NO: 585937 - RNA, 64 nt, hsa
ggaaauggacaccaagaauaucuccugaggaucacuccaagaaaagagauccacauaccauucu

SEQ ID NO: 585938 - RNA, 64 nt, hsa
ggacuucguugguuuuuuggagucuugguugugacuccaagagcagagugaggaagacccccaa

SEQ ID NO: 585939 - RNA, 64 nt, hsa
gggacuuuguuggcuuuuagaguguuggucaugacuccaagagcagagcagggaagagcccaag

SEQ ID NO: 585940 - RNA, 64 nt, hsa
gauuuuccccuuuuucuacccacuccuuugcuuccuccaagacuuacccaacuccuucccccuc

SEQ ID NO: 585941 - RNA, 64 nt, hsa
gaucccuauuccuaccccaucuauucucuguuggcuccaagagcuaccccagagaccuuaaaca

SEQ ID NO: 585942 - RNA, 64 nt, hsa
auuuagaaacaaguucuaggguggguuggaaaaucuccaagagcccugaccucaucuuccaccu

SEQ ID NO: 585943 - RNA, 64 nt, hsa
gcuaaggugaaaagggguguggcaaaggagccuacuccaagaauggaggcuguaggaauauaac

SEQ ID NO: 585944 - RNA, 64 nt, hsa
aaaugaaacccaggcaaccagccuagaagaaacacuccaagauauucauuaagugcuuuguuuc

SEQ ID NO: 585945 - RNA, 64 nt, hsa
aacguguugccuugaaccacuucccucaucucuccuccaagacacuguggacuuggucaccagc

SEQ ID NO: 585946 - RNA, 64 nt, hsa
ucacauuaaaaaaaacccauacauaagaaacagccuccaagaacauucaagcagcagucagaga

SEQ ID NO: 585947 - RNA, 64 nt, hsa
gagcaagauuguguuuuagagaggaaacuugaaacuccaagaaagcacuugauguuuuuauaug

SEQ ID NO: 585948 - RNA, 64 nt, hsa
aaggugagcucgcugaguccagccucguggucuucuccaagaugccgccagaugcccagccuac

SEQ ID NO: 585949 - RNA, 64 nt, hsa
ugcauuccagccugguugacagagugacccuugucuccaagaaaaaaaaaaagcaaaugggauu

SEQ ID NO: 585950 - RNA, 64 nt, hsa
acccccaagaaaccuccauccugccaggagcagccuccaagaaacuuuuaaaaaauagauuugc

SEQ ID NO: 585951 - RNA, 64 nt, hsa
cuucagaugacacguuuuguuuagagcuacuuugcuccaagacucuuaagcccaaaguaacugg

SEQ ID NO: 585952 - RNA, 64 nt, hsa
uguggcuuaguaauagaucacggcauguuucccgcuccaagagaauucacuuuaccuucagcag

SEQ ID NO: 585953 - RNA, 64 nt, hsa
gccugcccucgggcucugcucaccucuggugacccuccaagaugccccugcccucaguuucccc

SEQ ID NO: 585954 - RNA, 64 nt, hsa
ucucaguccugcaucuuuucuucugcuuucuucccuccaagagcaaaaccugggcaaggggacu

SEQ ID NO: 585955 - RNA, 64 nt, hsa
auccauucacagccaggagaugcugggccaguuccuccaagaggucuccaucauggcagugaug

SEQ ID NO: 585956 - RNA, 64 nt, hsa
ccagguguuuuaagguuaaguguuuaaagaaguacuccaagaacaaucugcuuuuuucaucauu

SEQ ID NO: 585957 - RNA, 64 nt, hsa
aagacaggaugaccuuggacaaggccaaacuguccuccaagacuccuuaaugaggggcaggagu

SEQ ID NO: 585958 - RNA, 64 nt, hsa
uaagauuuuuacuucaucuuucuugggccugcaccuccaagauaacaaagaagaagcaaugguc

SEQ ID NO: 585959 - RNA, 64 nt, hsa
ugagcuagaggaagaugaggggggaugcgaguaccuccaagaagaaaaaucacacucugaaugg

SEQ ID NO: 585960 - RNA, 64 nt, hsa
ugaucuguguacaauuuuagucacuaagacuuuccuccaagaacuaagccaacuugaugugaaa

SEQ ID NO: 585961 - RNA, 55 nt, hsa
caagcauaauuacuuacugacuuuccuccaagauuggcaugauaucuuugaauuu

SEQ ID NO: 585962 - RNA, 64 nt, hsa
uaauuugcucuuagguucuaucucuguagaaugucuccaagauugaagaagaaacugagcaguu

SEQ ID NO: 585963 - RNA, 64 nt, hsa
gcacaucucuucugggcggccaccugaggagugacuccaagaagaguuccggcagcuuucccca

SEQ ID NO: 585964 - RNA, 64 nt, hsa
ccugcagcagccucgcgccccgcguuccgggcggcuccaagagagagcggagcaagugucccgg

SEQ ID NO: 585965 - RNA, 64 nt, hsa
guggaaaacugcaugggaggcaaaaugcucuguucuccaagaggacccggaaguaaucacauag

SEQ ID NO: 585966 - RNA, 64 nt, hsa
auuaaaggaaggggcacaauucgcuaucacacaccuccaagaucaagauccuguucugagucag

SEQ ID NO: 585967 - RNA, 64 nt, hsa
ggucuaaaauuuuuaaggacuuuccuuccuccaucuccaagaaugcugaaaccaagggggauga

SEQ ID NO: 585968 - RNA, 64 nt, hsa
cgaccaaggggucuucauuuccaugaaaaagggacuccaagaggcagugguggcuguggccccc

SEQ ID NO: 585969 - RNA, 64 nt, hsa
cgguuccccagagcuuuggggaccacgcgaaaaccuccaagauauuuuucacaaaauagaaacu

SEQ ID NO: 585970 - RNA, 64 nt, hsa
cuuagguaggugcuuaacucuugugguggccagccuccaagaugagccccaguguucuugccuc

SEQ ID NO: 585971 - RNA, 64 nt, hsa
acaaaugugauaaugacaugauuucccaccugcccuccaagaaaauggugacucacucucaagu

SEQ ID NO: 585972 - RNA, 64 nt, hsa
guuuuuacuggaaacauagcaaaccuugauuuagcuccaagaaauugaguagggaaauauuugu

SEQ ID NO: 585973 - RNA, 64 nt, hsa
uaaagagcaaaggcaacgcccucagggucccuuccuccaagauggccauguaggguaauggaga

SEQ ID NO: 585974 - RNA, 64 nt, hsa
uaaauacucugaauaagagaccgguacuagcuaacuccaagagaucguuagcagcaucagucca

SEQ ID NO: 585975 - RNA, 64 nt, hsa
gauauugcgccugugugcguguguauaagucaagcuccaagaggcuccugaaugugacuggcgu

SEQ ID NO: 585976 - RNA, 64 nt, hsa
ccuagguuuuccuuccaagcacccagcccuccugcuccaagagggauaaccugcaccccucccu

SEQ ID NO: 585977 - RNA, 64 nt, hsa
ucucagcuucuuuggccuucuguaagaggggcuucuccaagagcaugucacuaguuuucuagaa

SEQ ID NO: 585978 - RNA, 64 nt, hsa
uaagaaaaagaaacuauuugcuccuuggcgaggacuccaagaacucacugaugcacgccgaguu

SEQ ID NO: 585979 - RNA, 64 nt, hsa
aagagcuggagaacuccauguacuuuggaaucuccuccaagauagccagaguuuaauacaucuu

SEQ ID NO: 585980 - RNA, 64 nt, hsa
uuccuauggcuggccacugcacagagcucuccagcuccaagaccuguugguuccaagcccugga

SEQ ID NO: 585981 - RNA, 64 nt, hsa
uucuccuggugucuacauguuugcuuagaggcggcuccaagagcccccagagcugccugcauag

SEQ ID NO: 585982 - RNA, 64 nt, hsa
caggaagcuucuagagacuuuaugcccuccagagcuccaagauauaagcccuccaagggaucag

SEQ ID NO: 585983 - RNA, 64 nt, hsa
agagggcucuuccuccaaauccuccccaccuguccuccaagaacagccuucccugcgcccaggc

SEQ ID NO: 585984 - RNA, 64 nt, hsa
gugcuccucggcagaugcuguuguuguuacuucccuccaagaggcuggaaaagggcucagagcu

SEQ ID NO: 585985 - RNA, 64 nt, hsa
aggaaaacaaaaaccucucuccucagccuuccaccuccaagagaggaggaaaaacaguugucug

SEQ ID NO: 585986 - RNA, 64 nt, hsa
uguguugugaaaguuuggaaggucagaccuuuuucuccaagaaggacaagccccuguguaagaa

SEQ ID NO: 585987 - RNA, 57 nt, hsa
uaacuauuucaaggagaugaagagcaucuccaagaagagaugguaaaaagauauaua

SEQ ID NO: 585988 - RNA, 64 nt, hsa
cuuguaaauagcacuaguuagacucuuuagaauacuccaagaguuagggcagcagaguggagcg

SEQ ID NO: 585989 - RNA, 64 nt, hsa
aacaaauuuguucuuccugauaugauaacuaggucuccaagagaaaauagaaaggcugcuuuag

SEQ ID NO: 585990 - RNA, 64 nt, hsa
ucgaccuccaguucucccugaugacaguagcugucuccaagagaaaaauccucacuuauuaacu

SEQ ID NO: 585991 - RNA, 64 nt, hsa
gaguaaacuccacaucuuugcacuaccuguuugccuccaagagacuaucaguuccuuggggaca

SEQ ID NO: 585992 - RNA, 64 nt, hsa
auaguaggacccaagggaaaggaagggaagagugcuccaagacuuggaccaggcacacacacac

SEQ ID NO: 585993 - RNA, 64 nt, hsa
aaaugaaugaaacagucaaaugguuugccucauucuccaagagccacaacucaagcugaacugu

SEQ ID NO: 585994 - RNA, 64 nt, hsa
gcaacagugcccccuccguccacuacgcuccugucuccaagaauguuuugcuagagcuaacaga

SEQ ID NO: 585995 - RNA, 64 nt, hsa
gauagauuuucugcuacuuugcugcuaugguuuucuccaagagcuacauaauuuaguuucauau

SEQ ID NO: 585996 - RNA, 64 nt, hsa
ugaucuggacuuccuauaauacaaauacacaauccuccaagaauuugacuuggaaaaaaauguc

SEQ ID NO: 585997 - RNA, 64 nt, hsa
acucauucaaggaggugaaaaugauggaugacuccuccaagaugaaaauggaccagccgcagug

SEQ ID NO: 585998 - RNA, 64 nt, hsa
gagaugcaaagagaagcgagagaggcaccuuguucuccaagaacuuacuguccaaucaugcugu

SEQ ID NO: 585999 - RNA, 64 nt, hsa
aaagaaaagaacacuugcccagggcagcuuugcccuccaagaggcucccuccugucucuaaguc

SEQ ID NO: 586000 - RNA, 64 nt, hsa
guggcuugaacuugccagaugcaaauaccacagacuccaagaaaacccgaguugggguuuguuu

SEQ ID NO: 586001 - RNA, 64 nt, hsa
cuguuuuagggguuauacauuuggacugugcauucuccaagagaugaagcggugaaguugggau

SEQ ID NO: 586002 - RNA, 64 nt, hsa
aguggaagcuuaauggaaaaggaaaguuaugauccuccaagacccuuaauugauagaccauacc

SEQ ID NO: 586003 - RNA, 64 nt, hsa
acugaauuugcacaccuccuugccaccuuccuuccuccaagauaccaucuccucauccuaaccc

SEQ ID NO: 586004 - RNA, 64 nt, hsa
uucuugcuauaugauuuagcaaguucuagaaggucuccaagacaauaauuacauuggcacaaug

SEQ ID NO: 586005 - RNA, 64 nt, hsa
ucagaccuuugauacgcuaaugugcauuuuaaaucuccaagaagcaccucuauuuuauacauca

SEQ ID NO: 586006 - RNA, 64 nt, hsa
auuuaugagacauucuugcuauaacuaagugcuucuccaagaccccaacugaguccccagcacc

SEQ ID NO: 586007 - RNA, 64 nt, hsa
cagagugugaaaacgaguuucucuuuuacagauucuccaagauuuguuucugugcccaacuuuc

SEQ ID NO: 586008 - RNA, 64 nt, hsa
aauacuggcccugucgacuauugccacccugcuucuccaagagcagaccaggccaccucauccg

SEQ ID NO: 586009 - RNA, 64 nt, hsa
acauuccaaaaggaaguucaacaguaagcagcaccuccaagacugucuccuuuuggccaauauc

SEQ ID NO: 586010 - RNA, 64 nt, hsa
cguuccugacaucacagcagccuccaacacaaggcuccaagaccuaggcucauggacgagaugg

SEQ ID NO: 586011 - RNA, 64 nt, hsa
uaugucagaucaaccuggaaggaaagaccuucuacuccaagaaggacaggccucucugcaagag

SEQ ID NO: 586012 - RNA, 64 nt, hsa
uccauggacuucugagccgacagucuucccuucucuccaagaggccucaguccccaagacugcc

SEQ ID NO: 586013 - RNA, 64 nt, hsa
agagacacagagugaugugaggcguuggcuuuuucuccaagaagguacagauaccucagauucg

SEQ ID NO: 586014 - RNA, 64 nt, hsa
ccacggucuguucuugaagcaguagccuaacacacuccaagauauggacacacgggagccgcug

SEQ ID NO: 586015 - RNA, 64 nt, hsa
cugucaugcaguguugucccuuccuaccuucuuccuccaagagaguaucaugaaguaaacuaca

SEQ ID NO: 586016 - RNA, 64 nt, hsa
aggcucccuugggaaagcccugcuuugcuccaggcuccaagaucuccuggcuaagucagcaagu

SEQ ID NO: 586017 - RNA, 64 nt, hsa
aacauuucuuucuuacaguucuggaggcuggaaacuccaagauuaaggcagauuucaugccuau

SEQ ID NO: 586018 - RNA, 64 nt, hsa
uccauuuguccaguuaauacuuccucuuaaaaaucuccaagaagcugggucuccagaucccauu

SEQ ID NO: 586019 - RNA, 64 nt, hsa
ggggcucuccagaccccuuuuccaugaugacccacuccaagauauuauguguaaauuguguuau

SEQ ID NO: 586020 - RNA, 64 nt, hsa
uguucagccacuauggaaagcaguuuggagauuucuccaagaacuuaaaauagaacuaccauuc

SEQ ID NO: 586021 - RNA, 64 nt, hsa
ucccucuuccuguguccccagauccccacuacagcuccaagaggaugggccuagaaagccaagu

SEQ ID NO: 586022 - RNA, 64 nt, hsa
ccucagggguccccuucugcaccgcuggcuuccacuccaagaagguggaccagggucugcaagu

SEQ ID NO: 586023 - RNA, 64 nt, hsa
gccccuccccucccgaacacugagaaauagugcacuccaagaaacguggaucucccccucaucc

SEQ ID NO: 586024 - RNA, 64 nt, hsa
aaugcaugugacugauaaagagauaacacccugucuccaagacacaggcuuuacauaaacagcu

SEQ ID NO: 586025 - RNA, 64 nt, hsa
uccuagaauguuucauuugcacaaguagggcugccuccaagaggaaccucugauuuauuuugua

SEQ ID NO: 586026 - RNA, 64 nt, hsa
uguaacagggucacaagaauucgacagccagaugcuccaagaggguggcccaaggcuauagccc

SEQ ID NO: 586027 - RNA, 64 nt, hsa
gaaaagugcuuuaggugagaugacuaaauuaugccuccaagaaaaaaaaauuaaagugcuuuuc

SEQ ID NO: 586028 - RNA, 64 nt, hsa
auccgauucuuuaaaaugcaccaucagaccuggccuccaagaagagcuguagcguaccaugcgu

SEQ ID NO: 586029 - RNA, 64 nt, hsa
uuucuccaaaggccauccuuuuggggccaccuggcuccaagaagcaucgcuggucuuggggacg

SEQ ID NO: 586030 - RNA, 64 nt, hsa
augaauucuaaaccaaucaaaugucugggaagcccuccaagaaaaaaaauagaaaagcacuuga

SEQ ID NO: 586031 - RNA, 64 nt, hsa
aaagagcaucuucucucccacugcaccccuucuccuccaagaauaguugcccacauucccaaaa

SEQ ID NO: 586032 - RNA, 64 nt, hsa
agaggcccccagggaguugugagcagauuagacccuccaagaccgccccagggguuggcccaug

SEQ ID NO: 586033 - RNA, 64 nt, hsa
acugcaucagccccugugagccuggcuucagugucuccaagaacuguaaccucggcaagugcca

SEQ ID NO: 586034 - RNA, 64 nt, hsa
ucauccugguagcucuccugaugcucguuuuccgcuccaagagagaggugaaacggugagcgag

SEQ ID NO: 586035 - RNA, 64 nt, hsa
ugccuuuuguuaaaagaugguaaaccagaucugucuccaagaccuuggccucuccuuggaggac

SEQ ID NO: 586036 - RNA, 64 nt, hsa
agaagucacauuccugaacaggauauucucacagcuccaagaauuucuaggacugaauuaugaa

SEQ ID NO: 586037 - RNA, 64 nt, hsa
aggcccauuaguugagaaagucacagauauauuucuccaagaaagccaacaaccaccaccacaa

SEQ ID NO: 586038 - RNA, 64 nt, hsa
cgccaucuaugguguggaugggaaacugcuccagcuccaagagguuuuucagcucuuugacaac

SEQ ID NO: 586039 - RNA, 64 nt, hsa
ucuuugauaaaagaaaaauaagucagauuguuaacuccaagauugaaaaaaaaaacucuugaaa

SEQ ID NO: 586040 - RNA, 59 nt, hsa
uuuuacagaagauucuauaaacaagcauucuccaagaagaccucucuccugugggugca

SEQ ID NO: 586041 - RNA, 64 nt, hsa
aaacuggggucuaaauccuaaagcaaaauugaaacuccaagaugcaaaguccagaguggcauuu

SEQ ID NO: 586042 - RNA, 64 nt, hsa
gacauugaaauuguuuaagagccugauauucuuccuccaagaauuugaucucaguacccauuua

SEQ ID NO: 586043 - RNA, 64 nt, hsa
cccuucagcacaggaccuggugacaugacauaaacuccaagacagaaccucaguuuacagcaca

SEQ ID NO: 586044 - RNA, 64 nt, hsa
gcauacaacagcaugccaacaguaauauauuauucuccaagacuuuaccuauguaaguguucaa

SEQ ID NO: 586045 - RNA, 64 nt, hsa
uaggcagagagcucagauggcccuuuuaagggggcuccaagaaccaacaucacugcucuuuuag

SEQ ID NO: 586046 - RNA, 64 nt, hsa
ucggacugaggccuucucaaacuuuacucuaagucuccaagaauacagaaaaugcuuuuccgcg

SEQ ID NO: 586047 - RNA, 64 nt, hsa
auuuuuguaaaaguuuaaugacccacuuuagaugcuccaagaacaagcaucccuuccauguaug

SEQ ID NO: 586048 - RNA, 64 nt, hsa
uucccugaguccucaccagcccuccccauuuguccuccaagacuccacucaaacaucuccucuu

SEQ ID NO: 586049 - RNA, 64 nt, hsa
uaagguggauucagugucuggcacacugagacaccuccaagaaggagauugaugcaucagguuc

SEQ ID NO: 586050 - RNA, 64 nt, hsa
cggaaaauucaugcagauauggauggaaagaagacuccaagaggaaaacgaggauggaaaaccu

SEQ ID NO: 586051 - RNA, 64 nt, hsa
cugucccuguaaaagagaggggcaaauagagagucuccaagagaacgcccucaugcucagcaca

SEQ ID NO: 586052 - RNA, 64 nt, hsa
cgacauaacagaauugcccuccaagucacacaagcuccaagacuaaacaaacagacagguccuc

SEQ ID NO: 586053 - RNA, 64 nt, hsa
accucaacaagacugagagccuuuccccgcuucucuccaagaaggagacguucagcuagauuug

SEQ ID NO: 586054 - RNA, 64 nt, hsa
guggcaauauagaaacacgaacuuuagcugcauccuccaagaaucuaucugcuuaugcaguuuu

SEQ ID NO: 586055 - RNA, 64 nt, hsa
acccuuugagccuuacaucucauucacugucuuucuccaagaaaaguauuuugggcggacaguc

SEQ ID NO: 586056 - RNA, 64 nt, hsa
caaaaacuuuacaauacauuuauguugaauggaacuccaagaucucaccucuccauccaggaau

SEQ ID NO: 586057 - RNA, 64 nt, hsa
auagcggcccuggaggauguuagacuugcucccucuccaagacagcagcagccugcaccugccc

SEQ ID NO: 586058 - RNA, 64 nt, hsa
ccuccucccccggcugggccuccuucuuccacuucuccaagaauggaagccugaacugaggccu

SEQ ID NO: 586059 - RNA, 64 nt, hsa
gauuaaauauguauuuuguagacucuuucccggucuccaagaacaaaguaaaugauucuauuuu

SEQ ID NO: 586060 - RNA, 64 nt, hsa
cagacaggucucuauuuuuuuaaguuauccaggacuccaagaaccauaguuacugaaaagggag

SEQ ID NO: 586061 - RNA, 64 nt, hsa
ucacuacuuuaauaaagaauuaacagagauugaacuccaagagguggguaauuugguuuaaaaa

SEQ ID NO: 586062 - RNA, 64 nt, hsa
ccccaagugccugccccuccccagaguauuaacgcuccaagaguauuauuaacgcugcuguacc

SEQ ID NO: 586063 - RNA, 64 nt, hsa
gcugguugugcugcaggcucccccugaggccccucuccaagaggagcacacuuuggggagaugu

SEQ ID NO: 586064 - RNA, 64 nt, hsa
gcugggggagccaccccucggccauucccuccaccuccaagacagguggcggccgggcaggcac

SEQ ID NO: 586065 - RNA, 64 nt, hsa
auugaguguguucuaagugaaggcaaugggguuucuccaagacagccuguguggccucuacucu

SEQ ID NO: 586066 - RNA, 64 nt, hsa
uccccaaaacuguugguaaaugucagauuuuuuccuccaagaguugugcuuuuguguuauuugu

SEQ ID NO: 586067 - RNA, 64 nt, hsa
cugucacaguaacgugaaaacugauuauucuuuacuccaagagaauguuuuaacccaagcaagu

SEQ ID NO: 586068 - RNA, 64 nt, hsa
aagugguaguccaaauuuucuuuaagcagcugcucuccaagacagggcccuggaaaggcccaca

SEQ ID NO: 586069 - RNA, 64 nt, hsa
ccugagcaccaugauucccacagccagcucuuggcuccaagaugagcacccacaggaagccgac

SEQ ID NO: 586070 - RNA, 64 nt, hsa
uguugaacuucaaccugagggggccgacagugcccuccaagacagagacgacugaacuuuuggg

SEQ ID NO: 586071 - RNA, 64 nt, hsa
uucuguuuuucuccuagucccucuccugccaccucuccaagacuuccgugggacacccacuucc

SEQ ID NO: 586072 - RNA, 64 nt, hsa
acccagacaucugacuaauggcucugugcccacacuccaagaccugugccuuuuagagaagcuc

SEQ ID NO: 586073 - RNA, 64 nt, hsa
ugugucccagaugcugucauuagucuauaugguucuccaagaaacugaaugaauccauuggaga

SEQ ID NO: 586074 - RNA, 64 nt, hsa
aggcccugcuuccuggaaaggacacucagagcagcuccaagacagaggcucuguggcggggguc

SEQ ID NO: 586075 - RNA, 64 nt, hsa
uuguuucuaaugucucugaacucaaagugaggugcuccaagacgcugugaacuucugcaaagac

SEQ ID NO: 586076 - RNA, 64 nt, hsa
ggguaucuuuuucuuuugacuccccuuauucccucuccaagaguaguugcacuuaacuuuuuuu

SEQ ID NO: 586077 - RNA, 64 nt, hsa
aagugauaguccaaauuuucuuuaagcagcugcucuccaagacagggcccuggaaagaggccca

SEQ ID NO: 586078 - RNA, 64 nt, hsa
cuguugaauaacaucgguguaauuacaaagucaacuccaagaauguguauuuacaauauuugcc

SEQ ID NO: 586079 - RNA, 64 nt, hsa
agcuuacucaccccggagucuuuucuuucucuugcuccaagaagagcccuguuggugcuuuacc

SEQ ID NO: 586080 - RNA, 64 nt, hsa
uuaaaacguuuucuaacaguuuacuguugcuuaucuccaagauauuauggaauuaagaauuuuu

SEQ ID NO: 586081 - RNA, 64 nt, hsa
cgcuccuccaccccuuccagaccaagcucaacgccuccaagaccagcaggccaaggccaagccc

SEQ ID NO: 586082 - RNA, 64 nt, hsa
ugcaaggcaccccauccacacauuugcaccacuacuccaagauaguauuuuucuuuucacacaa

SEQ ID NO: 586083 - RNA, 64 nt, hsa
ccacccccuucccuguccuuccccaacuccccagcuccaagaguggaagaaauccccaagauca

SEQ ID NO: 586084 - RNA, 64 nt, hsa
cggccccagauagcagccccagggaggaugcugccuccaagaggugugagcccucugucucggg

SEQ ID NO: 586085 - RNA, 64 nt, hsa
ugugggagguuaagaggagucccuucuggguugacuccaagagccaaggagauggcagacccug

SEQ ID NO: 586086 - RNA, 64 nt, hsa
gaggacuuaagguugcaagaaugaagauuucagacuccaagaucccuuauucuuugggccuuga

SEQ ID NO: 586087 - RNA, 64 nt, hsa
ucggagaccuguuuaacaagcaaaaaucaaaacccuccaagauugucucauauucuaccuggac

SEQ ID NO: 586088 - RNA, 64 nt, hsa
auagggcccaaaccuuuuuauuuuacaauaugagcuccaagacacuuacugaucuacugugaau

SEQ ID NO: 586089 - RNA, 64 nt, hsa
acaauccccgagggcugcugcuuugcgucuguggcuccaagaagugccuguggucaggccccag

SEQ ID NO: 586090 - RNA, 64 nt, hsa
aaauuuucauuuuuaauguaauccccaagauuuucuccaagaaauaaauuguuguuuuguauuu

SEQ ID NO: 586091 - RNA, 64 nt, hsa
gucgcgcaucuccgugguuaucccgcugucuccucuccaagaacaagcagagcccgggccacug

SEQ ID NO: 586092 - RNA, 64 nt, hsa
ccagcgccuggaggaggcaggggcaggaagcggccuccaagacccuucgccuugggacaggaau

SEQ ID NO: 586093 - RNA, 64 nt, hsa
uuuaaacuguaguaguuggucuagaaacaaaauacuccaagaaaaagaaaauuuucaaauaaaa

SEQ ID NO: 586094 - RNA, 64 nt, hsa
acaaccacucaccaguccuaguuuuagaccucaucuccaagauagcaucccaucucagaagaug

SEQ ID NO: 586095 - RNA, 64 nt, hsa
ccgucuguagcaggagcuagggcugcugccucagcuccaagacaagaaugaaccuggcuguguc

SEQ ID NO: 586096 - RNA, 64 nt, hsa
ccagagcuagauccugaugggucucuaagguucccuccaagaagacaaggacaggagacuuggg

SEQ ID NO: 586097 - RNA, 64 nt, hsa
uuguccagaugggccucggagcaccagucacuuacuccaagaagucguuuccuguggccaauaa

SEQ ID NO: 586098 - RNA, 64 nt, hsa
gugcuugaaauggacaagcuggaccuauuccucacuccaagacuuguucuacaggaaagggucc

SEQ ID NO: 586099 - RNA, 64 nt, hsa
gcccguugcucuugggcugguuuccccugaacaccuccaagaggcugccugccuugccagcacc

SEQ ID NO: 586100 - RNA, 64 nt, hsa
uccuggaguggagcauuuagcccaggucuuaauucuccaagaggaggaauacauaguaugguaa

SEQ ID NO: 586101 - RNA, 64 nt, hsa
uggcaccucccucccucucaaccacuugagcaaacuccaagacaccuucuaccccaacaccagc

SEQ ID NO: 586102 - RNA, 64 nt, hsa
cuuuguuaguagucuuaaagcugcugccauaguccuccaagaagaaagcaccaagacaacauuu

SEQ ID NO: 586103 - RNA, 64 nt, hsa
ucagagacccaggaguugggagcuuucgcuccuucuccaagacucaggccugugggcacucuau

SEQ ID NO: 586104 - RNA, 64 nt, hsa
augccuuccuguccuuucuacucaaugguccccacuccaagaugaguugacacaaccccuuccc

SEQ ID NO: 586105 - RNA, 64 nt, hsa
auaaggaauaaaaggaaaaacuuucuuccucucucuccaagaggauaugggaagcuucugugag

SEQ ID NO: 586106 - RNA, 64 nt, hsa
accugugcaggccccauggcaccaucuaucuggccuccaagaugagaaaggagcaugggacaga

SEQ ID NO: 586107 - RNA, 64 nt, hsa
ggucugcuucuuccacuuauacuuagucucugugcuccaagaggucaaauuuuugcuucuagaa

SEQ ID NO: 586108 - RNA, 64 nt, hsa
aaguuuuuuuguuuuuguuuuuguuuuguggcuccuccaagauauagguacaugaaguuuaggu

SEQ ID NO: 586109 - RNA, 64 nt, hsa
aagaugggaauuaccuucaucccucucucuuugccuccaagaaguguaaccgccuugaagagcu

SEQ ID NO: 586110 - RNA, 64 nt, hsa
ggggaagcaagauggguaagggcucaggaaguugcuccaagaacaguagcugaugaagcugccc

SEQ ID NO: 586111 - RNA, 64 nt, hsa
uaguugaccuucaaauauucaagcuauucugcagcuccaagaugcaauuauagaaacagcuccu

SEQ ID NO: 586112 - RNA, 64 nt, hsa
ccauagaacaauuucacugcaaacaugcaugauucuccaagacaaaagaagagagauccuaaag

SEQ ID NO: 586113 - RNA, 64 nt, hsa
gaaccaggguauuuuuguuagguuuucuaugugacuccaagagggaauggucaaguuguuucau

SEQ ID NO: 586114 - RNA, 64 nt, hsa
aaacagagacaugguucuauaaugcuucaugucccuccaagauuugagaucaauuuagggauug

SEQ ID NO: 586115 - RNA, 64 nt, hsa
uccagcuucuacgcucacagcaacugcuuaccugcuccaagaagaugggaggaaggggagcccc

SEQ ID NO: 586116 - RNA, 64 nt, hsa
auucccagggaaccccagggggcaacugacauugcuccaagauguucuccugauguagcuugag

SEQ ID NO: 586117 - RNA, 64 nt, hsa
acggaaaguuaucuuacagcaaacuguaguuugccuccaagacaccauugucucccuuuaaucu

SEQ ID NO: 586118 - RNA, 64 nt, hsa
gacgcgccgcucccucaugcugcccgggcccuuccuccaagacccuacagagccugaggggcac

SEQ ID NO: 586119 - RNA, 64 nt, hsa
uuauuuaaaagccaaacgugcccugagcccucuccuccaagagguccccucagcaucaagcagc

SEQ ID NO: 586120 - RNA, 64 nt, hsa
agacucugaggacauggagagagacucaaagagacuccaagauucaaagagacuaauagagaca

SEQ ID NO: 586121 - RNA, 64 nt, hsa
uacauaggcaaagagaauucgagggauagacagucuccaagaaaagugaaguggugggagagaa

SEQ ID NO: 586122 - RNA, 64 nt, hsa
auuacuguccacauuuuacaggcaaggaaacaggcuccaagaggcugaggacuuugcccaggau

SEQ ID NO: 586123 - RNA, 64 nt, hsa
ggcgauucugauuucccuucucaaaucugcucaacuccaagagucuugagaaacugcuaaaauu

SEQ ID NO: 586124 - RNA, 64 nt, hsa
uggagauaaggcuggacuggucuaucagauugaacuccaagaaugaucacacaaaauguuuagg

SEQ ID NO: 586125 - RNA, 64 nt, hsa
ccaguguccgccaucuucaggguugcacagaauccuccaagauacuuugcagccuuuuuucccc

SEQ ID NO: 586126 - RNA, 64 nt, hsa
uaucuuucuuccaccagacuccaagcccacucuccuccaagacuguguugucuuuucucaccaa

SEQ ID NO: 586127 - RNA, 64 nt, hsa
gauccugcuuauuguaacugacaacuguuuucaacuccaagagcuaaacuauuggcaguucaug

SEQ ID NO: 586128 - RNA, 64 nt, hsa
ggacugaagauuggcaaaaacgaaaagcuucuuccuccaagagcccauugaagaagcccaguga

SEQ ID NO: 586129 - RNA, 64 nt, hsa
cacaagcugaacuguggcauagcucucucuucuucuccaagaagacucagcagccuacauuccc

SEQ ID NO: 586130 - RNA, 64 nt, hsa
uuuucaguuuuaaaugugggcaaaaaggcauuuucuccaagauuuuaaaacuaauucuuauuuu

SEQ ID NO: 586131 - RNA, 64 nt, hsa
cucacucccuaaagcccucuucaggggucaccuccuccaagaagcccuccuugccaccccccgc

SEQ ID NO: 586132 - RNA, 64 nt, hsa
ucauagcgggaaauaaagcaccuuccaagcuugccuccaagaguuacgaguuaaggaagagugc

SEQ ID NO: 586133 - RNA, 64 nt, hsa
uuaggaauguggugcucuuguugggggaagugagcuccaagaguagcuuuuuuucaucucuuag

SEQ ID NO: 586134 - RNA, 64 nt, hsa
ucucccaacccucugguuggugauucaacuugggcuccaagacuuggguaagcucugggccuuc

SEQ ID NO: 586135 - RNA, 64 nt, hsa
ccuuggggcauuauggguucuucccccacuuccccuccaagacccuguguucauuugguguucc

SEQ ID NO: 586136 - RNA, 64 nt, hsa
ccaaggggcaggaggcacccucucuuauccccuccuccaagagcaguagagaauuuaagcacaa

SEQ ID NO: 586137 - RNA, 64 nt, hsa
ucugacauuuuagaaaagccgaacaguagauagucuccaagaugggaaacaugucgugugucug

SEQ ID NO: 586138 - RNA, 64 nt, hsa
ccgccucuccaaaauaaccggccacacucccaaacuccaagacagccauacuuccagcgaaaug

SEQ ID NO: 586139 - RNA, 64 nt, hsa
auuaggauuagagacaaguucuguuuagaaauaacuccaagauugggaggccgaccugggugga

SEQ ID NO: 586140 - RNA, 64 nt, hsa
ggaccugagcccgcacauuccacucccauucucccuccaagaggggcccagcauuguauuuccc

SEQ ID NO: 586141 - RNA, 64 nt, hsa
cucagcagaguuacuguacucaaauggcaugugucuccaagacagcuuaugaauaucuaaaagg

SEQ ID NO: 586142 - RNA, 64 nt, hsa
gaaggagaacugcaaaccucugaagaguuacaugcuccaagacucccuggagcacgugcagcug

SEQ ID NO: 586143 - RNA, 64 nt, hsa
gaacagacucgaucguuagggaauggucuuagaacuccaagauguuccauaaguguuuuuacuu

SEQ ID NO: 586144 - RNA, 64 nt, hsa
gaggaauucaguccccaggcagcccugccucugacuccaagagggugaaguccacagaagugag

SEQ ID NO: 586145 - RNA, 64 nt, hsa
auugguccuacuuucuuucucuggaaaggaaagccuccaagacuccaugugcuugggcagcuug

SEQ ID NO: 586146 - RNA, 64 nt, hsa
ugagaccagacaaagcccgggaggcagaaagaugcuccaagaaccaacacuaucaaugucuuug

SEQ ID NO: 586147 - RNA, 64 nt, hsa
gauuggagagggauggggagggaagggaaggcagcuccaagaagaggucccuguggcgaaguua

SEQ ID NO: 586148 - RNA, 64 nt, hsa
gguuucacuggauuuucuucuucaguaugugcuucuccaagaauacaaaucguccuuguucuua

SEQ ID NO: 586149 - RNA, 64 nt, hsa
ccucuugcguuuuggcccccauuugcucccugagcuccaagauaagaauggccccgagagaacu

SEQ ID NO: 586150 - RNA, 64 nt, hsa
cacugggggcuucuccccaggagaccacgcugcccuccaagaccaggagcagcugugagcugga

SEQ ID NO: 586151 - RNA, 64 nt, hsa
gccaggaggcugcagaacgugugucucccccucccuccaagagguccugcucccucugccagaa

SEQ ID NO: 586152 - RNA, 64 nt, hsa
gggugggaggggcugagauggcugcuggcccggccuccaagaguucuggacaggaggcagacac

SEQ ID NO: 586153 - RNA, 64 nt, hsa
cuuccucuucuuugccgcggacucccuuuccugccuccaagaccuggugucucccacugugagc

SEQ ID NO: 586154 - RNA, 64 nt, hsa
caucauggaggagcggugagaacauggaaccggacuccaagaugacgaucuaaagacccgggag

SEQ ID NO: 586155 - RNA, 64 nt, hsa
ccucucucacuccuugaaaacacuguucucugcccuccaagaccuucuccuucaccuuuguccc

SEQ ID NO: 586156 - RNA, 64 nt, hsa
cuaagcaggguccaagccuggggcugccucugcucuccaagacccaaagacccugggaaccucc

SEQ ID NO: 586157 - RNA, 64 nt, hsa
ucucgcccucccuuuuccucucuccuccugcccccuccaagaaguacugacuggucuccucuau

SEQ ID NO: 586158 - RNA, 64 nt, hsa
uaaauuauccaucacuuuuguuuuaaaguggucccuccaagaauaauguggcauacacaguggg

SEQ ID NO: 586159 - RNA, 64 nt, hsa
ucauucuccuugaugaagccaccgccucuauggacuccaagacugacacccugguucagaacac

SEQ ID NO: 586160 - RNA, 64 nt, hsa
ggacccuugcuuugauaccauucuugggcacauacuccaagauuguauuagauuuuugugauga

SEQ ID NO: 586161 - RNA, 64 nt, hsa
gaucaaguaucaucagauucauccauugaaaaaccuccaagagggcaugaauauggcagagucu

SEQ ID NO: 586162 - RNA, 64 nt, hsa
ucuuuuuuucccuacagggucacccucaggaucucuccaagaaaucuugugucaaauuaguaac

SEQ ID NO: 586163 - RNA, 64 nt, hsa
gugauggaaaaagcgcuguuuccuugccugcuuucuccaagacagauuuucggaacacauuucc

SEQ ID NO: 586164 - RNA, 64 nt, hsa
uucuuccuuuaccccccauuuuuccuauuauucgcuccaagaaagaugcuaagucugagcucca

SEQ ID NO: 586165 - RNA, 64 nt, hsa
gcagaaaaaaaaaaaaccaaaaaggauugcuuuacuccaagaggagagauugucuuaggauaaa

SEQ ID NO: 586166 - RNA, 64 nt, hsa
ggucccacaaagcacuuucuuaaaccuugagaaucuccaagagaaaaauauuuggggaaggagg

SEQ ID NO: 586167 - RNA, 52 nt, hsa
gauacaucacuaaaggcuaaggcuccaagagcuugggaucagaagucagaag

SEQ ID NO: 586168 - RNA, 64 nt, hsa
uggagcugcacaaagucagcagggaccacuaaaucuccaagaccuggugugcggaggcaggagc

SEQ ID NO: 586169 - RNA, 64 nt, hsa
gccccagcaaucgugacugacguuugcuccuugacuccaagaaacugagaccaaagaagcugcu

SEQ ID NO: 586170 - RNA, 64 nt, hsa
uuacuucagggggaccacuguaagaaaagccaaacuccaagaccaaguaaguuagaggagucuu

SEQ ID NO: 586171 - RNA, 64 nt, hsa
acuugguaucacucuuucagauugaagcugacaucuccaagagguacagcgggcgcccugugaa

SEQ ID NO: 586172 - RNA, 64 nt, hsa
cuaacaucguggcuguggagagggucaaggaguacuccaagacagagacagagguggguacugg

SEQ ID NO: 586173 - RNA, 64 nt, hsa
acauggguccacugcaccagugugacaucuacaacuccaagauugccgggaagcuccuggggug

SEQ ID NO: 586174 - RNA, 51 nt, hsa
cagggaguuggggccacugaacuccaagauaaagacaccaugaggggacug

SEQ ID NO: 586175 - RNA, 64 nt, hsa
gaagcucacucccuuccucuccaucucucccucucuccaagacucuggcaguggccuaugaucc

SEQ ID NO: 586176 - RNA, 64 nt, hsa
cagcugcuucggaacaccgucccuccuaugcacccuccaagacgugcagcagaugcaaaggguu

SEQ ID NO: 586177 - RNA, 64 nt, hsa
cagcagccgggacccucuggagagcuuguuuucccuccaagaagagguuugagacaggcggcau

SEQ ID NO: 586178 - RNA, 64 nt, hsa
acuguccacccagccuugcuguuaggcaccaugacuccaagaugaagauguggucccugcccuu

SEQ ID NO: 586179 - RNA, 64 nt, hsa
uuacuauugaacuguauucuaguggcuguucaugcuccaagacuuuaguuaccgagacaugaau

SEQ ID NO: 586180 - RNA, 64 nt, hsa
ugaccacuccaguuaggaugccaagcagccacgucuccaagagcucccgugcguaggcuggaca

SEQ ID NO: 586181 - RNA, 64 nt, hsa
ccacuguuggcucuccagcaaccaaaguacaacacuccaagauggguucaucuuuucuuccuuu

SEQ ID NO: 586182 - RNA, 64 nt, hsa
cccaugaggacaaaguguagcagccuccugccugcuccaagaaaagggcuugcgaaaggaaagc

SEQ ID NO: 586183 - RNA, 64 nt, hsa
gcucagaccagcucuuccgaaaaccaggccuuaucuccaagaccagagauaguggggagacuuc

SEQ ID NO: 586184 - RNA, 64 nt, hsa
agaccauuauuuacagaugcauggaaaacaaagucuccaagaaaacacuucugucuugaugguc

SEQ ID NO: 586185 - RNA, 64 nt, hsa
gggaggugcaggggccaagagagacgugguaggucuccaagagucccacccgggggggaagaag

SEQ ID NO: 586186 - RNA, 64 nt, hsa
cucaggggcuccaugcugggucugaggccccugccuccaagauuuaaccugcaaguugcucuga

SEQ ID NO: 586187 - RNA, 64 nt, hsa
aggcauaugauggggagggggugccccuacccaccuccaagaggcuacagcccugugucuggcc

SEQ ID NO: 586188 - RNA, 64 nt, hsa
gacgcucgugggggaaacauacuaaacggacagacuccaagagcugccaccgcuggggcugcac

SEQ ID NO: 586189 - RNA, 64 nt, hsa
ucccugggagggacaugcuuagcaguccccuucccuccaagaaggauuugguccgucauaaccc

SEQ ID NO: 586190 - RNA, 64 nt, hsa
ggccgaaauuucuacaccugugucuaguccuccccuccaagagcauuaacuauuuaaaacaagg

SEQ ID NO: 586191 - RNA, 64 nt, hsa
auuauuucuucuguaaauauuucagaauguaucucuccaagaugagagcucauuaaaagacaau

SEQ ID NO: 586192 - RNA, 64 nt, hsa
aguuuagagaaaaaaaauuaaaaagaaacaaagucuccaagaaauaugggacuaugugaaaaga

SEQ ID NO: 586193 - RNA, 64 nt, hsa
agaacgccacaaagauacuccuugagaagagcaacuccaagacacauaauugucagauucacca

SEQ ID NO: 586194 - RNA, 64 nt, hsa
uagauucucugugucuaagauucuagaucagaugcuccaagauucuagaugauuaaauaagauu

SEQ ID NO: 586195 - RNA, 64 nt, hsa
ggccaaggucccagaccaagcugaaucacgcuuucuccaagacagcccgcaggcuaagugcauu

SEQ ID NO: 586196 - RNA, 64 nt, hsa
ucaaaacgacgggggcaggugcaaguucauaggucuccaagaccacccuccuuucauuugcuag

SEQ ID NO: 586197 - RNA, 64 nt, hsa
gcuccaggcuucagaaaguggugcugagaacuugcuccaagaagaagucaaaccaaacuugcag

SEQ ID NO: 586198 - RNA, 64 nt, hsa
uucguuggcccgccccuuuccucuggccccuccucuccaagaaaauuagcuccucccucguucu

SEQ ID NO: 586199 - RNA, 64 nt, hsa
aggggagagaagacuuuguuuccgacucaucacccuccaagagggcagcgcucccagugguggg

SEQ ID NO: 586200 - RNA, 64 nt, hsa
ccccaggggauggcccucccccucuaccaagccacuccaagagccagccccuuucugcuccaca

SEQ ID NO: 586201 - RNA, 64 nt, hsa
aggaggaggggacuggggucccggauucuugggucuccaagaagucuguccacagacuucugcc

SEQ ID NO: 586202 - RNA, 64 nt, hsa
gacuggagacaaaacccucugcuuccuugggucccuccaagacucccuggggcccaacuguguu

SEQ ID NO: 586203 - RNA, 64 nt, hsa
cgcccugcacauuccccaccuccacauuccccuccuccaagaucucagcuccuuaacauaucag

SEQ ID NO: 586204 - RNA, 64 nt, hsa
gaaaagaacguauuuuaaaagccacauagagugacuccaagaacaauuguccauggucucaaac

SEQ ID NO: 586205 - RNA, 64 nt, hsa
gggcacuucacagccagccuagggucuucggcaccuccaagagcugaaucucccuccaacccuu

SEQ ID NO: 586206 - RNA, 64 nt, hsa
gcuuuuccagacugugguugugaaccggcuccuucuccaagaaagguugcaagcugagaacauc

SEQ ID NO: 586207 - RNA, 64 nt, hsa
gccaugcagacccaugccccccucccccaggcagcuccaagaaagcucccugacucgccccuuc

SEQ ID NO: 586208 - RNA, 64 nt, hsa
gucugucuccccugccccacugcuggaacagaggcuccaagaaaacagggaccuuauuauucau

SEQ ID NO: 586209 - RNA, 64 nt, hsa
caucccccugguccuaccccuggcccuuggccuccuccaagagggcucaccccgggugcugcuc

SEQ ID NO: 586210 - RNA, 64 nt, hsa
caccagccucgagucucccauguuguaguacauucuccaagaugcagcccaggagccucucuga

SEQ ID NO: 586211 - RNA, 64 nt, hsa
agccgacugcuguucccagacuucccuggccacgcuccaagacgccagcucugccgcgggcacu

SEQ ID NO: 586212 - RNA, 64 nt, hsa
cagagcgggugucagacugaggauuucgcuuccccuccaagacgcugggggucuuggcugcugc

SEQ ID NO: 586213 - RNA, 64 nt, hsa
ugccagauggagccuuuauuccacgucgcguggucuccaagaccccaccuaccucccugaugcu

SEQ ID NO: 586214 - RNA, 64 nt, hsa
cccugggcugugucuccucccuguaccgugucaacuccaagagcuggcaccaggccgggagggc

SEQ ID NO: 586215 - RNA, 64 nt, hsa
ccucagcuccucccuggggaaggaacuagucuuucuccaagaagaacucgacuugucugaaauc

SEQ ID NO: 586216 - RNA, 64 nt, hsa
ccagaagcaucccauggaccauggggugaguguccuccaagagcccccugagcucagcccucug

SEQ ID NO: 586217 - RNA, 64 nt, hsa
aggacugaacuccaucgccaucuucuucccuuaacuccaagaacuugggauaagagugugagag

SEQ ID NO: 586218 - RNA, 64 nt, hsa
uuguccacuucuuuaaggaaugcaguuuauucuacuccaagagauucugccucccuuguguccg

SEQ ID NO: 586219 - RNA, 64 nt, hsa
uuucccacaaccguauaacgaccgauggucauuucuccaagagcaggcuuggcgaguccuugca

SEQ ID NO: 586220 - RNA, 64 nt, hsa
aagugaauuuacuuuuuggguccagaaugacuuucuccaagaauuauaagaugaaaauuauaua

SEQ ID NO: 586221 - RNA, 64 nt, hsa
auaucuaauggagcaauuugucuuuugcuauauucuccaagauuaucucuuaagaccauaugcc

SEQ ID NO: 586222 - RNA, 64 nt, hsa
ccauugccuagaaaccuuugcauucauccuccuucuccaagaccuauggagaaggucccaggcc

SEQ ID NO: 586223 - RNA, 64 nt, hsa
uuucauugauuuaaucauaaauaauggaaauggucuccaagaaguuuuauuuuucauuuuuuug

SEQ ID NO: 586224 - RNA, 64 nt, hsa
uugacaggagggagccugggaaaauaauuuuuuccuccaagauucucagauccagguuaggaaa

SEQ ID NO: 586225 - RNA, 64 nt, hsa
aaaaacaaguuccuuagagguuguauucuuuauucuccaagaaucugucugaaacuuguacagc

SEQ ID NO: 586226 - RNA, 64 nt, hsa
cuucucuuuguguuuguuuuguucuuauuacaaacuccaagacauuucuuagaauugucuacag

SEQ ID NO: 586227 - RNA, 64 nt, hsa
uccuuguugacaacagggguacacucacacagaccuccaagacuuucuucuccaccucuucuuu

SEQ ID NO: 586228 - RNA, 64 nt, hsa
caauuuugauagucugaacacaagcauuucacuucuccaagaaguaccugugaacaguacaaua

SEQ ID NO: 586229 - RNA, 64 nt, hsa; identical to SEQ ID NO: 586228

SEQ ID NO: 586230 - RNA, 65 nt, hsa
aacggucccacccaagccugucaccucugcucauccuccaagaccacccagcuuucucccagcca

SEQ ID NO: 586231 - RNA, 65 nt, hsa
uuucuccucaggacaaggccuugcucacucacucacuccaagaccaccagggucccaggaagccg

SEQ ID NO: 586232 - RNA, 65 nt, hsa
uuccccccucaauugagagcucuuguuauucagagcuccaagacuagaccuggcuaacaaacaua

SEQ ID NO: 586233 - RNA, 65 nt, hsa
cuguuuucaaagcccccgauaaucgcucuuuuccacuccaagaugcccucauaaaccaauguggc

SEQ ID NO: 586234 - RNA, 65 nt, hsa
ugggggcggcuugucuucgcuggcuccuaccccaucuccaagauaagccugagccuuagcuccca

SEQ ID NO: 586235 - RNA, 65 nt, hsa
gauauuauuuaaauguugaaaucuuaaaaaccugccuccaagauuucagaagccaaguuuuucua

SEQ ID NO: 586236 - RNA, 65 nt, hsa
ggaaagauauaauuugagcaguggcuuuaugcagacuccaagaacaaaaccaccagguauuuuuu

SEQ ID NO: 586237 - RNA, 65 nt, hsa
aagaugagaccaaagaaucuggcaaacaucacagacuccaagaauuaccuaauaauccagaucac

SEQ ID NO: 586238 - RNA, 65 nt, hsa
gcuacauuauaagaauaaguaaacauuuccuggaccuccaagaagauuuugauaaagcugcuuua

SEQ ID NO: 586239 - RNA, 65 nt, hsa
ccccucacugcacuuuggaccccuggggccaacaucuccaagacaaaguuuuucagaaaagagga

SEQ ID NO: 586240 - RNA, 65 nt, hsa
ucuguuuccuaauucaggaccccacucaucuagcccuccaagagccuccgccaaauuguagccau

SEQ ID NO: 586241 - RNA, 65 nt, hsa
aguuguucacagauauuuuauguuuuuuuaauuuucuccaagaauauuuauagaauuccaaagaa

SEQ ID NO: 586242 - RNA, 65 nt, hsa
gaaggcugggguuagaguggggagugggcuucuuccuccaagaucucagucucucagugcuuggc

SEQ ID NO: 586243 - RNA, 65 nt, hsa
gcauugacccgucuccaucggaccccagccccuaucuccaagagacagaggaggggucaggaggc

SEQ ID NO: 586244 - RNA, 65 nt, hsa
gaggcuugcccagauagacuaacaacccuuuagugcuccaagaagugagaauuuccgaaaaagau

SEQ ID NO: 586245 - RNA, 65 nt, hsa
ucugagccuggucuuuuguccuuuuuuauuuuggucuccaagaugaaugcucaucuuuggagggu

SEQ ID NO: 586246 - RNA, 65 nt, hsa
gacuaaagggcuugucuugguggggucucccaccccuccaagacccauucugcacagucccucca

SEQ ID NO: 586247 - RNA, 65 nt, hsa
gauuugaucugcucaucuucaguugaaugcccucacuccaagacuggaugcuggaucucauagaa

SEQ ID NO: 586248 - RNA, 65 nt, hsa
cauugaaacagaaggaaaugcuguggaccacagaacuccaagaauuguuuaaaaaaaaaaaagug

SEQ ID NO: 586249 - RNA, 65 nt, hsa
cagcauuucaugggggcugaggcagaacccaggagcuccaagaaaggccacccauagagcucauc

SEQ ID NO: 586250 - RNA, 65 nt, hsa
caggcaccucagugggguuccgggccaccucaggacuccaagaggcuguguggagccaccacucc

SEQ ID NO: 586251 - RNA, 65 nt, hsa
ggcagggagugauagccaaacuccuuggucaccugcuccaagaaggaagcaguagcugagcaccu

SEQ ID NO: 586252 - RNA, 65 nt, hsa
augcccaugagcugacauuuuacucaucccucugccuccaagaaggccuguauuauacguguccu

SEQ ID NO: 586253 - RNA, 65 nt, hsa
guacaaacuugaagcaaguugccuucuaauuuuuacuccaagauuguuucauaucuauuccuuaa

SEQ ID NO: 586254 - RNA, 65 nt, hsa
ccuggccggcuuuucuccaucuggggacaguccuacuccaagaacacugcacaccagcuccucac

SEQ ID NO: 586255 - RNA, 65 nt, hsa
uccucagauaagcccuuaggcaccagcuuagacaccuccaagaaccaggccccgcugaugcaaga

SEQ ID NO: 586256 - RNA, 65 nt, hsa
gagguggcagggcggaggaccugcuugggaagaaacuccaagaagauuggaaugcuuccaaagca

SEQ ID NO: 586257 - RNA, 65 nt, hsa
cggaaauggacaccaagaauaucuccugaggaucacuccaagaaaagagauccacauaccauucu

SEQ ID NO: 586258 - RNA, 65 nt, hsa
gggacuucguugguuuuuuggagucuugguugugacuccaagagcagagugaggaagacccccaa

SEQ ID NO: 586259 - RNA, 65 nt, hsa
agggacuuuguuggcuuuuagaguguuggucaugacuccaagagcagagcagggaagagcccaag

SEQ ID NO: 586260 - RNA, 65 nt, hsa
ggauuuuccccuuuuucuacccacuccuuugcuuccuccaagacuuacccaacuccuucccccuc

SEQ ID NO: 586261 - RNA, 65 nt, hsa
ggaucccuauuccuaccccaucuauucucuguuggcuccaagagcuaccccagagaccuuaaaca

SEQ ID NO: 586262 - RNA, 65 nt, hsa
cauuuagaaacaaguucuaggguggguuggaaaaucuccaagagcccugaccucaucuuccaccu

SEQ ID NO: 586263 - RNA, 65 nt, hsa
cgcuaaggugaaaagggguguggcaaaggagccuacuccaagaauggaggcuguaggaauauaac

SEQ ID NO: 586264 - RNA, 65 nt, hsa
gaaaugaaacccaggcaaccagccuagaagaaacacuccaagauauucauuaagugcuuuguuuc

SEQ ID NO: 586265 - RNA, 65 nt, hsa
aaacguguugccuugaaccacuucccucaucucuccuccaagacacuguggacuuggucaccagc

SEQ ID NO: 586266 - RNA, 65 nt, hsa
aucacauuaaaaaaaacccauacauaagaaacagccuccaagaacauucaagcagcagucagaga

SEQ ID NO: 586267 - RNA, 65 nt, hsa
ugagcaagauuguguuuuagagaggaaacuugaaacuccaagaaagcacuugauguuuuuauaug

SEQ ID NO: 586268 - RNA, 65 nt, hsa
caaggugagcucgcugaguccagccucguggucuucuccaagaugccgccagaugcccagccuac

SEQ ID NO: 586269 - RNA, 65 nt, hsa
cugcauuccagccugguugacagagugacccuugucuccaagaaaaaaaaaaagcaaaugggauu

SEQ ID NO: 586270 - RNA, 65 nt, hsa
cacccccaagaaaccuccauccugccaggagcagccuccaagaaacuuuuaaaaaauagauuugc

SEQ ID NO: 586271 - RNA, 65 nt, hsa
gcuucagaugacacguuuuguuuagagcuacuuugcuccaagacucuuaagcccaaaguaacugg

SEQ ID NO: 586272 - RNA, 65 nt, hsa
guguggcuuaguaauagaucacggcauguuucccgcuccaagagaauucacuuuaccuucagcag

SEQ ID NO: 586273 - RNA, 65 nt, hsa
agccugcccucgggcucugcucaccucuggugacccuccaagaugccccugcccucaguuucccc

SEQ ID NO: 586274 - RNA, 65 nt, hsa
aucucaguccugcaucuuuucuucugcuuucuucccuccaagagcaaaaccugggcaaggggacu

SEQ ID NO: 586275 - RNA, 65 nt, hsa
cauccauucacagccaggagaugcugggccaguuccuccaagaggucuccaucauggcagugaug

SEQ ID NO: 586276 - RNA, 65 nt, hsa
accagguguuuuaagguuaaguguuuaaagaaguacuccaagaacaaucugcuuuuuucaucauu

SEQ ID NO: 586277 - RNA, 65 nt, hsa
aaagacaggaugaccuuggacaaggccaaacuguccuccaagacuccuuaaugaggggcaggagu

SEQ ID NO: 586278 - RNA, 65 nt, hsa
uuaagauuuuuacuucaucuuucuugggccugcaccuccaagauaacaaagaagaagcaaugguc

SEQ ID NO: 586279 - RNA, 65 nt, hsa
augagcuagaggaagaugaggggggaugcgaguaccuccaagaagaaaaaucacacucugaaugg

SEQ ID NO: 586280 - RNA, 65 nt, hsa
gugaucuguguacaauuuuagucacuaagacuuuccuccaagaacuaagccaacuugaugugaaa

SEQ ID NO: 586281 - RNA, 55 nt, hsa; identical to SEQ ID NO: 585961

SEQ ID NO: 586282 - RNA, 65 nt, hsa
uuaauuugcucuuagguucuaucucuguagaaugucuccaagauugaagaagaaacugagcaguu

SEQ ID NO: 586283 - RNA, 65 nt, hsa
cgcacaucucuucugggcggccaccugaggagugacuccaagaagaguuccggcagcuuucccca

SEQ ID NO: 586284 - RNA, 65 nt, hsa
cccugcagcagccucgcgccccgcguuccgggcggcuccaagagagagcggagcaagugucccgg

SEQ ID NO: 586285 - RNA, 65 nt, hsa
aguggaaaacugcaugggaggcaaaaugcucuguucuccaagaggacccggaaguaaucacauag

SEQ ID NO: 586286 - RNA, 65 nt, hsa
gauuaaaggaaggggcacaauucgcuaucacacaccuccaagaucaagauccuguucugagucag

SEQ ID NO: 586287 - RNA, 65 nt, hsa
gggucuaaaauuuuuaaggacuuuccuuccuccaucuccaagaaugcugaaaccaagggggauga

SEQ ID NO: 586288 - RNA, 65 nt, hsa
acgaccaaggggucuucauuuccaugaaaaagggacuccaagaggcagugguggcuguggccccc

SEQ ID NO: 586289 - RNA, 65 nt, hsa
acgguuccccagagcuuuggggaccacgcgaaaaccuccaagauauuuuucacaaaauagaaacu

SEQ ID NO: 586290 - RNA, 65 nt, hsa
ucuuagguaggugcuuaacucuugugguggccagccuccaagaugagccccaguguucuugccuc

SEQ ID NO: 586291 - RNA, 65 nt, hsa
gacaaaugugauaaugacaugauuucccaccugcccuccaagaaaauggugacucacucucaagu

SEQ ID NO: 586292 - RNA, 65 nt, hsa
uguuuuuacuggaaacauagcaaaccuugauuuagcuccaagaaauugaguagggaaauauuugu

SEQ ID NO: 586293 - RNA, 65 nt, hsa
guaaagagcaaaggcaacgcccucagggucccuuccuccaagauggccauguaggguaauggaga

SEQ ID NO: 586294 - RNA, 65 nt, hsa
guaaauacucugaauaagagaccgguacuagcuaacuccaagagaucguuagcagcaucagucca

SEQ ID NO: 586295 - RNA, 65 nt, hsa
agauauugcgccugugugcguguguauaagucaagcuccaagaggcuccugaaugugacuggcgu

SEQ ID NO: 586296 - RNA, 65 nt, hsa
uccuagguuuuccuuccaagcacccagcccuccugcuccaagagggauaaccugcaccccucccu

SEQ ID NO: 586297 - RNA, 65 nt, hsa
uucucagcuucuuuggccuucuguaagaggggcuucuccaagagcaugucacuaguuuucuagaa

SEQ ID NO: 586298 - RNA, 65 nt, hsa
guaagaaaaagaaacuauuugcuccuuggcgaggacuccaagaacucacugaugcacgccgaguu

SEQ ID NO: 586299 - RNA, 65 nt, hsa
aaagagcuggagaacuccauguacuuuggaaucuccuccaagauagccagaguuuaauacaucuu

SEQ ID NO: 586300 - RNA, 65 nt, hsa
guuccuauggcuggccacugcacagagcucuccagcuccaagaccuguugguuccaagcccugga

SEQ ID NO: 586301 - RNA, 65 nt, hsa
cuucuccuggugucuacauguuugcuuagaggcggcuccaagagcccccagagcugccugcauag

SEQ ID NO: 586302 - RNA, 65 nt, hsa
ucaggaagcuucuagagacuuuaugcccuccagagcuccaagauauaagcccuccaagggaucag

SEQ ID NO: 586303 - RNA, 65 nt, hsa
gagagggcucuuccuccaaauccuccccaccuguccuccaagaacagccuucccugcgcccaggc

SEQ ID NO: 586304 - RNA, 65 nt, hsa
ugugcuccucggcagaugcuguuguuguuacuucccuccaagaggcuggaaaagggcucagagcu

SEQ ID NO: 586305 - RNA, 65 nt, hsa
uaggaaaacaaaaaccucucuccucagccuuccaccuccaagagaggaggaaaaacaguugucug

SEQ ID NO: 586306 - RNA, 65 nt, hsa
guguguugugaaaguuuggaaggucagaccuuuuucuccaagaaggacaagccccuguguaagaa

SEQ ID NO: 586307 - RNA, 57 nt, hsa; identical to SEQ ID NO: 585987

SEQ ID NO: 586308 - RNA, 65 nt, hsa
acuuguaaauagcacuaguuagacucuuuagaauacuccaagaguuagggcagcagaguggagcg

SEQ ID NO: 586309 - RNA, 65 nt, hsa
gaacaaauuuguucuuccugauaugauaacuaggucuccaagagaaaauagaaaggcugcuuuag

SEQ ID NO: 586310 - RNA, 65 nt, hsa
uucgaccuccaguucucccugaugacaguagcugucuccaagagaaaaauccucacuuauuaacu

SEQ ID NO: 586311 - RNA, 65 nt, hsa
agaguaaacuccacaucuuugcacuaccuguuugccuccaagagacuaucaguuccuuggggaca

SEQ ID NO: 586312 - RNA, 65 nt, hsa
gauaguaggacccaagggaaaggaagggaagagugcuccaagacuuggaccaggcacacacacac

SEQ ID NO: 586313 - RNA, 65 nt, hsa
aaaaugaaugaaacagucaaaugguuugccucauucuccaagagccacaacucaagcugaacugu

SEQ ID NO: 586314 - RNA, 65 nt, hsa
agcaacagugcccccuccguccacuacgcuccugucuccaagaauguuuugcuagagcuaacaga

SEQ ID NO: 586315 - RNA, 65 nt, hsa
ugauagauuuucugcuacuuugcugcuaugguuuucuccaagagcuacauaauuuaguuucauau

SEQ ID NO: 586316 - RNA, 65 nt, hsa
augaucuggacuuccuauaauacaaauacacaauccuccaagaauuugacuuggaaaaaaauguc

SEQ ID NO: 586317 - RNA, 65 nt, hsa
aacucauucaaggaggugaaaaugauggaugacuccuccaagaugaaaauggaccagccgcagug

SEQ ID NO: 586318 - RNA, 65 nt, hsa
agagaugcaaagagaagcgagagaggcaccuuguucuccaagaacuuacuguccaaucaugcugu

SEQ ID NO: 586319 - RNA, 65 nt, hsa
gaaagaaaagaacacuugcccagggcagcuuugcccuccaagaggcucccuccugucucuaaguc

SEQ ID NO: 586320 - RNA, 65 nt, hsa
uguggcuugaacuugccagaugcaaauaccacagacuccaagaaaacccgaguugggguuuguuu

SEQ ID NO: 586321 - RNA, 65 nt, hsa
ccuguuuuagggguuauacauuuggacugugcauucuccaagagaugaagcggugaaguugggau

SEQ ID NO: 586322 - RNA, 65 nt, hsa
uaguggaagcuuaauggaaaaggaaaguuaugauccuccaagacccuuaauugauagaccauacc

SEQ ID NO: 586323 - RNA, 65 nt, hsa
uacugaauuugcacaccuccuugccaccuuccuuccuccaagauaccaucuccucauccuaaccc

SEQ ID NO: 586324 - RNA, 65 nt, hsa
cuucuugcuauaugauuuagcaaguucuagaaggucuccaagacaauaauuacauuggcacaaug

SEQ ID NO: 586325 - RNA, 65 nt, hsa
uucagaccuuugauacgcuaaugugcauuuuaaaucuccaagaagcaccucuauuuuauacauca

SEQ ID NO: 586326 - RNA, 65 nt, hsa
cauuuaugagacauucuugcuauaacuaagugcuucuccaagaccccaacugaguccccagcacc

SEQ ID NO: 586327 - RNA, 65 nt, hsa
ucagagugugaaaacgaguuucucuuuuacagauucuccaagauuuguuucugugcccaacuuuc

SEQ ID NO: 586328 - RNA, 65 nt, hsa
gaauacuggcccugucgacuauugccacccugcuucuccaagagcagaccaggccaccucauccg

SEQ ID NO: 586329 - RNA, 65 nt, hsa
uacauuccaaaaggaaguucaacaguaagcagcaccuccaagacugucuccuuuuggccaauauc

SEQ ID NO: 586330 - RNA, 65 nt, hsa
ccguuccugacaucacagcagccuccaacacaaggcuccaagaccuaggcucauggacgagaugg

SEQ ID NO: 586331 - RNA, 65 nt, hsa
auaugucagaucaaccuggaaggaaagaccuucuacuccaagaaggacaggccucucugcaagag

SEQ ID NO: 586332 - RNA, 65 nt, hsa
cuccauggacuucugagccgacagucuucccuucucuccaagaggccucaguccccaagacugcc

SEQ ID NO: 586333 - RNA, 65 nt, hsa
uagagacacagagugaugugaggcguuggcuuuuucuccaagaagguacagauaccucagauucg

SEQ ID NO: 586334 - RNA, 65 nt, hsa
uccacggucuguucuugaagcaguagccuaacacacuccaagauauggacacacgggagccgcug

SEQ ID NO: 586335 - RNA, 65 nt, hsa
ucugucaugcaguguugucccuuccuaccuucuuccuccaagagaguaucaugaaguaaacuaca

SEQ ID NO: 586336 - RNA, 65 nt, hsa
caggcucccuugggaaagcccugcuuugcuccaggcuccaagaucuccuggcuaagucagcaagu

SEQ ID NO: 586337 - RNA, 65 nt, hsa
aaacauuucuuucuuacaguucuggaggcuggaaacuccaagauuaaggcagauuucaugccuau

SEQ ID NO: 586338 - RNA, 65 nt, hsa
uuccauuuguccaguuaauacuuccucuuaaaaaucuccaagaagcugggucuccagaucccauu

SEQ ID NO: 586339 - RNA, 65 nt, hsa
aggggcucuccagaccccuuuuccaugaugacccacuccaagauauuauguguaaauuguguuau

SEQ ID NO: 586340 - RNA, 65 nt, hsa
uuguucagccacuauggaaagcaguuuggagauuucuccaagaacuuaaaauagaacuaccauuc

SEQ ID NO: 586341 - RNA, 65 nt, hsa
uucccucuuccuguguccccagauccccacuacagcuccaagaggaugggccuagaaagccaagu

SEQ ID NO: 586342 - RNA, 65 nt, hsa
gccucagggguccccuucugcaccgcuggcuuccacuccaagaagguggaccagggucugcaagu

SEQ ID NO: 586343 - RNA, 65 nt, hsa
ggccccuccccucccgaacacugagaaauagugcacuccaagaaacguggaucucccccucaucc

SEQ ID NO: 586344 - RNA, 65 nt, hsa
caaugcaugugacugauaaagagauaacacccugucuccaagacacaggcuuuacauaaacagcu

SEQ ID NO: 586345 - RNA, 65 nt, hsa
guccuagaauguuucauuugcacaaguagggcugccuccaagaggaaccucugauuuauuuugua

SEQ ID NO: 586346 - RNA, 65 nt, hsa
guguaacagggucacaagaauucgacagccagaugcuccaagaggguggcccaaggcuauagccc

SEQ ID NO: 586347 - RNA, 65 nt, hsa
ugaaaagugcuuuaggugagaugacuaaauuaugccuccaagaaaaaaaaauuaaagugcuuuuc

SEQ ID NO: 586348 - RNA, 65 nt, hsa
aauccgauucuuuaaaaugcaccaucagaccuggccuccaagaagagcuguagcguaccaugcgu

SEQ ID NO: 586349 - RNA, 65 nt, hsa
uuuucuccaaaggccauccuuuuggggccaccuggcuccaagaagcaucgcuggucuuggggacg

SEQ ID NO: 586350 - RNA, 65 nt, hsa
aaugaauucuaaaccaaucaaaugucugggaagcccuccaagaaaaaaaauagaaaagcacuuga

SEQ ID NO: 586351 - RNA, 65 nt, hsa
gaaagagcaucuucucucccacugcaccccuucuccuccaagaauaguugcccacauucccaaaa

SEQ ID NO: 586352 - RNA, 65 nt, hsa
aagaggcccccagggaguugugagcagauuagacccuccaagaccgccccagggguuggcccaug

SEQ ID NO: 586353 - RNA, 65 nt, hsa
uacugcaucagccccugugagccuggcuucagugucuccaagaacuguaaccucggcaagugcca

SEQ ID NO: 586354 - RNA, 65 nt, hsa
aucauccugguagcucuccugaugcucguuuuccgcuccaagagagaggugaaacggugagcgag

SEQ ID NO: 586355 - RNA, 65 nt, hsa
uugccuuuuguuaaaagaugguaaaccagaucugucuccaagaccuuggccucuccuuggaggac

SEQ ID NO: 586356 - RNA, 65 nt, hsa
uagaagucacauuccugaacaggauauucucacagcuccaagaauuucuaggacugaauuaugaa

SEQ ID NO: 586357 - RNA, 65 nt, hsa
gaggcccauuaguugagaaagucacagauauauuucuccaagaaagccaacaaccaccaccacaa

SEQ ID NO: 586358 - RNA, 65 nt, hsa
gcgccaucuaugguguggaugggaaacugcuccagcuccaagagguuuuucagcucuuugacaac

SEQ ID NO: 586359 - RNA, 65 nt, hsa
uucuuugauaaaagaaaaauaagucagauuguuaacuccaagauugaaaaaaaaaacucuugaaa

SEQ ID NO: 586360 - RNA, 59 nt, hsa; identical to SEQ ID NO: 586040

SEQ ID NO: 586361 - RNA, 65 nt, hsa
uaaacuggggucuaaauccuaaagcaaaauugaaacuccaagaugcaaaguccagaguggcauuu

SEQ ID NO: 586362 - RNA, 65 nt, hsa
ugacauugaaauuguuuaagagccugauauucuuccuccaagaauuugaucucaguacccauuua

SEQ ID NO: 586363 - RNA, 65 nt, hsa
gcccuucagcacaggaccuggugacaugacauaaacuccaagacagaaccucaguuuacagcaca

SEQ ID NO: 586364 - RNA, 65 nt, hsa
agcauacaacagcaugccaacaguaauauauuauucuccaagacuuuaccuauguaaguguucaa

SEQ ID NO: 586365 - RNA, 65 nt, hsa
uuaggcagagagcucagauggcccuuuuaagggggcuccaagaaccaacaucacugcucuuuuag

SEQ ID NO: 586366 - RNA, 65 nt, hsa
uucggacugaggccuucucaaacuuuacucuaagucuccaagaauacagaaaaugcuuuuccgcg

SEQ ID NO: 586367 - RNA, 65 nt, hsa
cauuuuuguaaaaguuuaaugacccacuuuagaugcuccaagaacaagcaucccuuccauguaug

SEQ ID NO: 586368 - RNA, 65 nt, hsa
cuucccugaguccucaccagcccuccccauuuguccuccaagacuccacucaaacaucuccucuu

SEQ ID NO: 586369 - RNA, 65 nt, hsa
cuaagguggauucagugucuggcacacugagacaccuccaagaaggagauugaugcaucagguuc

SEQ ID NO: 586370 - RNA, 65 nt, hsa
ucggaaaauucaugcagauauggauggaaagaagacuccaagaggaaaacgaggauggaaaaccu

SEQ ID NO: 586371 - RNA, 65 nt, hsa
ucugucccuguaaaagagaggggcaaauagagagucuccaagagaacgcccucaugcucagcaca

SEQ ID NO: 586372 - RNA, 65 nt, hsa
acgacauaacagaauugcccuccaagucacacaagcuccaagacuaaacaaacagacagguccuc

SEQ ID NO: 586373 - RNA, 65 nt, hsa
uaccucaacaagacugagagccuuuccccgcuucucuccaagaaggagacguucagcuagauuug

SEQ ID NO: 586374 - RNA, 65 nt, hsa
aguggcaauauagaaacacgaacuuuagcugcauccuccaagaaucuaucugcuuaugcaguuuu

SEQ ID NO: 586375 - RNA, 65 nt, hsa
aacccuuugagccuuacaucucauucacugucuuucuccaagaaaaguauuuugggcggacaguc

SEQ ID NO: 586376 - RNA, 65 nt, hsa
acaaaaacuuuacaauacauuuauguugaauggaacuccaagaucucaccucuccauccaggaau

SEQ ID NO: 586377 - RNA, 65 nt, hsa
aauagcggcccuggaggauguuagacuugcucccucuccaagacagcagcagccugcaccugccc

SEQ ID NO: 586378 - RNA, 65 nt, hsa
cccuccucccccggcugggccuccuucuuccacuucuccaagaauggaagccugaacugaggccu

SEQ ID NO: 586379 - RNA, 65 nt, hsa
ggauuaaauauguauuuuguagacucuuucccggucuccaagaacaaaguaaaugauucuauuuu

SEQ ID NO: 586380 - RNA, 65 nt, hsa
ccagacaggucucuauuuuuuuaaguuauccaggacuccaagaaccauaguuacugaaaagggag

SEQ ID NO: 586381 - RNA, 65 nt, hsa
uucacuacuuuaauaaagaauuaacagagauugaacuccaagagguggguaauuugguuuaaaaa

SEQ ID NO: 586382 - RNA, 65 nt, hsa
cccccaagugccugccccuccccagaguauuaacgcuccaagaguauuauuaacgcugcuguacc

SEQ ID NO: 586383 - RNA, 65 nt, hsa
ggcugguugugcugcaggcucccccugaggccccucuccaagaggagcacacuuuggggagaugu

SEQ ID NO: 586384 - RNA, 65 nt, hsa
agcugggggagccaccccucggccauucccuccaccuccaagacagguggcggccgggcaggcac

SEQ ID NO: 586385 - RNA, 65 nt, hsa
aauugaguguguucuaagugaaggcaaugggguuucuccaagacagccuguguggccucuacucu

SEQ ID NO: 586386 - RNA, 65 nt, hsa
cuccccaaaacuguugguaaaugucagauuuuuuccuccaagaguugugcuuuuguguuauuugu

SEQ ID NO: 586387 - RNA, 65 nt, hsa
ccugucacaguaacgugaaaacugauuauucuuuacuccaagagaauguuuuaacccaagcaagu

SEQ ID NO: 586388 - RNA, 65 nt, hsa
uaagugguaguccaaauuuucuuuaagcagcugcucuccaagacagggcccuggaaaggcccaca

SEQ ID NO: 586389 - RNA, 65 nt, hsa
gccugagcaccaugauucccacagccagcucuuggcuccaagaugagcacccacaggaagccgac

SEQ ID NO: 586390 - RNA, 65 nt, hsa
guguugaacuucaaccugagggggccgacagugcccuccaagacagagacgacugaacuuuuggg

SEQ ID NO: 586391 - RNA, 65 nt, hsa
guucuguuuuucuccuagucccucuccugccaccucuccaagacuuccgugggacacccacuucc

SEQ ID NO: 586392 - RNA, 65 nt, hsa
cacccagacaucugacuaauggcucugugcccacacuccaagaccugugccuuuuagagaagcuc

SEQ ID NO: 586393 - RNA, 65 nt, hsa
gugugucccagaugcugucauuagucuauaugguucuccaagaaacugaaugaauccauuggaga

SEQ ID NO: 586394 - RNA, 65 nt, hsa
aaggcccugcuuccuggaaaggacacucagagcagcuccaagacagaggcucuguggcggggguc

SEQ ID NO: 586395 - RNA, 65 nt, hsa
auuguuucuaaugucucugaacucaaagugaggugcuccaagacgcugugaacuucugcaaagac

SEQ ID NO: 586396 - RNA, 65 nt, hsa
gggguaucuuuuucuuuugacuccccuuauucccucuccaagaguaguugcacuuaacuuuuuuu

SEQ ID NO: 586397 - RNA, 65 nt, hsa
uaagugauaguccaaauuuucuuuaagcagcugcucuccaagacagggcccuggaaagaggccca

SEQ ID NO: 586398 - RNA, 65 nt, hsa
ucuguugaauaacaucgguguaauuacaaagucaacuccaagaauguguauuuacaauauuugcc

SEQ ID NO: 586399 - RNA, 65 nt, hsa
gagcuuacucaccccggagucuuuucuuucucuugcuccaagaagagcccuguuggugcuuuacc

SEQ ID NO: 586400 - RNA, 65 nt, hsa
guuaaaacguuuucuaacaguuuacuguugcuuaucuccaagauauuauggaauuaagaauuuuu

SEQ ID NO: 586401 - RNA, 65 nt, hsa
acgcuccuccaccccuuccagaccaagcucaacgccuccaagaccagcaggccaaggccaagccc

SEQ ID NO: 586402 - RNA, 65 nt, hsa
gugcaaggcaccccauccacacauuugcaccacuacuccaagauaguauuuuucuuuucacacaa

SEQ ID NO: 586403 - RNA, 65 nt, hsa
gccacccccuucccuguccuuccccaacuccccagcuccaagaguggaagaaauccccaagauca

SEQ ID NO: 586404 - RNA, 65 nt, hsa
ccggccccagauagcagccccagggaggaugcugccuccaagaggugugagcccucugucucggg

SEQ ID NO: 586405 - RNA, 65 nt, hsa
cugugggagguuaagaggagucccuucuggguugacuccaagagccaaggagauggcagacccug

SEQ ID NO: 586406 - RNA, 65 nt, hsa
ugaggacuuaagguugcaagaaugaagauuucagacuccaagaucccuuauucuuugggccuuga

SEQ ID NO: 586407 - RNA, 65 nt, hsa
cucggagaccuguuuaacaagcaaaaaucaaaacccuccaagauugucucauauucuaccuggac

SEQ ID NO: 586408 - RNA, 65 nt, hsa
aauagggcccaaaccuuuuuauuuuacaauaugagcuccaagacacuuacugaucuacugugaau

SEQ ID NO: 586409 - RNA, 65 nt, hsa
aacaauccccgagggcugcugcuuugcgucuguggcuccaagaagugccuguggucaggccccag

SEQ ID NO: 586410 - RNA, 65 nt, hsa
caaauuuucauuuuuaauguaauccccaagauuuucuccaagaaauaaauuguuguuuuguauuu

SEQ ID NO: 586411 - RNA, 65 nt, hsa
agucgcgcaucuccgugguuaucccgcugucuccucuccaagaacaagcagagcccgggccacug

SEQ ID NO: 586412 - RNA, 65 nt, hsa
uccagcgccuggaggaggcaggggcaggaagcggccuccaagacccuucgccuugggacaggaau

SEQ ID NO: 586413 - RNA, 65 nt, hsa
cuuuaaacuguaguaguuggucuagaaacaaaauacuccaagaaaaagaaaauuuucaaauaaaa

SEQ ID NO: 586414 - RNA, 65 nt, hsa
cacaaccacucaccaguccuaguuuuagaccucaucuccaagauagcaucccaucucagaagaug

SEQ ID NO: 586415 - RNA, 65 nt, hsa
uccgucuguagcaggagcuagggcugcugccucagcuccaagacaagaaugaaccuggcuguguc

SEQ ID NO: 586416 - RNA, 65 nt, hsa
uccagagcuagauccugaugggucucuaagguucccuccaagaagacaaggacaggagacuuggg

SEQ ID NO: 586417 - RNA, 65 nt, hsa
uuuguccagaugggccucggagcaccagucacuuacuccaagaagucguuuccuguggccaauaa

SEQ ID NO: 586418 - RNA, 65 nt, hsa
agugcuugaaauggacaagcuggaccuauuccucacuccaagacuuguucuacaggaaagggucc

SEQ ID NO: 586419 - RNA, 65 nt, hsa
ugcccguugcucuugggcugguuuccccugaacaccuccaagaggcugccugccuugccagcacc

SEQ ID NO: 586420 - RNA, 65 nt, hsa
auccuggaguggagcauuuagcccaggucuuaauucuccaagaggaggaauacauaguaugguaa

SEQ ID NO: 586421 - RNA, 65 nt, hsa
auggcaccucccucccucucaaccacuugagcaaacuccaagacaccuucuaccccaacaccagc

SEQ ID NO: 586422 - RNA, 65 nt, hsa
ucuuuguuaguagucuuaaagcugcugccauaguccuccaagaagaaagcaccaagacaacauuu

SEQ ID NO: 586423 - RNA, 65 nt, hsa
uucagagacccaggaguugggagcuuucgcuccuucuccaagacucaggccugugggcacucuau

SEQ ID NO: 586424 - RNA, 65 nt, hsa
uaugccuuccuguccuuucuacucaaugguccccacuccaagaugaguugacacaaccccuuccc

SEQ ID NO: 586425 - RNA, 65 nt, hsa
uauaaggaauaaaaggaaaaacuuucuuccucucucuccaagaggauaugggaagcuucugugag

SEQ ID NO: 586426 - RNA, 65 nt, hsa
caccugugcaggccccauggcaccaucuaucuggccuccaagaugagaaaggagcaugggacaga

SEQ ID NO: 586427 - RNA, 65 nt, hsa
aggucugcuucuuccacuuauacuuagucucugugcuccaagaggucaaauuuuugcuucuagaa

SEQ ID NO: 586428 - RNA, 65 nt, hsa
aaaguuuuuuuguuuuuguuuuuguuuuguggcuccuccaagauauagguacaugaaguuuaggu

SEQ ID NO: 586429 - RNA, 65 nt, hsa
gaagaugggaauuaccuucaucccucucucuuugccuccaagaaguguaaccgccuugaagagcu

SEQ ID NO: 586430 - RNA, 65 nt, hsa
aggggaagcaagauggguaagggcucaggaaguugcuccaagaacaguagcugaugaagcugccc

SEQ ID NO: 586431 - RNA, 65 nt, hsa
uuaguugaccuucaaauauucaagcuauucugcagcuccaagaugcaauuauagaaacagcuccu

SEQ ID NO: 586432 - RNA, 65 nt, hsa
accauagaacaauuucacugcaaacaugcaugauucuccaagacaaaagaagagagauccuaaag

SEQ ID NO: 586433 - RNA, 65 nt, hsa
ugaaccaggguauuuuuguuagguuuucuaugugacuccaagagggaauggucaaguuguuucau

SEQ ID NO: 586434 - RNA, 65 nt, hsa
aaaacagagacaugguucuauaaugcuucaugucccuccaagauuugagaucaauuuagggauug

SEQ ID NO: 586435 - RNA, 65 nt, hsa
cuccagcuucuacgcucacagcaacugcuuaccugcuccaagaagaugggaggaaggggagcccc

SEQ ID NO: 586436 - RNA, 65 nt, hsa
uauucccagggaaccccagggggcaacugacauugcuccaagauguucuccugauguagcuugag

SEQ ID NO: 586437 - RNA, 65 nt, hsa
cacggaaaguuaucuuacagcaaacuguaguuugccuccaagacaccauugucucccuuuaaucu

SEQ ID NO: 586438 - RNA, 65 nt, hsa
ggacgcgccgcucccucaugcugcccgggcccuuccuccaagacccuacagagccugaggggcac

SEQ ID NO: 586439 - RNA, 65 nt, hsa
cuuauuuaaaagccaaacgugcccugagcccucuccuccaagagguccccucagcaucaagcagc

SEQ ID NO: 586440 - RNA, 65 nt, hsa
gagacucugaggacauggagagagacucaaagagacuccaagauucaaagagacuaauagagaca

SEQ ID NO: 586441 - RNA, 65 nt, hsa
cuacauaggcaaagagaauucgagggauagacagucuccaagaaaagugaaguggugggagagaa

SEQ ID NO: 586442 - RNA, 65 nt, hsa
uauuacuguccacauuuuacaggcaaggaaacaggcuccaagaggcugaggacuuugcccaggau

SEQ ID NO: 586443 - RNA, 65 nt, hsa
cggcgauucugauuucccuucucaaaucugcucaacuccaagagucuugagaaacugcuaaaauu

SEQ ID NO: 586444 - RNA, 65 nt, hsa
guggagauaaggcuggacuggucuaucagauugaacuccaagaaugaucacacaaaauguuuagg

SEQ ID NO: 586445 - RNA, 65 nt, hsa
uccaguguccgccaucuucaggguugcacagaauccuccaagauacuuugcagccuuuuuucccc

SEQ ID NO: 586446 - RNA, 65 nt, hsa
cuaucuuucuuccaccagacuccaagcccacucuccuccaagacuguguugucuuuucucaccaa

SEQ ID NO: 586447 - RNA, 65 nt, hsa
ugauccugcuuauuguaacugacaacuguuuucaacuccaagagcuaaacuauuggcaguucaug

SEQ ID NO: 586448 - RNA, 65 nt, hsa
aggacugaagauuggcaaaaacgaaaagcuucuuccuccaagagcccauugaagaagcccaguga

SEQ ID NO: 586449 - RNA, 65 nt, hsa
ccacaagcugaacuguggcauagcucucucuucuucuccaagaagacucagcagccuacauuccc

SEQ ID NO: 586450 - RNA, 65 nt, hsa
auuuucaguuuuaaaugugggcaaaaaggcauuuucuccaagauuuuaaaacuaauucuuauuuu

SEQ ID NO: 586451 - RNA, 65 nt, hsa
gcucacucccuaaagcccucuucaggggucaccuccuccaagaagcccuccuugccaccccccgc

SEQ ID NO: 586452 - RNA, 65 nt, hsa
aucauagcgggaaauaaagcaccuuccaagcuugccuccaagaguuacgaguuaaggaagagugc

SEQ ID NO: 586453 - RNA, 65 nt, hsa
guuaggaauguggugcucuuguugggggaagugagcuccaagaguagcuuuuuuucaucucuuag

SEQ ID NO: 586454 - RNA, 65 nt, hsa
cucucccaacccucugguuggugauucaacuugggcuccaagacuuggguaagcucugggccuuc

SEQ ID NO: 586455 - RNA, 65 nt, hsa
gccuuggggcauuauggguucuucccccacuuccccuccaagacccuguguucauuugguguucc

SEQ ID NO: 586456 - RNA, 65 nt, hsa
gccaaggggcaggaggcacccucucuuauccccuccuccaagagcaguagagaauuuaagcacaa

SEQ ID NO: 586457 - RNA, 65 nt, hsa
aucugacauuuuagaaaagccgaacaguagauagucuccaagaugggaaacaugucgugugucug

SEQ ID NO: 586458 - RNA, 65 nt, hsa
gccgccucuccaaaauaaccggccacacucccaaacuccaagacagccauacuuccagcgaaaug

SEQ ID NO: 586459 - RNA, 65 nt, hsa
cauuaggauuagagacaaguucuguuuagaaauaacuccaagauugggaggccgaccugggugga

SEQ ID NO: 586460 - RNA, 65 nt, hsa
uggaccugagcccgcacauuccacucccauucucccuccaagaggggcccagcauuguauuuccc

SEQ ID NO: 586461 - RNA, 65 nt, hsa
ucucagcagaguuacuguacucaaauggcaugugucuccaagacagcuuaugaauaucuaaaagg

SEQ ID NO: 586462 - RNA, 65 nt, hsa
ugaaggagaacugcaaaccucugaagaguuacaugcuccaagacucccuggagcacgugcagcug

SEQ ID NO: 586463 - RNA, 65 nt, hsa
ugaacagacucgaucguuagggaauggucuuagaacuccaagauguuccauaaguguuuuuacuu

SEQ ID NO: 586464 - RNA, 65 nt, hsa
agaggaauucaguccccaggcagcccugccucugacuccaagagggugaaguccacagaagugag

SEQ ID NO: 586465 - RNA, 65 nt, hsa
gauugguccuacuuucuuucucuggaaaggaaagccuccaagacuccaugugcuugggcagcuug

SEQ ID NO: 586466 - RNA, 65 nt, hsa
cugagaccagacaaagcccgggaggcagaaagaugcuccaagaaccaacacuaucaaugucuuug

SEQ ID NO: 586467 - RNA, 65 nt, hsa
ggauuggagagggauggggagggaagggaaggcagcuccaagaagaggucccuguggcgaaguua

SEQ ID NO: 586468 - RNA, 65 nt, hsa
ugguuucacuggauuuucuucuucaguaugugcuucuccaagaauacaaaucguccuuguucuua

SEQ ID NO: 586469 - RNA, 65 nt, hsa
uccucuugcguuuuggcccccauuugcucccugagcuccaagauaagaauggccccgagagaacu

SEQ ID NO: 586470 - RNA, 65 nt, hsa
gcacugggggcuucuccccaggagaccacgcugcccuccaagaccaggagcagcugugagcugga

SEQ ID NO: 586471 - RNA, 65 nt, hsa
ggccaggaggcugcagaacgugugucucccccucccuccaagagguccugcucccucugccagaa

SEQ ID NO: 586472 - RNA, 65 nt, hsa
ggggugggaggggcugagauggcugcuggcccggccuccaagaguucuggacaggaggcagacac

SEQ ID NO: 586473 - RNA, 65 nt, hsa
ucuuccucuucuuugccgcggacucccuuuccugccuccaagaccuggugucucccacugugagc

SEQ ID NO: 586474 - RNA, 65 nt, hsa
ucaucauggaggagcggugagaacauggaaccggacuccaagaugacgaucuaaagacccgggag

SEQ ID NO: 586475 - RNA, 65 nt, hsa
accucucucacuccuugaaaacacuguucucugcccuccaagaccuucuccuucaccuuuguccc

SEQ ID NO: 586476 - RNA, 65 nt, hsa
gcuaagcaggguccaagccuggggcugccucugcucuccaagacccaaagacccugggaaccucc

SEQ ID NO: 586477 - RNA, 65 nt, hsa
uucucgcccucccuuuuccucucuccuccugcccccuccaagaaguacugacuggucuccucuau

SEQ ID NO: 586478 - RNA, 65 nt, hsa
guaaauuauccaucacuuuuguuuuaaaguggucccuccaagaauaauguggcauacacaguggg

SEQ ID NO: 586479 - RNA, 65 nt, hsa
aucauucuccuugaugaagccaccgccucuauggacuccaagacugacacccugguucagaacac

SEQ ID NO: 586480 - RNA, 65 nt, hsa
uggacccuugcuuugauaccauucuugggcacauacuccaagauuguauuagauuuuugugauga

SEQ ID NO: 586481 - RNA, 65 nt, hsa
ggaucaaguaucaucagauucauccauugaaaaaccuccaagagggcaugaauauggcagagucu

SEQ ID NO: 586482 - RNA, 65 nt, hsa
uucuuuuuuucccuacagggucacccucaggaucucuccaagaaaucuugugucaaauuaguaac

SEQ ID NO: 586483 - RNA, 65 nt, hsa
ggugauggaaaaagcgcuguuuccuugccugcuuucuccaagacagauuuucggaacacauuucc

SEQ ID NO: 586484 - RNA, 65 nt, hsa
uuucuuccuuuaccccccauuuuuccuauuauucgcuccaagaaagaugcuaagucugagcucca

SEQ ID NO: 586485 - RNA, 65 nt, hsa
ugcagaaaaaaaaaaaaccaaaaaggauugcuuuacuccaagaggagagauugucuuaggauaaa

SEQ ID NO: 586486 - RNA, 65 nt, hsa
cggucccacaaagcacuuucuuaaaccuugagaaucuccaagagaaaaauauuuggggaaggagg

SEQ ID NO: 586487 - RNA, 52 nt, hsa; identical to SEQ ID NO: 586167

SEQ ID NO: 586488 - RNA, 65 nt, hsa
uuggagcugcacaaagucagcagggaccacuaaaucuccaagaccuggugugcggaggcaggagc

SEQ ID NO: 586489 - RNA, 65 nt, hsa
ggccccagcaaucgugacugacguuugcuccuugacuccaagaaacugagaccaaagaagcugcu

SEQ ID NO: 586490 - RNA, 65 nt, hsa
uuuacuucagggggaccacuguaagaaaagccaaacuccaagaccaaguaaguuagaggagucuu

SEQ ID NO: 586491 - RNA, 65 nt, hsa
accaaggagcugcagaagcugauugaagcugacaucuccaagagguacagcgggcgcccugugaa

SEQ ID NO: 586492 - RNA, 65 nt, hsa
ucuaacaucguggcuguggagagggucaaggaguacuccaagacagagacagagguggguacugg

SEQ ID NO: 586493 - RNA, 65 nt, hsa
cacauggguccacugcaccagugugacaucuacaacuccaagauugccgggaagcuccuggggug

SEQ ID NO: 586494 - RNA, 51 nt, hsa; identical to SEQ ID NO: 586174

SEQ ID NO: 586495 - RNA, 65 nt, hsa
cgaagcucacucccuuccucuccaucucucccucucuccaagacucuggcaguggccuaugaucc

SEQ ID NO: 586496 - RNA, 65 nt, hsa
gcagcugcuucggaacaccgucccuccuaugcacccuccaagacgugcagcagaugcaaaggguu

SEQ ID NO: 586497 - RNA, 65 nt, hsa
ccagcagccgggacccucuggagagcuuguuuucccuccaagaagagguuugagacaggcggcau

SEQ ID NO: 586498 - RNA, 65 nt, hsa
gacuguccacccagccuugcuguuaggcaccaugacuccaagaugaagauguggucccugcccuu

SEQ ID NO: 586499 - RNA, 65 nt, hsa
uuuacuauugaacuguauucuaguggcuguucaugcuccaagacuuuaguuaccgagacaugaau

SEQ ID NO: 586500 - RNA, 65 nt, hsa
cugaccacuccaguuaggaugccaagcagccacgucuccaagagcucccgugcguaggcuggaca

SEQ ID NO: 586501 - RNA, 65 nt, hsa
uccacuguuggcucuccagcaaccaaaguacaacacuccaagauggguucaucuuuucuuccuuu

SEQ ID NO: 586502 - RNA, 65 nt, hsa
gcccaugaggacaaaguguagcagccuccugccugcuccaagaaaagggcuugcgaaaggaaagc

SEQ ID NO: 586503 - RNA, 65 nt, hsa
ugcucagaccagcucuuccgaaaaccaggccuuaucuccaagaccagagauaguggggagacuuc

SEQ ID NO: 586504 - RNA, 65 nt, hsa
cagaccauuauuuacagaugcauggaaaacaaagucuccaagaaaacacuucugucuugaugguc

SEQ ID NO: 586505 - RNA, 65 nt, hsa
ugggaggugcaggggccaagagagacgugguaggucuccaagagucccacccgggggggaagaag

SEQ ID NO: 586506 - RNA, 65 nt, hsa
gcucaggggcuccaugcugggucugaggccccugccuccaagauuuaaccugcaaguugcucuga

SEQ ID NO: 586507 - RNA, 65 nt, hsa
uaggcauaugauggggagggggugccccuacccaccuccaagaggcuacagcccugugucuggcc

SEQ ID NO: 586508 - RNA, 65 nt, hsa
cgacgcucgugggggaaacauacuaaacggacagacuccaagagcugccaccgcuggggcugcac

SEQ ID NO: 586509 - RNA, 65 nt, hsa
gucccugggagggacaugcuuagcaguccccuucccuccaagaaggauuugguccgucauaaccc

SEQ ID NO: 586510 - RNA, 65 nt, hsa
uggccgaaauuucuacaccugugucuaguccuccccuccaagagcauuaacuauuuaaaacaagg

SEQ ID NO: 586511 - RNA, 65 nt, hsa
gauuauuucuucuguaaauauuucagaauguaucucuccaagaugagagcucauuaaaagacaau

SEQ ID NO: 586512 - RNA, 65 nt, hsa
aaguuuagagaaaaaaaauuaaaaagaaacaaagucuccaagaaauaugggacuaugugaaaaga

SEQ ID NO: 586513 - RNA, 65 nt, hsa
gagaacgccacaaagauacuccuugagaagagcaacuccaagacacauaauugucagauucacca

SEQ ID NO: 586514 - RNA, 65 nt, hsa
uuagauucucugugucuaagauucuagaucagaugcuccaagauucuagaugauuaaauaagauu

SEQ ID NO: 586515 - RNA, 65 nt, hsa
gggccaaggucccagaccaagcugaaucacgcuuucuccaagacagcccgcaggcuaagugcauu

SEQ ID NO: 586516 - RNA, 65 nt, hsa
cucaaaacgacgggggcaggugcaaguucauaggucuccaagaccacccuccuuucauuugcuag

SEQ ID NO: 586517 - RNA, 65 nt, hsa
agcuccaggcuucagaaaguggugcugagaacuugcuccaagaagaagucaaaccaaacuugcag

SEQ ID NO: 586518 - RNA, 65 nt, hsa
cuucguuggcccgccccuuuccucuggccccuccucuccaagaaaauuagcuccucccucguucu

SEQ ID NO: 586519 - RNA, 65 nt, hsa
gaggggagagaagacuuuguuuccgacucaucacccuccaagagggcagcgcucccagugguggg

SEQ ID NO: 586520 - RNA, 65 nt, hsa
uccccaggggauggcccucccccucuaccaagccacuccaagagccagccccuuucugcuccaca

SEQ ID NO: 586521 - RNA, 65 nt, hsa
gaggaggaggggacuggggucccggauucuugggucuccaagaagucuguccacagacuucugcc

SEQ ID NO: 586522 - RNA, 65 nt, hsa
ggacuggagacaaaacccucugcuuccuugggucccuccaagacucccuggggcccaacuguguu

SEQ ID NO: 586523 - RNA, 65 nt, hsa
ucgcccugcacauuccccaccuccacauuccccuccuccaagaucucagcuccuuaacauaucag

SEQ ID NO: 586524 - RNA, 65 nt, hsa
agaaaagaacguauuuuaaaagccacauagagugacuccaagaacaauuguccauggucucaaac

SEQ ID NO: 586525 - RNA, 65 nt, hsa
ugggcacuucacagccagccuagggucuucggcaccuccaagagcugaaucucccuccaacccuu

SEQ ID NO: 586526 - RNA, 65 nt, hsa
ugcuuuuccagacugugguugugaaccggcuccuucuccaagaaagguugcaagcugagaacauc

SEQ ID NO: 586527 - RNA, 65 nt, hsa
ugccaugcagacccaugccccccucccccaggcagcuccaagaaagcucccugacucgccccuuc

SEQ ID NO: 586528 - RNA, 65 nt, hsa
ugucugucuccccugccccacugcuggaacagaggcuccaagaaaacagggaccuuauuauucau

SEQ ID NO: 586529 - RNA, 65 nt, hsa
acaucccccugguccuaccccuggcccuuggccuccuccaagagggcucaccccgggugcugcuc

SEQ ID NO: 586530 - RNA, 65 nt, hsa
gcaccagccucgagucucccauguuguaguacauucuccaagaugcagcccaggagccucucuga

SEQ ID NO: 586531 - RNA, 65 nt, hsa
cagccgacugcuguucccagacuucccuggccacgcuccaagacgccagcucugccgcgggcacu

SEQ ID NO: 586532 - RNA, 65 nt, hsa
gcagagcgggugucagacugaggauuucgcuuccccuccaagacgcugggggucuuggcugcugc

SEQ ID NO: 586533 - RNA, 65 nt, hsa
gugccagauggagccuuuauuccacgucgcguggucuccaagaccccaccuaccucccugaugcu

SEQ ID NO: 586534 - RNA, 65 nt, hsa
acccugggcugugucuccucccuguaccgugucaacuccaagagcuggcaccaggccgggagggc

SEQ ID NO: 586535 - RNA, 65 nt, hsa
gccucagcuccucccuggggaaggaacuagucuuucuccaagaagaacucgacuugucugaaauc

SEQ ID NO: 586536 - RNA, 65 nt, hsa
gccagaagcaucccauggaccauggggugaguguccuccaagagcccccugagcucagcccucug

SEQ ID NO: 586537 - RNA, 65 nt, hsa
aaggacugaacuccaucgccaucuucuucccuuaacuccaagaacuugggauaagagugugagag

SEQ ID NO: 586538 - RNA, 65 nt, hsa
cuuguccacuucuuuaaggaaugcaguuuauucuacuccaagagauucugccucccuuguguccg

SEQ ID NO: 586539 - RNA, 65 nt, hsa
cuuucccacaaccguauaacgaccgauggucauuucuccaagagcaggcuuggcgaguccuugca

SEQ ID NO: 586540 - RNA, 65 nt, hsa
gaagugaauuuacuuuuuggguccagaaugacuuucuccaagaauuauaagaugaaaauuauaua

SEQ ID NO: 586541 - RNA, 65 nt, hsa
aauaucuaauggagcaauuugucuuuugcuauauucuccaagauuaucucuuaagaccauaugcc

SEQ ID NO: 586542 - RNA, 65 nt, hsa
cccauugccuagaaaccuuugcauucauccuccuucuccaagaccuauggagaaggucccaggcc

SEQ ID NO: 586543 - RNA, 65 nt, hsa
guuucauugauuuaaucauaaauaauggaaauggucuccaagaaguuuuauuuuucauuuuuuug

SEQ ID NO: 586544 - RNA, 65 nt, hsa
uuugacaggagggagccugggaaaauaauuuuuuccuccaagauucucagauccagguuaggaaa

SEQ ID NO: 586545 - RNA, 65 nt, hsa
gaaaaacaaguuccuuagagguuguauucuuuauucuccaagaaucugucugaaacuuguacagc

SEQ ID NO: 586546 - RNA, 65 nt, hsa
ucuucucuuuguguuuguuuuguucuuauuacaaacuccaagacauuucuuagaauugucuacag

SEQ ID NO: 586547 - RNA, 65 nt, hsa
uuccuuguugacaacagggguacacucacacagaccuccaagacuuucuucuccaccucuucuuu

SEQ ID NO: 586548 - RNA, 65 nt, hsa
acaauuuugauagucugaacacaagcauuucacuucuccaagaaguaccugugaacaguacaaua

SEQ ID NO: 586549 - RNA, 65 nt, hsa; identical to SEQ ID NO: 586548

SEQ ID NO: 586550 - RNA, 64 nt, hsa; identical to SEQ ID NO: 120914

SEQ ID NO: 586551 - RNA, 64 nt, hsa; identical to SEQ ID NO: 120915

SEQ ID NO: 586552 - RNA, 64 nt, hsa; identical to SEQ ID NO: 341009

SEQ ID NO: 586553 - RNA, 64 nt, hsa; identical to SEQ ID NO: 341010

SEQ ID NO: 586554 - RNA, 64 nt, hsa; identical to SEQ ID NO: 341011

SEQ ID NO: 586555 - RNA, 64 nt, hsa; identical to SEQ ID NO: 341012

SEQ ID NO: 586556 - RNA, 64 nt, hsa; identical to SEQ ID NO: 341013

SEQ ID NO: 586557 - RNA, 64 nt, hsa; identical to SEQ ID NO: 341014

SEQ ID NO: 586558 - RNA, 64 nt, hsa; identical to SEQ ID NO: 341015

SEQ ID NO: 586559 - RNA, 64 nt, hsa; identical to SEQ ID NO: 341016

SEQ ID NO: 586560 - RNA, 64 nt, hsa; identical to SEQ ID NO: 341017

SEQ ID NO: 586561 - RNA, 64 nt, hsa; identical to SEQ ID NO: 341018

SEQ ID NO: 586562 - RNA, 64 nt, hsa; identical to SEQ ID NO: 341019

SEQ ID NO: 586563 - RNA, 64 nt, hsa; identical to SEQ ID NO: 341020

SEQ ID NO: 586564 - RNA, 64 nt, hsa; identical to SEQ ID NO: 341021

SEQ ID NO: 586565 - RNA, 64 nt, hsa; identical to SEQ ID NO: 341022

SEQ ID NO: 586566 - RNA, 64 nt, hsa; identical to SEQ ID NO: 341023

SEQ ID NO: 586567 - RNA, 64 nt, hsa; identical to SEQ ID NO: 341024

SEQ ID NO: 586568 - RNA, 64 nt, hsa; identical to SEQ ID NO: 341025

SEQ ID NO: 586569 - RNA, 64 nt, hsa; identical to SEQ ID NO: 341026

SEQ ID NO: 586570 - RNA, 64 nt, hsa; identical to SEQ ID NO: 341027

SEQ ID NO: 586571 - RNA, 64 nt, hsa; identical to SEQ ID NO: 341028

SEQ ID NO: 586572 - RNA, 64 nt, hsa; identical to SEQ ID NO: 341029

SEQ ID NO: 586573 - RNA, 64 nt, hsa; identical to SEQ ID NO: 341030

SEQ ID NO: 586574 - RNA, 64 nt, hsa; identical to SEQ ID NO: 341031

SEQ ID NO: 586575 - RNA, 64 nt, hsa; identical to SEQ ID NO: 341032

SEQ ID NO: 586576 - RNA, 64 nt, hsa; identical to SEQ ID NO: 341033

SEQ ID NO: 586577 - RNA, 64 nt, hsa; identical to SEQ ID NO: 341034

SEQ ID NO: 586578 - RNA, 64 nt, hsa; identical to SEQ ID NO: 341035

SEQ ID NO: 586579 - RNA, 64 nt, hsa; identical to SEQ ID NO: 341036

SEQ ID NO: 586580 - RNA, 64 nt, hsa; identical to SEQ ID NO: 341037

SEQ ID NO: 586581 - RNA, 64 nt, hsa; identical to SEQ ID NO: 341038

SEQ ID NO: 586582 - RNA, 64 nt, hsa; identical to SEQ ID NO: 341039

SEQ ID NO: 586583 - RNA, 64 nt, hsa; identical to SEQ ID NO: 341040

SEQ ID NO: 586584 - RNA, 64 nt, hsa; identical to SEQ ID NO: 341041

SEQ ID NO: 586585 - RNA, 64 nt, hsa
uauagaccuggggcugcaguuggggacuucaugucagugcaaaugccauuaguuccauuuguac

SEQ ID NO: 586586 - RNA, 64 nt, hsa
uaauuuaaggaacaaguaacuaaaaauguuaagccagugcaaaauaaucugcuuaccuacucac

SEQ ID NO: 586587 - RNA, 64 nt, hsa
cgcccugacaccugcuucuaaugagaaaugaagucagugcaaggaggaaugagagguggggagg

SEQ ID NO: 586588 - RNA, 64 nt, hsa
aauaucauguccaggccuggaaagaauacaaauccagugcaaaauuaaaccauuaguucuugau

SEQ ID NO: 586589 - RNA, 64 nt, hsa
aguacucaguaagacagugcagugcucaguaaggcagugcaauacucaguaacaguguaguacu

SEQ ID NO: 586590 - RNA, 64 nt, hsa
gugcaguacucaggaaugcagcacaguacucaggcagugcaauacucagugcgguacucaguaa

SEQ ID NO: 586591 - RNA, 64 nt, hsa
uucaagucucuuuuaccccuggcagagccaguugcagugcaauuuuuuguacuaaaugccaaua

SEQ ID NO: 586592 - RNA, 64 nt, hsa
agaaaaaauugucugaaauguuuauuuugcaaaacagugcaauagaaucuaguuaugccuucau

SEQ ID NO: 586593 - RNA, 64 nt, hsa
cuuucugguuuuaauuuuuaguugugcuuugagucagugcaauaaacuagacuuuuuccaaacc

SEQ ID NO: 586594 - RNA, 64 nt, hsa
ugugagaaguguccucagccgacacucacgagggcagugcaagggagaaccugccagcccagcc

SEQ ID NO: 586595 - RNA, 64 nt, hsa
uccauuccacgcaguugcucaaagcagaaauuuucagugcaagucuugaugcugcgccgucccc

SEQ ID NO: 586596 - RNA, 64 nt, hsa
gcccaggcuggaguacaauggugcgaucucagcucagugcaaccuccgccacccggguucaggc

SEQ ID NO: 586597 - RNA, 64 nt, hsa; identical to SEQ ID NO: 353575

SEQ ID NO: 586598 - RNA, 64 nt, hsa; identical to SEQ ID NO: 353576

SEQ ID NO: 586599 - RNA, 64 nt, hsa; identical to SEQ ID NO: 161197

SEQ ID NO: 586600 - RNA, 64 nt, hsa; identical to SEQ ID NO: 161198

SEQ ID NO: 586601 - RNA, 64 nt, hsa; identical to SEQ ID NO: 161199

SEQ ID NO: 586602 - RNA, 64 nt, hsa; identical to SEQ ID NO: 161200

SEQ ID NO: 586603 - RNA, 64 nt, hsa; identical to SEQ ID NO: 161201

SEQ ID NO: 586604 - RNA, 64 nt, hsa; identical to SEQ ID NO: 161202

SEQ ID NO: 586605 - RNA, 64 nt, hsa; identical to SEQ ID NO: 161203

SEQ ID NO: 586606 - RNA, 64 nt, hsa; identical to SEQ ID NO: 161204

SEQ ID NO: 586607 - RNA, 64 nt, hsa; identical to SEQ ID NO: 161205

SEQ ID NO: 586608 - RNA, 64 nt, hsa; identical to SEQ ID NO: 161206

SEQ ID NO: 586609 - RNA, 64 nt, hsa; identical to SEQ ID NO: 161207

SEQ ID NO: 586610 - RNA, 64 nt, hsa; identical to SEQ ID NO: 161208

SEQ ID NO: 586611 - RNA, 64 nt, hsa; identical to SEQ ID NO: 161209

SEQ ID NO: 586612 - RNA, 64 nt, hsa; identical to SEQ ID NO: 161210

SEQ ID NO: 586613 - RNA, 64 nt, hsa; identical to SEQ ID NO: 161211

SEQ ID NO: 586614 - RNA, 64 nt, hsa; identical to SEQ ID NO: 161212

SEQ ID NO: 586615 - RNA, 64 nt, hsa; identical to SEQ ID NO: 161213

SEQ ID NO: 586616 - RNA, 64 nt, hsa; identical to SEQ ID NO: 161214

SEQ ID NO: 586617 - RNA, 64 nt, hsa; identical to SEQ ID NO: 161215

SEQ ID NO: 586618 - RNA, 64 nt, hsa; identical to SEQ ID NO: 161216

SEQ ID NO: 586619 - RNA, 64 nt, hsa; identical to SEQ ID NO: 161217

SEQ ID NO: 586620 - RNA, 64 nt, hsa; identical to SEQ ID NO: 161218

SEQ ID NO: 586621 - RNA, 64 nt, hsa; identical to SEQ ID NO: 161219

SEQ ID NO: 586622 - RNA, 64 nt, hsa; identical to SEQ ID NO: 161220

SEQ ID NO: 586623 - RNA, 64 nt, hsa; identical to SEQ ID NO: 161221

SEQ ID NO: 586624 - RNA, 64 nt, hsa; identical to SEQ ID NO: 161222

SEQ ID NO: 586625 - RNA, 64 nt, hsa; identical to SEQ ID NO: 161223

SEQ ID NO: 586626 - RNA, 64 nt, hsa; identical to SEQ ID NO: 161224

SEQ ID NO: 586627 - RNA, 64 nt, hsa; identical to SEQ ID NO: 161225

SEQ ID NO: 586628 - RNA, 64 nt, hsa; identical to SEQ ID NO: 161226

SEQ ID NO: 586629 - RNA, 64 nt, hsa; identical to SEQ ID NO: 161227

SEQ ID NO: 586630 - RNA, 64 nt, hsa; identical to SEQ ID NO: 161228

SEQ ID NO: 586631 - RNA, 64 nt, hsa; identical to SEQ ID NO: 161229

SEQ ID NO: 586632 - RNA, 64 nt, hsa; identical to SEQ ID NO: 161230

SEQ ID NO: 586633 - RNA, 64 nt, hsa; identical to SEQ ID NO: 161231

SEQ ID NO: 586634 - RNA, 64 nt, hsa; identical to SEQ ID NO: 161232

SEQ ID NO: 586635 - RNA, 60 nt, hsa; identical to SEQ ID NO: 161233

SEQ ID NO: 586636 - RNA, 64 nt, hsa; identical to SEQ ID NO: 161234

SEQ ID NO: 586637 - RNA, 64 nt, hsa; identical to SEQ ID NO: 161235

SEQ ID NO: 586638 - RNA, 64 nt, hsa; identical to SEQ ID NO: 161236

SEQ ID NO: 586639 - RNA, 64 nt, hsa; identical to SEQ ID NO: 161237

SEQ ID NO: 586640 - RNA, 64 nt, hsa; identical to SEQ ID NO: 161238

SEQ ID NO: 586641 - RNA, 64 nt, hsa; identical to SEQ ID NO: 161239

SEQ ID NO: 586642 - RNA, 64 nt, hsa; identical to SEQ ID NO: 161240

SEQ ID NO: 586643 - RNA, 64 nt, hsa; identical to SEQ ID NO: 161241

SEQ ID NO: 586644 - RNA, 64 nt, hsa; identical to SEQ ID NO: 161242

SEQ ID NO: 586645 - RNA, 64 nt, hsa; identical to SEQ ID NO: 161243

SEQ ID NO: 586646 - RNA, 64 nt, hsa; identical to SEQ ID NO: 161244

SEQ ID NO: 586647 - RNA, 64 nt, hsa; identical to SEQ ID NO: 161245

SEQ ID NO: 586648 - RNA, 64 nt, hsa; identical to SEQ ID NO: 161246

SEQ ID NO: 586649 - RNA, 64 nt, hsa; identical to SEQ ID NO: 161247

SEQ ID NO: 586650 - RNA, 64 nt, hsa; identical to SEQ ID NO: 161248

SEQ ID NO: 586651 - RNA, 64 nt, hsa; identical to SEQ ID NO: 161249

SEQ ID NO: 586652 - RNA, 64 nt, hsa; identical to SEQ ID NO: 161250

SEQ ID NO: 586653 - RNA, 64 nt, hsa; identical to SEQ ID NO: 161251

SEQ ID NO: 586654 - RNA, 64 nt, hsa; identical to SEQ ID NO: 161252

SEQ ID NO: 586655 - RNA, 64 nt, hsa; identical to SEQ ID NO: 161253

SEQ ID NO: 586656 - RNA, 64 nt, hsa; identical to SEQ ID NO: 161254

SEQ ID NO: 586657 - RNA, 64 nt, hsa; identical to SEQ ID NO: 161255

SEQ ID NO: 586658 - RNA, 64 nt, hsa; identical to SEQ ID NO: 161256

SEQ ID NO: 586659 - RNA, 64 nt, hsa; identical to SEQ ID NO: 161257

SEQ ID NO: 586660 - RNA, 64 nt, hsa; identical to SEQ ID NO: 161258

SEQ ID NO: 586661 - RNA, 64 nt, hsa; identical to SEQ ID NO: 161259

SEQ ID NO: 586662 - RNA, 64 nt, hsa; identical to SEQ ID NO: 161260

SEQ ID NO: 586663 - RNA, 64 nt, hsa; identical to SEQ ID NO: 161261

SEQ ID NO: 586664 - RNA, 64 nt, hsa; identical to SEQ ID NO: 161262

SEQ ID NO: 586665 - RNA, 64 nt, hsa; identical to SEQ ID NO: 161263

SEQ ID NO: 586666 - RNA, 64 nt, hsa; identical to SEQ ID NO: 161264

SEQ ID NO: 586667 - RNA, 64 nt, hsa; identical to SEQ ID NO: 161265

SEQ ID NO: 586668 - RNA, 64 nt, hsa; identical to SEQ ID NO: 161266

SEQ ID NO: 586669 - RNA, 64 nt, hsa; identical to SEQ ID NO: 161267

SEQ ID NO: 586670 - RNA, 64 nt, hsa; identical to SEQ ID NO: 161268

SEQ ID NO: 586671 - RNA, 64 nt, hsa; identical to SEQ ID NO: 161269

SEQ ID NO: 586672 - RNA, 64 nt, hsa; identical to SEQ ID NO: 161270

SEQ ID NO: 586673 - RNA, 64 nt, hsa; identical to SEQ ID NO: 161271

SEQ ID NO: 586674 - RNA, 64 nt, hsa; identical to SEQ ID NO: 161272

SEQ ID NO: 586675 - RNA, 64 nt, hsa; identical to SEQ ID NO: 161273

SEQ ID NO: 586676 - RNA, 64 nt, hsa; identical to SEQ ID NO: 161274

SEQ ID NO: 586677 - RNA, 64 nt, hsa; identical to SEQ ID NO: 161275

SEQ ID NO: 586678 - RNA, 64 nt, hsa; identical to SEQ ID NO: 161276

SEQ ID NO: 586679 - RNA, 64 nt, hsa; identical to SEQ ID NO: 161277

SEQ ID NO: 586680 - RNA, 64 nt, hsa; identical to SEQ ID NO: 161278

SEQ ID NO: 586681 - RNA, 64 nt, hsa; identical to SEQ ID NO: 161279

SEQ ID NO: 586682 - RNA, 63 nt, hsa; identical to SEQ ID NO: 161280

SEQ ID NO: 586683 - RNA, 64 nt, hsa; identical to SEQ ID NO: 161281

SEQ ID NO: 586684 - RNA, 64 nt, hsa; identical to SEQ ID NO: 161282

SEQ ID NO: 586685 - RNA, 64 nt, hsa; identical to SEQ ID NO: 161283

SEQ ID NO: 586686 - RNA, 64 nt, hsa; identical to SEQ ID NO: 161284

SEQ ID NO: 586687 - RNA, 64 nt, hsa; identical to SEQ ID NO: 261645

SEQ ID NO: 586688 - RNA, 64 nt, hsa; identical to SEQ ID NO: 261646

SEQ ID NO: 586689 - RNA, 64 nt, hsa; identical to SEQ ID NO: 261647

SEQ ID NO: 586690 - RNA, 64 nt, hsa; identical to SEQ ID NO: 261648

SEQ ID NO: 586691 - RNA, 64 nt, hsa; identical to SEQ ID NO: 263253

SEQ ID NO: 586692 - RNA, 64 nt, hsa; identical to SEQ ID NO: 263254

SEQ ID NO: 586693 - RNA, 64 nt, hsa; identical to SEQ ID NO: 263255

SEQ ID NO: 586694 - RNA, 64 nt, hsa; identical to SEQ ID NO: 263256

SEQ ID NO: 586695 - RNA, 64 nt, hsa; identical to SEQ ID NO: 263257

SEQ ID NO: 586696 - RNA, 64 nt, hsa; identical to SEQ ID NO: 263258

SEQ ID NO: 586697 - RNA, 64 nt, hsa; identical to SEQ ID NO: 263259

SEQ ID NO: 586698 - RNA, 64 nt, hsa; identical to SEQ ID NO: 263260

SEQ ID NO: 586699 - RNA, 64 nt, hsa; identical to SEQ ID NO: 263261

SEQ ID NO: 586700 - RNA, 64 nt, hsa; identical to SEQ ID NO: 263262

SEQ ID NO: 586701 - RNA, 64 nt, hsa; identical to SEQ ID NO: 263263

SEQ ID NO: 586702 - RNA, 64 nt, hsa; identical to SEQ ID NO: 263264

SEQ ID NO: 586703 - RNA, 64 nt, hsa; identical to SEQ ID NO: 263265

SEQ ID NO: 586704 - RNA, 64 nt, hsa; identical to SEQ ID NO: 263266

SEQ ID NO: 586705 - RNA, 64 nt, hsa; identical to SEQ ID NO: 263267

SEQ ID NO: 586706 - RNA, 64 nt, hsa; identical to SEQ ID NO: 263268

SEQ ID NO: 586707 - RNA, 64 nt, hsa; identical to SEQ ID NO: 263269

SEQ ID NO: 586708 - RNA, 64 nt, hsa; identical to SEQ ID NO: 263270

SEQ ID NO: 586709 - RNA, 64 nt, hsa; identical to SEQ ID NO: 263271

SEQ ID NO: 586710 - RNA, 64 nt, hsa; identical to SEQ ID NO: 263272

SEQ ID NO: 586711 - RNA, 59 nt, hsa; identical to SEQ ID NO: 263273

SEQ ID NO: 586712 - RNA, 64 nt, hsa; identical to SEQ ID NO: 24683

SEQ ID NO: 586713 - RNA, 64 nt, hsa; identical to SEQ ID NO: 24684

SEQ ID NO: 586714 - RNA, 64 nt, hsa; identical to SEQ ID NO: 24685

SEQ ID NO: 586715 - RNA, 64 nt, hsa; identical to SEQ ID NO: 24686

SEQ ID NO: 586716 - RNA, 64 nt, hsa; identical to SEQ ID NO: 24687

SEQ ID NO: 586717 - RNA, 64 nt, hsa; identical to SEQ ID NO: 24688

SEQ ID NO: 586718 - RNA, 64 nt, hsa; identical to SEQ ID NO: 24689

SEQ ID NO: 586719 - RNA, 64 nt, hsa; identical to SEQ ID NO: 24690

SEQ ID NO: 586720 - RNA, 64 nt, hsa; identical to SEQ ID NO: 24691

SEQ ID NO: 586721 - RNA, 64 nt, hsa; identical to SEQ ID NO: 24692

SEQ ID NO: 586722 - RNA, 64 nt, hsa; identical to SEQ ID NO: 24693

SEQ ID NO: 586723 - RNA, 64 nt, hsa; identical to SEQ ID NO: 24694

SEQ ID NO: 586724 - RNA, 64 nt, hsa; identical to SEQ ID NO: 24695

SEQ ID NO: 586725 - RNA, 64 nt, hsa; identical to SEQ ID NO: 24696

SEQ ID NO: 586726 - RNA, 64 nt, hsa; identical to SEQ ID NO: 24697

SEQ ID NO: 586727 - RNA, 64 nt, hsa; identical to SEQ ID NO: 24698

SEQ ID NO: 586728 - RNA, 64 nt, hsa; identical to SEQ ID NO: 24699

SEQ ID NO: 586729 - RNA, 64 nt, hsa; identical to SEQ ID NO: 24700

SEQ ID NO: 586730 - RNA, 64 nt, hsa; identical to SEQ ID NO: 24701

SEQ ID NO: 586731 - RNA, 64 nt, hsa; identical to SEQ ID NO: 24702

SEQ ID NO: 586732 - RNA, 64 nt, hsa; identical to SEQ ID NO: 24703

SEQ ID NO: 586733 - RNA, 64 nt, hsa; identical to SEQ ID NO: 24704

SEQ ID NO: 586734 - RNA, 64 nt, hsa; identical to SEQ ID NO: 24705

SEQ ID NO: 586735 - RNA, 64 nt, hsa; identical to SEQ ID NO: 24706

SEQ ID NO: 586736 - RNA, 64 nt, hsa; identical to SEQ ID NO: 24707

SEQ ID NO: 586737 - RNA, 64 nt, hsa; identical to SEQ ID NO: 24708

SEQ ID NO: 586738 - RNA, 64 nt, hsa; identical to SEQ ID NO: 24709

SEQ ID NO: 586739 - RNA, 64 nt, hsa; identical to SEQ ID NO: 24710

SEQ ID NO: 586740 - RNA, 64 nt, hsa; identical to SEQ ID NO: 24711

SEQ ID NO: 586741 - RNA, 64 nt, hsa; identical to SEQ ID NO: 24712

SEQ ID NO: 586742 - RNA, 64 nt, hsa; identical to SEQ ID NO: 24713

SEQ ID NO: 586743 - RNA, 64 nt, hsa; identical to SEQ ID NO: 24714

SEQ ID NO: 586744 - RNA, 64 nt, hsa; identical to SEQ ID NO: 24715

SEQ ID NO: 586745 - RNA, 64 nt, hsa; identical to SEQ ID NO: 24716

SEQ ID NO: 586746 - RNA, 64 nt, hsa; identical to SEQ ID NO: 24717

SEQ ID NO: 586747 - RNA, 64 nt, hsa; identical to SEQ ID NO: 24718

SEQ ID NO: 586748 - RNA, 64 nt, hsa; identical to SEQ ID NO: 24719

SEQ ID NO: 586749 - RNA, 64 nt, hsa; identical to SEQ ID NO: 24720

SEQ ID NO: 586750 - RNA, 50 nt, hsa; identical to SEQ ID NO: 24721

SEQ ID NO: 586751 - RNA, 64 nt, hsa; identical to SEQ ID NO: 24722

SEQ ID NO: 586752 - RNA, 64 nt, hsa; identical to SEQ ID NO: 24723

SEQ ID NO: 586753 - RNA, 64 nt, hsa; identical to SEQ ID NO: 24724

SEQ ID NO: 586754 - RNA, 64 nt, hsa; identical to SEQ ID NO: 24725

SEQ ID NO: 586755 - RNA, 64 nt, hsa; identical to SEQ ID NO: 24726

SEQ ID NO: 586756 - RNA, 64 nt, hsa; identical to SEQ ID NO: 24727

SEQ ID NO: 586757 - RNA, 64 nt, hsa; identical to SEQ ID NO: 111411

SEQ ID NO: 586758 - RNA, 64 nt, hsa; identical to SEQ ID NO: 111412

SEQ ID NO: 586759 - RNA, 64 nt, hsa; identical to SEQ ID NO: 111413

SEQ ID NO: 586760 - RNA, 64 nt, hsa; identical to SEQ ID NO: 111414

SEQ ID NO: 586761 - RNA, 64 nt, hsa; identical to SEQ ID NO: 111415

SEQ ID NO: 586762 - RNA, 64 nt, hsa; identical to SEQ ID NO: 111416

SEQ ID NO: 586763 - RNA, 64 nt, hsa; identical to SEQ ID NO: 111417

SEQ ID NO: 586764 - RNA, 64 nt, hsa; identical to SEQ ID NO: 111418

SEQ ID NO: 586765 - RNA, 64 nt, hsa; identical to SEQ ID NO: 111419

SEQ ID NO: 586766 - RNA, 64 nt, hsa; identical to SEQ ID NO: 111420

SEQ ID NO: 586767 - RNA, 64 nt, hsa; identical to SEQ ID NO: 111421

SEQ ID NO: 586768 - RNA, 64 nt, hsa; identical to SEQ ID NO: 111422

SEQ ID NO: 586769 - RNA, 64 nt, hsa; identical to SEQ ID NO: 111423

SEQ ID NO: 586770 - RNA, 64 nt, hsa; identical to SEQ ID NO: 111424

SEQ ID NO: 586771 - RNA, 64 nt, hsa; identical to SEQ ID NO: 111425

SEQ ID NO: 586772 - RNA, 64 nt, hsa; identical to SEQ ID NO: 111426

SEQ ID NO: 586773 - RNA, 64 nt, hsa; identical to SEQ ID NO: 111427

SEQ ID NO: 586774 - RNA, 64 nt, hsa; identical to SEQ ID NO: 111428

SEQ ID NO: 586775 - RNA, 64 nt, hsa; identical to SEQ ID NO: 111429

SEQ ID NO: 586776 - RNA, 64 nt, hsa; identical to SEQ ID NO: 111430

SEQ ID NO: 586777 - RNA, 64 nt, hsa; identical to SEQ ID NO: 111431

SEQ ID NO: 586778 - RNA, 64 nt, hsa; identical to SEQ ID NO: 111432

SEQ ID NO: 586779 - RNA, 64 nt, hsa; identical to SEQ ID NO: 111433

SEQ ID NO: 586780 - RNA, 64 nt, hsa; identical to SEQ ID NO: 111434

SEQ ID NO: 586781 - RNA, 58 nt, hsa; identical to SEQ ID NO: 111435

SEQ ID NO: 586782 - RNA, 64 nt, hsa; identical to SEQ ID NO: 111436

SEQ ID NO: 586783 - RNA, 64 nt, hsa; identical to SEQ ID NO: 111437

SEQ ID NO: 586784 - RNA, 64 nt, hsa; identical to SEQ ID NO: 111438

SEQ ID NO: 586785 - RNA, 64 nt, hsa; identical to SEQ ID NO: 111439

SEQ ID NO: 586786 - RNA, 64 nt, hsa; identical to SEQ ID NO: 111440

SEQ ID NO: 586787 - RNA, 64 nt, hsa; identical to SEQ ID NO: 111441

SEQ ID NO: 586788 - RNA, 64 nt, hsa; identical to SEQ ID NO: 111442

SEQ ID NO: 586789 - RNA, 64 nt, hsa; identical to SEQ ID NO: 111443

SEQ ID NO: 586790 - RNA, 64 nt, hsa; identical to SEQ ID NO: 111444

SEQ ID NO: 586791 - RNA, 64 nt, hsa; identical to SEQ ID NO: 111445

SEQ ID NO: 586792 - RNA, 64 nt, hsa; identical to SEQ ID NO: 111446

SEQ ID NO: 586793 - RNA, 64 nt, hsa; identical to SEQ ID NO: 111447

SEQ ID NO: 586794 - RNA, 64 nt, hsa; identical to SEQ ID NO: 111448

SEQ ID NO: 586795 - RNA, 64 nt, hsa; identical to SEQ ID NO: 111449

SEQ ID NO: 586796 - RNA, 64 nt, hsa; identical to SEQ ID NO: 111450

SEQ ID NO: 586797 - RNA, 64 nt, hsa; identical to SEQ ID NO: 111451

SEQ ID NO: 586798 - RNA, 64 nt, hsa; identical to SEQ ID NO: 111452

SEQ ID NO: 586799 - RNA, 64 nt, hsa; identical to SEQ ID NO: 111453

SEQ ID NO: 586800 - RNA, 64 nt, hsa; identical to SEQ ID NO: 111454

SEQ ID NO: 586801 - RNA, 64 nt, hsa; identical to SEQ ID NO: 111455

SEQ ID NO: 586802 - RNA, 64 nt, hsa; identical to SEQ ID NO: 111456

SEQ ID NO: 586803 - RNA, 64 nt, hsa; identical to SEQ ID NO: 111457

SEQ ID NO: 586804 - RNA, 64 nt, hsa; identical to SEQ ID NO: 111458

SEQ ID NO: 586805 - RNA, 64 nt, hsa; identical to SEQ ID NO: 111459

SEQ ID NO: 586806 - RNA, 52 nt, hsa; identical to SEQ ID NO: 111460

SEQ ID NO: 586807 - RNA, 64 nt, hsa; identical to SEQ ID NO: 111461

SEQ ID NO: 586808 - RNA, 64 nt, hsa; identical to SEQ ID NO: 111462

SEQ ID NO: 586809 - RNA, 64 nt, hsa; identical to SEQ ID NO: 111463

SEQ ID NO: 586810 - RNA, 64 nt, hsa; identical to SEQ ID NO: 111464

SEQ ID NO: 586811 - RNA, 64 nt, hsa; identical to SEQ ID NO: 111465

SEQ ID NO: 586812 - RNA, 64 nt, hsa; identical to SEQ ID NO: 111466

SEQ ID NO: 586813 - RNA, 64 nt, hsa; identical to SEQ ID NO: 111467

SEQ ID NO: 586814 - RNA, 64 nt, hsa; identical to SEQ ID NO: 92614

SEQ ID NO: 586815 - RNA, 64 nt, hsa; identical to SEQ ID NO: 92615

SEQ ID NO: 586816 - RNA, 64 nt, hsa; identical to SEQ ID NO: 92616

SEQ ID NO: 586817 - RNA, 64 nt, hsa; identical to SEQ ID NO: 92617

SEQ ID NO: 586818 - RNA, 64 nt, hsa; identical to SEQ ID NO: 92618

SEQ ID NO: 586819 - RNA, 64 nt, hsa; identical to SEQ ID NO: 92619

SEQ ID NO: 586820 - RNA, 64 nt, hsa; identical to SEQ ID NO: 92620

SEQ ID NO: 586821 - RNA, 64 nt, hsa; identical to SEQ ID NO: 92621

SEQ ID NO: 586822 - RNA, 64 nt, hsa; identical to SEQ ID NO: 92622

SEQ ID NO: 586823 - RNA, 64 nt, hsa; identical to SEQ ID NO: 92623

SEQ ID NO: 586824 - RNA, 64 nt, hsa; identical to SEQ ID NO: 92624

SEQ ID NO: 586825 - RNA, 64 nt, hsa; identical to SEQ ID NO: 92625

SEQ ID NO: 586826 - RNA, 64 nt, hsa; identical to SEQ ID NO: 92626

SEQ ID NO: 586827 - RNA, 64 nt, hsa; identical to SEQ ID NO: 92627

SEQ ID NO: 586828 - RNA, 64 nt, hsa; identical to SEQ ID NO: 92628

SEQ ID NO: 586829 - RNA, 64 nt, hsa; identical to SEQ ID NO: 92629

SEQ ID NO: 586830 - RNA, 64 nt, hsa; identical to SEQ ID NO: 92630

SEQ ID NO: 586831 - RNA, 64 nt, hsa; identical to SEQ ID NO: 92631

SEQ ID NO: 586832 - RNA, 64 nt, hsa; identical to SEQ ID NO: 92632

SEQ ID NO: 586833 - RNA, 64 nt, hsa; identical to SEQ ID NO: 92633

SEQ ID NO: 586834 - RNA, 64 nt, hsa; identical to SEQ ID NO: 92634

SEQ ID NO: 586835 - RNA, 64 nt, hsa; identical to SEQ ID NO: 92635

SEQ ID NO: 586836 - RNA, 64 nt, hsa; identical to SEQ ID NO: 92636

SEQ ID NO: 586837 - RNA, 64 nt, hsa; identical to SEQ ID NO: 92637

SEQ ID NO: 586838 - RNA, 64 nt, hsa; identical to SEQ ID NO: 92638

SEQ ID NO: 586839 - RNA, 64 nt, hsa; identical to SEQ ID NO: 92639

SEQ ID NO: 586840 - RNA, 64 nt, hsa; identical to SEQ ID NO: 92640

SEQ ID NO: 586841 - RNA, 64 nt, hsa; identical to SEQ ID NO: 92641

SEQ ID NO: 586842 - RNA, 64 nt, hsa; identical to SEQ ID NO: 92642

SEQ ID NO: 586843 - RNA, 64 nt, hsa; identical to SEQ ID NO: 92643

SEQ ID NO: 586844 - RNA, 64 nt, hsa; identical to SEQ ID NO: 92644

SEQ ID NO: 586845 - RNA, 64 nt, hsa; identical to SEQ ID NO: 92645

SEQ ID NO: 586846 - RNA, 64 nt, hsa; identical to SEQ ID NO: 92646

SEQ ID NO: 586847 - RNA, 64 nt, hsa; identical to SEQ ID NO: 92647

SEQ ID NO: 586848 - RNA, 64 nt, hsa; identical to SEQ ID NO: 92648

SEQ ID NO: 586849 - RNA, 64 nt, hsa; identical to SEQ ID NO: 92649

SEQ ID NO: 586850 - RNA, 64 nt, hsa; identical to SEQ ID NO: 92650

SEQ ID NO: 586851 - RNA, 64 nt, hsa; identical to SEQ ID NO: 92651

SEQ ID NO: 586852 - RNA, 64 nt, hsa; identical to SEQ ID NO: 92652

SEQ ID NO: 586853 - RNA, 64 nt, hsa; identical to SEQ ID NO: 92653

SEQ ID NO: 586854 - RNA, 64 nt, hsa; identical to SEQ ID NO: 92654

SEQ ID NO: 586855 - RNA, 64 nt, hsa; identical to SEQ ID NO: 92655

SEQ ID NO: 586856 - RNA, 64 nt, hsa; identical to SEQ ID NO: 92656

SEQ ID NO: 586857 - RNA, 64 nt, hsa; identical to SEQ ID NO: 92657

SEQ ID NO: 586858 - RNA, 64 nt, hsa; identical to SEQ ID NO: 92658

SEQ ID NO: 586859 - RNA, 64 nt, hsa; identical to SEQ ID NO: 92659

SEQ ID NO: 586860 - RNA, 64 nt, hsa; identical to SEQ ID NO: 92660

SEQ ID NO: 586861 - RNA, 64 nt, hsa; identical to SEQ ID NO: 92661

SEQ ID NO: 586862 - RNA, 64 nt, hsa; identical to SEQ ID NO: 92662

SEQ ID NO: 586863 - RNA, 64 nt, hsa; identical to SEQ ID NO: 92663

SEQ ID NO: 586864 - RNA, 64 nt, hsa; identical to SEQ ID NO: 92664

SEQ ID NO: 586865 - RNA, 64 nt, hsa; identical to SEQ ID NO: 92665

SEQ ID NO: 586866 - RNA, 64 nt, hsa; identical to SEQ ID NO: 92666

SEQ ID NO: 586867 - RNA, 64 nt, hsa; identical to SEQ ID NO: 92667

SEQ ID NO: 586868 - RNA, 64 nt, hsa; identical to SEQ ID NO: 92668

SEQ ID NO: 586869 - RNA, 64 nt, hsa; identical to SEQ ID NO: 92669

SEQ ID NO: 586870 - RNA, 64 nt, hsa; identical to SEQ ID NO: 92670

SEQ ID NO: 586871 - RNA, 64 nt, hsa; identical to SEQ ID NO: 92671

SEQ ID NO: 586872 - RNA, 64 nt, hsa; identical to SEQ ID NO: 92672

SEQ ID NO: 586873 - RNA, 64 nt, hsa; identical to SEQ ID NO: 92673

SEQ ID NO: 586874 - RNA, 64 nt, hsa; identical to SEQ ID NO: 92674

SEQ ID NO: 586875 - RNA, 64 nt, hsa; identical to SEQ ID NO: 92675

SEQ ID NO: 586876 - RNA, 64 nt, hsa; identical to SEQ ID NO: 92676

SEQ ID NO: 586877 - RNA, 64 nt, hsa; identical to SEQ ID NO: 92677

SEQ ID NO: 586878 - RNA, 64 nt, hsa; identical to SEQ ID NO: 92678

SEQ ID NO: 586879 - RNA, 64 nt, hsa; identical to SEQ ID NO: 92679

SEQ ID NO: 586880 - RNA, 64 nt, hsa; identical to SEQ ID NO: 92680

SEQ ID NO: 586881 - RNA, 64 nt, hsa; identical to SEQ ID NO: 92681

SEQ ID NO: 586882 - RNA, 64 nt, hsa; identical to SEQ ID NO: 92682

SEQ ID NO: 586883 - RNA, 64 nt, hsa; identical to SEQ ID NO: 92683

SEQ ID NO: 586884 - RNA, 64 nt, hsa; identical to SEQ ID NO: 92684

SEQ ID NO: 586885 - RNA, 64 nt, hsa; identical to SEQ ID NO: 92685

SEQ ID NO: 586886 - RNA, 64 nt, hsa; identical to SEQ ID NO: 92686

SEQ ID NO: 586887 - RNA, 64 nt, hsa; identical to SEQ ID NO: 92687

SEQ ID NO: 586888 - RNA, 64 nt, hsa; identical to SEQ ID NO: 92688

SEQ ID NO: 586889 - RNA, 62 nt, hsa; identical to SEQ ID NO: 92689

SEQ ID NO: 586890 - RNA, 64 nt, hsa; identical to SEQ ID NO: 92690

SEQ ID NO: 586891 - RNA, 64 nt, hsa; identical to SEQ ID NO: 92691

SEQ ID NO: 586892 - RNA, 64 nt, hsa; identical to SEQ ID NO: 92692

SEQ ID NO: 586893 - RNA, 64 nt, hsa; identical to SEQ ID NO: 92693

SEQ ID NO: 586894 - RNA, 64 nt, hsa; identical to SEQ ID NO: 92694

SEQ ID NO: 586895 - RNA, 64 nt, hsa; identical to SEQ ID NO: 92695

SEQ ID NO: 586896 - RNA, 64 nt, hsa; identical to SEQ ID NO: 92696

SEQ ID NO: 586897 - RNA, 64 nt, hsa; identical to SEQ ID NO: 92697

SEQ ID NO: 586898 - RNA, 64 nt, hsa; identical to SEQ ID NO: 92698

SEQ ID NO: 586899 - RNA, 64 nt, hsa; identical to SEQ ID NO: 92699

SEQ ID NO: 586900 - RNA, 64 nt, hsa; identical to SEQ ID NO: 92700

SEQ ID NO: 586901 - RNA, 64 nt, hsa; identical to SEQ ID NO: 92701

SEQ ID NO: 586902 - RNA, 64 nt, hsa; identical to SEQ ID NO: 92702

SEQ ID NO: 586903 - RNA, 64 nt, hsa; identical to SEQ ID NO: 92703

SEQ ID NO: 586904 - RNA, 64 nt, hsa; identical to SEQ ID NO: 92704

SEQ ID NO: 586905 - RNA, 64 nt, hsa; identical to SEQ ID NO: 92705

SEQ ID NO: 586906 - RNA, 64 nt, hsa; identical to SEQ ID NO: 92706

SEQ ID NO: 586907 - RNA, 64 nt, hsa; identical to SEQ ID NO: 92707

SEQ ID NO: 586908 - RNA, 64 nt, hsa; identical to SEQ ID NO: 92708

SEQ ID NO: 586909 - RNA, 64 nt, hsa; identical to SEQ ID NO: 92709

SEQ ID NO: 586910 - RNA, 64 nt, hsa; identical to SEQ ID NO: 92710

SEQ ID NO: 586911 - RNA, 64 nt, hsa; identical to SEQ ID NO: 92711

SEQ ID NO: 586912 - RNA, 64 nt, hsa; identical to SEQ ID NO: 92712

SEQ ID NO: 586913 - RNA, 64 nt, hsa; identical to SEQ ID NO: 92713

SEQ ID NO: 586914 - RNA, 64 nt, hsa; identical to SEQ ID NO: 92714

SEQ ID NO: 586915 - RNA, 64 nt, hsa; identical to SEQ ID NO: 92715

SEQ ID NO: 586916 - RNA, 64 nt, hsa; identical to SEQ ID NO: 92716

SEQ ID NO: 586917 - RNA, 64 nt, hsa; identical to SEQ ID NO: 92717

SEQ ID NO: 586918 - RNA, 64 nt, hsa; identical to SEQ ID NO: 92718

SEQ ID NO: 586919 - RNA, 64 nt, hsa; identical to SEQ ID NO: 92719

SEQ ID NO: 586920 - RNA, 64 nt, hsa; identical to SEQ ID NO: 92720

SEQ ID NO: 586921 - RNA, 64 nt, hsa; identical to SEQ ID NO: 92721

SEQ ID NO: 586922 - RNA, 64 nt, hsa; identical to SEQ ID NO: 92722

SEQ ID NO: 586923 - RNA, 64 nt, hsa; identical to SEQ ID NO: 92723

SEQ ID NO: 586924 - RNA, 64 nt, hsa; identical to SEQ ID NO: 92724

SEQ ID NO: 586925 - RNA, 64 nt, hsa; identical to SEQ ID NO: 92725

SEQ ID NO: 586926 - RNA, 64 nt, hsa; identical to SEQ ID NO: 92726

SEQ ID NO: 586927 - RNA, 64 nt, hsa; identical to SEQ ID NO: 92727

SEQ ID NO: 586928 - RNA, 64 nt, hsa; identical to SEQ ID NO: 92728

SEQ ID NO: 586929 - RNA, 64 nt, hsa; identical to SEQ ID NO: 92729

SEQ ID NO: 586930 - RNA, 64 nt, hsa; identical to SEQ ID NO: 92730

SEQ ID NO: 586931 - RNA, 64 nt, hsa; identical to SEQ ID NO: 92731

SEQ ID NO: 586932 - RNA, 64 nt, hsa; identical to SEQ ID NO: 92732

SEQ ID NO: 586933 - RNA, 64 nt, hsa; identical to SEQ ID NO: 92733

SEQ ID NO: 586934 - RNA, 64 nt, hsa; identical to SEQ ID NO: 92734

SEQ ID NO: 586935 - RNA, 64 nt, hsa; identical to SEQ ID NO: 92735

SEQ ID NO: 586936 - RNA, 64 nt, hsa; identical to SEQ ID NO: 92736

SEQ ID NO: 586937 - RNA, 64 nt, hsa; identical to SEQ ID NO: 92737

SEQ ID NO: 586938 - RNA, 64 nt, hsa; identical to SEQ ID NO: 92738

SEQ ID NO: 586939 - RNA, 64 nt, hsa; identical to SEQ ID NO: 92739

SEQ ID NO: 586940 - RNA, 64 nt, hsa; identical to SEQ ID NO: 92740

SEQ ID NO: 586941 - RNA, 64 nt, hsa; identical to SEQ ID NO: 92741

SEQ ID NO: 586942 - RNA, 64 nt, hsa; identical to SEQ ID NO: 92742

SEQ ID NO: 586943 - RNA, 64 nt, hsa; identical to SEQ ID NO: 92743

SEQ ID NO: 586944 - RNA, 64 nt, hsa; identical to SEQ ID NO: 92744

SEQ ID NO: 586945 - RNA, 64 nt, hsa; identical to SEQ ID NO: 92745

SEQ ID NO: 586946 - RNA, 64 nt, hsa; identical to SEQ ID NO: 92746

SEQ ID NO: 586947 - RNA, 64 nt, hsa; identical to SEQ ID NO: 92747

SEQ ID NO: 586948 - RNA, 64 nt, hsa; identical to SEQ ID NO: 92748

SEQ ID NO: 586949 - RNA, 64 nt, hsa; identical to SEQ ID NO: 92749

SEQ ID NO: 586950 - RNA, 64 nt, hsa; identical to SEQ ID NO: 92750

SEQ ID NO: 586951 - RNA, 64 nt, hsa; identical to SEQ ID NO: 92751

SEQ ID NO: 586952 - RNA, 64 nt, hsa; identical to SEQ ID NO: 92752

SEQ ID NO: 586953 - RNA, 64 nt, hsa; identical to SEQ ID NO: 92753

SEQ ID NO: 586954 - RNA, 64 nt, hsa; identical to SEQ ID NO: 92754

SEQ ID NO: 586955 - RNA, 64 nt, hsa; identical to SEQ ID NO: 92755

SEQ ID NO: 586956 - RNA, 64 nt, hsa; identical to SEQ ID NO: 92756

SEQ ID NO: 586957 - RNA, 64 nt, hsa; identical to SEQ ID NO: 92757

SEQ ID NO: 586958 - RNA, 64 nt, hsa; identical to SEQ ID NO: 92758

SEQ ID NO: 586959 - RNA, 64 nt, hsa; identical to SEQ ID NO: 92759

SEQ ID NO: 586960 - RNA, 64 nt, hsa; identical to SEQ ID NO: 92760

SEQ ID NO: 586961 - RNA, 64 nt, hsa; identical to SEQ ID NO: 92761

SEQ ID NO: 586962 - RNA, 64 nt, hsa; identical to SEQ ID NO: 92762

SEQ ID NO: 586963 - RNA, 64 nt, hsa; identical to SEQ ID NO: 92763

SEQ ID NO: 586964 - RNA, 64 nt, hsa; identical to SEQ ID NO: 92764

SEQ ID NO: 586965 - RNA, 64 nt, hsa; identical to SEQ ID NO: 92765

SEQ ID NO: 586966 - RNA, 64 nt, hsa; identical to SEQ ID NO: 92766

SEQ ID NO: 586967 - RNA, 64 nt, hsa; identical to SEQ ID NO: 92767

SEQ ID NO: 586968 - RNA, 64 nt, hsa; identical to SEQ ID NO: 92768

SEQ ID NO: 586969 - RNA, 64 nt, hsa; identical to SEQ ID NO: 92769

SEQ ID NO: 586970 - RNA, 64 nt, hsa; identical to SEQ ID NO: 92770

SEQ ID NO: 586971 - RNA, 64 nt, hsa; identical to SEQ ID NO: 92771

SEQ ID NO: 586972 - RNA, 64 nt, hsa; identical to SEQ ID NO: 92772

SEQ ID NO: 586973 - RNA, 64 nt, hsa; identical to SEQ ID NO: 92773

SEQ ID NO: 586974 - RNA, 64 nt, hsa; identical to SEQ ID NO: 92774

SEQ ID NO: 586975 - RNA, 64 nt, hsa; identical to SEQ ID NO: 92775

SEQ ID NO: 586976 - RNA, 64 nt, hsa; identical to SEQ ID NO: 92776

SEQ ID NO: 586977 - RNA, 64 nt, hsa; identical to SEQ ID NO: 92777

SEQ ID NO: 586978 - RNA, 64 nt, hsa; identical to SEQ ID NO: 92778

SEQ ID NO: 586979 - RNA, 64 nt, hsa; identical to SEQ ID NO: 92779

SEQ ID NO: 586980 - RNA, 64 nt, hsa; identical to SEQ ID NO: 92780

SEQ ID NO: 586981 - RNA, 64 nt, hsa; identical to SEQ ID NO: 92781

SEQ ID NO: 586982 - RNA, 64 nt, hsa; identical to SEQ ID NO: 92782

SEQ ID NO: 586983 - RNA, 64 nt, hsa; identical to SEQ ID NO: 92783

SEQ ID NO: 586984 - RNA, 64 nt, hsa; identical to SEQ ID NO: 92784

SEQ ID NO: 586985 - RNA, 64 nt, hsa; identical to SEQ ID NO: 92785

SEQ ID NO: 586986 - RNA, 64 nt, hsa; identical to SEQ ID NO: 92786

SEQ ID NO: 586987 - RNA, 64 nt, hsa; identical to SEQ ID NO: 92787

SEQ ID NO: 586988 - RNA, 64 nt, hsa; identical to SEQ ID NO: 92788

SEQ ID NO: 586989 - RNA, 64 nt, hsa; identical to SEQ ID NO: 92789

SEQ ID NO: 586990 - RNA, 64 nt, hsa; identical to SEQ ID NO: 92790

SEQ ID NO: 586991 - RNA, 64 nt, hsa; identical to SEQ ID NO: 92791

SEQ ID NO: 586992 - RNA, 64 nt, hsa; identical to SEQ ID NO: 92792

SEQ ID NO: 586993 - RNA, 64 nt, hsa; identical to SEQ ID NO: 92793

SEQ ID NO: 586994 - RNA, 64 nt, hsa; identical to SEQ ID NO: 92794

SEQ ID NO: 586995 - RNA, 64 nt, hsa; identical to SEQ ID NO: 92795

SEQ ID NO: 586996 - RNA, 64 nt, hsa; identical to SEQ ID NO: 92796

SEQ ID NO: 586997 - RNA, 64 nt, hsa; identical to SEQ ID NO: 92797

SEQ ID NO: 586998 - RNA, 64 nt, hsa; identical to SEQ ID NO: 92798

SEQ ID NO: 586999 - RNA, 64 nt, hsa; identical to SEQ ID NO: 92799

SEQ ID NO: 587000 - RNA, 64 nt, hsa; identical to SEQ ID NO: 92800

SEQ ID NO: 587001 - RNA, 64 nt, hsa; identical to SEQ ID NO: 92801

SEQ ID NO: 587002 - RNA, 64 nt, hsa; identical to SEQ ID NO: 92802

SEQ ID NO: 587003 - RNA, 64 nt, hsa; identical to SEQ ID NO: 92803

SEQ ID NO: 587004 - RNA, 64 nt, hsa; identical to SEQ ID NO: 92804

SEQ ID NO: 587005 - RNA, 64 nt, hsa; identical to SEQ ID NO: 92805

SEQ ID NO: 587006 - RNA, 64 nt, hsa; identical to SEQ ID NO: 92806

SEQ ID NO: 587007 - RNA, 64 nt, hsa; identical to SEQ ID NO: 92807

SEQ ID NO: 587008 - RNA, 64 nt, hsa; identical to SEQ ID NO: 92808

SEQ ID NO: 587009 - RNA, 64 nt, hsa; identical to SEQ ID NO: 92809

SEQ ID NO: 587010 - RNA, 64 nt, hsa; identical to SEQ ID NO: 92810

SEQ ID NO: 587011 - RNA, 64 nt, hsa; identical to SEQ ID NO: 92811

SEQ ID NO: 587012 - RNA, 64 nt, hsa; identical to SEQ ID NO: 92812

SEQ ID NO: 587013 - RNA, 64 nt, hsa; identical to SEQ ID NO: 92813

SEQ ID NO: 587014 - RNA, 64 nt, hsa; identical to SEQ ID NO: 92814

SEQ ID NO: 587015 - RNA, 64 nt, hsa; identical to SEQ ID NO: 92815

SEQ ID NO: 587016 - RNA, 64 nt, hsa; identical to SEQ ID NO: 92816

SEQ ID NO: 587017 - RNA, 64 nt, hsa; identical to SEQ ID NO: 92817

SEQ ID NO: 587018 - RNA, 64 nt, hsa; identical to SEQ ID NO: 92818

SEQ ID NO: 587019 - RNA, 64 nt, hsa; identical to SEQ ID NO: 92819

SEQ ID NO: 587020 - RNA, 64 nt, hsa; identical to SEQ ID NO: 92820

SEQ ID NO: 587021 - RNA, 64 nt, hsa; identical to SEQ ID NO: 92821

SEQ ID NO: 587022 - RNA, 64 nt, hsa; identical to SEQ ID NO: 92822

SEQ ID NO: 587023 - RNA, 64 nt, hsa; identical to SEQ ID NO: 92823

SEQ ID NO: 587024 - RNA, 64 nt, hsa; identical to SEQ ID NO: 92824

SEQ ID NO: 587025 - RNA, 64 nt, hsa; identical to SEQ ID NO: 92825

SEQ ID NO: 587026 - RNA, 64 nt, hsa; identical to SEQ ID NO: 92826

SEQ ID NO: 587027 - RNA, 64 nt, hsa; identical to SEQ ID NO: 92827

SEQ ID NO: 587028 - RNA, 64 nt, hsa; identical to SEQ ID NO: 92828

SEQ ID NO: 587029 - RNA, 64 nt, hsa; identical to SEQ ID NO: 92829

SEQ ID NO: 587030 - RNA, 64 nt, hsa; identical to SEQ ID NO: 92830

SEQ ID NO: 587031 - RNA, 64 nt, hsa; identical to SEQ ID NO: 92831

SEQ ID NO: 587032 - RNA, 64 nt, hsa; identical to SEQ ID NO: 92832

SEQ ID NO: 587033 - RNA, 64 nt, hsa; identical to SEQ ID NO: 92833

SEQ ID NO: 587034 - RNA, 64 nt, hsa; identical to SEQ ID NO: 92834

SEQ ID NO: 587035 - RNA, 64 nt, hsa; identical to SEQ ID NO: 92835

SEQ ID NO: 587036 - RNA, 64 nt, hsa; identical to SEQ ID NO: 92836

SEQ ID NO: 587037 - RNA, 64 nt, hsa; identical to SEQ ID NO: 92837

SEQ ID NO: 587038 - RNA, 64 nt, hsa; identical to SEQ ID NO: 92838

SEQ ID NO: 587039 - RNA, 64 nt, hsa; identical to SEQ ID NO: 92839

SEQ ID NO: 587040 - RNA, 64 nt, hsa; identical to SEQ ID NO: 92840

SEQ ID NO: 587041 - RNA, 64 nt, hsa; identical to SEQ ID NO: 92841

SEQ ID NO: 587042 - RNA, 64 nt, hsa; identical to SEQ ID NO: 92842

SEQ ID NO: 587043 - RNA, 64 nt, hsa; identical to SEQ ID NO: 92843

SEQ ID NO: 587044 - RNA, 64 nt, hsa; identical to SEQ ID NO: 92844

SEQ ID NO: 587045 - RNA, 64 nt, hsa; identical to SEQ ID NO: 92845

SEQ ID NO: 587046 - RNA, 64 nt, hsa; identical to SEQ ID NO: 92846

SEQ ID NO: 587047 - RNA, 64 nt, hsa; identical to SEQ ID NO: 92847

SEQ ID NO: 587048 - RNA, 64 nt, hsa; identical to SEQ ID NO: 92848

SEQ ID NO: 587049 - RNA, 64 nt, hsa; identical to SEQ ID NO: 92849

SEQ ID NO: 587050 - RNA, 64 nt, hsa; identical to SEQ ID NO: 92850

SEQ ID NO: 587051 - RNA, 64 nt, hsa; identical to SEQ ID NO: 92851

SEQ ID NO: 587052 - RNA, 64 nt, hsa; identical to SEQ ID NO: 92852

SEQ ID NO: 587053 - RNA, 64 nt, hsa; identical to SEQ ID NO: 92853

SEQ ID NO: 587054 - RNA, 64 nt, hsa; identical to SEQ ID NO: 92854

SEQ ID NO: 587055 - RNA, 64 nt, hsa; identical to SEQ ID NO: 92855

SEQ ID NO: 587056 - RNA, 64 nt, hsa; identical to SEQ ID NO: 92856

SEQ ID NO: 587057 - RNA, 64 nt, hsa; identical to SEQ ID NO: 92857

SEQ ID NO: 587058 - RNA, 64 nt, hsa; identical to SEQ ID NO: 92858

SEQ ID NO: 587059 - RNA, 64 nt, hsa; identical to SEQ ID NO: 92859

SEQ ID NO: 587060 - RNA, 64 nt, hsa; identical to SEQ ID NO: 92860

SEQ ID NO: 587061 - RNA, 64 nt, hsa; identical to SEQ ID NO: 92861

SEQ ID NO: 587062 - RNA, 64 nt, hsa; identical to SEQ ID NO: 92862

SEQ ID NO: 587063 - RNA, 64 nt, hsa; identical to SEQ ID NO: 92863

SEQ ID NO: 587064 - RNA, 64 nt, hsa; identical to SEQ ID NO: 92864

SEQ ID NO: 587065 - RNA, 64 nt, hsa; identical to SEQ ID NO: 92865

SEQ ID NO: 587066 - RNA, 64 nt, hsa; identical to SEQ ID NO: 92866

SEQ ID NO: 587067 - RNA, 64 nt, hsa; identical to SEQ ID NO: 92867

SEQ ID NO: 587068 - RNA, 64 nt, hsa; identical to SEQ ID NO: 92868

SEQ ID NO: 587069 - RNA, 64 nt, hsa; identical to SEQ ID NO: 92869

SEQ ID NO: 587070 - RNA, 64 nt, hsa; identical to SEQ ID NO: 92870

SEQ ID NO: 587071 - RNA, 64 nt, hsa; identical to SEQ ID NO: 92871

SEQ ID NO: 587072 - RNA, 64 nt, hsa; identical to SEQ ID NO: 92872

SEQ ID NO: 587073 - RNA, 64 nt, hsa; identical to SEQ ID NO: 92873

SEQ ID NO: 587074 - RNA, 64 nt, hsa; identical to SEQ ID NO: 92874

SEQ ID NO: 587075 - RNA, 64 nt, hsa; identical to SEQ ID NO: 92875

SEQ ID NO: 587076 - RNA, 64 nt, hsa; identical to SEQ ID NO: 92876

SEQ ID NO: 587077 - RNA, 64 nt, hsa; identical to SEQ ID NO: 92877

SEQ ID NO: 587078 - RNA, 64 nt, hsa; identical to SEQ ID NO: 92878

SEQ ID NO: 587079 - RNA, 64 nt, hsa; identical to SEQ ID NO: 92879

SEQ ID NO: 587080 - RNA, 64 nt, hsa; identical to SEQ ID NO: 92880

SEQ ID NO: 587081 - RNA, 64 nt, hsa; identical to SEQ ID NO: 92881

SEQ ID NO: 587082 - RNA, 64 nt, hsa; identical to SEQ ID NO: 92882

SEQ ID NO: 587083 - RNA, 64 nt, hsa; identical to SEQ ID NO: 92883

SEQ ID NO: 587084 - RNA, 64 nt, hsa; identical to SEQ ID NO: 92884

SEQ ID NO: 587085 - RNA, 64 nt, hsa; identical to SEQ ID NO: 92885

SEQ ID NO: 587086 - RNA, 64 nt, hsa; identical to SEQ ID NO: 92886

SEQ ID NO: 587087 - RNA, 64 nt, hsa; identical to SEQ ID NO: 92887

SEQ ID NO: 587088 - RNA, 64 nt, hsa; identical to SEQ ID NO: 92888

SEQ ID NO: 587089 - RNA, 64 nt, hsa; identical to SEQ ID NO: 92889

SEQ ID NO: 587090 - RNA, 64 nt, hsa; identical to SEQ ID NO: 92890

SEQ ID NO: 587091 - RNA, 64 nt, hsa; identical to SEQ ID NO: 92891

SEQ ID NO: 587092 - RNA, 64 nt, hsa; identical to SEQ ID NO: 92892

SEQ ID NO: 587093 - RNA, 64 nt, hsa; identical to SEQ ID NO: 92893

SEQ ID NO: 587094 - RNA, 64 nt, hsa; identical to SEQ ID NO: 92894

SEQ ID NO: 587095 - RNA, 64 nt, hsa; identical to SEQ ID NO: 92895

SEQ ID NO: 587096 - RNA, 64 nt, hsa; identical to SEQ ID NO: 92896

SEQ ID NO: 587097 - RNA, 64 nt, hsa; identical to SEQ ID NO: 92897

SEQ ID NO: 587098 - RNA, 64 nt, hsa; identical to SEQ ID NO: 92898

SEQ ID NO: 587099 - RNA, 64 nt, hsa; identical to SEQ ID NO: 92899

SEQ ID NO: 587100 - RNA, 64 nt, hsa; identical to SEQ ID NO: 92900

SEQ ID NO: 587101 - RNA, 64 nt, hsa; identical to SEQ ID NO: 92901

SEQ ID NO: 587102 - RNA, 64 nt, hsa; identical to SEQ ID NO: 92902

SEQ ID NO: 587103 - RNA, 64 nt, hsa; identical to SEQ ID NO: 92903

SEQ ID NO: 587104 - RNA, 64 nt, hsa; identical to SEQ ID NO: 92904

SEQ ID NO: 587105 - RNA, 64 nt, hsa; identical to SEQ ID NO: 92905

SEQ ID NO: 587106 - RNA, 64 nt, hsa; identical to SEQ ID NO: 92906

SEQ ID NO: 587107 - RNA, 64 nt, hsa; identical to SEQ ID NO: 92907

SEQ ID NO: 587108 - RNA, 64 nt, hsa; identical to SEQ ID NO: 92908

SEQ ID NO: 587109 - RNA, 64 nt, hsa; identical to SEQ ID NO: 92909

SEQ ID NO: 587110 - RNA, 64 nt, hsa; identical to SEQ ID NO: 92910

SEQ ID NO: 587111 - RNA, 64 nt, hsa; identical to SEQ ID NO: 92911

SEQ ID NO: 587112 - RNA, 64 nt, hsa; identical to SEQ ID NO: 92912

SEQ ID NO: 587113 - RNA, 64 nt, hsa; identical to SEQ ID NO: 92913

SEQ ID NO: 587114 - RNA, 64 nt, hsa; identical to SEQ ID NO: 92914

SEQ ID NO: 587115 - RNA, 64 nt, hsa; identical to SEQ ID NO: 92915

SEQ ID NO: 587116 - RNA, 64 nt, hsa; identical to SEQ ID NO: 92916

SEQ ID NO: 587117 - RNA, 64 nt, hsa; identical to SEQ ID NO: 92917

SEQ ID NO: 587118 - RNA, 64 nt, hsa; identical to SEQ ID NO: 92918

SEQ ID NO: 587119 - RNA, 64 nt, hsa; identical to SEQ ID NO: 92919

SEQ ID NO: 587120 - RNA, 64 nt, hsa; identical to SEQ ID NO: 92920

SEQ ID NO: 587121 - RNA, 64 nt, hsa; identical to SEQ ID NO: 92921

SEQ ID NO: 587122 - RNA, 64 nt, hsa; identical to SEQ ID NO: 92922

SEQ ID NO: 587123 - RNA, 64 nt, hsa; identical to SEQ ID NO: 92923

SEQ ID NO: 587124 - RNA, 64 nt, hsa; identical to SEQ ID NO: 92924

SEQ ID NO: 587125 - RNA, 64 nt, hsa; identical to SEQ ID NO: 92925

SEQ ID NO: 587126 - RNA, 64 nt, hsa; identical to SEQ ID NO: 92926

SEQ ID NO: 587127 - RNA, 64 nt, hsa; identical to SEQ ID NO: 92927

SEQ ID NO: 587128 - RNA, 64 nt, hsa; identical to SEQ ID NO: 92928

SEQ ID NO: 587129 - RNA, 64 nt, hsa; identical to SEQ ID NO: 92929

SEQ ID NO: 587130 - RNA, 64 nt, hsa; identical to SEQ ID NO: 92930

SEQ ID NO: 587131 - RNA, 64 nt, hsa; identical to SEQ ID NO: 92931

SEQ ID NO: 587132 - RNA, 64 nt, hsa; identical to SEQ ID NO: 92932

SEQ ID NO: 587133 - RNA, 64 nt, hsa; identical to SEQ ID NO: 92933

SEQ ID NO: 587134 - RNA, 64 nt, hsa; identical to SEQ ID NO: 92934

SEQ ID NO: 587135 - RNA, 64 nt, hsa; identical to SEQ ID NO: 92935

SEQ ID NO: 587136 - RNA, 64 nt, hsa; identical to SEQ ID NO: 92936

SEQ ID NO: 587137 - RNA, 64 nt, hsa; identical to SEQ ID NO: 92937

SEQ ID NO: 587138 - RNA, 64 nt, hsa; identical to SEQ ID NO: 92938

SEQ ID NO: 587139 - RNA, 64 nt, hsa; identical to SEQ ID NO: 92939

SEQ ID NO: 587140 - RNA, 64 nt, hsa; identical to SEQ ID NO: 92940

SEQ ID NO: 587141 - RNA, 64 nt, hsa; identical to SEQ ID NO: 92941

SEQ ID NO: 587142 - RNA, 64 nt, hsa; identical to SEQ ID NO: 92942

SEQ ID NO: 587143 - RNA, 64 nt, hsa; identical to SEQ ID NO: 92943

SEQ ID NO: 587144 - RNA, 64 nt, hsa; identical to SEQ ID NO: 92944

SEQ ID NO: 587145 - RNA, 62 nt, hsa; identical to SEQ ID NO: 92945

SEQ ID NO: 587146 - RNA, 64 nt, hsa; identical to SEQ ID NO: 92946

SEQ ID NO: 587147 - RNA, 64 nt, hsa; identical to SEQ ID NO: 92947

SEQ ID NO: 587148 - RNA, 64 nt, hsa; identical to SEQ ID NO: 92948

SEQ ID NO: 587149 - RNA, 64 nt, hsa; identical to SEQ ID NO: 92949

SEQ ID NO: 587150 - RNA, 64 nt, hsa; identical to SEQ ID NO: 92950

SEQ ID NO: 587151 - RNA, 64 nt, hsa; identical to SEQ ID NO: 92951

SEQ ID NO: 587152 - RNA, 64 nt, hsa; identical to SEQ ID NO: 92952

SEQ ID NO: 587153 - RNA, 64 nt, hsa; identical to SEQ ID NO: 92953

SEQ ID NO: 587154 - RNA, 64 nt, hsa; identical to SEQ ID NO: 92954

SEQ ID NO: 587155 - RNA, 64 nt, hsa; identical to SEQ ID NO: 92955

SEQ ID NO: 587156 - RNA, 64 nt, hsa; identical to SEQ ID NO: 92956

SEQ ID NO: 587157 - RNA, 64 nt, hsa; identical to SEQ ID NO: 92957

SEQ ID NO: 587158 - RNA, 64 nt, hsa; identical to SEQ ID NO: 92958

SEQ ID NO: 587159 - RNA, 64 nt, hsa; identical to SEQ ID NO: 92959

SEQ ID NO: 587160 - RNA, 64 nt, hsa; identical to SEQ ID NO: 92960

SEQ ID NO: 587161 - RNA, 64 nt, hsa; identical to SEQ ID NO: 92961

SEQ ID NO: 587162 - RNA, 64 nt, hsa; identical to SEQ ID NO: 92962

SEQ ID NO: 587163 - RNA, 64 nt, hsa; identical to SEQ ID NO: 92963

SEQ ID NO: 587164 - RNA, 64 nt, hsa; identical to SEQ ID NO: 92964

SEQ ID NO: 587165 - RNA, 64 nt, hsa; identical to SEQ ID NO: 92965

SEQ ID NO: 587166 - RNA, 64 nt, hsa; identical to SEQ ID NO: 92966

SEQ ID NO: 587167 - RNA, 64 nt, hsa; identical to SEQ ID NO: 92967

SEQ ID NO: 587168 - RNA, 64 nt, hsa; identical to SEQ ID NO: 92968

SEQ ID NO: 587169 - RNA, 64 nt, hsa; identical to SEQ ID NO: 92969

SEQ ID NO: 587170 - RNA, 64 nt, hsa; identical to SEQ ID NO: 92970

SEQ ID NO: 587171 - RNA, 64 nt, hsa; identical to SEQ ID NO: 92971

SEQ ID NO: 587172 - RNA, 64 nt, hsa; identical to SEQ ID NO: 92972

SEQ ID NO: 587173 - RNA, 64 nt, hsa; identical to SEQ ID NO: 92973

SEQ ID NO: 587174 - RNA, 64 nt, hsa; identical to SEQ ID NO: 92974

SEQ ID NO: 587175 - RNA, 64 nt, hsa; identical to SEQ ID NO: 92975

SEQ ID NO: 587176 - RNA, 64 nt, hsa; identical to SEQ ID NO: 92976

SEQ ID NO: 587177 - RNA, 64 nt, hsa; identical to SEQ ID NO: 92977

SEQ ID NO: 587178 - RNA, 64 nt, hsa; identical to SEQ ID NO: 92978

SEQ ID NO: 587179 - RNA, 64 nt, hsa; identical to SEQ ID NO: 92979

SEQ ID NO: 587180 - RNA, 64 nt, hsa; identical to SEQ ID NO: 92980

SEQ ID NO: 587181 - RNA, 64 nt, hsa; identical to SEQ ID NO: 92981

SEQ ID NO: 587182 - RNA, 64 nt, hsa; identical to SEQ ID NO: 92982

SEQ ID NO: 587183 - RNA, 64 nt, hsa; identical to SEQ ID NO: 92983

SEQ ID NO: 587184 - RNA, 64 nt, hsa; identical to SEQ ID NO: 92984

SEQ ID NO: 587185 - RNA, 64 nt, hsa; identical to SEQ ID NO: 92985

SEQ ID NO: 587186 - RNA, 64 nt, hsa; identical to SEQ ID NO: 92986

SEQ ID NO: 587187 - RNA, 64 nt, hsa; identical to SEQ ID NO: 92987

SEQ ID NO: 587188 - RNA, 64 nt, hsa; identical to SEQ ID NO: 92988

SEQ ID NO: 587189 - RNA, 64 nt, hsa; identical to SEQ ID NO: 92989

SEQ ID NO: 587190 - RNA, 64 nt, hsa; identical to SEQ ID NO: 92990

SEQ ID NO: 587191 - RNA, 64 nt, hsa; identical to SEQ ID NO: 92991

SEQ ID NO: 587192 - RNA, 64 nt, hsa; identical to SEQ ID NO: 92992

SEQ ID NO: 587193 - RNA, 64 nt, hsa; identical to SEQ ID NO: 92993

SEQ ID NO: 587194 - RNA, 64 nt, hsa; identical to SEQ ID NO: 92994

SEQ ID NO: 587195 - RNA, 64 nt, hsa; identical to SEQ ID NO: 92995

SEQ ID NO: 587196 - RNA, 64 nt, hsa; identical to SEQ ID NO: 92996

SEQ ID NO: 587197 - RNA, 64 nt, hsa; identical to SEQ ID NO: 92997

SEQ ID NO: 587198 - RNA, 64 nt, hsa; identical to SEQ ID NO: 92998

SEQ ID NO: 587199 - RNA, 64 nt, hsa; identical to SEQ ID NO: 92999

SEQ ID NO: 587200 - RNA, 64 nt, hsa; identical to SEQ ID NO: 93000

SEQ ID NO: 587201 - RNA, 64 nt, hsa; identical to SEQ ID NO: 93001

SEQ ID NO: 587202 - RNA, 64 nt, hsa; identical to SEQ ID NO: 93002

SEQ ID NO: 587203 - RNA, 64 nt, hsa; identical to SEQ ID NO: 93003

SEQ ID NO: 587204 - RNA, 64 nt, hsa; identical to SEQ ID NO: 93004

SEQ ID NO: 587205 - RNA, 64 nt, hsa; identical to SEQ ID NO: 93005

SEQ ID NO: 587206 - RNA, 64 nt, hsa; identical to SEQ ID NO: 93006

SEQ ID NO: 587207 - RNA, 64 nt, hsa; identical to SEQ ID NO: 93007

SEQ ID NO: 587208 - RNA, 64 nt, hsa; identical to SEQ ID NO: 93008

SEQ ID NO: 587209 - RNA, 64 nt, hsa; identical to SEQ ID NO: 93009

SEQ ID NO: 587210 - RNA, 64 nt, hsa; identical to SEQ ID NO: 93010

SEQ ID NO: 587211 - RNA, 64 nt, hsa; identical to SEQ ID NO: 93011

SEQ ID NO: 587212 - RNA, 64 nt, hsa; identical to SEQ ID NO: 93012

SEQ ID NO: 587213 - RNA, 64 nt, hsa; identical to SEQ ID NO: 93013

SEQ ID NO: 587214 - RNA, 64 nt, hsa; identical to SEQ ID NO: 93014

SEQ ID NO: 587215 - RNA, 64 nt, hsa; identical to SEQ ID NO: 93015

SEQ ID NO: 587216 - RNA, 64 nt, hsa; identical to SEQ ID NO: 93016

SEQ ID NO: 587217 - RNA, 64 nt, hsa; identical to SEQ ID NO: 93017

SEQ ID NO: 587218 - RNA, 64 nt, hsa; identical to SEQ ID NO: 93018

SEQ ID NO: 587219 - RNA, 64 nt, hsa; identical to SEQ ID NO: 93019

SEQ ID NO: 587220 - RNA, 64 nt, hsa; identical to SEQ ID NO: 93020

SEQ ID NO: 587221 - RNA, 64 nt, hsa; identical to SEQ ID NO: 93021

SEQ ID NO: 587222 - RNA, 64 nt, hsa; identical to SEQ ID NO: 93022

SEQ ID NO: 587223 - RNA, 64 nt, hsa; identical to SEQ ID NO: 93023

SEQ ID NO: 587224 - RNA, 64 nt, hsa; identical to SEQ ID NO: 93024

SEQ ID NO: 587225 - RNA, 64 nt, hsa; identical to SEQ ID NO: 93025

SEQ ID NO: 587226 - RNA, 64 nt, hsa; identical to SEQ ID NO: 93026

SEQ ID NO: 587227 - RNA, 64 nt, hsa; identical to SEQ ID NO: 93027

SEQ ID NO: 587228 - RNA, 64 nt, hsa; identical to SEQ ID NO: 93028

SEQ ID NO: 587229 - RNA, 64 nt, hsa; identical to SEQ ID NO: 93029

SEQ ID NO: 587230 - RNA, 64 nt, hsa; identical to SEQ ID NO: 93030

SEQ ID NO: 587231 - RNA, 64 nt, hsa; identical to SEQ ID NO: 93031

SEQ ID NO: 587232 - RNA, 64 nt, hsa; identical to SEQ ID NO: 93032

SEQ ID NO: 587233 - RNA, 64 nt, hsa; identical to SEQ ID NO: 93033

SEQ ID NO: 587234 - RNA, 64 nt, hsa; identical to SEQ ID NO: 93034

SEQ ID NO: 587235 - RNA, 64 nt, hsa; identical to SEQ ID NO: 93035

SEQ ID NO: 587236 - RNA, 64 nt, hsa; identical to SEQ ID NO: 93036

SEQ ID NO: 587237 - RNA, 64 nt, hsa; identical to SEQ ID NO: 93037

SEQ ID NO: 587238 - RNA, 64 nt, hsa; identical to SEQ ID NO: 93038

SEQ ID NO: 587239 - RNA, 64 nt, hsa; identical to SEQ ID NO: 93039

SEQ ID NO: 587240 - RNA, 64 nt, hsa; identical to SEQ ID NO: 93040

SEQ ID NO: 587241 - RNA, 64 nt, hsa; identical to SEQ ID NO: 93041

SEQ ID NO: 587242 - RNA, 64 nt, hsa; identical to SEQ ID NO: 93042

SEQ ID NO: 587243 - RNA, 64 nt, hsa; identical to SEQ ID NO: 93043

SEQ ID NO: 587244 - RNA, 64 nt, hsa; identical to SEQ ID NO: 93044

SEQ ID NO: 587245 - RNA, 64 nt, hsa; identical to SEQ ID NO: 93045

SEQ ID NO: 587246 - RNA, 64 nt, hsa; identical to SEQ ID NO: 93046

SEQ ID NO: 587247 - RNA, 64 nt, hsa; identical to SEQ ID NO: 93047

SEQ ID NO: 587248 - RNA, 64 nt, hsa; identical to SEQ ID NO: 93048

SEQ ID NO: 587249 - RNA, 64 nt, hsa; identical to SEQ ID NO: 93049

SEQ ID NO: 587250 - RNA, 64 nt, hsa; identical to SEQ ID NO: 93050

SEQ ID NO: 587251 - RNA, 64 nt, hsa; identical to SEQ ID NO: 93051

SEQ ID NO: 587252 - RNA, 64 nt, hsa; identical to SEQ ID NO: 93052

SEQ ID NO: 587253 - RNA, 64 nt, hsa; identical to SEQ ID NO: 93053

SEQ ID NO: 587254 - RNA, 64 nt, hsa; identical to SEQ ID NO: 93054

SEQ ID NO: 587255 - RNA, 64 nt, hsa; identical to SEQ ID NO: 93055

SEQ ID NO: 587256 - RNA, 64 nt, hsa; identical to SEQ ID NO: 93056

SEQ ID NO: 587257 - RNA, 64 nt, hsa; identical to SEQ ID NO: 93057

SEQ ID NO: 587258 - RNA, 64 nt, hsa; identical to SEQ ID NO: 93058

SEQ ID NO: 587259 - RNA, 64 nt, hsa; identical to SEQ ID NO: 93059

SEQ ID NO: 587260 - RNA, 64 nt, hsa; identical to SEQ ID NO: 93060

SEQ ID NO: 587261 - RNA, 64 nt, hsa; identical to SEQ ID NO: 93061

SEQ ID NO: 587262 - RNA, 64 nt, hsa; identical to SEQ ID NO: 93062

SEQ ID NO: 587263 - RNA, 64 nt, hsa; identical to SEQ ID NO: 93063

SEQ ID NO: 587264 - RNA, 64 nt, hsa; identical to SEQ ID NO: 93064

SEQ ID NO: 587265 - RNA, 64 nt, hsa; identical to SEQ ID NO: 93065

SEQ ID NO: 587266 - RNA, 64 nt, hsa; identical to SEQ ID NO: 93066

SEQ ID NO: 587267 - RNA, 64 nt, hsa; identical to SEQ ID NO: 93067

SEQ ID NO: 587268 - RNA, 64 nt, hsa; identical to SEQ ID NO: 93068

SEQ ID NO: 587269 - RNA, 64 nt, hsa; identical to SEQ ID NO: 93069

SEQ ID NO: 587270 - RNA, 64 nt, hsa; identical to SEQ ID NO: 93070

SEQ ID NO: 587271 - RNA, 64 nt, hsa; identical to SEQ ID NO: 93071

SEQ ID NO: 587272 - RNA, 64 nt, hsa; identical to SEQ ID NO: 93072

SEQ ID NO: 587273 - RNA, 64 nt, hsa; identical to SEQ ID NO: 93073

SEQ ID NO: 587274 - RNA, 64 nt, hsa; identical to SEQ ID NO: 93074

SEQ ID NO: 587275 - RNA, 64 nt, hsa; identical to SEQ ID NO: 93075

SEQ ID NO: 587276 - RNA, 64 nt, hsa; identical to SEQ ID NO: 93076

SEQ ID NO: 587277 - RNA, 64 nt, hsa; identical to SEQ ID NO: 93077

SEQ ID NO: 587278 - RNA, 64 nt, hsa; identical to SEQ ID NO: 93078

SEQ ID NO: 587279 - RNA, 64 nt, hsa; identical to SEQ ID NO: 93079

SEQ ID NO: 587280 - RNA, 64 nt, hsa; identical to SEQ ID NO: 93080

SEQ ID NO: 587281 - RNA, 64 nt, hsa; identical to SEQ ID NO: 93081

SEQ ID NO: 587282 - RNA, 64 nt, hsa; identical to SEQ ID NO: 93082

SEQ ID NO: 587283 - RNA, 64 nt, hsa; identical to SEQ ID NO: 93083

SEQ ID NO: 587284 - RNA, 64 nt, hsa; identical to SEQ ID NO: 93084

SEQ ID NO: 587285 - RNA, 64 nt, hsa; identical to SEQ ID NO: 93085

SEQ ID NO: 587286 - RNA, 64 nt, hsa; identical to SEQ ID NO: 93086

SEQ ID NO: 587287 - RNA, 64 nt, hsa; identical to SEQ ID NO: 93087

SEQ ID NO: 587288 - RNA, 64 nt, hsa; identical to SEQ ID NO: 93088

SEQ ID NO: 587289 - RNA, 64 nt, hsa; identical to SEQ ID NO: 93089

SEQ ID NO: 587290 - RNA, 64 nt, hsa; identical to SEQ ID NO: 93090

SEQ ID NO: 587291 - RNA, 64 nt, hsa; identical to SEQ ID NO: 93091

SEQ ID NO: 587292 - RNA, 64 nt, hsa; identical to SEQ ID NO: 93092

SEQ ID NO: 587293 - RNA, 64 nt, hsa; identical to SEQ ID NO: 93093

SEQ ID NO: 587294 - RNA, 64 nt, hsa; identical to SEQ ID NO: 93094

SEQ ID NO: 587295 - RNA, 64 nt, hsa; identical to SEQ ID NO: 93095

SEQ ID NO: 587296 - RNA, 64 nt, hsa; identical to SEQ ID NO: 93096

SEQ ID NO: 587297 - RNA, 64 nt, hsa; identical to SEQ ID NO: 93097

SEQ ID NO: 587298 - RNA, 64 nt, hsa; identical to SEQ ID NO: 93098

SEQ ID NO: 587299 - RNA, 64 nt, hsa; identical to SEQ ID NO: 93099

SEQ ID NO: 587300 - RNA, 64 nt, hsa; identical to SEQ ID NO: 93100

SEQ ID NO: 587301 - RNA, 64 nt, hsa; identical to SEQ ID NO: 93101

SEQ ID NO: 587302 - RNA, 64 nt, hsa; identical to SEQ ID NO: 93102

SEQ ID NO: 587303 - RNA, 64 nt, hsa; identical to SEQ ID NO: 93103

SEQ ID NO: 587304 - RNA, 64 nt, hsa; identical to SEQ ID NO: 93104

SEQ ID NO: 587305 - RNA, 64 nt, hsa; identical to SEQ ID NO: 93105

SEQ ID NO: 587306 - RNA, 64 nt, hsa; identical to SEQ ID NO: 93106

SEQ ID NO: 587307 - RNA, 64 nt, hsa; identical to SEQ ID NO: 93107

SEQ ID NO: 587308 - RNA, 64 nt, hsa; identical to SEQ ID NO: 93108

SEQ ID NO: 587309 - RNA, 64 nt, hsa; identical to SEQ ID NO: 93109

SEQ ID NO: 587310 - RNA, 64 nt, hsa; identical to SEQ ID NO: 93110

SEQ ID NO: 587311 - RNA, 64 nt, hsa; identical to SEQ ID NO: 93111

SEQ ID NO: 587312 - RNA, 64 nt, hsa; identical to SEQ ID NO: 93112

SEQ ID NO: 587313 - RNA, 64 nt, hsa; identical to SEQ ID NO: 93113

SEQ ID NO: 587314 - RNA, 64 nt, hsa; identical to SEQ ID NO: 93114

SEQ ID NO: 587315 - RNA, 64 nt, hsa; identical to SEQ ID NO: 93115

SEQ ID NO: 587316 - RNA, 64 nt, hsa; identical to SEQ ID NO: 93116

SEQ ID NO: 587317 - RNA, 64 nt, hsa; identical to SEQ ID NO: 93117

SEQ ID NO: 587318 - RNA, 64 nt, hsa; identical to SEQ ID NO: 93118

SEQ ID NO: 587319 - RNA, 64 nt, hsa; identical to SEQ ID NO: 93119

SEQ ID NO: 587320 - RNA, 64 nt, hsa; identical to SEQ ID NO: 93120

SEQ ID NO: 587321 - RNA, 64 nt, hsa; identical to SEQ ID NO: 93121

SEQ ID NO: 587322 - RNA, 64 nt, hsa; identical to SEQ ID NO: 93122

SEQ ID NO: 587323 - RNA, 64 nt, hsa; identical to SEQ ID NO: 93123

SEQ ID NO: 587324 - RNA, 64 nt, hsa; identical to SEQ ID NO: 93124

SEQ ID NO: 587325 - RNA, 64 nt, hsa; identical to SEQ ID NO: 93125

SEQ ID NO: 587326 - RNA, 64 nt, hsa; identical to SEQ ID NO: 93126

SEQ ID NO: 587327 - RNA, 64 nt, hsa; identical to SEQ ID NO: 93127

SEQ ID NO: 587328 - RNA, 64 nt, hsa; identical to SEQ ID NO: 93128

SEQ ID NO: 587329 - RNA, 64 nt, hsa; identical to SEQ ID NO: 93129

SEQ ID NO: 587330 - RNA, 64 nt, hsa; identical to SEQ ID NO: 93130

SEQ ID NO: 587331 - RNA, 64 nt, hsa; identical to SEQ ID NO: 93131

SEQ ID NO: 587332 - RNA, 64 nt, hsa; identical to SEQ ID NO: 93132

SEQ ID NO: 587333 - RNA, 64 nt, hsa; identical to SEQ ID NO: 93133

SEQ ID NO: 587334 - RNA, 64 nt, hsa; identical to SEQ ID NO: 93134

SEQ ID NO: 587335 - RNA, 64 nt, hsa; identical to SEQ ID NO: 93135

SEQ ID NO: 587336 - RNA, 64 nt, hsa; identical to SEQ ID NO: 93136

SEQ ID NO: 587337 - RNA, 64 nt, hsa; identical to SEQ ID NO: 93137

SEQ ID NO: 587338 - RNA, 64 nt, hsa; identical to SEQ ID NO: 93138

SEQ ID NO: 587339 - RNA, 64 nt, hsa; identical to SEQ ID NO: 93139

SEQ ID NO: 587340 - RNA, 64 nt, hsa; identical to SEQ ID NO: 93140

SEQ ID NO: 587341 - RNA, 64 nt, hsa; identical to SEQ ID NO: 93141

SEQ ID NO: 587342 - RNA, 64 nt, hsa; identical to SEQ ID NO: 93142

SEQ ID NO: 587343 - RNA, 64 nt, hsa; identical to SEQ ID NO: 93143

SEQ ID NO: 587344 - RNA, 64 nt, hsa; identical to SEQ ID NO: 93144

SEQ ID NO: 587345 - RNA, 64 nt, hsa; identical to SEQ ID NO: 93145

SEQ ID NO: 587346 - RNA, 64 nt, hsa; identical to SEQ ID NO: 93146

SEQ ID NO: 587347 - RNA, 64 nt, hsa; identical to SEQ ID NO: 93147

SEQ ID NO: 587348 - RNA, 64 nt, hsa; identical to SEQ ID NO: 93148

SEQ ID NO: 587349 - RNA, 64 nt, hsa; identical to SEQ ID NO: 93149

SEQ ID NO: 587350 - RNA, 64 nt, hsa; identical to SEQ ID NO: 93150

SEQ ID NO: 587351 - RNA, 64 nt, hsa; identical to SEQ ID NO: 93151

SEQ ID NO: 587352 - RNA, 64 nt, hsa; identical to SEQ ID NO: 234551

SEQ ID NO: 587353 - RNA, 64 nt, hsa; identical to SEQ ID NO: 234551

SEQ ID NO: 587354 - RNA, 65 nt, hsa; identical to SEQ ID NO: 489615

SEQ ID NO: 587355 - RNA, 65 nt, hsa; identical to SEQ ID NO: 489616

SEQ ID NO: 587356 - RNA, 65 nt, hsa; identical to SEQ ID NO: 489617

SEQ ID NO: 587357 - RNA, 65 nt, hsa; identical to SEQ ID NO: 489618

SEQ ID NO: 587358 - RNA, 65 nt, hsa; identical to SEQ ID NO: 489619

SEQ ID NO: 587359 - RNA, 65 nt, hsa; identical to SEQ ID NO: 489625

SEQ ID NO: 587360 - RNA, 65 nt, hsa; identical to SEQ ID NO: 489626

SEQ ID NO: 587361 - RNA, 65 nt, hsa; identical to SEQ ID NO: 489658

SEQ ID NO: 587362 - RNA, 65 nt, hsa; identical to SEQ ID NO: 489659

SEQ ID NO: 587363 - RNA, 65 nt, hsa; identical to SEQ ID NO: 489665

SEQ ID NO: 587364 - RNA, 65 nt, hsa; identical to SEQ ID NO: 489666

SEQ ID NO: 587365 - RNA, 65 nt, hsa; identical to SEQ ID NO: 489682

SEQ ID NO: 587366 - RNA, 65 nt, hsa; identical to SEQ ID NO: 489683

SEQ ID NO: 587367 - RNA, 65 nt, hsa; identical to SEQ ID NO: 489692

SEQ ID NO: 587368 - RNA, 65 nt, hsa; identical to SEQ ID NO: 489693

SEQ ID NO: 587369 - RNA, 65 nt, hsa; identical to SEQ ID NO: 489712

SEQ ID NO: 587370 - RNA, 65 nt, hsa; identical to SEQ ID NO: 489713

SEQ ID NO: 587371 - RNA, 65 nt, hsa; identical to SEQ ID NO: 489714

SEQ ID NO: 587372 - RNA, 65 nt, hsa; identical to SEQ ID NO: 489715

SEQ ID NO: 587373 - RNA, 65 nt, hsa; identical to SEQ ID NO: 489731

SEQ ID NO: 587374 - RNA, 65 nt, hsa; identical to SEQ ID NO: 489732

SEQ ID NO: 587375 - RNA, 65 nt, hsa; identical to SEQ ID NO: 489745

SEQ ID NO: 587376 - RNA, 65 nt, hsa; identical to SEQ ID NO: 489746

SEQ ID NO: 587377 - RNA, 65 nt, hsa; identical to SEQ ID NO: 489754

SEQ ID NO: 587378 - RNA, 65 nt, hsa; identical to SEQ ID NO: 489755

SEQ ID NO: 587379 - RNA, 65 nt, hsa; identical to SEQ ID NO: 489756

SEQ ID NO: 587380 - RNA, 65 nt, hsa; identical to SEQ ID NO: 489760

SEQ ID NO: 587381 - RNA, 65 nt, hsa; identical to SEQ ID NO: 489761

SEQ ID NO: 587382 - RNA, 65 nt, hsa; identical to SEQ ID NO: 489762

SEQ ID NO: 587383 - RNA, 65 nt, hsa; identical to SEQ ID NO: 489777

SEQ ID NO: 587384 - RNA, 65 nt, hsa; identical to SEQ ID NO: 489778

SEQ ID NO: 587385 - RNA, 65 nt, hsa; identical to SEQ ID NO: 489781

SEQ ID NO: 587386 - RNA, 65 nt, hsa; identical to SEQ ID NO: 489782

SEQ ID NO: 587387 - RNA, 65 nt, hsa; identical to SEQ ID NO: 489849

SEQ ID NO: 587388 - RNA, 65 nt, hsa; identical to SEQ ID NO: 489850

SEQ ID NO: 587389 - RNA, 65 nt, hsa; identical to SEQ ID NO: 489855

SEQ ID NO: 587390 - RNA, 65 nt, hsa; identical to SEQ ID NO: 489856

SEQ ID NO: 587391 - RNA, 65 nt, hsa; identical to SEQ ID NO: 489893

SEQ ID NO: 587392 - RNA, 65 nt, hsa; identical to SEQ ID NO: 489894

SEQ ID NO: 587393 - RNA, 65 nt, hsa; identical to SEQ ID NO: 489898

SEQ ID NO: 587394 - RNA, 65 nt, hsa; identical to SEQ ID NO: 489899

SEQ ID NO: 587395 - RNA, 65 nt, hsa; identical to SEQ ID NO: 489914

SEQ ID NO: 587396 - RNA, 65 nt, hsa; identical to SEQ ID NO: 489915

SEQ ID NO: 587397 - RNA, 65 nt, hsa; identical to SEQ ID NO: 489918

SEQ ID NO: 587398 - RNA, 65 nt, hsa; identical to SEQ ID NO: 489919

SEQ ID NO: 587399 - RNA, 65 nt, hsa; identical to SEQ ID NO: 489925

SEQ ID NO: 587400 - RNA, 65 nt, hsa; identical to SEQ ID NO: 489926

SEQ ID NO: 587401 - RNA, 65 nt, hsa; identical to SEQ ID NO: 489956

SEQ ID NO: 587402 - RNA, 65 nt, hsa; identical to SEQ ID NO: 489957

SEQ ID NO: 587403 - RNA, 65 nt, hsa; identical to SEQ ID NO: 490016

SEQ ID NO: 587404 - RNA, 65 nt, hsa; identical to SEQ ID NO: 490017

SEQ ID NO: 587405 - RNA, 65 nt, hsa; identical to SEQ ID NO: 490087

SEQ ID NO: 587406 - RNA, 65 nt, hsa; identical to SEQ ID NO: 490088

SEQ ID NO: 587407 - RNA, 65 nt, hsa; identical to SEQ ID NO: 490090

SEQ ID NO: 587408 - RNA, 65 nt, hsa; identical to SEQ ID NO: 490091

SEQ ID NO: 587409 - RNA, 65 nt, hsa; identical to SEQ ID NO: 490105

SEQ ID NO: 587410 - RNA, 65 nt, hsa; identical to SEQ ID NO: 490106

SEQ ID NO: 587411 - RNA, 64 nt, hsa; identical to SEQ ID NO: 437741

SEQ ID NO: 587412 - RNA, 64 nt, hsa; identical to SEQ ID NO: 437742

SEQ ID NO: 587413 - RNA, 64 nt, hsa; identical to SEQ ID NO: 437743

SEQ ID NO: 587414 - RNA, 64 nt, hsa; identical to SEQ ID NO: 437744

SEQ ID NO: 587415 - RNA, 64 nt, hsa; identical to SEQ ID NO: 437745

SEQ ID NO: 587416 - RNA, 64 nt, hsa; identical to SEQ ID NO: 437746

SEQ ID NO: 587417 - RNA, 64 nt, hsa
ucugcuucaaaaggcucucaacaugaagguuaacacagucaaucaaacuuacauuccugccaag

SEQ ID NO: 587418 - RNA, 64 nt, hsa
uuuuguauauauggauuauguuuuagcauuuuauacagucaacuuuguaaugaacuuuuuaaaa

SEQ ID NO: 587419 - RNA, 64 nt, hsa
ccgccugcaucuagugcugcuucugcagaucaacacagucaaagcggcucuagcucugauaaca

SEQ ID NO: 587420 - RNA, 64 nt, hsa
cacagcagguuacucagcaguuugugccuccuacacagucaaagaaagagaaaaaagauaaagu

SEQ ID NO: 587421 - RNA, 64 nt, hsa
gcuaaguacagaauuuuaucuacaguacugugagacagucaauuauugccuaggguaguucaaa

SEQ ID NO: 587422 - RNA, 64 nt, hsa
uuuaguguauucacaaaguuguguaaccgugaccacagucaauuuuagaacauuucguuacccc

SEQ ID NO: 587423 - RNA, 64 nt, hsa; identical to SEQ ID NO: 326924

SEQ ID NO: 587424 - RNA, 64 nt, hsa; identical to SEQ ID NO: 326925

SEQ ID NO: 587425 - RNA, 64 nt, hsa; identical to SEQ ID NO: 326926

SEQ ID NO: 587426 - RNA, 64 nt, hsa; identical to SEQ ID NO: 326927

SEQ ID NO: 587427 - RNA, 64 nt, hsa; identical to SEQ ID NO: 326928

SEQ ID NO: 587428 - RNA, 64 nt, hsa; identical to SEQ ID NO: 326929

SEQ ID NO: 587429 - RNA, 64 nt, hsa; identical to SEQ ID NO: 326930

SEQ ID NO: 587430 - RNA, 64 nt, hsa; identical to SEQ ID NO: 326931

SEQ ID NO: 587431 - RNA, 64 nt, hsa; identical to SEQ ID NO: 326932

SEQ ID NO: 587432 - RNA, 64 nt, hsa; identical to SEQ ID NO: 326933

SEQ ID NO: 587433 - RNA, 64 nt, hsa; identical to SEQ ID NO: 326934

SEQ ID NO: 587434 - RNA, 64 nt, hsa; identical to SEQ ID NO: 326935

SEQ ID NO: 587435 - RNA, 64 nt, hsa; identical to SEQ ID NO: 326936

SEQ ID NO: 587436 - RNA, 64 nt, hsa; identical to SEQ ID NO: 326937

SEQ ID NO: 587437 - RNA, 64 nt, hsa; identical to SEQ ID NO: 326938

SEQ ID NO: 587438 - RNA, 64 nt, hsa; identical to SEQ ID NO: 326939

SEQ ID NO: 587439 - RNA, 64 nt, hsa; identical to SEQ ID NO: 326940

SEQ ID NO: 587440 - RNA, 56 nt, hsa; identical to SEQ ID NO: 326941

SEQ ID NO: 587441 - RNA, 64 nt, hsa; identical to SEQ ID NO: 326942

SEQ ID NO: 587442 - RNA, 64 nt, hsa; identical to SEQ ID NO: 326943

SEQ ID NO: 587443 - RNA, 64 nt, hsa; identical to SEQ ID NO: 326944

SEQ ID NO: 587444 - RNA, 64 nt, hsa; identical to SEQ ID NO: 326945

SEQ ID NO: 587445 - RNA, 64 nt, hsa; identical to SEQ ID NO: 326946

SEQ ID NO: 587446 - RNA, 64 nt, hsa; identical to SEQ ID NO: 326947

SEQ ID NO: 587447 - RNA, 64 nt, hsa; identical to SEQ ID NO: 326948

SEQ ID NO: 587448 - RNA, 64 nt, hsa; identical to SEQ ID NO: 326949

SEQ ID NO: 587449 - RNA, 64 nt, hsa; identical to SEQ ID NO: 326950

SEQ ID NO: 587450 - RNA, 64 nt, hsa; identical to SEQ ID NO: 326951

SEQ ID NO: 587451 - RNA, 64 nt, hsa; identical to SEQ ID NO: 326952

SEQ ID NO: 587452 - RNA, 64 nt, hsa; identical to SEQ ID NO: 326953

SEQ ID NO: 587453 - RNA, 64 nt, hsa; identical to SEQ ID NO: 326954

SEQ ID NO: 587454 - RNA, 64 nt, hsa; identical to SEQ ID NO: 326955

SEQ ID NO: 587455 - RNA, 63 nt, hsa
guccucaguuugcagugcucuagcuccuggcagaagcaagagggaaacauuccuaauuuaguu

SEQ ID NO: 587456 - RNA, 63 nt, hsa
uaaaagcaaccauggggagaaaaagaucagugaaagcaagacagucaaauacuuaguaggcuu

SEQ ID NO: 587457 - RNA, 63 nt, hsa
uagucucaugagcccuuugcauucuuuccccuuaagcaagaauagaauguaguggaaauuuau

SEQ ID NO: 587458 - RNA, 63 nt, hsa
acugacuaccugggguaggcacauuauguguuaaagcaagacagaggccagagaggggcaggu

SEQ ID NO: 587459 - RNA, 63 nt, hsa
gagcagagcaugcagugauggaagaagcaggaaaagcaagaagaaaagacagcagcaucaaga

SEQ ID NO: 587460 - RNA, 63 nt, hsa
gcacccagaacaugcugagcagaacaucagaaaaagcaagaagaagaaaaggcgacaucaaga

SEQ ID NO: 587461 - RNA, 63 nt, hsa
acaauggacauuaguuuuuaaaaaguuacguggaagcaagauuucuauauuuguuuuuuuaaa

SEQ ID NO: 587462 - RNA, 63 nt, hsa
guugaauaauaauuagcauauaauugucuacagaagcaagagcaaucuggaaggaacaaaaau

SEQ ID NO: 587463 - RNA, 63 nt, hsa
cuaugguuucacauagacgugcagugugaaccaaagcaagacugaaugugacuguaaauaauu

SEQ ID NO: 587464 - RNA, 63 nt, hsa
aguauaaaagaucucuggcuuugcugaaauuuuaagcaagaaguucuauuuaauggagauguc

SEQ ID NO: 587465 - RNA, 63 nt, hsa
aauguguuacaugggaagaaaaagauuaagaaaaagcaagauaauuuugaagaaggacgagag

SEQ ID NO: 587466 - RNA, 63 nt, hsa
uucaugauuuugcaaaugggaaggauuucuuuaaagcaagacacaaaagcauacacaggaaaa

SEQ ID NO: 587467 - RNA, 63 nt, hsa
gucuugauaccuugguuugucccagcugaagugaagcaagagaguuugaauuaauuuuuccau

SEQ ID NO: 587468 - RNA, 63 nt, hsa
augauugcgccacugcacucagcccgggugacaaagcaagacccugucucagaaaaaaagaaa

SEQ ID NO: 587469 - RNA, 63 nt, hsa
aauaaacugguuguauggccauagcuauccgaaaagcaagagacaaagcaagacaaauauuca

SEQ ID NO: 587470 - RNA, 63 nt, hsa
guauggccauagcuauccgaaaagcaagagacaaagcaagacaaauauucacacaaaaaugaa

SEQ ID NO: 587471 - RNA, 63 nt, hsa
aucugcuaaugggagaccaaaucuuuguccgggaagcaagaagugggugggagaauguauccu

SEQ ID NO: 587472 - RNA, 63 nt, hsa
ggucccuguccucugucuuugaggcugguuaggaagcaagaguccugaucuuucaugcugcac

SEQ ID NO: 587473 - RNA, 63 nt, hsa
cuugcuuucuuucuuaaaaaaaagaaaaagaaaaagcaagaagaaggaagaaagaaaaagaca

SEQ ID NO: 587474 - RNA, 63 nt, hsa
ugacaauagagggccacggggaggcccccccagaagcaagauucaaaucucuugcuuucuuuc

SEQ ID NO: 587475 - RNA, 63 nt, hsa
cacuugaaugcaaaggaaaacacuugcacagcaaagcaagagaagucacagcagcaagacacg

SEQ ID NO: 587476 - RNA, 63 nt, hsa
augacucuccuuugaaaugagaaaaagaaaagaaagcaagaacagaaaacgaagccacaggaa

SEQ ID NO: 587477 - RNA, 64 nt, hsa; identical to SEQ ID NO: 72787

SEQ ID NO: 587478 - RNA, 64 nt, hsa; identical to SEQ ID NO: 72788

SEQ ID NO: 587479 - RNA, 64 nt, hsa; identical to SEQ ID NO: 72789

SEQ ID NO: 587480 - RNA, 64 nt, hsa; identical to SEQ ID NO: 72790

SEQ ID NO: 587481 - RNA, 64 nt, hsa; identical to SEQ ID NO: 72791

SEQ ID NO: 587482 - RNA, 64 nt, hsa; identical to SEQ ID NO: 72792

SEQ ID NO: 587483 - RNA, 64 nt, hsa; identical to SEQ ID NO: 72793

SEQ ID NO: 587484 - RNA, 64 nt, hsa; identical to SEQ ID NO: 72794

SEQ ID NO: 587485 - RNA, 64 nt, hsa; identical to SEQ ID NO: 72795

SEQ ID NO: 587486 - RNA, 64 nt, hsa; identical to SEQ ID NO: 72796

SEQ ID NO: 587487 - RNA, 64 nt, hsa; identical to SEQ ID NO: 72797

SEQ ID NO: 587488 - RNA, 64 nt, hsa; identical to SEQ ID NO: 72798

SEQ ID NO: 587489 - RNA, 64 nt, hsa; identical to SEQ ID NO: 72799

SEQ ID NO: 587490 - RNA, 64 nt, hsa; identical to SEQ ID NO: 72800

SEQ ID NO: 587491 - RNA, 64 nt, hsa; identical to SEQ ID NO: 72801

SEQ ID NO: 587492 - RNA, 64 nt, hsa; identical to SEQ ID NO: 72802

SEQ ID NO: 587493 - RNA, 64 nt, hsa; identical to SEQ ID NO: 72803

SEQ ID NO: 587494 - RNA, 64 nt, hsa; identical to SEQ ID NO: 72804

SEQ ID NO: 587495 - RNA, 64 nt, hsa; identical to SEQ ID NO: 72805

SEQ ID NO: 587496 - RNA, 64 nt, hsa; identical to SEQ ID NO: 72806

SEQ ID NO: 587497 - RNA, 64 nt, hsa; identical to SEQ ID NO: 72807

SEQ ID NO: 587498 - RNA, 64 nt, hsa; identical to SEQ ID NO: 72808

SEQ ID NO: 587499 - RNA, 64 nt, hsa; identical to SEQ ID NO: 72809

SEQ ID NO: 587500 - RNA, 64 nt, hsa; identical to SEQ ID NO: 72810

SEQ ID NO: 587501 - RNA, 64 nt, hsa; identical to SEQ ID NO: 72811

SEQ ID NO: 587502 - RNA, 64 nt, hsa; identical to SEQ ID NO: 72812

SEQ ID NO: 587503 - RNA, 64 nt, hsa; identical to SEQ ID NO: 72813

SEQ ID NO: 587504 - RNA, 64 nt, hsa; identical to SEQ ID NO: 72814

SEQ ID NO: 587505 - RNA, 64 nt, hsa; identical to SEQ ID NO: 72815

SEQ ID NO: 587506 - RNA, 64 nt, hsa; identical to SEQ ID NO: 72816

SEQ ID NO: 587507 - RNA, 64 nt, hsa; identical to SEQ ID NO: 72817

SEQ ID NO: 587508 - RNA, 64 nt, hsa; identical to SEQ ID NO: 72818

SEQ ID NO: 587509 - RNA, 64 nt, hsa; identical to SEQ ID NO: 72819

SEQ ID NO: 587510 - RNA, 64 nt, hsa; identical to SEQ ID NO: 72820

SEQ ID NO: 587511 - RNA, 64 nt, hsa; identical to SEQ ID NO: 72821

SEQ ID NO: 587512 - RNA, 64 nt, hsa; identical to SEQ ID NO: 72822

SEQ ID NO: 587513 - RNA, 64 nt, hsa; identical to SEQ ID NO: 72823

SEQ ID NO: 587514 - RNA, 64 nt, hsa; identical to SEQ ID NO: 72824

SEQ ID NO: 587515 - RNA, 64 nt, hsa; identical to SEQ ID NO: 72825

SEQ ID NO: 587516 - RNA, 64 nt, hsa; identical to SEQ ID NO: 72826

SEQ ID NO: 587517 - RNA, 64 nt, hsa; identical to SEQ ID NO: 72827

SEQ ID NO: 587518 - RNA, 64 nt, hsa; identical to SEQ ID NO: 72828

SEQ ID NO: 587519 - RNA, 64 nt, hsa; identical to SEQ ID NO: 72829

SEQ ID NO: 587520 - RNA, 64 nt, hsa; identical to SEQ ID NO: 72830

SEQ ID NO: 587521 - RNA, 64 nt, hsa; identical to SEQ ID NO: 72831

SEQ ID NO: 587522 - RNA, 64 nt, hsa; identical to SEQ ID NO: 72832

SEQ ID NO: 587523 - RNA, 64 nt, hsa; identical to SEQ ID NO: 72833

SEQ ID NO: 587524 - RNA, 64 nt, hsa; identical to SEQ ID NO: 72834

SEQ ID NO: 587525 - RNA, 64 nt, hsa; identical to SEQ ID NO: 72835

SEQ ID NO: 587526 - RNA, 64 nt, hsa; identical to SEQ ID NO: 72836

SEQ ID NO: 587527 - RNA, 64 nt, hsa; identical to SEQ ID NO: 72837

SEQ ID NO: 587528 - RNA, 64 nt, hsa; identical to SEQ ID NO: 72838

SEQ ID NO: 587529 - RNA, 64 nt, hsa; identical to SEQ ID NO: 72839

SEQ ID NO: 587530 - RNA, 64 nt, hsa; identical to SEQ ID NO: 72840

SEQ ID NO: 587531 - RNA, 64 nt, hsa; identical to SEQ ID NO: 72841

SEQ ID NO: 587532 - RNA, 64 nt, hsa; identical to SEQ ID NO: 370200

SEQ ID NO: 587533 - RNA, 64 nt, hsa; identical to SEQ ID NO: 370201

SEQ ID NO: 587534 - RNA, 64 nt, hsa; identical to SEQ ID NO: 370202

SEQ ID NO: 587535 - RNA, 64 nt, hsa; identical to SEQ ID NO: 370203

SEQ ID NO: 587536 - RNA, 64 nt, hsa; identical to SEQ ID NO: 370204

SEQ ID NO: 587537 - RNA, 64 nt, hsa; identical to SEQ ID NO: 370205

SEQ ID NO: 587538 - RNA, 64 nt, hsa; identical to SEQ ID NO: 370206

SEQ ID NO: 587539 - RNA, 64 nt, hsa; identical to SEQ ID NO: 370207

SEQ ID NO: 587540 - RNA, 64 nt, hsa; identical to SEQ ID NO: 370208

SEQ ID NO: 587541 - RNA, 64 nt, hsa; identical to SEQ ID NO: 370209

SEQ ID NO: 587542 - RNA, 64 nt, hsa; identical to SEQ ID NO: 370210

SEQ ID NO: 587543 - RNA, 64 nt, hsa; identical to SEQ ID NO: 370211

SEQ ID NO: 587544 - RNA, 64 nt, hsa; identical to SEQ ID NO: 302078

SEQ ID NO: 587545 - RNA, 64 nt, hsa; identical to SEQ ID NO: 302079

SEQ ID NO: 587546 - RNA, 64 nt, hsa; identical to SEQ ID NO: 302080

SEQ ID NO: 587547 - RNA, 63 nt, hsa; identical to SEQ ID NO: 302081

SEQ ID NO: 587548 - RNA, 64 nt, hsa; identical to SEQ ID NO: 302082

SEQ ID NO: 587549 - RNA, 64 nt, hsa; identical to SEQ ID NO: 302083

SEQ ID NO: 587550 - RNA, 64 nt, hsa; identical to SEQ ID NO: 302084

SEQ ID NO: 587551 - RNA, 64 nt, hsa; identical to SEQ ID NO: 302085

SEQ ID NO: 587552 - RNA, 64 nt, hsa
ugugggugguauuuucaugcaaauaaguaaggguggguuuuauauuuuguagaaguuuucgguc

SEQ ID NO: 587553 - RNA, 64 nt, hsa
agucuuauaccucaacuaccuuucaguccugucuggguuuuaaauaagugaaguagaagaaauu

SEQ ID NO: 587554 - RNA, 64 nt, hsa
gaaucaccaaugugggugugaaaaugccuacaaaggguuuuagugccuuagaaguccuaagaag

SEQ ID NO: 587555 - RNA, 64 nt, hsa
ucucaaccuuggcugcacauuggaaucaccuguaggguuuuaaagcauccaaaugguaauuaac

SEQ ID NO: 587556 - RNA, 64 nt, hsa
gaaaacaggguggguagcuaaggucauuccuccuggguuuuaguggcauugccuuccuucacua

SEQ ID NO: 587557 - RNA, 64 nt, hsa
acucugagaauucagcuuuggagucccgggugagggguuuuagauaaacccaucaauaucaccc

SEQ ID NO: 587558 - RNA, 64 nt, hsa
gcugugccaguugcucugguauucagguuucucuggguuuuacagaacgcauggaccccauuca

SEQ ID NO: 587559 - RNA, 64 nt, hsa
ucuuuuuccugguuaauuguuuucugaguuuuuuggguuuuauuuuuugcugaugacuauugau

SEQ ID NO: 587560 - RNA, 64 nt, hsa
gcuuucuuugagggcauuuauucugugugacuguggguuuuauuuuguauucugguuaagaaaa

SEQ ID NO: 587561 - RNA, 64 nt, hsa
uuugaguauauguguguguguguaacuaucauguggguuuuaaaaauccuuuuuuacaguggua

SEQ ID NO: 587562 - RNA, 64 nt, hsa
gcagaaugguuggccuaaugauuaugcuacagauggguuuuaaaugacccgucuagguuacugc

SEQ ID NO: 587563 - RNA, 64 nt, hsa
aaauuggagcuauucuucacugguccuuaaccuuggguuuuaaaaagaaggcuucucuguuugg

SEQ ID NO: 587564 - RNA, 64 nt, hsa
cuuucugaagccuggggagaaaucagugacagagggguuuuauuguuauguggguuuucuuuug

SEQ ID NO: 587565 - RNA, 64 nt, hsa
uccccauuuuuaucauauuuccaccaucacuucaggguuuuaagagucagugcucaccugggcg

SEQ ID NO: 587566 - RNA, 64 nt, hsa
uagguggagacacacuucccagaucaccgcaggcggguuuuacccggagagcucugggccguuc

SEQ ID NO: 587567 - RNA, 64 nt, hsa
acagaggucuagacgugagauccgcgucgggacaggguuuuaagugacaaagaagggcgagugg

SEQ ID NO: 587568 - RNA, 64 nt, hsa
cagucaaguugaguucaagugaaagauucuuccaggguuuuauuuuuuccccuccuaacaaagu

SEQ ID NO: 587569 - RNA, 64 nt, hsa
uggcuugguuuggaccacaguccucugcuacccaggguuuuagagccccugcucuaggaaacag

SEQ ID NO: 587570 - RNA, 64 nt, hsa
ugcgguuuuauuacauuaauaaccuuucaccucaggguuuuaugaagaggaaaggguuuuaugc

SEQ ID NO: 587571 - RNA, 64 nt, hsa
uaaccuuucaccucaggguuuuaugaagaggaaaggguuuuaugcaaaagaaagugcuacaauu

SEQ ID NO: 587572 - RNA, 64 nt, hsa
auguuguccucuggacauauuuaucaauauaauuggguuuuaaauaguauaaaagaaaacuugu

SEQ ID NO: 587573 - RNA, 64 nt, hsa
gcucaccauacuccuuuccauguacauccagugaggguuuuauuacgcuagguuucccuuccau

SEQ ID NO: 587574 - RNA, 64 nt, hsa; identical to SEQ ID NO: 388546

SEQ ID NO: 587575 - RNA, 64 nt, hsa; identical to SEQ ID NO: 388547

SEQ ID NO: 587576 - RNA, 64 nt, hsa; identical to SEQ ID NO: 388548

SEQ ID NO: 587577 - RNA, 64 nt, hsa; identical to SEQ ID NO: 388549

SEQ ID NO: 587578 - RNA, 64 nt, hsa; identical to SEQ ID NO: 388550

SEQ ID NO: 587579 - RNA, 64 nt, hsa; identical to SEQ ID NO: 388551

SEQ ID NO: 587580 - RNA, 64 nt, hsa; identical to SEQ ID NO: 388552

SEQ ID NO: 587581 - RNA, 64 nt, hsa; identical to SEQ ID NO: 388553

SEQ ID NO: 587582 - RNA, 64 nt, hsa; identical to SEQ ID NO: 388554

SEQ ID NO: 587583 - RNA, 64 nt, hsa; identical to SEQ ID NO: 388555

SEQ ID NO: 587584 - RNA, 64 nt, hsa; identical to SEQ ID NO: 388556

SEQ ID NO: 587585 - RNA, 64 nt, hsa; identical to SEQ ID NO: 388557

SEQ ID NO: 587586 - RNA, 64 nt, hsa; identical to SEQ ID NO: 388558

SEQ ID NO: 587587 - RNA, 64 nt, hsa; identical to SEQ ID NO: 388559

SEQ ID NO: 587588 - RNA, 64 nt, hsa; identical to SEQ ID NO: 45815

SEQ ID NO: 587589 - RNA, 64 nt, hsa; identical to SEQ ID NO: 45816

SEQ ID NO: 587590 - RNA, 64 nt, hsa; identical to SEQ ID NO: 45817

SEQ ID NO: 587591 - RNA, 64 nt, hsa; identical to SEQ ID NO: 45818

SEQ ID NO: 587592 - RNA, 64 nt, hsa; identical to SEQ ID NO: 45819

SEQ ID NO: 587593 - RNA, 64 nt, hsa; identical to SEQ ID NO: 45820

SEQ ID NO: 587594 - RNA, 64 nt, hsa; identical to SEQ ID NO: 45821

SEQ ID NO: 587595 - RNA, 64 nt, hsa; identical to SEQ ID NO: 45822

SEQ ID NO: 587596 - RNA, 64 nt, hsa; identical to SEQ ID NO: 45823

SEQ ID NO: 587597 - RNA, 64 nt, hsa; identical to SEQ ID NO: 45824

SEQ ID NO: 587598 - RNA, 64 nt, hsa; identical to SEQ ID NO: 45825

SEQ ID NO: 587599 - RNA, 64 nt, hsa; identical to SEQ ID NO: 45826

SEQ ID NO: 587600 - RNA, 64 nt, hsa; identical to SEQ ID NO: 45827

SEQ ID NO: 587601 - RNA, 64 nt, hsa; identical to SEQ ID NO: 45828

SEQ ID NO: 587602 - RNA, 64 nt, hsa; identical to SEQ ID NO: 45829

SEQ ID NO: 587603 - RNA, 64 nt, hsa; identical to SEQ ID NO: 45830

SEQ ID NO: 587604 - RNA, 64 nt, hsa; identical to SEQ ID NO: 45831

SEQ ID NO: 587605 - RNA, 64 nt, hsa; identical to SEQ ID NO: 45832

SEQ ID NO: 587606 - RNA, 64 nt, hsa; identical to SEQ ID NO: 276199

SEQ ID NO: 587607 - RNA, 64 nt, hsa; identical to SEQ ID NO: 276200

SEQ ID NO: 587608 - RNA, 64 nt, hsa; identical to SEQ ID NO: 276201

SEQ ID NO: 587609 - RNA, 64 nt, hsa; identical to SEQ ID NO: 276202

SEQ ID NO: 587610 - RNA, 64 nt, hsa; identical to SEQ ID NO: 276203

SEQ ID NO: 587611 - RNA, 64 nt, hsa; identical to SEQ ID NO: 276204

SEQ ID NO: 587612 - RNA, 64 nt, hsa; identical to SEQ ID NO: 276205

SEQ ID NO: 587613 - RNA, 64 nt, hsa; identical to SEQ ID NO: 276206

SEQ ID NO: 587614 - RNA, 64 nt, hsa; identical to SEQ ID NO: 276207

SEQ ID NO: 587615 - RNA, 64 nt, hsa; identical to SEQ ID NO: 276208

SEQ ID NO: 587616 - RNA, 64 nt, hsa; identical to SEQ ID NO: 276209

SEQ ID NO: 587617 - RNA, 56 nt, hsa; identical to SEQ ID NO: 276210

SEQ ID NO: 587618 - RNA, 64 nt, hsa; identical to SEQ ID NO: 276211

SEQ ID NO: 587619 - RNA, 64 nt, hsa; identical to SEQ ID NO: 276212

SEQ ID NO: 587620 - RNA, 64 nt, hsa; identical to SEQ ID NO: 276213

SEQ ID NO: 587621 - RNA, 64 nt, hsa; identical to SEQ ID NO: 276214

SEQ ID NO: 587622 - RNA, 64 nt, hsa; identical to SEQ ID NO: 276215

SEQ ID NO: 587623 - RNA, 64 nt, hsa; identical to SEQ ID NO: 276216

SEQ ID NO: 587624 - RNA, 64 nt, hsa; identical to SEQ ID NO: 276217

SEQ ID NO: 587625 - RNA, 64 nt, hsa; identical to SEQ ID NO: 276218

SEQ ID NO: 587626 - RNA, 64 nt, hsa; identical to SEQ ID NO: 276219

SEQ ID NO: 587627 - RNA, 64 nt, hsa; identical to SEQ ID NO: 276220

SEQ ID NO: 587628 - RNA, 64 nt, hsa; identical to SEQ ID NO: 276221

SEQ ID NO: 587629 - RNA, 64 nt, hsa; identical to SEQ ID NO: 276222

SEQ ID NO: 587630 - RNA, 64 nt, hsa; identical to SEQ ID NO: 276222

SEQ ID NO: 587631 - RNA, 64 nt, hsa; identical to SEQ ID NO: 276224

SEQ ID NO: 587632 - RNA, 64 nt, hsa; identical to SEQ ID NO: 276225

SEQ ID NO: 587633 - RNA, 64 nt, hsa; identical to SEQ ID NO: 276226

SEQ ID NO: 587634 - RNA, 64 nt, hsa; identical to SEQ ID NO: 276227

SEQ ID NO: 587635 - RNA, 64 nt, hsa
auaagacuguuuuugacaauuuuuuuaucaagaaagagcaaauaaaaagcagugguaaugaucc

SEQ ID NO: 587636 - RNA, 64 nt, hsa
accacagcucagaauuccagcaguucauccagucagagcaaaaugguuaauugcccaguuuguc

SEQ ID NO: 587637 - RNA, 64 nt, hsa
aauaaauucuacacaaggcuuucaagaccaucagagagcaaaaccacauguucugucuugagga

SEQ ID NO: 587638 - RNA, 64 nt, hsa
accacauguucugucuugaggagccauagcagaaagagcaaauuagucauuauuuacugaacau

SEQ ID NO: 587639 - RNA, 64 nt, hsa
gcaucuagauuggagugcugcacaaacaaacauaagagcaaagcaaaacuguaucacauagggu

SEQ ID NO: 587640 - RNA, 64 nt, hsa
uugugcuggucuugcaaguuugucuaccaguaagagagcaaaguuuccuuccuuucuucucuuu

SEQ ID NO: 587641 - RNA, 64 nt, hsa
aacuaaguugucacccaauaucuuagacacuuugagagcaaagggggugcuguaaauaaguaua

SEQ ID NO: 587642 - RNA, 64 nt, hsa
aggcuccaccucagaaauucugaaauggguaguaagagcaaauuuucauuuuaaagcacaccug

SEQ ID NO: 587643 - RNA, 64 nt, hsa
agguugugcagugcuguguauggauuuuacucuaagagcaaaggaaagccacugaagaguauaa

SEQ ID NO: 587644 - RNA, 64 nt, hsa
aacagcuuggggaagagaauuccauacugaaagaagagcaaauacaaaagccugaaggaaagaa

SEQ ID NO: 587645 - RNA, 64 nt, hsa
auuuaccauauuauuguuuuuaaaaaagcaguuuagagcaaacugucacuaaacuuggauaaau

SEQ ID NO: 587646 - RNA, 64 nt, hsa
aucuuuaacuauagccuagagaaaagaggguugaagagcaaagcagauuuuuuuuuuccuuuuc

SEQ ID NO: 587647 - RNA, 64 nt, hsa
caagaucgugccacuucacuccagccugggcaaaagagcaaaacgccaucucaaaaaauauaca

SEQ ID NO: 587648 - RNA, 64 nt, hsa
uaauaauaauaaacuuuuucagaaagaauugaguagagcaaaaaugacaaagauguguagcugu

SEQ ID NO: 587649 - RNA, 64 nt, hsa
aauggguaaccuagacuucagagagaaugagcagagagcaaaggagaaaucuggcuguccuucc

SEQ ID NO: 587650 - RNA, 64 nt, hsa
ccauccuccugugucacugaauaucaacucugaaagagcaaaccuaacaggagaaaggacaacc

SEQ ID NO: 587651 - RNA, 64 nt, hsa
gugaccaauauggaauaaagaagaaggcagaaagagagcaaaugaaaaauuucaacuuguauau

SEQ ID NO: 587652 - RNA, 64 nt, hsa
guccucugggagcugaagcacacggccauguuggagagcaaaacuuaauaauaauucuuuuuua

SEQ ID NO: 587653 - RNA, 64 nt, hsa
aaagcuauuuuuguuaauguaaaguaaauauuucagagcaaauuuuuuaaacuuauugcacuaa

SEQ ID NO: 587654 - RNA, 64 nt, hsa
aauuauauaacuaacaauuguccaaauagaugagagagcaaaucaugugagaaaauucagaaua

SEQ ID NO: 587655 - RNA, 64 nt, hsa
gccuaugauuuagcuggcaggccagguuuucucaagagcaaaaucacccucuggccccuuggca

SEQ ID NO: 587656 - RNA, 64 nt, hsa
cuauguguguggauuccagggcaacucuagcaucagagcaaaagccuuggguuucucgcauuca

SEQ ID NO: 587657 - RNA, 64 nt, hsa
cagaucgcgccauugcacuccagccuggguaacaagagcaaaacucuguccaaaaaaaaaaaaa

SEQ ID NO: 587658 - RNA, 64 nt, hsa
acugaugagaguacuaacuggaaaaaggcugaagagagcaaauauauuauuaagauggguugga

SEQ ID NO: 587659 - RNA, 54 nt, hsa
uuggagccuucuuacuauaggaggagagcaaauaucauuauaugaaaguccucu

SEQ ID NO: 587660 - RNA, 64 nt, hsa
guagagcauaccacuugaagaaggaaagaaccgaagagcaaacaaaaguucugcguaaugagac

SEQ ID NO: 587661 - RNA, 64 nt, hsa
uacaguuuuagcggggagggggauaggaagacgcagagcaaaugagcuccggagucccugcagg

SEQ ID NO: 587662 - RNA, 64 nt, hsa
gcacuuuaaauaagguagaauggaaaaaacccagagagcaaagugcauuacuuaaagaugcagu

SEQ ID NO: 587663 - RNA, 64 nt, hsa
ccugucccucgccauacacugaugccuggcagcuagagcaaauggcucguguucuuugucgaag

SEQ ID NO: 587664 - RNA, 64 nt, hsa
ggcauuacauuggcaaauaagguuuggaagcagaagagcaaaaaaaagauauuguuaaaaugag

SEQ ID NO: 587665 - RNA, 64 nt, hsa
uaugguauuuguuaaauacguuuguuuuuauugcagagcaaaaauaaaucaaauuagaagcaau

SEQ ID NO: 587666 - RNA, 64 nt, hsa
cugaauacaugccacaaggaugaagcuugugaguagagcaaacaaacguuuuuccaaagaauuc

SEQ ID NO: 587667 - RNA, 64 nt, hsa
cacaucccacaaaauggcccuugguggcagcaauagagcaaagguuaccuuuuuguauggugaa

SEQ ID NO: 587668 - RNA, 64 nt, hsa
cagugggcgccucacacucagaaccucauaccccagagcaaaccgauggucagggagagggcua

SEQ ID NO: 587669 - RNA, 64 nt, hsa
aagaccaugccauuacacucaagcuugggcaacgagagcaaaacucugucucaaaaaaaaaauu

SEQ ID NO: 587670 - RNA, 64 nt, hsa
ugaggagcggacucacuugauguuuccuggaagcagagcaaaaugcucuugucccugucgcguc

SEQ ID NO: 587671 - RNA, 64 nt, hsa
ugguuccagaaccgacgcaugaaguggaaaaaggagagcaaacugcucagcgcgucucagcuca

SEQ ID NO: 587672 - RNA, 64 nt, hsa; identical to SEQ ID NO: 300594

SEQ ID NO: 587673 - RNA, 64 nt, hsa; identical to SEQ ID NO: 300595

SEQ ID NO: 587674 - RNA, 64 nt, hsa; identical to SEQ ID NO: 300596

SEQ ID NO: 587675 - RNA, 64 nt, hsa; identical to SEQ ID NO: 300597

SEQ ID NO: 587676 - RNA, 64 nt, hsa; identical to SEQ ID NO: 300598

SEQ ID NO: 587677 - RNA, 64 nt, hsa; identical to SEQ ID NO: 300599

SEQ ID NO: 587678 - RNA, 64 nt, hsa; identical to SEQ ID NO: 300600

SEQ ID NO: 587679 - RNA, 64 nt, hsa; identical to SEQ ID NO: 300601

SEQ ID NO: 587680 - RNA, 64 nt, hsa; identical to SEQ ID NO: 300602

SEQ ID NO: 587681 - RNA, 64 nt, hsa; identical to SEQ ID NO: 300603

SEQ ID NO: 587682 - RNA, 64 nt, hsa; identical to SEQ ID NO: 300604

SEQ ID NO: 587683 - RNA, 64 nt, hsa; identical to SEQ ID NO: 300605

SEQ ID NO: 587684 - RNA, 64 nt, hsa; identical to SEQ ID NO: 300606

SEQ ID NO: 587685 - RNA, 64 nt, hsa; identical to SEQ ID NO: 300607

SEQ ID NO: 587686 - RNA, 64 nt, hsa; identical to SEQ ID NO: 300608

SEQ ID NO: 587687 - RNA, 64 nt, hsa; identical to SEQ ID NO: 300609

SEQ ID NO: 587688 - RNA, 64 nt, hsa; identical to SEQ ID NO: 300610

SEQ ID NO: 587689 - RNA, 64 nt, hsa; identical to SEQ ID NO: 300611

SEQ ID NO: 587690 - RNA, 64 nt, hsa; identical to SEQ ID NO: 300612

SEQ ID NO: 587691 - RNA, 64 nt, hsa; identical to SEQ ID NO: 300613

SEQ ID NO: 587692 - RNA, 64 nt, hsa; identical to SEQ ID NO: 300614

SEQ ID NO: 587693 - RNA, 64 nt, hsa; identical to SEQ ID NO: 300615

SEQ ID NO: 587694 - RNA, 64 nt, hsa; identical to SEQ ID NO: 300616

SEQ ID NO: 587695 - RNA, 64 nt, hsa; identical to SEQ ID NO: 300617

SEQ ID NO: 587696 - RNA, 64 nt, hsa; identical to SEQ ID NO: 300618

SEQ ID NO: 587697 - RNA, 64 nt, hsa; identical to SEQ ID NO: 300619

SEQ ID NO: 587698 - RNA, 64 nt, hsa; identical to SEQ ID NO: 300620

SEQ ID NO: 587699 - RNA, 64 nt, hsa; identical to SEQ ID NO: 300621

SEQ ID NO: 587700 - RNA, 64 nt, hsa; identical to SEQ ID NO: 300622

SEQ ID NO: 587701 - RNA, 64 nt, hsa; identical to SEQ ID NO: 300623

SEQ ID NO: 587702 - RNA, 64 nt, hsa; identical to SEQ ID NO: 300624

SEQ ID NO: 587703 - RNA, 64 nt, hsa; identical to SEQ ID NO: 300625

SEQ ID NO: 587704 - RNA, 64 nt, hsa; identical to SEQ ID NO: 300626

SEQ ID NO: 587705 - RNA, 64 nt, hsa; identical to SEQ ID NO: 300627

SEQ ID NO: 587706 - RNA, 64 nt, hsa; identical to SEQ ID NO: 300628

SEQ ID NO: 587707 - RNA, 64 nt, hsa; identical to SEQ ID NO: 300629

SEQ ID NO: 587708 - RNA, 64 nt, hsa; identical to SEQ ID NO: 300630

SEQ ID NO: 587709 - RNA, 64 nt, hsa; identical to SEQ ID NO: 300631

SEQ ID NO: 587710 - RNA, 64 nt, hsa; identical to SEQ ID NO: 300632

SEQ ID NO: 587711 - RNA, 64 nt, hsa; identical to SEQ ID NO: 300633

SEQ ID NO: 587712 - RNA, 64 nt, hsa; identical to SEQ ID NO: 300634

SEQ ID NO: 587713 - RNA, 64 nt, hsa; identical to SEQ ID NO: 300635

SEQ ID NO: 587714 - RNA, 64 nt, hsa; identical to SEQ ID NO: 300636

SEQ ID NO: 587715 - RNA, 64 nt, hsa; identical to SEQ ID NO: 300637

SEQ ID NO: 587716 - RNA, 64 nt, hsa; identical to SEQ ID NO: 300638

SEQ ID NO: 587717 - RNA, 64 nt, hsa; identical to SEQ ID NO: 300639

SEQ ID NO: 587718 - RNA, 64 nt, hsa; identical to SEQ ID NO: 300640

SEQ ID NO: 587719 - RNA, 64 nt, hsa; identical to SEQ ID NO: 300641

SEQ ID NO: 587720 - RNA, 64 nt, hsa; identical to SEQ ID NO: 300642

SEQ ID NO: 587721 - RNA, 64 nt, hsa; identical to SEQ ID NO: 300643

SEQ ID NO: 587722 - RNA, 64 nt, hsa; identical to SEQ ID NO: 300644

SEQ ID NO: 587723 - RNA, 64 nt, hsa; identical to SEQ ID NO: 300645

SEQ ID NO: 587724 - RNA, 64 nt, hsa; identical to SEQ ID NO: 300646

SEQ ID NO: 587725 - RNA, 64 nt, hsa; identical to SEQ ID NO: 300647

SEQ ID NO: 587726 - RNA, 64 nt, hsa; identical to SEQ ID NO: 300648

SEQ ID NO: 587727 - RNA, 64 nt, hsa; identical to SEQ ID NO: 300649

SEQ ID NO: 587728 - RNA, 64 nt, hsa; identical to SEQ ID NO: 300650

SEQ ID NO: 587729 - RNA, 64 nt, hsa; identical to SEQ ID NO: 300651

SEQ ID NO: 587730 - RNA, 64 nt, hsa; identical to SEQ ID NO: 300652

SEQ ID NO: 587731 - RNA, 64 nt, hsa; identical to SEQ ID NO: 300653

SEQ ID NO: 587732 - RNA, 64 nt, hsa; identical to SEQ ID NO: 300654

SEQ ID NO: 587733 - RNA, 64 nt, hsa; identical to SEQ ID NO: 300655

SEQ ID NO: 587734 - RNA, 64 nt, hsa; identical to SEQ ID NO: 300656

SEQ ID NO: 587735 - RNA, 64 nt, hsa; identical to SEQ ID NO: 300657

SEQ ID NO: 587736 - RNA, 64 nt, hsa; identical to SEQ ID NO: 300658

SEQ ID NO: 587737 - RNA, 64 nt, hsa; identical to SEQ ID NO: 300659

SEQ ID NO: 587738 - RNA, 64 nt, hsa; identical to SEQ ID NO: 300660

SEQ ID NO: 587739 - RNA, 64 nt, hsa; identical to SEQ ID NO: 300661

SEQ ID NO: 587740 - RNA, 64 nt, hsa; identical to SEQ ID NO: 300662

SEQ ID NO: 587741 - RNA, 64 nt, hsa; identical to SEQ ID NO: 300663

SEQ ID NO: 587742 - RNA, 64 nt, hsa; identical to SEQ ID NO: 482054

SEQ ID NO: 587743 - RNA, 64 nt, hsa; identical to SEQ ID NO: 482055

SEQ ID NO: 587744 - RNA, 64 nt, hsa; identical to SEQ ID NO: 482056

SEQ ID NO: 587745 - RNA, 64 nt, hsa; identical to SEQ ID NO: 482057

SEQ ID NO: 587746 - RNA, 64 nt, hsa; identical to SEQ ID NO: 482058

SEQ ID NO: 587747 - RNA, 64 nt, hsa; identical to SEQ ID NO: 482059

SEQ ID NO: 587748 - RNA, 64 nt, hsa; identical to SEQ ID NO: 482060

SEQ ID NO: 587749 - RNA, 64 nt, hsa; identical to SEQ ID NO: 482061

SEQ ID NO: 587750 - RNA, 64 nt, hsa; identical to SEQ ID NO: 482062

SEQ ID NO: 587751 - RNA, 64 nt, hsa; identical to SEQ ID NO: 482063

SEQ ID NO: 587752 - RNA, 64 nt, hsa; identical to SEQ ID NO: 482064

SEQ ID NO: 587753 - RNA, 64 nt, hsa; identical to SEQ ID NO: 482065

SEQ ID NO: 587754 - RNA, 64 nt, hsa; identical to SEQ ID NO: 482066

SEQ ID NO: 587755 - RNA, 64 nt, hsa; identical to SEQ ID NO: 482067

SEQ ID NO: 587756 - RNA, 64 nt, hsa; identical to SEQ ID NO: 482068

SEQ ID NO: 587757 - RNA, 64 nt, hsa; identical to SEQ ID NO: 482069

SEQ ID NO: 587758 - RNA, 64 nt, hsa; identical to SEQ ID NO: 482070

SEQ ID NO: 587759 - RNA, 64 nt, hsa; identical to SEQ ID NO: 482071

SEQ ID NO: 587760 - RNA, 64 nt, hsa; identical to SEQ ID NO: 482072

SEQ ID NO: 587761 - RNA, 64 nt, hsa; identical to SEQ ID NO: 482073

SEQ ID NO: 587762 - RNA, 64 nt, hsa; identical to SEQ ID NO: 482074

SEQ ID NO: 587763 - RNA, 64 nt, hsa; identical to SEQ ID NO: 482075

SEQ ID NO: 587764 - RNA, 64 nt, hsa; identical to SEQ ID NO: 482076

SEQ ID NO: 587765 - RNA, 64 nt, hsa; identical to SEQ ID NO: 482077

SEQ ID NO: 587766 - RNA, 64 nt, hsa; identical to SEQ ID NO: 482078

SEQ ID NO: 587767 - RNA, 64 nt, hsa; identical to SEQ ID NO: 482079

SEQ ID NO: 587768 - RNA, 64 nt, hsa; identical to SEQ ID NO: 482080

SEQ ID NO: 587769 - RNA, 64 nt, hsa; identical to SEQ ID NO: 482081

SEQ ID NO: 587770 - RNA, 64 nt, hsa; identical to SEQ ID NO: 482082

SEQ ID NO: 587771 - RNA, 64 nt, hsa; identical to SEQ ID NO: 482083

SEQ ID NO: 587772 - RNA, 64 nt, hsa; identical to SEQ ID NO: 482084

SEQ ID NO: 587773 - RNA, 64 nt, hsa; identical to SEQ ID NO: 482085

SEQ ID NO: 587774 - RNA, 64 nt, hsa; identical to SEQ ID NO: 482086

SEQ ID NO: 587775 - RNA, 64 nt, hsa; identical to SEQ ID NO: 482087

SEQ ID NO: 587776 - RNA, 64 nt, hsa; identical to SEQ ID NO: 482088

SEQ ID NO: 587777 - RNA, 64 nt, hsa; identical to SEQ ID NO: 482089

SEQ ID NO: 587778 - RNA, 64 nt, hsa; identical to SEQ ID NO: 482090

SEQ ID NO: 587779 - RNA, 64 nt, hsa; identical to SEQ ID NO: 482091

SEQ ID NO: 587780 - RNA, 64 nt, hsa; identical to SEQ ID NO: 482092

SEQ ID NO: 587781 - RNA, 64 nt, hsa; identical to SEQ ID NO: 482093

SEQ ID NO: 587782 - RNA, 64 nt, hsa; identical to SEQ ID NO: 482094

SEQ ID NO: 587783 - RNA, 64 nt, hsa; identical to SEQ ID NO: 482095

SEQ ID NO: 587784 - RNA, 64 nt, hsa; identical to SEQ ID NO: 482096

SEQ ID NO: 587785 - RNA, 64 nt, hsa; identical to SEQ ID NO: 482097

SEQ ID NO: 587786 - RNA, 64 nt, hsa; identical to SEQ ID NO: 482098

SEQ ID NO: 587787 - RNA, 64 nt, hsa; identical to SEQ ID NO: 482099

SEQ ID NO: 587788 - RNA, 64 nt, hsa; identical to SEQ ID NO: 482100

SEQ ID NO: 587789 - RNA, 64 nt, hsa; identical to SEQ ID NO: 482101

SEQ ID NO: 587790 - RNA, 64 nt, hsa; identical to SEQ ID NO: 482102

SEQ ID NO: 587791 - RNA, 64 nt, hsa; identical to SEQ ID NO: 482103

SEQ ID NO: 587792 - RNA, 64 nt, hsa; identical to SEQ ID NO: 482104

SEQ ID NO: 587793 - RNA, 64 nt, hsa; identical to SEQ ID NO: 482105

SEQ ID NO: 587794 - RNA, 64 nt, hsa; identical to SEQ ID NO: 482106

SEQ ID NO: 587795 - RNA, 64 nt, hsa; identical to SEQ ID NO: 482107

SEQ ID NO: 587796 - RNA, 64 nt, hsa; identical to SEQ ID NO: 482108

SEQ ID NO: 587797 - RNA, 64 nt, hsa; identical to SEQ ID NO: 482109

SEQ ID NO: 587798 - RNA, 64 nt, hsa; identical to SEQ ID NO: 482110

SEQ ID NO: 587799 - RNA, 64 nt, hsa; identical to SEQ ID NO: 482111

SEQ ID NO: 587800 - RNA, 64 nt, hsa; identical to SEQ ID NO: 482112

SEQ ID NO: 587801 - RNA, 64 nt, hsa; identical to SEQ ID NO: 482113

SEQ ID NO: 587802 - RNA, 64 nt, hsa; identical to SEQ ID NO: 482114

SEQ ID NO: 587803 - RNA, 64 nt, hsa; identical to SEQ ID NO: 482115

SEQ ID NO: 587804 - RNA, 64 nt, hsa; identical to SEQ ID NO: 482116

SEQ ID NO: 587805 - RNA, 64 nt, hsa; identical to SEQ ID NO: 482117

SEQ ID NO: 587806 - RNA, 64 nt, hsa; identical to SEQ ID NO: 482118

SEQ ID NO: 587807 - RNA, 64 nt, hsa; identical to SEQ ID NO: 482119

SEQ ID NO: 587808 - RNA, 64 nt, hsa; identical to SEQ ID NO: 482120

SEQ ID NO: 587809 - RNA, 63 nt, hsa; identical to SEQ ID NO: 482121

SEQ ID NO: 587810 - RNA, 64 nt, hsa; identical to SEQ ID NO: 482122

SEQ ID NO: 587811 - RNA, 64 nt, hsa; identical to SEQ ID NO: 482123

SEQ ID NO: 587812 - RNA, 64 nt, hsa; identical to SEQ ID NO: 482124

SEQ ID NO: 587813 - RNA, 64 nt, hsa; identical to SEQ ID NO: 482125

SEQ ID NO: 587814 - RNA, 64 nt, hsa; identical to SEQ ID NO: 482126

SEQ ID NO: 587815 - RNA, 64 nt, hsa; identical to SEQ ID NO: 482127

SEQ ID NO: 587816 - RNA, 64 nt, hsa; identical to SEQ ID NO: 482128

SEQ ID NO: 587817 - RNA, 64 nt, hsa; identical to SEQ ID NO: 482129

SEQ ID NO: 587818 - RNA, 64 nt, hsa; identical to SEQ ID NO: 482130

SEQ ID NO: 587819 - RNA, 64 nt, hsa; identical to SEQ ID NO: 482131

SEQ ID NO: 587820 - RNA, 64 nt, hsa; identical to SEQ ID NO: 482132

SEQ ID NO: 587821 - RNA, 64 nt, hsa; identical to SEQ ID NO: 482133

SEQ ID NO: 587822 - RNA, 64 nt, hsa; identical to SEQ ID NO: 482134

SEQ ID NO: 587823 - RNA, 64 nt, hsa; identical to SEQ ID NO: 482135

SEQ ID NO: 587824 - RNA, 64 nt, hsa; identical to SEQ ID NO: 482136

SEQ ID NO: 587825 - RNA, 64 nt, hsa; identical to SEQ ID NO: 482137

SEQ ID NO: 587826 - RNA, 64 nt, hsa; identical to SEQ ID NO: 482138

SEQ ID NO: 587827 - RNA, 64 nt, hsa; identical to SEQ ID NO: 482139

SEQ ID NO: 587828 - RNA, 64 nt, hsa; identical to SEQ ID NO: 482140

SEQ ID NO: 587829 - RNA, 64 nt, hsa; identical to SEQ ID NO: 482141

SEQ ID NO: 587830 - RNA, 64 nt, hsa; identical to SEQ ID NO: 482142

SEQ ID NO: 587831 - RNA, 64 nt, hsa; identical to SEQ ID NO: 482143

SEQ ID NO: 587832 - RNA, 64 nt, hsa; identical to SEQ ID NO: 482144

SEQ ID NO: 587833 - RNA, 64 nt, hsa; identical to SEQ ID NO: 482145

SEQ ID NO: 587834 - RNA, 64 nt, hsa; identical to SEQ ID NO: 482146

SEQ ID NO: 587835 - RNA, 64 nt, hsa; identical to SEQ ID NO: 482147

SEQ ID NO: 587836 - RNA, 64 nt, hsa; identical to SEQ ID NO: 482148

SEQ ID NO: 587837 - RNA, 64 nt, hsa; identical to SEQ ID NO: 482149

SEQ ID NO: 587838 - RNA, 64 nt, hsa; identical to SEQ ID NO: 482150

SEQ ID NO: 587839 - RNA, 64 nt, hsa; identical to SEQ ID NO: 482151

SEQ ID NO: 587840 - RNA, 64 nt, hsa; identical to SEQ ID NO: 482152

SEQ ID NO: 587841 - RNA, 64 nt, hsa; identical to SEQ ID NO: 482153

SEQ ID NO: 587842 - RNA, 64 nt, hsa; identical to SEQ ID NO: 482154

SEQ ID NO: 587843 - RNA, 64 nt, hsa; identical to SEQ ID NO: 482155

SEQ ID NO: 587844 - RNA, 64 nt, hsa; identical to SEQ ID NO: 482156

SEQ ID NO: 587845 - RNA, 64 nt, hsa; identical to SEQ ID NO: 482157

SEQ ID NO: 587846 - RNA, 64 nt, hsa; identical to SEQ ID NO: 482158

SEQ ID NO: 587847 - RNA, 64 nt, hsa; identical to SEQ ID NO: 482159

SEQ ID NO: 587848 - RNA, 64 nt, hsa; identical to SEQ ID NO: 482160

SEQ ID NO: 587849 - RNA, 64 nt, hsa; identical to SEQ ID NO: 482161

SEQ ID NO: 587850 - RNA, 64 nt, hsa; identical to SEQ ID NO: 482162

SEQ ID NO: 587851 - RNA, 64 nt, hsa; identical to SEQ ID NO: 482163

SEQ ID NO: 587852 - RNA, 64 nt, hsa; identical to SEQ ID NO: 482164

SEQ ID NO: 587853 - RNA, 64 nt, hsa; identical to SEQ ID NO: 465416

SEQ ID NO: 587854 - RNA, 64 nt, hsa; identical to SEQ ID NO: 465417

SEQ ID NO: 587855 - RNA, 64 nt, hsa; identical to SEQ ID NO: 465418

SEQ ID NO: 587856 - RNA, 64 nt, hsa; identical to SEQ ID NO: 465419

SEQ ID NO: 587857 - RNA, 64 nt, hsa; identical to SEQ ID NO: 465420

SEQ ID NO: 587858 - RNA, 64 nt, hsa; identical to SEQ ID NO: 465421

SEQ ID NO: 587859 - RNA, 64 nt, hsa; identical to SEQ ID NO: 465422

SEQ ID NO: 587860 - RNA, 64 nt, hsa; identical to SEQ ID NO: 465423

SEQ ID NO: 587861 - RNA, 64 nt, hsa; identical to SEQ ID NO: 465424

SEQ ID NO: 587862 - RNA, 64 nt, hsa; identical to SEQ ID NO: 465425

SEQ ID NO: 587863 - RNA, 64 nt, hsa; identical to SEQ ID NO: 465426

SEQ ID NO: 587864 - RNA, 64 nt, hsa; identical to SEQ ID NO: 465427

SEQ ID NO: 587865 - RNA, 64 nt, hsa; identical to SEQ ID NO: 465428

SEQ ID NO: 587866 - RNA, 64 nt, hsa; identical to SEQ ID NO: 465429

SEQ ID NO: 587867 - RNA, 64 nt, hsa; identical to SEQ ID NO: 465430

SEQ ID NO: 587868 - RNA, 64 nt, hsa; identical to SEQ ID NO: 465431

SEQ ID NO: 587869 - RNA, 64 nt, hsa; identical to SEQ ID NO: 465432

SEQ ID NO: 587870 - RNA, 64 nt, hsa; identical to SEQ ID NO: 465433

SEQ ID NO: 587871 - RNA, 64 nt, hsa; identical to SEQ ID NO: 465434

SEQ ID NO: 587872 - RNA, 64 nt, hsa; identical to SEQ ID NO: 465435

SEQ ID NO: 587873 - RNA, 64 nt, hsa; identical to SEQ ID NO: 465436

SEQ ID NO: 587874 - RNA, 64 nt, hsa; identical to SEQ ID NO: 465437

SEQ ID NO: 587875 - RNA, 64 nt, hsa; identical to SEQ ID NO: 465438

SEQ ID NO: 587876 - RNA, 64 nt, hsa; identical to SEQ ID NO: 465439

SEQ ID NO: 587877 - RNA, 64 nt, hsa; identical to SEQ ID NO: 156063

SEQ ID NO: 587878 - RNA, 64 nt, hsa; identical to SEQ ID NO: 156064

SEQ ID NO: 587879 - RNA, 64 nt, hsa; identical to SEQ ID NO: 156065

SEQ ID NO: 587880 - RNA, 64 nt, hsa; identical to SEQ ID NO: 156066

SEQ ID NO: 587881 - RNA, 64 nt, hsa; identical to SEQ ID NO: 156067

SEQ ID NO: 587882 - RNA, 64 nt, hsa; identical to SEQ ID NO: 156068

SEQ ID NO: 587883 - RNA, 64 nt, hsa; identical to SEQ ID NO: 156069

SEQ ID NO: 587884 - RNA, 64 nt, hsa; identical to SEQ ID NO: 156070

SEQ ID NO: 587885 - RNA, 64 nt, hsa; identical to SEQ ID NO: 156071

SEQ ID NO: 587886 - RNA, 64 nt, hsa; identical to SEQ ID NO: 156072

SEQ ID NO: 587887 - RNA, 64 nt, hsa; identical to SEQ ID NO: 156073

SEQ ID NO: 587888 - RNA, 64 nt, hsa; identical to SEQ ID NO: 156074

SEQ ID NO: 587889 - RNA, 64 nt, hsa; identical to SEQ ID NO: 156075

SEQ ID NO: 587890 - RNA, 64 nt, hsa; identical to SEQ ID NO: 156076

SEQ ID NO: 587891 - RNA, 64 nt, hsa; identical to SEQ ID NO: 156077

SEQ ID NO: 587892 - RNA, 64 nt, hsa; identical to SEQ ID NO: 156078

SEQ ID NO: 587893 - RNA, 64 nt, hsa; identical to SEQ ID NO: 156079

SEQ ID NO: 587894 - RNA, 64 nt, hsa; identical to SEQ ID NO: 156080

SEQ ID NO: 587895 - RNA, 64 nt, hsa; identical to SEQ ID NO: 156081

SEQ ID NO: 587896 - RNA, 64 nt, hsa; identical to SEQ ID NO: 156082

SEQ ID NO: 587897 - RNA, 64 nt, hsa; identical to SEQ ID NO: 156083

SEQ ID NO: 587898 - RNA, 64 nt, hsa; identical to SEQ ID NO: 156084

SEQ ID NO: 587899 - RNA, 64 nt, hsa; identical to SEQ ID NO: 156085

SEQ ID NO: 587900 - RNA, 64 nt, hsa; identical to SEQ ID NO: 156086

SEQ ID NO: 587901 - RNA, 64 nt, hsa; identical to SEQ ID NO: 156087

SEQ ID NO: 587902 - RNA, 64 nt, hsa; identical to SEQ ID NO: 156088

SEQ ID NO: 587903 - RNA, 64 nt, hsa; identical to SEQ ID NO: 156089

SEQ ID NO: 587904 - RNA, 64 nt, hsa; identical to SEQ ID NO: 156090

SEQ ID NO: 587905 - RNA, 64 nt, hsa; identical to SEQ ID NO: 156091

SEQ ID NO: 587906 - RNA, 64 nt, hsa; identical to SEQ ID NO: 156092

SEQ ID NO: 587907 - RNA, 64 nt, hsa; identical to SEQ ID NO: 156093

SEQ ID NO: 587908 - RNA, 64 nt, hsa; identical to SEQ ID NO: 156094

SEQ ID NO: 587909 - RNA, 64 nt, hsa; identical to SEQ ID NO: 156095

SEQ ID NO: 587910 - RNA, 64 nt, hsa; identical to SEQ ID NO: 156096

SEQ ID NO: 587911 - RNA, 64 nt, hsa; identical to SEQ ID NO: 156097

SEQ ID NO: 587912 - RNA, 64 nt, hsa; identical to SEQ ID NO: 156098

SEQ ID NO: 587913 - RNA, 64 nt, hsa; identical to SEQ ID NO: 156099

SEQ ID NO: 587914 - RNA, 64 nt, hsa; identical to SEQ ID NO: 156100

SEQ ID NO: 587915 - RNA, 64 nt, hsa; identical to SEQ ID NO: 156101

SEQ ID NO: 587916 - RNA, 64 nt, hsa; identical to SEQ ID NO: 156102

SEQ ID NO: 587917 - RNA, 64 nt, hsa; identical to SEQ ID NO: 156103

SEQ ID NO: 587918 - RNA, 64 nt, hsa; identical to SEQ ID NO: 156104

SEQ ID NO: 587919 - RNA, 64 nt, hsa; identical to SEQ ID NO: 156105

SEQ ID NO: 587920 - RNA, 64 nt, hsa; identical to SEQ ID NO: 156106

SEQ ID NO: 587921 - RNA, 64 nt, hsa; identical to SEQ ID NO: 156107

SEQ ID NO: 587922 - RNA, 64 nt, hsa; identical to SEQ ID NO: 156108

SEQ ID NO: 587923 - RNA, 64 nt, hsa; identical to SEQ ID NO: 156109

SEQ ID NO: 587924 - RNA, 64 nt, hsa; identical to SEQ ID NO: 156110

SEQ ID NO: 587925 - RNA, 64 nt, hsa; identical to SEQ ID NO: 156111

SEQ ID NO: 587926 - RNA, 64 nt, hsa
auauauguugguaggauguuauuagagagauaugugugcauauauauuuuuuugcaccugaauc

SEQ ID NO: 587927 - RNA, 64 nt, hsa
auuaagauuucuuuuuauaaguauucauuuugaaugugcauauaguuauuugaccccuuccaaa

SEQ ID NO: 587928 - RNA, 64 nt, hsa
cccauagaauaaaauucucucuaguuuacuugugugugcauacaucucauccacaggggaagau

SEQ ID NO: 587929 - RNA, 64 nt, hsa
uagagagacauaauuagagaugcaugcuuuguucugugcauagagaccuuuaagcaaacuacua

SEQ ID NO: 587930 - RNA, 64 nt, hsa
cgcucucugaagcagaaaagggacuggaaccaauugugcauaucagcugacuuuuuguuuguuu

SEQ ID NO: 587931 - RNA, 64 nt, hsa
uacauggugugaugcugcauuauauauaaaacugugugcauauauuaaauuuugucucuugauu

SEQ ID NO: 587932 - RNA, 64 nt, hsa
uuuguaaaaauaacuguagcuuauauucuuuauuugugcauaccaaugugaaaauccacucuuu

SEQ ID NO: 587933 - RNA, 64 nt, hsa
aaauuuaguccugugcauacugugguguuuuuacugugcauauuugaauuuuucaugcaguuuu

SEQ ID NO: 587934 - RNA, 64 nt, hsa
cagcauuccaugcacuugcuuuaaaauuuaguccugugcauacugugguguuuuuacugugcau

SEQ ID NO: 587935 - RNA, 64 nt, hsa
aauucaggacacauacauuuauagagugugaggcugugcauacguacauucaucccuuaauguu

SEQ ID NO: 587936 - RNA, 64 nt, hsa
uuauucauucuuuuuaagguuauuuuuuauuaacugugcauaugaaauuuccacucaauuuaaa

SEQ ID NO: 587937 - RNA, 64 nt, hsa
ugggugagcauaccugucucagcuguuuggccaaugugcauaaccuacucggauccccaccuga

SEQ ID NO: 587938 - RNA, 64 nt, hsa
uuguuaaacccuucugucuacuggccucccuuugugugcauacgccucuuguucaugucagcuu

SEQ ID NO: 587939 - RNA, 64 nt, hsa
ugauuacaguguguuuuggagcuggcucuguuugugugcauaugauaaugcagaguugagccag

SEQ ID NO: 587940 - RNA, 64 nt, hsa
cuuuuuaaaaauauauauaucuaaaugaaugcaaugugcauaaauauuuuuuaaacauaacagu

SEQ ID NO: 587941 - RNA, 64 nt, hsa
uuugagccugauguuuacagugucugugugugugugugcauaugugugugugugcauaugcaug

SEQ ID NO: 587942 - RNA, 64 nt, hsa
acagugucugugugugugugugcauaugugugugugugcauaugcaugugugugugugugugug

SEQ ID NO: 587943 - RNA, 64 nt, hsa
aagacuuaaaaauuguguuuacagaugguuuauuugugcauauuuuuacuacugcuuuuccuaa

SEQ ID NO: 587944 - RNA, 64 nt, hsa
gguaaagaugaagcaauaauuuuuaaauuguguaugugcauaugaagcacagacaugcaugugu

SEQ ID NO: 587945 - RNA, 64 nt, hsa
uuccuuuuagccaucuuuuguucuuguaaucccaacuagauaggcuuuaugcucacaucauugu

SEQ ID NO: 587946 - RNA, 64 nt, hsa
gacuaaauuccagugagaguaugaaugaagaacaacuagauauuaaugucaaucauuuaagauu

SEQ ID NO: 587947 - RNA, 64 nt, hsa
aucaaagaucuugaaauaguaauaguaugaaaauacuagauaaaauuaauguuuaaaauguuuu

SEQ ID NO: 587948 - RNA, 64 nt, hsa
uaagcuuuguaagcuaagcaauaguuuauguccuacuagauacacugcaaacuacaguggggau

SEQ ID NO: 587949 - RNA, 64 nt, hsa
aauacacaacccccuucccaccauccuucaugucacuagauacacaacccccuucccaccaucc

SEQ ID NO: 587950 - RNA, 64 nt, hsa
auuggucugauauaugcugcucuugguucuauaaacuagauaaaagcagugcuuugugaaaugc

SEQ ID NO: 587951 - RNA, 64 nt, hsa; identical to SEQ ID NO: 421834

SEQ ID NO: 587952 - RNA, 64 nt, hsa; identical to SEQ ID NO: 421835

SEQ ID NO: 587953 - RNA, 64 nt, hsa; identical to SEQ ID NO: 421836

SEQ ID NO: 587954 - RNA, 64 nt, hsa; identical to SEQ ID NO: 421837

SEQ ID NO: 587955 - RNA, 64 nt, hsa; identical to SEQ ID NO: 421838

SEQ ID NO: 587956 - RNA, 64 nt, hsa; identical to SEQ ID NO: 421839

SEQ ID NO: 587957 - RNA, 64 nt, hsa; identical to SEQ ID NO: 421840

SEQ ID NO: 587958 - RNA, 64 nt, hsa; identical to SEQ ID NO: 421841

SEQ ID NO: 587959 - RNA, 64 nt, hsa; identical to SEQ ID NO: 421842

SEQ ID NO: 587960 - RNA, 64 nt, hsa; identical to SEQ ID NO: 421843

SEQ ID NO: 587961 - RNA, 64 nt, hsa; identical to SEQ ID NO: 421844

SEQ ID NO: 587962 - RNA, 64 nt, hsa; identical to SEQ ID NO: 421845

SEQ ID NO: 587963 - RNA, 64 nt, hsa; identical to SEQ ID NO: 421846

SEQ ID NO: 587964 - RNA, 64 nt, hsa; identical to SEQ ID NO: 421847

SEQ ID NO: 587965 - RNA, 64 nt, hsa; identical to SEQ ID NO: 421848

SEQ ID NO: 587966 - RNA, 64 nt, hsa; identical to SEQ ID NO: 421849

SEQ ID NO: 587967 - RNA, 64 nt, hsa; identical to SEQ ID NO: 421850

SEQ ID NO: 587968 - RNA, 64 nt, hsa; identical to SEQ ID NO: 421851

SEQ ID NO: 587969 - RNA, 64 nt, hsa; identical to SEQ ID NO: 421852

SEQ ID NO: 587970 - RNA, 64 nt, hsa; identical to SEQ ID NO: 421853

SEQ ID NO: 587971 - RNA, 64 nt, hsa; identical to SEQ ID NO: 421854

SEQ ID NO: 587972 - RNA, 64 nt, hsa; identical to SEQ ID NO: 421855

SEQ ID NO: 587973 - RNA, 63 nt, hsa; identical to SEQ ID NO: 421856

SEQ ID NO: 587974 - RNA, 64 nt, hsa; identical to SEQ ID NO: 421857

SEQ ID NO: 587975 - RNA, 64 nt, hsa; identical to SEQ ID NO: 421858

SEQ ID NO: 587976 - RNA, 64 nt, hsa; identical to SEQ ID NO: 421859

SEQ ID NO: 587977 - RNA, 64 nt, hsa; identical to SEQ ID NO: 421860

SEQ ID NO: 587978 - RNA, 64 nt, hsa; identical to SEQ ID NO: 421861

SEQ ID NO: 587979 - RNA, 64 nt, hsa; identical to SEQ ID NO: 421862

SEQ ID NO: 587980 - RNA, 64 nt, hsa; identical to SEQ ID NO: 421863

SEQ ID NO: 587981 - RNA, 64 nt, hsa; identical to SEQ ID NO: 421864

SEQ ID NO: 587982 - RNA, 64 nt, hsa; identical to SEQ ID NO: 421865

SEQ ID NO: 587983 - RNA, 64 nt, hsa; identical to SEQ ID NO: 421866

SEQ ID NO: 587984 - RNA, 64 nt, hsa; identical to SEQ ID NO: 421867

SEQ ID NO: 587985 - RNA, 64 nt, hsa; identical to SEQ ID NO: 421868

SEQ ID NO: 587986 - RNA, 64 nt, hsa; identical to SEQ ID NO: 421869

SEQ ID NO: 587987 - RNA, 64 nt, hsa; identical to SEQ ID NO: 421870

SEQ ID NO: 587988 - RNA, 64 nt, hsa; identical to SEQ ID NO: 421871

SEQ ID NO: 587989 - RNA, 64 nt, hsa; identical to SEQ ID NO: 421872

SEQ ID NO: 587990 - RNA, 64 nt, hsa; identical to SEQ ID NO: 421873

SEQ ID NO: 587991 - RNA, 64 nt, hsa
cccagcucguuguuaaacgugcugacggcaaggggcaauggagugaguuucccaacuaagaaac

SEQ ID NO: 587992 - RNA, 64 nt, hsa
uggaggacugcaggaggagggcaggguugggugggcaauggaaggagggaggagagaaaugaau

SEQ ID NO: 587993 - RNA, 64 nt, hsa
acaccuaaggucugccagccaggcuccuggcugggcaauggaagaugguguggcccuguuaguc

SEQ ID NO: 587994 - RNA, 64 nt, hsa
aauguuaguauuucugcuuugaauccuugauauugcaauggaauuccuacuuuauuaaauguau

SEQ ID NO: 587995 - RNA, 64 nt, hsa
ggacacucacuuuuucagagacucaacagucucugcaauggaguguggguccaccuuagccucu

SEQ ID NO: 587996 - RNA, 64 nt, hsa
caaaagcccucaagucacaaaguaaaugguucaagcaauggaguacugggucacagggauuccu

SEQ ID NO: 587997 - RNA, 64 nt, hsa
acaagaagcaccagggaaaguuuagagauuugcggcaauggaccgaagaacgggccaggaaguc

SEQ ID NO: 587998 - RNA, 64 nt, hsa
acuuuuaguuccuaaaaagaaacauauuucaaaagcaauggaaucuagaauucuuauaacauga

SEQ ID NO: 587999 - RNA, 64 nt, hsa
ccgaguggaaauguggaacuugaugccacccccugcaauggagagacugauuuaggagcauugu

SEQ ID NO: 588000 - RNA, 64 nt, hsa
ugugagaaaacagccccaucaggcuuguguuaaggcaauggacugaaugagugcgugcugggug

SEQ ID NO: 588001 - RNA, 64 nt, hsa
uuggacagcucucccagacaggagccaggguugagcaauggagagcccagcccccacgucuuac

SEQ ID NO: 588002 - RNA, 64 nt, hsa
uugauuccuuaucuuugcuauugugaacagugcugcaauggacauacacgugcaugugccuuua

SEQ ID NO: 588003 - RNA, 64 nt, hsa
gauguagcagaagagaucauuucuggaggcuucagcaauggaauuuagcauuauaagagagauu

SEQ ID NO: 588004 - RNA, 64 nt, hsa
ggacuagggguccuuugugaaagagcaagauggagcaauggagagaagaccucuuccugaauca

SEQ ID NO: 588005 - RNA, 64 nt, hsa
acucaagucuauuacuuguagaguccaauucuuagcaauggaaucgcucuaggauucuaguuug

SEQ ID NO: 588006 - RNA, 64 nt, hsa
guaccuuagguucuuucugaaaaggagguaucuagcaauggauaaauagauaccacugaaugaa

SEQ ID NO: 588007 - RNA, 64 nt, hsa
ggugagcccacucuucacccgucaggcccuggccgcaauggacaagccuccugcucacuccacc

SEQ ID NO: 588008 - RNA, 64 nt, hsa
caugaauucaccgcaacacaugcagacaacugcugcaauggagaguaugaagaaaccuggucuu

SEQ ID NO: 588009 - RNA, 64 nt, hsa
ugauacugguuuuuguuaaacauuggaaguucaggcaauggaauaaauguaggaacauacagaa

SEQ ID NO: 588010 - RNA, 64 nt, hsa
ucgcaucucagcggggcgcacauguuauccacaagcaauggaccuuuggggaagggggaguuuu

SEQ ID NO: 588011 - RNA, 64 nt, hsa
gaguccccucccucaucccuuaggguccagaagagcaauggaggaagugacagcuaauguugca

SEQ ID NO: 588012 - RNA, 64 nt, hsa
gauucccuacuaaugagaggcagggagagcaugggcaauggagacccaccaaugauccccaacc

SEQ ID NO: 588013 - RNA, 64 nt, hsa
agcgacccucccugcagggcugggcuuuugcauggcaauggaugggacauuaaagggacaugua

SEQ ID NO: 588014 - RNA, 64 nt, hsa
aacgccaaaaaaagaugaaagucuuguauccaaagcaauggaguacauguuuggcugguaguag

SEQ ID NO: 588015 - RNA, 64 nt, hsa
gacccucacacuccuuuucucuuaacagcaaaaugcaauggaaggaagaaaaguuccaacaaag

SEQ ID NO: 588016 - RNA, 64 nt, hsa
aaagaagcuacaggaggaacuuucugacuuaucagcaauggaagaugcuuuggaugaguuaauu

SEQ ID NO: 588017 - RNA, 64 nt, hsa
cuucagcagaauauuaagaaauaaagcaugaucugcaauggaaagguuuuuuuggcacuaacuu

SEQ ID NO: 588018 - RNA, 64 nt, hsa
auuugucaagaugggauuuggaagacaagugaaugcaauggaagauuuugaucaaaaauguaau

SEQ ID NO: 588019 - RNA, 64 nt, hsa
gaaaacccacugccuagaggccaucuuaaaggaagcaauggauggaucccuuucaucccaacug

SEQ ID NO: 588020 - RNA, 64 nt, hsa
auuugugccucuuggauccaagcaggccuugaaugcaauggaagugguuuauagucccuugcuc

SEQ ID NO: 588021 - RNA, 64 nt, hsa
gaggccuaguuuaaaucacaauuccgaaucuggggcaauggaaucacugcuuccagcuggggca

SEQ ID NO: 588022 - RNA, 64 nt, hsa
gauguagaagcagccagucacagacccauucuaugcaauggacauuuauuugaaaaaaauucuc

SEQ ID NO: 588023 - RNA, 64 nt, hsa
uuucucuguagcacauguuaccuuucuuugugaggcaauggaguggucuaggauugagcaaaaa

SEQ ID NO: 588024 - RNA, 64 nt, hsa
ccugcacauucccucaugcucccacacaaguccagcaauggaaaugcuuggguuccucuugcuu

SEQ ID NO: 588025 - RNA, 64 nt, hsa
gguuuuuaccacuguacuccaaccccguuuuuaagcaauggaacucuuucuucaaacaaaagcu

SEQ ID NO: 588026 - RNA, 64 nt, hsa
ugacacaaaagcaaguuugauuuuugcagcacuagcaauggacuuuguuguuuuucuuuuugau

SEQ ID NO: 588027 - RNA, 64 nt, hsa
aaaucccaugggguggggguauccuggucggucggcaauggaggguggcuggcuuggugguuau

SEQ ID NO: 588028 - RNA, 64 nt, hsa
cucagcacaggugucagggugcaaggaagaccuggcaauggacagcaggaggcagguuccugga

SEQ ID NO: 588029 - RNA, 64 nt, hsa
ugugaguaaacccuacuggacagugacauaaaaggcaauggaauuuucuauaaacauuuucuca

SEQ ID NO: 588030 - RNA, 64 nt, hsa
acagcccuuucgguuaugaagucccugcuugaaggcaauggaccuggggaagagacuaucacaa

SEQ ID NO: 588031 - RNA, 64 nt, hsa
aaaugccaaaauuguccaucugccucugaguagggcaauggaaauaccaaaccuucugacuuug

SEQ ID NO: 588032 - RNA, 64 nt, hsa
ugcucacaacuuaguguaauauaccagcuuguaugcaauggauuuucaaccagauaacauaccu

SEQ ID NO: 588033 - RNA, 64 nt, hsa
cuuccauuuugaaaaguagagguugcuuaagcaagcaauggauaauaagagacuuuuccugagg

SEQ ID NO: 588034 - RNA, 64 nt, hsa
ccaaaacguugauuugcauaauacagugguaugugcaauggauaaauugccguuauuucaaaaa

SEQ ID NO: 588035 - RNA, 64 nt, hsa
uuuuuuuuugcccaagaggcaucucaguacuccagcaauggaggaagaauagagaauuuugccu

SEQ ID NO: 588036 - RNA, 64 nt, hsa
cugaugaaugggaaauaaaauguggucuguccacgcaauggaacauuauuagacucuaaaaaga

SEQ ID NO: 588037 - RNA, 64 nt, hsa
caaauuuaaagacugcuccagauagccugcauuugcaauggaauaacugacaaaucacaagugg

SEQ ID NO: 588038 - RNA, 64 nt, hsa
ccuggguggccagacucugugcucacaauccagagcaauggauccuccaacaccaccaggugga

SEQ ID NO: 588039 - RNA, 64 nt, hsa
acacuaccacugcuuuuugaagaauuaucauaaggcaauggagaauaaaagaaagaccaugauu

SEQ ID NO: 588040 - RNA, 64 nt, hsa
gugaauugugaaauuacuuucagugguuuaagaagcaauggagaaaaugauaauacagcauaau

SEQ ID NO: 588041 - RNA, 64 nt, hsa
uauuccuauucuuauuucuucauuuuaagucauugcaauggaaaguaauauuauaaaaugguaa

SEQ ID NO: 588042 - RNA, 64 nt, hsa
auauuauagaagagaauauacacaacucagagaugcaauggauaauauaaaaagaguaccugag

SEQ ID NO: 588043 - RNA, 64 nt, hsa
agacgugggaucagaaucuuccaacuuuagaggugcaauggaagacacuacgcuacuugguuga

SEQ ID NO: 588044 - RNA, 64 nt, hsa
acuucacaggagauugauggcauugaggaagauugcaauggagaucaugacacuacuguuaaua

SEQ ID NO: 588045 - RNA, 64 nt, hsa
cuuuccauauaacacuuaucuucuucuuaauucggcaauggaauaucuuuuaaguuuuaaaaaa

SEQ ID NO: 588046 - RNA, 64 nt, hsa
uuugacuuuaauuuauguaacuugaaccuaugaagcaauggauauuuguacuguuuaauguucu

SEQ ID NO: 588047 - RNA, 64 nt, hsa
uagcuuuuggauagaaauuuugaguggaucaacagcaauggaaugaggagugaggcuuuuuauu

SEQ ID NO: 588048 - RNA, 64 nt, hsa
uuacauuuauuuucuucagccugugcaaaacaaagcaauggaaaaggaaacuaaaaaauauaca

SEQ ID NO: 588049 - RNA, 64 nt, hsa
accguaaacuauggacucuaguucaguuuuauaugcaauggaucacuauuuuauuuaauuuuuu

SEQ ID NO: 588050 - RNA, 64 nt, hsa
cuggcuuuuguaguuuugauaaagaccauugcaggcaauggaauugugccagagaaaucugauu

SEQ ID NO: 588051 - RNA, 64 nt, hsa
uuaaugugccuaagaaauuuucucugaggcuuuagcaauggaaauuugauugcccauuguauaa

SEQ ID NO: 588052 - RNA, 64 nt, hsa
cucuuuuuuccaucccuuuuuaauuuuuuuaacagcaauggaggaaguuaacaauuuuuaaugg

SEQ ID NO: 588053 - RNA, 64 nt, hsa
gggggcuccugccugagguccucagaaucccacugcaauggacccaggcagcgccccaggaagc

SEQ ID NO: 588054 - RNA, 64 nt, hsa
uuggcauuauuugcugaggguaggaaaguccuaggcaauggaguccagauuuuaguaagucaga

SEQ ID NO: 588055 - RNA, 64 nt, hsa
uucauuuaauuucugcagauaaauaguuuccugagcaauggaugcuaugccuggauaccagucu

SEQ ID NO: 588056 - RNA, 64 nt, hsa
aguagggcacugaguacccuaggaagaagucagagcaauggauacaaaugaccuugcucuugga

SEQ ID NO: 588057 - RNA, 64 nt, hsa
ccugacggacaaguggaggccucuugcugcggcugcaauggaggcaaggggcugcagagcccag

SEQ ID NO: 588058 - RNA, 64 nt, hsa
ugcaaggaagcagucucuuuggucaguaacaagugcaauggaaagaaaacgaucccuuccuucu

SEQ ID NO: 588059 - RNA, 64 nt, hsa
acuauaaacauauauuguguaaagaaaaaguucagcaauggaacuaguuucugcagaucaagca

SEQ ID NO: 588060 - RNA, 64 nt, hsa
aaagcagcucagaaguauuguugcucaugguguggcaauggacugaacuguaaugaaaauguua

SEQ ID NO: 588061 - RNA, 64 nt, hsa
uaagccauuugaauuuuuaaaaaauuucauacaugcaauggaauauagauauguauauacacau

SEQ ID NO: 588062 - RNA, 64 nt, hsa
ugauguguuuugaccuuugcaggcgaguaaccaggcaauggaguggagugucuccuggagagag

SEQ ID NO: 588063 - RNA, 64 nt, hsa
ggauugaagugcagaauuuggcauaucgaugcaugcaauggaaagaaaaaaaauuuguuaaaau

SEQ ID NO: 588064 - RNA, 64 nt, hsa
cauuuggauucuuaaccuugaauccaaagugucugcaauggacaacaauugaaggaguggcaaa

SEQ ID NO: 588065 - RNA, 64 nt, hsa
gccccagcuauugcaccacugcucuccaagcugggcaauggagucagauucucuuucuuaaaaa

SEQ ID NO: 588066 - RNA, 64 nt, hsa
uccuuaaaauaucagcacaaguugggggaggcaggcaauggaauauaauggaauauucuugaga

SEQ ID NO: 588067 - RNA, 64 nt, hsa
uugucuggauguggugccugguaaccaucuuucagcaauggauuauaguuuaaucauggccuga

SEQ ID NO: 588068 - RNA, 64 nt, hsa
guggauuuuaagcugcuauuauuguauuucaguggcaauggacacauuagccuuuuacaagagg

SEQ ID NO: 588069 - RNA, 64 nt, hsa
accugcugucugcuuagaagaacggcuuucugcugcaauggagagaaaucauaacagacggugg

SEQ ID NO: 588070 - RNA, 64 nt, hsa
aguaccauucagaauaggaucugaagagaucaaagcaauggagaccaccaaacugucuugaagg

SEQ ID NO: 588071 - RNA, 64 nt, hsa
cugcggggugguagaaaagguagaguaggcuguggcaauggaauaaaacacgauuaaaaacguu

SEQ ID NO: 588072 - RNA, 64 nt, hsa
gaucuucgaugaaccugacaaaaacaagcaaugggcaauggauucucuauucaauaaaucgugc

SEQ ID NO: 588073 - RNA, 64 nt, hsa
ugacauuuauuauaccaauuaagcuuggaauggggcaauggaugcauuucccaaaacgugugaa

SEQ ID NO: 588074 - RNA, 64 nt, hsa
cccuuaagguauaguguguguugcaaaucacucugcaauggaaacuuuuauauucaggguaggu

SEQ ID NO: 588075 - RNA, 64 nt, hsa
auucucugauagaauucuggucaucagauguacugcaauggaacaaaacucaucuggcugcauc

SEQ ID NO: 588076 - RNA, 64 nt, hsa
guggaaauucaccuagagugaguacuuuccuugugcaauggagggagacgaucuagcuauagau

SEQ ID NO: 588077 - RNA, 64 nt, hsa
aacagaaggacccauggcaguauaaagcaaugaagcaauggaguauuaucucacaaauauaaaa

SEQ ID NO: 588078 - RNA, 64 nt, hsa
agaaauucagaaacguaauucuuacauugugauugcaauggauacucauggaagaaagugggua

SEQ ID NO: 588079 - RNA, 64 nt, hsa
uguuguuaguuucuggggaaagaauaguaaccaugcaauggaaaaaaauggacaaccucuugac

SEQ ID NO: 588080 - RNA, 64 nt, hsa
acucccugaaaccucuuucuaugucccagcugaagcaauggaaacauuuuucuggagaucauuu

SEQ ID NO: 588081 - RNA, 64 nt, hsa
ugucugcacacaccagaaauggacauuuucauaugcaauggaaaacagccacaaaaaaaccuac

SEQ ID NO: 588082 - RNA, 64 nt, hsa
auguagcaguugaugauuuucuaucuuaauaaaugcaauggaaguguuacuauaguagauuccu

SEQ ID NO: 588083 - RNA, 64 nt, hsa
cacaugcacuguggcuuaaauaccauaccuacuagcaauggagguucagucaggcucucuucua

SEQ ID NO: 588084 - RNA, 64 nt, hsa
ccaucccuucugaaaguaggaaguuggagcucuugcaauggaauucaagaacagacucuggagu

SEQ ID NO: 588085 - RNA, 64 nt, hsa
gcuuuaaaaauugugaauuauuugaauauucaaagcaauggagaaacaaguuauauaugcugac

SEQ ID NO: 588086 - RNA, 64 nt, hsa
guguuuauugguggcagugacaccaaagauagaggcaauggauagaaauuuuuaaacuggaaag

SEQ ID NO: 588087 - RNA, 64 nt, hsa
uuuaacuagcuuuaaguuuaaagauggaagcuaagcaauggaaaugcuauacguuuuugacauu

SEQ ID NO: 588088 - RNA, 64 nt, hsa
ucuuucccucccaucucugccaucugucugucuggcaauggaaggagcuucagcaggagguccu

SEQ ID NO: 588089 - RNA, 64 nt, hsa
ugaucucugcccagccccuuccuuuccaaaccaugcaauggaagagcccagaugggugaagauu

SEQ ID NO: 588090 - RNA, 64 nt, hsa
auaccucuuucuucuucgcuuccuccucucccaagcaauggaaacuuuuacccauguaauucua

SEQ ID NO: 588091 - RNA, 64 nt, hsa
cuaagugauuccuccagggugggaagcacggggagcaauggaaucagauggcucauucucuccu

SEQ ID NO: 588092 - RNA, 64 nt, hsa
cuccauccagcucuaucuuuguguuuacaucauggcaauggaaacacaauuuaaguauuaauac

SEQ ID NO: 588093 - RNA, 64 nt, hsa
ccccaaaauugaaucuguacauccacaaaaauaugcaauggauguagaaaauaaaauucaagaa

SEQ ID NO: 588094 - RNA, 64 nt, hsa
ucaaagugaagaaaauguaacagaagccagugaagcaauggaagcuggagugugacuggaaaaa

SEQ ID NO: 588095 - RNA, 64 nt, hsa
aacacagccuggauugagaauuuuuauaagauuggcaauggaaaaacauuuauucuuuuaaaua

SEQ ID NO: 588096 - RNA, 64 nt, hsa
gggaaugagcuuccauuaugcugcagagcuggcagcaauggaugaaaguugcaggaaguuaguu

SEQ ID NO: 588097 - RNA, 64 nt, hsa
ccaggccagagcaaacagaaaaagaagguugagggcaauggacaaggaaggaauaaagggagaa

SEQ ID NO: 588098 - RNA, 64 nt, hsa
ggagcaaggccaccagguccagagaaccuggcaugcaauggacauggaagcugaaaauuacuug

SEQ ID NO: 588099 - RNA, 64 nt, hsa
uuuuggaauuuccuucgugauguucgagagcucagcaauggaccccucacagagcuccucuauc

SEQ ID NO: 588100 - RNA, 64 nt, hsa
ggcagcaaucccaauaaauucugacauguccuuggcaauggaagccuggguuggagauccugag

SEQ ID NO: 588101 - RNA, 64 nt, hsa
aacauauagugaauuucuaauucuaauguucagugcaauggaagacauuuauuuggacaguaau

SEQ ID NO: 588102 - RNA, 64 nt, hsa
uuuuguauuucagagaaaauucagguaccaggaugcaauggauuuauuugauucaggggaccug

SEQ ID NO: 588103 - RNA, 64 nt, hsa
ccggcgaaacuagcaaccagggcgggccaguugggcaauggagcugcuggagcccgguacccac

SEQ ID NO: 588104 - RNA, 58 nt, hsa
uaccagagaguauuguguagugcucucugcaauggaacaugugauuucaggguugccg

SEQ ID NO: 588105 - RNA, 64 nt, hsa
uugaugggucaugggccaugccauacccccuguggcaauggaguguguggaugcucaccugugc

SEQ ID NO: 588106 - RNA, 64 nt, hsa
cagaacuaagucugaaccgccaagaugcuaaauugcaauggaagcuuaacuuuaguuuauuucu

SEQ ID NO: 588107 - RNA, 64 nt, hsa
aaagaaacauuuucucugaaauauauuauuaagggcaauggagauaaauuaauaguagaugugg

SEQ ID NO: 588108 - RNA, 64 nt, hsa
auugugugcuggucuaagcaagcugagaucauuugcaauggaaaacacguaacuuguuuaaaag

SEQ ID NO: 588109 - RNA, 64 nt, hsa
cuauaaaaagaaaaaaauggaaaaaaauuacaaggcaauggaaacuauuauaaggccauuuccu

SEQ ID NO: 588110 - RNA, 64 nt, hsa
uggauacuggaaaauguauagcuuuuugauuagggcaauggagugcauaaauuagaaacuucua

SEQ ID NO: 588111 - RNA, 64 nt, hsa
ccccagugcuaaaagauaccaggcaucuaguuuagcaauggagggaaacagaaacagccuguag

SEQ ID NO: 588112 - RNA, 50 nt, hsa
augaagguaauccggagugagcaauggaguggcugccauggaaggaagaa

SEQ ID NO: 588113 - RNA, 64 nt, hsa
auuacccacccaaggcuucuagaaggagcuuccugcaauggaaggaaggagaagcucugaagcc

SEQ ID NO: 588114 - RNA, 64 nt, hsa
ucgucuuuugcuaccuuugucuuuuggagggaaagcaauggaugggauauguuaaaagaaacau

SEQ ID NO: 588115 - RNA, 64 nt, hsa
gcaccggucagagcccugagugccucaggguuuggcaauggaauuuuuaauguaauaaaucuuu

SEQ ID NO: 588116 - RNA, 64 nt, hsa
ggaggaggaggagucaggugaggaggcugcagaagcaauggagugaaccucugcuccccacaca

SEQ ID NO: 588117 - RNA, 64 nt, hsa
acuuguguuacuaauuuguauaacccauaucugugcaauggaauauaaauaucacaaaguuguu

SEQ ID NO: 588118 - RNA, 64 nt, hsa
ccuauugacuccuacaguucuuucccuucucuuggcaauggaagcuccaguacccagauuggag

SEQ ID NO: 588119 - RNA, 64 nt, hsa
agauguguguagggccacaagaaugagaaagggggcaauggagugacaggugaccugcucaggu

SEQ ID NO: 588120 - RNA, 64 nt, hsa
ugaaucugagguaucaaacacacacaggauaccagcaauggauggcaggggagaguguuccuuu

SEQ ID NO: 588121 - RNA, 64 nt, hsa
gugucugagaaacaaaucuuuguucucuuaggcugcaauggaacaacuuuaccaggguuuuggc

SEQ ID NO: 588122 - RNA, 64 nt, hsa
auguaaacuggauugagaaauucucagugauucugcaauggauuuuuuuuuaaugcagaaguaa

SEQ ID NO: 588123 - RNA, 64 nt, hsa
agaacauuuaguucguuuugaaaggcugcgacgagcaauggaacuucgaagguaggaagagagu

SEQ ID NO: 588124 - RNA, 64 nt, hsa
guacuuugcucauacgagcuuucauguucagcaugcaauggaaucaugcuuguccaugugaaau

SEQ ID NO: 588125 - RNA, 64 nt, hsa
uucgagcuggcaguucuguucacguccauugccggcaauggaugucuuuguggugaugauccuu

SEQ ID NO: 588126 - RNA, 63 nt, hsa
auuguaacaggcaaaacuagaugguggaagacagcaauggagaccuguccucauggcugugac

SEQ ID NO: 588127 - RNA, 50 nt, hsa
acaagaaaaaggccaccuaggcaauggaagcccucaaagaagucggaaug

SEQ ID NO: 588128 - RNA, 64 nt, hsa
aacuauuauaaugcaaauacuuuuuaacuuagaggcaauggaaaaauaaaaguugacuguacua

SEQ ID NO: 588129 - RNA, 64 nt, hsa
aaagauuugcauuuuauuaugucugucuuaucaugcaauggaaaugaugcuuuuuguaaguaug

SEQ ID NO: 588130 - RNA, 64 nt, hsa
gggugccacagccuuuugggaugggggugagcgugcaauggaggcuggggguggcgaggugccg

SEQ ID NO: 588131 - RNA, 64 nt, hsa
ugcagggccagaccugccugcauucugagacaaagcaauggacgguccgcagaagcagaccuca

SEQ ID NO: 588132 - RNA, 64 nt, hsa
auuuaguuagugauaagauguucaucccagcauugcaauggagaaaaaugggaagcaaugguuu

SEQ ID NO: 588133 - RNA, 64 nt, hsa
ugcaggcccaaggcguugguaagggggcagcugagcaauggaacgcguuucccccucucauuau

SEQ ID NO: 588134 - RNA, 64 nt, hsa
uuaacauuuggggccugauaggggaaauggugaagcaauggaaaagaacagacaacuaaugauu

SEQ ID NO: 588135 - RNA, 64 nt, hsa
cacaucuuguuuucauaaacacuagagaggaacagcaauggauaaaaaaacagaugguagggag

SEQ ID NO: 588136 - RNA, 64 nt, hsa
aauugaggcagggaauagaccucacuagcccuuugcaauggagaucaucguucuaguggccaug

SEQ ID NO: 588137 - RNA, 64 nt, hsa
gaauuccugcaccuguguuugauguuauuuguaugcaauggauugcuggcccuuuguuccuaag

SEQ ID NO: 588138 - RNA, 64 nt, hsa
gcaaacuuucaaaggugguuauuauaacauacuagcaauggaccuuacuacuguaaggaaugua

SEQ ID NO: 588139 - RNA, 64 nt, hsa
acauuauuauuaguggauuucuuaauaggaagaugcaauggagaugacaaauuuggaaaaacca

SEQ ID NO: 588140 - RNA, 64 nt, hsa
aggacuuagggccagcccugcgugaacugcaggggcaauggaugguaaagcccuuuggcucuug

SEQ ID NO: 588141 - RNA, 64 nt, hsa
aggaaauuuuuuagguaaguucaggcauauguaugcaauggaaagccacuagaaaucuucaggc

SEQ ID NO: 588142 - RNA, 64 nt, hsa
cucgugugccaaagaaacauagacaacuguagaggcaauggauauggaaaacauuuuucguaaa

SEQ ID NO: 588143 - RNA, 64 nt, hsa
gcugagguuugugaaacaguaggauucucuuuuggcaauggagaauugcaucugaugguucaag

SEQ ID NO: 588144 - RNA, 64 nt, hsa
ugaggugggauuuucccuccccacagugcacugagcaauggaggguggugagggagccaugcug

SEQ ID NO: 588145 - RNA, 64 nt, hsa
gucugcucauuguuuuguugcuggaacuaaauaugcaauggaucaugagacucagauucuauga

SEQ ID NO: 588146 - RNA, 64 nt, hsa
guaacauaaaacauguuuuuaucacucaaaguaagcaauggagguaacaaauauugugcauuuu

SEQ ID NO: 588147 - RNA, 64 nt, hsa
ugcgaugcuaagugcuuuucuccucugagucuuagcaauggacaauuccaauaccuccacacag

SEQ ID NO: 588148 - RNA, 64 nt, hsa
ggugcggcacggaggagcgcaugcgugcuuaucugcaauggaggcgcucuggaggcuguggugu

SEQ ID NO: 588149 - RNA, 64 nt, hsa
cgugagaagucaacaacuuagccaccacuuccccgcaauggaccauguaacaaauaccucagca

SEQ ID NO: 588150 - RNA, 64 nt, hsa
ucagcuguccuuuuuucuuguuugauuuuugacagcaauggagaauggguuauauaaagacugc

SEQ ID NO: 588151 - RNA, 64 nt, hsa
uguggcucccuggugcaaaacaauuagcaguuaugcaauggaccugauucuaguuuauucuaau

SEQ ID NO: 588152 - RNA, 64 nt, hsa
aaagcucagagacugguuugaaugguuuaauuuugcaauggaucauguccaugccagguguuac

SEQ ID NO: 588153 - RNA, 64 nt, hsa
ccaucccuguuauagaagcuuagagagccagccagcaauggaaccuucugguuccugcgccaau

SEQ ID NO: 588154 - RNA, 64 nt, hsa
uuuugaguguuauaagguggaaggaaacauaguagcaauggauacuuuuuugaaaaauuauugc

SEQ ID NO: 588155 - RNA, 64 nt, hsa
ccgcuucuucauguagauguauauuauuuaggaagcaauggaauucccuucugggagguaagau

SEQ ID NO: 588156 - RNA, 64 nt, hsa
gggcaccccuucugccccccccacugagaacuaugcaauggaguuucaugaaaugguccacaua

SEQ ID NO: 588157 - RNA, 64 nt, hsa
ucaacauaccuuggccagcaaguuagagaaucuggcaauggaugaacugaaagugaugaacugg

SEQ ID NO: 588158 - RNA, 64 nt, hsa
auuuuuauauuuguuuuagauguuuuaaauaguugcaauggauuaaaaaugaugauuuaaaaug

SEQ ID NO: 588159 - RNA, 64 nt, hsa
ccggacauacgcagcaccauacaauauuucacaagcaauggaaaagcaguuaccucauucaaag

SEQ ID NO: 588160 - RNA, 64 nt, hsa
gacgggccuccugauaaucgucuugggcaugauugcaauggagggcaaaugcgucccugaggag

SEQ ID NO: 588161 - RNA, 64 nt, hsa
ugacuguguagugucacccacaagggaggcuagggcaauggagcaggccaccagcagcagcugu

SEQ ID NO: 588162 - RNA, 64 nt, hsa
cauuucaauacccaaagaaagacaagugacaggggcaauggaucucaggcucugagauaaguau

SEQ ID NO: 588163 - RNA, 64 nt, hsa
uguaacugcuaaucaagggugaugcacagcaaaagcaauggaccccaucccucuaaagccugcc

SEQ ID NO: 588164 - RNA, 64 nt, hsa; identical to SEQ ID NO: 215532

SEQ ID NO: 588165 - RNA, 64 nt, hsa; identical to SEQ ID NO: 215533

SEQ ID NO: 588166 - RNA, 64 nt, hsa; identical to SEQ ID NO: 215534

SEQ ID NO: 588167 - RNA, 64 nt, hsa; identical to SEQ ID NO: 215535

SEQ ID NO: 588168 - RNA, 64 nt, hsa; identical to SEQ ID NO: 215536

SEQ ID NO: 588169 - RNA, 64 nt, hsa; identical to SEQ ID NO: 215537

SEQ ID NO: 588170 - RNA, 64 nt, hsa; identical to SEQ ID NO: 215538

SEQ ID NO: 588171 - RNA, 64 nt, hsa; identical to SEQ ID NO: 215539

SEQ ID NO: 588172 - RNA, 64 nt, hsa; identical to SEQ ID NO: 212558

SEQ ID NO: 588173 - RNA, 64 nt, hsa; identical to SEQ ID NO: 212559

SEQ ID NO: 588174 - RNA, 64 nt, hsa; identical to SEQ ID NO: 212560

SEQ ID NO: 588175 - RNA, 64 nt, hsa; identical to SEQ ID NO: 212561

SEQ ID NO: 588176 - RNA, 64 nt, hsa; identical to SEQ ID NO: 212562

SEQ ID NO: 588177 - RNA, 64 nt, hsa; identical to SEQ ID NO: 212563

SEQ ID NO: 588178 - RNA, 64 nt, hsa; identical to SEQ ID NO: 212564

SEQ ID NO: 588179 - RNA, 64 nt, hsa; identical to SEQ ID NO: 212565

SEQ ID NO: 588180 - RNA, 53 nt, hsa
caacaucaacaaauaaauaagaaagcaaaaagaucugggauauguguuggaaa

SEQ ID NO: 588181 - RNA, 64 nt, hsa
ucucaucaucucuguuauacaccuguaucaugaaagcaaaaagaaguaaacaucaggagucagc

SEQ ID NO: 588182 - RNA, 52 nt, hsa
agaccgacgaggaugacuagacagcaaaaaaggaaaaguuaaacuaaaaaaa

SEQ ID NO: 588183 - RNA, 64 nt, hsa
uaaucucaaaggagaaaaaaaaccuuguaaaaaaagcaaaaaugacaacagaaaaacaaucuua

SEQ ID NO: 588184 - RNA, 64 nt, hsa
aagucauuguugucuucaaguguaccaucugccuagcaaaaaauugcuacaaacuuucucuuau

SEQ ID NO: 588185 - RNA, 64 nt, hsa
cauuagcuuuugauuauaaagcucaacuaguauaagcaaaaauauaacaucuagaagcacaguu

SEQ ID NO: 588186 - RNA, 64 nt, hsa
cuaacuaaaaccaaaaaaaccuguccagugugcaagcaaaaaguuguuccuucucaaggcgauu

SEQ ID NO: 588187 - RNA, 64 nt, hsa
uucaguguccuuaaggguucuguaguguuaucaaagcaaaaagaaaaugcugcauaaaaauacc

SEQ ID NO: 588188 - RNA, 64 nt, hsa
uccaacagacaggauugugugagcagcugaaaggagcaaaaaagaacucaguguaagagaaggc

SEQ ID NO: 588189 - RNA, 64 nt, hsa
ucuuucuuucuuuuuuuuuuuuuuuuaguaauuuagcaaaaacauuacuguucuaaugcugaag

SEQ ID NO: 588190 - RNA, 64 nt, hsa
aagcaaaaaucaggcugagaaaaagcaaaagaaaagcaaaaaaaagaagaagaaacagcagaaa

SEQ ID NO: 588191 - RNA, 64 nt, hsa
augguauaaagaggaaaccaagaaaaagaagccaagcaaaaaucaggcugagaaaaagcaaaag

SEQ ID NO: 588192 - RNA, 64 nt, hsa
gaaugauauuuuaggaauaacggacuuuuaaagaagcaaaaaaaaagacugaauuuccuugcuu

SEQ ID NO: 588193 - RNA, 64 nt, hsa
uucauguuuaauuuguauuuguaaaaaaacaaaaagcaaaaaaauucccaaaacccagauaaca

SEQ ID NO: 588194 - RNA, 64 nt, hsa
auagcccucuggagaccgccuagaucagagacucagcaaaaacaggcucgccuucccucuccca

SEQ ID NO: 588195 - RNA, 64 nt, hsa
ucaagcagguacgcuguacauuuuuacagacaaaagcaaaaaccuguacucgcuuugugguuca

SEQ ID NO: 588196 - RNA, 64 nt, hsa
cucuguccagaggcuuuaaaacuggugcaauuacagcaaaaagggauucuguagcuuuaacuug

SEQ ID NO: 588197 - RNA, 64 nt, hsa
uuguaaaccacaucuuuuuugcacuuuuuuuauaagcaaaaacgugccguuuaaaccacuggau

SEQ ID NO: 588198 - RNA, 64 nt, hsa
aacaucuuuguacauuuaagucuguauuauaauaagcaaaaagauuguguguauguauguuuaa

SEQ ID NO: 588199 - RNA, 64 nt, hsa
gacauuuggacagauccugucauuguuuaagcugagcaaaaaaccacacaaaaguuguguaaga

SEQ ID NO: 588200 - RNA, 64 nt, hsa
uuccugacauaguaaaguuugcuuucauaacugcagcaaaaaaggucaacuugccaagucacug

SEQ ID NO: 588201 - RNA, 64 nt, hsa
cuguauucuccuccaacaucaccacuagcguaaaagcaaaaagcuuuuacaaaacacagccaaa

SEQ ID NO: 588202 - RNA, 64 nt, hsa
auggaagaauguguuauguucaucuuguaaucauagcaaaaagucugcaaaccccagggucaag

SEQ ID NO: 588203 - RNA, 64 nt, hsa
ugacuuggauauaugguugaagaaucaaaacaaaagcaaaaaaaaaaagcaaaaaaagaaaaga

SEQ ID NO: 588204 - RNA, 64 nt, hsa
ugguugaagaaucaaaacaaaagcaaaaaaaaaaagcaaaaaaagaaaagagaaaaaaagaaaa

SEQ ID NO: 588205 - RNA, 64 nt, hsa
uuagauugccuuuucaugcagugagauucaguuaagcaaaaaugaaauuugucucuauagcuaa

SEQ ID NO: 588206 - RNA, 64 nt, hsa
cauuagaaugucugggaaaauauuucucaaagacagcaaaaaccucucaaacugaggagcaaca

SEQ ID NO: 588207 - RNA, 64 nt, hsa
ucaugacgaagacgccaaaaacaauugcaacagaagcaaaaauucacaaaugggaucuaauuaa

SEQ ID NO: 588208 - RNA, 64 nt, hsa
aaucuaaagaaauauugauaguaaggcaauccuaagcaaaaagaacaaagcuggaggcaucacg

SEQ ID NO: 588209 - RNA, 64 nt, hsa
aacaucuggauuucauccuugaccucauuuacaaagcaaaaagagaugcuggauucagauauaa

SEQ ID NO: 588210 - RNA, 64 nt, hsa
ggauugacauacccaaaguagccagcuggucuucagcaaaaaaaaaaaagcuaaugucuucuaa

SEQ ID NO: 588211 - RNA, 64 nt, hsa
cauuacauuggcaaauaagguuuggaagcagaagagcaaaaaaaagauauuguuaaaaugaggc

SEQ ID NO: 588212 - RNA, 64 nt, hsa
ugguauuuguuaaauacguuuguuuuuauugcagagcaaaaauaaaucaaauuagaagcaauac

SEQ ID NO: 588213 - RNA, 64 nt, hsa
aggugaugggcagaucuuuucuuuaaaauaaaaaagcaaaaacucuugugguaccuagucagau

SEQ ID NO: 588214 - RNA, 64 nt, hsa
caaauuaccuaggcugagguuagagagauuggccagcaaaaacugugggaagaugaacuuuguc

SEQ ID NO: 588215 - RNA, 64 nt, hsa
ggagaagacaacagugagcuuagaauaucuauaaagcaaaaaauguagucucuuguuuaaaaaa

SEQ ID NO: 588216 - RNA, 64 nt, hsa
ggaaugcaaggauacaaaacuuuagcaugcuuugagcaaaaauuuaaacuuacuggaaucuuuu

SEQ ID NO: 588217 - RNA, 64 nt, hsa
gagcaagauaugacuauagcccacaacccaaagaagcaaaaauucguuuuuaucuuuugaaauc

SEQ ID NO: 588218 - RNA, 64 nt, hsa
guuugacuguguggcacaggggggcauuuggcacagcaaaaagcccacccaggacuuagccuca

SEQ ID NO: 588219 - RNA, 64 nt, hsa
cccugccuaaggaacugcagagagguggcaaaucagcaaaaaggacaccaggcucuucuuggcc

SEQ ID NO: 588220 - RNA, 64 nt, hsa
acucucaacauuucccuuauuugguucagcuuuuagcaaaaagggcuacaguucacccugcaga

SEQ ID NO: 588221 - RNA, 64 nt, hsa
uucaucaagaaaaaguggaaccagcugucccuccagcaaaaacagcagcccuaauagcagccca

SEQ ID NO: 588222 - RNA, 64 nt, hsa
gagcaaagggaggcuccggcugccccagauuggcagcaaaaauaagccgucaaguaguaagaag

SEQ ID NO: 588223 - RNA, 64 nt, hsa
ccaaaaaagagcccaaaaagccaaagcaauccuaagcaaaaagaacaaagcuggaggcaucgca

SEQ ID NO: 588224 - RNA, 64 nt, hsa
ucaugacaaagaucccaaaaauaauuguaacgaaagcaaaaauugacaaaugggacaugauuaa

SEQ ID NO: 588225 - RNA, 64 nt, hsa
uuaaauucuauugaaaaaggaaaaucagcaauucagcaaaaaauaaauaaaaaauaaaaaugua

SEQ ID NO: 588226 - RNA, 64 nt, hsa
gugugaccgaccccuuggccaaaaaaaaacaaaaagcaaaaaacaaaaaccuacccuguucugg

SEQ ID NO: 588227 - RNA, 64 nt, hsa
aaugucaguuuaauaaguggucucuuuuuagcagagcaaaaaaauauagcguaaauacuuauuu

SEQ ID NO: 588228 - RNA, 64 nt, hsa
gaaaguguuuacuggauucauuuuguaauauuuuagcaaaaagagacuucaauguuguggacaa

SEQ ID NO: 588229 - RNA, 64 nt, hsa
aaaaauuuuacauagaucaguuguauuucuauuuagcaaaaaugagugcucugcuuuuauuugg

SEQ ID NO: 588230 - RNA, 64 nt, hsa
cacgcguuucauucaaugucuccacagacuggguagcaaaaaaaucaccuuuuaguuuuaguuu

SEQ ID NO: 588231 - RNA, 64 nt, hsa
aauaagugcuauaaagaaauauaaaggguuugggagcaaaaagagggaguggaucuauuuuaga

SEQ ID NO: 588232 - RNA, 64 nt, hsa
uuaaaauguucauuaauaaaguuguuggacgggaagcaaaaaaaaaaaguuguuuaagauaaau

SEQ ID NO: 588233 - RNA, 64 nt, hsa
gacauacacuagagacaccuuguaguauuuugggagcaaaaaaauuauuuucucuuaacaagac

SEQ ID NO: 588234 - RNA, 64 nt, hsa
acacacacacacacuuucuauaaaacuugaaaauagcaaaaacccucaacuguuguaaaucaug

SEQ ID NO: 588235 - RNA, 64 nt, hsa
ccuaaacagcaguuaaguugucucuaaaugaacuagcaaaaaaaaaaaauguaguuuuuguuug

SEQ ID NO: 588236 - RNA, 64 nt, hsa
caauugaucagauuacuaaaaggacuugggaaaaagcaaaaaggucccauuguacuggacugag

SEQ ID NO: 588237 - RNA, 64 nt, hsa
uacauuucaacccaucuggcuaaaguuaagacuuagcaaaaauuaaaauguugccuuuguccaa

SEQ ID NO: 588238 - RNA, 64 nt, hsa
uguuuuuuuaacaaaagagauaaaauacaauugaagcaaaaaauaacagcuaguauauaauaua

SEQ ID NO: 588239 - RNA, 62 nt, hsa
gcuauuguucugcuauuaccagauuuauugugccacacaaaaggaucaugugugucagcagg

SEQ ID NO: 588240 - RNA, 62 nt, hsa
aguaaaugugaaccuugucuaaguacuguaauccacacaacacauuauaagaagcaaaccag

SEQ ID NO: 588241 - RNA, 62 nt, hsa
ccggaucaucagcacaauugugaaacuugucaccacacaauaaaaagcagucuuagagagug

SEQ ID NO: 588242 - RNA, 62 nt, hsa
cuuauuuguuuuaauguacagaugugggaaaaccacacaaauuccgcaguuuauucuggaug

SEQ ID NO: 588243 - RNA, 62 nt, hsa
cuuucuuagguaauucacugcagguuaagaauccacacaaccaaguucaugggaauuuugug

SEQ ID NO: 588244 - RNA, 62 nt, hsa
uauccuacauuauuggaaaauaaaugagauguccacacaaauggauuauccacauaaucaaa

SEQ ID NO: 588245 - RNA, 62 nt, hsa
gguuacaaauccauaacaaaugacuggaaaagccacacaacucuuacauacugauauuuaga

SEQ ID NO: 588246 - RNA, 62 nt, hsa
ggaucugcaucuagccugcauaucacauugacccacacaaaagauuuuuaaguacgaaguaa

SEQ ID NO: 588247 - RNA, 62 nt, hsa
ccugggcuguguaugccugcggaugcagugucccacacaaggacacuuccucuaggaugcca

SEQ ID NO: 588248 - RNA, 60 nt, hsa; identical to SEQ ID NO: 579611

SEQ ID NO: 588249 - RNA, 64 nt, hsa
acguggauauaccucuucaggauggccuccuugcugucuuuauugaagagcugcccacccagag

SEQ ID NO: 588250 - RNA, 64 nt, hsa
gcacucuuuuuucuccauauuaguuaacaagaggugucuuuaggcccuggauguuaccaucuca

SEQ ID NO: 588251 - RNA, 64 nt, hsa
acauaugugaugucgaugucucugucuuuuuuuuugucuuuaaaaaauaauuggcagcaacugu

SEQ ID NO: 588252 - RNA, 64 nt, hsa
agaaacugugaauuuccaaauaaaucugaacacuugucuuuauuaauuacuggcucuucugucu

SEQ ID NO: 588253 - RNA, 64 nt, hsa
augcaauugugcucuucauuuaggaugcuuucauugucuuuaagauguguuaggaaugucaaca

SEQ ID NO: 588254 - RNA, 64 nt, hsa
aaaaagccugugaaaggugucuucuuugacuuaaugucuuuaaaaguauccagagauacuacaa

SEQ ID NO: 588255 - RNA, 64 nt, hsa
cauggucauuuuuagcccuuuuccuuaggaaccaugucuuuauuuucucaauaaagaaauuacu

SEQ ID NO: 588256 - RNA, 64 nt, hsa
ugggagcucagguacucuuuuagucaucuuuguaugucuuuagcagaguucuugacauguggua

SEQ ID NO: 588257 - RNA, 64 nt, hsa
auagaaaugugauuacaaagaagucugacuaccaugucuuuaaacauauggcaucucucaacuu

SEQ ID NO: 588258 - RNA, 64 nt, hsa
guagguauuaacuagaauauaaauccuuagaaauugucuuuauaccuucaaaaauuauacuaug

SEQ ID NO: 588259 - RNA, 64 nt, hsa
gaggguaguuucuccagucuccccagucuguuggugucuuuauaggaaacuauaaagcagagca

SEQ ID NO: 588260 - RNA, 64 nt, hsa
ugucuuuauaggaaacuauaaagcagagcaguggugucuuuagaggaaacucauucaagucagg

SEQ ID NO: 588261 - RNA, 64 nt, hsa
accuuuucaguccuucucccaacccccugcaaauugucuuuaaaacaacaacacauaaggaauc

SEQ ID NO: 588262 - RNA, 64 nt, hsa
caauugaucuugaaguauuucuaguccugugauuugucuuuauauuaaaucauuagcauuaauc

SEQ ID NO: 588263 - RNA, 64 nt, hsa
ugugagcaaaguuuguagcugcuggauuauugucugucuuuauagcaaguuccaguaaaccaca

SEQ ID NO: 588264 - RNA, 64 nt, hsa
uuuuuccuuucuuuaagcuguguacagugaaaauugucuuuacuguauuuuuguucucugguaa

SEQ ID NO: 588265 - RNA, 64 nt, hsa
aaaauaaauaaauaugcaauaacauuaaauuaaaugucuuuacaagaagcagugaaggcacugg

SEQ ID NO: 588266 - RNA, 64 nt, hsa
aaucaaaccugcugaugcuacaaauguuaauuucugucuuuauaaaaauaugucucaaaagaac

SEQ ID NO: 588267 - RNA, 64 nt, hsa
ccaggccuaagggcuauguuugguaccaguguuuugucuuuagcuuuucuaugugauugugccg

SEQ ID NO: 588268 - RNA, 64 nt, hsa
guacccauagggaaaggcaggucuuucuggaaauugucuuuagaagaaagaauuguauuucuuu

SEQ ID NO: 588269 - RNA, 64 nt, hsa
aaccccuuaaagauaauguacaugcuucaugucaugucuuuaaaauaauuuaaucaacuuuauu

SEQ ID NO: 588270 - RNA, 64 nt, hsa
gucgaucuuuaaguuguuacuauuguguuauucaugucuuuaaaucagauaccaaauauuuuuu

SEQ ID NO: 588271 - RNA, 64 nt, hsa
acugcauuucagccugggggauacagugagaccuugucuuuaaaaaaaaaaugcugcaaaacca

SEQ ID NO: 588272 - RNA, 64 nt, hsa
guucgagaucagccuaggcaacauggugaaauccugucuuuaccaaaaguuuaaaaauuagcuu

SEQ ID NO: 588273 - RNA, 64 nt, hsa
uagaagauauuuucagugucuuuaccugaggguaugucuuuagcuauguuuuagggccauacau

SEQ ID NO: 588274 - RNA, 64 nt, hsa
uugugaauuacauuuuuauagaagauauuuucagugucuuuaccugaggguaugucuuuagcua

SEQ ID NO: 588275 - RNA, 64 nt, hsa
ucacuagguuugaaugaucauguuuuauaagaaaugucuuuauuuuaguguguuaaaaccuuau

SEQ ID NO: 588276 - RNA, 64 nt, hsa
uaucuuucaauucugaaaaauucuguggguggccugucuuuaagcaaugcuuuucucuugugag

SEQ ID NO: 588277 - RNA, 64 nt, hsa
guauuuuaauagcgucauaacuagaacugaauuuugucuuuaugauuuuuaaagaaaaguuuug

SEQ ID NO: 588278 - RNA, 64 nt, hsa
ugacucaagacuuccagagccucaaaugagaaaaugucuuuauuaaauguagaaagugauccau

SEQ ID NO: 588279 - RNA, 64 nt, hsa
caaugugaauagucaucuccuaauuuguuucuucugucuuuauguuuuucuauaaccuggauuu

SEQ ID NO: 588280 - RNA, 64 nt, hsa
ccauagugucacuuccacacaauuauuuauuucaugucuuuacuggaccugaaauuuaaacugc

SEQ ID NO: 588281 - RNA, 64 nt, hsa
acucuuuguuauuugaaaacauguuuauuuuucuugucuuuauuuuaaccuuugauagaaccau

SEQ ID NO: 588282 - RNA, 64 nt, hsa
aagugaggugugucacaaugagauugaauuucacugucuuuaauucuguaucuguagacggcuc

SEQ ID NO: 588283 - RNA, 64 nt, hsa
acacucacauacacacacacacacacacucugacugucuuuauugcagaagacaguguguugcc

SEQ ID NO: 588284 - RNA, 64 nt, hsa
gugguauuugaaucauuuugccaggucauuucucugucuuuaguauuuuuugcuggugcuucuu

SEQ ID NO: 588285 - RNA, 64 nt, hsa
gguaagauaugugugaccuucuuggaaugaauauugucuuuagaauacccuuugauaagcugag

SEQ ID NO: 588286 - RNA, 64 nt, hsa
gucacauauggaauuuugagaaaauaaagcaugcugucuuuaggaauuuuuauacuucuuuguc

SEQ ID NO: 588287 - RNA, 64 nt, hsa
aggugagaaagaaaguuaagguuaaggcuagaguugucuuuaaggguuaggguuaggaccaggu

SEQ ID NO: 588288 - RNA, 64 nt, hsa
guuauggggucuuuccccuguauacuaccaguugugucuuuagauggcacacaaguccaaauaa

SEQ ID NO: 588289 - RNA, 64 nt, hsa
auuuaugcacauuauaaugguuacaucugcuuuuugucuuuaaaauaaaaaaaaaaaucagaga

SEQ ID NO: 588290 - RNA, 64 nt, hsa
guauaauuuuaaauuuuaaugcaaaauuuuaauuugucuuuauuuuuuaucauuugaacugaua

SEQ ID NO: 588291 - RNA, 64 nt, hsa
caucgucuuuuaguuccaacaaagaaaggugccaugucuuuacuagacugaggagcccucucgc

SEQ ID NO: 588292 - RNA, 64 nt, hsa
gauggcaauagucauuaaaaacauagaaaaaugaugucuuuaaguggagaauuguggaaggauu

SEQ ID NO: 588293 - RNA, 64 nt, hsa
uacagguauugcacuggguggggaaaggauagugugucuuuaacucuuaaauuguuugguccua

SEQ ID NO: 588294 - RNA, 64 nt, hsa
gaccaguuucugugggcguguauuggagcagguuugucuuuaaauguuaaagaugcacuauccu

SEQ ID NO: 588295 - RNA, 64 nt, hsa
uauucccaauccuaggcaccacugaguuguuuucugucuuuauaaguuuuucuuucuacaucuu

SEQ ID NO: 588296 - RNA, 64 nt, hsa
agugucuucaaauccucaccaacauccaggauugugucuuuaugauuauagccauuuuuguagg

SEQ ID NO: 588297 - RNA, 64 nt, hsa
uuccccaaucaauacccuugugauuucuuaugccugucuuuacuuuaaucuccuaauccuguca

SEQ ID NO: 588298 - RNA, 64 nt, hsa
uccccaaauuaauacuuuuauaauuuccuaugccugucuuuaccgcaaucucuaaacacaaauu

SEQ ID NO: 588299 - RNA, 64 nt, hsa
cauaaauugguuuuagcuaaacacuuacuaguagugucuuuaaauuauuuaaucaaccuugucu

SEQ ID NO: 588300 - RNA, 64 nt, hsa
cauuaaauuaaauauguuauaagguggcuuuacuugucuuuauaaaaauaaauauaucuacuaa

SEQ ID NO: 588301 - RNA, 64 nt, hsa; identical to SEQ ID NO: 251943

SEQ ID NO: 588302 - RNA, 64 nt, hsa; identical to SEQ ID NO: 251944

SEQ ID NO: 588303 - RNA, 64 nt, hsa; identical to SEQ ID NO: 251945

SEQ ID NO: 588304 - RNA, 64 nt, hsa; identical to SEQ ID NO: 251946

SEQ ID NO: 588305 - RNA, 64 nt, hsa; identical to SEQ ID NO: 251947

SEQ ID NO: 588306 - RNA, 64 nt, hsa; identical to SEQ ID NO: 251948

SEQ ID NO: 588307 - RNA, 64 nt, hsa; identical to SEQ ID NO: 251949

SEQ ID NO: 588308 - RNA, 64 nt, hsa; identical to SEQ ID NO: 251950

SEQ ID NO: 588309 - RNA, 64 nt, hsa; identical to SEQ ID NO: 251951

SEQ ID NO: 588310 - RNA, 64 nt, hsa; identical to SEQ ID NO: 251952

SEQ ID NO: 588311 - RNA, 64 nt, hsa; identical to SEQ ID NO: 251953

SEQ ID NO: 588312 - RNA, 64 nt, hsa; identical to SEQ ID NO: 251954

SEQ ID NO: 588313 - RNA, 64 nt, hsa; identical to SEQ ID NO: 251955

SEQ ID NO: 588314 - RNA, 64 nt, hsa; identical to SEQ ID NO: 251956

SEQ ID NO: 588315 - RNA, 64 nt, hsa
auuuuuccucccaauacccacccuucucucucgagggaucuaggcaccuuggucccagugucuu

SEQ ID NO: 588316 - RNA, 64 nt, hsa
uuccuuuuguucucacugccaaacugccuguccugggaucuaguuaucuuggcccugcacucuc

SEQ ID NO: 588317 - RNA, 64 nt, hsa
aaaggagacauagcccaaacccuggcuuauucuugggaucuacugauugcgggcucugcaagac

SEQ ID NO: 588318 - RNA, 64 nt, hsa
uccucccuugcccuugcaaucuccagcaaaaggugggaucuaggaagaaagaauccaguguaga

SEQ ID NO: 588319 - RNA, 64 nt, hsa; identical to SEQ ID NO: 529719

SEQ ID NO: 588320 - RNA, 64 nt, hsa; identical to SEQ ID NO: 529720

SEQ ID NO: 588321 - RNA, 64 nt, hsa; identical to SEQ ID NO: 529721

SEQ ID NO: 588322 - RNA, 64 nt, hsa; identical to SEQ ID NO: 529722

SEQ ID NO: 588323 - RNA, 64 nt, hsa; identical to SEQ ID NO: 529723

SEQ ID NO: 588324 - RNA, 64 nt, hsa; identical to SEQ ID NO: 529724

SEQ ID NO: 588325 - RNA, 64 nt, hsa; identical to SEQ ID NO: 529725

SEQ ID NO: 588326 - RNA, 64 nt, hsa; identical to SEQ ID NO: 529726

SEQ ID NO: 588327 - RNA, 64 nt, hsa; identical to SEQ ID NO: 74837

SEQ ID NO: 588328 - RNA, 64 nt, hsa; identical to SEQ ID NO: 74838

SEQ ID NO: 588329 - RNA, 64 nt, hsa; identical to SEQ ID NO: 74839

SEQ ID NO: 588330 - RNA, 64 nt, hsa; identical to SEQ ID NO: 74840

SEQ ID NO: 588331 - RNA, 64 nt, hsa; identical to SEQ ID NO: 74841

SEQ ID NO: 588332 - RNA, 64 nt, hsa; identical to SEQ ID NO: 74842

SEQ ID NO: 588333 - RNA, 64 nt, hsa; identical to SEQ ID NO: 74843

SEQ ID NO: 588334 - RNA, 64 nt, hsa
aguacaauggcagcuacuucgacagaggagccaagggcggcagccgccucugcacaccggaagg

SEQ ID NO: 588335 - RNA, 64 nt, hsa
gugaguggucuucaaacgagggucccgauccccggggcggcaggaagggggccgacuccacgcu

SEQ ID NO: 588336 - RNA, 64 nt, hsa
auaggauguaacauaaugaaacacaccugucuaggggcggcaaucaacagucuuacacagagag

SEQ ID NO: 588337 - RNA, 64 nt, hsa
gauccucagcgggcagcggaagcucgagauggaggggcggcagguggugagucucgaccccgca

SEQ ID NO: 588338 - RNA, 64 nt, hsa
cgcugugacaguuuccccggugugagcccggugagggcggcaggcagggguuauccggccccac

SEQ ID NO: 588339 - RNA, 64 nt, hsa
cuuaagaacacaaagcggggggaggguuggggaggggcggcaggagggagguuugugagagcga

SEQ ID NO: 588340 - RNA, 64 nt, hsa
ugcagccacugccugacuucacucgggcgggggagggcggcagucggucggcucgcucugggcg

SEQ ID NO: 588341 - RNA, 64 nt, hsa
aggcccugggcaaggggauggggcugugggggcggggcggcaugggcuucagaaguaucugcac

SEQ ID NO: 588342 - RNA, 64 nt, hsa
ggacucagccuucagacagagaggacuguagggagggcggcaggggccuggagauccuccugca

SEQ ID NO: 588343 - RNA, 64 nt, hsa
ccuuucccagagggcaccacgcaagggcagagcugggcggcauccacagccagagaggcagagg

SEQ ID NO: 588344 - RNA, 64 nt, hsa
aacaggauaacccuugaauguagcagccccgggagggcggcacaggucgggcgcaggauucagc

SEQ ID NO: 588345 - RNA, 64 nt, hsa
acgccgugccccuccuggcccauacgccuugccagggcggcaggauugucacaccguuuuagga

SEQ ID NO: 588346 - RNA, 64 nt, hsa
acagauggcccggcuagccgccuggacugcaggggggcggcagcagcggcgguggcagugggug

SEQ ID NO: 588347 - RNA, 50 nt, hsa
gucgucugaagaagcucugagggcggcaggaccagccagcagcagcccaa

SEQ ID NO: 588348 - RNA, 64 nt, hsa
cugcgaggccugcccuccaaaccugacuggggaugggcggcacugugcgggugagccgggaaca

SEQ ID NO: 588349 - RNA, 64 nt, hsa
gaucaggacgaaggaccaccgucgguccucagcagggcggcagccuccuccuggcuguccgggg

SEQ ID NO: 588350 - RNA, 64 nt, hsa
gcguguguggccuaauccaccugguggcccugcggggcggcauccgagccccuguuucuccucc

SEQ ID NO: 588351 - RNA, 64 nt, hsa
uuugauaugucugcaugcaaaguggaacagaguugggcggcaaugacagaagagcuuccuuggc

SEQ ID NO: 588352 - RNA, 64 nt, hsa
acuagcuagacuuccacauagucccaccccaagugggcggcaguguuccuggcaugaccaggau

SEQ ID NO: 588353 - RNA, 64 nt, hsa
ccuuccagaaacuuuauauggguagaggaagccagggcggcaaaugcgagaccaaauaucauuu

SEQ ID NO: 588354 - RNA, 64 nt, hsa
uggcccuggcaggacccagggccuccagacgugcgggcggcacaugccuuggggacauccugcc

SEQ ID NO: 588355 - RNA, 64 nt, hsa
uagaauuuagcagacagcuguuccacgcgggccagggcggcaugaagaagucccgccgcuacgu

SEQ ID NO: 588356 - RNA, 64 nt, hsa
agaugggguggagggggccaccggggcagggagggggcggcaaggggggaaugggaguugucuc

SEQ ID NO: 588357 - RNA, 64 nt, hsa
caauuguguccauucugaggucucuccagugggagggcggcagcuccugucccuggguucaggc

SEQ ID NO: 588358 - RNA, 64 nt, hsa
acaagaggcucaacuucaucacugaguacaucaagggcggcacgcuccggggcaucaucaagag

SEQ ID NO: 588359 - RNA, 64 nt, hsa
caucgacgugaagucccacguguccggugugcuugggcggcaucgcaucaacgcgcagaccuaa

SEQ ID NO: 588360 - RNA, 64 nt, hsa
augacacaguagccaccgguggaugacagcccacgggcggcacagucacuucugccuguugcuc

SEQ ID NO: 588361 - RNA, 64 nt, hsa
agaagaggccauagcugcuccagccggggcuccggggcggcagcagagcuggcacaccgauucu

SEQ ID NO: 588362 - RNA, 55 nt, hsa
ucugcaacucggaacucugaacccagggcggcagggcggaaggugcuccucaggc

SEQ ID NO: 588363 - RNA, 64 nt, hsa
acgggggcuggagaaggccuggauaaagacagaagggcggcaacacaccaccccagcccccacc

SEQ ID NO: 588364 - RNA, 64 nt, hsa
ccgaagucagucggaguacuugaagaaggcccacgggcggcacggaguuccugagcccuuucug

SEQ ID NO: 588365 - RNA, 64 nt, hsa
ggggucucauuccuuucuguuccccagugccccggggcggcauuuuacugcucagaauuuggag

SEQ ID NO: 588366 - RNA, 64 nt, hsa
gguacaucgugagcaaggagccugcauucccagggggcggcagggacagcauguaaggucuuag

SEQ ID NO: 588367 - RNA, 64 nt, hsa
cuggcugaccccuggccggcccaggccuccacgggggcggcaggcuggguucauuccccggccc

SEQ ID NO: 588368 - RNA, 64 nt, hsa
uggcgagcuccuaggccucuggcuuccugguagagggcggcaugccgaagggucugcugggugu

SEQ ID NO: 588369 - RNA, 64 nt, hsa
aacuguaaguccuguuugguuguuguuggacgcagggcggcacaugaguguuuuugguuagagc

SEQ ID NO: 588370 - RNA, 64 nt, hsa
gggggcucggggcagaggggcggugucuuguagcgggcggcagcgccagcgccccucugucagg

SEQ ID NO: 588371 - RNA, 64 nt, hsa
gugggcagcuguggcagagcagcgacccgcggcggggcggcauccccagcugguucgggccgug

SEQ ID NO: 588372 - RNA, 64 nt, hsa
aaccuguugcuccaggaugcauucugauaggagggggcggcagggcugggccuugugacaaucu

SEQ ID NO: 588373 - RNA, 64 nt, hsa
ugugcaggugacguccgggcugccgucccagcaggggcggcaggagagagaggcuggccuacac

SEQ ID NO: 588374 - RNA, 64 nt, hsa
gagcagcaccucgaguuagaacccggcccacguagggcggcacucacacgcgaaaguaucacca

SEQ ID NO: 588375 - RNA, 64 nt, hsa
ccacgugcagguggagcucugggaugcuauguuggggcggcaagcggugggccgagggccgggu

SEQ ID NO: 588376 - RNA, 64 nt, hsa
guauagacagaacccaggguugagaacagaaggugggcggcaggaucagagugaaagcagaggc

SEQ ID NO: 588377 - RNA, 64 nt, hsa
caccuggugagcccuagcagggcugagacccccagggcggcagccugucugcugcugagugauu

SEQ ID NO: 588378 - RNA, 64 nt, hsa
cacaaauuccuaagggggaagaggagaggguauggggcggcagacccuaucaucaacuguccag

SEQ ID NO: 588379 - RNA, 64 nt, hsa
uaacucuguccugaagagugggacaaaugcagccgggcggcagaucuagcgggagcucaaaggg

SEQ ID NO: 588380 - RNA, 64 nt, hsa
cuccuaccuggggacuccucaaaccacuugccuggggcggcaugaacccucuugccauccugau

SEQ ID NO: 588381 - RNA, 64 nt, hsa
ccccucugcacaggccucccgaaguccugaagcugggcggcagugaggugucaccccccuccag

SEQ ID NO: 588382 - RNA, 64 nt, hsa
ccccagggcccacccccaggaaggccacagugcugggcggcaucccugcagaggaaagacagga

SEQ ID NO: 588383 - RNA, 64 nt, hsa
ugaccagcaggcagccucaucuggucgggggcgggggcggcaggagcagaagcggggucuccgu

SEQ ID NO: 588384 - RNA, 64 nt, hsa
ccgggcguggaccacccgcccuggcaguugaauggggcggcaauugcggggcccaccuuagacc

SEQ ID NO: 588385 - RNA, 64 nt, hsa
ggcagaaaaaggagaagcaggcaccuuuuucacagggcggcaggaugaaaaugacugccagcag

SEQ ID NO: 588386 - RNA, 64 nt, hsa
cuccagggagaaggaccucaaaucgccacucuuugggcggcaggugcgguccccacggccggcu

SEQ ID NO: 588387 - RNA, 64 nt, hsa
caggcccucugagugagccccacgggguccaggcgggcggcagcagcccaggggccccaggccu

SEQ ID NO: 588388 - RNA, 57 nt, hsa
uggucuccuggaacuggugaggccgcagggcggcaccuggggcuacccucgacuuug

SEQ ID NO: 588389 - RNA, 64 nt, hsa
uguguggucguuccaaacugccccagggcuuugggggcggcacuugggguuucugggaaugaca

SEQ ID NO: 588390 - RNA, 64 nt, hsa
caauacuuugauugcauauuagacauucuuaacagggcggcagucuaguguugaaaguuuuauu

SEQ ID NO: 588391 - RNA, 64 nt, hsa
gggcugggucuggggccgccacaggccccucacggggcggcagaggcaacuucagugucccugu

SEQ ID NO: 588392 - RNA, 64 nt, hsa
cgugcccagcuguccccccaggccucuccucagagggcggcacaggcugggcuccagcaggugg

SEQ ID NO: 588393 - RNA, 64 nt, hsa
uggcgauucuaguuaauaaaaaggggggagaugugggcggcaagccacccaggcaccgaggcaa

SEQ ID NO: 588394 - RNA, 64 nt, hsa
cacgagaaaagccaguggagaaagcgcccuuccagggcggcagcagcgggagccacgcagaccc

SEQ ID NO: 588395 - RNA, 64 nt, hsa
aaggagccggccugcugggcagcguggccacaaggggcggcacuccucaggccgggggagccac

SEQ ID NO: 588396 - RNA, 64 nt, hsa
uugcuggggcuguccugguugcagccaucguccugggcggcacgggcuggggauuuaaguaaga

SEQ ID NO: 588397 - RNA, 64 nt, hsa
agucugucuggauugaguccuacagugucagauagggcggcaaaugccaaagcagggaaacagg

SEQ ID NO: 588398 - RNA, 64 nt, hsa
aucccugaccuccuggagacaccaccugcuuuccgggcggcacugugaugggagcugguggcga

SEQ ID NO: 588399 - RNA, 64 nt, hsa
ugagugcccccgcgugccugcguguugagugugugggcggcagugccguuccggaggccugguc

SEQ ID NO: 588400 - RNA, 64 nt, hsa
gcaggcccacaggggccaccgcagagccgagucggggcggcaucgugcuggugccucuggcccc

SEQ ID NO: 588401 - RNA, 64 nt, hsa
uggaggcacacagcugcagagacagagaggacgugggcggcagagaggacuguugacauccaag

SEQ ID NO: 588402 - RNA, 64 nt, hsa
gcuuucagccucugggucugagucauggccgggugggcggcacagccuucuccacuggccggag

SEQ ID NO: 588403 - RNA, 64 nt, hsa
auguggcagaggggucucagucgugcuaggcaucgggcggcagcgccgacagcccuucccucgc

SEQ ID NO: 588404 - RNA, 64 nt, hsa
gggugggagucgggguguggcaggccgcgguggggggcggcaguggcuccgcgcacucacccgg

SEQ ID NO: 588405 - RNA, 52 nt, hsa
ggaugaccaugagcgugugauggggcggcagccccgggccucucugcgggcc

SEQ ID NO: 588406 - RNA, 64 nt, hsa
ccgucuccgggccauggcguucacugcagggcgggggcggcaccgcuccccugugacugcaucc

SEQ ID NO: 588407 - RNA, 64 nt, hsa
ggggugacucggagcagcagguguggccccgggcgggcggcaccgcguccagggcagccucccu

SEQ ID NO: 588408 - RNA, 64 nt, hsa
aagaagggggcacugcccggcccggcugugaggagggcggcagggggcacggccuccagcuucc

SEQ ID NO: 588409 - RNA, 64 nt, hsa
cccauccacuauuaaugcacuaggugggaggagagggcggcaaugacacugcaccucuccuuuc

SEQ ID NO: 588410 - RNA, 64 nt, hsa
uggggacauguaggaugggcucuuaccccagggagggcggcaggcuccacuucggcgagagguu

SEQ ID NO: 588411 - RNA, 64 nt, hsa
gggacagccauaacacccccgggacaguaggucugggcggcaccacugggaacucuggacuuga

SEQ ID NO: 588412 - RNA, 64 nt, hsa
cccacccagggcucccuccuggagcaucccaggcgggcggcacgccaacagccccccccuugaa

SEQ ID NO: 588413 - RNA, 64 nt, hsa
cccacgagaauaugucacuugcccagauaaaacugggcggcagccagaguucccugaaguggga

SEQ ID NO: 588414 - RNA, 64 nt, hsa
uggcuccagaacuccugugccaggcgggagggaagggcggcacuggagagaugggcccaucauu

SEQ ID NO: 588415 - RNA, 64 nt, hsa
acaugcagaagcaaauaucaggccugucgcacacgggcggcauuuaaauaggaauuucuauuuu

SEQ ID NO: 588416 - RNA, 64 nt, hsa
ccuuuugccauggaggucugggagagagagcagagggcggcagggcuaaguuggugaucauugg

SEQ ID NO: 588417 - RNA, 64 nt, hsa
aaccaacaacacagcuggggcgggcccuguggcugggcggcagccaguccagcucuugcuuccu

SEQ ID NO: 588418 - RNA, 64 nt, hsa
acccgaggaggccggacucagacacauaggcggggggcggcaccuggcaucagcaauacgcagu

SEQ ID NO: 588419 - RNA, 64 nt, hsa
ucucggacgugagugcaacuggggcuaggucaucgggcggcacccugcacagagcuccugggcc

SEQ ID NO: 588420 - RNA, 64 nt, hsa
cagagagcgcacccuacucuuuccgugacgaugagggcggcaaaaacagacauuucuuccuuca

SEQ ID NO: 588421 - RNA, 50 nt, hsa
agagccacauccaggccugagggcggcaccccagcccugcccuugcuucc

SEQ ID NO: 588422 - RNA, 64 nt, hsa; identical to SEQ ID NO: 159322

SEQ ID NO: 588423 - RNA, 64 nt, hsa; identical to SEQ ID NO: 159323

SEQ ID NO: 588424 - RNA, 64 nt, hsa; identical to SEQ ID NO: 159324

SEQ ID NO: 588425 - RNA, 64 nt, hsa; identical to SEQ ID NO: 159325

SEQ ID NO: 588426 - RNA, 64 nt, hsa; identical to SEQ ID NO: 159326

SEQ ID NO: 588427 - RNA, 64 nt, hsa; identical to SEQ ID NO: 159327

SEQ ID NO: 588428 - RNA, 64 nt, hsa; identical to SEQ ID NO: 159328

SEQ ID NO: 588429 - RNA, 64 nt, hsa; identical to SEQ ID NO: 159329

SEQ ID NO: 588430 - RNA, 64 nt, hsa; identical to SEQ ID NO: 159330

SEQ ID NO: 588431 - RNA, 64 nt, hsa; identical to SEQ ID NO: 159331

SEQ ID NO: 588432 - RNA, 64 nt, hsa; identical to SEQ ID NO: 159332

SEQ ID NO: 588433 - RNA, 64 nt, hsa; identical to SEQ ID NO: 159333

SEQ ID NO: 588434 - RNA, 64 nt, hsa; identical to SEQ ID NO: 159334

SEQ ID NO: 588435 - RNA, 64 nt, hsa; identical to SEQ ID NO: 159335

SEQ ID NO: 588436 - RNA, 64 nt, hsa; identical to SEQ ID NO: 159336

SEQ ID NO: 588437 - RNA, 64 nt, hsa; identical to SEQ ID NO: 159337

SEQ ID NO: 588438 - RNA, 64 nt, hsa; identical to SEQ ID NO: 159338

SEQ ID NO: 588439 - RNA, 64 nt, hsa; identical to SEQ ID NO: 159339

SEQ ID NO: 588440 - RNA, 64 nt, hsa; identical to SEQ ID NO: 159340

SEQ ID NO: 588441 - RNA, 64 nt, hsa; identical to SEQ ID NO: 159341

SEQ ID NO: 588442 - RNA, 64 nt, hsa; identical to SEQ ID NO: 159342

SEQ ID NO: 588443 - RNA, 64 nt, hsa; identical to SEQ ID NO: 159343

SEQ ID NO: 588444 - RNA, 64 nt, hsa; identical to SEQ ID NO: 159344

SEQ ID NO: 588445 - RNA, 64 nt, hsa; identical to SEQ ID NO: 159345

SEQ ID NO: 588446 - RNA, 64 nt, hsa; identical to SEQ ID NO: 159346

SEQ ID NO: 588447 - RNA, 64 nt, hsa; identical to SEQ ID NO: 159347

SEQ ID NO: 588448 - RNA, 64 nt, hsa; identical to SEQ ID NO: 159348

SEQ ID NO: 588449 - RNA, 64 nt, hsa; identical to SEQ ID NO: 159349

SEQ ID NO: 588450 - RNA, 64 nt, hsa; identical to SEQ ID NO: 159350

SEQ ID NO: 588451 - RNA, 64 nt, hsa; identical to SEQ ID NO: 159351

SEQ ID NO: 588452 - RNA, 64 nt, hsa; identical to SEQ ID NO: 159352

SEQ ID NO: 588453 - RNA, 64 nt, hsa; identical to SEQ ID NO: 159353

SEQ ID NO: 588454 - RNA, 64 nt, hsa; identical to SEQ ID NO: 159354

SEQ ID NO: 588455 - RNA, 64 nt, hsa; identical to SEQ ID NO: 159355

SEQ ID NO: 588456 - RNA, 64 nt, hsa; identical to SEQ ID NO: 159356

SEQ ID NO: 588457 - RNA, 64 nt, hsa; identical to SEQ ID NO: 159357

SEQ ID NO: 588458 - RNA, 64 nt, hsa; identical to SEQ ID NO: 159358

SEQ ID NO: 588459 - RNA, 64 nt, hsa; identical to SEQ ID NO: 159359

SEQ ID NO: 588460 - RNA, 64 nt, hsa; identical to SEQ ID NO: 159360

SEQ ID NO: 588461 - RNA, 64 nt, hsa; identical to SEQ ID NO: 159361

SEQ ID NO: 588462 - RNA, 64 nt, hsa; identical to SEQ ID NO: 159362

SEQ ID NO: 588463 - RNA, 64 nt, hsa; identical to SEQ ID NO: 159363

SEQ ID NO: 588464 - RNA, 64 nt, hsa; identical to SEQ ID NO: 159364

SEQ ID NO: 588465 - RNA, 64 nt, hsa; identical to SEQ ID NO: 159365

SEQ ID NO: 588466 - RNA, 64 nt, hsa; identical to SEQ ID NO: 159366

SEQ ID NO: 588467 - RNA, 64 nt, hsa; identical to SEQ ID NO: 159365

SEQ ID NO: 588468 - RNA, 64 nt, hsa; identical to SEQ ID NO: 159368

SEQ ID NO: 588469 - RNA, 64 nt, hsa; identical to SEQ ID NO: 159369

SEQ ID NO: 588470 - RNA, 64 nt, hsa; identical to SEQ ID NO: 159370

SEQ ID NO: 588471 - RNA, 64 nt, hsa; identical to SEQ ID NO: 159371

SEQ ID NO: 588472 - RNA, 64 nt, hsa; identical to SEQ ID NO: 159372

SEQ ID NO: 588473 - RNA, 64 nt, hsa; identical to SEQ ID NO: 159373

SEQ ID NO: 588474 - RNA, 64 nt, hsa; identical to SEQ ID NO: 159374

SEQ ID NO: 588475 - RNA, 64 nt, hsa; identical to SEQ ID NO: 159375

SEQ ID NO: 588476 - RNA, 64 nt, hsa; identical to SEQ ID NO: 159376

SEQ ID NO: 588477 - RNA, 64 nt, hsa; identical to SEQ ID NO: 159377

SEQ ID NO: 588478 - RNA, 64 nt, hsa; identical to SEQ ID NO: 318507

SEQ ID NO: 588479 - RNA, 64 nt, hsa; identical to SEQ ID NO: 318508

SEQ ID NO: 588480 - RNA, 64 nt, hsa; identical to SEQ ID NO: 318509

SEQ ID NO: 588481 - RNA, 64 nt, hsa; identical to SEQ ID NO: 318510

SEQ ID NO: 588482 - RNA, 64 nt, hsa; identical to SEQ ID NO: 318511

SEQ ID NO: 588483 - RNA, 64 nt, hsa; identical to SEQ ID NO: 318512

SEQ ID NO: 588484 - RNA, 64 nt, hsa; identical to SEQ ID NO: 318513

SEQ ID NO: 588485 - RNA, 64 nt, hsa; identical to SEQ ID NO: 318514

SEQ ID NO: 588486 - RNA, 64 nt, hsa; identical to SEQ ID NO: 318515

SEQ ID NO: 588487 - RNA, 64 nt, hsa; identical to SEQ ID NO: 318516

SEQ ID NO: 588488 - RNA, 64 nt, hsa; identical to SEQ ID NO: 318517

SEQ ID NO: 588489 - RNA, 64 nt, hsa; identical to SEQ ID NO: 318518

SEQ ID NO: 588490 - RNA, 64 nt, hsa; identical to SEQ ID NO: 318519

SEQ ID NO: 588491 - RNA, 64 nt, hsa; identical to SEQ ID NO: 318520

SEQ ID NO: 588492 - RNA, 64 nt, hsa; identical to SEQ ID NO: 318521

SEQ ID NO: 588493 - RNA, 64 nt, hsa; identical to SEQ ID NO: 318522

SEQ ID NO: 588494 - RNA, 57 nt, hsa; identical to SEQ ID NO: 318523

SEQ ID NO: 588495 - RNA, 64 nt, hsa; identical to SEQ ID NO: 318524

SEQ ID NO: 588496 - RNA, 64 nt, hsa; identical to SEQ ID NO: 318525

SEQ ID NO: 588497 - RNA, 64 nt, hsa; identical to SEQ ID NO: 532235

SEQ ID NO: 588498 - RNA, 64 nt, hsa; identical to SEQ ID NO: 532236

SEQ ID NO: 588499 - RNA, 64 nt, hsa; identical to SEQ ID NO: 532237

SEQ ID NO: 588500 - RNA, 63 nt, hsa; identical to SEQ ID NO: 532238

SEQ ID NO: 588501 - RNA, 50 nt, hsa; identical to SEQ ID NO: 532239

SEQ ID NO: 588502 - RNA, 64 nt, hsa; identical to SEQ ID NO: 532240

SEQ ID NO: 588503 - RNA, 64 nt, hsa; identical to SEQ ID NO: 532241

SEQ ID NO: 588504 - RNA, 61 nt, hsa; identical to SEQ ID NO: 532242

SEQ ID NO: 588505 - RNA, 64 nt, hsa; identical to SEQ ID NO: 532243

SEQ ID NO: 588506 - RNA, 64 nt, hsa; identical to SEQ ID NO: 532244

SEQ ID NO: 588507 - RNA, 64 nt, hsa; identical to SEQ ID NO: 532245

SEQ ID NO: 588508 - RNA, 64 nt, hsa; identical to SEQ ID NO: 532246

SEQ ID NO: 588509 - RNA, 64 nt, hsa; identical to SEQ ID NO: 532247

SEQ ID NO: 588510 - RNA, 64 nt, hsa; identical to SEQ ID NO: 532248

SEQ ID NO: 588511 - RNA, 64 nt, hsa; identical to SEQ ID NO: 532249

SEQ ID NO: 588512 - RNA, 64 nt, hsa; identical to SEQ ID NO: 532250

SEQ ID NO: 588513 - RNA, 64 nt, hsa; identical to SEQ ID NO: 532251

SEQ ID NO: 588514 - RNA, 64 nt, hsa; identical to SEQ ID NO: 532252

SEQ ID NO: 588515 - RNA, 64 nt, hsa; identical to SEQ ID NO: 532253

SEQ ID NO: 588516 - RNA, 64 nt, hsa; identical to SEQ ID NO: 532254

SEQ ID NO: 588517 - RNA, 64 nt, hsa; identical to SEQ ID NO: 532255

SEQ ID NO: 588518 - RNA, 64 nt, hsa; identical to SEQ ID NO: 532256

SEQ ID NO: 588519 - RNA, 64 nt, hsa; identical to SEQ ID NO: 138645

SEQ ID NO: 588520 - RNA, 64 nt, hsa; identical to SEQ ID NO: 138646

SEQ ID NO: 588521 - RNA, 64 nt, hsa; identical to SEQ ID NO: 138647

SEQ ID NO: 588522 - RNA, 64 nt, hsa; identical to SEQ ID NO: 138648

SEQ ID NO: 588523 - RNA, 64 nt, hsa; identical to SEQ ID NO: 138649

SEQ ID NO: 588524 - RNA, 64 nt, hsa; identical to SEQ ID NO: 138650

SEQ ID NO: 588525 - RNA, 64 nt, hsa
gaaacuugauuugagauuuuuaugccugugacuuccuuggaaaucaaauguaaaguuuaauuga

SEQ ID NO: 588526 - RNA, 64 nt, hsa
ugcauaguucccaugcacgcugggcaaugagaauccuuggaaacauuggugaugcuaucaguuu

SEQ ID NO: 588527 - RNA, 64 nt, hsa
accuaauccacagaaaguaaugucuuuccccuccccuuggaauuuuuguuuuguuuuuggaaau

SEQ ID NO: 588528 - RNA, 64 nt, hsa
aggccccguccugccgugacacccuucauccuacccuuggaaccccaaggccaaguugguucaa

SEQ ID NO: 588529 - RNA, 64 nt, hsa
gaaccgacugaguaaugaagaagaggaaggaagcccuuggaaggaacguaaaauccauuucagc

SEQ ID NO: 588530 - RNA, 64 nt, hsa
ggaaggaacguaaaauccauuucagccugccgccccuuggaauggagggucuucuagggaccag

SEQ ID NO: 588531 - RNA, 64 nt, hsa
uuggaaauagaaagaagccauauaugaccagaagccuuggaaccagccccaucagaaccugagc

SEQ ID NO: 588532 - RNA, 64 nt, hsa
ccaaccucuuuuuccuccuggacacauuggaaugccuuggaaauagaaagaagccauauaugac

SEQ ID NO: 588533 - RNA, 64 nt, hsa
cucuggccacugugggagggaaggacaaggguucccuuggaaaugugaagggucuuggccucau

SEQ ID NO: 588534 - RNA, 64 nt, hsa
cuuucucucuggaaaguugaaguaucuccaaaggccuuggaaauggcacaaaggugauaaggag

SEQ ID NO: 588535 - RNA, 64 nt, hsa
gcacaauuauucaggacugaacugcuuugaggugccuuggaacuggcuuuggaaauagcuaucu

SEQ ID NO: 588536 - RNA, 64 nt, hsa
gcaagaggcagaaacacugacucugagaccaugaccuuggaagauccucagagaucaacuagcc

SEQ ID NO: 588537 - RNA, 64 nt, hsa
ggaagggaaagccugaggccggcauaaggggaggccuuggaaccugagcugccaaugccagccc

SEQ ID NO: 588538 - RNA, 64 nt, hsa
agagcccuucuucccaucaaaaagguaucaaaugccuuggaagcucccugauccuacaaaacaa

SEQ ID NO: 588539 - RNA, 64 nt, hsa
aagaaaacagcauggccaguaaacugagcaagggccuuggaauccuugagaaucacauuuaugu

SEQ ID NO: 588540 - RNA, 64 nt, hsa
accucuaagcuccuuucacagaaaucgucaucugccuuggaaugcaaauaguucuuauuugcca

SEQ ID NO: 588541 - RNA, 64 nt, hsa
aaugagcugucugcaggaggugaagcaguguuuuccuuggaauguuugaggaccugcaauagaa

SEQ ID NO: 588542 - RNA, 64 nt, hsa
ccacugagcacauggggucuuucaggauccucucccuuggaagggcaaugugugagcuaaggac

SEQ ID NO: 588543 - RNA, 64 nt, hsa
gagucaccagaugaggcucuaaacagaucgcaucccuuggaauuagaaagcaguggagaccggg

SEQ ID NO: 588544 - RNA, 64 nt, hsa
cugugcuuacauaccuuugucaucucucuuccccccuuggaaguuguccucagggggauuuguu

SEQ ID NO: 588545 - RNA, 64 nt, hsa
gcagaacgaugugcacccucugcguuuuggauguccuuggaaugugggagccuagaaauaaccc

SEQ ID NO: 588546 - RNA, 64 nt, hsa
uucaauguagcaaagcauuccuaguuaaccagagccuuggaaucuacugccugcuggccaggcu

SEQ ID NO: 588547 - RNA, 64 nt, hsa
augaguaacuuacauucucuuaauuguaaugguuccuuggaaagucaucguggaaaaugaaggc

SEQ ID NO: 588548 - RNA, 64 nt, hsa
ugguuaaauuaaaaaaaaaaaagagcacgacaaaccuuggaaaucaagaaaguucuggaaugau

SEQ ID NO: 588549 - RNA, 64 nt, hsa
cagacagucuuugaguaacaucuguucccaucuuccuuggaagcaggacacaccagcuccuccg

SEQ ID NO: 588550 - RNA, 64 nt, hsa
ggcagcccucuaccugggccccgggagccgugcuccuuggaacgcaaagggccgaggagcaucu

SEQ ID NO: 588551 - RNA, 64 nt, hsa
uagccaaauucugucuccugcauacacuccggcaugcauccaacaccaauggcuuucuagauga

SEQ ID NO: 588552 - RNA, 64 nt, hsa
uuugagauucaagaaaaauuucuauucuuuuuuuugcauccaauugugccugaacuuuuaaaau

SEQ ID NO: 588553 - RNA, 64 nt, hsa
acuggagggccaugauggcaucgugcuggcucucugcauccaggggugaguccaggcacaugug

SEQ ID NO: 588554 - RNA, 64 nt, hsa
uuacucauagaucugggacauccgaacccuugacugcauccacguccugcagacgucugguggc

SEQ ID NO: 588555 - RNA, 64 nt, hsa
ugggauccacgucuagggaccacucuggcuucugugcauccacccaggcccccgacccaucacu

SEQ ID NO: 588556 - RNA, 64 nt, hsa
ccacauucuccgggucauggccgagcuugaccucugcauccauggugacggagguggcaaugac

SEQ ID NO: 588557 - RNA, 64 nt, hsa; identical to SEQ ID NO: 324616

SEQ ID NO: 588558 - RNA, 64 nt, hsa; identical to SEQ ID NO: 324617

SEQ ID NO: 588559 - RNA, 64 nt, hsa; identical to SEQ ID NO: 54817

SEQ ID NO: 588560 - RNA, 64 nt, hsa; identical to SEQ ID NO: 54818

SEQ ID NO: 588561 - RNA, 64 nt, hsa; identical to SEQ ID NO: 54819

SEQ ID NO: 588562 - RNA, 64 nt, hsa; identical to SEQ ID NO: 54820

SEQ ID NO: 588563 - RNA, 64 nt, hsa; identical to SEQ ID NO: 54821

SEQ ID NO: 588564 - RNA, 64 nt, hsa; identical to SEQ ID NO: 54822

SEQ ID NO: 588565 - RNA, 64 nt, hsa; identical to SEQ ID NO: 54823

SEQ ID NO: 588566 - RNA, 64 nt, hsa; identical to SEQ ID NO: 54824

SEQ ID NO: 588567 - RNA, 64 nt, hsa; identical to SEQ ID NO: 54825

SEQ ID NO: 588568 - RNA, 64 nt, hsa; identical to SEQ ID NO: 54826

SEQ ID NO: 588569 - RNA, 64 nt, hsa; identical to SEQ ID NO: 54827

SEQ ID NO: 588570 - RNA, 64 nt, hsa; identical to SEQ ID NO: 54828

SEQ ID NO: 588571 - RNA, 64 nt, hsa; identical to SEQ ID NO: 54829

SEQ ID NO: 588572 - RNA, 64 nt, hsa; identical to SEQ ID NO: 54830

SEQ ID NO: 588573 - RNA, 64 nt, hsa; identical to SEQ ID NO: 54831

SEQ ID NO: 588574 - RNA, 64 nt, hsa; identical to SEQ ID NO: 54832

SEQ ID NO: 588575 - RNA, 64 nt, hsa; identical to SEQ ID NO: 54833

SEQ ID NO: 588576 - RNA, 64 nt, hsa; identical to SEQ ID NO: 54834

SEQ ID NO: 588577 - RNA, 64 nt, hsa; identical to SEQ ID NO: 54835

SEQ ID NO: 588578 - RNA, 64 nt, hsa; identical to SEQ ID NO: 54836

SEQ ID NO: 588579 - RNA, 64 nt, hsa; identical to SEQ ID NO: 54837

SEQ ID NO: 588580 - RNA, 64 nt, hsa; identical to SEQ ID NO: 54838

SEQ ID NO: 588581 - RNA, 64 nt, hsa; identical to SEQ ID NO: 54839

SEQ ID NO: 588582 - RNA, 64 nt, hsa; identical to SEQ ID NO: 54840

SEQ ID NO: 588583 - RNA, 64 nt, hsa; identical to SEQ ID NO: 54841

SEQ ID NO: 588584 - RNA, 64 nt, hsa; identical to SEQ ID NO: 54842

SEQ ID NO: 588585 - RNA, 64 nt, hsa; identical to SEQ ID NO: 54843

SEQ ID NO: 588586 - RNA, 64 nt, hsa; identical to SEQ ID NO: 54844

SEQ ID NO: 588587 - RNA, 64 nt, hsa; identical to SEQ ID NO: 54845

SEQ ID NO: 588588 - RNA, 64 nt, hsa; identical to SEQ ID NO: 54846

SEQ ID NO: 588589 - RNA, 64 nt, hsa; identical to SEQ ID NO: 54847

SEQ ID NO: 588590 - RNA, 64 nt, hsa; identical to SEQ ID NO: 54848

SEQ ID NO: 588591 - RNA, 64 nt, hsa; identical to SEQ ID NO: 54849

SEQ ID NO: 588592 - RNA, 64 nt, hsa; identical to SEQ ID NO: 54850

SEQ ID NO: 588593 - RNA, 64 nt, hsa; identical to SEQ ID NO: 54851

SEQ ID NO: 588594 - RNA, 64 nt, hsa; identical to SEQ ID NO: 54852

SEQ ID NO: 588595 - RNA, 64 nt, hsa; identical to SEQ ID NO: 54853

SEQ ID NO: 588596 - RNA, 64 nt, hsa; identical to SEQ ID NO: 54854

SEQ ID NO: 588597 - RNA, 64 nt, hsa; identical to SEQ ID NO: 54855

SEQ ID NO: 588598 - RNA, 64 nt, hsa; identical to SEQ ID NO: 54856

SEQ ID NO: 588599 - RNA, 64 nt, hsa; identical to SEQ ID NO: 54857

SEQ ID NO: 588600 - RNA, 64 nt, hsa; identical to SEQ ID NO: 54858

SEQ ID NO: 588601 - RNA, 64 nt, hsa; identical to SEQ ID NO: 54859

SEQ ID NO: 588602 - RNA, 64 nt, hsa; identical to SEQ ID NO: 54860

SEQ ID NO: 588603 - RNA, 64 nt, hsa; identical to SEQ ID NO: 54861

SEQ ID NO: 588604 - RNA, 64 nt, hsa; identical to SEQ ID NO: 54862

SEQ ID NO: 588605 - RNA, 64 nt, hsa; identical to SEQ ID NO: 54863

SEQ ID NO: 588606 - RNA, 64 nt, hsa; identical to SEQ ID NO: 54864

SEQ ID NO: 588607 - RNA, 64 nt, hsa; identical to SEQ ID NO: 54865

SEQ ID NO: 588608 - RNA, 64 nt, hsa; identical to SEQ ID NO: 54866

SEQ ID NO: 588609 - RNA, 64 nt, hsa; identical to SEQ ID NO: 54867

SEQ ID NO: 588610 - RNA, 64 nt, hsa; identical to SEQ ID NO: 54868

SEQ ID NO: 588611 - RNA, 64 nt, hsa; identical to SEQ ID NO: 54869

SEQ ID NO: 588612 - RNA, 64 nt, hsa; identical to SEQ ID NO: 54870

SEQ ID NO: 588613 - RNA, 64 nt, hsa; identical to SEQ ID NO: 54871

SEQ ID NO: 588614 - RNA, 64 nt, hsa; identical to SEQ ID NO: 54872

SEQ ID NO: 588615 - RNA, 64 nt, hsa; identical to SEQ ID NO: 54870

SEQ ID NO: 588616 - RNA, 64 nt, hsa; identical to SEQ ID NO: 54871

SEQ ID NO: 588617 - RNA, 64 nt, hsa; identical to SEQ ID NO: 54872

SEQ ID NO: 588618 - RNA, 64 nt, hsa; identical to SEQ ID NO: 54870

SEQ ID NO: 588619 - RNA, 64 nt, hsa; identical to SEQ ID NO: 54877

SEQ ID NO: 588620 - RNA, 64 nt, hsa; identical to SEQ ID NO: 54878

SEQ ID NO: 588621 - RNA, 64 nt, hsa; identical to SEQ ID NO: 54879

SEQ ID NO: 588622 - RNA, 64 nt, hsa; identical to SEQ ID NO: 54880

SEQ ID NO: 588623 - RNA, 64 nt, hsa; identical to SEQ ID NO: 54881

SEQ ID NO: 588624 - RNA, 64 nt, hsa; identical to SEQ ID NO: 54882

SEQ ID NO: 588625 - RNA, 64 nt, hsa; identical to SEQ ID NO: 54883

SEQ ID NO: 588626 - RNA, 64 nt, hsa; identical to SEQ ID NO: 54884

SEQ ID NO: 588627 - RNA, 64 nt, hsa; identical to SEQ ID NO: 54885

SEQ ID NO: 588628 - RNA, 64 nt, hsa; identical to SEQ ID NO: 54886

SEQ ID NO: 588629 - RNA, 64 nt, hsa; identical to SEQ ID NO: 54887

SEQ ID NO: 588630 - RNA, 64 nt, hsa; identical to SEQ ID NO: 54888

SEQ ID NO: 588631 - RNA, 64 nt, hsa; identical to SEQ ID NO: 54889

SEQ ID NO: 588632 - RNA, 64 nt, hsa; identical to SEQ ID NO: 54890

SEQ ID NO: 588633 - RNA, 64 nt, hsa; identical to SEQ ID NO: 54891

SEQ ID NO: 588634 - RNA, 64 nt, hsa; identical to SEQ ID NO: 54892

SEQ ID NO: 588635 - RNA, 64 nt, hsa; identical to SEQ ID NO: 54893

SEQ ID NO: 588636 - RNA, 64 nt, hsa; identical to SEQ ID NO: 54894

SEQ ID NO: 588637 - RNA, 64 nt, hsa; identical to SEQ ID NO: 54895

SEQ ID NO: 588638 - RNA, 64 nt, hsa; identical to SEQ ID NO: 54896

SEQ ID NO: 588639 - RNA, 64 nt, hsa
gccagaagaaauugaggauguuuccuuucacagcugcuccaagccuguugcccaauucacggua

SEQ ID NO: 588640 - RNA, 64 nt, hsa
gcuccaguaagaaucacagugcugggaaucuaguugcuccaauaugaggcagcuucaugugcag

SEQ ID NO: 588641 - RNA, 64 nt, hsa
gucagaagcaaacaggagcggcaacuucuaacuuugcuccaagccacucucuuuuuaaacagca

SEQ ID NO: 588642 - RNA, 64 nt, hsa
aauggugucuguccagccccucccucugucccugugcuccaagcugcccccggcugcagcccag

SEQ ID NO: 588643 - RNA, 64 nt, hsa
uuuuacuauugaacuguauucuaguggcuguucaugcuccaagacuuuaguuaccgagacauga

SEQ ID NO: 588644 - RNA, 64 nt, hsa
cccugaucucugaccucugcugagugcugggcacugcuccaagggacaggugggccuggcggcc

SEQ ID NO: 588645 - RNA, 64 nt, hsa
aauggcauuugcugauuucauaaaccuuucacgucuggacgaauuaccaaaugccaugaauugc

SEQ ID NO: 588646 - RNA, 64 nt, hsa
aaagcuguucuucucuuagacacaauuucuucaucuggacgagcaguggagagggaaagcaacu

SEQ ID NO: 588647 - RNA, 64 nt, hsa
ugucugcaggagagcaagccaggaggacaugggccuggacgacacggccucgcagcaaagugug

SEQ ID NO: 588648 - RNA, 64 nt, hsa
aggaaacuucacacgucaaaauccauagaagcgccuggacgaggcuuaaagugcuuugugagug

SEQ ID NO: 588649 - RNA, 64 nt, hsa
acuguguccaucugaccccaaaggaguucuugaucuggacgauggauauugcuuccaaugaaag

SEQ ID NO: 588650 - RNA, 64 nt, hsa
uauuaucuuuaauuuugaaaaggcuuauuucauccuggacgaguuuauaauagguggggaaauu

SEQ ID NO: 588651 - RNA, 64 nt, hsa
acaacuggaccaguuugguauuagaaguaggaggcuggacgacuucacccccaaaggguccuga

SEQ ID NO: 588652 - RNA, 64 nt, hsa
caacgcagcacuagcaagcagguucgggacagcccuggacgauuucccgaccgcugcucaggcu

SEQ ID NO: 588653 - RNA, 64 nt, hsa
ugggaacuugacucucucaucugucuaaagaguacuggacgauauaaaaauauauauuuuuuaa

SEQ ID NO: 588654 - RNA, 64 nt, hsa
ugcaugagccgagauggcgccacugcucuccagccuggacgacagagcaagacuccgucucuaa

SEQ ID NO: 588655 - RNA, 64 nt, hsa
gaucauagacagugaucauucaggguucaucucacuggacgaguucaggcagaccuggaagcug

SEQ ID NO: 588656 - RNA, 64 nt, hsa
ugcuuggugaagaaacugugugagcuguccugaccuggacgaugacguggggaaacccuccacc

SEQ ID NO: 588657 - RNA, 64 nt, hsa
ucagccuuaacaggcucagcaaaucagggcguggcuggacgauuuccuugcaucugagggcaga

SEQ ID NO: 588658 - RNA, 64 nt, hsa
ugaguguguuuccugucaccaauggccuguuuggcuggacgaugccucggcuugaccuuuuuug

SEQ ID NO: 588659 - RNA, 64 nt, hsa
ugaaagcucagauuaagcaagccaugccaagaaacuggacgauguguaagccuagacucuaaaa

SEQ ID NO: 588660 - RNA, 64 nt, hsa
uuugcaaaugucuuucucucaaugaagagcauaucuggacgacugugcaaugcugugugcuccc

SEQ ID NO: 588661 - RNA, 64 nt, hsa
cagcuggggcgaaggagcaccggccugggucuugcuggacgaguguggccuagagcugggggag

SEQ ID NO: 588662 - RNA, 64 nt, hsa
ggcugggccuccgccccugcaccagucacaugcacuggacgagggccgaaacuccugucugcua

SEQ ID NO: 588663 - RNA, 64 nt, hsa
cuaaucuucaucaaacaaaaaaugaaaagucugucuggacgaaggggagugagcuugagccuuu

SEQ ID NO: 588664 - RNA, 51 nt, hsa
ggcaugucggcgucagaugagcuggacgacucacaggugcgucagaugcug

SEQ ID NO: 588665 - RNA, 64 nt, hsa
cggagugacgggcgcccggccccacucuccggaucuggacgaugggcucacgccaggaacgccg

SEQ ID NO: 588666 - RNA, 64 nt, hsa
uccucgcugauuagcuuccugccugcugucagugcuggacgaagugcuauaacuacuuuaugua

SEQ ID NO: 588667 - RNA, 64 nt, hsa
aagggugagggucacucccucccagaagccccgucuggacgagccuugccugaccucuucggug

SEQ ID NO: 588668 - RNA, 64 nt, hsa
cgagggguacaaggccagccacaagccggaggaacuggacgagcacgcgcugguggagcuggag

SEQ ID NO: 588669 - RNA, 64 nt, hsa
ucaucuccugaggcucuuccugcugcugcucucccuggacgaccggccucgaggcaacccuggg

SEQ ID NO: 588670 - RNA, 64 nt, hsa
ccccgcacgccaugagcccgccgcgggccauacgcuggacgagucggaccgaggcuaggacgug

SEQ ID NO: 588671 - RNA, 64 nt, hsa
aacaccccacggggcuguuuguccacgacccaggcuggacgaaugccuggucagagggugaccu

SEQ ID NO: 588672 - RNA, 64 nt, hsa
ucuuucuuuaaaaagaaagaggguugaaaauccucuggacgaacagaagucacuuuggcuguuc

SEQ ID NO: 588673 - RNA, 64 nt, hsa
gcagugagccaagaucacgccacugcauuccagccuggacgacagagcgagacuccgucucaaa

SEQ ID NO: 588674 - RNA, 64 nt, hsa
ccacuccuguaguuucuuuucuguaaaaugggaucuggacgaaugauaccaaacguuucuuucu

SEQ ID NO: 588675 - RNA, 64 nt, hsa
acagugagucgagaucgcgccacugcacuccagccuggacgacagagugagauucugucucaaa

SEQ ID NO: 588676 - RNA, 64 nt, hsa
aauagacauagccggcauaucucauggucaggagcuggacgauucugguaacuuaggcuuuuuu

SEQ ID NO: 588677 - RNA, 64 nt, hsa
ucaccgggagccacgccgugcauggcagccuucccuggacgagcgcucgguguucacacugaac

SEQ ID NO: 588678 - RNA, 64 nt, hsa
ccagcggcacggccugaggcggcgguggacugcgcuggacgauagcuuggagggauggagaggc

SEQ ID NO: 588679 - RNA, 64 nt, hsa
uaguccuccagcucuuuuauugagcauccacgugcuggacgauacuuauuuacaauuccuaagu

SEQ ID NO: 588680 - RNA, 64 nt, hsa
cccccgccacaggauccagagcaagcaccgcccccuggacgagcgggcccugcaggucugcugg

SEQ ID NO: 588681 - RNA, 64 nt, hsa
gcuagagaagagccuggagcucaaguuugacguccuggacgaaaaccagagcaagcucagcgag

SEQ ID NO: 588682 - RNA, 64 nt, hsa
gugaccucgggaauggcaauuuuuugggcggccccuggacgaaggucugaaucccgacucugau

SEQ ID NO: 588683 - RNA, 58 nt, hsa
gccuggcccugcaggucugagcccgggacuggacgagcaguagauccagcagccugca

SEQ ID NO: 588684 - RNA, 64 nt, hsa
acagugagcugagaucgugccacugcacuccauccuggacgacagagugagacucugucucaaa

SEQ ID NO: 588685 - RNA, 64 nt, hsa
ccucaccuacaugcccucccagccccucccaucucuggacgaggccuccuuccucagguuccuc

SEQ ID NO: 588686 - RNA, 64 nt, hsa
gaaaaucauuugaggucagaaguucaaggccagccuggacgacauagcgagacuccaccucuac

SEQ ID NO: 588687 - RNA, 64 nt, hsa
acagcagcuucuugaaacauuugcauagaauucacuggacgaauuaagccugcacucauauggc

SEQ ID NO: 588688 - RNA, 64 nt, hsa
gaggcggagguugcaguuagcugagauugcgccacuggacgacagagcgagacucagucucaaa

SEQ ID NO: 588689 - RNA, 64 nt, hsa
aaucaggggagaggagaggccugauggggcagagcuggacgaagucugcuaagagagauggagg

SEQ ID NO: 588690 - RNA, 64 nt, hsa
aggcugcagcggcagcuccagauggccuccugagcuggacgaccccaggucuccagacaucuag

SEQ ID NO: 588691 - RNA, 64 nt, hsa
gaagcgccccaggaagggcgccgagugcccucuccuggacgaucgcgggucgcagaagcccagg

SEQ ID NO: 588692 - RNA, 64 nt, hsa
ggccuaggguuccagacugguuggacuuguucgucuggacgacacuggaguggaacacugccuc

SEQ ID NO: 588693 - RNA, 64 nt, hsa
ugauuggacuugcgaauagccacugcacugcggccuggacgacguagugauacccugacucuua

SEQ ID NO: 588694 - RNA, 64 nt, hsa
gcaguaagccgagaucgcgccacugcacuccagccuggacgacagagcaagacuccgucucaaa

SEQ ID NO: 588695 - RNA, 64 nt, hsa
ccuuauggagugagcagccaccuuugggcucauucuggacgacgugucuuugacacaucugacc

SEQ ID NO: 588696 - RNA, 64 nt, hsa
caccucgucuugaaucugaccuuguccaagaaggcuggacgagagaccuucuguccccucccag

SEQ ID NO: 588697 - RNA, 64 nt, hsa
ucuucaguagaugaccuggcuguaaagagauucccuggacgagccagaucauucaguuucagcg

SEQ ID NO: 588698 - RNA, 64 nt, hsa
auaaaaucuguuuucagccugacugcuuuagucacuggacgagcaucagcuacugcggugucag

SEQ ID NO: 588699 - RNA, 64 nt, hsa
acuuccucugaacuguuacugccugaauggaguccuggacgacauuggguuuuuccucuaggag

SEQ ID NO: 588700 - RNA, 64 nt, hsa
cagcucugcaucggccuugcaggaacaacaccuccuggacgagcucucucgggcccaggccugg

SEQ ID NO: 588701 - RNA, 64 nt, hsa
uugugucuggcuugcugaguguaaaaguuguuaucuggacgaucugucucucugcuccaaagaa

SEQ ID NO: 588702 - RNA, 64 nt, hsa
gcagaagcugggcccugaacacacggggccaugucuggacgagcaggggagagaggcugaacug

SEQ ID NO: 588703 - RNA, 64 nt, hsa
caucuguucaaaaauugugacauugggcaugaggcuggacgacuuguuaauguaguuguuucua

SEQ ID NO: 588704 - RNA, 64 nt, hsa
gccucaggaucuggagaugcaguuccagaggauccuggacgaccccuccccaccucagccuggg

SEQ ID NO: 588705 - RNA, 64 nt, hsa
augugauuugguaccauuucacaccagcaggugucuggacgaaaacaucaaugugaauaagggc

SEQ ID NO: 588706 - RNA, 64 nt, hsa
gcagugagcccugauugugccagugcacuccagccuggacgacagagcaagacccuguauuaaa

SEQ ID NO: 588707 - RNA, 64 nt, hsa; identical to SEQ ID NO: 334582

SEQ ID NO: 588708 - RNA, 64 nt, hsa; identical to SEQ ID NO: 334583

SEQ ID NO: 588709 - RNA, 64 nt, hsa; identical to SEQ ID NO: 334584

SEQ ID NO: 588710 - RNA, 64 nt, hsa; identical to SEQ ID NO: 334585

SEQ ID NO: 588711 - RNA, 64 nt, hsa; identical to SEQ ID NO: 334586

SEQ ID NO: 588712 - RNA, 64 nt, hsa; identical to SEQ ID NO: 334587

SEQ ID NO: 588713 - RNA, 64 nt, hsa; identical to SEQ ID NO: 84166

SEQ ID NO: 588714 - RNA, 64 nt, hsa; identical to SEQ ID NO: 84167

SEQ ID NO: 588715 - RNA, 64 nt, hsa; identical to SEQ ID NO: 84168

SEQ ID NO: 588716 - RNA, 64 nt, hsa; identical to SEQ ID NO: 84169

SEQ ID NO: 588717 - RNA, 64 nt, hsa; identical to SEQ ID NO: 84170

SEQ ID NO: 588718 - RNA, 64 nt, hsa; identical to SEQ ID NO: 84171

SEQ ID NO: 588719 - RNA, 64 nt, hsa; identical to SEQ ID NO: 84172

SEQ ID NO: 588720 - RNA, 64 nt, hsa; identical to SEQ ID NO: 84173

SEQ ID NO: 588721 - RNA, 64 nt, hsa; identical to SEQ ID NO: 84174

SEQ ID NO: 588722 - RNA, 64 nt, hsa; identical to SEQ ID NO: 84175

SEQ ID NO: 588723 - RNA, 64 nt, hsa; identical to SEQ ID NO: 84176

SEQ ID NO: 588724 - RNA, 64 nt, hsa; identical to SEQ ID NO: 84177

SEQ ID NO: 588725 - RNA, 64 nt, hsa; identical to SEQ ID NO: 84178

SEQ ID NO: 588726 - RNA, 64 nt, hsa; identical to SEQ ID NO: 84179

SEQ ID NO: 588727 - RNA, 64 nt, hsa; identical to SEQ ID NO: 84180

SEQ ID NO: 588728 - RNA, 64 nt, hsa; identical to SEQ ID NO: 84181

SEQ ID NO: 588729 - RNA, 64 nt, hsa; identical to SEQ ID NO: 84182

SEQ ID NO: 588730 - RNA, 64 nt, hsa; identical to SEQ ID NO: 84183

SEQ ID NO: 588731 - RNA, 64 nt, hsa; identical to SEQ ID NO: 84184

SEQ ID NO: 588732 - RNA, 64 nt, hsa; identical to SEQ ID NO: 84185

SEQ ID NO: 588733 - RNA, 64 nt, hsa; identical to SEQ ID NO: 84186

SEQ ID NO: 588734 - RNA, 64 nt, hsa; identical to SEQ ID NO: 84187

SEQ ID NO: 588735 - RNA, 64 nt, hsa; identical to SEQ ID NO: 84188

SEQ ID NO: 588736 - RNA, 64 nt, hsa; identical to SEQ ID NO: 84189

SEQ ID NO: 588737 - RNA, 64 nt, hsa; identical to SEQ ID NO: 84190

SEQ ID NO: 588738 - RNA, 64 nt, hsa; identical to SEQ ID NO: 84191

SEQ ID NO: 588739 - RNA, 64 nt, hsa; identical to SEQ ID NO: 84192

SEQ ID NO: 588740 - RNA, 64 nt, hsa; identical to SEQ ID NO: 84193

SEQ ID NO: 588741 - RNA, 64 nt, hsa; identical to SEQ ID NO: 84194

SEQ ID NO: 588742 - RNA, 64 nt, hsa; identical to SEQ ID NO: 84195

SEQ ID NO: 588743 - RNA, 64 nt, hsa; identical to SEQ ID NO: 84196

SEQ ID NO: 588744 - RNA, 64 nt, hsa; identical to SEQ ID NO: 84197

SEQ ID NO: 588745 - RNA, 64 nt, hsa; identical to SEQ ID NO: 84198

SEQ ID NO: 588746 - RNA, 64 nt, hsa; identical to SEQ ID NO: 84199

SEQ ID NO: 588747 - RNA, 64 nt, hsa; identical to SEQ ID NO: 84200

SEQ ID NO: 588748 - RNA, 64 nt, hsa; identical to SEQ ID NO: 84201

SEQ ID NO: 588749 - RNA, 64 nt, hsa; identical to SEQ ID NO: 84202

SEQ ID NO: 588750 - RNA, 64 nt, hsa; identical to SEQ ID NO: 84203

SEQ ID NO: 588751 - RNA, 64 nt, hsa; identical to SEQ ID NO: 84204

SEQ ID NO: 588752 - RNA, 64 nt, hsa; identical to SEQ ID NO: 84205

SEQ ID NO: 588753 - RNA, 64 nt, hsa; identical to SEQ ID NO: 84206

SEQ ID NO: 588754 - RNA, 64 nt, hsa; identical to SEQ ID NO: 84207

SEQ ID NO: 588755 - RNA, 64 nt, hsa; identical to SEQ ID NO: 84208

SEQ ID NO: 588756 - RNA, 64 nt, hsa; identical to SEQ ID NO: 84209

SEQ ID NO: 588757 - RNA, 64 nt, hsa; identical to SEQ ID NO: 84210

SEQ ID NO: 588758 - RNA, 64 nt, hsa; identical to SEQ ID NO: 84211

SEQ ID NO: 588759 - RNA, 64 nt, hsa; identical to SEQ ID NO: 84212

SEQ ID NO: 588760 - RNA, 64 nt, hsa; identical to SEQ ID NO: 84213

SEQ ID NO: 588761 - RNA, 64 nt, hsa; identical to SEQ ID NO: 84214

SEQ ID NO: 588762 - RNA, 64 nt, hsa; identical to SEQ ID NO: 84215

SEQ ID NO: 588763 - RNA, 64 nt, hsa; identical to SEQ ID NO: 84216

SEQ ID NO: 588764 - RNA, 64 nt, hsa; identical to SEQ ID NO: 84217

SEQ ID NO: 588765 - RNA, 64 nt, hsa; identical to SEQ ID NO: 84218

SEQ ID NO: 588766 - RNA, 64 nt, hsa; identical to SEQ ID NO: 84219

SEQ ID NO: 588767 - RNA, 64 nt, hsa; identical to SEQ ID NO: 84220

SEQ ID NO: 588768 - RNA, 64 nt, hsa; identical to SEQ ID NO: 84221

SEQ ID NO: 588769 - RNA, 64 nt, hsa; identical to SEQ ID NO: 84222

SEQ ID NO: 588770 - RNA, 64 nt, hsa; identical to SEQ ID NO: 84223

SEQ ID NO: 588771 - RNA, 64 nt, hsa; identical to SEQ ID NO: 84224

SEQ ID NO: 588772 - RNA, 64 nt, hsa; identical to SEQ ID NO: 84225

SEQ ID NO: 588773 - RNA, 64 nt, hsa; identical to SEQ ID NO: 84226

SEQ ID NO: 588774 - RNA, 64 nt, hsa; identical to SEQ ID NO: 84227

SEQ ID NO: 588775 - RNA, 64 nt, hsa; identical to SEQ ID NO: 84228

SEQ ID NO: 588776 - RNA, 64 nt, hsa; identical to SEQ ID NO: 84229

SEQ ID NO: 588777 - RNA, 64 nt, hsa; identical to SEQ ID NO: 84230

SEQ ID NO: 588778 - RNA, 64 nt, hsa; identical to SEQ ID NO: 84231

SEQ ID NO: 588779 - RNA, 64 nt, hsa; identical to SEQ ID NO: 84232

SEQ ID NO: 588780 - RNA, 64 nt, hsa; identical to SEQ ID NO: 84233

SEQ ID NO: 588781 - RNA, 64 nt, hsa; identical to SEQ ID NO: 424256

SEQ ID NO: 588782 - RNA, 64 nt, hsa; identical to SEQ ID NO: 424257

SEQ ID NO: 588783 - RNA, 64 nt, hsa; identical to SEQ ID NO: 424258

SEQ ID NO: 588784 - RNA, 64 nt, hsa; identical to SEQ ID NO: 424259

SEQ ID NO: 588785 - RNA, 64 nt, hsa; identical to SEQ ID NO: 424260

SEQ ID NO: 588786 - RNA, 64 nt, hsa; identical to SEQ ID NO: 424261

SEQ ID NO: 588787 - RNA, 64 nt, hsa; identical to SEQ ID NO: 424262

SEQ ID NO: 588788 - RNA, 64 nt, hsa; identical to SEQ ID NO: 424263

SEQ ID NO: 588789 - RNA, 64 nt, hsa; identical to SEQ ID NO: 424264

SEQ ID NO: 588790 - RNA, 64 nt, hsa; identical to SEQ ID NO: 424265

SEQ ID NO: 588791 - RNA, 64 nt, hsa; identical to SEQ ID NO: 424266

SEQ ID NO: 588792 - RNA, 64 nt, hsa; identical to SEQ ID NO: 424267

SEQ ID NO: 588793 - RNA, 64 nt, hsa; identical to SEQ ID NO: 424268

SEQ ID NO: 588794 - RNA, 64 nt, hsa; identical to SEQ ID NO: 424269

SEQ ID NO: 588795 - RNA, 64 nt, hsa; identical to SEQ ID NO: 424270

SEQ ID NO: 588796 - RNA, 64 nt, hsa; identical to SEQ ID NO: 424271

SEQ ID NO: 588797 - RNA, 64 nt, hsa; identical to SEQ ID NO: 424272

SEQ ID NO: 588798 - RNA, 64 nt, hsa; identical to SEQ ID NO: 424273

SEQ ID NO: 588799 - RNA, 64 nt, hsa; identical to SEQ ID NO: 424274

SEQ ID NO: 588800 - RNA, 59 nt, hsa; identical to SEQ ID NO: 424275

SEQ ID NO: 588801 - RNA, 64 nt, hsa; identical to SEQ ID NO: 424276

SEQ ID NO: 588802 - RNA, 64 nt, hsa; identical to SEQ ID NO: 424277

SEQ ID NO: 588803 - RNA, 64 nt, hsa; identical to SEQ ID NO: 550329

SEQ ID NO: 588804 - RNA, 64 nt, hsa; identical to SEQ ID NO: 550330

SEQ ID NO: 588805 - RNA, 64 nt, hsa; identical to SEQ ID NO: 550331

SEQ ID NO: 588806 - RNA, 64 nt, hsa; identical to SEQ ID NO: 550332

SEQ ID NO: 588807 - RNA, 64 nt, hsa; identical to SEQ ID NO: 550333

SEQ ID NO: 588808 - RNA, 64 nt, hsa; identical to SEQ ID NO: 550334

SEQ ID NO: 588809 - RNA, 64 nt, hsa; identical to SEQ ID NO: 550335

SEQ ID NO: 588810 - RNA, 64 nt, hsa; identical to SEQ ID NO: 550336

SEQ ID NO: 588811 - RNA, 64 nt, hsa; identical to SEQ ID NO: 550337

SEQ ID NO: 588812 - RNA, 64 nt, hsa; identical to SEQ ID NO: 550338

SEQ ID NO: 588813 - RNA, 64 nt, hsa; identical to SEQ ID NO: 550339

SEQ ID NO: 588814 - RNA, 64 nt, hsa; identical to SEQ ID NO: 550340

SEQ ID NO: 588815 - RNA, 64 nt, hsa; identical to SEQ ID NO: 550341

SEQ ID NO: 588816 - RNA, 64 nt, hsa; identical to SEQ ID NO: 550342

SEQ ID NO: 588817 - RNA, 64 nt, hsa
gccaccugagaccugcuccacgacccuuccaggcagagccgagaguucgccccaacccuucccc

SEQ ID NO: 588818 - RNA, 64 nt, hsa
aacccggacagcucaguccugccagcagccgcaaagagccgaggcugccaggcccauuuauguc

SEQ ID NO: 588819 - RNA, 63 nt, hsa
gccaccuaaacgaucaguguggugcugcguucuggccaguaaauuccauguuuuuggcuauau

SEQ ID NO: 588820 - RNA, 63 nt, hsa
ucuagaccuuagacacucaagauuacggucccgggccaguaacagcaccugggagcuugguag

SEQ ID NO: 588821 - RNA, 63 nt, hsa
gagaacuaaguaagaaacacaaugccaacagcuggccaguaauuaguguugugcacuucaugu

SEQ ID NO: 588822 - RNA, 63 nt, hsa
auuuauuuauugagaguuuuuuagugcaaucugggccaguauuuuuauagauuaugauuaugu

SEQ ID NO: 588823 - RNA, 63 nt, hsa
gaaaaguuuggcuacuaacaguagcauugugauggccaguauauccaguccauggauaaagaa

SEQ ID NO: 588824 - RNA, 63 nt, hsa
augucagaacagagugcaacccagucacacuguggccaguaaaauacuauugccucauauugu

SEQ ID NO: 588825 - RNA, 63 nt, hsa
gccacaaacaaguacuuuaccccacagcuuaguggccaguaaacacccuggggacuaggaaaa

SEQ ID NO: 588826 - RNA, 63 nt, hsa
agcugucuugguaaaggagagagagagacauggggccaguaauuccggggugcucagaaguuu

SEQ ID NO: 588827 - RNA, 63 nt, hsa
gucccaaggguccacgauguacaaagucauuucggccaguaggugugcagaccccuccccgcc

SEQ ID NO: 588828 - RNA, 63 nt, hsa
cuuccucacuguaucuuugcccagacccaccugggccaguaggccccuguccccagccacaca

SEQ ID NO: 588829 - RNA, 63 nt, hsa
gcccagcccugaccucaggaagugucagagcauggccaguaguuggcagcccgaaagacacac

SEQ ID NO: 588830 - RNA, 63 nt, hsa
ugccacccccugugagcagggauuagguguucaggccaguaucuugggcaugggggagccuuu

SEQ ID NO: 588831 - RNA, 63 nt, hsa
aagacuuaauuuccuuguugagaacaggaaaguggccaguagccaggcaagucauagaauuga

SEQ ID NO: 588832 - RNA, 63 nt, hsa
cagcuuuuuuuuuuuuuuuuuuaaauuggcuuuggccaguagcuaaagugcaagacugaauua

SEQ ID NO: 588833 - RNA, 63 nt, hsa
caaaguuugccaaccauaagugucaaaagcacaggccaguauuaagcagaaguucuaccaccu

SEQ ID NO: 588834 - RNA, 63 nt, hsa
uauacauccuggguaaugagagguggcuuuugcggccaguauuagacuggaaguucauaccua

SEQ ID NO: 588835 - RNA, 63 nt, hsa
gcaggggcagagaaggaagggaccaggggacugggccaguauguggaggauggggccugcgug

SEQ ID NO: 588836 - RNA, 63 nt, hsa
auaucuguuuuuaauguuuuguuucucccuccaggccaguauaaagggacuugaaguauuuuu

SEQ ID NO: 588837 - RNA, 63 nt, hsa
guauaauuuuuaugcucuuugauuaucuaauaaggccaguauuucaaaagcuguucugaauuu

SEQ ID NO: 588838 - RNA, 63 nt, hsa
auagagcuagcuaaucucuacaaacccucuguaggccaguaguucucaaaguguggucucugg

SEQ ID NO: 588839 - RNA, 63 nt, hsa
ugcuagccucucuuacuaauggaauuauauacuggccaguaaaaugggccucccaauugcugu

SEQ ID NO: 588840 - RNA, 63 nt, hsa
augaagugcucucguucucaguagcggcaucauggccaguagugucuuugaggaguucaccac

SEQ ID NO: 588841 - RNA, 63 nt, hsa
auuauugauugugagauagguuagguuuuggggggccaguaguucagugagaauguuuauguu

SEQ ID NO: 588842 - RNA, 63 nt, hsa
uuucucucucccucuuucucucucucuuucguaggccaguagcaauguuguguucacagucua

SEQ ID NO: 588843 - RNA, 63 nt, hsa
ccuucccuuggagagggccuggcuucaacauugggccaguaggcaucuuagcuuggcaggugu

SEQ ID NO: 588844 - RNA, 63 nt, hsa
cucugcacgcuugaccaaagcagugaugagggcggccaguaccugcggugugcgugguagguu

SEQ ID NO: 588845 - RNA, 63 nt, hsa
cguacuaacgucugcaaaccccaagacguuugaggccaguaggaaguugagaaagaaagccac

SEQ ID NO: 588846 - RNA, 63 nt, hsa
ucucuuucucugguggucuuccuucuaccccaaggccaguaguuuugacacuucccaguggaa

SEQ ID NO: 588847 - RNA, 63 nt, hsa
cccuaaacccaacucacguuucuguaugucuuaggccaguaucccaaaccucuuccacgucac

SEQ ID NO: 588848 - RNA, 63 nt, hsa
uguggcucaguggagggagacccagcauagccaggccaguauggagcaccucacgcacagcuc

SEQ ID NO: 588849 - RNA, 63 nt, hsa
uggugaaauugcuguggggguaucgggggauauggccaguaaaguauugagagacuaacaaau

SEQ ID NO: 588850 - RNA, 63 nt, hsa
guugguugccccucaccucagagcucccccaaaggccaguaauggauccccggccucaguccc

SEQ ID NO: 588851 - RNA, 63 nt, hsa
ggugcaggcauagcugccugcugcucuggcagaggccaguaaauacaguuccuagaagcagcc

SEQ ID NO: 588852 - RNA, 63 nt, hsa
ccauaugaccucaugcaucuccaccugcucccaggccaguaagggaaauagaaaaacccugcc

SEQ ID NO: 588853 - RNA, 63 nt, hsa
ggucucauacaaggauauuuggagugaaaugcuggccaguacuuguucucccuugccccaacc

SEQ ID NO: 588854 - RNA, 63 nt, hsa
ucuuucaauccucauuaucuuuagcccucagcuggccaguacuuauugcuaaagaaagggaga

SEQ ID NO: 588855 - RNA, 63 nt, hsa
uuagccuccuucgcaggcauguccuggacaccgggccaguaucuauauauguguauguacguu

SEQ ID NO: 588856 - RNA, 63 nt, hsa
gugcugggauuacaggugugagccaccacacuuggccaguauauccucaguaugaagauauuu

SEQ ID NO: 588857 - RNA, 63 nt, hsa
ugucugcaucugugcuguguguguagugugguuggccaguaggugaguaucccugugugugug

SEQ ID NO: 588858 - RNA, 63 nt, hsa
ugugaguguuuauauagaaaugaacauagaccuggccaguaaaaggcucugaggaggcuuaaa

SEQ ID NO: 588859 - RNA, 63 nt, hsa
gagugcagggaggggcaggaaaggagacaaggaggccaguauggacacuguguccaguauggc

SEQ ID NO: 588860 - RNA, 63 nt, hsa
caguuccccacccagcgauuagggagcugggcuggccaguacagccaguggggaguggguggg

SEQ ID NO: 588861 - RNA, 63 nt, hsa
uucacacagaaaucuguagcacugcuuuuuugaggccaguagcaacauccagagaucauucuu

SEQ ID NO: 588862 - RNA, 63 nt, hsa
auuuggggcaucucuauagaaagugaccaccaaggccaguaaguacgggaaaaaauguuuacu

SEQ ID NO: 588863 - RNA, 63 nt, hsa
cucucucaugacugcacaccccauucaggcagaggccaguacagaggaggagccauuguggca

SEQ ID NO: 588864 - RNA, 63 nt, hsa
ccuuacccucuguaagauacugauucuuccuggggccaguauuaccuuguaugcaaauauuac

SEQ ID NO: 588865 - RNA, 63 nt, hsa
gaaagucacauuuaggguuuauuuuuuacacuuggccaguaaaauaggguaaauccuauuaga

SEQ ID NO: 588866 - RNA, 63 nt, hsa
auuauguacagaauaggaccuauccaguagccaggccaguaggcaguuggggaaggugggaag

SEQ ID NO: 588867 - RNA, 63 nt, hsa
gcuuuauaagugaggguagggugagggaggacaggccaguagggggagggaaagggagagggg

SEQ ID NO: 588868 - RNA, 63 nt, hsa
gccccaggggguuagaggaggggugaagauuggggccaguaucgaucuuaugaagcuggagga

SEQ ID NO: 588869 - RNA, 63 nt, hsa
aguuucugaagucuucacagcucuuaaaagccaggccaguacugacuguguggugguaaaugc

SEQ ID NO: 588870 - RNA, 63 nt, hsa
gugcuuuggguugaaaagaaguuuuuaguccuaggccaguagauggcagcagcuuuucauugc

SEQ ID NO: 588871 - RNA, 63 nt, hsa
aacuguaucuugaggugguaguaaaacacagagggccaguaacgggucguaaugacuuauugu

SEQ ID NO: 588872 - RNA, 63 nt, hsa
cuuuauucuuccaaguucauucauacucaaagaggccaguacuuugccauccuugcacuucug

SEQ ID NO: 588873 - RNA, 63 nt, hsa
gaauuuauagagcauuuuuuuucuuaccaagauggccaguaucauuuuacccccaccucccaa

SEQ ID NO: 588874 - RNA, 63 nt, hsa
ugauauuuaauccuuaaaaccccuuuaaaugagggccaguauuaucucugcuuucagaaguag

SEQ ID NO: 588875 - RNA, 63 nt, hsa
caaauuuaauaacuuuaugggugagguacuuugggccaguagaguauacuacaguuauguuua

SEQ ID NO: 588876 - RNA, 63 nt, hsa
uuuauuuaauacaaucggauuuaauaauuuuguggccaguaaaauuauaccauuggcaugaag

SEQ ID NO: 588877 - RNA, 63 nt, hsa
gggaacgucaggucucucugaggucaggucugaggccaguauccuccagcccucccaaugcca

SEQ ID NO: 588878 - RNA, 63 nt, hsa
agcagagauaacacuucccaacucauuuugugaggccaguauuacccuaauagcaaaaccagg

SEQ ID NO: 588879 - RNA, 63 nt, hsa
aaaaagauggaacuuuuccaauucaguuuuugaggccaguacaaccuugauaacaaaaccuaa

SEQ ID NO: 588880 - RNA, 63 nt, hsa
caggccucuuggcagucacaucucuuccuccgaggccaguaccuuuccauuuauucuuugauc

SEQ ID NO: 588881 - RNA, 63 nt, hsa
guccuggcaggaagccaccauuggagaaggugaggccaguaaccaucucaugggauucgcuau

SEQ ID NO: 588882 - RNA, 63 nt, hsa
gggguacaaaggggcccaugcaggagaugcccuggccaguaggaccuccaacagguuguuucc

SEQ ID NO: 588883 - RNA, 63 nt, hsa
acucuaaauacuaccggagucucuuuguagguuggccaguauauguuuuuagugaaauauuau

SEQ ID NO: 588884 - RNA, 63 nt, hsa
aaaaaguauauuuauugcagaggauguucauaaggccaguaugauuuauaaaugcaaucuccc

SEQ ID NO: 588885 - RNA, 63 nt, hsa
gcuaucauuagccacagguacugcugauuauaaggccaguaaaauuuuaguaccuggagguuu

SEQ ID NO: 588886 - RNA, 63 nt, hsa
ugcugugggcuggucccacacauccaggaaagaggccaguagagaauucugcccacuuuuuau

SEQ ID NO: 588887 - RNA, 63 nt, hsa
cucuaccugaacaaagagaugaauaauuccaugggccaguaugccaguuugaauucucagucu

SEQ ID NO: 588888 - RNA, 63 nt, hsa
ggcuaauaggaauucccuccuggugccaccacuggccaguaccuuuccuaagucuuugcucaa

SEQ ID NO: 588889 - RNA, 52 nt, hsa
ucuuucaggcaaagcacuaaagggccaguaccagugaguggccccaccugug

SEQ ID NO: 588890 - RNA, 63 nt, hsa
augacauaauuuaugucuccauuuuguuguauuggccaguacuuuuacaaaucaaaacaucuc

SEQ ID NO: 588891 - RNA, 63 nt, hsa
ucugagucuagaacccaggcuucuaaauuucuaggccaguacuacugcucucaaaagagauua

SEQ ID NO: 588892 - RNA, 63 nt, hsa
guaccaagugaauuuaaauaauugguguggauuggccaguagcuaagaagugggcuuuuaaag

SEQ ID NO: 588893 - RNA, 63 nt, hsa
ccccccaaccacaggaauggaggcgggacacagggccaguaggagcaauaggauuuuaauaaa

SEQ ID NO: 588894 - RNA, 63 nt, hsa
aucauauuuguauuucagguucuuuuuuaucuuggccaguauauuaugacuaaacgauuauau

SEQ ID NO: 588895 - RNA, 63 nt, hsa
ucauugucugaccaaaauuccuucugcacaugaggccaguauaggcaacgucacauuuguuug

SEQ ID NO: 588896 - RNA, 63 nt, hsa
gcccacugccuaccgcgugagccgcagcccuggggccaguaggaagcggacccgcuccaggua

SEQ ID NO: 588897 - RNA, 63 nt, hsa
guucuuccuacauaaaaugcaagaaaacagcauggccaguaaacugagcaagggccuuggaau

SEQ ID NO: 588898 - RNA, 63 nt, hsa
aacacucuguacugugugcggacccgcagugacggccaguaaaguggacuuaacucccaagug

SEQ ID NO: 588899 - RNA, 63 nt, hsa
augcauuacaacucuguagauuguuaguuacuaggccaguagcuaggaauugguauaaauuua

SEQ ID NO: 588900 - RNA, 63 nt, hsa
uucagagggagccagcucuuuauguuggccccaggccaguacuaagcaaauuaaaaagaccga

SEQ ID NO: 588901 - RNA, 63 nt, hsa
auuauggauaacucgaaagacagcucaggugaaggccaguaaugauuuuuuugaaguuucaau

SEQ ID NO: 588902 - RNA, 63 nt, hsa
agcacagcacuuugguuuugcugagaucgaagaggccaguaggagacacgacagcacacacag

SEQ ID NO: 588903 - RNA, 63 nt, hsa
ccguucuuauagaugauuuuguagaauaugcacggccaguagucacagguggaaaacgcagcc

SEQ ID NO: 588904 - RNA, 63 nt, hsa
uccaggccugaggcugcugacguuugacaccagggccaguagagagugcccuuuuguaucuua

SEQ ID NO: 588905 - RNA, 63 nt, hsa
gauguuuaaucuucauuaauaaauaccucaaauggccaguaacucaauauuacuuuucuuccu

SEQ ID NO: 588906 - RNA, 63 nt, hsa
agugcuuugucuauucuuuauuucucucaggguggccaguauuuugacuuauuuauccugcuu

SEQ ID NO: 588907 - RNA, 63 nt, hsa
uuggucuaacuucuacauuccuacuguuaaaaaggccaguauaucuuaaacaaaugaauaggc

SEQ ID NO: 588908 - RNA, 63 nt, hsa
uaagcacugaauucacuacugaucccaucgccuggccaguagaacagucauuacuccauuaac

SEQ ID NO: 588909 - RNA, 63 nt, hsa
cacugggcccauuugaaggugucucagacauuuggccaguaugucuuucucagggguuugguc

SEQ ID NO: 588910 - RNA, 63 nt, hsa
aguuuuauaagguauuugcauuuuagaagcucuggccaguaguuguuaagauguuggcauuaa

SEQ ID NO: 588911 - RNA, 63 nt, hsa
aagcauucccuuggugaauugucacgugaguggggccaguaagagugaagucugcuccuugaa

SEQ ID NO: 588912 - RNA, 63 nt, hsa
cuagauaaauguggugaaauugccacuagaaagggccaguagcaauguguucuuaauuccuag

SEQ ID NO: 588913 - RNA, 63 nt, hsa
gcuuggcaccuuagcagacugcuggaaccuuuuggccaguaggucgugcccgccuggugccuu

SEQ ID NO: 588914 - RNA, 63 nt, hsa
uauugggacaguccucuucuauauguuuuaaguggccaguaauuuaaugaauuucugguuugu

SEQ ID NO: 588915 - RNA, 63 nt, hsa
ccagguucguauagaaaaagcacagcucucacuggccaguagcugccaaaaagaacacccauc

SEQ ID NO: 588916 - RNA, 63 nt, hsa
ugagaggcaguggccucuugagugaacaggggaggccaguagaugccccagauccagagccgu

SEQ ID NO: 588917 - RNA, 63 nt, hsa
cugguuacccaacuacagaaccuccuuugaucaggccaguagguugugaugcaggcuggagcc

SEQ ID NO: 588918 - RNA, 63 nt, hsa
cucccauagggcuuuuccaagcugccacuggucggccaguacagccuccggaagcagcccuac

SEQ ID NO: 588919 - RNA, 63 nt, hsa
ggaucaugaagucaagaguucgagaccagcaauggccaguauggugaaacccugucucuccua

SEQ ID NO: 588920 - RNA, 63 nt, hsa
agccucuagcuacccuguaucgaggcaaggggaggccaguaaaguuugccaagccugauccug

SEQ ID NO: 588921 - RNA, 63 nt, hsa
aauguaacuaagcauuuguguucugauaucugaggccaguaacuauuaauaucuaguucucag

SEQ ID NO: 588922 - RNA, 63 nt, hsa
uaauaauguuuauaagcugggcauggucgcucaggccaguaaucccagugacuuaggaggcug

SEQ ID NO: 588923 - RNA, 63 nt, hsa
cggccuggcagaggagcccaagggacugaagauggccaguagcuggguccugaggccccugaa

SEQ ID NO: 588924 - RNA, 63 nt, hsa
cugaccucagggcucccagcucggggccuguggggccaguaugcuggucugggagucccuccu

SEQ ID NO: 588925 - RNA, 63 nt, hsa
ugagaaaccuggcagccugcuguuaacaacacaggccaguauuggguuuuauugaauuuggua

SEQ ID NO: 588926 - RNA, 63 nt, hsa
uggauuguauugugagauccugugauuccugguggccaguauccuggauuccucuaagaucuu

SEQ ID NO: 588927 - RNA, 63 nt, hsa
auagaagcagaaaaacauuuagggauaacaucaggccaguagaauuaagccucuccaccuguc

SEQ ID NO: 588928 - RNA, 63 nt, hsa
cacccccaaaguaagaagaaacauguuuccaguggccaguaugucuuucauugcuuugcaccc

SEQ ID NO: 588929 - RNA, 63 nt, hsa
auuaacugccaaaacaagagccugauuuuuugaggccaguaauucguuugcuagaauugauuu

SEQ ID NO: 588930 - RNA, 63 nt, hsa
cuaaugggauccagcagggccauuucuccagagggccaguauccuauuaggagacucuuggaa

SEQ ID NO: 588931 - RNA, 63 nt, hsa
cagaagcgaugggguaccguguaggggagccaaggccaguaguuuggggguaggaguccccua

SEQ ID NO: 588932 - RNA, 63 nt, hsa
agacaccaccuuccugccagcuguuugcccuuaggccaguacacagaauuaaagugggggaga

SEQ ID NO: 588933 - RNA, 63 nt, hsa
aguguaacuaagcauuuguguucugauaucugaggccaguaacuauuaauaucuaguucucag

SEQ ID NO: 588934 - RNA, 63 nt, hsa
auccacuuucuucuaaaauaaagagaagaaaauggccaguauucauccuguccuucucuuucc

SEQ ID NO: 588935 - RNA, 63 nt, hsa
aauguaacuaaguauuuguguucugauaucugaggccaguaacuauuaauaucuaguucucag

SEQ ID NO: 588936 - RNA, 63 nt, hsa
aagcugcggucuccuguuugauaaaagaauauuggccaguauugcagauuuuaacugauuugg

SEQ ID NO: 588937 - RNA, 63 nt, hsa
ccuuucacguauuccgucugcacaggcaaccaaggccaguagaaagcuauggcugcaaaaccc

SEQ ID NO: 588938 - RNA, 63 nt, hsa
aaaaauuggauaaaguauaggaggguuacuuggggccaguaaaucaguagacugaacauucaa

SEQ ID NO: 588939 - RNA, 63 nt, hsa
ccccugcuggucgcuguuucggggacucggggcggccaguaccaccgccugaggcggggcuca

SEQ ID NO: 588940 - RNA, 63 nt, hsa
ggcugcaaugcagcauguugcccuggcaccuguggccaguacucgggacagacuaagggcgcu

SEQ ID NO: 588941 - RNA, 63 nt, hsa
cuguguuggccccugugccucagucccgcggauggccaguagggggcgcuggaggacugcggg

SEQ ID NO: 588942 - RNA, 63 nt, hsa
uuaauccuauuuauccccuggaaugugcgugcuggccaguaggagggcuggcuuuggcagcuc

SEQ ID NO: 588943 - RNA, 63 nt, hsa
aaagagccccccgggucacccccgccccacugaggccaguagggggccaggccucccacuccu

SEQ ID NO: 588944 - RNA, 63 nt, hsa
acuacuaguuauuugugauagcaacauacacauggccaguaaugcucuuguccaggaagaucu

SEQ ID NO: 588945 - RNA, 63 nt, hsa
gauugaguucaucaugagccguugcuaaugccaggccaguaaaaguauaacagcaaauaacca

SEQ ID NO: 588946 - RNA, 63 nt, hsa
ucgccagaggagcacuuggcaaggucagugaggggccaguagacccccggagaagcaguaccg

SEQ ID NO: 588947 - RNA, 63 nt, hsa
ccaucagggaagcuuguuguaacggcuuuugaaggccaguaaccauuguugugguuguguuuu

SEQ ID NO: 588948 - RNA, 63 nt, hsa
uuuugcuuguacagaaucuguagugauuuugguggccaguaaaugccagccauuucucaaacc

SEQ ID NO: 588949 - RNA, 63 nt, hsa
aaaaaugaagucugacuagaauucuauugcagaggccaguacauuuaguauggcauugaguug

SEQ ID NO: 588950 - RNA, 63 nt, hsa
caguuuacuucuaaguaaucacagauaauacauggccaguaaucccaggcuggccauucauuc

SEQ ID NO: 588951 - RNA, 63 nt, hsa
cuugcagcuagcaagguugugugacuaagcccuggccaguaggcauggaagugaagacuguaa

SEQ ID NO: 588952 - RNA, 63 nt, hsa
ucacuguguccacaugagcgaaccccagcacguggccaguaucaucagcuccuucuuacagug

SEQ ID NO: 588953 - RNA, 63 nt, hsa
uuaguggggaaagggacggggugcagacggcagggccaguauggggcccccucccucuccucu

SEQ ID NO: 588954 - RNA, 63 nt, hsa
cuacuuaaguacuugucauguacucuuagaggaggccaguaaugaucagaaccauuuuacuuu

SEQ ID NO: 588955 - RNA, 63 nt, hsa
acagugaccuccacccccgcagcccucuuaaaaggccaguacucuuggggguggggggagggu

SEQ ID NO: 588956 - RNA, 63 nt, hsa
cacccacauucgcugaagcgauggagagucgggggccaguagccagccaaccccguggggacc

SEQ ID NO: 588957 - RNA, 63 nt, hsa
acaguacaggaucuuuggucuacucuaucacaaggccaguaccacacucaugaagaaagaaca

SEQ ID NO: 588958 - RNA, 63 nt, hsa
aaauaugcucacaguuuguagucauguagaaaaggccaguauaaaaauguaguagacuuaaag

SEQ ID NO: 588959 - RNA, 63 nt, hsa
ccggaagggcuccauacugucccaauaaggugaggccaguagcaggaauaauaaaucccacuu

SEQ ID NO: 588960 - RNA, 64 nt, hsa; identical to SEQ ID NO: 68768

SEQ ID NO: 588961 - RNA, 64 nt, hsa; identical to SEQ ID NO: 68769

SEQ ID NO: 588962 - RNA, 64 nt, hsa; identical to SEQ ID NO: 68770

SEQ ID NO: 588963 - RNA, 64 nt, hsa; identical to SEQ ID NO: 68771

SEQ ID NO: 588964 - RNA, 64 nt, hsa; identical to SEQ ID NO: 68772

SEQ ID NO: 588965 - RNA, 64 nt, hsa; identical to SEQ ID NO: 68773

SEQ ID NO: 588966 - RNA, 64 nt, hsa; identical to SEQ ID NO: 68774

SEQ ID NO: 588967 - RNA, 64 nt, hsa; identical to SEQ ID NO: 68775

SEQ ID NO: 588968 - RNA, 64 nt, hsa; identical to SEQ ID NO: 68776

SEQ ID NO: 588969 - RNA, 64 nt, hsa; identical to SEQ ID NO: 68777

SEQ ID NO: 588970 - RNA, 64 nt, hsa; identical to SEQ ID NO: 68778

SEQ ID NO: 588971 - RNA, 64 nt, hsa; identical to SEQ ID NO: 68779

SEQ ID NO: 588972 - RNA, 64 nt, hsa; identical to SEQ ID NO: 68780

SEQ ID NO: 588973 - RNA, 64 nt, hsa; identical to SEQ ID NO: 68781

SEQ ID NO: 588974 - RNA, 64 nt, hsa; identical to SEQ ID NO: 68782

SEQ ID NO: 588975 - RNA, 64 nt, hsa; identical to SEQ ID NO: 68783

SEQ ID NO: 588976 - RNA, 64 nt, hsa; identical to SEQ ID NO: 68784

SEQ ID NO: 588977 - RNA, 64 nt, hsa; identical to SEQ ID NO: 68785

SEQ ID NO: 588978 - RNA, 64 nt, hsa; identical to SEQ ID NO: 68786

SEQ ID NO: 588979 - RNA, 64 nt, hsa; identical to SEQ ID NO: 68787

SEQ ID NO: 588980 - RNA, 64 nt, hsa; identical to SEQ ID NO: 68788

SEQ ID NO: 588981 - RNA, 64 nt, hsa; identical to SEQ ID NO: 68789

SEQ ID NO: 588982 - RNA, 64 nt, hsa; identical to SEQ ID NO: 68790

SEQ ID NO: 588983 - RNA, 64 nt, hsa; identical to SEQ ID NO: 68791

SEQ ID NO: 588984 - RNA, 64 nt, hsa; identical to SEQ ID NO: 68792

SEQ ID NO: 588985 - RNA, 64 nt, hsa; identical to SEQ ID NO: 68793

SEQ ID NO: 588986 - RNA, 64 nt, hsa; identical to SEQ ID NO: 68794

SEQ ID NO: 588987 - RNA, 64 nt, hsa; identical to SEQ ID NO: 68795

SEQ ID NO: 588988 - RNA, 64 nt, hsa; identical to SEQ ID NO: 68796

SEQ ID NO: 588989 - RNA, 64 nt, hsa; identical to SEQ ID NO: 68797

SEQ ID NO: 588990 - RNA, 64 nt, hsa; identical to SEQ ID NO: 68798

SEQ ID NO: 588991 - RNA, 64 nt, hsa; identical to SEQ ID NO: 68799

SEQ ID NO: 588992 - RNA, 64 nt, hsa; identical to SEQ ID NO: 68800

SEQ ID NO: 588993 - RNA, 64 nt, hsa; identical to SEQ ID NO: 68801

SEQ ID NO: 588994 - RNA, 59 nt, hsa; identical to SEQ ID NO: 68802

SEQ ID NO: 588995 - RNA, 64 nt, hsa; identical to SEQ ID NO: 68803

SEQ ID NO: 588996 - RNA, 64 nt, hsa; identical to SEQ ID NO: 68804

SEQ ID NO: 588997 - RNA, 64 nt, hsa; identical to SEQ ID NO: 68805

SEQ ID NO: 588998 - RNA, 64 nt, hsa; identical to SEQ ID NO: 68806

SEQ ID NO: 588999 - RNA, 64 nt, hsa; identical to SEQ ID NO: 68807

SEQ ID NO: 589000 - RNA, 64 nt, hsa; identical to SEQ ID NO: 68808

SEQ ID NO: 589001 - RNA, 64 nt, hsa; identical to SEQ ID NO: 68809

SEQ ID NO: 589002 - RNA, 64 nt, hsa; identical to SEQ ID NO: 68810

SEQ ID NO: 589003 - RNA, 64 nt, hsa; identical to SEQ ID NO: 68811

SEQ ID NO: 589004 - RNA, 64 nt, hsa; identical to SEQ ID NO: 68812

SEQ ID NO: 589005 - RNA, 64 nt, hsa
gcguguauaauuuucuuaacuuguacaguugguaaacuuuuaugagaggaauuguuauucugag

SEQ ID NO: 589006 - RNA, 64 nt, hsa
aguuuuauauagcugauagaccaaccuauauccaaacuuuuauaaaauauuaauuauucuuguu

SEQ ID NO: 589007 - RNA, 64 nt, hsa
aguaugaguuuuuuguuguuuuuguuuuacuuaaaacuuuuaauuuauccagaauggcaguagc

SEQ ID NO: 589008 - RNA, 64 nt, hsa
acccagagcagauacucauaaaguauaaaguaaaaacuuuuaaccauuauuaaacagagaacuu

SEQ ID NO: 589009 - RNA, 64 nt, hsa
ucagaaaauacaagauuuacauaaaggucauuucaacuuuuaagguuaccagugauuguauaaa

SEQ ID NO: 589010 - RNA, 64 nt, hsa
cagacuuccaagugugcuaauucuuuaccuccuaaacuuuuaguugcaauuguuuugcagugua

SEQ ID NO: 589011 - RNA, 64 nt, hsa
gaauacuaauucauuuuaucacuuucauugguaaaacuuuuaaauucaacaccugaaaaucaug

SEQ ID NO: 589012 - RNA, 64 nt, hsa
gugauuauaaagcauuuuuuaagagacaaauuuuaacuuuuaauuuuuauuuuggcaaaacugu

SEQ ID NO: 589013 - RNA, 64 nt, hsa
cgaucacaucuacagaaaauggcuaaaccaaguuaacuuuuauuauagacagugaauaaaacac

SEQ ID NO: 589014 - RNA, 64 nt, hsa
uuuauauuucucguauuuaauaugggugaacaccaacuuuuauuuggaauaauaauuuuccucc

SEQ ID NO: 589015 - RNA, 64 nt, hsa
uuugacuuauuguccccacuaaaacaaaacaaaaaacuuuuaaugccuuccacauuaauuagau

SEQ ID NO: 589016 - RNA, 64 nt, hsa
acuuccuuaacauuuauacauuguuuuaagaaaaaacuuuuaaaaauauuucuuauagucuccu

SEQ ID NO: 589017 - RNA, 64 nt, hsa
gucucagcucugagggucuuugugaguucccaccaacuuuuaauuauucaugcccuugaccaug

SEQ ID NO: 589018 - RNA, 64 nt, hsa
aacauuuuccugugcauuaaccucugcaugugaaaacuuuuaacaguuacugaacuauguaaau

SEQ ID NO: 589019 - RNA, 64 nt, hsa
gaauggggucugugggcuaguuaaaauagaaauaaacuuuuaaaauauccacagaauugauauu

SEQ ID NO: 589020 - RNA, 64 nt, hsa
ggaggagugaguguguucaaagaucaacauauuuaacuuuuaaacacuaucucaaagccagcau

SEQ ID NO: 589021 - RNA, 64 nt, hsa
ggaugaauaacuaccuguggcauuguugguucugaacuuuuacaguucaggccugcugugaauc

SEQ ID NO: 589022 - RNA, 64 nt, hsa
acauuugcucaagaauuuuuuccgucaaauugugaacuuuuaauucuugcauuguaauuggcug

SEQ ID NO: 589023 - RNA, 64 nt, hsa
ugcaaauauuuuaacaauauuaaaugugcaauagaacuuuuauaaaauaauuagaacagagauu

SEQ ID NO: 589024 - RNA, 64 nt, hsa
auaugugaauuaauaggcuguggugccauauauuaacuuuuaauuguguaacuuuuauguuuaa

SEQ ID NO: 589025 - RNA, 64 nt, hsa
ggcuguggugccauauauuaacuuuuaauuguguaacuuuuauguuuaaauuuugcacugcaau

SEQ ID NO: 589026 - RNA, 64 nt, hsa
uuaugcuccaucccauucacuucugcauuccuguaacuuuuaaucccuauguuugucucacuuu

SEQ ID NO: 589027 - RNA, 64 nt, hsa
aauaugcagaaucucugccuagaaucuuuauucaaacuuuuauuagccagugaaacacuugcuu

SEQ ID NO: 589028 - RNA, 64 nt, hsa
ccagcuaauuuuuuauauuuuuuuguagagacaaaacuuuuauuuuuuuuucccauguugcuca

SEQ ID NO: 589029 - RNA, 64 nt, hsa
guguuguaaccauggaaaagucccuuuccaaucaaacuuuuagcaccccuuuccccccaucucu

SEQ ID NO: 589030 - RNA, 64 nt, hsa
cauuuguuuuuguuuggcuguuuguuuauuuuuuaacuuuuauuucgucucaguuuuuggucac

SEQ ID NO: 589031 - RNA, 64 nt, hsa
uagcuguuacuuuuacaguaccugauacuccuaaaacuuuuaacuuauacaaauuagucaauaa

SEQ ID NO: 589032 - RNA, 64 nt, hsa
aacauugcaacucagggcuaaagucauccagugaaacuuuuagagccagaaguaacuuuguccc

SEQ ID NO: 589033 - RNA, 64 nt, hsa
gaacuuuuaccgacuccaaaaaucucaggaauuaaacuuuuaacaguuacagcaauaaagaaua

SEQ ID NO: 589034 - RNA, 64 nt, hsa
gggaaagacauuucuuuccucugcucacuuuaagaacuuuuaccgacuccaaaaaucucaggaa

SEQ ID NO: 589035 - RNA, 64 nt, hsa
ucuagccuaaccuucaacauaaaauaaugaagagaacuuuuaaacuuuuuuaugaauuccuaaa

SEQ ID NO: 589036 - RNA, 64 nt, hsa
aacaaagggauuaaagaccuaaauaugaagacaaaacuuuuaaaugagaaucuauaagguuauu

SEQ ID NO: 589037 - RNA, 64 nt, hsa
ccauuuuguuaaaaaaaaaaaaaaaaaagcacauaacuuuuaacacuagaaucagcccgcaaga

SEQ ID NO: 589038 - RNA, 64 nt, hsa
aggaucuaaauauucagguuuuaagccugcugcaaacuuuuaaaauauuaugauagauucugua

SEQ ID NO: 589039 - RNA, 64 nt, hsa
uaaaauagucucuugaagcccuagucauggaaguaacuuuuauuuuaauugacauucucuuauu

SEQ ID NO: 589040 - RNA, 64 nt, hsa
uucaucagauuuuuguuauauuuuuuggaagugaaacuuuuagcaagugggugucuaguuuuua

SEQ ID NO: 589041 - RNA, 64 nt, hsa
uuguacauuucuguguuuuuuggaggugcaguuaaacuuuuaagcuuaagugugacaggacuga

SEQ ID NO: 589042 - RNA, 64 nt, hsa
acgcuaagcuacuguccaaucucuugugauguguaacuuuuacaugugaauauuaaaguagauu

SEQ ID NO: 589043 - RNA, 64 nt, hsa
cucauuuuuguccaguguuuuucuuuuuaagaugaacuuuuaaagaaccuugcgauuugcacau

SEQ ID NO: 589044 - RNA, 64 nt, hsa
cauuuuucucuccaacauauuuuacaauaaaagcaacuuuuaauuguauagauauauauuuccc

SEQ ID NO: 589045 - RNA, 64 nt, hsa
uguacauuguuuacaucuggauuuuccuguaauaaacuuuuagcaccuaaauugcaagaucuaa

SEQ ID NO: 589046 - RNA, 64 nt, hsa
acuaaaaaugaaaaugauagggcaacaauuuuuuaacuuuuauuuuaaguucaaggguacaugu

SEQ ID NO: 589047 - RNA, 64 nt, hsa
guuacguaccauauuuguaacuaucaacuuuuaaaacuuuuaacguuuuuguuacaugcauugu

SEQ ID NO: 589048 - RNA, 64 nt, hsa
uagaaaauuguuacguaccauauuuguaacuaucaacuuuuaaaacuuuuaacguuuuuguuac

SEQ ID NO: 589049 - RNA, 64 nt, hsa
ugaaucuguuaugauaaagaaaaaauaaaguggaaacuuuuagaguauuacuucauagggcaga

SEQ ID NO: 589050 - RNA, 64 nt, hsa
uaaaauauuuucucaaacuaauucaugaaacagcaacuuuuaccaauaccuuuguauacucuca

SEQ ID NO: 589051 - RNA, 64 nt, hsa
guugauccagcuguacggaaauuuaggguauuuaaacuuuuaaaggaucaugagcuguuucuug

SEQ ID NO: 589052 - RNA, 64 nt, hsa
gaauuuuauuuuuaaaaaauacaugcacacucaaaacuuuuagcuuugaucacaaguggacaaa

SEQ ID NO: 589053 - RNA, 64 nt, hsa
cucucuacaugacauauugagauuuuuuuuaaucaacuuuuaagauagugauguucuguucuaa

SEQ ID NO: 589054 - RNA, 64 nt, hsa
auuaaauaggauucuuagaaguauguccucauagaacuuuuaauacuuaaggcuuuguaaaaac

SEQ ID NO: 589055 - RNA, 64 nt, hsa
auuauuuucuuaguuuuguucuuggacaaauuuaaacuuuuaaaagauuauucaagaugaauuu

SEQ ID NO: 589056 - RNA, 64 nt, hsa
auuagcaaagagguggguucuguuuuccaggugaaacuuuuagcuccaugacagaccagccugu

SEQ ID NO: 589057 - RNA, 64 nt, hsa
ugcugauauucagcaaauuucuaaguuuauggugaacuuuuaacucaauguguaaauagaucug

SEQ ID NO: 589058 - RNA, 64 nt, hsa
auaguguuuuucaaaucuuuaacaucauuuuuucaacuuuuaagauauaauaucaacuauucua

SEQ ID NO: 589059 - RNA, 64 nt, hsa
agaaauuauauuuauaugaaguaaaucacuugacaacuuuuaagggcauguuauuugaagugcu

SEQ ID NO: 589060 - RNA, 64 nt, hsa
ggugacaugauaccuauucgaaacauuuuauacaaacuuuuauagacaaauuguguuuuuauac

SEQ ID NO: 589061 - RNA, 64 nt, hsa
cuuagccuccuucgaccuagucucugcauaccucaacuuuuacguaccaaugcuacucugcugu

SEQ ID NO: 589062 - RNA, 64 nt, hsa
aauacuagcccuuuuuauauauuuacacaagcaaaacuuuuaaauauuugaauugacaguuaca

SEQ ID NO: 589063 - RNA, 64 nt, hsa
uaucugaagguucuuuugcccuuauuaaccucucaacuuuuauugcuguauucuagucagacca

SEQ ID NO: 589064 - RNA, 64 nt, hsa
cagcaauuuauuggcuagucauagaaaauuuuugaacuuuuaacuguauuuuaauugauguuua

SEQ ID NO: 589065 - RNA, 64 nt, hsa
uuugacuuuaauuguaaaagccguuaauguagaaaacuuuuaaaaaaauuaauauggcagaaua

SEQ ID NO: 589066 - RNA, 64 nt, hsa
gcuuguugaucaguguugaagaaagugcaaaaggaacuuuuauauauuugacaguguaggaaau

SEQ ID NO: 589067 - RNA, 64 nt, hsa
uaugguuccuuccuucccuccuaaaauaugacuuaacuuuuaagagaaauguucugacacccac

SEQ ID NO: 589068 - RNA, 64 nt, hsa
cgcugugugcgccucacaucuggcucccaguggaaacuuuuacuccuccucauccgcagaugug

SEQ ID NO: 589069 - RNA, 64 nt, hsa
aacccuuucauucugguacaagagucggggguauaacuuuuauacuugaaucuaccuaccaagu

SEQ ID NO: 589070 - RNA, 64 nt, hsa
uuugcuacuuauauaaaaauuuuuaucaacacuaaacuuuuaaaguuuacaaguuuuuuuuuuc

SEQ ID NO: 589071 - RNA, 64 nt, hsa
gucuacagugguucaacuuuuaaguuaagggaaaaacuuuuacuuuguagauaauauaaaauaa

SEQ ID NO: 589072 - RNA, 64 nt, hsa
aguuugaugaggugaucacugucuacagugguucaacuuuuaaguuaagggaaaaacuuuuacu

SEQ ID NO: 589073 - RNA, 64 nt, hsa
guuuggaauugcccugcccaagucacugucuuuuaacuuuuaaacugaauauuaaaauguaucu

SEQ ID NO: 589074 - RNA, 64 nt, hsa
uuucauuugcuacugaauuugguaaauccuggguaacuuuuaucaagaugaagacauuuuaccc

SEQ ID NO: 589075 - RNA, 64 nt, hsa
uggauuacaggcgugagccacugugcccagcccuaacuuuuaauguacaucacacacacacuca

SEQ ID NO: 589076 - RNA, 64 nt, hsa
gggauuacaggugugauccaccgcaccuggcccuaacuuuuaauauacaacacacacacacaca

SEQ ID NO: 589077 - RNA, 64 nt, hsa
aggaucuuaaagacaucccucagguguucuauuuaacuuuuauuuuauuuuauuuuauuuauuu

SEQ ID NO: 589078 - RNA, 64 nt, hsa
auucuuccuaaaaauugagagguuuccuuuuauuaacuuuuaaaauaaagaaauaaguaguuuc

SEQ ID NO: 589079 - RNA, 64 nt, hsa
gaaaauucuaaaauuuguccuugucuagguugagaacuuuuacacacacuaagauaaagauaga

SEQ ID NO: 589080 - RNA, 64 nt, hsa
auuuuuacuuagauacuaauaaaauacauuuagaaacuuuuaaagucaugaaaaagcauuaacc

SEQ ID NO: 589081 - RNA, 64 nt, hsa
aaaguaucauuacauauaggaaaacaauaauuuuaacuuuuaagguugaaaagacaauagccca

SEQ ID NO: 589082 - RNA, 64 nt, hsa
auggaucauacacaauagguuuuuaaaaauuaauaacuuuuaguaauuacuuuuauuaauuuaa

SEQ ID NO: 589083 - RNA, 64 nt, hsa
cauacacaauagguuuuuuaaaauuaauauuaauaacuuuuauuaauuuaaaauagaaugcuua

SEQ ID NO: 589084 - RNA, 64 nt, hsa
cccaauuguaaaacagucaccauuuacuaccaguaacuuuuaguuaaugucuuacaaggaaaaa

SEQ ID NO: 589085 - RNA, 64 nt, hsa
uuuucccuaugucuguucuuacguauuuuuuuuaaacuuuuauuucaguaguguuuggggaaca

SEQ ID NO: 589086 - RNA, 64 nt, hsa
aaccaaauucugcuauaagucuugaucuucaaugaacuuuuaaauaaugcauuuagcuggaaaa

SEQ ID NO: 589087 - RNA, 64 nt, hsa
uuggcccagugugauugauugcuuuaucuuugguaacuuuuacuugaaugggauuugcugaauu

SEQ ID NO: 589088 - RNA, 64 nt, hsa
cuuuugaaauaccuggaaaugcaguuuuaauaugaacuuuuaagacagaugucucuuacaugau

SEQ ID NO: 589089 - RNA, 64 nt, hsa
aaaguucaaauucgagaagauuuaacucaaguggaacuuuuaacucguuugaccuccaaaccau

SEQ ID NO: 589090 - RNA, 64 nt, hsa
ugaaagaugugacagugcuuuugacaacaccuaaaacuuuuaaacauaaaaaaucauacuggug

SEQ ID NO: 589091 - RNA, 64 nt, hsa
aagaaaacuucuacaagugugaacaguguggcaaaacuuuuaaugaaugcucacaccuuauugc

SEQ ID NO: 589092 - RNA, 64 nt, hsa
uaaagucaugugccaccacacccagcuuacucugaacuuuuaugacagaugauuguuuuuuguu

SEQ ID NO: 589093 - RNA, 64 nt, hsa
guauuuugaauguacacgcaugcugaagcuaaguaacuuuuaaucaaagaaauaagaugguauu

SEQ ID NO: 589094 - RNA, 64 nt, hsa
uuuauucagauuuagaguaaaaaauaagcauauaaacuuuuauuaugugcucuuaacaguuuua

SEQ ID NO: 589095 - RNA, 64 nt, hsa
uguuugcaucucucuaugaagauacgucuguccaaacuuuuaaaaggcauaacuguauuuuaug

SEQ ID NO: 589096 - RNA, 64 nt, hsa
uuuguguauuagcaaugguuuuuacuaaugcuaaaacuuuuaaaguuuauuuuuuaauaaauug

SEQ ID NO: 589097 - RNA, 64 nt, hsa
aagcccaaucaccagcaguuuuuaaaaaggugauaacuuuuauuagcucuugugggcuaucaag

SEQ ID NO: 589098 - RNA, 64 nt, hsa
uuugacccugugggaggaugguacuuuucuuuuuaacuuuuauuuuaaguucagggguacgugu

SEQ ID NO: 589099 - RNA, 64 nt, hsa
gucaauuuuaugguucucagaagccaaaauacacaacuuuuagcacauaaacaccaacgauggc

SEQ ID NO: 589100 - RNA, 64 nt, hsa
aaaccauauccacacacaacaacuaauuguaugaaacuuuuauauccuaauuuaaaagcuguga

SEQ ID NO: 589101 - RNA, 64 nt, hsa
cagaaggacuuagaaacauguuuuuuuccuuuuaaacuuuuaagucaguuuuuaugaaguuguu

SEQ ID NO: 589102 - RNA, 64 nt, hsa
cuugaaaucuccucuacaugaucuuuguucuuuaacaguguauaccagaggguuaguuggggaa

SEQ ID NO: 589103 - RNA, 64 nt, hsa
uaauuaugguuucauggacacuguugagcaauguacaguguauggugugcuuaccuguccacuc

SEQ ID NO: 589104 - RNA, 64 nt, hsa
cuguaaaauacugucauacuugcuauuuccugguacaguguaguuuuuccccuuucauuugaau

SEQ ID NO: 589105 - RNA, 64 nt, hsa
ugcagugcucaguaaggcagugcaauacucaguaacaguguaguacucaguaacagugaaguac

SEQ ID NO: 589106 - RNA, 64 nt, hsa
cagugcucaguaaggcagugaauugcuuaguaacacaguguagugcucaguaggacagcauagu

SEQ ID NO: 589107 - RNA, 64 nt, hsa
auuauaacucuauuggucuuugaaacaaagcgauacaguguaggugguaucauucucuuucuca

SEQ ID NO: 589108 - RNA, 64 nt, hsa
uaggagcuaauuuguccaccagcauuaauguaacacaguguaguuaugaaaauauauugaagga

SEQ ID NO: 589109 - RNA, 64 nt, hsa
uagaagcaucccuuuguauacuguuuugcuacuuacaguguacuuggcauugcuuuaucucacu

SEQ ID NO: 589110 - RNA, 64 nt, hsa
uuauuuuuucuacaucuauuuuguguacuuguacacaguguacauucuuuuaaauuauaucgug

SEQ ID NO: 589111 - RNA, 64 nt, hsa
gucuuaggauaauugcugacuuuguaucuuggauacaguguaaaccagauccauauaaggugaa

SEQ ID NO: 589112 - RNA, 64 nt, hsa
aggcucaaagaauuuauguaaccuucccagagucacaguguaaaguuagauguugaaacccagu

SEQ ID NO: 589113 - RNA, 64 nt, hsa
guuauguggucacaugaugugcauagagauagcuacaguguaauaauuuacacuauuuugugcu

SEQ ID NO: 589114 - RNA, 64 nt, hsa
ugauucuuagacauugcagucucuucgaggcuuuacaguguaaacugucuugccccuucaucuu

SEQ ID NO: 589115 - RNA, 64 nt, hsa
cuuggugacuguauaaaguuagugguauucagggacaguguagcaaguagcuuacaaggggaca

SEQ ID NO: 589116 - RNA, 64 nt, hsa
aggaaugccuguggucauaguuuugugauguguaacaguguauaauuacauacugaauuauuuc

SEQ ID NO: 589117 - RNA, 64 nt, hsa
ggcuuaauuugggaggggggacuuauuucuguuuacaguguauuaccuuccuucccuccucuuc

SEQ ID NO: 589118 - RNA, 64 nt, hsa
uuguuuuuacagaaaagauaaaacucaaaagagaacaguguauuccuucugaggggcuuuuaua

SEQ ID NO: 589119 - RNA, 64 nt, hsa
uucuuuugccgaacgaugguugcaucucucggacacaguguacccccucccaagcccucccuga

SEQ ID NO: 589120 - RNA, 64 nt, hsa
cuacucuggguccugaggggggguggcagguaccacaguguaggcagcagggucagggccaaag

SEQ ID NO: 589121 - RNA, 64 nt, hsa
guuauguuuuauuauauauuuuauguuuuaugauauggguuagggauucuccauggacuccaga

SEQ ID NO: 589122 - RNA, 64 nt, hsa
acauuaauccagagagaauuuuauguuuuaugauauggguuauguuuuauuauauauuuuaugu

SEQ ID NO: 589123 - RNA, 64 nt, hsa
uuccccuuuaaaggaaacuuugaaaggauugugaauacuggaaaaugacaaaacuaaagguaga

SEQ ID NO: 589124 - RNA, 64 nt, hsa
auggguaaaggaaacauuuugccuuuuguaucuuauacuggaaugggaugucuguaaguccuag

SEQ ID NO: 589125 - RNA, 64 nt, hsa
ugauccuacaagcuuacuacacauaggaaaauucauacuggagagaaacuacaaaugugaagaa

SEQ ID NO: 589126 - RNA, 64 nt, hsa
ugauccucaacuuuuacuaaacauaagguaauucauacuggagaaaagccauacaaaugagaag

SEQ ID NO: 589127 - RNA, 64 nt, hsa
caguccucacaccuuucuacacauaagauaauuuauacuggagaggaacucuauaguugugaag

SEQ ID NO: 589128 - RNA, 64 nt, hsa
uaaccaauccucauaccuuacuauacagaaauucauacuggagagaaagccuacaauugugaag

SEQ ID NO: 589129 - RNA, 64 nt, hsa
cuuccuuaacccuuaacuguagauaagaaaauucauacuggaaagaaacccuacaaaugugaag

SEQ ID NO: 589130 - RNA, 64 nt, hsa
ugauucucaacucuuacuacauguaagaguauuuauacuggaaagaaacccuacaaauguaaaa

SEQ ID NO: 589131 - RNA, 64 nt, hsa
caguccgcaaagcucacugaacauaaguuaauucauacuggagaaaaacccuacaaauguaaag

SEQ ID NO: 589132 - RNA, 64 nt, hsa
aaguccucaacucuuacugcacauaagaucauucauacuggagagaaaccuuacaaaugugagg

SEQ ID NO: 589133 - RNA, 64 nt, hsa
caagucucaacacuuacuauacauaagauaauuuauacuggagcaaaaccuuggaaauucaaag

SEQ ID NO: 589134 - RNA, 64 nt, hsa
aagucuucaacccuuucugcacauaauauaauucauacuggagagaaaccccacaaauaugaag

SEQ ID NO: 589135 - RNA, 64 nt, hsa
cauuucucaacccuuacuaaacauaagaugauucauacuggagagaaguuacacaaaugugaug

SEQ ID NO: 589136 - RNA, 64 nt, hsa
ugauccucaaaacucauugaacacaagaaaauucauacuggagagaaaccuuacaagugugaag

SEQ ID NO: 589137 - RNA, 64 nt, hsa
cgaucuucaacccuuauuggacauaagagaauucauacuggagagaaacccuacaaaugugaag

SEQ ID NO: 589138 - RNA, 64 nt, hsa
auuuuuuuuuaaaguucaguauguaacaaguucuauacuggauccuuucuuucucuaauaaucc

SEQ ID NO: 589139 - RNA, 64 nt, hsa
gcugaaaauaacagcuacacaucuacagcuuaggauacuggagauuuaaugagaaaaaguacca

SEQ ID NO: 589140 - RNA, 64 nt, hsa
ucaacucauaggcuuauuuccaauuuaauugaccauacuggauacuuaggucaaauuucuguuc

SEQ ID NO: 589141 - RNA, 64 nt, hsa
cuguuuuccagacauacagguucuguggaauaagauacuggacuccucuucccaagauggcacu

SEQ ID NO: 589142 - RNA, 64 nt, hsa
ugguugcuuucccuauuuguucaauagacugauaauacuggaauuuauagaguuugagccauua

SEQ ID NO: 589143 - RNA, 64 nt, hsa
auugugagagacaacaguugccuccuuuugacaaauacuggauauuagcaguuuauuuaugaaa

SEQ ID NO: 589144 - RNA, 64 nt, hsa
uguguuucuaaaguauuuauguauuaaccugaccauacuggaaucagacauaaauacuuauuua

SEQ ID NO: 589145 - RNA, 64 nt, hsa
cagggauuuuuuuaaaaagucaaucagaaaagggauacuggagcuucuucauguauguaacagc

SEQ ID NO: 589146 - RNA, 64 nt, hsa
gcucuuaaauguuccuguuaccauccuaauguaaauacuggauuuuucugucauuuagcaccau

SEQ ID NO: 589147 - RNA, 64 nt, hsa
aagcccucaauucuuaacagacauaagauaauuuauacuggagagaaacucuacaaaucagaaa

SEQ ID NO: 589148 - RNA, 64 nt, hsa
ugguugucacacuucauuguagguaagauaauucauacuggagaaaacgccuacaugugugaac

SEQ ID NO: 589149 - RNA, 64 nt, hsa
cacuucucaacccugccuacacguaagauaauucauacuggaaggaaacccuacaaauaugagg

SEQ ID NO: 589150 - RNA, 64 nt, hsa
aaauccucauccauuaguaaacauaagauaauucauacuggagagaaaaccuacaaaugugagg

SEQ ID NO: 589151 - RNA, 64 nt, hsa
cugucccuccaauuuacugcacauaagauaauuuauacuggagagaagcccuacaaaugugaaa

SEQ ID NO: 589152 - RNA, 64 nt, hsa
caauuuucaaaccuuacuaaacauaagauaacucauacuggagaaaaaucuuacaaaugugaag

SEQ ID NO: 589153 - RNA, 64 nt, hsa
caguccucaauuuuuacuaaacauaagaaaauucauacuggagagaaacccuaugauugugaaa

SEQ ID NO: 589154 - RNA, 64 nt, hsa
uuuaaaaguucucaacccuuauuacacauaauuuauacuggacagaaauccuaaagugugaaga

SEQ ID NO: 589155 - RNA, 64 nt, hsa
aaguccucaauucuuaacagauauaagauguuucauacuggagcgaaacuacaauccugaauga

SEQ ID NO: 589156 - RNA, 64 nt, hsa
cauaggucgucccugcuucaacaucacaguauucauacuggagagaaaccuuacgaauguauua

SEQ ID NO: 589157 - RNA, 64 nt, hsa
uguaguucaaaccuuacuguacaucagagaauucauacuggagaaaagccauauaaauguagug

SEQ ID NO: 589158 - RNA, 64 nt, hsa
cagaaaucaaaccucacugaacaugagaaaauucauacuggagagaaaccuuaucauuguaauc

SEQ ID NO: 589159 - RNA, 64 nt, hsa
cagagacaaaaucuucuugagcaugaaaaaauucauacuggagagaaaccauucaaauguaaug

SEQ ID NO: 589160 - RNA, 64 nt, hsa
ccuggccaaaaaauuaacauucuaaaggauuuaaauacuggaauuugaaaagccaaacugugaa

SEQ ID NO: 589161 - RNA, 55 nt, hsa
agccuugcaugucaucauagacuucauacuggagagaaaccuuacaaaugugaag

SEQ ID NO: 589162 - RNA, 64 nt, hsa
cacagaucacgccuuaaaagacauaggagaauucauacuggagagaaaccuuacaaguguaaug

SEQ ID NO: 589163 - RNA, 64 nt, hsa
caucguucauaccuugcaguucaucagugaacucauacuggagagaaaccuuacaaaugucaug

SEQ ID NO: 589164 - RNA, 64 nt, hsa
uuaagguccaaccucauucaccaucagcgaguucauacuggagaaaggcaugagugcgggcagu

SEQ ID NO: 589165 - RNA, 64 nt, hsa
cacaguucuucguuccgucgccaucagagaguucauacuggaaugaggccuuauaagugaagca

SEQ ID NO: 589166 - RNA, 64 nt, hsa
auuuuaacgauuuucaaaguugauaugaaaguucauacuggaggguaguugcaugaauguaagu

SEQ ID NO: 589167 - RNA, 64 nt, hsa
aguuccaguuauauucauauacaugaacgaauucauacuggagagaaacccuaugaauguaaag

SEQ ID NO: 589168 - RNA, 64 nt, hsa
uacuacuacucagcucaaagacaugaaaggacucauacuggagagaaacccuacaaauguaagg

SEQ ID NO: 589169 - RNA, 64 nt, hsa
uaucacaacucugcucaaagacaugaaaagacucauacuggagagaaacccuacaaaugcaagg

SEQ ID NO: 589170 - RNA, 64 nt, hsa
uaccaccaaucugcucaaaaacaugaaaaggcucauacuggagagaaacccuacaaauguaagg

SEQ ID NO: 589171 - RNA, 64 nt, hsa
cuucacacagccuuuugagcacacaugagaauguauacuggagagaaacccuauaaauauuaag

SEQ ID NO: 589172 - RNA, 64 nt, hsa
uguuccagcuccuucugaauacacaaaagaguucauacuggacagaagcugugugaauacaaac

SEQ ID NO: 589173 - RNA, 64 nt, hsa
ugguugucacacuugauuguagguaagguaaguuauacuggagaaaacuucuacaugugugaac

SEQ ID NO: 589174 - RNA, 64 nt, hsa
caguccucaacucuuacuaaacauaaaaaaauucauacuggagggaacuccugugacugugaag

SEQ ID NO: 589175 - RNA, 64 nt, hsa
aauggcugucacacuugauuguagguaagauaauauacuggagaaaacuacuagaauaaacaau

SEQ ID NO: 589176 - RNA, 64 nt, hsa
caguccuuaaggcuuacuacauauaagacaacucauacuggagagaaaccaugcaugugugaag

SEQ ID NO: 589177 - RNA, 64 nt, hsa
guuccucaauccuuacuaaacauucauguaauucauacuggagggaauuccuauaauugugugg

SEQ ID NO: 589178 - RNA, 64 nt, hsa
uguuccucacaccuuacuacucauaaaagaauucauacuggaggaaaagcccuacaaaugugaa

SEQ ID NO: 589179 - RNA, 64 nt, hsa
cgguccucaaaccuuguggaacauaagagaauucauacuggagagaaacccuacaaaugcgaag

SEQ ID NO: 589180 - RNA, 64 nt, hsa
gcugauucucagucuaguaaacauaagaaaauucauacuggagagaaaaucuacaaaggugaag

SEQ ID NO: 589181 - RNA, 64 nt, hsa
acccaggcaucaaaaccggaacaucacaggguuuauacuggagaguaacuacacaaagauaaug

SEQ ID NO: 589182 - RNA, 64 nt, hsa
uagcauuaaagccuuguaagacauacaauaauuuauacuggagaaaaacuuugcaaguauaaug

SEQ ID NO: 589183 - RNA, 64 nt, hsa
ucacguucacacgucauuagacaucagagaaucuauacuggacagaaaucuuacaaaugucauc

SEQ ID NO: 589184 - RNA, 64 nt, hsa
gaucguucacauauugcaggucaucggugaacucauacuggagagaaaccuuacaaaugucaug

SEQ ID NO: 589185 - RNA, 64 nt, hsa
acaagacuugggagugauucacaccuggaacaacauacuggacuucacacuggagagaaaccuu

SEQ ID NO: 589186 - RNA, 64 nt, hsa
uuggaaaucacaccuuaaagacauaggagaauuuauacuggagagaaagcuuacaaauguaagg

SEQ ID NO: 589187 - RNA, 64 nt, hsa
gucacaaaucacagcuugaaagacaggagaauucauacuggagaaaaaacauacaaauguaagg

SEQ ID NO: 589188 - RNA, 64 nt, hsa
cacaauucaacccuuguaagucacaaagccauucauacuggagagaaacuuuacaaguguaaug

SEQ ID NO: 589189 - RNA, 64 nt, hsa
caaaaagcaaccuuugcacaucaccauagacuucauacuggagagaaaccuuacaaaugggagg

SEQ ID NO: 589190 - RNA, 64 nt, hsa
ucacaauucaacccuguaagucauaaggcaauucauacuggagagaaaccuuacaagcauaaug

SEQ ID NO: 589191 - RNA, 64 nt, hsa; identical to SEQ ID NO: 90763

SEQ ID NO: 589192 - RNA, 64 nt, hsa; identical to SEQ ID NO: 90764

SEQ ID NO: 589193 - RNA, 64 nt, hsa; identical to SEQ ID NO: 90765

SEQ ID NO: 589194 - RNA, 64 nt, hsa; identical to SEQ ID NO: 90766

SEQ ID NO: 589195 - RNA, 64 nt, hsa; identical to SEQ ID NO: 90767

SEQ ID NO: 589196 - RNA, 64 nt, hsa; identical to SEQ ID NO: 90768

SEQ ID NO: 589197 - RNA, 64 nt, hsa; identical to SEQ ID NO: 90769

SEQ ID NO: 589198 - RNA, 64 nt, hsa; identical to SEQ ID NO: 90770

SEQ ID NO: 589199 - RNA, 64 nt, hsa; identical to SEQ ID NO: 90771

SEQ ID NO: 589200 - RNA, 64 nt, hsa; identical to SEQ ID NO: 90772

SEQ ID NO: 589201 - RNA, 64 nt, hsa; identical to SEQ ID NO: 90773

SEQ ID NO: 589202 - RNA, 64 nt, hsa; identical to SEQ ID NO: 90774

SEQ ID NO: 589203 - RNA, 64 nt, hsa; identical to SEQ ID NO: 90775

SEQ ID NO: 589204 - RNA, 64 nt, hsa; identical to SEQ ID NO: 90776

SEQ ID NO: 589205 - RNA, 64 nt, hsa; identical to SEQ ID NO: 90777

SEQ ID NO: 589206 - RNA, 64 nt, hsa; identical to SEQ ID NO: 90778

SEQ ID NO: 589207 - RNA, 64 nt, hsa; identical to SEQ ID NO: 90779

SEQ ID NO: 589208 - RNA, 64 nt, hsa; identical to SEQ ID NO: 90780

SEQ ID NO: 589209 - RNA, 64 nt, hsa; identical to SEQ ID NO: 90781

SEQ ID NO: 589210 - RNA, 64 nt, hsa; identical to SEQ ID NO: 90782

SEQ ID NO: 589211 - RNA, 64 nt, hsa; identical to SEQ ID NO: 90783

SEQ ID NO: 589212 - RNA, 64 nt, hsa; identical to SEQ ID NO: 90784

SEQ ID NO: 589213 - RNA, 64 nt, hsa; identical to SEQ ID NO: 90785

SEQ ID NO: 589214 - RNA, 64 nt, hsa; identical to SEQ ID NO: 90786

SEQ ID NO: 589215 - RNA, 64 nt, hsa; identical to SEQ ID NO: 90787

SEQ ID NO: 589216 - RNA, 64 nt, hsa; identical to SEQ ID NO: 90788

SEQ ID NO: 589217 - RNA, 64 nt, hsa; identical to SEQ ID NO: 90789

SEQ ID NO: 589218 - RNA, 64 nt, hsa; identical to SEQ ID NO: 90790

SEQ ID NO: 589219 - RNA, 64 nt, hsa; identical to SEQ ID NO: 90791

SEQ ID NO: 589220 - RNA, 64 nt, hsa; identical to SEQ ID NO: 90792

SEQ ID NO: 589221 - RNA, 64 nt, hsa; identical to SEQ ID NO: 90793

SEQ ID NO: 589222 - RNA, 64 nt, hsa; identical to SEQ ID NO: 90794

SEQ ID NO: 589223 - RNA, 64 nt, hsa; identical to SEQ ID NO: 90795

SEQ ID NO: 589224 - RNA, 64 nt, hsa; identical to SEQ ID NO: 90796

SEQ ID NO: 589225 - RNA, 64 nt, hsa; identical to SEQ ID NO: 90797

SEQ ID NO: 589226 - RNA, 64 nt, hsa; identical to SEQ ID NO: 90798

SEQ ID NO: 589227 - RNA, 64 nt, hsa; identical to SEQ ID NO: 90799

SEQ ID NO: 589228 - RNA, 64 nt, hsa; identical to SEQ ID NO: 90800

SEQ ID NO: 589229 - RNA, 64 nt, hsa; identical to SEQ ID NO: 90801

SEQ ID NO: 589230 - RNA, 64 nt, hsa; identical to SEQ ID NO: 90802

SEQ ID NO: 589231 - RNA, 64 nt, hsa; identical to SEQ ID NO: 90803

SEQ ID NO: 589232 - RNA, 64 nt, hsa; identical to SEQ ID NO: 90804

SEQ ID NO: 589233 - RNA, 64 nt, hsa; identical to SEQ ID NO: 90805

SEQ ID NO: 589234 - RNA, 64 nt, hsa; identical to SEQ ID NO: 90806

SEQ ID NO: 589235 - RNA, 64 nt, hsa; identical to SEQ ID NO: 90807

SEQ ID NO: 589236 - RNA, 64 nt, hsa; identical to SEQ ID NO: 90808

SEQ ID NO: 589237 - RNA, 64 nt, hsa; identical to SEQ ID NO: 90809

SEQ ID NO: 589238 - RNA, 64 nt, hsa; identical to SEQ ID NO: 90810

SEQ ID NO: 589239 - RNA, 64 nt, hsa; identical to SEQ ID NO: 90811

SEQ ID NO: 589240 - RNA, 64 nt, hsa; identical to SEQ ID NO: 90812

SEQ ID NO: 589241 - RNA, 64 nt, hsa; identical to SEQ ID NO: 90813

SEQ ID NO: 589242 - RNA, 64 nt, hsa; identical to SEQ ID NO: 90814

SEQ ID NO: 589243 - RNA, 64 nt, hsa; identical to SEQ ID NO: 90815

SEQ ID NO: 589244 - RNA, 64 nt, hsa; identical to SEQ ID NO: 90816

SEQ ID NO: 589245 - RNA, 64 nt, hsa; identical to SEQ ID NO: 90817

SEQ ID NO: 589246 - RNA, 64 nt, hsa; identical to SEQ ID NO: 90818

SEQ ID NO: 589247 - RNA, 64 nt, hsa; identical to SEQ ID NO: 90819

SEQ ID NO: 589248 - RNA, 64 nt, hsa; identical to SEQ ID NO: 90820

SEQ ID NO: 589249 - RNA, 64 nt, hsa; identical to SEQ ID NO: 90821

SEQ ID NO: 589250 - RNA, 64 nt, hsa; identical to SEQ ID NO: 90822

SEQ ID NO: 589251 - RNA, 64 nt, hsa; identical to SEQ ID NO: 90823

SEQ ID NO: 589252 - RNA, 64 nt, hsa; identical to SEQ ID NO: 90824

SEQ ID NO: 589253 - RNA, 64 nt, hsa; identical to SEQ ID NO: 90825

SEQ ID NO: 589254 - RNA, 64 nt, hsa; identical to SEQ ID NO: 90826

SEQ ID NO: 589255 - RNA, 64 nt, hsa; identical to SEQ ID NO: 90827

SEQ ID NO: 589256 - RNA, 64 nt, hsa; identical to SEQ ID NO: 90828

SEQ ID NO: 589257 - RNA, 64 nt, hsa; identical to SEQ ID NO: 90829

SEQ ID NO: 589258 - RNA, 64 nt, hsa; identical to SEQ ID NO: 90830

SEQ ID NO: 589259 - RNA, 64 nt, hsa; identical to SEQ ID NO: 90831

SEQ ID NO: 589260 - RNA, 64 nt, hsa; identical to SEQ ID NO: 90832

SEQ ID NO: 589261 - RNA, 64 nt, hsa; identical to SEQ ID NO: 90833

SEQ ID NO: 589262 - RNA, 64 nt, hsa; identical to SEQ ID NO: 90834

SEQ ID NO: 589263 - RNA, 64 nt, hsa; identical to SEQ ID NO: 90835

SEQ ID NO: 589264 - RNA, 64 nt, hsa; identical to SEQ ID NO: 90836

SEQ ID NO: 589265 - RNA, 64 nt, hsa; identical to SEQ ID NO: 90837

SEQ ID NO: 589266 - RNA, 64 nt, hsa; identical to SEQ ID NO: 90838

SEQ ID NO: 589267 - RNA, 64 nt, hsa; identical to SEQ ID NO: 90839

SEQ ID NO: 589268 - RNA, 64 nt, hsa; identical to SEQ ID NO: 90840

SEQ ID NO: 589269 - RNA, 64 nt, hsa; identical to SEQ ID NO: 90841

SEQ ID NO: 589270 - RNA, 64 nt, hsa; identical to SEQ ID NO: 90842

SEQ ID NO: 589271 - RNA, 64 nt, hsa; identical to SEQ ID NO: 90843

SEQ ID NO: 589272 - RNA, 64 nt, hsa; identical to SEQ ID NO: 90844

SEQ ID NO: 589273 - RNA, 64 nt, hsa; identical to SEQ ID NO: 90845

SEQ ID NO: 589274 - RNA, 64 nt, hsa; identical to SEQ ID NO: 90846

SEQ ID NO: 589275 - RNA, 64 nt, hsa; identical to SEQ ID NO: 90847

SEQ ID NO: 589276 - RNA, 64 nt, hsa; identical to SEQ ID NO: 90848

SEQ ID NO: 589277 - RNA, 64 nt, hsa; identical to SEQ ID NO: 90849

SEQ ID NO: 589278 - RNA, 64 nt, hsa; identical to SEQ ID NO: 90850

SEQ ID NO: 589279 - RNA, 64 nt, hsa; identical to SEQ ID NO: 90851

SEQ ID NO: 589280 - RNA, 64 nt, hsa; identical to SEQ ID NO: 90852

SEQ ID NO: 589281 - RNA, 64 nt, hsa; identical to SEQ ID NO: 90853

SEQ ID NO: 589282 - RNA, 64 nt, hsa; identical to SEQ ID NO: 90854

SEQ ID NO: 589283 - RNA, 64 nt, hsa; identical to SEQ ID NO: 90855

SEQ ID NO: 589284 - RNA, 64 nt, hsa; identical to SEQ ID NO: 90856

SEQ ID NO: 589285 - RNA, 64 nt, hsa; identical to SEQ ID NO: 90857

SEQ ID NO: 589286 - RNA, 64 nt, hsa; identical to SEQ ID NO: 90858

SEQ ID NO: 589287 - RNA, 64 nt, hsa; identical to SEQ ID NO: 90859

SEQ ID NO: 589288 - RNA, 64 nt, hsa; identical to SEQ ID NO: 90860

SEQ ID NO: 589289 - RNA, 64 nt, hsa; identical to SEQ ID NO: 90861

SEQ ID NO: 589290 - RNA, 64 nt, hsa; identical to SEQ ID NO: 90862

SEQ ID NO: 589291 - RNA, 64 nt, hsa; identical to SEQ ID NO: 90863

SEQ ID NO: 589292 - RNA, 64 nt, hsa; identical to SEQ ID NO: 90864

SEQ ID NO: 589293 - RNA, 64 nt, hsa; identical to SEQ ID NO: 90865

SEQ ID NO: 589294 - RNA, 64 nt, hsa; identical to SEQ ID NO: 90866

SEQ ID NO: 589295 - RNA, 64 nt, hsa; identical to SEQ ID NO: 90867

SEQ ID NO: 589296 - RNA, 64 nt, hsa; identical to SEQ ID NO: 90868

SEQ ID NO: 589297 - RNA, 64 nt, hsa; identical to SEQ ID NO: 90869

SEQ ID NO: 589298 - RNA, 64 nt, hsa; identical to SEQ ID NO: 90870

SEQ ID NO: 589299 - RNA, 64 nt, hsa; identical to SEQ ID NO: 90871

SEQ ID NO: 589300 - RNA, 64 nt, hsa; identical to SEQ ID NO: 90872

SEQ ID NO: 589301 - RNA, 64 nt, hsa; identical to SEQ ID NO: 90873

SEQ ID NO: 589302 - RNA, 64 nt, hsa; identical to SEQ ID NO: 90874

SEQ ID NO: 589303 - RNA, 64 nt, hsa; identical to SEQ ID NO: 90875

SEQ ID NO: 589304 - RNA, 64 nt, hsa; identical to SEQ ID NO: 90876

SEQ ID NO: 589305 - RNA, 64 nt, hsa; identical to SEQ ID NO: 90877

SEQ ID NO: 589306 - RNA, 64 nt, hsa; identical to SEQ ID NO: 90878

SEQ ID NO: 589307 - RNA, 64 nt, hsa; identical to SEQ ID NO: 90879

SEQ ID NO: 589308 - RNA, 64 nt, hsa; identical to SEQ ID NO: 90880

SEQ ID NO: 589309 - RNA, 64 nt, hsa; identical to SEQ ID NO: 90881

SEQ ID NO: 589310 - RNA, 64 nt, hsa; identical to SEQ ID NO: 90882

SEQ ID NO: 589311 - RNA, 64 nt, hsa; identical to SEQ ID NO: 90883

SEQ ID NO: 589312 - RNA, 64 nt, hsa; identical to SEQ ID NO: 90884

SEQ ID NO: 589313 - RNA, 64 nt, hsa; identical to SEQ ID NO: 90885

SEQ ID NO: 589314 - RNA, 64 nt, hsa; identical to SEQ ID NO: 90886

SEQ ID NO: 589315 - RNA, 64 nt, hsa; identical to SEQ ID NO: 90887

SEQ ID NO: 589316 - RNA, 64 nt, hsa; identical to SEQ ID NO: 90888

SEQ ID NO: 589317 - RNA, 64 nt, hsa; identical to SEQ ID NO: 90889

SEQ ID NO: 589318 - RNA, 64 nt, hsa; identical to SEQ ID NO: 90890

SEQ ID NO: 589319 - RNA, 64 nt, hsa; identical to SEQ ID NO: 90891

SEQ ID NO: 589320 - RNA, 64 nt, hsa; identical to SEQ ID NO: 90892

SEQ ID NO: 589321 - RNA, 64 nt, hsa; identical to SEQ ID NO: 90893

SEQ ID NO: 589322 - RNA, 64 nt, hsa; identical to SEQ ID NO: 90894

SEQ ID NO: 589323 - RNA, 64 nt, hsa; identical to SEQ ID NO: 90895

SEQ ID NO: 589324 - RNA, 64 nt, hsa; identical to SEQ ID NO: 90896

SEQ ID NO: 589325 - RNA, 64 nt, hsa; identical to SEQ ID NO: 90897

SEQ ID NO: 589326 - RNA, 64 nt, hsa; identical to SEQ ID NO: 90898

SEQ ID NO: 589327 - RNA, 64 nt, hsa; identical to SEQ ID NO: 90899

SEQ ID NO: 589328 - RNA, 54 nt, hsa; identical to SEQ ID NO: 90900

SEQ ID NO: 589329 - RNA, 64 nt, hsa; identical to SEQ ID NO: 90901

SEQ ID NO: 589330 - RNA, 64 nt, hsa; identical to SEQ ID NO: 90902

SEQ ID NO: 589331 - RNA, 64 nt, hsa; identical to SEQ ID NO: 90903

SEQ ID NO: 589332 - RNA, 64 nt, hsa; identical to SEQ ID NO: 90904

SEQ ID NO: 589333 - RNA, 64 nt, hsa; identical to SEQ ID NO: 90905

SEQ ID NO: 589334 - RNA, 64 nt, hsa; identical to SEQ ID NO: 90906

SEQ ID NO: 589335 - RNA, 64 nt, hsa; identical to SEQ ID NO: 90907

SEQ ID NO: 589336 - RNA, 64 nt, hsa; identical to SEQ ID NO: 90908

SEQ ID NO: 589337 - RNA, 64 nt, hsa; identical to SEQ ID NO: 90909

SEQ ID NO: 589338 - RNA, 64 nt, hsa; identical to SEQ ID NO: 90910

SEQ ID NO: 589339 - RNA, 64 nt, hsa; identical to SEQ ID NO: 90911

SEQ ID NO: 589340 - RNA, 64 nt, hsa; identical to SEQ ID NO: 90912

SEQ ID NO: 589341 - RNA, 64 nt, hsa; identical to SEQ ID NO: 90913

SEQ ID NO: 589342 - RNA, 64 nt, hsa; identical to SEQ ID NO: 90914

SEQ ID NO: 589343 - RNA, 64 nt, hsa; identical to SEQ ID NO: 90915

SEQ ID NO: 589344 - RNA, 64 nt, hsa; identical to SEQ ID NO: 90916

SEQ ID NO: 589345 - RNA, 64 nt, hsa; identical to SEQ ID NO: 90917

SEQ ID NO: 589346 - RNA, 64 nt, hsa; identical to SEQ ID NO: 90918

SEQ ID NO: 589347 - RNA, 64 nt, hsa; identical to SEQ ID NO: 90919

SEQ ID NO: 589348 - RNA, 64 nt, hsa; identical to SEQ ID NO: 90920

SEQ ID NO: 589349 - RNA, 64 nt, hsa; identical to SEQ ID NO: 90921

SEQ ID NO: 589350 - RNA, 64 nt, hsa; identical to SEQ ID NO: 90922

SEQ ID NO: 589351 - RNA, 64 nt, hsa; identical to SEQ ID NO: 90923

SEQ ID NO: 589352 - RNA, 64 nt, hsa; identical to SEQ ID NO: 90924

SEQ ID NO: 589353 - RNA, 64 nt, hsa; identical to SEQ ID NO: 90925

SEQ ID NO: 589354 - RNA, 64 nt, hsa; identical to SEQ ID NO: 90926

SEQ ID NO: 589355 - RNA, 64 nt, hsa; identical to SEQ ID NO: 90927

SEQ ID NO: 589356 - RNA, 64 nt, hsa; identical to SEQ ID NO: 90928

SEQ ID NO: 589357 - RNA, 64 nt, hsa; identical to SEQ ID NO: 90929

SEQ ID NO: 589358 - RNA, 64 nt, hsa; identical to SEQ ID NO: 90811

SEQ ID NO: 589359 - RNA, 64 nt, hsa; identical to SEQ ID NO: 90931

SEQ ID NO: 589360 - RNA, 64 nt, hsa; identical to SEQ ID NO: 90932

SEQ ID NO: 589361 - RNA, 64 nt, hsa; identical to SEQ ID NO: 90933

SEQ ID NO: 589362 - RNA, 64 nt, hsa; identical to SEQ ID NO: 90934

SEQ ID NO: 589363 - RNA, 64 nt, hsa; identical to SEQ ID NO: 90935

SEQ ID NO: 589364 - RNA, 64 nt, hsa; identical to SEQ ID NO: 90936

SEQ ID NO: 589365 - RNA, 64 nt, hsa; identical to SEQ ID NO: 90937

SEQ ID NO: 589366 - RNA, 64 nt, hsa; identical to SEQ ID NO: 90938

SEQ ID NO: 589367 - RNA, 64 nt, hsa; identical to SEQ ID NO: 90939

SEQ ID NO: 589368 - RNA, 64 nt, hsa; identical to SEQ ID NO: 90940

SEQ ID NO: 589369 - RNA, 64 nt, hsa; identical to SEQ ID NO: 90941

SEQ ID NO: 589370 - RNA, 64 nt, hsa; identical to SEQ ID NO: 90942

SEQ ID NO: 589371 - RNA, 64 nt, hsa; identical to SEQ ID NO: 90943

SEQ ID NO: 589372 - RNA, 64 nt, hsa; identical to SEQ ID NO: 90944

SEQ ID NO: 589373 - RNA, 64 nt, hsa; identical to SEQ ID NO: 90945

SEQ ID NO: 589374 - RNA, 64 nt, hsa; identical to SEQ ID NO: 90946

SEQ ID NO: 589375 - RNA, 64 nt, hsa; identical to SEQ ID NO: 90947

SEQ ID NO: 589376 - RNA, 64 nt, hsa; identical to SEQ ID NO: 90948

SEQ ID NO: 589377 - RNA, 64 nt, hsa; identical to SEQ ID NO: 90949

SEQ ID NO: 589378 - RNA, 64 nt, hsa; identical to SEQ ID NO: 90950

SEQ ID NO: 589379 - RNA, 64 nt, hsa; identical to SEQ ID NO: 90951

SEQ ID NO: 589380 - RNA, 64 nt, hsa; identical to SEQ ID NO: 90952

SEQ ID NO: 589381 - RNA, 64 nt, hsa; identical to SEQ ID NO: 90953

SEQ ID NO: 589382 - RNA, 64 nt, hsa; identical to SEQ ID NO: 90954

SEQ ID NO: 589383 - RNA, 64 nt, hsa; identical to SEQ ID NO: 90955

SEQ ID NO: 589384 - RNA, 64 nt, hsa; identical to SEQ ID NO: 90956

SEQ ID NO: 589385 - RNA, 64 nt, hsa; identical to SEQ ID NO: 90957

SEQ ID NO: 589386 - RNA, 64 nt, hsa; identical to SEQ ID NO: 90958

SEQ ID NO: 589387 - RNA, 64 nt, hsa; identical to SEQ ID NO: 90959

SEQ ID NO: 589388 - RNA, 64 nt, hsa; identical to SEQ ID NO: 90960

SEQ ID NO: 589389 - RNA, 64 nt, hsa; identical to SEQ ID NO: 90961

SEQ ID NO: 589390 - RNA, 64 nt, hsa; identical to SEQ ID NO: 90962

SEQ ID NO: 589391 - RNA, 64 nt, hsa; identical to SEQ ID NO: 90963

SEQ ID NO: 589392 - RNA, 64 nt, hsa; identical to SEQ ID NO: 90964

SEQ ID NO: 589393 - RNA, 64 nt, hsa; identical to SEQ ID NO: 90965

SEQ ID NO: 589394 - RNA, 64 nt, hsa; identical to SEQ ID NO: 90966

SEQ ID NO: 589395 - RNA, 64 nt, hsa; identical to SEQ ID NO: 90967

SEQ ID NO: 589396 - RNA, 64 nt, hsa; identical to SEQ ID NO: 90968

SEQ ID NO: 589397 - RNA, 64 nt, hsa; identical to SEQ ID NO: 90969

SEQ ID NO: 589398 - RNA, 64 nt, hsa; identical to SEQ ID NO: 90970

SEQ ID NO: 589399 - RNA, 64 nt, hsa; identical to SEQ ID NO: 90971

SEQ ID NO: 589400 - RNA, 64 nt, hsa; identical to SEQ ID NO: 90972

SEQ ID NO: 589401 - RNA, 64 nt, hsa; identical to SEQ ID NO: 90973

SEQ ID NO: 589402 - RNA, 64 nt, hsa; identical to SEQ ID NO: 90974

SEQ ID NO: 589403 - RNA, 64 nt, hsa; identical to SEQ ID NO: 90975

SEQ ID NO: 589404 - RNA, 64 nt, hsa; identical to SEQ ID NO: 90976

SEQ ID NO: 589405 - RNA, 64 nt, hsa; identical to SEQ ID NO: 90977

SEQ ID NO: 589406 - RNA, 64 nt, hsa; identical to SEQ ID NO: 90978

SEQ ID NO: 589407 - RNA, 64 nt, hsa; identical to SEQ ID NO: 90979

SEQ ID NO: 589408 - RNA, 64 nt, hsa; identical to SEQ ID NO: 90980

SEQ ID NO: 589409 - RNA, 64 nt, hsa; identical to SEQ ID NO: 90981

SEQ ID NO: 589410 - RNA, 64 nt, hsa; identical to SEQ ID NO: 90982

SEQ ID NO: 589411 - RNA, 64 nt, hsa; identical to SEQ ID NO: 90983

SEQ ID NO: 589412 - RNA, 64 nt, hsa; identical to SEQ ID NO: 90984

SEQ ID NO: 589413 - RNA, 64 nt, hsa; identical to SEQ ID NO: 90985

SEQ ID NO: 589414 - RNA, 64 nt, hsa; identical to SEQ ID NO: 90986

SEQ ID NO: 589415 - RNA, 64 nt, hsa; identical to SEQ ID NO: 90987

SEQ ID NO: 589416 - RNA, 64 nt, hsa; identical to SEQ ID NO: 90988

SEQ ID NO: 589417 - RNA, 64 nt, hsa; identical to SEQ ID NO: 90989

SEQ ID NO: 589418 - RNA, 64 nt, hsa; identical to SEQ ID NO: 90990

SEQ ID NO: 589419 - RNA, 64 nt, hsa; identical to SEQ ID NO: 90991

SEQ ID NO: 589420 - RNA, 64 nt, hsa; identical to SEQ ID NO: 90992

SEQ ID NO: 589421 - RNA, 64 nt, hsa; identical to SEQ ID NO: 90993

SEQ ID NO: 589422 - RNA, 64 nt, hsa; identical to SEQ ID NO: 90994

SEQ ID NO: 589423 - RNA, 64 nt, hsa; identical to SEQ ID NO: 90995

SEQ ID NO: 589424 - RNA, 64 nt, hsa; identical to SEQ ID NO: 90996

SEQ ID NO: 589425 - RNA, 64 nt, hsa; identical to SEQ ID NO: 90997

SEQ ID NO: 589426 - RNA, 64 nt, hsa; identical to SEQ ID NO: 90998

SEQ ID NO: 589427 - RNA, 64 nt, hsa; identical to SEQ ID NO: 90999

SEQ ID NO: 589428 - RNA, 64 nt, hsa; identical to SEQ ID NO: 91000

SEQ ID NO: 589429 - RNA, 64 nt, hsa; identical to SEQ ID NO: 91001

SEQ ID NO: 589430 - RNA, 64 nt, hsa; identical to SEQ ID NO: 91002

SEQ ID NO: 589431 - RNA, 64 nt, hsa; identical to SEQ ID NO: 91003

SEQ ID NO: 589432 - RNA, 64 nt, hsa; identical to SEQ ID NO: 91004

SEQ ID NO: 589433 - RNA, 64 nt, hsa; identical to SEQ ID NO: 91005

SEQ ID NO: 589434 - RNA, 64 nt, hsa; identical to SEQ ID NO: 91006

SEQ ID NO: 589435 - RNA, 64 nt, hsa; identical to SEQ ID NO: 91007

SEQ ID NO: 589436 - RNA, 64 nt, hsa; identical to SEQ ID NO: 91008

SEQ ID NO: 589437 - RNA, 64 nt, hsa; identical to SEQ ID NO: 91009

SEQ ID NO: 589438 - RNA, 64 nt, hsa; identical to SEQ ID NO: 91010

SEQ ID NO: 589439 - RNA, 64 nt, hsa; identical to SEQ ID NO: 91011

SEQ ID NO: 589440 - RNA, 64 nt, hsa; identical to SEQ ID NO: 91012

SEQ ID NO: 589441 - RNA, 64 nt, hsa; identical to SEQ ID NO: 91013

SEQ ID NO: 589442 - RNA, 64 nt, hsa; identical to SEQ ID NO: 91014

SEQ ID NO: 589443 - RNA, 64 nt, hsa; identical to SEQ ID NO: 91015

SEQ ID NO: 589444 - RNA, 64 nt, hsa; identical to SEQ ID NO: 91016

SEQ ID NO: 589445 - RNA, 64 nt, hsa; identical to SEQ ID NO: 91017

SEQ ID NO: 589446 - RNA, 64 nt, hsa; identical to SEQ ID NO: 91018

SEQ ID NO: 589447 - RNA, 64 nt, hsa; identical to SEQ ID NO: 91019

SEQ ID NO: 589448 - RNA, 64 nt, hsa; identical to SEQ ID NO: 91020

SEQ ID NO: 589449 - RNA, 64 nt, hsa; identical to SEQ ID NO: 91021

SEQ ID NO: 589450 - RNA, 64 nt, hsa; identical to SEQ ID NO: 91022

SEQ ID NO: 589451 - RNA, 64 nt, hsa; identical to SEQ ID NO: 91023

SEQ ID NO: 589452 - RNA, 64 nt, hsa; identical to SEQ ID NO: 91024

SEQ ID NO: 589453 - RNA, 64 nt, hsa; identical to SEQ ID NO: 91025

SEQ ID NO: 589454 - RNA, 64 nt, hsa; identical to SEQ ID NO: 91026

SEQ ID NO: 589455 - RNA, 64 nt, hsa; identical to SEQ ID NO: 91027

SEQ ID NO: 589456 - RNA, 64 nt, hsa; identical to SEQ ID NO: 91028

SEQ ID NO: 589457 - RNA, 64 nt, hsa; identical to SEQ ID NO: 91029

SEQ ID NO: 589458 - RNA, 64 nt, hsa; identical to SEQ ID NO: 248033

SEQ ID NO: 589459 - RNA, 64 nt, hsa; identical to SEQ ID NO: 248034

SEQ ID NO: 589460 - RNA, 64 nt, hsa; identical to SEQ ID NO: 248035

SEQ ID NO: 589461 - RNA, 64 nt, hsa; identical to SEQ ID NO: 248036

SEQ ID NO: 589462 - RNA, 64 nt, hsa; identical to SEQ ID NO: 248037

SEQ ID NO: 589463 - RNA, 64 nt, hsa; identical to SEQ ID NO: 248038

SEQ ID NO: 589464 - RNA, 64 nt, hsa; identical to SEQ ID NO: 248039

SEQ ID NO: 589465 - RNA, 64 nt, hsa; identical to SEQ ID NO: 248040

SEQ ID NO: 589466 - RNA, 64 nt, hsa; identical to SEQ ID NO: 248041

SEQ ID NO: 589467 - RNA, 64 nt, hsa; identical to SEQ ID NO: 248042

SEQ ID NO: 589468 - RNA, 64 nt, hsa; identical to SEQ ID NO: 248043

SEQ ID NO: 589469 - RNA, 64 nt, hsa; identical to SEQ ID NO: 248044

SEQ ID NO: 589470 - RNA, 64 nt, hsa; identical to SEQ ID NO: 248045

SEQ ID NO: 589471 - RNA, 64 nt, hsa; identical to SEQ ID NO: 248046

SEQ ID NO: 589472 - RNA, 64 nt, hsa; identical to SEQ ID NO: 248047

SEQ ID NO: 589473 - RNA, 64 nt, hsa; identical to SEQ ID NO: 248048

SEQ ID NO: 589474 - RNA, 64 nt, hsa; identical to SEQ ID NO: 248049

SEQ ID NO: 589475 - RNA, 64 nt, hsa; identical to SEQ ID NO: 248050

SEQ ID NO: 589476 - RNA, 64 nt, hsa; identical to SEQ ID NO: 248051

SEQ ID NO: 589477 - RNA, 64 nt, hsa; identical to SEQ ID NO: 248052

SEQ ID NO: 589478 - RNA, 64 nt, hsa; identical to SEQ ID NO: 248053

SEQ ID NO: 589479 - RNA, 64 nt, hsa; identical to SEQ ID NO: 248054

SEQ ID NO: 589480 - RNA, 64 nt, hsa; identical to SEQ ID NO: 248055

SEQ ID NO: 589481 - RNA, 64 nt, hsa; identical to SEQ ID NO: 248056

SEQ ID NO: 589482 - RNA, 64 nt, hsa; identical to SEQ ID NO: 248057

SEQ ID NO: 589483 - RNA, 64 nt, hsa; identical to SEQ ID NO: 248058

SEQ ID NO: 589484 - RNA, 64 nt, hsa; identical to SEQ ID NO: 248059

SEQ ID NO: 589485 - RNA, 64 nt, hsa; identical to SEQ ID NO: 248060

SEQ ID NO: 589486 - RNA, 64 nt, hsa; identical to SEQ ID NO: 248061

SEQ ID NO: 589487 - RNA, 64 nt, hsa; identical to SEQ ID NO: 248062

SEQ ID NO: 589488 - RNA, 64 nt, hsa; identical to SEQ ID NO: 248063

SEQ ID NO: 589489 - RNA, 64 nt, hsa; identical to SEQ ID NO: 248064

SEQ ID NO: 589490 - RNA, 64 nt, hsa; identical to SEQ ID NO: 248065

SEQ ID NO: 589491 - RNA, 64 nt, hsa; identical to SEQ ID NO: 248066

SEQ ID NO: 589492 - RNA, 64 nt, hsa; identical to SEQ ID NO: 248067

SEQ ID NO: 589493 - RNA, 64 nt, hsa; identical to SEQ ID NO: 248068

SEQ ID NO: 589494 - RNA, 64 nt, hsa; identical to SEQ ID NO: 248069

SEQ ID NO: 589495 - RNA, 64 nt, hsa; identical to SEQ ID NO: 248070

SEQ ID NO: 589496 - RNA, 64 nt, hsa; identical to SEQ ID NO: 248071

SEQ ID NO: 589497 - RNA, 64 nt, hsa; identical to SEQ ID NO: 248072

SEQ ID NO: 589498 - RNA, 64 nt, hsa; identical to SEQ ID NO: 248073

SEQ ID NO: 589499 - RNA, 53 nt, hsa; identical to SEQ ID NO: 248074

SEQ ID NO: 589500 - RNA, 64 nt, hsa; identical to SEQ ID NO: 248075

SEQ ID NO: 589501 - RNA, 64 nt, hsa; identical to SEQ ID NO: 248076

SEQ ID NO: 589502 - RNA, 64 nt, hsa; identical to SEQ ID NO: 248077

SEQ ID NO: 589503 - RNA, 64 nt, hsa; identical to SEQ ID NO: 248078

SEQ ID NO: 589504 - RNA, 64 nt, hsa; identical to SEQ ID NO: 248079

SEQ ID NO: 589505 - RNA, 64 nt, hsa; identical to SEQ ID NO: 248080

SEQ ID NO: 589506 - RNA, 64 nt, hsa; identical to SEQ ID NO: 248081

SEQ ID NO: 589507 - RNA, 64 nt, hsa; identical to SEQ ID NO: 248082

SEQ ID NO: 589508 - RNA, 64 nt, hsa; identical to SEQ ID NO: 248083

SEQ ID NO: 589509 - RNA, 64 nt, hsa; identical to SEQ ID NO: 248084

SEQ ID NO: 589510 - RNA, 64 nt, hsa; identical to SEQ ID NO: 248085

SEQ ID NO: 589511 - RNA, 64 nt, hsa; identical to SEQ ID NO: 248086

SEQ ID NO: 589512 - RNA, 64 nt, hsa; identical to SEQ ID NO: 248087

SEQ ID NO: 589513 - RNA, 64 nt, hsa; identical to SEQ ID NO: 248088

SEQ ID NO: 589514 - RNA, 64 nt, hsa; identical to SEQ ID NO: 248089

SEQ ID NO: 589515 - RNA, 64 nt, hsa; identical to SEQ ID NO: 248090

SEQ ID NO: 589516 - RNA, 64 nt, hsa; identical to SEQ ID NO: 248091

SEQ ID NO: 589517 - RNA, 64 nt, hsa; identical to SEQ ID NO: 248092

SEQ ID NO: 589518 - RNA, 64 nt, hsa; identical to SEQ ID NO: 248093

SEQ ID NO: 589519 - RNA, 64 nt, hsa; identical to SEQ ID NO: 248094

SEQ ID NO: 589520 - RNA, 64 nt, hsa; identical to SEQ ID NO: 248095

SEQ ID NO: 589521 - RNA, 63 nt, hsa; identical to SEQ ID NO: 248096

SEQ ID NO: 589522 - RNA, 64 nt, hsa; identical to SEQ ID NO: 248097

SEQ ID NO: 589523 - RNA, 64 nt, hsa; identical to SEQ ID NO: 248098

SEQ ID NO: 589524 - RNA, 64 nt, hsa; identical to SEQ ID NO: 248099

SEQ ID NO: 589525 - RNA, 64 nt, hsa; identical to SEQ ID NO: 248100

SEQ ID NO: 589526 - RNA, 64 nt, hsa; identical to SEQ ID NO: 248101

SEQ ID NO: 589527 - RNA, 64 nt, hsa; identical to SEQ ID NO: 248102

SEQ ID NO: 589528 - RNA, 64 nt, hsa; identical to SEQ ID NO: 248103

SEQ ID NO: 589529 - RNA, 64 nt, hsa; identical to SEQ ID NO: 248104

SEQ ID NO: 589530 - RNA, 64 nt, hsa; identical to SEQ ID NO: 248105

SEQ ID NO: 589531 - RNA, 64 nt, hsa; identical to SEQ ID NO: 248106

SEQ ID NO: 589532 - RNA, 64 nt, hsa; identical to SEQ ID NO: 248107

SEQ ID NO: 589533 - RNA, 64 nt, hsa; identical to SEQ ID NO: 248108

SEQ ID NO: 589534 - RNA, 64 nt, hsa; identical to SEQ ID NO: 248109

SEQ ID NO: 589535 - RNA, 64 nt, hsa; identical to SEQ ID NO: 248110

SEQ ID NO: 589536 - RNA, 64 nt, hsa; identical to SEQ ID NO: 248111

SEQ ID NO: 589537 - RNA, 64 nt, hsa; identical to SEQ ID NO: 248112

SEQ ID NO: 589538 - RNA, 64 nt, hsa; identical to SEQ ID NO: 248113

SEQ ID NO: 589539 - RNA, 64 nt, hsa; identical to SEQ ID NO: 248114

SEQ ID NO: 589540 - RNA, 64 nt, hsa; identical to SEQ ID NO: 248115

SEQ ID NO: 589541 - RNA, 64 nt, hsa; identical to SEQ ID NO: 248116

SEQ ID NO: 589542 - RNA, 64 nt, hsa; identical to SEQ ID NO: 248117

SEQ ID NO: 589543 - RNA, 64 nt, hsa; identical to SEQ ID NO: 248118

SEQ ID NO: 589544 - RNA, 64 nt, hsa; identical to SEQ ID NO: 248119

SEQ ID NO: 589545 - RNA, 64 nt, hsa; identical to SEQ ID NO: 248120

SEQ ID NO: 589546 - RNA, 64 nt, hsa; identical to SEQ ID NO: 248121

SEQ ID NO: 589547 - RNA, 64 nt, hsa; identical to SEQ ID NO: 248122

SEQ ID NO: 589548 - RNA, 64 nt, hsa; identical to SEQ ID NO: 248123

SEQ ID NO: 589549 - RNA, 64 nt, hsa; identical to SEQ ID NO: 248124

SEQ ID NO: 589550 - RNA, 64 nt, hsa; identical to SEQ ID NO: 248125

SEQ ID NO: 589551 - RNA, 64 nt, hsa; identical to SEQ ID NO: 248126

SEQ ID NO: 589552 - RNA, 64 nt, hsa; identical to SEQ ID NO: 248127

SEQ ID NO: 589553 - RNA, 64 nt, hsa; identical to SEQ ID NO: 526357

SEQ ID NO: 589554 - RNA, 64 nt, hsa; identical to SEQ ID NO: 526358

SEQ ID NO: 589555 - RNA, 64 nt, hsa; identical to SEQ ID NO: 526359

SEQ ID NO: 589556 - RNA, 64 nt, hsa; identical to SEQ ID NO: 526360

SEQ ID NO: 589557 - RNA, 64 nt, hsa; identical to SEQ ID NO: 526361

SEQ ID NO: 589558 - RNA, 64 nt, hsa; identical to SEQ ID NO: 526362

SEQ ID NO: 589559 - RNA, 64 nt, hsa; identical to SEQ ID NO: 526363

SEQ ID NO: 589560 - RNA, 64 nt, hsa; identical to SEQ ID NO: 526364

SEQ ID NO: 589561 - RNA, 64 nt, hsa; identical to SEQ ID NO: 526365

SEQ ID NO: 589562 - RNA, 64 nt, hsa; identical to SEQ ID NO: 526366

SEQ ID NO: 589563 - RNA, 64 nt, hsa; identical to SEQ ID NO: 526367

SEQ ID NO: 589564 - RNA, 64 nt, hsa; identical to SEQ ID NO: 526368

SEQ ID NO: 589565 - RNA, 64 nt, hsa; identical to SEQ ID NO: 526369

SEQ ID NO: 589566 - RNA, 64 nt, hsa; identical to SEQ ID NO: 526370

SEQ ID NO: 589567 - RNA, 64 nt, hsa; identical to SEQ ID NO: 526371

SEQ ID NO: 589568 - RNA, 64 nt, hsa; identical to SEQ ID NO: 526372

SEQ ID NO: 589569 - RNA, 64 nt, hsa; identical to SEQ ID NO: 526373

SEQ ID NO: 589570 - RNA, 64 nt, hsa; identical to SEQ ID NO: 526374

SEQ ID NO: 589571 - RNA, 64 nt, hsa; identical to SEQ ID NO: 526375

SEQ ID NO: 589572 - RNA, 64 nt, hsa; identical to SEQ ID NO: 526376

SEQ ID NO: 589573 - RNA, 64 nt, hsa; identical to SEQ ID NO: 526377

SEQ ID NO: 589574 - RNA, 64 nt, hsa; identical to SEQ ID NO: 526378

SEQ ID NO: 589575 - RNA, 64 nt, hsa; identical to SEQ ID NO: 526379

SEQ ID NO: 589576 - RNA, 64 nt, hsa; identical to SEQ ID NO: 526380

SEQ ID NO: 589577 - RNA, 64 nt, hsa; identical to SEQ ID NO: 526381

SEQ ID NO: 589578 - RNA, 64 nt, hsa; identical to SEQ ID NO: 526382

SEQ ID NO: 589579 - RNA, 64 nt, hsa; identical to SEQ ID NO: 526383

SEQ ID NO: 589580 - RNA, 64 nt, hsa; identical to SEQ ID NO: 526384

SEQ ID NO: 589581 - RNA, 64 nt, hsa; identical to SEQ ID NO: 526385

SEQ ID NO: 589582 - RNA, 64 nt, hsa; identical to SEQ ID NO: 526386

SEQ ID NO: 589583 - RNA, 64 nt, hsa; identical to SEQ ID NO: 526387

SEQ ID NO: 589584 - RNA, 64 nt, hsa; identical to SEQ ID NO: 526388

SEQ ID NO: 589585 - RNA, 64 nt, hsa; identical to SEQ ID NO: 126433

SEQ ID NO: 589586 - RNA, 64 nt, hsa; identical to SEQ ID NO: 126434

SEQ ID NO: 589587 - RNA, 64 nt, hsa; identical to SEQ ID NO: 126435

SEQ ID NO: 589588 - RNA, 64 nt, hsa; identical to SEQ ID NO: 126436

SEQ ID NO: 589589 - RNA, 64 nt, hsa; identical to SEQ ID NO: 126437

SEQ ID NO: 589590 - RNA, 64 nt, hsa; identical to SEQ ID NO: 126438

SEQ ID NO: 589591 - RNA, 64 nt, hsa; identical to SEQ ID NO: 126439

SEQ ID NO: 589592 - RNA, 64 nt, hsa; identical to SEQ ID NO: 126440

SEQ ID NO: 589593 - RNA, 64 nt, hsa; identical to SEQ ID NO: 126441

SEQ ID NO: 589594 - RNA, 64 nt, hsa; identical to SEQ ID NO: 126442

SEQ ID NO: 589595 - RNA, 64 nt, hsa; identical to SEQ ID NO: 126443

SEQ ID NO: 589596 - RNA, 64 nt, hsa; identical to SEQ ID NO: 126444

SEQ ID NO: 589597 - RNA, 64 nt, hsa; identical to SEQ ID NO: 126445

SEQ ID NO: 589598 - RNA, 64 nt, hsa; identical to SEQ ID NO: 126446

SEQ ID NO: 589599 - RNA, 64 nt, hsa; identical to SEQ ID NO: 126447

SEQ ID NO: 589600 - RNA, 64 nt, hsa; identical to SEQ ID NO: 126448

SEQ ID NO: 589601 - RNA, 64 nt, hsa; identical to SEQ ID NO: 126449

SEQ ID NO: 589602 - RNA, 64 nt, hsa; identical to SEQ ID NO: 126450

SEQ ID NO: 589603 - RNA, 64 nt, hsa; identical to SEQ ID NO: 126451

SEQ ID NO: 589604 - RNA, 64 nt, hsa; identical to SEQ ID NO: 126452

SEQ ID NO: 589605 - RNA, 64 nt, hsa; identical to SEQ ID NO: 126453

SEQ ID NO: 589606 - RNA, 64 nt, hsa; identical to SEQ ID NO: 126454

SEQ ID NO: 589607 - RNA, 64 nt, hsa; identical to SEQ ID NO: 126455

SEQ ID NO: 589608 - RNA, 64 nt, hsa; identical to SEQ ID NO: 126456

SEQ ID NO: 589609 - RNA, 64 nt, hsa; identical to SEQ ID NO: 126457

SEQ ID NO: 589610 - RNA, 64 nt, hsa; identical to SEQ ID NO: 126458

SEQ ID NO: 589611 - RNA, 64 nt, hsa
aaccuguaaauaugaaagaacaaagguuauuuccuggagaaaagacaauuuauucaacaccaac

SEQ ID NO: 589612 - RNA, 64 nt, hsa
cucaucauaugggcacaacucugguguccuucuauggagaaaaccucaaguaaaguuuuauucu

SEQ ID NO: 589613 - RNA, 64 nt, hsa
uguggcuccauauuucaacuaaaaauauaucuguuggagaaagaaauuaacaauaaagaauuuu

SEQ ID NO: 589614 - RNA, 64 nt, hsa
cucacuggcaggugugggaucuggggagagcggcuggagaaagaugcaguccucaggaaggggg

SEQ ID NO: 589615 - RNA, 64 nt, hsa
acucuguuucgaauauagccacagaaauaaaggauggagaaaaaucugggacagguaauuuugc

SEQ ID NO: 589616 - RNA, 64 nt, hsa
auucuguuucgaacauagccacagaaauaaaggauggagaaaaaucugggacagguaauuuugc

SEQ ID NO: 589617 - RNA, 64 nt, hsa
guucuguuuugaguauagccagagaaaacaaggauggagaaaaaucuaggacagguaauuuuga

SEQ ID NO: 589618 - RNA, 64 nt, hsa
auucuuuuucgaauauaaccagaggaaaaaaggauggagaaauaucuaggaaagguaauuuugc

SEQ ID NO: 589619 - RNA, 64 nt, hsa
auucuuuuucgaauauaaccagagaaaaaaaggauggagaaauaucuaggaaagguaauuuugc

SEQ ID NO: 589620 - RNA, 64 nt, hsa
auucuguuuuggguauagccagagaaaacaaggauggagaaaaaucuaggacagguaauuuuga

SEQ ID NO: 589621 - RNA, 64 nt, hsa
ugaggucaagaguucgagaccagccugaccaacauggagaaacccccaucucuacugaaaauac

SEQ ID NO: 589622 - RNA, 64 nt, hsa
gaguggcucuuugcaugaacacugugcaagguguuggagaaauccaaagcugaccaaaacaugg

SEQ ID NO: 589623 - RNA, 64 nt, hsa
agcggaguuguuaaggacugaagaaaaacuucucuggagaaaaauaaaauugcaauucuacuua

SEQ ID NO: 589624 - RNA, 64 nt, hsa
cagaaauucuguugaagacaguugagaauuccuuuggagaaaacagcccagcuuggcguggggu

SEQ ID NO: 589625 - RNA, 64 nt, hsa
aaaugcagagauuaagagcauauagaccaccuaguggagaaaaauggaguaaaggagauaagua

SEQ ID NO: 589626 - RNA, 64 nt, hsa
aacaggacagcagcucugcuagcuuggcuagugcuggagaaaguaccgggaagaaggagguggc

SEQ ID NO: 589627 - RNA, 64 nt, hsa
cagagucugagggucccggggcccgguuggcagcuggagaaagaggcaaaaagcccguagccgg

SEQ ID NO: 589628 - RNA, 64 nt, hsa
augaaggcagugggaaagcaaugccaaaugguuguggagaaaguggccggagccucccuggagu

SEQ ID NO: 589629 - RNA, 64 nt, hsa
ugagccuaggaguucgagaccagccuaggcaacauggagaaaccccgucucuaucagaaauaca

SEQ ID NO: 589630 - RNA, 64 nt, hsa
guaguaagcuuggaaaaauaauuuaagaauacaauggagaaauguaaauaaguaucuauguaaa

SEQ ID NO: 589631 - RNA, 64 nt, hsa
aaagcaaaagcuagagaagcaaguggagaaaugcuggagaaagcugcacccuacaggcaaccag

SEQ ID NO: 589632 - RNA, 64 nt, hsa
caccacugcccaaagcaaaagcuagagaagcaaguggagaaaugcuggagaaagcugcacccua

SEQ ID NO: 589633 - RNA, 64 nt, hsa
uucgauuuuucuggucuguggagaaacugugaauuggagaaauggagcucuguggcuucccacc

SEQ ID NO: 589634 - RNA, 64 nt, hsa
guuuugcuguguucacuucgauuuuucuggucuguggagaaacugugaauuggagaaauggagc

SEQ ID NO: 589635 - RNA, 64 nt, hsa
uugcuguucuggggggugaaaauagacuaacuacuggagaaacaaagagagaaagaaaacccag

SEQ ID NO: 589636 - RNA, 64 nt, hsa
uuuuuuucucucacuauaguauaagaaucuauuuuggagaaaaaaagaaaauaugagggucucg

SEQ ID NO: 589637 - RNA, 64 nt, hsa
cugccuguugcaaacgugaugcucccggauggaguggagaaacuaggagacugggacaagcaaa

SEQ ID NO: 589638 - RNA, 64 nt, hsa
cugcaaacaacccagaagcccauccucagaagacuggagaaaugauugaggaaugcaugggcac

SEQ ID NO: 589639 - RNA, 64 nt, hsa
ccucaacuuuuacuaaacauaagguaauucauacuggagaaaagccauacaaaugagaagaaug

SEQ ID NO: 589640 - RNA, 64 nt, hsa
gcucaaauguuguucaacaccagaaaauuuauauuggagaaaagcacuguaaauguaaugcauu

SEQ ID NO: 589641 - RNA, 64 nt, hsa
ccgcaaagcucacugaacauaaguuaauucauacuggagaaaaacccuacaaauguaaagaaug

SEQ ID NO: 589642 - RNA, 64 nt, hsa
ccucaacucuuauuacacauaagauaauucacaguggagaaaaacccuacaaaugugaagaaug

SEQ ID NO: 589643 - RNA, 64 nt, hsa
ugucacacuugauuguauauaagauaauucauacuggagaaaacucccagaaguggaguuuucc

SEQ ID NO: 589644 - RNA, 64 nt, hsa
guucaaacuuuguucaauaccaggaaauuuauauuggagaaaaacccuaugaguguaaugaauu

SEQ ID NO: 589645 - RNA, 64 nt, hsa
ugucacgcuugauuguagguaagauaauuuauauuggagaaaaauccuccaaguaugaagaaug

SEQ ID NO: 589646 - RNA, 64 nt, hsa
gcucaaacuuuguucgacaucagggaauuuguauuggagaaaaacccugcaaauguaauaaaua

SEQ ID NO: 589647 - RNA, 64 nt, hsa
uccauccauucuguuacacuuuguauuuucuaacuggagaaaagagugaggaacagaauguuuu

SEQ ID NO: 589648 - RNA, 64 nt, hsa
gggaccuuggaggaugaaggcgaguaugugacacuggagaaaaguggaccaggcaugucuuuug

SEQ ID NO: 589649 - RNA, 64 nt, hsa
ccauuuccacuuuuagauucaagagguccagccguggagaaacauccgggacccucagacacug

SEQ ID NO: 589650 - RNA, 64 nt, hsa
gccuacaagccccgagagaaugaugaauuggcacuggagaaagccgacguggugauggugacuc

SEQ ID NO: 589651 - RNA, 64 nt, hsa
aauuacugaauauuucagagcaaagcuaucaacuuggagaaacagggauuaaaaauaaggauaa

SEQ ID NO: 589652 - RNA, 64 nt, hsa
uuaaaaacuauauucaguaaaagccugcucaauuuggagaaauagaaccacaaacacagaucac

SEQ ID NO: 589653 - RNA, 64 nt, hsa
ucugaguguugccugcugaacucggaggggaguuuggagaaauuuuagacagcagcucuguguu

SEQ ID NO: 589654 - RNA, 64 nt, hsa
cacacuaccaggcccugcagccacaguguucuguuggagaaacuuggggaaguguuuucugaac

SEQ ID NO: 589655 - RNA, 64 nt, hsa
aauaugcucugguuggcaggcaacccuguagucauggagaaagguauuucaagaucuaguccaa

SEQ ID NO: 589656 - RNA, 64 nt, hsa
cacuucuugagcuuuaucuuuuuugacaauauacuggagaaacuuugaagaacaaguucaaacu

SEQ ID NO: 589657 - RNA, 64 nt, hsa
uaccguugagaagggaagaaaggcugagucuagguggagaaaaauaucaacagaacucuagcca

SEQ ID NO: 589658 - RNA, 64 nt, hsa
aacaauaaucacaauauauucaucccuucaguucuggagaaagccugauaccaggcacagccua

SEQ ID NO: 589659 - RNA, 64 nt, hsa
aaagucaccuaggcaacugccaaaauagcugaaauggagaaagggcuucaggcuggugacuagc

SEQ ID NO: 589660 - RNA, 64 nt, hsa
gccacagugaguuggucaaaugcuccugacaguguggagaaaccaacaggcaaaacgugggugc

SEQ ID NO: 589661 - RNA, 64 nt, hsa
uaaauuugccaugacuuccuggaggacagcagcauggagaaagauccuagaaaaggucagaccc

SEQ ID NO: 589662 - RNA, 64 nt, hsa
uuugagcagcuccaggccaagaaacaaauggccauggagaaacgcagagcaguccagaaccagu

SEQ ID NO: 589663 - RNA, 64 nt, hsa
aaagcuaaauaaccuuuaagaaugugggugguauuggagaaagaagaugaauuauagcuccgga

SEQ ID NO: 589664 - RNA, 64 nt, hsa
uggaggggaaaaagauccauucuacguauccuuguggagaaaagcuaaauaaccuuuaagaaug

SEQ ID NO: 589665 - RNA, 64 nt, hsa
ugaggucgggaguucgagaccagccuuaccaacauggagaaaccccaucucuacuaaaaauaca

SEQ ID NO: 589666 - RNA, 64 nt, hsa
cuuuuccagugcauuacaugguauuguauaucaguggagaaauguauuauuuccaugaucaaau

SEQ ID NO: 589667 - RNA, 64 nt, hsa
ggagugcuugggcagaaaguuguaaaguuugugcuggagaaagguuuauuuggacuuugauuac

SEQ ID NO: 589668 - RNA, 64 nt, hsa
cauguugcacacucuuugacagcaugcuguuuuguggagaaacuugcauucaugaagagcccau

SEQ ID NO: 589669 - RNA, 61 nt, hsa; identical to SEQ ID NO: 448102

SEQ ID NO: 589670 - RNA, 64 nt, hsa
ugaggucaggaguucgagaccagccugaccaacauggagaaacccugucucaacuaauaauaca

SEQ ID NO: 589671 - RNA, 64 nt, hsa
ugaaguaauauggcccacacuuuauucaccacccuggagaaaaaaaaacccaggaauaugugga

SEQ ID NO: 589672 - RNA, 64 nt, hsa
auuccuaccaggaaagaauacauauccaauagauuggagaaagccagagauuagcccucauucc

SEQ ID NO: 589673 - RNA, 64 nt, hsa
ucuugugugcugugggcacuggaguagagauuucuggagaaaaaaaaacaguuuauuucaucuu

SEQ ID NO: 589674 - RNA, 64 nt, hsa
gccagaaaaggcuucuguucacaacaguggcccauggagaaagaggcucuuauuaaacuuagau

SEQ ID NO: 589675 - RNA, 64 nt, hsa
ucuagugaauaaaaaaauuaguuugaaagauaucuggagaaaucgcauucauaaaacaauugga

SEQ ID NO: 589676 - RNA, 64 nt, hsa
acaaaaaugaaaauauuuauaauaggacucgacuuggagaaauugcuauucuuccuguugucca

SEQ ID NO: 589677 - RNA, 64 nt, hsa
agaauuucuggaagaaaggcuguggaagggccaauggagaaaaugaauggacaaagcucaggaa

SEQ ID NO: 589678 - RNA, 64 nt, hsa
ugugugcagacaauucucccugagguuagcccaauggagaaaugaagcagaggaaggaaacaua

SEQ ID NO: 589679 - RNA, 64 nt, hsa
agggccguaccccacccucagcaccccuuccauguggagaaaggagugaaaccuuuagggcagc

SEQ ID NO: 589680 - RNA, 64 nt, hsa
gguggcacugagcccccccaacacugugcccugguggagaaagcacugaccugucaugcccccc

SEQ ID NO: 589681 - RNA, 64 nt, hsa
aaucaucuaaaagccagccacugucagcaaagccuggagaaaugggaccagagagucugccccu

SEQ ID NO: 589682 - RNA, 64 nt, hsa
cgcuuuauggagcucaugcaggagaaugagcggguggagaaacuggaaugucgcugcauucagc

SEQ ID NO: 589683 - RNA, 64 nt, hsa
caacuaggauguguugggugagauguuucagaucuggagaaaugagcaggugucgggaaaugug

SEQ ID NO: 589684 - RNA, 64 nt, hsa
gggaauguucuaaaacuuuuucuuccuuaaaaaauggagaaaauugcacuugugcuugcugugu

SEQ ID NO: 589685 - RNA, 64 nt, hsa
auuuauaauuuugaucgaguuucuuaaaagacccuggagaaagaguggcauuucuucuguuuca

SEQ ID NO: 589686 - RNA, 64 nt, hsa
ucagaauucucccacaccaagugcaugucaguuguggagaaaacauagcaaaaagagccguacg

SEQ ID NO: 589687 - RNA, 64 nt, hsa
ggauggugaggacacagcuaugaucagggaauuuuggagaaacuacagcaucauggaugcugug

SEQ ID NO: 589688 - RNA, 64 nt, hsa
accugaggucaggaguucgagaccagccucaacauggagaaaccccgucucuauuaaaaauaca

SEQ ID NO: 589689 - RNA, 64 nt, hsa
agccaaagcugggcucaguggggaaggucaggaauggagaaauugccuuuucucguuagccucc

SEQ ID NO: 589690 - RNA, 64 nt, hsa
ugaggucaggaguucgaaaccagccuggccaacauggagaaaccccaucucuacuaaaaauaca

SEQ ID NO: 589691 - RNA, 64 nt, hsa
gcuguacacugaagagucaucagagaguucacacuggagaaagaccuuuugaaugcagcauuug

SEQ ID NO: 589692 - RNA, 64 nt, hsa
acucaaaucauauuagacaucggagaaaucacuuuggagaaaggucuuuugagugcacugagug

SEQ ID NO: 589693 - RNA, 64 nt, hsa
gcuccacacucauuagucaugagagaguucauacuggagaaaagccuuaugagugcagugaaug

SEQ ID NO: 589694 - RNA, 64 nt, hsa
gguccaaccucauucaccaucagcgaguucauacuggagaaaggcaugagugcgggcagugugg

SEQ ID NO: 589695 - RNA, 64 nt, hsa
aaucuagccuuauuauacaucugagaguucacacuggagaaaggccuuaugagugcagugacug

SEQ ID NO: 589696 - RNA, 64 nt, hsa
acuccagccuuauuaaacacuugagaguucacacuggagaaaggccauaugaaugcauugauug

SEQ ID NO: 589697 - RNA, 64 nt, hsa
cgaggucaggagaucgagaccauccuggcuaacguggagaaaccccgucucuacuaaaaaaaaa

SEQ ID NO: 589698 - RNA, 64 nt, hsa
aaaaaaaaaaccggauagaauaaugaccaaaaaauggagaaaaaguaggcugacucaggaaaca

SEQ ID NO: 589699 - RNA, 64 nt, hsa
guacuuguaccuaaggcccuggguucaagagaguuggagaaaccccucuagaaacauauuggcu

SEQ ID NO: 589700 - RNA, 64 nt, hsa
ggaaggcauuccaucaacaucagagaacucaugcuggagaaagacauuccaaauauaacuauua

SEQ ID NO: 589701 - RNA, 64 nt, hsa
uucugacccuacaaacaggucccuaauacugauguggagaaagcucaagagggaaucaucuggc

SEQ ID NO: 589702 - RNA, 64 nt, hsa
cuguacaugaaccaggucauguuuggccuuguguuggagaaagagaauuauccccacuucacag

SEQ ID NO: 589703 - RNA, 64 nt, hsa
gcauauacaugaauauaccuugagcaugaaucccuggagaaaucguuuucguagcucaccaaug

SEQ ID NO: 589704 - RNA, 64 nt, hsa
cucaaugaaauaagcugcuaaucagauuuuaccuuggagaaaugaaaauuauuucuuggggaug

SEQ ID NO: 589705 - RNA, 64 nt, hsa
auuggugaagacagacaccaguucccuacaagcauggagaaaaugaagaauaggccuguuuaau

SEQ ID NO: 589706 - RNA, 64 nt, hsa
ugaguuguaggaacugcuuuccaacuccaagcucccuccacaaguuucccucccaggcccccca

SEQ ID NO: 589707 - RNA, 64 nt, hsa
ugcggccagcccaggucugcaugcugagccccauccuccacagcuugccgcugacgcucucucc

SEQ ID NO: 589708 - RNA, 64 nt, hsa
gcucugcuccagaaacauguguguggcuucccuaccuccacaccaaggagcugccuugcugggu

SEQ ID NO: 589709 - RNA, 64 nt, hsa
gcuaucagcauuuuggcuggguggaaaaagcucuccuccacagagagcccucccaugucugcug

SEQ ID NO: 589710 - RNA, 64 nt, hsa
cugcugagagcuuccccugcacaauaaaacuuggccuccacaauccuuuaucuuaaccugaaca

SEQ ID NO: 589711 - RNA, 64 nt, hsa
acuggcgugugggagacccuguggccggcacccaccuccacacgaggacuaagcucugauuuuu

SEQ ID NO: 589712 - RNA, 64 nt, hsa
uauucuagacuuguuuuaguaauggaaacucuuaccuccacauauuauccuacagauguuucca

SEQ ID NO: 589713 - RNA, 64 nt, hsa
agauuuguuucuguuuuauagauuuaauucaauaccuccacauagauguuuuuauauuacauga

SEQ ID NO: 589714 - RNA, 64 nt, hsa
guuucaacuugacccucccacccccugcuacucuccuccacacaccccuccguuccgcuagccu

SEQ ID NO: 589715 - RNA, 64 nt, hsa
cccggccugcugcuugcugucgccacucaugucuccuccacaugcgguccacacaucaguaagg

SEQ ID NO: 589716 - RNA, 64 nt, hsa
gauggcagaggcaaauccacagaaggggggcugcccuccacacacacacgcccgucacccacac

SEQ ID NO: 589717 - RNA, 64 nt, hsa
gaaggccuccccuccgagcccagcucuccugucuccuccacagccaggcccugcacgcccaccu

SEQ ID NO: 589718 - RNA, 64 nt, hsa
agggaugggaccccucucugcugcccccuccuccccuccacacugcccaucucugaugucuggc

SEQ ID NO: 589719 - RNA, 64 nt, hsa
ggugaagcugugacaagggagugaccauccauccccuccacaggagggugaggaauugggacag

SEQ ID NO: 589720 - RNA, 64 nt, hsa
ccaucuuucuguuugucgucuuguugauuugcugccuccacacugucagcuccuugggaacaga

SEQ ID NO: 589721 - RNA, 64 nt, hsa
gagaacaacugagggccacccggucggggccaucccuccacacucugcauccuaccccaccuac

SEQ ID NO: 589722 - RNA, 64 nt, hsa
aggaaggcugugugggucuggagcccacgucccaccuccacacccuuggcuugggcccaugccc

SEQ ID NO: 589723 - RNA, 64 nt, hsa
ugaaaauagugaagcccacagaaaauaaguagcuccuccacagguuguaagcuaggucuagcug

SEQ ID NO: 589724 - RNA, 64 nt, hsa
cccagagccauacugccuugggucaguccagcccccuccacaucacugagccaucaaugagcug

SEQ ID NO: 589725 - RNA, 64 nt, hsa
ucuggggccagaauggcuguccuugucguagagcccuccacauuuucuuuuucuuuuuugagac

SEQ ID NO: 589726 - RNA, 64 nt, hsa
acuacaagugugagccaccgcgccuggcccaagcccuccacauuuucaauccaggagccuugag

SEQ ID NO: 589727 - RNA, 64 nt, hsa
acccuuugggacaguuacuucugggacccccuuuccuccacagagcccuucucccugguuucac

SEQ ID NO: 589728 - RNA, 64 nt, hsa
ccuaccacaaaccaggcuggaacccaagccccuuccuccacagcugccuucaguggguagaaug

SEQ ID NO: 589729 - RNA, 64 nt, hsa
uuuucugccagggguacugggucccccucagcacccuccacagcacaggccuuccaaguggaug

SEQ ID NO: 589730 - RNA, 64 nt, hsa
ccagcauguccucacaugcucaugcccacccgcuccuccacaagccuaguccauccugccugag

SEQ ID NO: 589731 - RNA, 64 nt, hsa
aaggagacugaggcuuagagagaggaggcagcccccuccacaccaguggccucgugguuauuag

SEQ ID NO: 589732 - RNA, 64 nt, hsa
gagcuggguggggacagugauaggcccaagguccccuccacaucccagcagcccaagcuuaaua

SEQ ID NO: 589733 - RNA, 64 nt, hsa; identical to SEQ ID NO: 312329

SEQ ID NO: 589734 - RNA, 64 nt, hsa; identical to SEQ ID NO: 312330

SEQ ID NO: 589735 - RNA, 64 nt, hsa; identical to SEQ ID NO: 312331

SEQ ID NO: 589736 - RNA, 64 nt, hsa; identical to SEQ ID NO: 312332

SEQ ID NO: 589737 - RNA, 64 nt, hsa; identical to SEQ ID NO: 312333

SEQ ID NO: 589738 - RNA, 64 nt, hsa; identical to SEQ ID NO: 312334

SEQ ID NO: 589739 - RNA, 64 nt, hsa; identical to SEQ ID NO: 312335

SEQ ID NO: 589740 - RNA, 64 nt, hsa; identical to SEQ ID NO: 312336

SEQ ID NO: 589741 - RNA, 64 nt, hsa; identical to SEQ ID NO: 312337

SEQ ID NO: 589742 - RNA, 64 nt, hsa; identical to SEQ ID NO: 312338

SEQ ID NO: 589743 - RNA, 61 nt, hsa; identical to SEQ ID NO: 312339

SEQ ID NO: 589744 - RNA, 64 nt, hsa; identical to SEQ ID NO: 312340

SEQ ID NO: 589745 - RNA, 64 nt, hsa; identical to SEQ ID NO: 312341

SEQ ID NO: 589746 - RNA, 64 nt, hsa; identical to SEQ ID NO: 312342

SEQ ID NO: 589747 - RNA, 64 nt, hsa; identical to SEQ ID NO: 312343

SEQ ID NO: 589748 - RNA, 64 nt, hsa; identical to SEQ ID NO: 312344

SEQ ID NO: 589749 - RNA, 64 nt, hsa; identical to SEQ ID NO: 312345

SEQ ID NO: 589750 - RNA, 64 nt, hsa; identical to SEQ ID NO: 312346

SEQ ID NO: 589751 - RNA, 64 nt, hsa
guucuucuguuggagagaugagacauuugacccuuagcuccaguuuucuucugauguuuccauc

SEQ ID NO: 589752 - RNA, 64 nt, hsa
uacacucccgcaacacagccauuauuuuauugucuagcuccaguuaucuguauuuuauguaaug

SEQ ID NO: 589753 - RNA, 64 nt, hsa
gggggcuggggugucaaaagugagaugaaguucuuagcuccagguuuugggguaaaccaaggua

SEQ ID NO: 589754 - RNA, 64 nt, hsa
auugcugcugauaugcuggugauucccaaauacauagcuccaacccccaacuucccccagacuu

SEQ ID NO: 589755 - RNA, 64 nt, hsa
ugagcacaggacaggaaaugggcuuugccacuuuuagcuccaggcuuuucuaaccagacuugau

SEQ ID NO: 589756 - RNA, 64 nt, hsa
cuuguauaguaauuuuguuguuguugggugcugguagcuccagaauuuugugaccacuauugug

SEQ ID NO: 589757 - RNA, 64 nt, hsa
augcaauaaguauguauugaacuguacuguaaaguagcuccaaaacuuaauuacucuccuguuu

SEQ ID NO: 589758 - RNA, 64 nt, hsa
uccuauauagauauauguaacuuagcuuuauuguuagcuccauaagcugccaguguugcuuuuc

SEQ ID NO: 589759 - RNA, 64 nt, hsa; identical to SEQ ID NO: 370200

SEQ ID NO: 589760 - RNA, 64 nt, hsa; identical to SEQ ID NO: 370201

SEQ ID NO: 589761 - RNA, 64 nt, hsa; identical to SEQ ID NO: 370202

SEQ ID NO: 589762 - RNA, 64 nt, hsa; identical to SEQ ID NO: 370203

SEQ ID NO: 589763 - RNA, 64 nt, hsa; identical to SEQ ID NO: 370204

SEQ ID NO: 589764 - RNA, 64 nt, hsa; identical to SEQ ID NO: 370205

SEQ ID NO: 589765 - RNA, 64 nt, hsa; identical to SEQ ID NO: 370206

SEQ ID NO: 589766 - RNA, 64 nt, hsa; identical to SEQ ID NO: 370207

SEQ ID NO: 589767 - RNA, 64 nt, hsa; identical to SEQ ID NO: 370208

SEQ ID NO: 589768 - RNA, 64 nt, hsa; identical to SEQ ID NO: 370209

SEQ ID NO: 589769 - RNA, 64 nt, hsa; identical to SEQ ID NO: 370210

SEQ ID NO: 589770 - RNA, 64 nt, hsa; identical to SEQ ID NO: 370211

SEQ ID NO: 589771 - RNA, 64 nt, hsa
uguuuuuauuuaccgaacaguuggaaaguaaaacuuugaauaucccagcgaagaaauggauaaa

SEQ ID NO: 589772 - RNA, 64 nt, hsa
aauguuaaucaaaaugaguauaucauuuccugucuuugaauaauccacucauuaauuuuuaaua

SEQ ID NO: 589773 - RNA, 64 nt, hsa
uccuacuuaaaugauuucauaaggaaaaccacuguuugaauaagccgcacaaaaaauaaaguua

SEQ ID NO: 589774 - RNA, 64 nt, hsa
uccccuuucccggaauuuuaagugucucuacaacuuugaauaaagggaaaugcccaagaugucc

SEQ ID NO: 589775 - RNA, 64 nt, hsa
ucuugaaucuacaaauaucuuuauauguauauaauuugaauauauacauguauguauauacaga

SEQ ID NO: 589776 - RNA, 64 nt, hsa
aucuguaaaacuaaauauagcauggaaaauccaauuugaauaagucaugcuuuccuagaauuua

SEQ ID NO: 589777 - RNA, 64 nt, hsa
aaacuuugaaguuaauacuuuugugcaacuguguuuugaauaaagccaugacaguguuaaaaac

SEQ ID NO: 589778 - RNA, 64 nt, hsa
uaaaucuuggcuaucuaaaauuuuuucccuuuguuuugaauauuuguaaguuuuuaagaaguua

SEQ ID NO: 589779 - RNA, 64 nt, hsa
guuaucuaauuuuugugauagggaaacaaauucuuuugaauaaaaauaaauaacaaaacaauaa

SEQ ID NO: 589780 - RNA, 64 nt, hsa
cucuccccaaagucaucauggguuuuggauuuguuuugaauauuuuuuucuuuuuuucuuuucc

SEQ ID NO: 589781 - RNA, 64 nt, hsa
ccauucagguuauauuuaaaaagaaaguuucucuuuugaauauugccacaagaauaaugggugg

SEQ ID NO: 589782 - RNA, 64 nt, hsa
acuuucaggcuacaagugacaagacagauucugcuuugaauauagcuacagaaauaaaggaugg

SEQ ID NO: 589783 - RNA, 64 nt, hsa
ccauucaggcuacaagugaugagaaagauucuguuuugaauauagccagaggaaaaaaggaugg

SEQ ID NO: 589784 - RNA, 64 nt, hsa
cuggagcagcacgcucagagacagugaacuagcauuugaauacacaaguccaagucuacugugu

SEQ ID NO: 589785 - RNA, 64 nt, hsa
uagugguuaauaguuuuccaguugcauuuaauuuuuugaauaugauaccuugucacauguaaau

SEQ ID NO: 589786 - RNA, 64 nt, hsa
agacccacaaucauuuacaguuuuaucuuuggccuuugaauagguucuuuuuucuuuaaugucu

SEQ ID NO: 589787 - RNA, 64 nt, hsa
uuaugccuuaaaauagguuucugauuacauaaaauuugaauagaacacucaagaaguauguaga

SEQ ID NO: 589788 - RNA, 64 nt, hsa
gaugcaaaggaacaaugguguuggcaaagucuucuuugaauaucagggacugagucaauaaaaa

SEQ ID NO: 589789 - RNA, 64 nt, hsa
aaauuggcuuccaacuaaaauacguuugacccauuuugaauaaggaaauugaaaagaaaaauuu

SEQ ID NO: 589790 - RNA, 64 nt, hsa
uguugccuuaauuucaaaagcugcuauuuuagaauuugaauaaguacuccuaaagugaccauua

SEQ ID NO: 589791 - RNA, 64 nt, hsa
auauuugauuuugaaauguauuuuuguacuuuauuuugaauaucauccauaugucugacauuau

SEQ ID NO: 589792 - RNA, 64 nt, hsa
auaacccuguggcagugacacgggcaaauuggcauuugaauaaagcccugggaccaccucaaca

SEQ ID NO: 589793 - RNA, 64 nt, hsa
gacaggugaguuaaauauaccauuucacacaaaguuugaauagaauacauuauaccucauaggu

SEQ ID NO: 589794 - RNA, 64 nt, hsa
ugugucucauugguucauagucuuuauuuuguccuuugaauaaacauuaaaagauuucuaaacu

SEQ ID NO: 589795 - RNA, 64 nt, hsa
guacucugaaaguuuuggaaacguauucaaacaauuugaauauaaauuuaucauuuaguuauaa

SEQ ID NO: 589796 - RNA, 64 nt, hsa
caggaugaugauguugucaccacugucucuuaauuuugaauaauaguuuccuuuaauaggagua

SEQ ID NO: 589797 - RNA, 64 nt, hsa
agauauauuuagauuagaaaugguuuggucugccuuugaauauuguuuauuuuacuuuacuagu

SEQ ID NO: 589798 - RNA, 64 nt, hsa
auagaaaacaauugccuucacuuuuaaggaguaauuugaauauuaauaacucuggucuagauuu

SEQ ID NO: 589799 - RNA, 64 nt, hsa
agcacaaauagcuuauauucagauccuaucuucauuugaauauagcuuuuaaaugaaauguuac

SEQ ID NO: 589800 - RNA, 64 nt, hsa
guggacauugggauuguugcuugaaaaauuaaaauuugaauauuuucucucucauuugcaucau

SEQ ID NO: 589801 - RNA, 64 nt, hsa
gaaacauucugucaggcgguaugacuggacagacuuugaauauacucuaaaaguggacagaaaa

SEQ ID NO: 589802 - RNA, 64 nt, hsa
gugacuuauuuuuuccauuauaccauuagucagauuugaauaacgagguuuugaaaggauaaaa

SEQ ID NO: 589803 - RNA, 64 nt, hsa
aguucauguuaguauaauuauagauuuacauauauuugaauaguuaauuugcuuuguuuuacac

SEQ ID NO: 589804 - RNA, 64 nt, hsa
uaguagucaaucuaacugcaauuagaaauugucuuuugaauauacuauauauauuuuuuauguu

SEQ ID NO: 589805 - RNA, 64 nt, hsa
auugucaucaauaucuacagaagcucuuugacgguuugaauacuauggcucaagguuuucauau

SEQ ID NO: 589806 - RNA, 64 nt, hsa
ucagaauuaccaucagaaccucaauugacauuccuuugaauacgcuaauaagugacaaauaaga

SEQ ID NO: 589807 - RNA, 64 nt, hsa
auaaaccaaaaacauuugauuaauaaaauaucuauuugaauaaauuaugagcuauccuuucaaa

SEQ ID NO: 589808 - RNA, 64 nt, hsa
aacuacuacauuggcugugcccaaaugaguccucuuugaauagaaagugaacccagggcaauga

SEQ ID NO: 589809 - RNA, 64 nt, hsa
auaggauagaaacguauuguuguauauuuccauuuuugaauagggucaaggagcccaagcaaau

SEQ ID NO: 589810 - RNA, 64 nt, hsa
gauacauuaagggugaaaauagcaauacaguagauuugaauaccuugauguuuugcauuacuuc

SEQ ID NO: 589811 - RNA, 64 nt, hsa
uaagugaucuuucuaauucgaaagcuguguucuuuuugaauaccgugcauggggguuaagcuga

SEQ ID NO: 589812 - RNA, 64 nt, hsa
ggauuaauuuaaacuuuacaauuuacaucaauauuuugaauaucugauuuuuuuuaaugggaga

SEQ ID NO: 589813 - RNA, 64 nt, hsa
uaaaaggauuaaacuuuacaauuuagaucaauauuuugaauaugugaaaggauuaauuuaaacu

SEQ ID NO: 589814 - RNA, 64 nt, hsa
aguuuccauaugcagggaguaacuuuaaacaauguuugaauaauuaacugcuaagucuuauauu

SEQ ID NO: 589815 - RNA, 64 nt, hsa
aauaggaaaaaaaaauaugcauuugcuuaguuuauuugaauaaaagcucuaaaccuagguuaua

SEQ ID NO: 589816 - RNA, 64 nt, hsa
guauugagauaugauaagugccuucuauuucauuuuugaauaauucuucauuuuuauaauuuua

SEQ ID NO: 589817 - RNA, 64 nt, hsa
cauuaauauuaugguuauugucagcaauuuuauguuugaauauuugaaauaaaaguuuaagauu

SEQ ID NO: 589818 - RNA, 64 nt, hsa
acuuaauucuuuuccauauauugugauacaaacuuuugaauauggaaucuuacuauuugaauag

SEQ ID NO: 589819 - RNA, 64 nt, hsa
ugugauacaaacuuuugaauauggaaucuuacuauuugaauagaaauguguauguauaauauac

SEQ ID NO: 589820 - RNA, 64 nt, hsa
agugacaaggaagcucacagcugggcgagugcauuuugaauaguuuuuuguaaguagugcuuuu

SEQ ID NO: 589821 - RNA, 64 nt, hsa
agagucagagauggggcuggucauguuccuuugguuugaauaacucccuugacgaaaacagacu

SEQ ID NO: 589822 - RNA, 64 nt, hsa
acugccucaauaucaagggcugagacuuuugaauuuugaauauucguuggguuucauguuaaga

SEQ ID NO: 589823 - RNA, 64 nt, hsa
agugcuauucaguguuucuuuuccugauaaacacuuugaauauuuuuuuuguguuuuuguuucc

SEQ ID NO: 589824 - RNA, 64 nt, hsa
cacaguguccagcauaugguagauacuuguaguguuugaauaaaugaaaccagcauuagagcuu

SEQ ID NO: 589825 - RNA, 64 nt, hsa
guguguccaaaguauaauuauuuuagaugcuaauuuugaauaguuuauuaaacaguuauaaaua

SEQ ID NO: 589826 - RNA, 64 nt, hsa
aagcuaagauguggauuuacaggaagaacccugguuugaauaacugaucugaaauuaguaguua

SEQ ID NO: 589827 - RNA, 64 nt, hsa
ucuuuuaggaaaauaagagaaagguaagggcucuuuugaauaaacugcuguuuuauuuguggca

SEQ ID NO: 589828 - RNA, 64 nt, hsa
caaaugaaaugaauauguugggacuuuggcauaauuugaauauagcauugugugaguugugauu

SEQ ID NO: 589829 - RNA, 64 nt, hsa
aggagaggagaaaaugaagaggcaugaagaaguauuugaauaaauaauggcuaaagauuuucca

SEQ ID NO: 589830 - RNA, 64 nt, hsa
ggggaacaagccaauaaagauguuuaggauaaaauuugaauagugaauauuaacaucguaaguc

SEQ ID NO: 589831 - RNA, 64 nt, hsa
uucuagaaguucuuauuuuguuuuuguuguaauguuugaauacuauuuaauauccgguuuuaau

SEQ ID NO: 589832 - RNA, 64 nt, hsa
gcacauuugaaauuugguaggcauugcaaacacauuugaauauuguguauuucauacuauucuu

SEQ ID NO: 589833 - RNA, 64 nt, hsa
guaccuaaguaguuuuucauuauuuuaaguugaauuugaauaaagauuccagaaauaaacaugg

SEQ ID NO: 589834 - RNA, 64 nt, hsa
auauguuuucuuuauuaaaaaauauuuuuuguaguuugaauaugaaauuuggaccaaaugauaa

SEQ ID NO: 589835 - RNA, 64 nt, hsa
uccucccacuguguguauguguguauauguauguuuugaauauguuuucuuuauuaaaaaauau

SEQ ID NO: 589836 - RNA, 64 nt, hsa
aaugcucaauacuuaccuaaucaaauggcauccauuugaauaaaaugacaauaacuaaagcuag

SEQ ID NO: 589837 - RNA, 64 nt, hsa
uuugccccaccuacucuguaauuugcuuguuuguuuugaauauacagagccuugauccagaagc

SEQ ID NO: 589838 - RNA, 64 nt, hsa
cauguuuauuaccuauaugguuguuuuaauuacauuugaauaauuauauuuuuccaaccacuga

SEQ ID NO: 589839 - RNA, 64 nt, hsa
cuucguggaaugcugcauuuauauguaagugacauuugaauacuguccuuccugcuuuaucugc

SEQ ID NO: 589840 - RNA, 64 nt, hsa
cauuuuccacuuuguuuuccccaaaacauaucaguuugaauacuugaaucaugcaggccaauau

SEQ ID NO: 589841 - RNA, 64 nt, hsa
gcagcccaccugccacccaggacgggcccugcacuuugaauaggcuuuccauuuuguuuuggag

SEQ ID NO: 589842 - RNA, 64 nt, hsa
aacacagaauacuuuaugcauauuacugauuuaauuugaauauaguuuuacagccuccuugaca

SEQ ID NO: 589843 - RNA, 64 nt, hsa
uaaauauacugaguugcccguuuugaaaaugcacuuugaauaaucucaaaaagauguacaaguu

SEQ ID NO: 589844 - RNA, 64 nt, hsa
uuuuuguucuagagucagaacagguggacuuugcuuugaauauuuuagaugggacaaaaauugu

SEQ ID NO: 589845 - RNA, 64 nt, hsa
uucuuuccugucucuuuccauuuaagauauuuuauuugaauacugauaaacauuuuauccugau

SEQ ID NO: 589846 - RNA, 64 nt, hsa
aaguucgguuaacaaggaaguguuaagcagauuuuuugaauacacuuacaauauacuggcuuau

SEQ ID NO: 589847 - RNA, 64 nt, hsa
uucucuacuggaauauugguauagucaauucuuauuugaauauuuauucuauuaaacugaguuu

SEQ ID NO: 589848 - RNA, 64 nt, hsa
cauugugggaaagcauucauaucugccaagauccuuugaauacaugcaagaacacacaauggag

SEQ ID NO: 589849 - RNA, 64 nt, hsa
caguaugggaaagcguucagaccugacaagauucuuugaauacagauaaugaauguaaacaauu

SEQ ID NO: 589850 - RNA, 64 nt, hsa
cauugugggaaagcauucauaucugccaagaucguuugaauacaugcaaaacacacacuggaga

SEQ ID NO: 589851 - RNA, 64 nt, hsa
caguaugggaaagccuucagaucggcuaggauucuuugaauacaaauaaugaauguaaacaauu

SEQ ID NO: 589852 - RNA, 64 nt, hsa
uuuacuucuuucuuauuuacuaagaauuugccuguuugaauaagaacaaaacgcuaaggugggu

SEQ ID NO: 589853 - RNA, 64 nt, hsa
ugcuuuucuucucucaaaauggauccgauaaauauuugaauagagcagauuguagaaugucgug

SEQ ID NO: 589854 - RNA, 64 nt, hsa
uuguuugcuuauuuuuaaauuaacuguuuugagcuuugaauacuuaaggcuuuagagggagaac

SEQ ID NO: 589855 - RNA, 64 nt, hsa
cgaguaaaguguaaugaguacuguggaaaccaaauuugaauacugcaaauuuguaggaguuacu

SEQ ID NO: 589856 - RNA, 64 nt, hsa
cagagcuuucagggagggcuguucaaguuugguuuuugaauagacagagguuucauuuucaucu

SEQ ID NO: 589857 - RNA, 64 nt, hsa
cguauuacauaaaacacccuugaaaauauaugacuuugaauaaaauaaagcuaccauguuaaua

SEQ ID NO: 589858 - RNA, 64 nt, hsa
uuuauaugguaaaggaauccuuucagcugccaguuuugaauaaugaauaucauauuguaucauc

SEQ ID NO: 589859 - RNA, 64 nt, hsa
uggaaagcugggugaagccaguuguggagaauuguuugaauauuaucccauugaauacccagag

SEQ ID NO: 589860 - RNA, 64 nt, hsa
gcaauauguacaguaacgcgucaggcuugugacauuugaauaaggaaaaacagaguuccuguua

SEQ ID NO: 589861 - RNA, 64 nt, hsa
caaaaauacaagucccguucuguagcucuggcccuuugaauauguuuaggaagaguugcuuccc

SEQ ID NO: 589862 - RNA, 64 nt, hsa
uauauaccuuauuaaagcuugaaaacauuuagcauuugaauaguaaguuucaucacaaaucaug

SEQ ID NO: 589863 - RNA, 64 nt, hsa
uuuuuguuuuguuuuuuaaggcaggucugucauuuuugaauacuguaaaacugugauaaacuuu

SEQ ID NO: 589864 - RNA, 64 nt, hsa; identical to SEQ ID NO: 220362

SEQ ID NO: 589865 - RNA, 64 nt, hsa; identical to SEQ ID NO: 220363

SEQ ID NO: 589866 - RNA, 64 nt, hsa; identical to SEQ ID NO: 220364

SEQ ID NO: 589867 - RNA, 64 nt, hsa; identical to SEQ ID NO: 220365

SEQ ID NO: 589868 - RNA, 64 nt, hsa; identical to SEQ ID NO: 220366

SEQ ID NO: 589869 - RNA, 64 nt, hsa; identical to SEQ ID NO: 220367

SEQ ID NO: 589870 - RNA, 64 nt, hsa; identical to SEQ ID NO: 220368

SEQ ID NO: 589871 - RNA, 64 nt, hsa; identical to SEQ ID NO: 220369

SEQ ID NO: 589872 - RNA, 64 nt, hsa; identical to SEQ ID NO: 220370

SEQ ID NO: 589873 - RNA, 64 nt, hsa; identical to SEQ ID NO: 220371

SEQ ID NO: 589874 - RNA, 64 nt, hsa; identical to SEQ ID NO: 220372

SEQ ID NO: 589875 - RNA, 64 nt, hsa; identical to SEQ ID NO: 220373

SEQ ID NO: 589876 - RNA, 64 nt, hsa; identical to SEQ ID NO: 220374

SEQ ID NO: 589877 - RNA, 64 nt, hsa; identical to SEQ ID NO: 220375

SEQ ID NO: 589878 - RNA, 64 nt, hsa; identical to SEQ ID NO: 220376

SEQ ID NO: 589879 - RNA, 64 nt, hsa; identical to SEQ ID NO: 220377

SEQ ID NO: 589880 - RNA, 64 nt, hsa; identical to SEQ ID NO: 220378

SEQ ID NO: 589881 - RNA, 64 nt, hsa; identical to SEQ ID NO: 220379

SEQ ID NO: 589882 - RNA, 64 nt, hsa; identical to SEQ ID NO: 220380

SEQ ID NO: 589883 - RNA, 64 nt, hsa; identical to SEQ ID NO: 220381

SEQ ID NO: 589884 - RNA, 64 nt, hsa; identical to SEQ ID NO: 220382

SEQ ID NO: 589885 - RNA, 64 nt, hsa; identical to SEQ ID NO: 220383

SEQ ID NO: 589886 - RNA, 64 nt, hsa; identical to SEQ ID NO: 220384

SEQ ID NO: 589887 - RNA, 64 nt, hsa; identical to SEQ ID NO: 220385

SEQ ID NO: 589888 - RNA, 64 nt, hsa; identical to SEQ ID NO: 220386

SEQ ID NO: 589889 - RNA, 64 nt, hsa; identical to SEQ ID NO: 220387

SEQ ID NO: 589890 - RNA, 64 nt, hsa; identical to SEQ ID NO: 220388

SEQ ID NO: 589891 - RNA, 64 nt, hsa; identical to SEQ ID NO: 220389

SEQ ID NO: 589892 - RNA, 64 nt, hsa; identical to SEQ ID NO: 220390

SEQ ID NO: 589893 - RNA, 64 nt, hsa; identical to SEQ ID NO: 220391

SEQ ID NO: 589894 - RNA, 64 nt, hsa; identical to SEQ ID NO: 220392

SEQ ID NO: 589895 - RNA, 64 nt, hsa; identical to SEQ ID NO: 220393

SEQ ID NO: 589896 - RNA, 64 nt, hsa; identical to SEQ ID NO: 220394

SEQ ID NO: 589897 - RNA, 64 nt, hsa; identical to SEQ ID NO: 220395

SEQ ID NO: 589898 - RNA, 64 nt, hsa; identical to SEQ ID NO: 220396

SEQ ID NO: 589899 - RNA, 64 nt, hsa; identical to SEQ ID NO: 220397

SEQ ID NO: 589900 - RNA, 64 nt, hsa; identical to SEQ ID NO: 220398

SEQ ID NO: 589901 - RNA, 64 nt, hsa; identical to SEQ ID NO: 220399

SEQ ID NO: 589902 - RNA, 64 nt, hsa; identical to SEQ ID NO: 220400

SEQ ID NO: 589903 - RNA, 64 nt, hsa; identical to SEQ ID NO: 220401

SEQ ID NO: 589904 - RNA, 64 nt, hsa; identical to SEQ ID NO: 220402

SEQ ID NO: 589905 - RNA, 64 nt, hsa; identical to SEQ ID NO: 220403

SEQ ID NO: 589906 - RNA, 64 nt, hsa; identical to SEQ ID NO: 220404

SEQ ID NO: 589907 - RNA, 64 nt, hsa; identical to SEQ ID NO: 220405

SEQ ID NO: 589908 - RNA, 64 nt, hsa; identical to SEQ ID NO: 220406

SEQ ID NO: 589909 - RNA, 64 nt, hsa; identical to SEQ ID NO: 220407

SEQ ID NO: 589910 - RNA, 64 nt, hsa; identical to SEQ ID NO: 220408

SEQ ID NO: 589911 - RNA, 64 nt, hsa; identical to SEQ ID NO: 220409

SEQ ID NO: 589912 - RNA, 64 nt, hsa; identical to SEQ ID NO: 220410

SEQ ID NO: 589913 - RNA, 64 nt, hsa; identical to SEQ ID NO: 220411

SEQ ID NO: 589914 - RNA, 64 nt, hsa; identical to SEQ ID NO: 220412

SEQ ID NO: 589915 - RNA, 64 nt, hsa; identical to SEQ ID NO: 220413

SEQ ID NO: 589916 - RNA, 64 nt, hsa; identical to SEQ ID NO: 220414

SEQ ID NO: 589917 - RNA, 64 nt, hsa; identical to SEQ ID NO: 220415

SEQ ID NO: 589918 - RNA, 64 nt, hsa; identical to SEQ ID NO: 220416

SEQ ID NO: 589919 - RNA, 64 nt, hsa; identical to SEQ ID NO: 220417

SEQ ID NO: 589920 - RNA, 64 nt, hsa; identical to SEQ ID NO: 220418

SEQ ID NO: 589921 - RNA, 64 nt, hsa; identical to SEQ ID NO: 220419

SEQ ID NO: 589922 - RNA, 64 nt, hsa; identical to SEQ ID NO: 220420

SEQ ID NO: 589923 - RNA, 64 nt, hsa; identical to SEQ ID NO: 220421

SEQ ID NO: 589924 - RNA, 64 nt, hsa; identical to SEQ ID NO: 220422

SEQ ID NO: 589925 - RNA, 64 nt, hsa; identical to SEQ ID NO: 142269

SEQ ID NO: 589926 - RNA, 64 nt, hsa; identical to SEQ ID NO: 142270

SEQ ID NO: 589927 - RNA, 64 nt, hsa; identical to SEQ ID NO: 142271

SEQ ID NO: 589928 - RNA, 64 nt, hsa; identical to SEQ ID NO: 142272

SEQ ID NO: 589929 - RNA, 64 nt, hsa; identical to SEQ ID NO: 142273

SEQ ID NO: 589930 - RNA, 64 nt, hsa; identical to SEQ ID NO: 142274

SEQ ID NO: 589931 - RNA, 64 nt, hsa; identical to SEQ ID NO: 142275

SEQ ID NO: 589932 - RNA, 64 nt, hsa; identical to SEQ ID NO: 142276

SEQ ID NO: 589933 - RNA, 64 nt, hsa; identical to SEQ ID NO: 142277

SEQ ID NO: 589934 - RNA, 64 nt, hsa; identical to SEQ ID NO: 142278

SEQ ID NO: 589935 - RNA, 64 nt, hsa; identical to SEQ ID NO: 142279

SEQ ID NO: 589936 - RNA, 64 nt, hsa; identical to SEQ ID NO: 142280

SEQ ID NO: 589937 - RNA, 64 nt, hsa; identical to SEQ ID NO: 142281

SEQ ID NO: 589938 - RNA, 64 nt, hsa; identical to SEQ ID NO: 142282

SEQ ID NO: 589939 - RNA, 64 nt, hsa; identical to SEQ ID NO: 142283

SEQ ID NO: 589940 - RNA, 64 nt, hsa; identical to SEQ ID NO: 142284

SEQ ID NO: 589941 - RNA, 64 nt, hsa; identical to SEQ ID NO: 142285

SEQ ID NO: 589942 - RNA, 64 nt, hsa; identical to SEQ ID NO: 142286

SEQ ID NO: 589943 - RNA, 64 nt, hsa; identical to SEQ ID NO: 142287

SEQ ID NO: 589944 - RNA, 64 nt, hsa; identical to SEQ ID NO: 142288

SEQ ID NO: 589945 - RNA, 64 nt, hsa; identical to SEQ ID NO: 142289

SEQ ID NO: 589946 - RNA, 64 nt, hsa; identical to SEQ ID NO: 142290

SEQ ID NO: 589947 - RNA, 64 nt, hsa; identical to SEQ ID NO: 142291

SEQ ID NO: 589948 - RNA, 64 nt, hsa; identical to SEQ ID NO: 142292

SEQ ID NO: 589949 - RNA, 64 nt, hsa; identical to SEQ ID NO: 142293

SEQ ID NO: 589950 - RNA, 64 nt, hsa; identical to SEQ ID NO: 142294

SEQ ID NO: 589951 - RNA, 64 nt, hsa; identical to SEQ ID NO: 142295

SEQ ID NO: 589952 - RNA, 64 nt, hsa; identical to SEQ ID NO: 142296

SEQ ID NO: 589953 - RNA, 64 nt, hsa; identical to SEQ ID NO: 142297

SEQ ID NO: 589954 - RNA, 64 nt, hsa; identical to SEQ ID NO: 142298

SEQ ID NO: 589955 - RNA, 64 nt, hsa; identical to SEQ ID NO: 142299

SEQ ID NO: 589956 - RNA, 64 nt, hsa; identical to SEQ ID NO: 142300

SEQ ID NO: 589957 - RNA, 64 nt, hsa; identical to SEQ ID NO: 142301

SEQ ID NO: 589958 - RNA, 64 nt, hsa; identical to SEQ ID NO: 142302

SEQ ID NO: 589959 - RNA, 64 nt, hsa; identical to SEQ ID NO: 142303

SEQ ID NO: 589960 - RNA, 64 nt, hsa; identical to SEQ ID NO: 142304

SEQ ID NO: 589961 - RNA, 64 nt, hsa; identical to SEQ ID NO: 142305

SEQ ID NO: 589962 - RNA, 64 nt, hsa; identical to SEQ ID NO: 142306

SEQ ID NO: 589963 - RNA, 64 nt, hsa; identical to SEQ ID NO: 142307

SEQ ID NO: 589964 - RNA, 64 nt, hsa; identical to SEQ ID NO: 142308

SEQ ID NO: 589965 - RNA, 64 nt, hsa; identical to SEQ ID NO: 142309

SEQ ID NO: 589966 - RNA, 64 nt, hsa; identical to SEQ ID NO: 142310

SEQ ID NO: 589967 - RNA, 64 nt, hsa; identical to SEQ ID NO: 142311

SEQ ID NO: 589968 - RNA, 64 nt, hsa; identical to SEQ ID NO: 142312

SEQ ID NO: 589969 - RNA, 64 nt, hsa; identical to SEQ ID NO: 142313

SEQ ID NO: 589970 - RNA, 64 nt, hsa; identical to SEQ ID NO: 142314

SEQ ID NO: 589971 - RNA, 64 nt, hsa; identical to SEQ ID NO: 142315

SEQ ID NO: 589972 - RNA, 64 nt, hsa; identical to SEQ ID NO: 142316

SEQ ID NO: 589973 - RNA, 64 nt, hsa; identical to SEQ ID NO: 142317

SEQ ID NO: 589974 - RNA, 64 nt, hsa; identical to SEQ ID NO: 142318

SEQ ID NO: 589975 - RNA, 64 nt, hsa; identical to SEQ ID NO: 142319

SEQ ID NO: 589976 - RNA, 64 nt, hsa; identical to SEQ ID NO: 142320

SEQ ID NO: 589977 - RNA, 64 nt, hsa; identical to SEQ ID NO: 142321

SEQ ID NO: 589978 - RNA, 64 nt, hsa; identical to SEQ ID NO: 142322

SEQ ID NO: 589979 - RNA, 64 nt, hsa; identical to SEQ ID NO: 142323

SEQ ID NO: 589980 - RNA, 64 nt, hsa; identical to SEQ ID NO: 142324

SEQ ID NO: 589981 - RNA, 64 nt, hsa; identical to SEQ ID NO: 142325

SEQ ID NO: 589982 - RNA, 64 nt, hsa; identical to SEQ ID NO: 142326

SEQ ID NO: 589983 - RNA, 64 nt, hsa; identical to SEQ ID NO: 142327

SEQ ID NO: 589984 - RNA, 64 nt, hsa; identical to SEQ ID NO: 142328

SEQ ID NO: 589985 - RNA, 64 nt, hsa; identical to SEQ ID NO: 142329

SEQ ID NO: 589986 - RNA, 64 nt, hsa; identical to SEQ ID NO: 142330

SEQ ID NO: 589987 - RNA, 64 nt, hsa; identical to SEQ ID NO: 142331

SEQ ID NO: 589988 - RNA, 64 nt, hsa; identical to SEQ ID NO: 142332

SEQ ID NO: 589989 - RNA, 64 nt, hsa; identical to SEQ ID NO: 142333

SEQ ID NO: 589990 - RNA, 64 nt, hsa; identical to SEQ ID NO: 142334

SEQ ID NO: 589991 - RNA, 64 nt, hsa; identical to SEQ ID NO: 142335

SEQ ID NO: 589992 - RNA, 64 nt, hsa; identical to SEQ ID NO: 142336

SEQ ID NO: 589993 - RNA, 64 nt, hsa; identical to SEQ ID NO: 142337

SEQ ID NO: 589994 - RNA, 64 nt, hsa; identical to SEQ ID NO: 142338

SEQ ID NO: 589995 - RNA, 64 nt, hsa; identical to SEQ ID NO: 142339

SEQ ID NO: 589996 - RNA, 64 nt, hsa; identical to SEQ ID NO: 142340

SEQ ID NO: 589997 - RNA, 64 nt, hsa; identical to SEQ ID NO: 142341

SEQ ID NO: 589998 - RNA, 64 nt, hsa; identical to SEQ ID NO: 142342

SEQ ID NO: 589999 - RNA, 64 nt, hsa; identical to SEQ ID NO: 142343

SEQ ID NO: 590000 - RNA, 64 nt, hsa; identical to SEQ ID NO: 142344

SEQ ID NO: 590001 - RNA, 64 nt, hsa; identical to SEQ ID NO: 142345

SEQ ID NO: 590002 - RNA, 64 nt, hsa; identical to SEQ ID NO: 142346

SEQ ID NO: 590003 - RNA, 64 nt, hsa; identical to SEQ ID NO: 142347

SEQ ID NO: 590004 - RNA, 64 nt, hsa; identical to SEQ ID NO: 142348

SEQ ID NO: 590005 - RNA, 64 nt, hsa; identical to SEQ ID NO: 142349

SEQ ID NO: 590006 - RNA, 64 nt, hsa; identical to SEQ ID NO: 142350

SEQ ID NO: 590007 - RNA, 64 nt, hsa; identical to SEQ ID NO: 142351

SEQ ID NO: 590008 - RNA, 64 nt, hsa; identical to SEQ ID NO: 142352

SEQ ID NO: 590009 - RNA, 64 nt, hsa; identical to SEQ ID NO: 142353

SEQ ID NO: 590010 - RNA, 64 nt, hsa; identical to SEQ ID NO: 142354

SEQ ID NO: 590011 - RNA, 64 nt, hsa; identical to SEQ ID NO: 142355

SEQ ID NO: 590012 - RNA, 64 nt, hsa; identical to SEQ ID NO: 142356

SEQ ID NO: 590013 - RNA, 64 nt, hsa; identical to SEQ ID NO: 142357

SEQ ID NO: 590014 - RNA, 64 nt, hsa; identical to SEQ ID NO: 142358

SEQ ID NO: 590015 - RNA, 64 nt, hsa; identical to SEQ ID NO: 142359

SEQ ID NO: 590016 - RNA, 64 nt, hsa; identical to SEQ ID NO: 142360

SEQ ID NO: 590017 - RNA, 64 nt, hsa; identical to SEQ ID NO: 142361

SEQ ID NO: 590018 - RNA, 64 nt, hsa; identical to SEQ ID NO: 142362

SEQ ID NO: 590019 - RNA, 64 nt, hsa; identical to SEQ ID NO: 142363

SEQ ID NO: 590020 - RNA, 64 nt, hsa; identical to SEQ ID NO: 142364

SEQ ID NO: 590021 - RNA, 64 nt, hsa; identical to SEQ ID NO: 142365

SEQ ID NO: 590022 - RNA, 64 nt, hsa; identical to SEQ ID NO: 142366

SEQ ID NO: 590023 - RNA, 64 nt, hsa; identical to SEQ ID NO: 142367

SEQ ID NO: 590024 - RNA, 64 nt, hsa; identical to SEQ ID NO: 142368

SEQ ID NO: 590025 - RNA, 64 nt, hsa; identical to SEQ ID NO: 142369

SEQ ID NO: 590026 - RNA, 64 nt, hsa; identical to SEQ ID NO: 142370

SEQ ID NO: 590027 - RNA, 64 nt, hsa; identical to SEQ ID NO: 142371

SEQ ID NO: 590028 - RNA, 64 nt, hsa; identical to SEQ ID NO: 142372

SEQ ID NO: 590029 - RNA, 64 nt, hsa; identical to SEQ ID NO: 142373

SEQ ID NO: 590030 - RNA, 64 nt, hsa; identical to SEQ ID NO: 142374

SEQ ID NO: 590031 - RNA, 64 nt, hsa; identical to SEQ ID NO: 142375

SEQ ID NO: 590032 - RNA, 64 nt, hsa; identical to SEQ ID NO: 142376

SEQ ID NO: 590033 - RNA, 64 nt, hsa; identical to SEQ ID NO: 142377

SEQ ID NO: 590034 - RNA, 64 nt, hsa; identical to SEQ ID NO: 142378

SEQ ID NO: 590035 - RNA, 64 nt, hsa; identical to SEQ ID NO: 142379

SEQ ID NO: 590036 - RNA, 64 nt, hsa; identical to SEQ ID NO: 142380

SEQ ID NO: 590037 - RNA, 64 nt, hsa; identical to SEQ ID NO: 142381

SEQ ID NO: 590038 - RNA, 64 nt, hsa; identical to SEQ ID NO: 142382

SEQ ID NO: 590039 - RNA, 64 nt, hsa; identical to SEQ ID NO: 142383

SEQ ID NO: 590040 - RNA, 64 nt, hsa; identical to SEQ ID NO: 142384

SEQ ID NO: 590041 - RNA, 64 nt, hsa; identical to SEQ ID NO: 142385

SEQ ID NO: 590042 - RNA, 64 nt, hsa; identical to SEQ ID NO: 142386

SEQ ID NO: 590043 - RNA, 64 nt, hsa; identical to SEQ ID NO: 142387

SEQ ID NO: 590044 - RNA, 64 nt, hsa; identical to SEQ ID NO: 142388

SEQ ID NO: 590045 - RNA, 64 nt, hsa; identical to SEQ ID NO: 142389

SEQ ID NO: 590046 - RNA, 64 nt, hsa; identical to SEQ ID NO: 142390

SEQ ID NO: 590047 - RNA, 64 nt, hsa; identical to SEQ ID NO: 142391

SEQ ID NO: 590048 - RNA, 64 nt, hsa; identical to SEQ ID NO: 142392

SEQ ID NO: 590049 - RNA, 64 nt, hsa; identical to SEQ ID NO: 142393

SEQ ID NO: 590050 - RNA, 64 nt, hsa; identical to SEQ ID NO: 142394

SEQ ID NO: 590051 - RNA, 61 nt, hsa; identical to SEQ ID NO: 142395

SEQ ID NO: 590052 - RNA, 64 nt, hsa; identical to SEQ ID NO: 142396

SEQ ID NO: 590053 - RNA, 64 nt, hsa; identical to SEQ ID NO: 142397

SEQ ID NO: 590054 - RNA, 64 nt, hsa; identical to SEQ ID NO: 142398

SEQ ID NO: 590055 - RNA, 64 nt, hsa; identical to SEQ ID NO: 142399

SEQ ID NO: 590056 - RNA, 64 nt, hsa; identical to SEQ ID NO: 142400

SEQ ID NO: 590057 - RNA, 64 nt, hsa; identical to SEQ ID NO: 142401

SEQ ID NO: 590058 - RNA, 64 nt, hsa; identical to SEQ ID NO: 142402

SEQ ID NO: 590059 - RNA, 64 nt, hsa; identical to SEQ ID NO: 142403

SEQ ID NO: 590060 - RNA, 64 nt, hsa; identical to SEQ ID NO: 142404

SEQ ID NO: 590061 - RNA, 64 nt, hsa; identical to SEQ ID NO: 142405

SEQ ID NO: 590062 - RNA, 64 nt, hsa; identical to SEQ ID NO: 142406

SEQ ID NO: 590063 - RNA, 64 nt, hsa; identical to SEQ ID NO: 142407

SEQ ID NO: 590064 - RNA, 64 nt, hsa; identical to SEQ ID NO: 142408

SEQ ID NO: 590065 - RNA, 64 nt, hsa; identical to SEQ ID NO: 142409

SEQ ID NO: 590066 - RNA, 64 nt, hsa; identical to SEQ ID NO: 142410

SEQ ID NO: 590067 - RNA, 64 nt, hsa; identical to SEQ ID NO: 142411

SEQ ID NO: 590068 - RNA, 64 nt, hsa; identical to SEQ ID NO: 142412

SEQ ID NO: 590069 - RNA, 64 nt, hsa; identical to SEQ ID NO: 142413

SEQ ID NO: 590070 - RNA, 64 nt, hsa; identical to SEQ ID NO: 142414

SEQ ID NO: 590071 - RNA, 64 nt, hsa; identical to SEQ ID NO: 142415

SEQ ID NO: 590072 - RNA, 64 nt, hsa; identical to SEQ ID NO: 142416

SEQ ID NO: 590073 - RNA, 64 nt, hsa; identical to SEQ ID NO: 142417

SEQ ID NO: 590074 - RNA, 64 nt, hsa; identical to SEQ ID NO: 142418

SEQ ID NO: 590075 - RNA, 64 nt, hsa; identical to SEQ ID NO: 142419

SEQ ID NO: 590076 - RNA, 64 nt, hsa; identical to SEQ ID NO: 142420

SEQ ID NO: 590077 - RNA, 64 nt, hsa; identical to SEQ ID NO: 142421

SEQ ID NO: 590078 - RNA, 64 nt, hsa; identical to SEQ ID NO: 142422

SEQ ID NO: 590079 - RNA, 64 nt, hsa; identical to SEQ ID NO: 142423

SEQ ID NO: 590080 - RNA, 64 nt, hsa; identical to SEQ ID NO: 142424

SEQ ID NO: 590081 - RNA, 64 nt, hsa; identical to SEQ ID NO: 142425

SEQ ID NO: 590082 - RNA, 64 nt, hsa; identical to SEQ ID NO: 142426

SEQ ID NO: 590083 - RNA, 64 nt, hsa; identical to SEQ ID NO: 142427

SEQ ID NO: 590084 - RNA, 64 nt, hsa; identical to SEQ ID NO: 142428

SEQ ID NO: 590085 - RNA, 64 nt, hsa; identical to SEQ ID NO: 142429

SEQ ID NO: 590086 - RNA, 64 nt, hsa; identical to SEQ ID NO: 142430

SEQ ID NO: 590087 - RNA, 64 nt, hsa; identical to SEQ ID NO: 142431

SEQ ID NO: 590088 - RNA, 64 nt, hsa; identical to SEQ ID NO: 142432

SEQ ID NO: 590089 - RNA, 64 nt, hsa; identical to SEQ ID NO: 142433

SEQ ID NO: 590090 - RNA, 64 nt, hsa; identical to SEQ ID NO: 142434

SEQ ID NO: 590091 - RNA, 64 nt, hsa; identical to SEQ ID NO: 142435

SEQ ID NO: 590092 - RNA, 64 nt, hsa; identical to SEQ ID NO: 142436

SEQ ID NO: 590093 - RNA, 64 nt, hsa; identical to SEQ ID NO: 142437

SEQ ID NO: 590094 - RNA, 64 nt, hsa; identical to SEQ ID NO: 142438

SEQ ID NO: 590095 - RNA, 64 nt, hsa; identical to SEQ ID NO: 142439

SEQ ID NO: 590096 - RNA, 64 nt, hsa; identical to SEQ ID NO: 142440

SEQ ID NO: 590097 - RNA, 64 nt, hsa; identical to SEQ ID NO: 142441

SEQ ID NO: 590098 - RNA, 64 nt, hsa; identical to SEQ ID NO: 142442

SEQ ID NO: 590099 - RNA, 64 nt, hsa; identical to SEQ ID NO: 142443

SEQ ID NO: 590100 - RNA, 64 nt, hsa; identical to SEQ ID NO: 142444

SEQ ID NO: 590101 - RNA, 64 nt, hsa; identical to SEQ ID NO: 142445

SEQ ID NO: 590102 - RNA, 64 nt, hsa; identical to SEQ ID NO: 142446

SEQ ID NO: 590103 - RNA, 56 nt, hsa; identical to SEQ ID NO: 142447

SEQ ID NO: 590104 - RNA, 64 nt, hsa; identical to SEQ ID NO: 142448

SEQ ID NO: 590105 - RNA, 64 nt, hsa; identical to SEQ ID NO: 142449

SEQ ID NO: 590106 - RNA, 64 nt, hsa; identical to SEQ ID NO: 142450

SEQ ID NO: 590107 - RNA, 64 nt, hsa; identical to SEQ ID NO: 142451

SEQ ID NO: 590108 - RNA, 64 nt, hsa; identical to SEQ ID NO: 142452

SEQ ID NO: 590109 - RNA, 64 nt, hsa; identical to SEQ ID NO: 142453

SEQ ID NO: 590110 - RNA, 64 nt, hsa; identical to SEQ ID NO: 142454

SEQ ID NO: 590111 - RNA, 64 nt, hsa; identical to SEQ ID NO: 142455

SEQ ID NO: 590112 - RNA, 64 nt, hsa; identical to SEQ ID NO: 142456

SEQ ID NO: 590113 - RNA, 64 nt, hsa; identical to SEQ ID NO: 142457

SEQ ID NO: 590114 - RNA, 64 nt, hsa; identical to SEQ ID NO: 142458

SEQ ID NO: 590115 - RNA, 64 nt, hsa; identical to SEQ ID NO: 142459

SEQ ID NO: 590116 - RNA, 64 nt, hsa; identical to SEQ ID NO: 142460

SEQ ID NO: 590117 - RNA, 64 nt, hsa; identical to SEQ ID NO: 142461

SEQ ID NO: 590118 - RNA, 64 nt, hsa; identical to SEQ ID NO: 142462

SEQ ID NO: 590119 - RNA, 64 nt, hsa; identical to SEQ ID NO: 142463

SEQ ID NO: 590120 - RNA, 64 nt, hsa; identical to SEQ ID NO: 142464

SEQ ID NO: 590121 - RNA, 64 nt, hsa; identical to SEQ ID NO: 142465

SEQ ID NO: 590122 - RNA, 64 nt, hsa; identical to SEQ ID NO: 142466

SEQ ID NO: 590123 - RNA, 64 nt, hsa; identical to SEQ ID NO: 142467

SEQ ID NO: 590124 - RNA, 64 nt, hsa; identical to SEQ ID NO: 142468

SEQ ID NO: 590125 - RNA, 64 nt, hsa; identical to SEQ ID NO: 142469

SEQ ID NO: 590126 - RNA, 64 nt, hsa; identical to SEQ ID NO: 142470

SEQ ID NO: 590127 - RNA, 64 nt, hsa; identical to SEQ ID NO: 142471

SEQ ID NO: 590128 - RNA, 64 nt, hsa; identical to SEQ ID NO: 142472

SEQ ID NO: 590129 - RNA, 64 nt, hsa; identical to SEQ ID NO: 142473

SEQ ID NO: 590130 - RNA, 64 nt, hsa; identical to SEQ ID NO: 142474

SEQ ID NO: 590131 - RNA, 64 nt, hsa; identical to SEQ ID NO: 142475

SEQ ID NO: 590132 - RNA, 64 nt, hsa; identical to SEQ ID NO: 142476

SEQ ID NO: 590133 - RNA, 64 nt, hsa; identical to SEQ ID NO: 142477

SEQ ID NO: 590134 - RNA, 64 nt, hsa; identical to SEQ ID NO: 142478

SEQ ID NO: 590135 - RNA, 64 nt, hsa; identical to SEQ ID NO: 142479

SEQ ID NO: 590136 - RNA, 64 nt, hsa; identical to SEQ ID NO: 142480

SEQ ID NO: 590137 - RNA, 64 nt, hsa; identical to SEQ ID NO: 142481

SEQ ID NO: 590138 - RNA, 64 nt, hsa; identical to SEQ ID NO: 142482

SEQ ID NO: 590139 - RNA, 64 nt, hsa; identical to SEQ ID NO: 142483

SEQ ID NO: 590140 - RNA, 64 nt, hsa; identical to SEQ ID NO: 142484

SEQ ID NO: 590141 - RNA, 64 nt, hsa; identical to SEQ ID NO: 142485

SEQ ID NO: 590142 - RNA, 64 nt, hsa; identical to SEQ ID NO: 142486

SEQ ID NO: 590143 - RNA, 64 nt, hsa; identical to SEQ ID NO: 142487

SEQ ID NO: 590144 - RNA, 64 nt, hsa; identical to SEQ ID NO: 142488

SEQ ID NO: 590145 - RNA, 64 nt, hsa; identical to SEQ ID NO: 142489

SEQ ID NO: 590146 - RNA, 64 nt, hsa; identical to SEQ ID NO: 142490

SEQ ID NO: 590147 - RNA, 64 nt, hsa; identical to SEQ ID NO: 142491

SEQ ID NO: 590148 - RNA, 64 nt, hsa; identical to SEQ ID NO: 142492

SEQ ID NO: 590149 - RNA, 64 nt, hsa; identical to SEQ ID NO: 142493

SEQ ID NO: 590150 - RNA, 64 nt, hsa; identical to SEQ ID NO: 142494

SEQ ID NO: 590151 - RNA, 64 nt, hsa; identical to SEQ ID NO: 142495

SEQ ID NO: 590152 - RNA, 64 nt, hsa; identical to SEQ ID NO: 142496

SEQ ID NO: 590153 - RNA, 64 nt, hsa; identical to SEQ ID NO: 142497

SEQ ID NO: 590154 - RNA, 64 nt, hsa; identical to SEQ ID NO: 142498

SEQ ID NO: 590155 - RNA, 64 nt, hsa; identical to SEQ ID NO: 142499

SEQ ID NO: 590156 - RNA, 64 nt, hsa; identical to SEQ ID NO: 142500

SEQ ID NO: 590157 - RNA, 64 nt, hsa; identical to SEQ ID NO: 142501

SEQ ID NO: 590158 - RNA, 64 nt, hsa; identical to SEQ ID NO: 142502

SEQ ID NO: 590159 - RNA, 64 nt, hsa; identical to SEQ ID NO: 142503

SEQ ID NO: 590160 - RNA, 64 nt, hsa; identical to SEQ ID NO: 142504

SEQ ID NO: 590161 - RNA, 64 nt, hsa; identical to SEQ ID NO: 142505

SEQ ID NO: 590162 - RNA, 64 nt, hsa; identical to SEQ ID NO: 142506

SEQ ID NO: 590163 - RNA, 64 nt, hsa; identical to SEQ ID NO: 142507

SEQ ID NO: 590164 - RNA, 64 nt, hsa; identical to SEQ ID NO: 142508

SEQ ID NO: 590165 - RNA, 64 nt, hsa; identical to SEQ ID NO: 142509

SEQ ID NO: 590166 - RNA, 64 nt, hsa; identical to SEQ ID NO: 142510

SEQ ID NO: 590167 - RNA, 64 nt, hsa; identical to SEQ ID NO: 142511

SEQ ID NO: 590168 - RNA, 64 nt, hsa; identical to SEQ ID NO: 142512

SEQ ID NO: 590169 - RNA, 64 nt, hsa; identical to SEQ ID NO: 142513

SEQ ID NO: 590170 - RNA, 64 nt, hsa; identical to SEQ ID NO: 142514

SEQ ID NO: 590171 - RNA, 64 nt, hsa; identical to SEQ ID NO: 142515

SEQ ID NO: 590172 - RNA, 64 nt, hsa; identical to SEQ ID NO: 142516

SEQ ID NO: 590173 - RNA, 64 nt, hsa; identical to SEQ ID NO: 142517

SEQ ID NO: 590174 - RNA, 64 nt, hsa; identical to SEQ ID NO: 142518

SEQ ID NO: 590175 - RNA, 64 nt, hsa; identical to SEQ ID NO: 142519

SEQ ID NO: 590176 - RNA, 64 nt, hsa; identical to SEQ ID NO: 142520

SEQ ID NO: 590177 - RNA, 64 nt, hsa; identical to SEQ ID NO: 142521

SEQ ID NO: 590178 - RNA, 64 nt, hsa; identical to SEQ ID NO: 142522

SEQ ID NO: 590179 - RNA, 64 nt, hsa; identical to SEQ ID NO: 142523

SEQ ID NO: 590180 - RNA, 64 nt, hsa; identical to SEQ ID NO: 142524

SEQ ID NO: 590181 - RNA, 64 nt, hsa; identical to SEQ ID NO: 142525

SEQ ID NO: 590182 - RNA, 64 nt, hsa; identical to SEQ ID NO: 142526

SEQ ID NO: 590183 - RNA, 64 nt, hsa; identical to SEQ ID NO: 142527

SEQ ID NO: 590184 - RNA, 64 nt, hsa; identical to SEQ ID NO: 142528

SEQ ID NO: 590185 - RNA, 64 nt, hsa; identical to SEQ ID NO: 142529

SEQ ID NO: 590186 - RNA, 64 nt, hsa; identical to SEQ ID NO: 142530

SEQ ID NO: 590187 - RNA, 64 nt, hsa; identical to SEQ ID NO: 142531

SEQ ID NO: 590188 - RNA, 64 nt, hsa; identical to SEQ ID NO: 142532

SEQ ID NO: 590189 - RNA, 64 nt, hsa; identical to SEQ ID NO: 142533

SEQ ID NO: 590190 - RNA, 64 nt, hsa; identical to SEQ ID NO: 142534

SEQ ID NO: 590191 - RNA, 64 nt, hsa; identical to SEQ ID NO: 142535

SEQ ID NO: 590192 - RNA, 64 nt, hsa; identical to SEQ ID NO: 142536

SEQ ID NO: 590193 - RNA, 64 nt, hsa; identical to SEQ ID NO: 142537

SEQ ID NO: 590194 - RNA, 64 nt, hsa; identical to SEQ ID NO: 142538

SEQ ID NO: 590195 - RNA, 64 nt, hsa; identical to SEQ ID NO: 142539

SEQ ID NO: 590196 - RNA, 64 nt, hsa; identical to SEQ ID NO: 142540

SEQ ID NO: 590197 - RNA, 64 nt, hsa; identical to SEQ ID NO: 142541

SEQ ID NO: 590198 - RNA, 59 nt, hsa; identical to SEQ ID NO: 142542

SEQ ID NO: 590199 - RNA, 64 nt, hsa; identical to SEQ ID NO: 142543

SEQ ID NO: 590200 - RNA, 64 nt, hsa; identical to SEQ ID NO: 142544

SEQ ID NO: 590201 - RNA, 64 nt, hsa; identical to SEQ ID NO: 142545

SEQ ID NO: 590202 - RNA, 64 nt, hsa; identical to SEQ ID NO: 142546

SEQ ID NO: 590203 - RNA, 64 nt, hsa; identical to SEQ ID NO: 142547

SEQ ID NO: 590204 - RNA, 64 nt, hsa; identical to SEQ ID NO: 142548

SEQ ID NO: 590205 - RNA, 64 nt, hsa; identical to SEQ ID NO: 142549

SEQ ID NO: 590206 - RNA, 64 nt, hsa; identical to SEQ ID NO: 142550

SEQ ID NO: 590207 - RNA, 64 nt, hsa; identical to SEQ ID NO: 142551

SEQ ID NO: 590208 - RNA, 64 nt, hsa; identical to SEQ ID NO: 142552

SEQ ID NO: 590209 - RNA, 64 nt, hsa; identical to SEQ ID NO: 142553

SEQ ID NO: 590210 - RNA, 64 nt, hsa; identical to SEQ ID NO: 142554

SEQ ID NO: 590211 - RNA, 64 nt, hsa; identical to SEQ ID NO: 142555

SEQ ID NO: 590212 - RNA, 64 nt, hsa; identical to SEQ ID NO: 142556

SEQ ID NO: 590213 - RNA, 64 nt, hsa; identical to SEQ ID NO: 142557

SEQ ID NO: 590214 - RNA, 64 nt, hsa; identical to SEQ ID NO: 142558

SEQ ID NO: 590215 - RNA, 64 nt, hsa; identical to SEQ ID NO: 142559

SEQ ID NO: 590216 - RNA, 64 nt, hsa; identical to SEQ ID NO: 142560

SEQ ID NO: 590217 - RNA, 64 nt, hsa; identical to SEQ ID NO: 142561

SEQ ID NO: 590218 - RNA, 64 nt, hsa; identical to SEQ ID NO: 142562

SEQ ID NO: 590219 - RNA, 64 nt, hsa; identical to SEQ ID NO: 142563

SEQ ID NO: 590220 - RNA, 64 nt, hsa; identical to SEQ ID NO: 142564

SEQ ID NO: 590221 - RNA, 64 nt, hsa; identical to SEQ ID NO: 142565

SEQ ID NO: 590222 - RNA, 64 nt, hsa; identical to SEQ ID NO: 142566

SEQ ID NO: 590223 - RNA, 64 nt, hsa; identical to SEQ ID NO: 142567

SEQ ID NO: 590224 - RNA, 64 nt, hsa; identical to SEQ ID NO: 142568

SEQ ID NO: 590225 - RNA, 64 nt, hsa; identical to SEQ ID NO: 142569

SEQ ID NO: 590226 - RNA, 64 nt, hsa; identical to SEQ ID NO: 142570

SEQ ID NO: 590227 - RNA, 64 nt, hsa; identical to SEQ ID NO: 142571

SEQ ID NO: 590228 - RNA, 64 nt, hsa; identical to SEQ ID NO: 142572

SEQ ID NO: 590229 - RNA, 64 nt, hsa; identical to SEQ ID NO: 142573

SEQ ID NO: 590230 - RNA, 64 nt, hsa; identical to SEQ ID NO: 142574

SEQ ID NO: 590231 - RNA, 64 nt, hsa; identical to SEQ ID NO: 142575

SEQ ID NO: 590232 - RNA, 64 nt, hsa; identical to SEQ ID NO: 142576

SEQ ID NO: 590233 - RNA, 64 nt, hsa; identical to SEQ ID NO: 142577

SEQ ID NO: 590234 - RNA, 64 nt, hsa; identical to SEQ ID NO: 142578

SEQ ID NO: 590235 - RNA, 64 nt, hsa; identical to SEQ ID NO: 142579

SEQ ID NO: 590236 - RNA, 64 nt, hsa; identical to SEQ ID NO: 142580

SEQ ID NO: 590237 - RNA, 64 nt, hsa; identical to SEQ ID NO: 142581

SEQ ID NO: 590238 - RNA, 64 nt, hsa; identical to SEQ ID NO: 142582

SEQ ID NO: 590239 - RNA, 64 nt, hsa; identical to SEQ ID NO: 142583

SEQ ID NO: 590240 - RNA, 55 nt, hsa; identical to SEQ ID NO: 142584

SEQ ID NO: 590241 - RNA, 64 nt, hsa; identical to SEQ ID NO: 142585

SEQ ID NO: 590242 - RNA, 64 nt, hsa; identical to SEQ ID NO: 142586

SEQ ID NO: 590243 - RNA, 64 nt, hsa; identical to SEQ ID NO: 142587

SEQ ID NO: 590244 - RNA, 64 nt, hsa; identical to SEQ ID NO: 142588

SEQ ID NO: 590245 - RNA, 64 nt, hsa; identical to SEQ ID NO: 142589

SEQ ID NO: 590246 - RNA, 64 nt, hsa; identical to SEQ ID NO: 142590

SEQ ID NO: 590247 - RNA, 64 nt, hsa; identical to SEQ ID NO: 142591

SEQ ID NO: 590248 - RNA, 64 nt, hsa; identical to SEQ ID NO: 142592

SEQ ID NO: 590249 - RNA, 64 nt, hsa; identical to SEQ ID NO: 142593

SEQ ID NO: 590250 - RNA, 64 nt, hsa; identical to SEQ ID NO: 142594

SEQ ID NO: 590251 - RNA, 64 nt, hsa; identical to SEQ ID NO: 142595

SEQ ID NO: 590252 - RNA, 64 nt, hsa; identical to SEQ ID NO: 142596

SEQ ID NO: 590253 - RNA, 64 nt, hsa; identical to SEQ ID NO: 142597

SEQ ID NO: 590254 - RNA, 64 nt, hsa; identical to SEQ ID NO: 142598

SEQ ID NO: 590255 - RNA, 64 nt, hsa; identical to SEQ ID NO: 142599

SEQ ID NO: 590256 - RNA, 64 nt, hsa; identical to SEQ ID NO: 142600

SEQ ID NO: 590257 - RNA, 64 nt, hsa; identical to SEQ ID NO: 142601

SEQ ID NO: 590258 - RNA, 64 nt, hsa; identical to SEQ ID NO: 142602

SEQ ID NO: 590259 - RNA, 64 nt, hsa; identical to SEQ ID NO: 142603

SEQ ID NO: 590260 - RNA, 64 nt, hsa; identical to SEQ ID NO: 142604

SEQ ID NO: 590261 - RNA, 64 nt, hsa; identical to SEQ ID NO: 142605

SEQ ID NO: 590262 - RNA, 64 nt, hsa; identical to SEQ ID NO: 142606

SEQ ID NO: 590263 - RNA, 64 nt, hsa; identical to SEQ ID NO: 142607

SEQ ID NO: 590264 - RNA, 64 nt, hsa; identical to SEQ ID NO: 142608

SEQ ID NO: 590265 - RNA, 64 nt, hsa; identical to SEQ ID NO: 142609

SEQ ID NO: 590266 - RNA, 64 nt, hsa; identical to SEQ ID NO: 142610

SEQ ID NO: 590267 - RNA, 64 nt, hsa; identical to SEQ ID NO: 142611

SEQ ID NO: 590268 - RNA, 64 nt, hsa; identical to SEQ ID NO: 142612

SEQ ID NO: 590269 - RNA, 64 nt, hsa; identical to SEQ ID NO: 142613

SEQ ID NO: 590270 - RNA, 64 nt, hsa; identical to SEQ ID NO: 142614

SEQ ID NO: 590271 - RNA, 64 nt, hsa; identical to SEQ ID NO: 142615

SEQ ID NO: 590272 - RNA, 64 nt, hsa; identical to SEQ ID NO: 142616

SEQ ID NO: 590273 - RNA, 64 nt, hsa; identical to SEQ ID NO: 142617

SEQ ID NO: 590274 - RNA, 64 nt, hsa; identical to SEQ ID NO: 142618

SEQ ID NO: 590275 - RNA, 64 nt, hsa; identical to SEQ ID NO: 142619

SEQ ID NO: 590276 - RNA, 64 nt, hsa; identical to SEQ ID NO: 142620

SEQ ID NO: 590277 - RNA, 64 nt, hsa; identical to SEQ ID NO: 142621

SEQ ID NO: 590278 - RNA, 64 nt, hsa; identical to SEQ ID NO: 142622

SEQ ID NO: 590279 - RNA, 64 nt, hsa; identical to SEQ ID NO: 142623

SEQ ID NO: 590280 - RNA, 64 nt, hsa; identical to SEQ ID NO: 142624

SEQ ID NO: 590281 - RNA, 64 nt, hsa; identical to SEQ ID NO: 142625

SEQ ID NO: 590282 - RNA, 64 nt, hsa; identical to SEQ ID NO: 142626

SEQ ID NO: 590283 - RNA, 64 nt, hsa; identical to SEQ ID NO: 142627

SEQ ID NO: 590284 - RNA, 64 nt, hsa; identical to SEQ ID NO: 142628

SEQ ID NO: 590285 - RNA, 64 nt, hsa; identical to SEQ ID NO: 142629

SEQ ID NO: 590286 - RNA, 64 nt, hsa; identical to SEQ ID NO: 142630

SEQ ID NO: 590287 - RNA, 64 nt, hsa; identical to SEQ ID NO: 142631

SEQ ID NO: 590288 - RNA, 64 nt, hsa; identical to SEQ ID NO: 142632

SEQ ID NO: 590289 - RNA, 64 nt, hsa; identical to SEQ ID NO: 142633

SEQ ID NO: 590290 - RNA, 64 nt, hsa; identical to SEQ ID NO: 142634

SEQ ID NO: 590291 - RNA, 64 nt, hsa; identical to SEQ ID NO: 142635

SEQ ID NO: 590292 - RNA, 64 nt, hsa; identical to SEQ ID NO: 142636

SEQ ID NO: 590293 - RNA, 64 nt, hsa; identical to SEQ ID NO: 142637

SEQ ID NO: 590294 - RNA, 64 nt, hsa; identical to SEQ ID NO: 142638

SEQ ID NO: 590295 - RNA, 64 nt, hsa; identical to SEQ ID NO: 142639

SEQ ID NO: 590296 - RNA, 64 nt, hsa; identical to SEQ ID NO: 142640

SEQ ID NO: 590297 - RNA, 64 nt, hsa; identical to SEQ ID NO: 142641

SEQ ID NO: 590298 - RNA, 64 nt, hsa; identical to SEQ ID NO: 142642

SEQ ID NO: 590299 - RNA, 64 nt, hsa; identical to SEQ ID NO: 142643

SEQ ID NO: 590300 - RNA, 64 nt, hsa; identical to SEQ ID NO: 142644

SEQ ID NO: 590301 - RNA, 64 nt, hsa; identical to SEQ ID NO: 142645

SEQ ID NO: 590302 - RNA, 64 nt, hsa; identical to SEQ ID NO: 142646

SEQ ID NO: 590303 - RNA, 64 nt, hsa; identical to SEQ ID NO: 142647

SEQ ID NO: 590304 - RNA, 64 nt, hsa; identical to SEQ ID NO: 142648

SEQ ID NO: 590305 - RNA, 64 nt, hsa; identical to SEQ ID NO: 142649

SEQ ID NO: 590306 - RNA, 64 nt, hsa; identical to SEQ ID NO: 142650

SEQ ID NO: 590307 - RNA, 64 nt, hsa; identical to SEQ ID NO: 142651

SEQ ID NO: 590308 - RNA, 64 nt, hsa; identical to SEQ ID NO: 142652

SEQ ID NO: 590309 - RNA, 64 nt, hsa; identical to SEQ ID NO: 142653

SEQ ID NO: 590310 - RNA, 64 nt, hsa; identical to SEQ ID NO: 142654

SEQ ID NO: 590311 - RNA, 64 nt, hsa; identical to SEQ ID NO: 142655

SEQ ID NO: 590312 - RNA, 64 nt, hsa; identical to SEQ ID NO: 142656

SEQ ID NO: 590313 - RNA, 64 nt, hsa; identical to SEQ ID NO: 142657

SEQ ID NO: 590314 - RNA, 64 nt, hsa; identical to SEQ ID NO: 142658

SEQ ID NO: 590315 - RNA, 64 nt, hsa; identical to SEQ ID NO: 142659

SEQ ID NO: 590316 - RNA, 64 nt, hsa; identical to SEQ ID NO: 142660

SEQ ID NO: 590317 - RNA, 64 nt, hsa; identical to SEQ ID NO: 142661

SEQ ID NO: 590318 - RNA, 64 nt, hsa; identical to SEQ ID NO: 142662

SEQ ID NO: 590319 - RNA, 64 nt, hsa; identical to SEQ ID NO: 142663

SEQ ID NO: 590320 - RNA, 64 nt, hsa; identical to SEQ ID NO: 142664

SEQ ID NO: 590321 - RNA, 64 nt, hsa; identical to SEQ ID NO: 142665

SEQ ID NO: 590322 - RNA, 64 nt, hsa; identical to SEQ ID NO: 142666

SEQ ID NO: 590323 - RNA, 64 nt, hsa; identical to SEQ ID NO: 142667

SEQ ID NO: 590324 - RNA, 64 nt, hsa; identical to SEQ ID NO: 142668

SEQ ID NO: 590325 - RNA, 64 nt, hsa; identical to SEQ ID NO: 142669

SEQ ID NO: 590326 - RNA, 64 nt, hsa; identical to SEQ ID NO: 142670

SEQ ID NO: 590327 - RNA, 64 nt, hsa; identical to SEQ ID NO: 142671

SEQ ID NO: 590328 - RNA, 64 nt, hsa; identical to SEQ ID NO: 142672

SEQ ID NO: 590329 - RNA, 64 nt, hsa; identical to SEQ ID NO: 142673

SEQ ID NO: 590330 - RNA, 64 nt, hsa; identical to SEQ ID NO: 142674

SEQ ID NO: 590331 - RNA, 64 nt, hsa; identical to SEQ ID NO: 142675

SEQ ID NO: 590332 - RNA, 64 nt, hsa; identical to SEQ ID NO: 142676

SEQ ID NO: 590333 - RNA, 64 nt, hsa; identical to SEQ ID NO: 142677

SEQ ID NO: 590334 - RNA, 64 nt, hsa; identical to SEQ ID NO: 142678

SEQ ID NO: 590335 - RNA, 64 nt, hsa; identical to SEQ ID NO: 142679

SEQ ID NO: 590336 - RNA, 64 nt, hsa; identical to SEQ ID NO: 142680

SEQ ID NO: 590337 - RNA, 64 nt, hsa; identical to SEQ ID NO: 142681

SEQ ID NO: 590338 - RNA, 64 nt, hsa; identical to SEQ ID NO: 142682

SEQ ID NO: 590339 - RNA, 64 nt, hsa; identical to SEQ ID NO: 142683

SEQ ID NO: 590340 - RNA, 64 nt, hsa; identical to SEQ ID NO: 142684

SEQ ID NO: 590341 - RNA, 64 nt, hsa; identical to SEQ ID NO: 142685

SEQ ID NO: 590342 - RNA, 64 nt, hsa; identical to SEQ ID NO: 142686

SEQ ID NO: 590343 - RNA, 64 nt, hsa; identical to SEQ ID NO: 142687

SEQ ID NO: 590344 - RNA, 64 nt, hsa; identical to SEQ ID NO: 142688

SEQ ID NO: 590345 - RNA, 64 nt, hsa; identical to SEQ ID NO: 142689

SEQ ID NO: 590346 - RNA, 64 nt, hsa; identical to SEQ ID NO: 142690

SEQ ID NO: 590347 - RNA, 64 nt, hsa; identical to SEQ ID NO: 142691

SEQ ID NO: 590348 - RNA, 64 nt, hsa; identical to SEQ ID NO: 142692

SEQ ID NO: 590349 - RNA, 64 nt, hsa; identical to SEQ ID NO: 142693

SEQ ID NO: 590350 - RNA, 64 nt, hsa; identical to SEQ ID NO: 142694

SEQ ID NO: 590351 - RNA, 64 nt, hsa; identical to SEQ ID NO: 142695

SEQ ID NO: 590352 - RNA, 64 nt, hsa; identical to SEQ ID NO: 142696

SEQ ID NO: 590353 - RNA, 64 nt, hsa; identical to SEQ ID NO: 142697

SEQ ID NO: 590354 - RNA, 64 nt, hsa; identical to SEQ ID NO: 142698

SEQ ID NO: 590355 - RNA, 64 nt, hsa; identical to SEQ ID NO: 142699

SEQ ID NO: 590356 - RNA, 64 nt, hsa; identical to SEQ ID NO: 142700

SEQ ID NO: 590357 - RNA, 64 nt, hsa; identical to SEQ ID NO: 142701

SEQ ID NO: 590358 - RNA, 64 nt, hsa; identical to SEQ ID NO: 142702

SEQ ID NO: 590359 - RNA, 64 nt, hsa; identical to SEQ ID NO: 142703

SEQ ID NO: 590360 - RNA, 64 nt, hsa; identical to SEQ ID NO: 142704

SEQ ID NO: 590361 - RNA, 64 nt, hsa; identical to SEQ ID NO: 142705

SEQ ID NO: 590362 - RNA, 64 nt, hsa; identical to SEQ ID NO: 142706

SEQ ID NO: 590363 - RNA, 64 nt, hsa; identical to SEQ ID NO: 142707

SEQ ID NO: 590364 - RNA, 64 nt, hsa; identical to SEQ ID NO: 142708

SEQ ID NO: 590365 - RNA, 64 nt, hsa; identical to SEQ ID NO: 142709

SEQ ID NO: 590366 - RNA, 64 nt, hsa; identical to SEQ ID NO: 142710

SEQ ID NO: 590367 - RNA, 64 nt, hsa; identical to SEQ ID NO: 142711

SEQ ID NO: 590368 - RNA, 64 nt, hsa; identical to SEQ ID NO: 142712

SEQ ID NO: 590369 - RNA, 64 nt, hsa; identical to SEQ ID NO: 142713

SEQ ID NO: 590370 - RNA, 64 nt, hsa; identical to SEQ ID NO: 142714

SEQ ID NO: 590371 - RNA, 64 nt, hsa; identical to SEQ ID NO: 142715

SEQ ID NO: 590372 - RNA, 64 nt, hsa; identical to SEQ ID NO: 142716

SEQ ID NO: 590373 - RNA, 64 nt, hsa; identical to SEQ ID NO: 142717

SEQ ID NO: 590374 - RNA, 64 nt, hsa; identical to SEQ ID NO: 142718

SEQ ID NO: 590375 - RNA, 64 nt, hsa; identical to SEQ ID NO: 142719

SEQ ID NO: 590376 - RNA, 64 nt, hsa; identical to SEQ ID NO: 142720

SEQ ID NO: 590377 - RNA, 64 nt, hsa; identical to SEQ ID NO: 142721

SEQ ID NO: 590378 - RNA, 64 nt, hsa; identical to SEQ ID NO: 142722

SEQ ID NO: 590379 - RNA, 64 nt, hsa; identical to SEQ ID NO: 142723

SEQ ID NO: 590380 - RNA, 64 nt, hsa; identical to SEQ ID NO: 142724

SEQ ID NO: 590381 - RNA, 64 nt, hsa; identical to SEQ ID NO: 142725

SEQ ID NO: 590382 - RNA, 64 nt, hsa; identical to SEQ ID NO: 142726

SEQ ID NO: 590383 - RNA, 64 nt, hsa; identical to SEQ ID NO: 142727

SEQ ID NO: 590384 - RNA, 64 nt, hsa; identical to SEQ ID NO: 142728

SEQ ID NO: 590385 - RNA, 64 nt, hsa; identical to SEQ ID NO: 142729

SEQ ID NO: 590386 - RNA, 64 nt, hsa; identical to SEQ ID NO: 142730

SEQ ID NO: 590387 - RNA, 64 nt, hsa; identical to SEQ ID NO: 142731

SEQ ID NO: 590388 - RNA, 64 nt, hsa; identical to SEQ ID NO: 142732

SEQ ID NO: 590389 - RNA, 64 nt, hsa; identical to SEQ ID NO: 142733

SEQ ID NO: 590390 - RNA, 64 nt, hsa; identical to SEQ ID NO: 142734

SEQ ID NO: 590391 - RNA, 64 nt, hsa; identical to SEQ ID NO: 142735

SEQ ID NO: 590392 - RNA, 64 nt, hsa; identical to SEQ ID NO: 142736

SEQ ID NO: 590393 - RNA, 64 nt, hsa; identical to SEQ ID NO: 142737

SEQ ID NO: 590394 - RNA, 64 nt, hsa; identical to SEQ ID NO: 142738

SEQ ID NO: 590395 - RNA, 64 nt, hsa; identical to SEQ ID NO: 142739

SEQ ID NO: 590396 - RNA, 64 nt, hsa; identical to SEQ ID NO: 142740

SEQ ID NO: 590397 - RNA, 64 nt, hsa; identical to SEQ ID NO: 142741

SEQ ID NO: 590398 - RNA, 64 nt, hsa; identical to SEQ ID NO: 142742

SEQ ID NO: 590399 - RNA, 64 nt, hsa; identical to SEQ ID NO: 142743

SEQ ID NO: 590400 - RNA, 64 nt, hsa; identical to SEQ ID NO: 142744

SEQ ID NO: 590401 - RNA, 64 nt, hsa; identical to SEQ ID NO: 142745

SEQ ID NO: 590402 - RNA, 64 nt, hsa; identical to SEQ ID NO: 142746

SEQ ID NO: 590403 - RNA, 64 nt, hsa; identical to SEQ ID NO: 142747

SEQ ID NO: 590404 - RNA, 64 nt, hsa; identical to SEQ ID NO: 142748

SEQ ID NO: 590405 - RNA, 64 nt, hsa; identical to SEQ ID NO: 142749

SEQ ID NO: 590406 - RNA, 64 nt, hsa; identical to SEQ ID NO: 142750

SEQ ID NO: 590407 - RNA, 64 nt, hsa; identical to SEQ ID NO: 142751

SEQ ID NO: 590408 - RNA, 64 nt, hsa; identical to SEQ ID NO: 142752

SEQ ID NO: 590409 - RNA, 64 nt, hsa; identical to SEQ ID NO: 142753

SEQ ID NO: 590410 - RNA, 64 nt, hsa; identical to SEQ ID NO: 142754

SEQ ID NO: 590411 - RNA, 64 nt, hsa; identical to SEQ ID NO: 142755

SEQ ID NO: 590412 - RNA, 64 nt, hsa; identical to SEQ ID NO: 142756

SEQ ID NO: 590413 - RNA, 64 nt, hsa; identical to SEQ ID NO: 142757

SEQ ID NO: 590414 - RNA, 64 nt, hsa; identical to SEQ ID NO: 142758

SEQ ID NO: 590415 - RNA, 64 nt, hsa; identical to SEQ ID NO: 142759

SEQ ID NO: 590416 - RNA, 64 nt, hsa; identical to SEQ ID NO: 142760

SEQ ID NO: 590417 - RNA, 64 nt, hsa; identical to SEQ ID NO: 142761

SEQ ID NO: 590418 - RNA, 64 nt, hsa; identical to SEQ ID NO: 142762

SEQ ID NO: 590419 - RNA, 64 nt, hsa; identical to SEQ ID NO: 142763

SEQ ID NO: 590420 - RNA, 64 nt, hsa; identical to SEQ ID NO: 142764

SEQ ID NO: 590421 - RNA, 64 nt, hsa; identical to SEQ ID NO: 142765

SEQ ID NO: 590422 - RNA, 64 nt, hsa; identical to SEQ ID NO: 142766

SEQ ID NO: 590423 - RNA, 64 nt, hsa; identical to SEQ ID NO: 142767

SEQ ID NO: 590424 - RNA, 64 nt, hsa; identical to SEQ ID NO: 142768

SEQ ID NO: 590425 - RNA, 64 nt, hsa; identical to SEQ ID NO: 142769

SEQ ID NO: 590426 - RNA, 64 nt, hsa; identical to SEQ ID NO: 142770

SEQ ID NO: 590427 - RNA, 64 nt, hsa; identical to SEQ ID NO: 142771

SEQ ID NO: 590428 - RNA, 64 nt, hsa; identical to SEQ ID NO: 142772

SEQ ID NO: 590429 - RNA, 64 nt, hsa; identical to SEQ ID NO: 142773

SEQ ID NO: 590430 - RNA, 64 nt, hsa; identical to SEQ ID NO: 142774

SEQ ID NO: 590431 - RNA, 64 nt, hsa; identical to SEQ ID NO: 142775

SEQ ID NO: 590432 - RNA, 64 nt, hsa; identical to SEQ ID NO: 142776

SEQ ID NO: 590433 - RNA, 64 nt, hsa; identical to SEQ ID NO: 142777

SEQ ID NO: 590434 - RNA, 64 nt, hsa; identical to SEQ ID NO: 142778

SEQ ID NO: 590435 - RNA, 64 nt, hsa; identical to SEQ ID NO: 142779

SEQ ID NO: 590436 - RNA, 64 nt, hsa; identical to SEQ ID NO: 142780

SEQ ID NO: 590437 - RNA, 64 nt, hsa; identical to SEQ ID NO: 142781

SEQ ID NO: 590438 - RNA, 64 nt, hsa; identical to SEQ ID NO: 142782

SEQ ID NO: 590439 - RNA, 64 nt, hsa; identical to SEQ ID NO: 142783

SEQ ID NO: 590440 - RNA, 64 nt, hsa; identical to SEQ ID NO: 142784

SEQ ID NO: 590441 - RNA, 64 nt, hsa; identical to SEQ ID NO: 142785

SEQ ID NO: 590442 - RNA, 64 nt, hsa; identical to SEQ ID NO: 142786

SEQ ID NO: 590443 - RNA, 64 nt, hsa; identical to SEQ ID NO: 142787

SEQ ID NO: 590444 - RNA, 64 nt, hsa; identical to SEQ ID NO: 142788

SEQ ID NO: 590445 - RNA, 64 nt, hsa; identical to SEQ ID NO: 142789

SEQ ID NO: 590446 - RNA, 64 nt, hsa; identical to SEQ ID NO: 142790

SEQ ID NO: 590447 - RNA, 64 nt, hsa; identical to SEQ ID NO: 142791

SEQ ID NO: 590448 - RNA, 64 nt, hsa; identical to SEQ ID NO: 142792

SEQ ID NO: 590449 - RNA, 64 nt, hsa; identical to SEQ ID NO: 142793

SEQ ID NO: 590450 - RNA, 64 nt, hsa; identical to SEQ ID NO: 142794

SEQ ID NO: 590451 - RNA, 64 nt, hsa; identical to SEQ ID NO: 142795

SEQ ID NO: 590452 - RNA, 64 nt, hsa; identical to SEQ ID NO: 142796

SEQ ID NO: 590453 - RNA, 64 nt, hsa; identical to SEQ ID NO: 142797

SEQ ID NO: 590454 - RNA, 64 nt, hsa; identical to SEQ ID NO: 142798

SEQ ID NO: 590455 - RNA, 64 nt, hsa; identical to SEQ ID NO: 142799

SEQ ID NO: 590456 - RNA, 64 nt, hsa; identical to SEQ ID NO: 142800

SEQ ID NO: 590457 - RNA, 64 nt, hsa; identical to SEQ ID NO: 142801

SEQ ID NO: 590458 - RNA, 64 nt, hsa; identical to SEQ ID NO: 142802

SEQ ID NO: 590459 - RNA, 64 nt, hsa; identical to SEQ ID NO: 142803

SEQ ID NO: 590460 - RNA, 64 nt, hsa; identical to SEQ ID NO: 142804

SEQ ID NO: 590461 - RNA, 64 nt, hsa; identical to SEQ ID NO: 142805

SEQ ID NO: 590462 - RNA, 64 nt, hsa; identical to SEQ ID NO: 142806

SEQ ID NO: 590463 - RNA, 64 nt, hsa; identical to SEQ ID NO: 142807

SEQ ID NO: 590464 - RNA, 64 nt, hsa; identical to SEQ ID NO: 142808

SEQ ID NO: 590465 - RNA, 64 nt, hsa; identical to SEQ ID NO: 142809

SEQ ID NO: 590466 - RNA, 64 nt, hsa; identical to SEQ ID NO: 142810

SEQ ID NO: 590467 - RNA, 64 nt, hsa; identical to SEQ ID NO: 142811

SEQ ID NO: 590468 - RNA, 64 nt, hsa; identical to SEQ ID NO: 142812

SEQ ID NO: 590469 - RNA, 64 nt, hsa; identical to SEQ ID NO: 142813

SEQ ID NO: 590470 - RNA, 64 nt, hsa; identical to SEQ ID NO: 142814

SEQ ID NO: 590471 - RNA, 64 nt, hsa; identical to SEQ ID NO: 142815

SEQ ID NO: 590472 - RNA, 64 nt, hsa; identical to SEQ ID NO: 142816

SEQ ID NO: 590473 - RNA, 64 nt, hsa; identical to SEQ ID NO: 142817

SEQ ID NO: 590474 - RNA, 64 nt, hsa; identical to SEQ ID NO: 142818

SEQ ID NO: 590475 - RNA, 64 nt, hsa; identical to SEQ ID NO: 142819

SEQ ID NO: 590476 - RNA, 64 nt, hsa; identical to SEQ ID NO: 142820

SEQ ID NO: 590477 - RNA, 64 nt, hsa; identical to SEQ ID NO: 142821

SEQ ID NO: 590478 - RNA, 64 nt, hsa; identical to SEQ ID NO: 142822

SEQ ID NO: 590479 - RNA, 64 nt, hsa; identical to SEQ ID NO: 142823

SEQ ID NO: 590480 - RNA, 64 nt, hsa; identical to SEQ ID NO: 142824

SEQ ID NO: 590481 - RNA, 64 nt, hsa; identical to SEQ ID NO: 142825

SEQ ID NO: 590482 - RNA, 64 nt, hsa; identical to SEQ ID NO: 142826

SEQ ID NO: 590483 - RNA, 64 nt, hsa; identical to SEQ ID NO: 142827

SEQ ID NO: 590484 - RNA, 64 nt, hsa; identical to SEQ ID NO: 142828

SEQ ID NO: 590485 - RNA, 64 nt, hsa; identical to SEQ ID NO: 142829

SEQ ID NO: 590486 - RNA, 64 nt, hsa; identical to SEQ ID NO: 142830

SEQ ID NO: 590487 - RNA, 64 nt, hsa; identical to SEQ ID NO: 142831

SEQ ID NO: 590488 - RNA, 64 nt, hsa; identical to SEQ ID NO: 142832

SEQ ID NO: 590489 - RNA, 64 nt, hsa; identical to SEQ ID NO: 142833

SEQ ID NO: 590490 - RNA, 64 nt, hsa; identical to SEQ ID NO: 142834

SEQ ID NO: 590491 - RNA, 64 nt, hsa; identical to SEQ ID NO: 142835

SEQ ID NO: 590492 - RNA, 64 nt, hsa; identical to SEQ ID NO: 142836

SEQ ID NO: 590493 - RNA, 64 nt, hsa; identical to SEQ ID NO: 142837

SEQ ID NO: 590494 - RNA, 64 nt, hsa; identical to SEQ ID NO: 142838

SEQ ID NO: 590495 - RNA, 64 nt, hsa; identical to SEQ ID NO: 142839

SEQ ID NO: 590496 - RNA, 64 nt, hsa; identical to SEQ ID NO: 142840

SEQ ID NO: 590497 - RNA, 64 nt, hsa; identical to SEQ ID NO: 142841

SEQ ID NO: 590498 - RNA, 64 nt, hsa; identical to SEQ ID NO: 142842

SEQ ID NO: 590499 - RNA, 64 nt, hsa; identical to SEQ ID NO: 142843

SEQ ID NO: 590500 - RNA, 64 nt, hsa; identical to SEQ ID NO: 142844

SEQ ID NO: 590501 - RNA, 64 nt, hsa; identical to SEQ ID NO: 142845

SEQ ID NO: 590502 - RNA, 64 nt, hsa; identical to SEQ ID NO: 142846

SEQ ID NO: 590503 - RNA, 64 nt, hsa; identical to SEQ ID NO: 142847

SEQ ID NO: 590504 - RNA, 64 nt, hsa; identical to SEQ ID NO: 142848

SEQ ID NO: 590505 - RNA, 64 nt, hsa; identical to SEQ ID NO: 142849

SEQ ID NO: 590506 - RNA, 64 nt, hsa; identical to SEQ ID NO: 142850

SEQ ID NO: 590507 - RNA, 64 nt, hsa; identical to SEQ ID NO: 142851

SEQ ID NO: 590508 - RNA, 64 nt, hsa; identical to SEQ ID NO: 142852

SEQ ID NO: 590509 - RNA, 64 nt, hsa; identical to SEQ ID NO: 142853

SEQ ID NO: 590510 - RNA, 64 nt, hsa; identical to SEQ ID NO: 142854

SEQ ID NO: 590511 - RNA, 64 nt, hsa; identical to SEQ ID NO: 142855

SEQ ID NO: 590512 - RNA, 64 nt, hsa; identical to SEQ ID NO: 142856

SEQ ID NO: 590513 - RNA, 64 nt, hsa; identical to SEQ ID NO: 142857

SEQ ID NO: 590514 - RNA, 64 nt, hsa; identical to SEQ ID NO: 142858

SEQ ID NO: 590515 - RNA, 64 nt, hsa; identical to SEQ ID NO: 142859

SEQ ID NO: 590516 - RNA, 64 nt, hsa; identical to SEQ ID NO: 142860

SEQ ID NO: 590517 - RNA, 64 nt, hsa; identical to SEQ ID NO: 142861

SEQ ID NO: 590518 - RNA, 64 nt, hsa; identical to SEQ ID NO: 142862

SEQ ID NO: 590519 - RNA, 64 nt, hsa; identical to SEQ ID NO: 142863

SEQ ID NO: 590520 - RNA, 64 nt, hsa; identical to SEQ ID NO: 142864

SEQ ID NO: 590521 - RNA, 64 nt, hsa; identical to SEQ ID NO: 142865

SEQ ID NO: 590522 - RNA, 64 nt, hsa; identical to SEQ ID NO: 142866

SEQ ID NO: 590523 - RNA, 64 nt, hsa; identical to SEQ ID NO: 142867

SEQ ID NO: 590524 - RNA, 64 nt, hsa; identical to SEQ ID NO: 142868

SEQ ID NO: 590525 - RNA, 64 nt, hsa; identical to SEQ ID NO: 142869

SEQ ID NO: 590526 - RNA, 64 nt, hsa; identical to SEQ ID NO: 142870

SEQ ID NO: 590527 - RNA, 64 nt, hsa; identical to SEQ ID NO: 142871

SEQ ID NO: 590528 - RNA, 64 nt, hsa; identical to SEQ ID NO: 142872

SEQ ID NO: 590529 - RNA, 64 nt, hsa; identical to SEQ ID NO: 142873

SEQ ID NO: 590530 - RNA, 64 nt, hsa; identical to SEQ ID NO: 142874

SEQ ID NO: 590531 - RNA, 64 nt, hsa; identical to SEQ ID NO: 142875

SEQ ID NO: 590532 - RNA, 64 nt, hsa; identical to SEQ ID NO: 142876

SEQ ID NO: 590533 - RNA, 64 nt, hsa; identical to SEQ ID NO: 142877

SEQ ID NO: 590534 - RNA, 64 nt, hsa; identical to SEQ ID NO: 142878

SEQ ID NO: 590535 - RNA, 64 nt, hsa; identical to SEQ ID NO: 142879

SEQ ID NO: 590536 - RNA, 64 nt, hsa; identical to SEQ ID NO: 142880

SEQ ID NO: 590537 - RNA, 64 nt, hsa; identical to SEQ ID NO: 142881

SEQ ID NO: 590538 - RNA, 64 nt, hsa; identical to SEQ ID NO: 142882

SEQ ID NO: 590539 - RNA, 64 nt, hsa; identical to SEQ ID NO: 142883

SEQ ID NO: 590540 - RNA, 64 nt, hsa; identical to SEQ ID NO: 142884

SEQ ID NO: 590541 - RNA, 64 nt, hsa; identical to SEQ ID NO: 142885

SEQ ID NO: 590542 - RNA, 64 nt, hsa; identical to SEQ ID NO: 142886

SEQ ID NO: 590543 - RNA, 64 nt, hsa; identical to SEQ ID NO: 142887

SEQ ID NO: 590544 - RNA, 64 nt, hsa; identical to SEQ ID NO: 142888

SEQ ID NO: 590545 - RNA, 64 nt, hsa; identical to SEQ ID NO: 142889

SEQ ID NO: 590546 - RNA, 64 nt, hsa; identical to SEQ ID NO: 142890

SEQ ID NO: 590547 - RNA, 64 nt, hsa; identical to SEQ ID NO: 142891

SEQ ID NO: 590548 - RNA, 64 nt, hsa; identical to SEQ ID NO: 142892

SEQ ID NO: 590549 - RNA, 64 nt, hsa; identical to SEQ ID NO: 142893

SEQ ID NO: 590550 - RNA, 64 nt, hsa; identical to SEQ ID NO: 142894

SEQ ID NO: 590551 - RNA, 64 nt, hsa; identical to SEQ ID NO: 142895

SEQ ID NO: 590552 - RNA, 64 nt, hsa; identical to SEQ ID NO: 142896

SEQ ID NO: 590553 - RNA, 64 nt, hsa; identical to SEQ ID NO: 142897

SEQ ID NO: 590554 - RNA, 64 nt, hsa; identical to SEQ ID NO: 142898

SEQ ID NO: 590555 - RNA, 64 nt, hsa; identical to SEQ ID NO: 142899

SEQ ID NO: 590556 - RNA, 64 nt, hsa; identical to SEQ ID NO: 142900

SEQ ID NO: 590557 - RNA, 64 nt, hsa; identical to SEQ ID NO: 142901

SEQ ID NO: 590558 - RNA, 64 nt, hsa; identical to SEQ ID NO: 142902

SEQ ID NO: 590559 - RNA, 64 nt, hsa; identical to SEQ ID NO: 142903

SEQ ID NO: 590560 - RNA, 64 nt, hsa; identical to SEQ ID NO: 142904

SEQ ID NO: 590561 - RNA, 64 nt, hsa; identical to SEQ ID NO: 142905

SEQ ID NO: 590562 - RNA, 64 nt, hsa; identical to SEQ ID NO: 142906

SEQ ID NO: 590563 - RNA, 64 nt, hsa; identical to SEQ ID NO: 142907

SEQ ID NO: 590564 - RNA, 64 nt, hsa; identical to SEQ ID NO: 142908

SEQ ID NO: 590565 - RNA, 64 nt, hsa; identical to SEQ ID NO: 142909

SEQ ID NO: 590566 - RNA, 64 nt, hsa; identical to SEQ ID NO: 142910

SEQ ID NO: 590567 - RNA, 64 nt, hsa; identical to SEQ ID NO: 142911

SEQ ID NO: 590568 - RNA, 64 nt, hsa; identical to SEQ ID NO: 142912

SEQ ID NO: 590569 - RNA, 64 nt, hsa; identical to SEQ ID NO: 142913

SEQ ID NO: 590570 - RNA, 64 nt, hsa; identical to SEQ ID NO: 142914

SEQ ID NO: 590571 - RNA, 64 nt, hsa; identical to SEQ ID NO: 142915

SEQ ID NO: 590572 - RNA, 64 nt, hsa; identical to SEQ ID NO: 142916

SEQ ID NO: 590573 - RNA, 64 nt, hsa; identical to SEQ ID NO: 142917

SEQ ID NO: 590574 - RNA, 64 nt, hsa; identical to SEQ ID NO: 142918

SEQ ID NO: 590575 - RNA, 64 nt, hsa; identical to SEQ ID NO: 142919

SEQ ID NO: 590576 - RNA, 64 nt, hsa; identical to SEQ ID NO: 142920

SEQ ID NO: 590577 - RNA, 64 nt, hsa; identical to SEQ ID NO: 142921

SEQ ID NO: 590578 - RNA, 64 nt, hsa; identical to SEQ ID NO: 142922

SEQ ID NO: 590579 - RNA, 64 nt, hsa; identical to SEQ ID NO: 142923

SEQ ID NO: 590580 - RNA, 64 nt, hsa; identical to SEQ ID NO: 142924

SEQ ID NO: 590581 - RNA, 64 nt, hsa; identical to SEQ ID NO: 142925

SEQ ID NO: 590582 - RNA, 64 nt, hsa; identical to SEQ ID NO: 142926

SEQ ID NO: 590583 - RNA, 64 nt, hsa; identical to SEQ ID NO: 142927

SEQ ID NO: 590584 - RNA, 64 nt, hsa; identical to SEQ ID NO: 142928

SEQ ID NO: 590585 - RNA, 64 nt, hsa; identical to SEQ ID NO: 142929

SEQ ID NO: 590586 - RNA, 64 nt, hsa; identical to SEQ ID NO: 142930

SEQ ID NO: 590587 - RNA, 64 nt, hsa; identical to SEQ ID NO: 142931

SEQ ID NO: 590588 - RNA, 64 nt, hsa; identical to SEQ ID NO: 142932

SEQ ID NO: 590589 - RNA, 64 nt, hsa; identical to SEQ ID NO: 142933

SEQ ID NO: 590590 - RNA, 64 nt, hsa; identical to SEQ ID NO: 142934

SEQ ID NO: 590591 - RNA, 64 nt, hsa; identical to SEQ ID NO: 142935

SEQ ID NO: 590592 - RNA, 64 nt, hsa; identical to SEQ ID NO: 142936

SEQ ID NO: 590593 - RNA, 64 nt, hsa; identical to SEQ ID NO: 142937

SEQ ID NO: 590594 - RNA, 64 nt, hsa; identical to SEQ ID NO: 142938

SEQ ID NO: 590595 - RNA, 64 nt, hsa; identical to SEQ ID NO: 142939

SEQ ID NO: 590596 - RNA, 64 nt, hsa; identical to SEQ ID NO: 142940

SEQ ID NO: 590597 - RNA, 64 nt, hsa; identical to SEQ ID NO: 142941

SEQ ID NO: 590598 - RNA, 64 nt, hsa; identical to SEQ ID NO: 142942

SEQ ID NO: 590599 - RNA, 64 nt, hsa; identical to SEQ ID NO: 142943

SEQ ID NO: 590600 - RNA, 64 nt, hsa; identical to SEQ ID NO: 142944

SEQ ID NO: 590601 - RNA, 64 nt, hsa; identical to SEQ ID NO: 142945

SEQ ID NO: 590602 - RNA, 64 nt, hsa; identical to SEQ ID NO: 142946

SEQ ID NO: 590603 - RNA, 64 nt, hsa; identical to SEQ ID NO: 142947

SEQ ID NO: 590604 - RNA, 64 nt, hsa; identical to SEQ ID NO: 142948

SEQ ID NO: 590605 - RNA, 64 nt, hsa; identical to SEQ ID NO: 142949

SEQ ID NO: 590606 - RNA, 64 nt, hsa; identical to SEQ ID NO: 142950

SEQ ID NO: 590607 - RNA, 64 nt, hsa; identical to SEQ ID NO: 142951

SEQ ID NO: 590608 - RNA, 64 nt, hsa; identical to SEQ ID NO: 142952

SEQ ID NO: 590609 - RNA, 64 nt, hsa; identical to SEQ ID NO: 142953

SEQ ID NO: 590610 - RNA, 64 nt, hsa; identical to SEQ ID NO: 142954

SEQ ID NO: 590611 - RNA, 64 nt, hsa; identical to SEQ ID NO: 142955

SEQ ID NO: 590612 - RNA, 64 nt, hsa; identical to SEQ ID NO: 142956

SEQ ID NO: 590613 - RNA, 64 nt, hsa; identical to SEQ ID NO: 142957

SEQ ID NO: 590614 - RNA, 64 nt, hsa; identical to SEQ ID NO: 142958

SEQ ID NO: 590615 - RNA, 64 nt, hsa; identical to SEQ ID NO: 142959

SEQ ID NO: 590616 - RNA, 64 nt, hsa; identical to SEQ ID NO: 142960

SEQ ID NO: 590617 - RNA, 64 nt, hsa; identical to SEQ ID NO: 142961

SEQ ID NO: 590618 - RNA, 64 nt, hsa; identical to SEQ ID NO: 142962

SEQ ID NO: 590619 - RNA, 64 nt, hsa; identical to SEQ ID NO: 142963

SEQ ID NO: 590620 - RNA, 64 nt, hsa; identical to SEQ ID NO: 142964

SEQ ID NO: 590621 - RNA, 64 nt, hsa; identical to SEQ ID NO: 142965

SEQ ID NO: 590622 - RNA, 64 nt, hsa; identical to SEQ ID NO: 142966

SEQ ID NO: 590623 - RNA, 64 nt, hsa; identical to SEQ ID NO: 142967

SEQ ID NO: 590624 - RNA, 64 nt, hsa; identical to SEQ ID NO: 142968

SEQ ID NO: 590625 - RNA, 64 nt, hsa; identical to SEQ ID NO: 142969

SEQ ID NO: 590626 - RNA, 64 nt, hsa; identical to SEQ ID NO: 142970

SEQ ID NO: 590627 - RNA, 64 nt, hsa; identical to SEQ ID NO: 142971

SEQ ID NO: 590628 - RNA, 64 nt, hsa; identical to SEQ ID NO: 142972

SEQ ID NO: 590629 - RNA, 64 nt, hsa; identical to SEQ ID NO: 142973

SEQ ID NO: 590630 - RNA, 64 nt, hsa; identical to SEQ ID NO: 142974

SEQ ID NO: 590631 - RNA, 64 nt, hsa; identical to SEQ ID NO: 142975

SEQ ID NO: 590632 - RNA, 64 nt, hsa; identical to SEQ ID NO: 142976

SEQ ID NO: 590633 - RNA, 64 nt, hsa; identical to SEQ ID NO: 142977

SEQ ID NO: 590634 - RNA, 64 nt, hsa; identical to SEQ ID NO: 142978

SEQ ID NO: 590635 - RNA, 64 nt, hsa; identical to SEQ ID NO: 142979

SEQ ID NO: 590636 - RNA, 64 nt, hsa; identical to SEQ ID NO: 142980

SEQ ID NO: 590637 - RNA, 64 nt, hsa; identical to SEQ ID NO: 142981

SEQ ID NO: 590638 - RNA, 64 nt, hsa; identical to SEQ ID NO: 142982

SEQ ID NO: 590639 - RNA, 64 nt, hsa; identical to SEQ ID NO: 142983

SEQ ID NO: 590640 - RNA, 64 nt, hsa; identical to SEQ ID NO: 142984

SEQ ID NO: 590641 - RNA, 64 nt, hsa; identical to SEQ ID NO: 142985

SEQ ID NO: 590642 - RNA, 64 nt, hsa; identical to SEQ ID NO: 142986

SEQ ID NO: 590643 - RNA, 64 nt, hsa; identical to SEQ ID NO: 142987

SEQ ID NO: 590644 - RNA, 64 nt, hsa; identical to SEQ ID NO: 142988

SEQ ID NO: 590645 - RNA, 64 nt, hsa; identical to SEQ ID NO: 142989

SEQ ID NO: 590646 - RNA, 64 nt, hsa; identical to SEQ ID NO: 142990

SEQ ID NO: 590647 - RNA, 64 nt, hsa; identical to SEQ ID NO: 142991

SEQ ID NO: 590648 - RNA, 64 nt, hsa; identical to SEQ ID NO: 142992

SEQ ID NO: 590649 - RNA, 64 nt, hsa; identical to SEQ ID NO: 142993

SEQ ID NO: 590650 - RNA, 64 nt, hsa; identical to SEQ ID NO: 142994

SEQ ID NO: 590651 - RNA, 64 nt, hsa; identical to SEQ ID NO: 142995

SEQ ID NO: 590652 - RNA, 64 nt, hsa; identical to SEQ ID NO: 142996

SEQ ID NO: 590653 - RNA, 64 nt, hsa; identical to SEQ ID NO: 142997

SEQ ID NO: 590654 - RNA, 64 nt, hsa; identical to SEQ ID NO: 142998

SEQ ID NO: 590655 - RNA, 64 nt, hsa; identical to SEQ ID NO: 142999

SEQ ID NO: 590656 - RNA, 64 nt, hsa; identical to SEQ ID NO: 143000

SEQ ID NO: 590657 - RNA, 64 nt, hsa; identical to SEQ ID NO: 143001

SEQ ID NO: 590658 - RNA, 64 nt, hsa; identical to SEQ ID NO: 143002

SEQ ID NO: 590659 - RNA, 64 nt, hsa; identical to SEQ ID NO: 143003

SEQ ID NO: 590660 - RNA, 64 nt, hsa; identical to SEQ ID NO: 143004

SEQ ID NO: 590661 - RNA, 64 nt, hsa; identical to SEQ ID NO: 143005

SEQ ID NO: 590662 - RNA, 64 nt, hsa; identical to SEQ ID NO: 143006

SEQ ID NO: 590663 - RNA, 64 nt, hsa; identical to SEQ ID NO: 143007

SEQ ID NO: 590664 - RNA, 64 nt, hsa; identical to SEQ ID NO: 143008

SEQ ID NO: 590665 - RNA, 64 nt, hsa; identical to SEQ ID NO: 143009

SEQ ID NO: 590666 - RNA, 64 nt, hsa; identical to SEQ ID NO: 143010

SEQ ID NO: 590667 - RNA, 64 nt, hsa; identical to SEQ ID NO: 143011

SEQ ID NO: 590668 - RNA, 64 nt, hsa; identical to SEQ ID NO: 143012

SEQ ID NO: 590669 - RNA, 64 nt, hsa; identical to SEQ ID NO: 143013

SEQ ID NO: 590670 - RNA, 64 nt, hsa; identical to SEQ ID NO: 143014

SEQ ID NO: 590671 - RNA, 64 nt, hsa; identical to SEQ ID NO: 143015

SEQ ID NO: 590672 - RNA, 64 nt, hsa; identical to SEQ ID NO: 143016

SEQ ID NO: 590673 - RNA, 64 nt, hsa; identical to SEQ ID NO: 143017

SEQ ID NO: 590674 - RNA, 64 nt, hsa; identical to SEQ ID NO: 143018

SEQ ID NO: 590675 - RNA, 64 nt, hsa; identical to SEQ ID NO: 143019

SEQ ID NO: 590676 - RNA, 64 nt, hsa; identical to SEQ ID NO: 143020

SEQ ID NO: 590677 - RNA, 64 nt, hsa; identical to SEQ ID NO: 143021

SEQ ID NO: 590678 - RNA, 64 nt, hsa; identical to SEQ ID NO: 143022

SEQ ID NO: 590679 - RNA, 64 nt, hsa; identical to SEQ ID NO: 143023

SEQ ID NO: 590680 - RNA, 64 nt, hsa; identical to SEQ ID NO: 143024

SEQ ID NO: 590681 - RNA, 64 nt, hsa; identical to SEQ ID NO: 143025

SEQ ID NO: 590682 - RNA, 64 nt, hsa; identical to SEQ ID NO: 143026

SEQ ID NO: 590683 - RNA, 64 nt, hsa; identical to SEQ ID NO: 143027

SEQ ID NO: 590684 - RNA, 64 nt, hsa; identical to SEQ ID NO: 143028

SEQ ID NO: 590685 - RNA, 64 nt, hsa; identical to SEQ ID NO: 143029

SEQ ID NO: 590686 - RNA, 64 nt, hsa; identical to SEQ ID NO: 143030

SEQ ID NO: 590687 - RNA, 64 nt, hsa; identical to SEQ ID NO: 143031

SEQ ID NO: 590688 - RNA, 64 nt, hsa; identical to SEQ ID NO: 143032

SEQ ID NO: 590689 - RNA, 64 nt, hsa; identical to SEQ ID NO: 143033

SEQ ID NO: 590690 - RNA, 64 nt, hsa; identical to SEQ ID NO: 143034

SEQ ID NO: 590691 - RNA, 64 nt, hsa; identical to SEQ ID NO: 143035

SEQ ID NO: 590692 - RNA, 64 nt, hsa; identical to SEQ ID NO: 143036

SEQ ID NO: 590693 - RNA, 64 nt, hsa; identical to SEQ ID NO: 143037

SEQ ID NO: 590694 - RNA, 64 nt, hsa; identical to SEQ ID NO: 143038

SEQ ID NO: 590695 - RNA, 64 nt, hsa; identical to SEQ ID NO: 143039

SEQ ID NO: 590696 - RNA, 64 nt, hsa; identical to SEQ ID NO: 143040

SEQ ID NO: 590697 - RNA, 64 nt, hsa; identical to SEQ ID NO: 143041

SEQ ID NO: 590698 - RNA, 64 nt, hsa; identical to SEQ ID NO: 143042

SEQ ID NO: 590699 - RNA, 64 nt, hsa; identical to SEQ ID NO: 143043

SEQ ID NO: 590700 - RNA, 64 nt, hsa; identical to SEQ ID NO: 143044

SEQ ID NO: 590701 - RNA, 64 nt, hsa; identical to SEQ ID NO: 143045

SEQ ID NO: 590702 - RNA, 64 nt, hsa; identical to SEQ ID NO: 143046

SEQ ID NO: 590703 - RNA, 64 nt, hsa; identical to SEQ ID NO: 143047

SEQ ID NO: 590704 - RNA, 64 nt, hsa; identical to SEQ ID NO: 143048

SEQ ID NO: 590705 - RNA, 64 nt, hsa; identical to SEQ ID NO: 143049

SEQ ID NO: 590706 - RNA, 64 nt, hsa; identical to SEQ ID NO: 143050

SEQ ID NO: 590707 - RNA, 64 nt, hsa; identical to SEQ ID NO: 143051

SEQ ID NO: 590708 - RNA, 64 nt, hsa; identical to SEQ ID NO: 143052

SEQ ID NO: 590709 - RNA, 64 nt, hsa; identical to SEQ ID NO: 143053

SEQ ID NO: 590710 - RNA, 64 nt, hsa; identical to SEQ ID NO: 143054

SEQ ID NO: 590711 - RNA, 64 nt, hsa; identical to SEQ ID NO: 143055

SEQ ID NO: 590712 - RNA, 64 nt, hsa; identical to SEQ ID NO: 143056

SEQ ID NO: 590713 - RNA, 64 nt, hsa; identical to SEQ ID NO: 143057

SEQ ID NO: 590714 - RNA, 64 nt, hsa; identical to SEQ ID NO: 143058

SEQ ID NO: 590715 - RNA, 64 nt, hsa; identical to SEQ ID NO: 143059

SEQ ID NO: 590716 - RNA, 64 nt, hsa; identical to SEQ ID NO: 143060

SEQ ID NO: 590717 - RNA, 64 nt, hsa; identical to SEQ ID NO: 143061

SEQ ID NO: 590718 - RNA, 64 nt, hsa; identical to SEQ ID NO: 143062

SEQ ID NO: 590719 - RNA, 64 nt, hsa; identical to SEQ ID NO: 143063

SEQ ID NO: 590720 - RNA, 64 nt, hsa; identical to SEQ ID NO: 143064

SEQ ID NO: 590721 - RNA, 64 nt, hsa; identical to SEQ ID NO: 143065

SEQ ID NO: 590722 - RNA, 64 nt, hsa; identical to SEQ ID NO: 143066

SEQ ID NO: 590723 - RNA, 64 nt, hsa; identical to SEQ ID NO: 143067

SEQ ID NO: 590724 - RNA, 64 nt, hsa; identical to SEQ ID NO: 143068

SEQ ID NO: 590725 - RNA, 64 nt, hsa; identical to SEQ ID NO: 143069

SEQ ID NO: 590726 - RNA, 64 nt, hsa; identical to SEQ ID NO: 143070

SEQ ID NO: 590727 - RNA, 64 nt, hsa; identical to SEQ ID NO: 143071

SEQ ID NO: 590728 - RNA, 64 nt, hsa; identical to SEQ ID NO: 143072

SEQ ID NO: 590729 - RNA, 64 nt, hsa; identical to SEQ ID NO: 143073

SEQ ID NO: 590730 - RNA, 64 nt, hsa; identical to SEQ ID NO: 143074

SEQ ID NO: 590731 - RNA, 64 nt, hsa; identical to SEQ ID NO: 143075

SEQ ID NO: 590732 - RNA, 64 nt, hsa; identical to SEQ ID NO: 143076

SEQ ID NO: 590733 - RNA, 64 nt, hsa; identical to SEQ ID NO: 143077

SEQ ID NO: 590734 - RNA, 64 nt, hsa; identical to SEQ ID NO: 143078

SEQ ID NO: 590735 - RNA, 64 nt, hsa; identical to SEQ ID NO: 143079

SEQ ID NO: 590736 - RNA, 64 nt, hsa; identical to SEQ ID NO: 143080

SEQ ID NO: 590737 - RNA, 64 nt, hsa; identical to SEQ ID NO: 143081

SEQ ID NO: 590738 - RNA, 64 nt, hsa; identical to SEQ ID NO: 143082

SEQ ID NO: 590739 - RNA, 64 nt, hsa; identical to SEQ ID NO: 143083

SEQ ID NO: 590740 - RNA, 64 nt, hsa; identical to SEQ ID NO: 143084

SEQ ID NO: 590741 - RNA, 64 nt, hsa; identical to SEQ ID NO: 143085

SEQ ID NO: 590742 - RNA, 64 nt, hsa; identical to SEQ ID NO: 143086

SEQ ID NO: 590743 - RNA, 64 nt, hsa; identical to SEQ ID NO: 143087

SEQ ID NO: 590744 - RNA, 64 nt, hsa; identical to SEQ ID NO: 143088

SEQ ID NO: 590745 - RNA, 64 nt, hsa; identical to SEQ ID NO: 143089

SEQ ID NO: 590746 - RNA, 64 nt, hsa; identical to SEQ ID NO: 143090

SEQ ID NO: 590747 - RNA, 64 nt, hsa; identical to SEQ ID NO: 143091

SEQ ID NO: 590748 - RNA, 64 nt, hsa; identical to SEQ ID NO: 143092

SEQ ID NO: 590749 - RNA, 64 nt, hsa; identical to SEQ ID NO: 143093

SEQ ID NO: 590750 - RNA, 64 nt, hsa; identical to SEQ ID NO: 143094

SEQ ID NO: 590751 - RNA, 64 nt, hsa; identical to SEQ ID NO: 143095

SEQ ID NO: 590752 - RNA, 64 nt, hsa; identical to SEQ ID NO: 143096

SEQ ID NO: 590753 - RNA, 64 nt, hsa; identical to SEQ ID NO: 143097

SEQ ID NO: 590754 - RNA, 64 nt, hsa; identical to SEQ ID NO: 143098

SEQ ID NO: 590755 - RNA, 64 nt, hsa; identical to SEQ ID NO: 143099

SEQ ID NO: 590756 - RNA, 64 nt, hsa; identical to SEQ ID NO: 143100

SEQ ID NO: 590757 - RNA, 64 nt, hsa; identical to SEQ ID NO: 143101

SEQ ID NO: 590758 - RNA, 64 nt, hsa; identical to SEQ ID NO: 143102

SEQ ID NO: 590759 - RNA, 64 nt, hsa; identical to SEQ ID NO: 143103

SEQ ID NO: 590760 - RNA, 64 nt, hsa; identical to SEQ ID NO: 143104

SEQ ID NO: 590761 - RNA, 64 nt, hsa; identical to SEQ ID NO: 143105

SEQ ID NO: 590762 - RNA, 64 nt, hsa; identical to SEQ ID NO: 143106

SEQ ID NO: 590763 - RNA, 64 nt, hsa; identical to SEQ ID NO: 143107

SEQ ID NO: 590764 - RNA, 64 nt, hsa; identical to SEQ ID NO: 143108

SEQ ID NO: 590765 - RNA, 64 nt, hsa; identical to SEQ ID NO: 143109

SEQ ID NO: 590766 - RNA, 64 nt, hsa; identical to SEQ ID NO: 143110

SEQ ID NO: 590767 - RNA, 64 nt, hsa; identical to SEQ ID NO: 143111

SEQ ID NO: 590768 - RNA, 64 nt, hsa; identical to SEQ ID NO: 143112

SEQ ID NO: 590769 - RNA, 64 nt, hsa; identical to SEQ ID NO: 143113

SEQ ID NO: 590770 - RNA, 64 nt, hsa; identical to SEQ ID NO: 143114

SEQ ID NO: 590771 - RNA, 64 nt, hsa; identical to SEQ ID NO: 143115

SEQ ID NO: 590772 - RNA, 64 nt, hsa; identical to SEQ ID NO: 143116

SEQ ID NO: 590773 - RNA, 64 nt, hsa; identical to SEQ ID NO: 143117

SEQ ID NO: 590774 - RNA, 64 nt, hsa; identical to SEQ ID NO: 143118

SEQ ID NO: 590775 - RNA, 64 nt, hsa; identical to SEQ ID NO: 143119

SEQ ID NO: 590776 - RNA, 64 nt, hsa; identical to SEQ ID NO: 143120

SEQ ID NO: 590777 - RNA, 64 nt, hsa; identical to SEQ ID NO: 143121

SEQ ID NO: 590778 - RNA, 64 nt, hsa; identical to SEQ ID NO: 143122

SEQ ID NO: 590779 - RNA, 64 nt, hsa; identical to SEQ ID NO: 143123

SEQ ID NO: 590780 - RNA, 64 nt, hsa; identical to SEQ ID NO: 143124

SEQ ID NO: 590781 - RNA, 64 nt, hsa; identical to SEQ ID NO: 143125

SEQ ID NO: 590782 - RNA, 64 nt, hsa; identical to SEQ ID NO: 143126

SEQ ID NO: 590783 - RNA, 64 nt, hsa; identical to SEQ ID NO: 143127

SEQ ID NO: 590784 - RNA, 64 nt, hsa; identical to SEQ ID NO: 143128

SEQ ID NO: 590785 - RNA, 64 nt, hsa; identical to SEQ ID NO: 143129

SEQ ID NO: 590786 - RNA, 64 nt, hsa; identical to SEQ ID NO: 143130

SEQ ID NO: 590787 - RNA, 64 nt, hsa; identical to SEQ ID NO: 143131

SEQ ID NO: 590788 - RNA, 64 nt, hsa; identical to SEQ ID NO: 143132

SEQ ID NO: 590789 - RNA, 64 nt, hsa; identical to SEQ ID NO: 143133

SEQ ID NO: 590790 - RNA, 64 nt, hsa; identical to SEQ ID NO: 143134

SEQ ID NO: 590791 - RNA, 64 nt, hsa; identical to SEQ ID NO: 143135

SEQ ID NO: 590792 - RNA, 64 nt, hsa; identical to SEQ ID NO: 143136

SEQ ID NO: 590793 - RNA, 64 nt, hsa; identical to SEQ ID NO: 143137

SEQ ID NO: 590794 - RNA, 64 nt, hsa; identical to SEQ ID NO: 143138

SEQ ID NO: 590795 - RNA, 64 nt, hsa; identical to SEQ ID NO: 143139

SEQ ID NO: 590796 - RNA, 64 nt, hsa; identical to SEQ ID NO: 143140

SEQ ID NO: 590797 - RNA, 64 nt, hsa; identical to SEQ ID NO: 143141

SEQ ID NO: 590798 - RNA, 64 nt, hsa; identical to SEQ ID NO: 143142

SEQ ID NO: 590799 - RNA, 64 nt, hsa; identical to SEQ ID NO: 143143

SEQ ID NO: 590800 - RNA, 64 nt, hsa; identical to SEQ ID NO: 143144

SEQ ID NO: 590801 - RNA, 64 nt, hsa; identical to SEQ ID NO: 143145

SEQ ID NO: 590802 - RNA, 64 nt, hsa; identical to SEQ ID NO: 143146

SEQ ID NO: 590803 - RNA, 64 nt, hsa; identical to SEQ ID NO: 143147

SEQ ID NO: 590804 - RNA, 64 nt, hsa; identical to SEQ ID NO: 143148

SEQ ID NO: 590805 - RNA, 64 nt, hsa; identical to SEQ ID NO: 143149

SEQ ID NO: 590806 - RNA, 64 nt, hsa; identical to SEQ ID NO: 143150

SEQ ID NO: 590807 - RNA, 64 nt, hsa; identical to SEQ ID NO: 143151

SEQ ID NO: 590808 - RNA, 64 nt, hsa; identical to SEQ ID NO: 143152

SEQ ID NO: 590809 - RNA, 64 nt, hsa; identical to SEQ ID NO: 143153

SEQ ID NO: 590810 - RNA, 64 nt, hsa; identical to SEQ ID NO: 143154

SEQ ID NO: 590811 - RNA, 64 nt, hsa; identical to SEQ ID NO: 143155

SEQ ID NO: 590812 - RNA, 64 nt, hsa; identical to SEQ ID NO: 143156

SEQ ID NO: 590813 - RNA, 64 nt, hsa; identical to SEQ ID NO: 143157

SEQ ID NO: 590814 - RNA, 64 nt, hsa; identical to SEQ ID NO: 143158

SEQ ID NO: 590815 - RNA, 64 nt, hsa; identical to SEQ ID NO: 143159

SEQ ID NO: 590816 - RNA, 64 nt, hsa; identical to SEQ ID NO: 143160

SEQ ID NO: 590817 - RNA, 64 nt, hsa; identical to SEQ ID NO: 143161

SEQ ID NO: 590818 - RNA, 64 nt, hsa; identical to SEQ ID NO: 143162

SEQ ID NO: 590819 - RNA, 64 nt, hsa; identical to SEQ ID NO: 143163

SEQ ID NO: 590820 - RNA, 64 nt, hsa; identical to SEQ ID NO: 143164

SEQ ID NO: 590821 - RNA, 64 nt, hsa; identical to SEQ ID NO: 143165

SEQ ID NO: 590822 - RNA, 64 nt, hsa; identical to SEQ ID NO: 143166

SEQ ID NO: 590823 - RNA, 64 nt, hsa; identical to SEQ ID NO: 143167

SEQ ID NO: 590824 - RNA, 64 nt, hsa; identical to SEQ ID NO: 143168

SEQ ID NO: 590825 - RNA, 64 nt, hsa; identical to SEQ ID NO: 143169

SEQ ID NO: 590826 - RNA, 64 nt, hsa; identical to SEQ ID NO: 143170

SEQ ID NO: 590827 - RNA, 64 nt, hsa; identical to SEQ ID NO: 143171

SEQ ID NO: 590828 - RNA, 64 nt, hsa; identical to SEQ ID NO: 143172

SEQ ID NO: 590829 - RNA, 64 nt, hsa; identical to SEQ ID NO: 143173

SEQ ID NO: 590830 - RNA, 64 nt, hsa; identical to SEQ ID NO: 143174

SEQ ID NO: 590831 - RNA, 64 nt, hsa; identical to SEQ ID NO: 143175

SEQ ID NO: 590832 - RNA, 64 nt, hsa; identical to SEQ ID NO: 143176

SEQ ID NO: 590833 - RNA, 64 nt, hsa; identical to SEQ ID NO: 143177

SEQ ID NO: 590834 - RNA, 64 nt, hsa; identical to SEQ ID NO: 143178

SEQ ID NO: 590835 - RNA, 64 nt, hsa; identical to SEQ ID NO: 143179

SEQ ID NO: 590836 - RNA, 64 nt, hsa; identical to SEQ ID NO: 143180

SEQ ID NO: 590837 - RNA, 64 nt, hsa; identical to SEQ ID NO: 143181

SEQ ID NO: 590838 - RNA, 64 nt, hsa; identical to SEQ ID NO: 143182

SEQ ID NO: 590839 - RNA, 64 nt, hsa; identical to SEQ ID NO: 143183

SEQ ID NO: 590840 - RNA, 64 nt, hsa; identical to SEQ ID NO: 143184

SEQ ID NO: 590841 - RNA, 64 nt, hsa; identical to SEQ ID NO: 143185

SEQ ID NO: 590842 - RNA, 64 nt, hsa; identical to SEQ ID NO: 143186

SEQ ID NO: 590843 - RNA, 64 nt, hsa; identical to SEQ ID NO: 143187

SEQ ID NO: 590844 - RNA, 64 nt, hsa; identical to SEQ ID NO: 143188

SEQ ID NO: 590845 - RNA, 64 nt, hsa; identical to SEQ ID NO: 143189

SEQ ID NO: 590846 - RNA, 64 nt, hsa; identical to SEQ ID NO: 143190

SEQ ID NO: 590847 - RNA, 64 nt, hsa; identical to SEQ ID NO: 143191

SEQ ID NO: 590848 - RNA, 64 nt, hsa; identical to SEQ ID NO: 143192

SEQ ID NO: 590849 - RNA, 64 nt, hsa; identical to SEQ ID NO: 143193

SEQ ID NO: 590850 - RNA, 64 nt, hsa; identical to SEQ ID NO: 143194

SEQ ID NO: 590851 - RNA, 64 nt, hsa; identical to SEQ ID NO: 143195

SEQ ID NO: 590852 - RNA, 64 nt, hsa; identical to SEQ ID NO: 143196

SEQ ID NO: 590853 - RNA, 64 nt, hsa; identical to SEQ ID NO: 143197

SEQ ID NO: 590854 - RNA, 64 nt, hsa; identical to SEQ ID NO: 143198

SEQ ID NO: 590855 - RNA, 64 nt, hsa; identical to SEQ ID NO: 143199

SEQ ID NO: 590856 - RNA, 64 nt, hsa; identical to SEQ ID NO: 143200

SEQ ID NO: 590857 - RNA, 64 nt, hsa; identical to SEQ ID NO: 143201

SEQ ID NO: 590858 - RNA, 64 nt, hsa; identical to SEQ ID NO: 143202

SEQ ID NO: 590859 - RNA, 64 nt, hsa; identical to SEQ ID NO: 143203

SEQ ID NO: 590860 - RNA, 64 nt, hsa; identical to SEQ ID NO: 143204

SEQ ID NO: 590861 - RNA, 64 nt, hsa; identical to SEQ ID NO: 143205

SEQ ID NO: 590862 - RNA, 64 nt, hsa; identical to SEQ ID NO: 143206

SEQ ID NO: 590863 - RNA, 64 nt, hsa; identical to SEQ ID NO: 143207

SEQ ID NO: 590864 - RNA, 64 nt, hsa; identical to SEQ ID NO: 143208

SEQ ID NO: 590865 - RNA, 64 nt, hsa; identical to SEQ ID NO: 299359

SEQ ID NO: 590866 - RNA, 64 nt, hsa; identical to SEQ ID NO: 299360

SEQ ID NO: 590867 - RNA, 64 nt, hsa; identical to SEQ ID NO: 299361

SEQ ID NO: 590868 - RNA, 64 nt, hsa; identical to SEQ ID NO: 299362

SEQ ID NO: 590869 - RNA, 64 nt, hsa; identical to SEQ ID NO: 299363

SEQ ID NO: 590870 - RNA, 64 nt, hsa; identical to SEQ ID NO: 299364

SEQ ID NO: 590871 - RNA, 64 nt, hsa; identical to SEQ ID NO: 299365

SEQ ID NO: 590872 - RNA, 64 nt, hsa; identical to SEQ ID NO: 299366

SEQ ID NO: 590873 - RNA, 64 nt, hsa; identical to SEQ ID NO: 299367

SEQ ID NO: 590874 - RNA, 64 nt, hsa; identical to SEQ ID NO: 299368

SEQ ID NO: 590875 - RNA, 64 nt, hsa; identical to SEQ ID NO: 299369

SEQ ID NO: 590876 - RNA, 64 nt, hsa; identical to SEQ ID NO: 299370

SEQ ID NO: 590877 - RNA, 64 nt, hsa; identical to SEQ ID NO: 299371

SEQ ID NO: 590878 - RNA, 64 nt, hsa; identical to SEQ ID NO: 299372

SEQ ID NO: 590879 - RNA, 64 nt, hsa; identical to SEQ ID NO: 299373

SEQ ID NO: 590880 - RNA, 64 nt, hsa; identical to SEQ ID NO: 299374

SEQ ID NO: 590881 - RNA, 64 nt, hsa; identical to SEQ ID NO: 299375

SEQ ID NO: 590882 - RNA, 64 nt, hsa; identical to SEQ ID NO: 299376

SEQ ID NO: 590883 - RNA, 64 nt, hsa; identical to SEQ ID NO: 299377

SEQ ID NO: 590884 - RNA, 64 nt, hsa; identical to SEQ ID NO: 299378

SEQ ID NO: 590885 - RNA, 64 nt, hsa; identical to SEQ ID NO: 299379

SEQ ID NO: 590886 - RNA, 64 nt, hsa; identical to SEQ ID NO: 299380

SEQ ID NO: 590887 - RNA, 64 nt, hsa; identical to SEQ ID NO: 299381

SEQ ID NO: 590888 - RNA, 64 nt, hsa; identical to SEQ ID NO: 299382

SEQ ID NO: 590889 - RNA, 64 nt, hsa; identical to SEQ ID NO: 299383

SEQ ID NO: 590890 - RNA, 64 nt, hsa; identical to SEQ ID NO: 299384

SEQ ID NO: 590891 - RNA, 64 nt, hsa; identical to SEQ ID NO: 299385

SEQ ID NO: 590892 - RNA, 64 nt, hsa; identical to SEQ ID NO: 299386

SEQ ID NO: 590893 - RNA, 64 nt, hsa; identical to SEQ ID NO: 299387

SEQ ID NO: 590894 - RNA, 64 nt, hsa; identical to SEQ ID NO: 299388

SEQ ID NO: 590895 - RNA, 64 nt, hsa; identical to SEQ ID NO: 299389

SEQ ID NO: 590896 - RNA, 64 nt, hsa; identical to SEQ ID NO: 299390

SEQ ID NO: 590897 - RNA, 64 nt, hsa; identical to SEQ ID NO: 299391

SEQ ID NO: 590898 - RNA, 64 nt, hsa; identical to SEQ ID NO: 299392

SEQ ID NO: 590899 - RNA, 64 nt, hsa; identical to SEQ ID NO: 299393

SEQ ID NO: 590900 - RNA, 64 nt, hsa; identical to SEQ ID NO: 299394

SEQ ID NO: 590901 - RNA, 64 nt, hsa; identical to SEQ ID NO: 299395

SEQ ID NO: 590902 - RNA, 64 nt, hsa; identical to SEQ ID NO: 299396

SEQ ID NO: 590903 - RNA, 64 nt, hsa; identical to SEQ ID NO: 299397

SEQ ID NO: 590904 - RNA, 64 nt, hsa; identical to SEQ ID NO: 299398

SEQ ID NO: 590905 - RNA, 64 nt, hsa; identical to SEQ ID NO: 299399

SEQ ID NO: 590906 - RNA, 64 nt, hsa; identical to SEQ ID NO: 299400

SEQ ID NO: 590907 - RNA, 64 nt, hsa; identical to SEQ ID NO: 299401

SEQ ID NO: 590908 - RNA, 64 nt, hsa; identical to SEQ ID NO: 299402

SEQ ID NO: 590909 - RNA, 64 nt, hsa; identical to SEQ ID NO: 299403

SEQ ID NO: 590910 - RNA, 64 nt, hsa; identical to SEQ ID NO: 299404

SEQ ID NO: 590911 - RNA, 64 nt, hsa; identical to SEQ ID NO: 299405

SEQ ID NO: 590912 - RNA, 64 nt, hsa; identical to SEQ ID NO: 299406

SEQ ID NO: 590913 - RNA, 64 nt, hsa; identical to SEQ ID NO: 299407

SEQ ID NO: 590914 - RNA, 64 nt, hsa; identical to SEQ ID NO: 299408

SEQ ID NO: 590915 - RNA, 64 nt, hsa; identical to SEQ ID NO: 299409

SEQ ID NO: 590916 - RNA, 64 nt, hsa; identical to SEQ ID NO: 299410

SEQ ID NO: 590917 - RNA, 64 nt, hsa; identical to SEQ ID NO: 299411

SEQ ID NO: 590918 - RNA, 64 nt, hsa; identical to SEQ ID NO: 299412

SEQ ID NO: 590919 - RNA, 64 nt, hsa; identical to SEQ ID NO: 299413

SEQ ID NO: 590920 - RNA, 64 nt, hsa; identical to SEQ ID NO: 299414

SEQ ID NO: 590921 - RNA, 64 nt, hsa; identical to SEQ ID NO: 299415

SEQ ID NO: 590922 - RNA, 64 nt, hsa; identical to SEQ ID NO: 299416

SEQ ID NO: 590923 - RNA, 64 nt, hsa; identical to SEQ ID NO: 299417

SEQ ID NO: 590924 - RNA, 64 nt, hsa; identical to SEQ ID NO: 299418

SEQ ID NO: 590925 - RNA, 64 nt, hsa; identical to SEQ ID NO: 299419

SEQ ID NO: 590926 - RNA, 64 nt, hsa; identical to SEQ ID NO: 299420

SEQ ID NO: 590927 - RNA, 64 nt, hsa; identical to SEQ ID NO: 299421

SEQ ID NO: 590928 - RNA, 64 nt, hsa; identical to SEQ ID NO: 299422

SEQ ID NO: 590929 - RNA, 64 nt, hsa; identical to SEQ ID NO: 299423

SEQ ID NO: 590930 - RNA, 64 nt, hsa; identical to SEQ ID NO: 299424

SEQ ID NO: 590931 - RNA, 64 nt, hsa; identical to SEQ ID NO: 299425

SEQ ID NO: 590932 - RNA, 64 nt, hsa; identical to SEQ ID NO: 299426

SEQ ID NO: 590933 - RNA, 64 nt, hsa; identical to SEQ ID NO: 299427

SEQ ID NO: 590934 - RNA, 64 nt, hsa; identical to SEQ ID NO: 511695

SEQ ID NO: 590935 - RNA, 64 nt, hsa; identical to SEQ ID NO: 511696

SEQ ID NO: 590936 - RNA, 64 nt, hsa; identical to SEQ ID NO: 511697

SEQ ID NO: 590937 - RNA, 64 nt, hsa; identical to SEQ ID NO: 511698

SEQ ID NO: 590938 - RNA, 64 nt, hsa; identical to SEQ ID NO: 511699

SEQ ID NO: 590939 - RNA, 64 nt, hsa; identical to SEQ ID NO: 511700

SEQ ID NO: 590940 - RNA, 64 nt, hsa; identical to SEQ ID NO: 511701

SEQ ID NO: 590941 - RNA, 64 nt, hsa; identical to SEQ ID NO: 511702

SEQ ID NO: 590942 - RNA, 64 nt, hsa; identical to SEQ ID NO: 511703

SEQ ID NO: 590943 - RNA, 64 nt, hsa; identical to SEQ ID NO: 511704

SEQ ID NO: 590944 - RNA, 64 nt, hsa; identical to SEQ ID NO: 511705

SEQ ID NO: 590945 - RNA, 64 nt, hsa; identical to SEQ ID NO: 511706

SEQ ID NO: 590946 - RNA, 64 nt, hsa; identical to SEQ ID NO: 511707

SEQ ID NO: 590947 - RNA, 64 nt, hsa; identical to SEQ ID NO: 511708

SEQ ID NO: 590948 - RNA, 64 nt, hsa; identical to SEQ ID NO: 511709

SEQ ID NO: 590949 - RNA, 64 nt, hsa; identical to SEQ ID NO: 511710

SEQ ID NO: 590950 - RNA, 64 nt, hsa; identical to SEQ ID NO: 511711

SEQ ID NO: 590951 - RNA, 64 nt, hsa; identical to SEQ ID NO: 511712

SEQ ID NO: 590952 - RNA, 64 nt, hsa; identical to SEQ ID NO: 511713

SEQ ID NO: 590953 - RNA, 64 nt, hsa; identical to SEQ ID NO: 511714

SEQ ID NO: 590954 - RNA, 64 nt, hsa; identical to SEQ ID NO: 511715

SEQ ID NO: 590955 - RNA, 64 nt, hsa; identical to SEQ ID NO: 511716

SEQ ID NO: 590956 - RNA, 64 nt, hsa; identical to SEQ ID NO: 483685

SEQ ID NO: 590957 - RNA, 64 nt, hsa; identical to SEQ ID NO: 483686

SEQ ID NO: 590958 - RNA, 64 nt, hsa; identical to SEQ ID NO: 483687

SEQ ID NO: 590959 - RNA, 64 nt, hsa; identical to SEQ ID NO: 483688

SEQ ID NO: 590960 - RNA, 62 nt, hsa
gcuggaucucauagaaaauucacagccagacaaucuucuaaucuggagucuuugagaucuuc

SEQ ID NO: 590961 - RNA, 62 nt, hsa
gccagacaaucuucuaaucuggagucuuugagaucuucuaccccaacucaucauuuuccuau

SEQ ID NO: 590962 - RNA, 62 nt, hsa
cccaccauucacugacucauuaggagauaggcaucuucuaaagauuuuuuuuauauugugua

SEQ ID NO: 590963 - RNA, 62 nt, hsa
uucauagcuguaguccauucuaauaauuucugaucuucuaguggcuacuuaauuagacauua

SEQ ID NO: 590964 - RNA, 62 nt, hsa
uuuauaaaguggaaguauuaggagauucauaaaucuucuauauugagaauuggcuauguuaa

SEQ ID NO: 590965 - RNA, 62 nt, hsa
aaaauauagaaauaaugucagaucagagucugaucuucuauguuuguauuuaaauggauuaa

SEQ ID NO: 590966 - RNA, 64 nt, hsa; identical to SEQ ID NO: 226243

SEQ ID NO: 590967 - RNA, 64 nt, hsa; identical to SEQ ID NO: 226244

SEQ ID NO: 590968 - RNA, 64 nt, hsa; identical to SEQ ID NO: 226245

SEQ ID NO: 590969 - RNA, 64 nt, hsa; identical to SEQ ID NO: 226246

SEQ ID NO: 590970 - RNA, 64 nt, hsa; identical to SEQ ID NO: 226247

SEQ ID NO: 590971 - RNA, 64 nt, hsa; identical to SEQ ID NO: 226248

SEQ ID NO: 590972 - RNA, 64 nt, hsa; identical to SEQ ID NO: 226249

SEQ ID NO: 590973 - RNA, 64 nt, hsa; identical to SEQ ID NO: 226250

SEQ ID NO: 590974 - RNA, 64 nt, hsa; identical to SEQ ID NO: 226251

SEQ ID NO: 590975 - RNA, 64 nt, hsa; identical to SEQ ID NO: 226252

SEQ ID NO: 590976 - RNA, 64 nt, hsa; identical to SEQ ID NO: 226253

SEQ ID NO: 590977 - RNA, 64 nt, hsa; identical to SEQ ID NO: 226254

SEQ ID NO: 590978 - RNA, 64 nt, hsa; identical to SEQ ID NO: 226255

SEQ ID NO: 590979 - RNA, 64 nt, hsa; identical to SEQ ID NO: 226256

SEQ ID NO: 590980 - RNA, 64 nt, hsa; identical to SEQ ID NO: 226257

SEQ ID NO: 590981 - RNA, 64 nt, hsa; identical to SEQ ID NO: 226258

SEQ ID NO: 590982 - RNA, 64 nt, hsa; identical to SEQ ID NO: 226259

SEQ ID NO: 590983 - RNA, 64 nt, hsa; identical to SEQ ID NO: 226260

SEQ ID NO: 590984 - RNA, 64 nt, hsa; identical to SEQ ID NO: 226261

SEQ ID NO: 590985 - RNA, 64 nt, hsa; identical to SEQ ID NO: 226262

SEQ ID NO: 590986 - RNA, 64 nt, hsa; identical to SEQ ID NO: 226263

SEQ ID NO: 590987 - RNA, 64 nt, hsa; identical to SEQ ID NO: 226264

SEQ ID NO: 590988 - RNA, 64 nt, hsa; identical to SEQ ID NO: 246723

SEQ ID NO: 590989 - RNA, 64 nt, hsa; identical to SEQ ID NO: 246724

SEQ ID NO: 590990 - RNA, 64 nt, hsa; identical to SEQ ID NO: 246725

SEQ ID NO: 590991 - RNA, 64 nt, hsa; identical to SEQ ID NO: 246726

SEQ ID NO: 590992 - RNA, 64 nt, hsa; identical to SEQ ID NO: 246727

SEQ ID NO: 590993 - RNA, 64 nt, hsa; identical to SEQ ID NO: 246728

SEQ ID NO: 590994 - RNA, 64 nt, hsa; identical to SEQ ID NO: 246729

SEQ ID NO: 590995 - RNA, 64 nt, hsa; identical to SEQ ID NO: 246730

SEQ ID NO: 590996 - RNA, 64 nt, hsa; identical to SEQ ID NO: 246731

SEQ ID NO: 590997 - RNA, 64 nt, hsa; identical to SEQ ID NO: 246732

SEQ ID NO: 590998 - RNA, 64 nt, hsa; identical to SEQ ID NO: 246733

SEQ ID NO: 590999 - RNA, 64 nt, hsa; identical to SEQ ID NO: 246734

SEQ ID NO: 591000 - RNA, 64 nt, hsa; identical to SEQ ID NO: 246735

SEQ ID NO: 591001 - RNA, 64 nt, hsa; identical to SEQ ID NO: 246736

SEQ ID NO: 591002 - RNA, 64 nt, hsa; identical to SEQ ID NO: 246737

SEQ ID NO: 591003 - RNA, 64 nt, hsa; identical to SEQ ID NO: 246738

SEQ ID NO: 591004 - RNA, 64 nt, hsa; identical to SEQ ID NO: 246739

SEQ ID NO: 591005 - RNA, 64 nt, hsa; identical to SEQ ID NO: 246740

SEQ ID NO: 591006 - RNA, 64 nt, hsa; identical to SEQ ID NO: 246741

SEQ ID NO: 591007 - RNA, 64 nt, hsa; identical to SEQ ID NO: 246742

SEQ ID NO: 591008 - RNA, 64 nt, hsa; identical to SEQ ID NO: 246743

SEQ ID NO: 591009 - RNA, 64 nt, hsa; identical to SEQ ID NO: 246744

SEQ ID NO: 591010 - RNA, 64 nt, hsa; identical to SEQ ID NO: 246745

SEQ ID NO: 591011 - RNA, 64 nt, hsa; identical to SEQ ID NO: 246746

SEQ ID NO: 591012 - RNA, 64 nt, hsa; identical to SEQ ID NO: 246747

SEQ ID NO: 591013 - RNA, 64 nt, hsa; identical to SEQ ID NO: 246748

SEQ ID NO: 591014 - RNA, 64 nt, hsa; identical to SEQ ID NO: 246749

SEQ ID NO: 591015 - RNA, 64 nt, hsa; identical to SEQ ID NO: 246750

SEQ ID NO: 591016 - RNA, 64 nt, hsa; identical to SEQ ID NO: 246751

SEQ ID NO: 591017 - RNA, 64 nt, hsa
cgguccuacuucaaaagaauuauuuuguacaaaaucaucauauuaauauuugaguuauuuuuau

SEQ ID NO: 591018 - RNA, 64 nt, hsa
cguuucugaguagcagcaauaggguuuucaucauucaucauagugacaacugugagcauuccac

SEQ ID NO: 591019 - RNA, 64 nt, hsa
ugagcaugucuccucuuuucaguggguaacaguaucaucauauuccuuuauaguuacuaaguuu

SEQ ID NO: 591020 - RNA, 64 nt, hsa
guugaagacaauuagugaaaguaauguuauaguaucaucauauucccuuuugcuaucugucccu

SEQ ID NO: 591021 - RNA, 64 nt, hsa
gcauaguuuuuaaucaacagucacaccuugcaagucaucauagucuucauacugcagagaaauc

SEQ ID NO: 591022 - RNA, 64 nt, hsa
gcaagguuuuuaaucaaaaaacaacccuugcacgucaucauagaauucauacugcagagaaacu

SEQ ID NO: 591023 - RNA, 64 nt, hsa; identical to SEQ ID NO: 290000

SEQ ID NO: 591024 - RNA, 64 nt, hsa; identical to SEQ ID NO: 290001

SEQ ID NO: 591025 - RNA, 64 nt, hsa; identical to SEQ ID NO: 290002

SEQ ID NO: 591026 - RNA, 64 nt, hsa; identical to SEQ ID NO: 290003

SEQ ID NO: 591027 - RNA, 64 nt, hsa; identical to SEQ ID NO: 290004

SEQ ID NO: 591028 - RNA, 64 nt, hsa; identical to SEQ ID NO: 290005

SEQ ID NO: 591029 - RNA, 64 nt, hsa; identical to SEQ ID NO: 290006

SEQ ID NO: 591030 - RNA, 64 nt, hsa; identical to SEQ ID NO: 290007

SEQ ID NO: 591031 - RNA, 64 nt, hsa; identical to SEQ ID NO: 290008

SEQ ID NO: 591032 - RNA, 64 nt, hsa; identical to SEQ ID NO: 290009

SEQ ID NO: 591033 - RNA, 64 nt, hsa; identical to SEQ ID NO: 290010

SEQ ID NO: 591034 - RNA, 64 nt, hsa; identical to SEQ ID NO: 290011

SEQ ID NO: 591035 - RNA, 64 nt, hsa; identical to SEQ ID NO: 290012

SEQ ID NO: 591036 - RNA, 64 nt, hsa; identical to SEQ ID NO: 290013

SEQ ID NO: 591037 - RNA, 64 nt, hsa; identical to SEQ ID NO: 290014

SEQ ID NO: 591038 - RNA, 64 nt, hsa; identical to SEQ ID NO: 290015

SEQ ID NO: 591039 - RNA, 64 nt, hsa; identical to SEQ ID NO: 290016

SEQ ID NO: 591040 - RNA, 64 nt, hsa; identical to SEQ ID NO: 290017

SEQ ID NO: 591041 - RNA, 64 nt, hsa; identical to SEQ ID NO: 290018

SEQ ID NO: 591042 - RNA, 64 nt, hsa; identical to SEQ ID NO: 290019

SEQ ID NO: 591043 - RNA, 64 nt, hsa; identical to SEQ ID NO: 290020

SEQ ID NO: 591044 - RNA, 64 nt, hsa; identical to SEQ ID NO: 290021

SEQ ID NO: 591045 - RNA, 64 nt, hsa; identical to SEQ ID NO: 290022

SEQ ID NO: 591046 - RNA, 64 nt, hsa; identical to SEQ ID NO: 290023

SEQ ID NO: 591047 - RNA, 64 nt, hsa; identical to SEQ ID NO: 290024

SEQ ID NO: 591048 - RNA, 64 nt, hsa; identical to SEQ ID NO: 290025

SEQ ID NO: 591049 - RNA, 64 nt, hsa; identical to SEQ ID NO: 290026

SEQ ID NO: 591050 - RNA, 64 nt, hsa; identical to SEQ ID NO: 290027

SEQ ID NO: 591051 - RNA, 64 nt, hsa; identical to SEQ ID NO: 290028

SEQ ID NO: 591052 - RNA, 64 nt, hsa; identical to SEQ ID NO: 290029

SEQ ID NO: 591053 - RNA, 56 nt, hsa; identical to SEQ ID NO: 290030

SEQ ID NO: 591054 - RNA, 64 nt, hsa; identical to SEQ ID NO: 290031

SEQ ID NO: 591055 - RNA, 64 nt, hsa; identical to SEQ ID NO: 290032

SEQ ID NO: 591056 - RNA, 64 nt, hsa; identical to SEQ ID NO: 290033

SEQ ID NO: 591057 - RNA, 64 nt, hsa; identical to SEQ ID NO: 290034

SEQ ID NO: 591058 - RNA, 64 nt, hsa; identical to SEQ ID NO: 290035

SEQ ID NO: 591059 - RNA, 64 nt, hsa; identical to SEQ ID NO: 290036

SEQ ID NO: 591060 - RNA, 64 nt, hsa; identical to SEQ ID NO: 290037

SEQ ID NO: 591061 - RNA, 64 nt, hsa; identical to SEQ ID NO: 290038

SEQ ID NO: 591062 - RNA, 64 nt, hsa; identical to SEQ ID NO: 290039

SEQ ID NO: 591063 - RNA, 64 nt, hsa; identical to SEQ ID NO: 290040

SEQ ID NO: 591064 - RNA, 64 nt, hsa; identical to SEQ ID NO: 272928

SEQ ID NO: 591065 - RNA, 64 nt, hsa; identical to SEQ ID NO: 272929

SEQ ID NO: 591066 - RNA, 64 nt, hsa; identical to SEQ ID NO: 272930

SEQ ID NO: 591067 - RNA, 64 nt, hsa; identical to SEQ ID NO: 272931

SEQ ID NO: 591068 - RNA, 62 nt, hsa
gaggcccugccagcucccagcgacgacgccaccgcgcuuaugaccgaccccaagcucaucac

SEQ ID NO: 591069 - RNA, 62 nt, hsa
gggcccucgcacccuugggugcucccggccgccgcgcuuaagaacauugccucuggguguca

SEQ ID NO: 591070 - RNA, 62 nt, hsa
uucuuccccuuccucucucccccaccagggggcgcgcuuaaauuuccagacagagaccagaa

SEQ ID NO: 591071 - RNA, 62 nt, hsa
ggggagcugggguugcagggcaacaguacagucgcgcuuacgaccuggcuagaacacaaggu

SEQ ID NO: 591072 - RNA, 64 nt, hsa
uuuauuguggaaucuuugaaaggacaaggccucugugaaugaaucagucccagggaagcauuug

SEQ ID NO: 591073 - RNA, 64 nt, hsa
uauuguaaaucuuugcuaaguaguguuuuccuuggugaaugaagucauuguugucuucaagugu

SEQ ID NO: 591074 - RNA, 64 nt, hsa
gugcuguuuggaaguguaaugauuuuaucacauggugaaugacuacuaagaguaaugauuauau

SEQ ID NO: 591075 - RNA, 64 nt, hsa
gaaugacuacuaagaguaaugauuauaucacauugugaaugacuacuugccacaguaaaaauac

SEQ ID NO: 591076 - RNA, 64 nt, hsa
uauacagaguaauauucuguggcccuuugacuuugugaaugagcacaaugaaaugccgccuacu

SEQ ID NO: 591077 - RNA, 64 nt, hsa
guuuuaggugauuuaaaaauauaccguguugguggugaaugacuauugaugacuguguuaagug

SEQ ID NO: 591078 - RNA, 64 nt, hsa
auuauaguuacaaauuuuagguuggugaauccaagugaaugaaauaucagcauaacuauguggg

SEQ ID NO: 591079 - RNA, 64 nt, hsa
uguauaaauuucucuuugcauauaauacauauuugugaaugagacauauucccaaaaaauucuu

SEQ ID NO: 591080 - RNA, 64 nt, hsa
cgauucugaaguugccacaaaaaauaagacacuggugaaugagaguauaauuguuuuucuucua

SEQ ID NO: 591081 - RNA, 64 nt, hsa
cgguauggaggauuugaggaacaguaaccaggaugugaaugauuuuguuacaucaguguucacu

SEQ ID NO: 591082 - RNA, 64 nt, hsa
uguuguauauguaacucuaagagaccuuccuagagugaaugaagguagaaaacugaaaagggag

SEQ ID NO: 591083 - RNA, 64 nt, hsa
cucuucucacaauccgagcugcucuuuguccucugugaaugaagguacuuuugcuuccauuuca

SEQ ID NO: 591084 - RNA, 61 nt, hsa
aguguacaccugcaagggcugaggcccugggcccagucagcccugcugcucagagugcagg

SEQ ID NO: 591085 - RNA, 61 nt, hsa
ggccuacaccugccaaggcugaaucccugggcccagucagcccugcugcacauggcacagg

SEQ ID NO: 591086 - RNA, 61 nt, hsa
uuuuggggggacagugccaaguccaucuuugcccagucaauucagugauugauagcaauuu

SEQ ID NO: 591087 - RNA, 61 nt, hsa
ugagcuuaucuguuugaugcuguggcagggucccagucacugggcauauccuccuucuccu

SEQ ID NO: 591088 - RNA, 61 nt, hsa
uuauaauuucugaacuguucugagaccuguucccagucacugauugcaauuucuuuuacac

SEQ ID NO: 591089 - RNA, 61 nt, hsa
ugacaguccccaggcaugcccacaggccaggcccagucacagcugggcuuccacaggucag

SEQ ID NO: 591090 - RNA, 61 nt, hsa
gguuccuucucagccgaaacagguccaguaucccagucauuucuucaaaugcugauagggg

SEQ ID NO: 591091 - RNA, 61 nt, hsa
cccaggacaagagcaagaaggacaucaguugcccagucaugugauccccugccaucuugcc

SEQ ID NO: 591092 - RNA, 61 nt, hsa
cugcccaugaggcucaugaagcagaggguaucccagucauagggagcagaaagagcaagug

SEQ ID NO: 591093 - RNA, 61 nt, hsa
gaaccaaagcgucaggggcuuggggcacagccccagucagcucaacccaguccugcuucag

SEQ ID NO: 591094 - RNA, 61 nt, hsa
uuucuugaguccuugcacucacuuccccugccccagucacgaugaccccuaaagcuuccuu

SEQ ID NO: 591095 - RNA, 61 nt, hsa
auucuggcagauaucaggcccccaguucagccccagucacccucuuuuacacauguggguc

SEQ ID NO: 591096 - RNA, 64 nt, hsa; identical to SEQ ID NO: 376674

SEQ ID NO: 591097 - RNA, 64 nt, hsa; identical to SEQ ID NO: 376675

SEQ ID NO: 591098 - RNA, 64 nt, hsa; identical to SEQ ID NO: 376676

SEQ ID NO: 591099 - RNA, 64 nt, hsa; identical to SEQ ID NO: 376677

SEQ ID NO: 591100 - RNA, 64 nt, hsa; identical to SEQ ID NO: 376678

SEQ ID NO: 591101 - RNA, 64 nt, hsa; identical to SEQ ID NO: 376679

SEQ ID NO: 591102 - RNA, 64 nt, hsa; identical to SEQ ID NO: 376680

SEQ ID NO: 591103 - RNA, 64 nt, hsa; identical to SEQ ID NO: 376681

SEQ ID NO: 591104 - RNA, 64 nt, hsa; identical to SEQ ID NO: 376682

SEQ ID NO: 591105 - RNA, 64 nt, hsa; identical to SEQ ID NO: 376683

SEQ ID NO: 591106 - RNA, 64 nt, hsa; identical to SEQ ID NO: 376684

SEQ ID NO: 591107 - RNA, 64 nt, hsa; identical to SEQ ID NO: 376685

SEQ ID NO: 591108 - RNA, 64 nt, hsa; identical to SEQ ID NO: 376686

SEQ ID NO: 591109 - RNA, 64 nt, hsa; identical to SEQ ID NO: 376687

SEQ ID NO: 591110 - RNA, 64 nt, hsa; identical to SEQ ID NO: 376688

SEQ ID NO: 591111 - RNA, 64 nt, hsa; identical to SEQ ID NO: 376689

SEQ ID NO: 591112 - RNA, 64 nt, hsa; identical to SEQ ID NO: 376690

SEQ ID NO: 591113 - RNA, 64 nt, hsa; identical to SEQ ID NO: 376691

SEQ ID NO: 591114 - RNA, 64 nt, hsa; identical to SEQ ID NO: 376692

SEQ ID NO: 591115 - RNA, 64 nt, hsa; identical to SEQ ID NO: 376693

SEQ ID NO: 591116 - RNA, 64 nt, hsa; identical to SEQ ID NO: 376694

SEQ ID NO: 591117 - RNA, 64 nt, hsa; identical to SEQ ID NO: 376695

SEQ ID NO: 591118 - RNA, 64 nt, hsa; identical to SEQ ID NO: 376696

SEQ ID NO: 591119 - RNA, 64 nt, hsa; identical to SEQ ID NO: 376697

SEQ ID NO: 591120 - RNA, 64 nt, hsa; identical to SEQ ID NO: 376698

SEQ ID NO: 591121 - RNA, 64 nt, hsa; identical to SEQ ID NO: 376699

SEQ ID NO: 591122 - RNA, 64 nt, hsa; identical to SEQ ID NO: 376700

SEQ ID NO: 591123 - RNA, 64 nt, hsa; identical to SEQ ID NO: 376701

SEQ ID NO: 591124 - RNA, 64 nt, hsa; identical to SEQ ID NO: 376702

SEQ ID NO: 591125 - RNA, 64 nt, hsa; identical to SEQ ID NO: 376703

SEQ ID NO: 591126 - RNA, 64 nt, hsa; identical to SEQ ID NO: 376704

SEQ ID NO: 591127 - RNA, 64 nt, hsa; identical to SEQ ID NO: 376705

SEQ ID NO: 591128 - RNA, 64 nt, hsa; identical to SEQ ID NO: 376706

SEQ ID NO: 591129 - RNA, 64 nt, hsa; identical to SEQ ID NO: 376707

SEQ ID NO: 591130 - RNA, 64 nt, hsa; identical to SEQ ID NO: 376708

SEQ ID NO: 591131 - RNA, 64 nt, hsa; identical to SEQ ID NO: 376709

SEQ ID NO: 591132 - RNA, 64 nt, hsa; identical to SEQ ID NO: 376710

SEQ ID NO: 591133 - RNA, 64 nt, hsa; identical to SEQ ID NO: 376711

SEQ ID NO: 591134 - RNA, 64 nt, hsa; identical to SEQ ID NO: 376712

SEQ ID NO: 591135 - RNA, 64 nt, hsa; identical to SEQ ID NO: 376713

SEQ ID NO: 591136 - RNA, 64 nt, hsa; identical to SEQ ID NO: 376714

SEQ ID NO: 591137 - RNA, 64 nt, hsa; identical to SEQ ID NO: 376715

SEQ ID NO: 591138 - RNA, 64 nt, hsa; identical to SEQ ID NO: 376716

SEQ ID NO: 591139 - RNA, 64 nt, hsa; identical to SEQ ID NO: 376717

SEQ ID NO: 591140 - RNA, 64 nt, hsa; identical to SEQ ID NO: 376718

SEQ ID NO: 591141 - RNA, 64 nt, hsa; identical to SEQ ID NO: 376719

SEQ ID NO: 591142 - RNA, 64 nt, hsa; identical to SEQ ID NO: 376720

SEQ ID NO: 591143 - RNA, 64 nt, hsa; identical to SEQ ID NO: 376721

SEQ ID NO: 591144 - RNA, 64 nt, hsa; identical to SEQ ID NO: 376722

SEQ ID NO: 591145 - RNA, 64 nt, hsa; identical to SEQ ID NO: 376723

SEQ ID NO: 591146 - RNA, 64 nt, hsa; identical to SEQ ID NO: 376724

SEQ ID NO: 591147 - RNA, 64 nt, hsa; identical to SEQ ID NO: 376725

SEQ ID NO: 591148 - RNA, 64 nt, hsa; identical to SEQ ID NO: 376726

SEQ ID NO: 591149 - RNA, 64 nt, hsa; identical to SEQ ID NO: 376727

SEQ ID NO: 591150 - RNA, 64 nt, hsa; identical to SEQ ID NO: 376728

SEQ ID NO: 591151 - RNA, 64 nt, hsa; identical to SEQ ID NO: 376729

SEQ ID NO: 591152 - RNA, 64 nt, hsa; identical to SEQ ID NO: 376730

SEQ ID NO: 591153 - RNA, 64 nt, hsa; identical to SEQ ID NO: 376731

SEQ ID NO: 591154 - RNA, 62 nt, hsa; identical to SEQ ID NO: 376732

SEQ ID NO: 591155 - RNA, 64 nt, hsa; identical to SEQ ID NO: 376733

SEQ ID NO: 591156 - RNA, 64 nt, hsa; identical to SEQ ID NO: 376734

SEQ ID NO: 591157 - RNA, 55 nt, hsa; identical to SEQ ID NO: 376735

SEQ ID NO: 591158 - RNA, 64 nt, hsa; identical to SEQ ID NO: 376736

SEQ ID NO: 591159 - RNA, 64 nt, hsa; identical to SEQ ID NO: 376737

SEQ ID NO: 591160 - RNA, 64 nt, hsa; identical to SEQ ID NO: 376738

SEQ ID NO: 591161 - RNA, 64 nt, hsa; identical to SEQ ID NO: 376739

SEQ ID NO: 591162 - RNA, 64 nt, hsa; identical to SEQ ID NO: 376740

SEQ ID NO: 591163 - RNA, 64 nt, hsa; identical to SEQ ID NO: 376741

SEQ ID NO: 591164 - RNA, 64 nt, hsa; identical to SEQ ID NO: 376742

SEQ ID NO: 591165 - RNA, 64 nt, hsa; identical to SEQ ID NO: 376743

SEQ ID NO: 591166 - RNA, 64 nt, hsa; identical to SEQ ID NO: 376744

SEQ ID NO: 591167 - RNA, 64 nt, hsa; identical to SEQ ID NO: 376745

SEQ ID NO: 591168 - RNA, 64 nt, hsa; identical to SEQ ID NO: 376746

SEQ ID NO: 591169 - RNA, 64 nt, hsa; identical to SEQ ID NO: 376747

SEQ ID NO: 591170 - RNA, 64 nt, hsa; identical to SEQ ID NO: 376748

SEQ ID NO: 591171 - RNA, 64 nt, hsa; identical to SEQ ID NO: 376749

SEQ ID NO: 591172 - RNA, 64 nt, hsa; identical to SEQ ID NO: 376750

SEQ ID NO: 591173 - RNA, 64 nt, hsa; identical to SEQ ID NO: 376751

SEQ ID NO: 591174 - RNA, 64 nt, hsa; identical to SEQ ID NO: 376752

SEQ ID NO: 591175 - RNA, 64 nt, hsa; identical to SEQ ID NO: 376753

SEQ ID NO: 591176 - RNA, 64 nt, hsa; identical to SEQ ID NO: 376754

SEQ ID NO: 591177 - RNA, 64 nt, hsa; identical to SEQ ID NO: 376755

SEQ ID NO: 591178 - RNA, 64 nt, hsa; identical to SEQ ID NO: 376756

SEQ ID NO: 591179 - RNA, 64 nt, hsa; identical to SEQ ID NO: 376757

SEQ ID NO: 591180 - RNA, 64 nt, hsa; identical to SEQ ID NO: 376758

SEQ ID NO: 591181 - RNA, 64 nt, hsa; identical to SEQ ID NO: 376759

SEQ ID NO: 591182 - RNA, 64 nt, hsa; identical to SEQ ID NO: 376760

SEQ ID NO: 591183 - RNA, 64 nt, hsa; identical to SEQ ID NO: 376761

SEQ ID NO: 591184 - RNA, 64 nt, hsa; identical to SEQ ID NO: 376762

SEQ ID NO: 591185 - RNA, 64 nt, hsa; identical to SEQ ID NO: 376763

SEQ ID NO: 591186 - RNA, 64 nt, hsa; identical to SEQ ID NO: 376764

SEQ ID NO: 591187 - RNA, 64 nt, hsa; identical to SEQ ID NO: 376765

SEQ ID NO: 591188 - RNA, 64 nt, hsa; identical to SEQ ID NO: 376766

SEQ ID NO: 591189 - RNA, 64 nt, hsa; identical to SEQ ID NO: 376767

SEQ ID NO: 591190 - RNA, 64 nt, hsa; identical to SEQ ID NO: 376768

SEQ ID NO: 591191 - RNA, 64 nt, hsa; identical to SEQ ID NO: 376769

SEQ ID NO: 591192 - RNA, 64 nt, hsa; identical to SEQ ID NO: 376770

SEQ ID NO: 591193 - RNA, 64 nt, hsa; identical to SEQ ID NO: 376771

SEQ ID NO: 591194 - RNA, 64 nt, hsa; identical to SEQ ID NO: 376772

SEQ ID NO: 591195 - RNA, 64 nt, hsa; identical to SEQ ID NO: 376773

SEQ ID NO: 591196 - RNA, 64 nt, hsa; identical to SEQ ID NO: 376774

SEQ ID NO: 591197 - RNA, 64 nt, hsa; identical to SEQ ID NO: 376775

SEQ ID NO: 591198 - RNA, 64 nt, hsa; identical to SEQ ID NO: 376776

SEQ ID NO: 591199 - RNA, 64 nt, hsa; identical to SEQ ID NO: 376777

SEQ ID NO: 591200 - RNA, 64 nt, hsa; identical to SEQ ID NO: 376778

SEQ ID NO: 591201 - RNA, 64 nt, hsa; identical to SEQ ID NO: 376779

SEQ ID NO: 591202 - RNA, 64 nt, hsa; identical to SEQ ID NO: 376780

SEQ ID NO: 591203 - RNA, 64 nt, hsa; identical to SEQ ID NO: 376781

SEQ ID NO: 591204 - RNA, 64 nt, hsa; identical to SEQ ID NO: 376782

SEQ ID NO: 591205 - RNA, 64 nt, hsa; identical to SEQ ID NO: 376783

SEQ ID NO: 591206 - RNA, 64 nt, hsa; identical to SEQ ID NO: 376784

SEQ ID NO: 591207 - RNA, 64 nt, hsa; identical to SEQ ID NO: 376785

SEQ ID NO: 591208 - RNA, 64 nt, hsa
gaagccguggggcagccucuucacauggggacaggggauggagcaugaggcaagggaaggaaaa

SEQ ID NO: 591209 - RNA, 64 nt, hsa
gugcuguuggagcauggaggagcuggaggagauggggauggacugacagcuaagagggcggcug

SEQ ID NO: 591210 - RNA, 64 nt, hsa
guguccucauccuugcuuuacucuggaaaguguggggauggagaggauggugcauuuccagugc

SEQ ID NO: 591211 - RNA, 64 nt, hsa
agccucugacacguggcucaccgcugucauuugggggauggaaugaacagucacuguucuauag

SEQ ID NO: 591212 - RNA, 64 nt, hsa
gggaagaccaccuggcaugagggagaggggcugagggauggacuucagccccucugcucuguac

SEQ ID NO: 591213 - RNA, 64 nt, hsa
gcugggcagagcagaggggcagcgauagacucuggggauggagcaggacggggacgggaggggc

SEQ ID NO: 591214 - RNA, 64 nt, hsa
gaaagagaaacagacaacucuguucucaggauuggggauggacggcuucggccaagcguuuuag

SEQ ID NO: 591215 - RNA, 64 nt, hsa
uuuuccuaagcaccagcggaaggagcugugccccgggauggagugaggguggagggcgcgucag

SEQ ID NO: 591216 - RNA, 64 nt, hsa
ccuacgugaagaccuccugguaggaucuguccaugggauggagaaccacucuguccagaucugg

SEQ ID NO: 591217 - RNA, 64 nt, hsa
aucaagaccucauccagcucguccaaaggcuucagggauggaaacaaaccagcucgucucagag

SEQ ID NO: 591218 - RNA, 64 nt, hsa
agaggcagaccugggaugccccaguuucucuucagggauggauagugaccugucuucauuuugc

SEQ ID NO: 591219 - RNA, 64 nt, hsa
cauugaaaaaauauauuuaguuuuuaaaauauuugggauggaacucccuacugaccucugagaa

SEQ ID NO: 591220 - RNA, 64 nt, hsa
ccuuuuccuugcaggagauggcgucuaccagaaggggauggacuucauuuuggagaagcucaac

SEQ ID NO: 591221 - RNA, 64 nt, hsa
ucuggauucuuggcccgcacagagcuggggcugagggauggacugaugcuuuuagcucaaacgu

SEQ ID NO: 591222 - RNA, 64 nt, hsa
acugcucucauaauugaagacguguuuguuauuggcagagaaccuuaaaaaaggccuuuaccuc

SEQ ID NO: 591223 - RNA, 64 nt, hsa
cuuuaccucagcgaugcuuccuagccccaggcuugcagagaacacagagugguguuguggucua

SEQ ID NO: 591224 - RNA, 64 nt, hsa
gugagacucaauaauaacugaacuacagcaaaaggcagagaauuacagggagaaaaaacuugua

SEQ ID NO: 591225 - RNA, 64 nt, hsa
uugcugacuuaaccccccauagugugggggaccugcagagaaccauggcauucccuauuccaca

SEQ ID NO: 591226 - RNA, 64 nt, hsa
uaaugccccaguugucccccacuccuaaugccaggcagagaaggacagccuuuauagacuuaau

SEQ ID NO: 591227 - RNA, 64 nt, hsa
cuggaccuaagucuaguguauccauacaauuggugcagagaaauaagguguaaauggugcuuug

SEQ ID NO: 591228 - RNA, 64 nt, hsa
cuaaauuuguucucaccaagcacugccugugcaugcagagaaaaucugugcauccucuuuuaua

SEQ ID NO: 591229 - RNA, 64 nt, hsa
uuguugagugcaacuuucauagucccaaagauaggcagagaacaucuccagaaaugugugugug

SEQ ID NO: 591230 - RNA, 64 nt, hsa
aauucauguggaucuggggacugagugugggagugcagagaaagaaagggaaacuggcugaggg

SEQ ID NO: 591231 - RNA, 64 nt, hsa
gaaccauuacaacaccuauauauccaagaagcaugcagagaagaauugguuuguuggccucaag

SEQ ID NO: 591232 - RNA, 64 nt, hsa
agggcuccuucuggagcauuugguggggacagcugcagagaagaggccuggaacucgggcagca

SEQ ID NO: 591233 - RNA, 64 nt, hsa
ccagggagggggccugcauuggcugcaaggaugagcagagaacaaggacagaggccaggcacug

SEQ ID NO: 591234 - RNA, 64 nt, hsa
cugugcagcuuaucaacgaccgcuguguggacaugcagagaagcaggcacgguagccacuggga

SEQ ID NO: 591235 - RNA, 64 nt, hsa
cuuaucaacgaccgcuguguggacaugcagagaagcagagaagaagaaaggagcugaggaggag

SEQ ID NO: 591236 - RNA, 64 nt, hsa
cuggacaccgccaugagcacagggcagggcuggggcagagaaaggaagggaacuggagcuggcc

SEQ ID NO: 591237 - RNA, 64 nt, hsa
uggcccaggagccauggccucacacagacccgaggcagagaacagcucauugggucacugguga

SEQ ID NO: 591238 - RNA, 64 nt, hsa
uuaaggaggaaauuagugccacccacggugagaagcagagaaggcacuugcauccuaugcagcc

SEQ ID NO: 591239 - RNA, 64 nt, hsa
auuugucaagaugguuagcucuuuguuuuggggugcagagaaagaaaagagcagcaacagcaga

SEQ ID NO: 591240 - RNA, 64 nt, hsa
uucccacuccuuaagcaagcacaaagaagaugaggcagagaauugucagagcugaaaguuccuu

SEQ ID NO: 591241 - RNA, 64 nt, hsa
cuguagaucccuaggccccugagagcuggacagagcagagaacuacagggccaaggguccagag

SEQ ID NO: 591242 - RNA, 64 nt, hsa
agaucugacagcccagaccuuucuacggcuggcagcagagaaacaaagucuggacccacuccau

SEQ ID NO: 591243 - RNA, 50 nt, hsa
uuguuuuuuccuucuuuugagcagagaaaguaaaaguacgacauagaaau

SEQ ID NO: 591244 - RNA, 64 nt, hsa
ucagaacccacagugagaggggagggcuccuggggcagagaaguuccuuagguuuucuuuggaa

SEQ ID NO: 591245 - RNA, 64 nt, hsa
uaucuuauauugggcgauuugggggcucggggaggcagagaaucucuugggagucuuggguggc

SEQ ID NO: 591246 - RNA, 64 nt, hsa
cgugagcagugugucuccugcaugcagaaagggagcagagaaggccaggggcuuuugcuaaaaa

SEQ ID NO: 591247 - RNA, 64 nt, hsa
accucagcauuaucuauauaguaccuuugcucuugcagagaagccuugguacuaggcaguuaga

SEQ ID NO: 591248 - RNA, 64 nt, hsa
agagagggaaagaggcagagaaggaaagagacaggcagagaaggagagaggcagagagggagag

SEQ ID NO: 591249 - RNA, 64 nt, hsa
agacagaggggaagagaggcagagagggaaagaggcagagaaggaaagagacaggcagagaagg

SEQ ID NO: 591250 - RNA, 64 nt, hsa
gucacaccuugcaagucaucauagucuucauacugcagagaaaucuuacaaaugugaagacugu

SEQ ID NO: 591251 - RNA, 64 nt, hsa
aacaacccuugcacgucaucauagaauucauacugcagagaaacuuuacaaauaggaagaaugu

SEQ ID NO: 591252 - RNA, 64 nt, hsa
ugggacaccuguaauguaacccacacagcgguuugcagagaauguuagccaugacuugggcuuu

SEQ ID NO: 591253 - RNA, 64 nt, hsa
caacuuucuuagcucaagagagaggcugagaaaugcagagaagaauaagacauaaaauagcucc

SEQ ID NO: 591254 - RNA, 64 nt, hsa
uccagcugcguggucuccgcagaccaggcucugugugggcuagaggaaugucgcccauuacucc

SEQ ID NO: 591255 - RNA, 64 nt, hsa
ccagggcccucagggaggggacccugcggcuagagugggcuaggcccuggcuuugcccgucaga

SEQ ID NO: 591256 - RNA, 64 nt, hsa
uaaggaacaagauggaagagaaguggacugggaguauuuuuauggccugcuuuuuaccucagag

SEQ ID NO: 591257 - RNA, 64 nt, hsa
acaggcaugugccaccacgcccggcuaauguuuguauuuuuaguagagacgggguuucaccaug

SEQ ID NO: 591258 - RNA, 64 nt, hsa
aggagugaaggaggcaggugggaaaugguauuucuauuuuuaaauccagugaaauuaucuugag

SEQ ID NO: 591259 - RNA, 64 nt, hsa
uuaaauccagugaaauuaucuugagucuacacauuauuuuuaaaacacaaaaauuguucggcug

SEQ ID NO: 591260 - RNA, 64 nt, hsa
gccuuaaaauauucauaguuaauacagguauaucuauuuuuauuuacuuuguaagaaacaagcu

SEQ ID NO: 591261 - RNA, 64 nt, hsa
uauaugaauugccauaauggaaauaaucugauuuuauuuuuacaacuaacauccauuccccuuc

SEQ ID NO: 591262 - RNA, 64 nt, hsa
uuauaaauagucaagguuugggccacacaaaguauauuuuuaucauggaaaaauuucaacuccu

SEQ ID NO: 591263 - RNA, 64 nt, hsa
ucuaaaaugagaaaaaagagagaaaacaaaauguuauuuuuauaccauaacuugaguguauugc

SEQ ID NO: 591264 - RNA, 64 nt, hsa
aaaaggcaguuuuggaaacuacauugggggacguuauuuuuauuuauauauggggccuaggcca

SEQ ID NO: 591265 - RNA, 64 nt, hsa
guacaggcgucugccaccaugccuaauuuuuuucuauuuuuaggagagaccgguuuucaccacg

SEQ ID NO: 591266 - RNA, 64 nt, hsa
gugacccacugcgcacagccccagcuaauuuucauauuuuuaguagagacaggguuuugccaug

SEQ ID NO: 591267 - RNA, 64 nt, hsa
auauaucuuauaaauguuugauucccuuccuugcuauuuuuauucaguagauuuuuguuuggca

SEQ ID NO: 591268 - RNA, 64 nt, hsa
gaguuuuuugaaagaccccaauuuaagccuugcuuauuuuuaaauuauuuccauucagugaugu

SEQ ID NO: 591269 - RNA, 64 nt, hsa
uaaaagaaauaugaucagagcuugaacacaggcuuauuuuuaaaauaaaaauauuuuuaacaug

SEQ ID NO: 591270 - RNA, 64 nt, hsa
gagcuugaacacaggcuuauuuuuaaaauaaaaauauuuuuaacauggguuuccuuauugaaaa

SEQ ID NO: 591271 - RNA, 64 nt, hsa
gugcuuaaauauaucaugcugaccagaauccuguuauuuuuauaugcaucauaaaauuucccau

SEQ ID NO: 591272 - RNA, 64 nt, hsa
uauccaucugcauagccuuguaaaagugccauuuuauuuuuagugcuaaauucuuguuaaauaa

SEQ ID NO: 591273 - RNA, 64 nt, hsa
cauuuuaaugaucaauuuaccugcauauaaaauuuauuuuuaaucaagcugaucuuaauguaua

SEQ ID NO: 591274 - RNA, 64 nt, hsa
caauuucugaccaaucaaguacacuaaauuagaauauuuuuaaaguauguaacauucccaguuu

SEQ ID NO: 591275 - RNA, 64 nt, hsa
caguuuuaauguugaauuugguauuuugaaggguuauuuuuaauguauuuugguaauacauuua

SEQ ID NO: 591276 - RNA, 64 nt, hsa
gaugcugcuaaguaguucucuguauuaaaggagauauuuuuaaaacaggguacaacccccugcu

SEQ ID NO: 591277 - RNA, 64 nt, hsa
auucagaaucaaauagaguuuuugagcauuugacuauuuuuagaaucauaaaauuaguuacuaa

SEQ ID NO: 591278 - RNA, 64 nt, hsa
guaauagacucuaagcaauugccaagauguauucuauuuuuaugaaguguauauauauuaccuu

SEQ ID NO: 591279 - RNA, 64 nt, hsa
gaacuuccugauacaaauguagggauauauacuguauuuuuaaacauuucucaccaacuuucuu

SEQ ID NO: 591280 - RNA, 64 nt, hsa
acugacuagauuuauucauaccaugagacaacacuauuuuuauuuauauaugcauauauauaca

SEQ ID NO: 591281 - RNA, 64 nt, hsa
aggcaccugccaacacgcccggcuaauuuuuuuguauuuuuaguagagacgggguuucaccaug

SEQ ID NO: 591282 - RNA, 62 nt, hsa
uaaaaaauguaucaaaauaauaaacguguucugauauuuuuaaaauaagugaccuuguguuc

SEQ ID NO: 591283 - RNA, 64 nt, hsa
acuuaaaacucuuagaauauucucuuauuauuuauauuuuuauauuucuugaaagaugguaagu

SEQ ID NO: 591284 - RNA, 64 nt, hsa
acaggcgcccgucaccacacccagguaauuuuuguauuuuuaguagagacggaguuuugccaug

SEQ ID NO: 591285 - RNA, 64 nt, hsa
agaaguaaguaaaaguaggaauaguuuccauggauauuuuuauuuuuauuaacuuuuuucaguu

SEQ ID NO: 591286 - RNA, 64 nt, hsa
aaguaaaaguaggaauaguuuccauggauauuuuuauuuuuauuaacuuuuuucaguuucuuuu

SEQ ID NO: 591287 - RNA, 64 nt, hsa
ggaauauaguaaaauaaguaaauuucuuuuggaauauuuuuaguaacaaauagccacuauaauu

SEQ ID NO: 591288 - RNA, 64 nt, hsa
cccaaauggaaaauuucugaaaugcuggauuaucuauuuuuaaacaagcaguugacuuaaaacu

SEQ ID NO: 591289 - RNA, 64 nt, hsa
acugguguuaugaagaacguaaaugcacuguuuuuauuuuuauuuuauauaauuuaaauugacu

SEQ ID NO: 591290 - RNA, 64 nt, hsa
ucugugugaggauacauaaucuuucaguaaacuguauuuuuaacuuuuccauaagcugauuuug

SEQ ID NO: 591291 - RNA, 64 nt, hsa
uuaguacaaagccuuggauacaguuugcuuguaauauuuuuaauaaugugaggaguacaguguu

SEQ ID NO: 591292 - RNA, 64 nt, hsa
auuuuuuuaauuuuguggguacauaguaggaguguauuuuuauggguuacaugagauauucuga

SEQ ID NO: 591293 - RNA, 64 nt, hsa
auacuguuaguuauuuuaaaaugugcaauuaaauuauuuuuaacuauauucacccuguugugcu

SEQ ID NO: 591294 - RNA, 64 nt, hsa
gcuucccagcucagaacauauacugaauggaauguauuuuuaagagaauaaagucuauuuuuuu

SEQ ID NO: 591295 - RNA, 64 nt, hsa
guuucuuuaaucugcacacuuucuagauagauuuuauuuuuaaguguccucagcauugcagaaa

SEQ ID NO: 591296 - RNA, 64 nt, hsa
ugguauuacccuaaacuguuuaaauaaagagcucuauuuuuaaagaaaaaagguacaauugaau

SEQ ID NO: 591297 - RNA, 64 nt, hsa
aggcacccgccaccacaccuggcuaauuuuuuuguauuuuuaguagagacgggguuucaccaug

SEQ ID NO: 591298 - RNA, 64 nt, hsa
cgaaaucaacccuuccuaaguuuaagggaaaaguuauuuuuaaaaacaacuuaauaaaaacuua

SEQ ID NO: 591299 - RNA, 64 nt, hsa
uacaggcaugugccacaacgccuggcuaauuuuguauuuuuaguagagacugguuucuccaugu

SEQ ID NO: 591300 - RNA, 64 nt, hsa
aagcaagauaucuuauguagaaauauuuugauaauauuuuuacagugagcuuucccauguuuuu

SEQ ID NO: 591301 - RNA, 64 nt, hsa
caucuuaaaaaaauccaguacagugcaugaagcauauuuuuaaagaaguuggugucuuacuugg

SEQ ID NO: 591302 - RNA, 64 nt, hsa
acaggugcacgccaccacaacuggcuaauuuuuguauuuuuaguagagaugggguuucgcuaug

SEQ ID NO: 591303 - RNA, 64 nt, hsa
cuugucuguuugugucugggagguuuuuuuuuucuauuuuuauuuuuucaugaaaauuauuggu

SEQ ID NO: 591304 - RNA, 64 nt, hsa
uaugugcgcaccaccacgccuggcuaauuuuuuguauuuuuaguagagaugggguuucaccaug

SEQ ID NO: 591305 - RNA, 64 nt, hsa
auuuggaaaagaauuuaggaauacuaaggacaauuauuuuuauagacaaaguaaaaagacagau

SEQ ID NO: 591306 - RNA, 64 nt, hsa
ggauuuuaaaauuaaaugugagguaaaauaaguuuauuuuuaauaguaucugucaaguuaauau

SEQ ID NO: 591307 - RNA, 64 nt, hsa
aucucaaaaaaaaaaaaaaacucuuguaucucaauauuuuuaaaccacaggccuaaauaaaacu

SEQ ID NO: 591308 - RNA, 64 nt, hsa
cuauaaagaaaauacuugcaauauauuuuuccuuuauuuuuaugacuaauauaaaucaagaaaa

SEQ ID NO: 591309 - RNA, 64 nt, hsa
uaauaaccugguauaaacaugaaggguauggcuuuauuuuuauagauaagaaaaaugaagccaa

SEQ ID NO: 591310 - RNA, 64 nt, hsa
uuccauucuaacauuucagugugugaaauuacuuuauuuuuagaaaguauguucuauaguaaaa

SEQ ID NO: 591311 - RNA, 64 nt, hsa
agugacaauauuaagguacaugaucagcucuuucuauuuuuacucguaaaaauuauggaaauga

SEQ ID NO: 591312 - RNA, 64 nt, hsa
cauuuauauuaguuauguuugauaaaugucucaguauuuuuauaauaugauaagccugggauuc

SEQ ID NO: 591313 - RNA, 64 nt, hsa
agaauccaccugacuuccccuaaugcauuaaaaauauuuuuauuuaaauaacuuuauuuauaac

SEQ ID NO: 591314 - RNA, 64 nt, hsa
uuuuagaauggauuuauuuuucauuuuugccaguuauuuuuauuuucuuuuacuuuucuacaua

SEQ ID NO: 591315 - RNA, 64 nt, hsa
caucucagagccauaaggucaucuuugcuagagcuauuuuuaccuauguauuuaucguucuuga

SEQ ID NO: 591316 - RNA, 64 nt, hsa
gacagcuuguaaauguauuuguaaaaauuguauauauuuuuacagaaagucuauuucuuugaaa

SEQ ID NO: 591317 - RNA, 64 nt, hsa
auaggcgugcaccaccacgcccagcuaauuuuuguauuuuuaguaaagacaggguuuugccaca

SEQ ID NO: 591318 - RNA, 64 nt, hsa
aaccagaauaaaauaaccaauacuccacugcucauauuuuuaucuaauucagauggaucuuccu

SEQ ID NO: 591319 - RNA, 64 nt, hsa
uuaaugaucaacaauuuaauguauuaguccaaauuauuuuuacguagucaucaacaauuugacc

SEQ ID NO: 591320 - RNA, 64 nt, hsa
aagacccugucuuaaaaaaagaggauucaacacauauuuuuauauuauguuaaaguaaagaaau

SEQ ID NO: 591321 - RNA, 64 nt, hsa
gcccuuuccauuaguuguauuuuuuauuuauuuuuauuuuuauuuuuuuuuagagauggagucu

SEQ ID NO: 591322 - RNA, 64 nt, hsa
uuucuugcccuuuccauuaguuguauuuuuuauuuauuuuuauuuuuauuuuuuuuuagagaug

SEQ ID NO: 591323 - RNA, 64 nt, hsa
gccaccgugccuggccacgcccaacuaauuuuuguauuuuuaguagagacaggguuucaccaug

SEQ ID NO: 591324 - RNA, 64 nt, hsa
auaggcaccuaccaccacgcccggcuaauuuuuguauuuuuaguagagacgggguuucaccaug

SEQ ID NO: 591325 - RNA, 64 nt, hsa
gcagccaaagagaacaauccagggaaccuacauuuauuuuuaaggacaaauauuuccuccucag

SEQ ID NO: 591326 - RNA, 64 nt, hsa
uuaaaaugccucaaaugugcacauguauauaggauauuuuuauaacuucccugaugaauaaucu

SEQ ID NO: 591327 - RNA, 64 nt, hsa
acaggcaugugccaccacgccaagcuaauuuuuguauuuuuaguagagacgggguuucaccaug

SEQ ID NO: 591328 - RNA, 64 nt, hsa
auuuuggggguggguggguggauaucuuaauuuuuauuuuuaaaaaaugaaauagugauguugu

SEQ ID NO: 591329 - RNA, 64 nt, hsa
cucuaggccuucaggacucuagaauguccauauuuauuuuuauguucuuggcuuuguguuuuag

SEQ ID NO: 591330 - RNA, 64 nt, hsa
uacaggcgcccgccaccaugcccggcuaauuuuguauuuuuaguagagacaggguuucuccaug

SEQ ID NO: 591331 - RNA, 64 nt, hsa
auggucuggaguaacgcuucguuauuuuuauuuuuauuuuuauuuauuuauuuauuuuuuugag

SEQ ID NO: 591332 - RNA, 64 nt, hsa
cugggaauggucuggaguaacgcuucguuauuuuuauuuuuauuuuuauuuauuuauuuauuuu

SEQ ID NO: 591333 - RNA, 64 nt, hsa
ggcauccugggaauggucuggaguaacgcuucguuauuuuuauuuuuauuuuuauuuauuuauu

SEQ ID NO: 591334 - RNA, 64 nt, hsa
gaguagccuuuaaucauggauagucuucuuggauuauuuuuauauuugaaaagaaaauguuuua

SEQ ID NO: 591335 - RNA, 64 nt, hsa
guaggcuauaaaacaaaaaaagguugcuguuuucuauuuuuaaauaaaccaaaaaaaaacagaa

SEQ ID NO: 591336 - RNA, 64 nt, hsa
acaggcacccaccaucaugcuuggcuaauuuuuguauuuuuaguagagaugggguuucaccaug

SEQ ID NO: 591337 - RNA, 64 nt, hsa
acaggcaugcaccaccaugcccagcuaauuuuuguauuuuuaguagagauggaauuuugccaug

SEQ ID NO: 591338 - RNA, 64 nt, hsa
gacuaagucuuuguacuaaagcauuugcuauaauuauuuuuaaaaaaacaaacagaugaaaacc

SEQ ID NO: 591339 - RNA, 64 nt, hsa
auauaccuuuguuucccuagcauuuuuauuuauuuauuuuuauuuuauuuuauuuuuugagaug

SEQ ID NO: 591340 - RNA, 64 nt, hsa
uauuaaaauuauucugcuaauauaccuagauuuuuauuuuuaggucucuguccauugcuuuuaa

SEQ ID NO: 591341 - RNA, 64 nt, hsa
gcaggcaccgccaccacgccuggcuaauuuuuuguauuuuuaguagagaagguguuucaccgug

SEQ ID NO: 591342 - RNA, 64 nt, hsa
aagcuuauauuacuacaaaaaacuuauuuuuauauauuuuuauauuuuuguauuauuuauagcu

SEQ ID NO: 591343 - RNA, 64 nt, hsa
guguauuaagaagcuuauauuacuacaaaaaacuuauuuuuauauauuuuuauauuuuuguauu

SEQ ID NO: 591344 - RNA, 64 nt, hsa
gggauugaaagcacuuuuaccacauggagaaauauauuuuuaauuugugaugcuuuucuacaag

SEQ ID NO: 591345 - RNA, 64 nt, hsa
ccaaaaacuuggagugaaggaugaugcuauuuuuuauuuuuaaauauaucuucagguuauuuuc

SEQ ID NO: 591346 - RNA, 64 nt, hsa
cagaauaacuggucuuguuaagagugcaauauuauauuuuuauguaaaaauaaaaauuaauuug

SEQ ID NO: 591347 - RNA, 64 nt, hsa
gccgucugucucucccauaugauggcugucuguauauuuuuacuuggggugcugcuuuauuggc

SEQ ID NO: 591348 - RNA, 64 nt, hsa
aagaugccuaaauagaagcaaguuuaaagagcuauauuuuuaaacaugaacaaacucccauggg

SEQ ID NO: 591349 - RNA, 64 nt, hsa
cauuucucaaguggaaaguaaacaguguuggcacuauuuuuauauaugguuaaagagaccuguc

SEQ ID NO: 591350 - RNA, 64 nt, hsa
gguucaauuauaaacauuuggccuuuuacuauguuauuuuuauuuuguaugaauacauuauccu

SEQ ID NO: 591351 - RNA, 64 nt, hsa
aagauuaaacuagacagauaguuuagguggaguauauuuuuaaaacucagaacauguauauugg

SEQ ID NO: 591352 - RNA, 62 nt, hsa
uuggacaaccaagaccaugauagacucuaacuuauuuuuauaaggaauauugacuccuuggc

SEQ ID NO: 591353 - RNA, 64 nt, hsa
acaggcaccugccaccacgcccagcuaauuuuuguauuuuuaguaaagacgggggauuucacca

SEQ ID NO: 591354 - RNA, 64 nt, hsa
uauacacauacaauuuauguuuuccuguugaauguauuuuuaugagauuuuaaccagaacaaag

SEQ ID NO: 591355 - RNA, 64 nt, hsa
ucaaaggaaaaaaagauuuauuaucaaggggcaauauuuuuaucuuuuccaaaauaaauuuguu

SEQ ID NO: 591356 - RNA, 64 nt, hsa
ucagcuuuuaagauacgaguuuuguguaauuugguauuuuuaaucauuuauguuauuuuaaaag

SEQ ID NO: 591357 - RNA, 64 nt, hsa
acauaagguacuugaagauuuauuaguuuaauucuauuuuuacaguaaccuugaauucuucuga

SEQ ID NO: 591358 - RNA, 64 nt, hsa
auaaauaauagauuauacacaucaucuuaauaacuauuuuuaaguuauuuaccauagccucugu

SEQ ID NO: 591359 - RNA, 64 nt, hsa
aauguauaauugccaauugauuguaacuauuauuuauuuuuaaaugaaaguguaagaaugcuuu

SEQ ID NO: 591360 - RNA, 64 nt, hsa
ucuaaucucugauuauuaaaauguuuauaaaguuuauuuuuaccaaagagaugcaauucauuau

SEQ ID NO: 591361 - RNA, 64 nt, hsa
uaaaugucuuuuuaaaaagagaaauauaaacauauauuuuuacuauuaaaauauucaguuuuuu

SEQ ID NO: 591362 - RNA, 64 nt, hsa
gcacugcugugaaaugugaaguacuuuguuuuuuuauuuuuaaugauuuucuuuuuguuauuaa

SEQ ID NO: 591363 - RNA, 64 nt, hsa
acugagccagcuaacuuaaaaagcugccuuaguuuauuuuuagagauuacagaauuuuuaaaca

SEQ ID NO: 591364 - RNA, 64 nt, hsa
cuucccuacuauugccucucugaccuuuuuaaauuauuuuuaauaccaaaagaguucuuuugaa

SEQ ID NO: 591365 - RNA, 64 nt, hsa
uccuuuccccaagaaucuccuugggacuuugacuuauuuuuaaagcuguguuggagcucaucuu

SEQ ID NO: 591366 - RNA, 64 nt, hsa
cuguuuuguaacugguuuaccucuauaguuuauuuauuuuuaaauuauaaacacuuuucagcug

SEQ ID NO: 591367 - RNA, 64 nt, hsa
uuauagccucuaaagccugugguauuuuauauaauauuuuuauaacuuuaagagacuguaguaa

SEQ ID NO: 591368 - RNA, 64 nt, hsa
aacacuuauuucuguguuaugguucuuauucauauauuuuuauagcacuuuuggaaccuauauu

SEQ ID NO: 591369 - RNA, 64 nt, hsa
agauaagguacaggaaugaaccuugguuuaaagguauuuuuauaugaaaaugguguguuauugg

SEQ ID NO: 591370 - RNA, 64 nt, hsa
auuuuacacuuauauuuucacaguuaauugaacauauuuuuaaacaacuguaguuuugggcaac

SEQ ID NO: 591371 - RNA, 64 nt, hsa
uuuaaaggaaaaaugaaauuaucuuccuuuagcuuauuuuuaagguaaaacagcuuuuuacucu

SEQ ID NO: 591372 - RNA, 64 nt, hsa
acuacagcugugcgccaccacaucuggcuaauuuuauuuuuauuuuuguagagacaggagucuu

SEQ ID NO: 591373 - RNA, 64 nt, hsa
caugacuuagaagauaucauugccauguagguuuuauuuuuaaaagucuugagcucuucuuaaa

SEQ ID NO: 591374 - RNA, 64 nt, hsa
aucagucucggcugucagaauaacuucuaaaagguauuuuuauaagcaguucaaguuacugaaa

SEQ ID NO: 591375 - RNA, 64 nt, hsa
aguagcuugaaagagcuuaaucauaugcaguaaguauuuuuauuaccaauaaauuuaaaauuuu

SEQ ID NO: 591376 - RNA, 64 nt, hsa
uauuaccaauaaauuuaaaauuuuuuaagaaaaauauuuuuauccuagggccaaguguugccug

SEQ ID NO: 591377 - RNA, 64 nt, hsa
ucagcuaugcagaaaaauuuagcuuaugcuuccauauuuuuaaauuuuguuuuuuaaguuuugc

SEQ ID NO: 591378 - RNA, 64 nt, hsa
uaccuuuuaguaauaaaaugacuugaaaucauauuauuuuuaaaagcccuuugcuucuuucauu

SEQ ID NO: 591379 - RNA, 64 nt, hsa
uuuuuucacaguuauuauucuucuauuaacaaauuauuuuuaucuuuccuaguacauuuucacu

SEQ ID NO: 591380 - RNA, 64 nt, hsa
agcugaggcaauucuaacuuuuuugcuauccagcuauuuuuauuuguuugugcauuugggggga

SEQ ID NO: 591381 - RNA, 64 nt, hsa
aauauuuuccaugaaaaugcaacaacauguauaauauuuuuaauuaaauaaaaaucuguggugg

SEQ ID NO: 591382 - RNA, 64 nt, hsa
cuacagcaauuaacuuuaagccuccuuuuagagauauuuuuaaaacuuguuuaaaauuuuugug

SEQ ID NO: 591383 - RNA, 64 nt, hsa
acuugcauacgcucauauucuaggguuuuuucucuauuuuuaggguaucauaguaaaucauuag

SEQ ID NO: 591384 - RNA, 64 nt, hsa
uuucuuucuuacaaaaacugauuuuucccauaaauauuuuuacuucagaggacuaggaccauuu

SEQ ID NO: 591385 - RNA, 64 nt, hsa
agcaguuuggguuuggaguauuauauuuggcuucuauuuuuauuauuuuggaucaccauucucc

SEQ ID NO: 591386 - RNA, 64 nt, hsa
caggcgcccgccaccacgccuggcuaauuuuuuauauuuuuaguagagacaggguuucaccaug

SEQ ID NO: 591387 - RNA, 64 nt, hsa
auaggcguccaccaccacgcccagcuaauuuuuguauuuuuaguagaaaugggguuucaccaug

SEQ ID NO: 591388 - RNA, 64 nt, hsa
ugugucuuuuuugaaguuuagaaauauccuaaucuauuuuuauuuaucuaaaaguaaguguuuu

SEQ ID NO: 591389 - RNA, 64 nt, hsa
gaggaauuugaaacaggauauuuaagaguguggauauuuuuaaaaugcaauaaacaucucagua

SEQ ID NO: 591390 - RNA, 64 nt, hsa
uaaauuuacacuuauaaugccuuuguauuaaaauuauuuuuaacaugugcuuuuccaaauuaaa

SEQ ID NO: 591391 - RNA, 64 nt, hsa
guuuuaaaucuuuuuaaguuuuuuuaauacgaucuauuuuuauagguucuuuuucagaaguaaa

SEQ ID NO: 591392 - RNA, 64 nt, hsa
uuguaaacagagugucauauguauuuaaguuguguauuuuuauaaaguaaagccaaguaucaaa

SEQ ID NO: 591393 - RNA, 64 nt, hsa
auuccugcuugggcuccaaauuucugaagaguaauauuuuuaaacuauagcuuacaaaauacau

SEQ ID NO: 591394 - RNA, 64 nt, hsa
uuacuguaacuaaguuauuuuuaaaguuaaaauauauuuuuacgugccuuuggcuuuuuauugc

SEQ ID NO: 591395 - RNA, 64 nt, hsa
guaagacacaggcaaaguauuacuguaacuaaguuauuuuuaaaguuaaaauauauuuuuacgu

SEQ ID NO: 591396 - RNA, 64 nt, hsa
agcuguacuucuugaauauaaaaaaucaugccaguauuuuuaaaggcauuagagucaacuacac

SEQ ID NO: 591397 - RNA, 64 nt, hsa
gcgaaucucaaaauuagauccuaagauguguucuuauuuuuauaacaucuuuauugaaauucua

SEQ ID NO: 591398 - RNA, 64 nt, hsa
uuuucaucauugcuuugaauugaauuuuuauaucuauuuuuauauguaacucuuuuuuuaccuc

SEQ ID NO: 591399 - RNA, 54 nt, hsa
auaacaagaagaaaaauuagacaguauuuuuaaccuuuuucucuaucugaagug

SEQ ID NO: 591400 - RNA, 64 nt, hsa
ggcuacugaguaaacuugacuugugagggguuuuuauuuuuacucauuaaaagucaacuuaaaa

SEQ ID NO: 591401 - RNA, 64 nt, hsa
ggaaagcacuccuacccuccaggugcuauacuuguauuuuuaccaggacuagcagaaaucaaaa

SEQ ID NO: 591402 - RNA, 64 nt, hsa
guuuaaaaugucacugcuuuacuuugauguaucauauuuuuaaauaaaaauaaauauuccuuua

SEQ ID NO: 591403 - RNA, 64 nt, hsa
aucauugcuguacaauaugcugguuucuguaggguauuuuuaauuuugucagaaauuuuagauu

SEQ ID NO: 591404 - RNA, 64 nt, hsa
guguuaggcacuauaguauuuauauugaagcuuguauuuuuaacuguugcuuguucucuuaaaa

SEQ ID NO: 591405 - RNA, 64 nt, hsa
auuuguguuaacauggaagaggauucauuguuuuuauuuuuauuuuuuuaauuuuuucuuuuuu

SEQ ID NO: 591406 - RNA, 64 nt, hsa
caagaacacauugcagaaguaagacaaacauguauauuuuuaaauguucuaacauaagaccugu

SEQ ID NO: 591407 - RNA, 64 nt, hsa
uuuuccauuuuguugcuugguugguuuguugcuuuauuuuuaaaaggagaaguuuaacuuugcu

SEQ ID NO: 591408 - RNA, 64 nt, hsa
gaugaugucuuauuuauuagauggauaaugguuuuauuuuuaaucucuuaagucaauguaaaaa

SEQ ID NO: 591409 - RNA, 64 nt, hsa
ccaaaauauuaauaaauuuagaucucaaaaccacuauuuuuauuauuucauuauuuuucagagg

SEQ ID NO: 591410 - RNA, 64 nt, hsa
caucauaugacgugugggugggagcaaccaaaguuauuuuuacagggacuuuauuuuuugaucu

SEQ ID NO: 591411 - RNA, 64 nt, hsa
uuuuuugauggcaugcugccuuaaaagagccauuuauuuuuagagaucugucauauuaugaaag

SEQ ID NO: 591412 - RNA, 64 nt, hsa
aacuuagguuuuacucuuuucuuucuacagaccauauuuuuaaagaaauguuuauacaauaauu

SEQ ID NO: 591413 - RNA, 64 nt, hsa
aguucucacaauggucuuugauccauuucgaguauauuuuuauauaugaugugauguagggguc

SEQ ID NO: 591414 - RNA, 64 nt, hsa
uucuuuggagaaaggucuauccagguccuuugccuauuuuuaauugaguugucuuuuuuuuuuu

SEQ ID NO: 591415 - RNA, 64 nt, hsa
aaugcagaaauuauauagucuccucagauuuuaauauuuuuauuucuuuccuggcacagcuguu

SEQ ID NO: 591416 - RNA, 64 nt, hsa
gucuagauggauauuagaugcccgaucauauagauauuuuuaagugcaacauuuacaugauaac

SEQ ID NO: 591417 - RNA, 64 nt, hsa
uuagugcuuaacauuuucccaagugugggaacauuauuuuuagauugaguagguaccuuguagc

SEQ ID NO: 591418 - RNA, 64 nt, hsa
acaggcaacugccaccaugcccggcuaauuuuuguauuuuuaguagagaugggguuucaccaug

SEQ ID NO: 591419 - RNA, 64 nt, hsa
cuuauucucaguggaaaacuccaguuguaaugcauauuuuuaaagacaauuuggaucuaaauau

SEQ ID NO: 591420 - RNA, 64 nt, hsa
gugccuguaaagucuccucuaauauuuaaaggauuauuuuuaugcaaaguauucuguuucagca

SEQ ID NO: 591421 - RNA, 64 nt, hsa
gcauccauucuauuuuuaacuuccauaucugccauauuuuuacaaaauuuguucuagugcauuu

SEQ ID NO: 591422 - RNA, 64 nt, hsa
ccaaacaccuuuaguacaguccuugcauccauucuauuuuuaacuuccauaucugccauauuuu

SEQ ID NO: 591423 - RNA, 64 nt, hsa
ucacuugauuuaacacacucagguagaauauuuuuauuuuuacuguuuuauacccagaaguuau

SEQ ID NO: 591424 - RNA, 64 nt, hsa
uacaaaucacuugauuuaacacacucagguagaauauuuuuauuuuuacuguuuuauacccaga

SEQ ID NO: 591425 - RNA, 64 nt, hsa
uaagguuuaugguuuagcuuaaagagcaccuuuguauuuuuauuaucagauggggcaacauauu

SEQ ID NO: 591426 - RNA, 64 nt, hsa
caagacuagcuaauuuauuuuuuugcaucuuaguuauuuuuaaaaacaaauucuucaaguauga

SEQ ID NO: 591427 - RNA, 64 nt, hsa
ugauacuaccuuuguaugucugucuuuucccguguauuuuuaaauaacuggugaucuauaauuu

SEQ ID NO: 591428 - RNA, 64 nt, hsa
accggaauccucucuauacaaguuuauuaaagauuauuuuuauuaccguacauauuucucguuu

SEQ ID NO: 591429 - RNA, 64 nt, hsa
uuuuugaguggaugauguuucgugaaguauacuguauuuuuaccuuuuuccuuccuuaucacug

SEQ ID NO: 591430 - RNA, 64 nt, hsa
aauacauucugcuuucaucuuggucacauacaauuauuuuuacaguucucccaagggaguuagg

SEQ ID NO: 591431 - RNA, 64 nt, hsa
aacaugucaucuucaaaauauuuuuauuuucuaauauuuuuaauaauaaacauuuuauaguguu

SEQ ID NO: 591432 - RNA, 64 nt, hsa
ucguauauccuggaauaacaugucaucuucaaaauauuuuuauuuucuaauauuuuuaauaaua

SEQ ID NO: 591433 - RNA, 64 nt, hsa
aacuaaaccaacuuuuuccaaagugcgcuaugcauauuuuuaaugaaagaugacauguauuugc

SEQ ID NO: 591434 - RNA, 64 nt, hsa
uuuaugauuaauaaaaguucauuuuuuaaauuuguauuuuuauacaaccuccaaaaaaaaaaac

SEQ ID NO: 591435 - RNA, 64 nt, hsa
caagaguauuuacaggaaugaaguagcugacacauauuuuuagacucuguauaauucagaacag

SEQ ID NO: 591436 - RNA, 64 nt, hsa
ugacaaacuuuugcuuguaguuuuacuguacauuuauuuuuaaagaaaaagaaaacaaaagcca

SEQ ID NO: 591437 - RNA, 64 nt, hsa
auccauagauugcugagaaaaauggaaauauuuuuauuuuuacagauuuugcacuucugaauuc

SEQ ID NO: 591438 - RNA, 64 nt, hsa
agguuaauccauagauugcugagaaaaauggaaauauuuuuauuuuuacagauuuugcacuucu

SEQ ID NO: 591439 - RNA, 64 nt, hsa
ucucccaugaaagaauucaguuuguuaguaccuauauuuuuaaacuggugaaacugacccaaau

SEQ ID NO: 591440 - RNA, 64 nt, hsa
gucucucucauaugcuagguagcaaauggggugauauuuuuauagaagugggcaaaaauuauuu

SEQ ID NO: 591441 - RNA, 64 nt, hsa
aaaacgucuuuauuuaucaaaaaaacacagaggcuauuuuuauauccuugguaugaaauaugua

SEQ ID NO: 591442 - RNA, 64 nt, hsa
caacaaugcuauacagcgcaguuguuuccauuccuauuuuuaauaaaucucaggggaagccuca

SEQ ID NO: 591443 - RNA, 64 nt, hsa
agauuuacuuggaagagcaaagaaggaaaaauuauauuuuuaaagaaagagaauauucaggcuu

SEQ ID NO: 591444 - RNA, 64 nt, hsa
uuucugguuagaaacauugcugguaguuggauuauauuuuuauuguauucauuuaucuuagggg

SEQ ID NO: 591445 - RNA, 64 nt, hsa
aauaucuauaucuauaucuauaucuauaucuauauauuuuuaaucaucuacauguaaaugaagc

SEQ ID NO: 591446 - RNA, 64 nt, hsa
uaagucuguaaccuggcaacauuuuacaacccuguauuuuuaaagauggcuuucuaauaaaaaa

SEQ ID NO: 591447 - RNA, 64 nt, hsa
gagcuaggccucugcuacaagcacuugaaaaugauauuuuuauuuuuaacgucucaacaaucug

SEQ ID NO: 591448 - RNA, 64 nt, hsa
ggccucugcuacaagcacuugaaaaugauauuuuuauuuuuaacgucucaacaaucugauaucg

SEQ ID NO: 591449 - RNA, 64 nt, hsa
cccaaagcagcuggagagacuuuggggacuuuuuuauuuuuauuuuuugccuaacagcuuuugg

SEQ ID NO: 591450 - RNA, 64 nt, hsa
acacucagugggggacauuuuggugaagaugcaauauuuuuaugucaugugaugcucuuuccuc

SEQ ID NO: 591451 - RNA, 64 nt, hsa
caggggcccaccaccgcgcccggcuaauuuuuuguauuuuuaguagagacgggguuucaccgug

SEQ ID NO: 591452 - RNA, 64 nt, hsa
uacuuaaacacaccaauuguagaaagcaacccuuuauuuuuagcaaguuugguuuacucuucuc

SEQ ID NO: 591453 - RNA, 64 nt, hsa
uuuucaugcuuuaucaauagcccaggauauauuuuauuuuuagaauuuugugaaacagacuugu

SEQ ID NO: 591454 - RNA, 64 nt, hsa
aaaccgaacugggcauauuucuaauuggcuuuacuauuuuuauuuuuaaauuauguuuuacugu

SEQ ID NO: 591455 - RNA, 64 nt, hsa
aacugggcauauuucuaauuggcuuuacuauuuuuauuuuuaaauuauguuuuacuguucauuu

SEQ ID NO: 591456 - RNA, 64 nt, hsa
uaagaauaugcaucuuaaaauggcaaguuuuccauauuuuuacaacucacuggugguuuuccgc

SEQ ID NO: 591457 - RNA, 64 nt, hsa
accaggcuuucuagaaagaauaaacuuacauauuuauuuuuaggacaugaaaauagcaauauuc

SEQ ID NO: 591458 - RNA, 64 nt, hsa
aaauugggguuuauuucagcaaacuuguugaauuuauuuuuaagaaagaaauacuguauuggga

SEQ ID NO: 591459 - RNA, 64 nt, hsa
uagacaauauaagagcuuccaauuuuccuucagauauuuuuaauauuaaauauauuuuagugac

SEQ ID NO: 591460 - RNA, 64 nt, hsa
guuuagguagagccacaaaagaaaagacuuguaauauuuuuauauacagaggaaaucuguaaca

SEQ ID NO: 591461 - RNA, 64 nt, hsa
uucuuucagauuuuuugaaccauccacuuacauauauuuuuaaaaaaugaaauccuuuuccugu

SEQ ID NO: 591462 - RNA, 64 nt, hsa
acuaauguaaaaugauuuguaguggaaacauuuauauuuuuauaauaaacauaaugaaaauauu

SEQ ID NO: 591463 - RNA, 64 nt, hsa
gacuucuaggaauuuauaaccaaaauuuuaaaacuauuuuuauauuuuuuuaaaucuuuaaaaa

SEQ ID NO: 591464 - RNA, 64 nt, hsa
cuguauuuggcauuuagacuaacuucuagauguauauuuuuaauaauagauucauaauguuaca

SEQ ID NO: 591465 - RNA, 64 nt, hsa
guuugugagaaaccauugggaacuauacucuuuuuauuuuuauuuuuuauuuuuuuuauuauuu

SEQ ID NO: 591466 - RNA, 64 nt, hsa
uacaggcaugcuccaccaugcccagcuaauuuuguauuuuuaguagaaacgggguuucaccaua

SEQ ID NO: 591467 - RNA, 64 nt, hsa
acaggcgugugccaccaugccuggcuaacuuuuguauuuuuaguagagacgggguuucaccacg

SEQ ID NO: 591468 - RNA, 64 nt, hsa
acagacaugcgccaccaugucuggcuaauuuuuguauuuuuaguggagaugggguuucgccuug

SEQ ID NO: 591469 - RNA, 64 nt, hsa
acagguguacgccaccacacccagcuaauuuuuguauuuuuaguagggacagguuuugccaugu

SEQ ID NO: 591470 - RNA, 64 nt, hsa
gcccaccaccaugcccggcuaauuuuuguuuuuguauuuuuaguagagacaggguuucacugug

SEQ ID NO: 591471 - RNA, 64 nt, hsa
caggugugugccuccacacccggcuaauuuuuuguauuuuuaguagagacgggguuuugccaug

SEQ ID NO: 591472 - RNA, 64 nt, hsa
gccuacuauaaggaauauaugacaugcuaaauuuuauuuuuaaacgguucuucaagucagauua

SEQ ID NO: 591473 - RNA, 64 nt, hsa
uacacuaucuaucuuagauagauauauuuuuuuuuauuuuuaaauauuguacuauuuauggugg

SEQ ID NO: 591474 - RNA, 64 nt, hsa
uuuuguuuuucuuaguaaguguaaaugguugcuuuauuuuuauuuuaaaaagguaugucuuugg

SEQ ID NO: 591475 - RNA, 64 nt, hsa
auccaaauaccucagcuaaguaauucuauuuuauuauuuuuacuguuauguauguuuuuaauca

SEQ ID NO: 591476 - RNA, 64 nt, hsa
uuaaauuuucagguauuuagcuccccuuucauauuauuuuuaaauuuuuuaauuaccuguugua

SEQ ID NO: 591477 - RNA, 64 nt, hsa
gaaaaggcauuuggcauuuaacugucucuuguuuuauuuuuaaguuuuuggaaaccuuuugaca

SEQ ID NO: 591478 - RNA, 64 nt, hsa
aauuuaaaauagauacagaaaaguacacugguaauauuuuuauuuccuauuggagagugaaucc

SEQ ID NO: 591479 - RNA, 64 nt, hsa
aaauauagcauccuucuguuguuuauuuuaaauauauuuuuaaugaaaagggacuuaaaaagua

SEQ ID NO: 591480 - RNA, 64 nt, hsa
ucaggugcauuccaccacacauggcuaauuuuuguauuuuuaguagaaaugggguuucgucaug

SEQ ID NO: 591481 - RNA, 64 nt, hsa
acaggugccuaccaccaugccaggcuaauuuuuguauuuuuaguaaagacaggguuucaccaua

SEQ ID NO: 591482 - RNA, 64 nt, hsa
gaaaaauuauaucugaaucaagauucauguuuuuuauuuuuauuuuuuuugauacagagucuca

SEQ ID NO: 591483 - RNA, 64 nt, hsa
caggcacccgccaccacacccagcuauuuuuuuguauuuuuaguagagacagagucucaccaca

SEQ ID NO: 591484 - RNA, 64 nt, hsa
ugucuuuucuguugucuucaaauuuuaugccuuuuauuuuuaauuuaaucccguucaauuauuu

SEQ ID NO: 591485 - RNA, 64 nt, hsa
uuacuucaaaauauucacaaggcuaaauaacucuuauuuuuauuuuugaagguuuuuuuuuuua

SEQ ID NO: 591486 - RNA, 64 nt, hsa
gcagcagaaggaagacagaaagauagaaauugauuauuuuuaugauagcaguauucaggaucuc

SEQ ID NO: 591487 - RNA, 64 nt, hsa
cuauacuuguguuuuguuugggggcugggaaauguauuuuuacauuguagccaaucauuuuaua

SEQ ID NO: 591488 - RNA, 64 nt, hsa
agaaagugguucaauuccccuguuggcauaugauuauuuuuacuaaaauuaauacagcucugug

SEQ ID NO: 591489 - RNA, 64 nt, hsa
aucgugauuauauucaucuacuuagaaauuguuuuauuuuuaaauuaauuugcuuagcuguuug

SEQ ID NO: 591490 - RNA, 64 nt, hsa
uagcaacagccuccuuauuagucucccuguuuuuuauuuuuauuccuuucuacacuacaaccaa

SEQ ID NO: 591491 - RNA, 64 nt, hsa
gcaggcaccucuucccuucaauaucuguucuucguauuuuuaaaaaaauuuguuuuagacugcc

SEQ ID NO: 591492 - RNA, 64 nt, hsa
caagugccugccaccacgccuggguuauuuuuuauauuuuuaguagagacgggguuucacugug

SEQ ID NO: 591493 - RNA, 64 nt, hsa
gauaccuuguaaaguuccugccccaguauagggauauuuuuacugucuuuuuuauuuuuugaga

SEQ ID NO: 591494 - RNA, 64 nt, hsa
acgaguuuacugauuggagcauagggcuuguuguuauuuuuauucaagcuuuuaguaauagccu

SEQ ID NO: 591495 - RNA, 64 nt, hsa
aaaaagagaguuauuacaaauaaauaugucucuuuauuuuuaaaaaugaaaucuuaauucauuu

SEQ ID NO: 591496 - RNA, 64 nt, hsa
aggcuuauccuucugcauuaguauaaagagucuguauuuuuaauaaauguuaaauaagcuaaca

SEQ ID NO: 591497 - RNA, 64 nt, hsa
ugugacuaagaaggaaaauaugcauauaguggcauauuuuuauaugaaucaucuccucuguggu

SEQ ID NO: 591498 - RNA, 64 nt, hsa
aucacaugauuuggagaaauuagacacaaucucuuauuuuuauaccacugucuugggcuaaaau

SEQ ID NO: 591499 - RNA, 64 nt, hsa
aaauaaugcacauuuaauauguuuuaaaaugucuuauuuuuaagaauuauaacuaaaagaccaa

SEQ ID NO: 591500 - RNA, 64 nt, hsa
uuucgccagggaucuuuucaaaacugguaguaguuauuuuuaaaaaucauguuugacaucuuuc

SEQ ID NO: 591501 - RNA, 64 nt, hsa
uauaggugugcgccaccacaccagcuaauuuuuguauuuuuaguagagacgggguuuuacuuug

SEQ ID NO: 591502 - RNA, 64 nt, hsa
cauuugauucauucucacauuuuuuuccuuuaaauauuuuuaguugaccuuuuuccuuugguuu

SEQ ID NO: 591503 - RNA, 64 nt, hsa
uagaagaagcuaugucaagaggcugaauuauuuuuauuuuuaaacagguggugagaaauuucug

SEQ ID NO: 591504 - RNA, 64 nt, hsa
uuuaccuagaagaagcuaugucaagaggcugaauuauuuuuauuuuuaaacagguggugagaaa

SEQ ID NO: 591505 - RNA, 64 nt, hsa
accacgccuggcuaacuaacuaacuaacuuuuuguauuuuuaguagagacaggguuucacugug

SEQ ID NO: 591506 - RNA, 64 nt, hsa
acaguugaagcaucuaaaaauugaaauaaauauauauuuuuaacauauauuguacuugaauuau

SEQ ID NO: 591507 - RNA, 64 nt, hsa
gguuuaucuuggcauauauccuucaguuuguuuuuauuuuuaauuuuuccuuuuuuuccgauua

SEQ ID NO: 591508 - RNA, 64 nt, hsa
cuagauuacauaauaguauuucuagaaaaagagauauuuuuagauuguaugccacuuuuguuua

SEQ ID NO: 591509 - RNA, 64 nt, hsa
acugcccgugucuccagaauguagagcccaucaauauuuuuauuuuaggagguguacuugacac

SEQ ID NO: 591510 - RNA, 64 nt, hsa
uccuugccgcgacugugaagauaaaguucaaaaguauuuuuaccaaaguguagcuaauauuuca

SEQ ID NO: 591511 - RNA, 64 nt, hsa
cauauacauuuuucuugagucucaagguauuuuauauuuuuagucagaaaaaauaauuuuucau

SEQ ID NO: 591512 - RNA, 64 nt, hsa
uucaaauguccuguuugauacuacuguagaacacuauuuuuaauacagaaaaagcucccuauaa

SEQ ID NO: 591513 - RNA, 64 nt, hsa
acccaaccccuggaaaacuaaauuuuuaagugcuuauuuuuauagaaguuugaaaauuuaaugc

SEQ ID NO: 591514 - RNA, 64 nt, hsa
ggugccugccaccacacccagcuaauuuuuuuuguauuuuuaguagagacgggguuucaccgug

SEQ ID NO: 591515 - RNA, 64 nt, hsa
cauucaggaauagauuuauacaccauuauuguuuuauuuuuaaauuuucauucacucuucuguu

SEQ ID NO: 591516 - RNA, 64 nt, hsa
uucccaauacguuucauagaaaauaaguaagaacuauuuuuaaaauauucaaacaaaacuaaaa

SEQ ID NO: 591517 - RNA, 64 nt, hsa
aauuuugauauuagucuuauguuaucuuccauucuauuuuuaucugcuuuuugcugcuaguuuc

SEQ ID NO: 591518 - RNA, 64 nt, hsa
ucuuuuccacuguuuguaaggugcaacaauuuaauauuuuuaagggacuuuuuaagaguuccuu

SEQ ID NO: 591519 - RNA, 64 nt, hsa
uucccagauuuuauauacucuugaauaaaagguuuauuuuuauuuauaagugggcauaaaauaa

SEQ ID NO: 591520 - RNA, 64 nt, hsa
uuuaugaaaacucaacauugaguaaaaaaaaacauauuuuuaacuuuauuuuccuguuguacaa

SEQ ID NO: 591521 - RNA, 64 nt, hsa
auauauuuauucuuuaguuuuugugauaugcuuauauuuuuaaggaaguaaguuauagcauacu

SEQ ID NO: 591522 - RNA, 64 nt, hsa
uacauuauuuacugccuauuucauucugauucuauauuuuuagcuuuaugcugaacuguucaau

SEQ ID NO: 591523 - RNA, 64 nt, hsa
aaauauaucuauauauauuuagcauaagacgugauauuuuuaauuucuuuuuuaaaaaauuaua

SEQ ID NO: 591524 - RNA, 64 nt, hsa
acaauauucagaaaguuuaagcauauaaacuuuuuauuuuuaacuugccuaaaucccuguauuc

SEQ ID NO: 591525 - RNA, 64 nt, hsa
guuauuugcaaguguauuucuuugcuuuguagaguauuuuuauuggguguuaacuuugacagcu

SEQ ID NO: 591526 - RNA, 64 nt, hsa
uuauuuuguuacacuaaagggcaggugguucuaauauuuuuagcucuguucuuuauaacaaggu

SEQ ID NO: 591527 - RNA, 64 nt, hsa
gagcauuuuauauccacaucuuuaaguauuguuuuauuuuuaugugcucucaucagaaauguca

SEQ ID NO: 591528 - RNA, 64 nt, hsa
ucuuucugucaaauuagauuuaaugagagaguacuauuuuuaaggagcuaucuguuuauguaga

SEQ ID NO: 591529 - RNA, 64 nt, hsa
guuguuguuaguggggacuaugauacuguaauaauauuuuuaaaaauuuacaucaagagaggca

SEQ ID NO: 591530 - RNA, 64 nt, hsa
cagcuuugauugauuucagcauucguugcuuugcuauuuuuacaaaacagcauugauugaagca

SEQ ID NO: 591531 - RNA, 64 nt, hsa
gcuguaaagaugaaggcaucaaauaaacucaaaguauuuuuaaauuuuuuugauaauagagaaa

SEQ ID NO: 591532 - RNA, 64 nt, hsa
acaggcacacacuaccacgccuggcuaauuuuuguauuuuuauuauagacgggguuucaccaug

SEQ ID NO: 591533 - RNA, 64 nt, hsa
uuucacuuuaucuuauuggaguuuuugaguuauuuauuuuuacaguaacuuauuugacuauuaa

SEQ ID NO: 591534 - RNA, 64 nt, hsa
uuacaggcgugagccaccgcgcccagccggaauuuauuuuuaauuaucuuuacaauuauuaucu

SEQ ID NO: 591535 - RNA, 64 nt, hsa
uuuuaaaugaguuuuguuaguuucaguuguauuuuauuuuuaguuuuauuaguugauuuucauu

SEQ ID NO: 591536 - RNA, 64 nt, hsa
ucauguacacacagaaaaaaaaaccagucauuuuuauuuuuauuuuuugagacagaguuucgcu

SEQ ID NO: 591537 - RNA, 64 nt, hsa
cagacacccaucaccacgcccagcuaauuuuauguauuuuuaguagagaugggguuucaccaug

SEQ ID NO: 591538 - RNA, 64 nt, hsa
uaaacuugaaacaaaaauggacaaauaucuaaaauauuuuuaaauguauguauuuuaauuggca

SEQ ID NO: 591539 - RNA, 64 nt, hsa
caggcgcccgccaccacgccuggcuaauuuuuuguauuuuuaguagagacgggauuuuaucaug

SEQ ID NO: 591540 - RNA, 64 nt, hsa
guagcugggauuacagcugccugccaaauuuuuguauuuuuaguggaaccgggguuucaccaug

SEQ ID NO: 591541 - RNA, 64 nt, hsa
ucaaauaaaauguuuuuuuguauuuucuccaaguuauuuuuauauguaaaguuaaaauuagaua

SEQ ID NO: 591542 - RNA, 64 nt, hsa
auagugaagauggaauaugucugcuacaaaugcuuauuuuuauuguugcuauuuucaguguaua

SEQ ID NO: 591543 - RNA, 64 nt, hsa
gaaauaauaccucaagauaaucugauuuauuagcuauuuuuaaacauuuuuaaucacaagcugu

SEQ ID NO: 591544 - RNA, 64 nt, hsa
caaaccuugauccauuuugacauuuguuaugcacuauuuuuauaucucugugagagauuuuucc

SEQ ID NO: 591545 - RNA, 64 nt, hsa
aauuuuucauauucuugucauuaauauuauuuuguauuuuuauguggaaauauauaauuuuaug

SEQ ID NO: 591546 - RNA, 64 nt, hsa
caagaauauguauuaauagugccuaauguaucuauauuuuuauuauucaugaauuaaauuacua

SEQ ID NO: 591547 - RNA, 64 nt, hsa
aaagcaacagcaagacauauuuuguuagauauuuuauuuuuaauguuuucuauaauuuaaaaau

SEQ ID NO: 591548 - RNA, 64 nt, hsa
uaauaugaccuuuuuaaauuuuuuuuauuuuuuuuauuuuuauuucuuuaagauggagucuugc

SEQ ID NO: 591549 - RNA, 64 nt, hsa
gauuacaggcagcaccacaccuggcuaauuuucauauuuuuaguagagaugggguuucaacaua

SEQ ID NO: 591550 - RNA, 64 nt, hsa
gugcagaaaauauuuaauaucaaaagaaaauugauauuuuuauacaaguaauuuccugagcuaa

SEQ ID NO: 591551 - RNA, 64 nt, hsa
cacacuugaagccuaaauuugugcuuuuuaagaauauuuuuagacuauuucuuuuuauaggggc

SEQ ID NO: 591552 - RNA, 64 nt, hsa
acaggcgcaugccaccaugcccagcuaauuuuuguauuuuuaguagaggcgggguuucaccaug

SEQ ID NO: 591553 - RNA, 64 nt, hsa
aaaaucauuuuuauaaaauggggggaaauacugguauuuuuauaaucucgcagauaaaaaaggg

SEQ ID NO: 591554 - RNA, 64 nt, hsa
cuuugagggguucuuuucugguagcucaggcaauuauuuuuaccauaucagcacaugacaaggc

SEQ ID NO: 591555 - RNA, 64 nt, hsa
uacagacucaugccaccacgccagcuaauuuuuguauuuuuaguagagacgggguuucaccaug

SEQ ID NO: 591556 - RNA, 64 nt, hsa
auuacauauauaaaacuaaggcuuuuauuucuguuauuuuuaagcuuuuauuucuuguagcuaa

SEQ ID NO: 591557 - RNA, 64 nt, hsa
auucuucuugaaaauaaaaaauauugaaaugcuguauuuuuacagcuacuuuaaccuaugauaa

SEQ ID NO: 591558 - RNA, 64 nt, hsa
gauagcagacauuguuacaaggacauggugagucuauuuuuaaugcaccaaucuuguuuauagc

SEQ ID NO: 591559 - RNA, 64 nt, hsa
acaggcaugaaccaccacaccuggauaauuuuuguauuuuuaguagacacaaaguuucaccaug

SEQ ID NO: 591560 - RNA, 64 nt, hsa
caaaguauuugacaucuuaagcaaauauccagaauauuuuuaaguaaaaaaccaucuuaaguau

SEQ ID NO: 591561 - RNA, 64 nt, hsa
uguguacuuugucauguauggaguuucuaucuuuuauuuuuacuaaauaacuauagauauguau

SEQ ID NO: 591562 - RNA, 64 nt, hsa
aucaacaaagcaucgaugauggacagucucacacuauuuuuaucauauguuucuuugucagccu

SEQ ID NO: 591563 - RNA, 64 nt, hsa
acaggcgugcacuaccacacccagcugauuuuuguauuuuuaguauagaugggguuucaccaug

SEQ ID NO: 591564 - RNA, 64 nt, hsa
aacaauuuguuuuaauuuuuuauauauauguuuuuauuuuuaaaaaacauaccaguugaauggg

SEQ ID NO: 591565 - RNA, 64 nt, hsa
ugcaauccgauggaucuaauuaaaaaaaaggcaauauuuuuauauuaaaguacuauacuaggag

SEQ ID NO: 591566 - RNA, 64 nt, hsa
cuggguuuguguuacauauuuauauauuuuauuuuauuuuuauaauauagacaucaccuagaug

SEQ ID NO: 591567 - RNA, 64 nt, hsa
aucuacugcaaaacaccacuguuggaaaaauagguauuuuuaaauuguuuuuaaucuuuuuugg

SEQ ID NO: 591568 - RNA, 64 nt, hsa
auacaaaugggauuauacuaaaauaaguaaugccuauuuuuaaggauagguuaaauuugugaau

SEQ ID NO: 591569 - RNA, 64 nt, hsa
aaguuauuugucuucuuuucaaaauaauuagcuauauuuuuauauaauaugaauauauacauaa

SEQ ID NO: 591570 - RNA, 64 nt, hsa
cauauuuuuguaaauaugacagaauuugugaauauauuuuuaaagcaaaaaacuucaacaugca

SEQ ID NO: 591571 - RNA, 64 nt, hsa
uuacacucaggggucugaaaggcaguuugauuuuuauuuuuaacacacuugaaaaaagguugga

SEQ ID NO: 591572 - RNA, 64 nt, hsa
ucccuaguguuucuuaauuucuuuuuagaaaguguauuuuuauuaguauuuuuccggugaacag

SEQ ID NO: 591573 - RNA, 64 nt, hsa
uauaggcaugcaccaccaugcccagcuaauuuuguauuuuuauuagagacaggguuucuccgug

SEQ ID NO: 591574 - RNA, 64 nt, hsa
uuagcugaagguaaaucaauggaaaaaugaaauuuauuuuuaauauuacuacuauaugaauuau

SEQ ID NO: 591575 - RNA, 64 nt, hsa
uuaaaacagaagcucucuccuucauuaauuuaaauauuuuuaucggcucuagaaaaugcauaag

SEQ ID NO: 591576 - RNA, 64 nt, hsa
gcuuuuauuaucuuuaaacuuguugcauuuaaaauauuuuuaaaaccuucuuaacaaaacuucu

SEQ ID NO: 591577 - RNA, 64 nt, hsa
auaucauuaaguauauaaacaaucauuacuucuguauuuuuaaugaaugcaggaaaauaauauu

SEQ ID NO: 591578 - RNA, 64 nt, hsa
uacuucuguauuuuuaaugaaugcaggaaaauaauauuuuuauguauaaaagaugaagaaaaaa

SEQ ID NO: 591579 - RNA, 64 nt, hsa
uaauaugaaaaacaaauuuuuuaauucauaaaaguauuuuuauuagauuucauaugcaugaaac

SEQ ID NO: 591580 - RNA, 64 nt, hsa
aggugccugccaccaugccuggcuaauuuuuuuguauuuuuaguagaaacagggugucaccaug

SEQ ID NO: 591581 - RNA, 64 nt, hsa
uagucgugagccaccacgccuggccagaguuuuuuauuuuuaucaccaccauagauguuacagu

SEQ ID NO: 591582 - RNA, 64 nt, hsa
acaggcgccugccaccacgcccagcuaauuuuuguauuuuuaguagagaugggguuucaccaug

SEQ ID NO: 591583 - RNA, 64 nt, hsa
ucuacaaaaaaauuuguuuuuauuuguauuuauauauuuuuauuuuuguuuuuguugguaggcg

SEQ ID NO: 591584 - RNA, 64 nt, hsa
acaggugugugucaccacgcccggcuaauuuuuguauuuuuaguagagaugggguuucaccaug

SEQ ID NO: 591585 - RNA, 64 nt, hsa
cccaucaaaauguaagcugugcuccucucauuuuuauuuuuauuuuuuugggagagaauauuuc

SEQ ID NO: 591586 - RNA, 64 nt, hsa
aauaauaauaaaaagacuauuaagagcaauaaauuauuuuuaagaaaucgagauuuaguaaauc

SEQ ID NO: 591587 - RNA, 64 nt, hsa
gauguaguuaaguauuuacagauguuaaauggaguauuuuuauuuuauguauauacuauacaac

SEQ ID NO: 591588 - RNA, 64 nt, hsa
uaucugguaauuaugaaucuagaauuuuuuuacauauuuuuauaauacuguuagcucaguuauu

SEQ ID NO: 591589 - RNA, 64 nt, hsa
caggcacccgccacagugccuggcuaauuuuuuguauuuuuaguagagacaggguuucaccaug

SEQ ID NO: 591590 - RNA, 64 nt, hsa
augcauaauauuuucaaaguucuauaccaguaccuauuuuuacucuuacaaaauuuccuguaaa

SEQ ID NO: 591591 - RNA, 64 nt, hsa
uccaagauauuguauucccaagaagaaauugauuuauuuuuaaacuaucaguuacugaagacuu

SEQ ID NO: 591592 - RNA, 64 nt, hsa
uaguugcaaaauccaguagguuaaaauacucacauauuuuuacuuaaauuuucuuuaauuuacu

SEQ ID NO: 591593 - RNA, 64 nt, hsa
gauuacaggugugagccaccacgccuggccggcuuauuuuuauccacaguaaaucuucagcaac

SEQ ID NO: 591594 - RNA, 64 nt, hsa
acaggcaugugccacaguucccggcuaauuuuuguauuuuuaguagagacgggguuucaccaug

SEQ ID NO: 591595 - RNA, 64 nt, hsa
auauuauuuauuaaauguaguucaggaaauaaucuauuuuuacucuuuuuugggaaauacuugu

SEQ ID NO: 591596 - RNA, 64 nt, hsa
auuuagauuuauuuuaaaaguuuauuuaaguaaauauuuuuauaaaaaccagaaaacacuguau

SEQ ID NO: 591597 - RNA, 64 nt, hsa
auuugggcacauucagaguggaaaaaauuuguucuauuuuuacaucuuuaaauaccuaucuucu

SEQ ID NO: 591598 - RNA, 64 nt, hsa
ucccaaaggaagacauauacauggucaauaaguauauuuuuaaaaugcucaacauuaacuauuc

SEQ ID NO: 591599 - RNA, 64 nt, hsa
uugucuuuaacaaugucuauugguaaaggaaaguuauuuuuaaaaauuguauuguaauuccaug

SEQ ID NO: 591600 - RNA, 64 nt, hsa
uacaggcaugcaccaccacaccaggcuaauuuuguauuuuuaguagacacaggguuucuccaug

SEQ ID NO: 591601 - RNA, 64 nt, hsa
guuuuuauaaaaaguuaugcaaaugacuuuauuuuauuuuuauuuccugcauaccauuagaaua

SEQ ID NO: 591602 - RNA, 64 nt, hsa
acuagaagaacauuucaguauaaaaaaccuaauuuauuuuuacagaaaaauauuuuguuguuuu

SEQ ID NO: 591603 - RNA, 64 nt, hsa
uucaauauauuugaacaaauauaguuucuggcacuauuuuuauacuaggaaaaggaguuacuau

SEQ ID NO: 591604 - RNA, 64 nt, hsa
gaguguguacaaauaucuugacauaaugcaguuuuauuuuuaucauucugguaaaaaaacaaaa

SEQ ID NO: 591605 - RNA, 64 nt, hsa
gugucuguauuugguauauacuuugccacugcuguauuuuuauuuuugcacaacuuuugagagu

SEQ ID NO: 591606 - RNA, 64 nt, hsa
uaaacauguagaccgcuuuauaggcuucaaaauguauuuuuauauauuaccuuauuugaucuuc

SEQ ID NO: 591607 - RNA, 64 nt, hsa
caaauugaacuuucuaaaacuaaaagagucuuuuuauuuuuaaaacacaaguagaaugauuuaa

SEQ ID NO: 591608 - RNA, 64 nt, hsa
uguuaguaauucugaaguuuuuuaaauuuauggcuauuuuuacacgaugaugaauuuugacagu

SEQ ID NO: 591609 - RNA, 64 nt, hsa
auuacaacuuuggugauaaacaaaaggagucaguuauuuuuauucauauauuuuagcauauucg

SEQ ID NO: 591610 - RNA, 64 nt, hsa
aacucuguuccauacacuuguauaaauacauggauauuuuuauguacagaaguaugucucuuaa

SEQ ID NO: 591611 - RNA, 64 nt, hsa
uuuaauauucuuuuuuaugacaacuuagaucaacuauuuuuagcuugguaaauuuuucuaaaca

SEQ ID NO: 591612 - RNA, 64 nt, hsa
aacuguuggcuuuucuaaucuuguuaaauauaucuauuuuuaccaaagguauuuaauauucuuu

SEQ ID NO: 591613 - RNA, 64 nt, hsa
caaauuguuucuuugugcuucagcucauuuuccauauuuuuaaaacccugugguaaaagccuca

SEQ ID NO: 591614 - RNA, 64 nt, hsa
aaagaucaucaaugcuaacaccucacaauguguguauuuuuacaguagcuauguuugguuauuu

SEQ ID NO: 591615 - RNA, 64 nt, hsa
cagugccaacauuuaaaaaaguaugaaaaugauuuauuuuuauaugauguauacccauaaagaa

SEQ ID NO: 591616 - RNA, 64 nt, hsa
aaaauauuuuaggauaauugccuacagagggauuuauuuuuaugaugcuggaaauaugaaaugu

SEQ ID NO: 591617 - RNA, 64 nt, hsa
ugauaaucuuucuccacuguucuaauauauauuguauuuuuauuugauagcuugggauuuaaaa

SEQ ID NO: 591618 - RNA, 64 nt, hsa
auauuguauaguaucuugugcuaggugaggaaauuauuuuuaauuuugauaauuuaauauuccu

SEQ ID NO: 591619 - RNA, 64 nt, hsa
uuuucccuaagugguaagcaauuacuuuaaaacauauuuuuaaaaacaucgguaucgggagcug

SEQ ID NO: 591620 - RNA, 64 nt, hsa
acaggugcccaccaccaugccuggcuaguuuuuguauuuuuaguagaggcaagguuucaccauc

SEQ ID NO: 591621 - RNA, 64 nt, hsa
ugauuauucauucuguuauacucuaacaucuguauauuuuuaccaguauucucagaccacuucu

SEQ ID NO: 591622 - RNA, 64 nt, hsa
uuaucuuguaaaaacacuuuuuugguuuaauauauauuuuuaaaacauuucacuagugauugaa

SEQ ID NO: 591623 - RNA, 64 nt, hsa
uuuuccauaugacacugguuccgauuuuaaaaauuauuuuuaaauaaccgauuauugauuacug

SEQ ID NO: 591624 - RNA, 64 nt, hsa
uaacacaaguuuaccauuuuuaucaucuuuagauuauuuuuaaaucucacuaccuugaaguuug

SEQ ID NO: 591625 - RNA, 64 nt, hsa
uaccuuugugcuuucuaaguauaaagauuuaaauuauuuuuaauacgguuuuuagaaccacaga

SEQ ID NO: 591626 - RNA, 64 nt, hsa
gucauauuugauuuagaggguaacuuaaaucaguuauuuuuagcuuuuuagaacuuugaucugc

SEQ ID NO: 591627 - RNA, 64 nt, hsa
agggauugucaaaauaaucuccuugaggcaucuuuauuuuuaaaaugagauuaaaguaugugau

SEQ ID NO: 591628 - RNA, 64 nt, hsa
ggaagauacuuacaggggaaauuaauauuuugacuauuuuuauauauaaagaagaacucaaaaa

SEQ ID NO: 591629 - RNA, 64 nt, hsa
ggcagagcuaucucucucauagcuuuuaugcccuuauuuuuauucaacugguauuaauguuuuu

SEQ ID NO: 591630 - RNA, 64 nt, hsa
acaggugcccaccaccaugccuggcugguuuuuguauuuuuaguagaggcaagguuucaccauc

SEQ ID NO: 591631 - RNA, 64 nt, hsa; identical to SEQ ID NO: 591621

SEQ ID NO: 591632 - RNA, 64 nt, hsa
aguugcuuuuuucauaguucuuguuuucauguuuuauuuuuaaaaagacauauaaagauugcau

SEQ ID NO: 591633 - RNA, 64 nt, hsa
acauuuccuaauaaaccccuuugauuuaaaaauguauuuuuaaaaauguuuacauugaugauga

SEQ ID NO: 591634 - RNA, 64 nt, hsa
cucuucuagacuuuguguauaugauuuaaucuuuuauuuuuauuuuuguagaauggggguaaaa

SEQ ID NO: 591635 - RNA, 64 nt, hsa
ggggguaaaacuacaaaucuccuccucagggugauauuuuuaaagauuaaggaguaugacauca

SEQ ID NO: 591636 - RNA, 64 nt, hsa
ccagacccucgaggcugccacuccgucgugguuuuauuuuuaauauagagagaguuuugaauuc

SEQ ID NO: 591637 - RNA, 64 nt, hsa
ucaucacaugacaaaggauaaugugcaagaaaaguauuuuuauguaucauaaauguauuuugaa

SEQ ID NO: 591638 - RNA, 64 nt, hsa
auaggcacaugccaccgcgcccagcuaauuuuuguauuuuuaguagagaugggguuucaucaug

SEQ ID NO: 591639 - RNA, 64 nt, hsa
aggcgccugccaccaugcccgccuaauuuuuuuguauuuuuaguagagaugggguuucaccgug

SEQ ID NO: 591640 - RNA, 64 nt, hsa
aggccuuuuuuggcuuuagacacuggcugccagcuauuuuuacuagaacacagaaagccuauca

SEQ ID NO: 591641 - RNA, 64 nt, hsa
uugggauuggugggaaaugucaaaacaugcccuuuauuuuuaaaggcauucacaaacucucuga

SEQ ID NO: 591642 - RNA, 64 nt, hsa
caacagagagagacaugaguaagacccagauugcuauuuuuauuguuauuuuuaacaugaaucu

SEQ ID NO: 591643 - RNA, 64 nt, hsa
acaugaguaagacccagauugcuauuuuuauuguuauuuuuaacaugaaucuaaaguuuauggu

SEQ ID NO: 591644 - RNA, 64 nt, hsa
gaaaucaaucuuucuacuaauguaaauuugagauuauuuuuaaaaauggaauaaaagagguuuu

SEQ ID NO: 591645 - RNA, 64 nt, hsa
gggacaauauuguauucaacuguuuuauuuuuuauauuuuuaaaauuuaaaguauaauuaguuu

SEQ ID NO: 591646 - RNA, 64 nt, hsa
acugaauguaaugguugauauauguacauucugauauuuuuaaaucuuuaacuuuuuaaaguua

SEQ ID NO: 591647 - RNA, 64 nt, hsa
gugcaugcagagaaaaucugugcauccucuuuuauauuuuuaaaauacuguuuaacauuuguga

SEQ ID NO: 591648 - RNA, 64 nt, hsa
uucauauuuuuauaaauguauauuuauauuuuuguauuuuuaugaaauaaacuaguauuuauaa

SEQ ID NO: 591649 - RNA, 64 nt, hsa
uuaguugaagaaugucuuuguguuaauucauucauauuuuuauaaauguauauuuauauuuuug

SEQ ID NO: 591650 - RNA, 64 nt, hsa
auugucagacuauaaaccuuugcuuuuuaaaguuuauuuuuacuauuucuuuaucacuuuauug

SEQ ID NO: 591651 - RNA, 64 nt, hsa
auagacuucaguugagauguauacuuagcaaaauuauuuuuaaauugaaacagcacaguaaaua

SEQ ID NO: 591652 - RNA, 64 nt, hsa
agcaguuuauauuuuuugugacuuuaugcaaccauauuuuuacuuugucuugacaacugaaaga

SEQ ID NO: 591653 - RNA, 64 nt, hsa
gcagcauaauguuccugauguuaacagaagacuguauuuuuaaaguuacaaauuuguauaugga

SEQ ID NO: 591654 - RNA, 64 nt, hsa
caggcgugugccaccacacccggcuaauuuuucguauuuuuaguguagacgggguuucacuaug

SEQ ID NO: 591655 - RNA, 64 nt, hsa
uauaaugugguaccaccucagcccuaauaaauaauauuuuuaccuaaugucaaaucuuuuucca

SEQ ID NO: 591656 - RNA, 64 nt, hsa
gaagauuuauuccaauucuagaauuguucuuuuuuauuuuuauuuuuucaacugacuaacuuca

SEQ ID NO: 591657 - RNA, 64 nt, hsa
uuaacauguuuguaauugcuacagaauuuaaggguauuuuuaucucugugcuuucuuuuucaug

SEQ ID NO: 591658 - RNA, 64 nt, hsa
auugccuuaguuuuuaaaaauguuuggccauuaguauuuuuauaaaacucaaugcuaguuuuaa

SEQ ID NO: 591659 - RNA, 64 nt, hsa
cuuuucuuaucuguacuuccaaagcacuuucguauauuuuuauuauggcauuuauauauaguuc

SEQ ID NO: 591660 - RNA, 64 nt, hsa
uuacaccaccaugcccagcuacuaaaaauacuuguauuuuuaguagagacgggguuucaccaug

SEQ ID NO: 591661 - RNA, 64 nt, hsa
acaggcaccugccaccacgcccagcuaauuuuuguauuuuuaguagagaugggguuucaccaug

SEQ ID NO: 591662 - RNA, 64 nt, hsa
uuuuaagcuguaauugucuuugucuugauuuggcuauuuuuauaacugaaauccugagcaacag

SEQ ID NO: 591663 - RNA, 64 nt, hsa
agcuaagcaguggguaccugggaucucucugaacuauuuuuauaacuucuugugagucuuaagu

SEQ ID NO: 591664 - RNA, 64 nt, hsa
cgcgccaccacgcccggcuaauuuuuguauuuuguauuuuuaguagagaugggguuucaccaug

SEQ ID NO: 591665 - RNA, 64 nt, hsa
uuaaguuguucccccucccucugaaaaaaguauguauuuuuacauuagaaaagguuuuuuguug

SEQ ID NO: 591666 - RNA, 64 nt, hsa
uguaacugcacaauagcagaaaauuggcaagauguauuuuuacuuuccaagaugccgugugugc

SEQ ID NO: 591667 - RNA, 64 nt, hsa
aaauaaucacuuacuaagccuuaaauaaagccauuauuuuuauaucaauagcacaaaggaaaac

SEQ ID NO: 591668 - RNA, 64 nt, hsa
cauguagaguauuauguuuauacuuuaaacuugauauuuuuaguguauuauuuaaagauaaagg

SEQ ID NO: 591669 - RNA, 64 nt, hsa
uggaaaaggauauucacaguaguacaguucucaauauuuuuaauuagaugucauauuuuuuuaa

SEQ ID NO: 591670 - RNA, 64 nt, hsa
caggcgccugccaccacgccuggcuaauuuuuuguauuuuuaguggagacggauuuucaccgug

SEQ ID NO: 591671 - RNA, 64 nt, hsa
augcauaugagugaggaaauaaacuuuaaguaauuauuuuuaaaguucuuauacuuuuuaaaag

SEQ ID NO: 591672 - RNA, 64 nt, hsa
gccugccaaacuuggggcaauugaugcuaaaugguauuuuuaaaauaaauguuuuuauucuuua

SEQ ID NO: 591673 - RNA, 64 nt, hsa
gaaaagauauuuuuuguauauugacagcauaauuuauuuuuaaugcugucauuacacuuaaagu

SEQ ID NO: 591674 - RNA, 64 nt, hsa
uagguuuuuaaaacuauaaauguugucuuuuuuauauuuuuaugaaaaagcaguagaaaauuac

SEQ ID NO: 591675 - RNA, 64 nt, hsa
cuuaggaguuuuccuacuauuaauaaaugugcucuauuuuuacauuuauguucagaaaguuauc

SEQ ID NO: 591676 - RNA, 64 nt, hsa
aaguguggauaucaauauaaaauuuguuaaagaauauuuuuaacagcugacuuacaugaucguu

SEQ ID NO: 591677 - RNA, 64 nt, hsa
cucuucaccaccacuacccacuccauuuuuuuucuauuuuuaagauuagaggaaaaugaccauu

SEQ ID NO: 591678 - RNA, 64 nt, hsa
acuaaguggagacuuaguuuuugaaguguugaaguauuuuuaauuuuuuaaaugaaaccauauu

SEQ ID NO: 591679 - RNA, 64 nt, hsa
uccaguuagaguaaguacuucugugguuaauguauauuuuuauucuggcuuuuaaaaugggaau

SEQ ID NO: 591680 - RNA, 64 nt, hsa
cuuuugagcuggggcauuuaaagcuuuccuuuaauauuuuuaccugcucauuaugauuccuccu

SEQ ID NO: 591681 - RNA, 64 nt, hsa
auguuaguggaccucaguuauccaucuguaaauuuauuuuuauuuggcuaaaauaaucuaaaag

SEQ ID NO: 591682 - RNA, 64 nt, hsa
ugcauucucuauggcuauauaauguacguaaaucuauuuuuaaagguucagaggaauccauacc

SEQ ID NO: 591683 - RNA, 64 nt, hsa
aggugugaucuaccacaccugucuaaaaaguauguauuuuuaaauuuuuuuguagagacaggau

SEQ ID NO: 591684 - RNA, 64 nt, hsa
uaaagacuguuuauaaaggagagagcuggcgacuuauuuuuauuuuuauuuuuuggacagaguc

SEQ ID NO: 591685 - RNA, 64 nt, hsa
cuguuuauaaaggagagagcuggcgacuuauuuuuauuuuuauuuuuuggacagagucucccuu

SEQ ID NO: 591686 - RNA, 64 nt, hsa
caggcgucugccaccaugcccagcuacuuuuuuguauuuuuaguagauacgggguuucaccgug

SEQ ID NO: 591687 - RNA, 64 nt, hsa
aaugccaaacaaaguuaaauuacaguuaucaaaguauuuuuaaaacuucauagugauaaaugag

SEQ ID NO: 591688 - RNA, 64 nt, hsa
guucauauuagugagcauggcuuacugcuuuauuuauuuuuauuucuugucagggaguauucuc

SEQ ID NO: 591689 - RNA, 64 nt, hsa
cuuaucuccucucauugggaaagcuacaugauaguauuuuuaugcacucuucucccacacauac

SEQ ID NO: 591690 - RNA, 64 nt, hsa
gaggagacgaagugaaaacaaaucuauaaauauauauuuuuaaaauauuuaacuuuuuuuuaug

SEQ ID NO: 591691 - RNA, 64 nt, hsa
aggacaugcgugugucagggaugaguugaggugauauuuuuaugugcagcgacccuugguguuu

SEQ ID NO: 591692 - RNA, 64 nt, hsa
augugcacaguaguuuuuuuauugaaacuuguauuauuuuuaaagagaucuauacuauaaauau

SEQ ID NO: 591693 - RNA, 64 nt, hsa
uguguguguguguguguguguauauauauauauauauuuuuacuuuuauccucuuaccgaaggu

SEQ ID NO: 591694 - RNA, 64 nt, hsa
auuaggugccaaaauacccagcacaauacuuguauauuuuuaguaccauacagaaguaaaaucc

SEQ ID NO: 591695 - RNA, 64 nt, hsa
gggccugagaaaagaaugggagggggcuauuaauuauuuuuagcaaaauguugccuuugucuug

SEQ ID NO: 591696 - RNA, 64 nt, hsa
caaacaaauuauauuguacuuguaucuuuuuaccuauuuuuauacuuuuuauaauguuuacguu

SEQ ID NO: 591697 - RNA, 64 nt, hsa
aauauagucccacagaauacuuauguucacuuucuauuuuuaaaagacuacucugaaaaacacu

SEQ ID NO: 591698 - RNA, 64 nt, hsa
caggugugcaccaacaugcccagcuaauuuuuuauauuuuuaguagagacgggguuucaccaug

SEQ ID NO: 591699 - RNA, 64 nt, hsa
ccaagguagugaugguggccacgugccucguugcuauuuuuaaaguaauauucagaugugguuu

SEQ ID NO: 591700 - RNA, 64 nt, hsa
aagagaugcaacauacuacuuuugugucacaauuuauuuuuaucacccucucuaggguaacgug

SEQ ID NO: 591701 - RNA, 64 nt, hsa
cuuauucucauggucuuaaauuaaauuauucaaguauuuuuaaauauccaauuuguugugauuu

SEQ ID NO: 591702 - RNA, 64 nt, hsa
augaguuccacucccuuugaugauauauguuguauauuuuuaguuguaaagcaguaaucuuuaa

SEQ ID NO: 591703 - RNA, 64 nt, hsa
aguguguauaaaagucuccuuuuuaaaaagaucauauuuuuaaauaaagcauuuuuuguagaaa

SEQ ID NO: 591704 - RNA, 64 nt, hsa
augguauaacuccuaaagcuuucucugcuccaguuauuuuuauuaaauauuuuucacuuggcuu

SEQ ID NO: 591705 - RNA, 64 nt, hsa
ccaguuauuuuuauuaaauauuuuucacuuggcuuauuuuuaaaacugggaacauaaagugccu

SEQ ID NO: 591706 - RNA, 64 nt, hsa
auuucacuuuucucgaucacuaaacauaugcauauauuuuuaaaaaucaguaaaagcauuacuc

SEQ ID NO: 591707 - RNA, 64 nt, hsa
uuauuacuguaagaaauaguuuuauaaaaaauuauauuuuuauucaguaauuuaauuuuguaaa

SEQ ID NO: 591708 - RNA, 64 nt, hsa
uaggcacgugccaccacacccggcuaauuuuuuguauuuuuaguagagacagcguuucaccaug

SEQ ID NO: 591709 - RNA, 64 nt, hsa
auuuuucgucuauucuuaauauuuuuuaauuauuuauuuuuaagaguuuuauaccuugagcaga

SEQ ID NO: 591710 - RNA, 64 nt, hsa
guuugucuuccacagggaagcuuaaaacaaaagauauuuuuaacccacugacagaacaacaagg

SEQ ID NO: 591711 - RNA, 64 nt, hsa
ccauagacccaaagcccuuacguuugaugcaauuuauuuuuaaaauaggccuuguuuuucagcu

SEQ ID NO: 591712 - RNA, 64 nt, hsa
aguuucucauuuauauuuaacguauuggaccugauauuuuuagugggugcauucuuccagaaag

SEQ ID NO: 591713 - RNA, 64 nt, hsa
agacacccgccaacacgccaggcuaauguuuuuguauuuuuaauagagaugggguuuugccaug

SEQ ID NO: 591714 - RNA, 64 nt, hsa
acacucaaauaguauucucuucuuuugaaaauuuuauuuuuaucugaaaauaacaguugaucug

SEQ ID NO: 591715 - RNA, 64 nt, hsa
guaauacuguauaaagaccucaaucuauccagaguauuuuuauauaauguuggaugaguuagga

SEQ ID NO: 591716 - RNA, 64 nt, hsa
aaaauuuacucaaaucaaaguuaaguacagaguuuauuuuuaacaaaugucauagcuaugucac

SEQ ID NO: 591717 - RNA, 64 nt, hsa
uacuuggagggcacuucuuucgugguaguucuuuuauuuuuauuaaucucuguauccuuagaua

SEQ ID NO: 591718 - RNA, 64 nt, hsa
caggcgcccgccaccacgcccggcuaauuuuuuguauuuuuaguagagacgggguuucaccgug

SEQ ID NO: 591719 - RNA, 64 nt, hsa
aggcgugagccaccacgccagggcuuuauuuauuuauuuuuaccacaauaguuugaagcaguaa

SEQ ID NO: 591720 - RNA, 64 nt, hsa
ugggauuacaggcgcgcgccaccacgcgaacuuguauuuuuaguagagacgggguuucgccaug

SEQ ID NO: 591721 - RNA, 64 nt, hsa
uagcaacauaauauauggagcuaauuuguagaauuauuuuuacgauuuccaaacaaauguacug

SEQ ID NO: 591722 - RNA, 64 nt, hsa
caggcgcccgccaccacgcccagcuaauuuuuuguauuuuuaguagagacgggguuucacugug

SEQ ID NO: 591723 - RNA, 64 nt, hsa
uguuuaaugugaugugaauacauuuauguacauuuauuuuuaaauuuguaaauagcuuuaaauu

SEQ ID NO: 591724 - RNA, 64 nt, hsa
aaggaaccaauaaauaauccugccucuauuaauguauuuuuauuuaucauguaaccucaaagug

SEQ ID NO: 591725 - RNA, 64 nt, hsa
auugcuagaauaagguaaauugauacacaacugcuauuuuuaauuuagaacuuugaccuaauuu

SEQ ID NO: 591726 - RNA, 64 nt, hsa
gccacacuucuaacugcuucuggcgaacugauuuuauuuuuaauuuuuuucaauaaagauauuc

SEQ ID NO: 591727 - RNA, 64 nt, hsa
aagagccacuuagccugaaugggaaacgugagacuauuuuuaaacacacaccucuaaggaagaa

SEQ ID NO: 591728 - RNA, 64 nt, hsa
aggcaccugccaccgcgcccagcuaauuuuuuuguauuuuuaguagagaugggguuucacugug

SEQ ID NO: 591729 - RNA, 64 nt, hsa
auguguacaugaugaaucauugagggaggguggauauuuuuauuccuagauauggaggaaacau

SEQ ID NO: 591730 - RNA, 64 nt, hsa
ugauacaacagcuccacucauagauuuaaacuuuuauuuuuacuuaucuuggucauaaguuggc

SEQ ID NO: 591731 - RNA, 64 nt, hsa
uggauugcuuuauuauauucagggcaauauggauuauuuuuauaccaaggauuugcaucgugaa

SEQ ID NO: 591732 - RNA, 64 nt, hsa
cuuuccuuuuccacuucuuucuaacagauuuggauauuuuuaauuuccaggcauagcaauguua

SEQ ID NO: 591733 - RNA, 64 nt, hsa
gugaauugcuuuugaagucugucaguauuacugguauuuuuaaauaaagaagaauuuuucucca

SEQ ID NO: 591734 - RNA, 64 nt, hsa
gcugugcagcuccuuaaauaauaaagcuggaaaauauuuuuagucggguuaucaaauuugauuu

SEQ ID NO: 591735 - RNA, 64 nt, hsa
caugcagugacauacaaagaccaaggauuauguauauuuuuauaucucugugguuuugaaacuu

SEQ ID NO: 591736 - RNA, 64 nt, hsa
acgggcacgcaccaccacgucuggcuaauuuuuguauuuuuaguagagaugggguuucacccua

SEQ ID NO: 591737 - RNA, 64 nt, hsa
ucuccauucguauuuguauuagauauagagugacuauuuuuaaagcauguuaaaaauuuagguu

SEQ ID NO: 591738 - RNA, 64 nt, hsa
aaaauacacugaaugcuauuuuuacuaaccauucuauuuuuauagaaauagcugagaguuucua

SEQ ID NO: 591739 - RNA, 64 nt, hsa
uaaauagccucccuaaggaaaauacacugaaugcuauuuuuacuaaccauucuauuuuuauaga

SEQ ID NO: 591740 - RNA, 64 nt, hsa
uaaggauuuagaccagaggucuagauuaauacucuauuuuuacauuuaaaccuuuuauuauaag

SEQ ID NO: 591741 - RNA, 64 nt, hsa
uuauaaaauuaaaaguuugaaaagcaauauuguauauuuuuaucuauauaaaauaacuaaaaug

SEQ ID NO: 591742 - RNA, 64 nt, hsa
acuaaaaguaugagcguuaggacacuauuuuaauuauuuuuaauuuauuaauauuuaaauaugu

SEQ ID NO: 591743 - RNA, 64 nt, hsa
gugaagcugaguuaauuuauguaagucauauuuauauuuuuaagaaguaccacuugaaacauuu

SEQ ID NO: 591744 - RNA, 64 nt, hsa
uaggcuuaccucaaauaaauggcuaacuuauacauauuuuuaaagaaauauuuauauuguauuu

SEQ ID NO: 591745 - RNA, 64 nt, hsa
aaauucuuaaagauguuggguuguuuauuagugguauuuuuauguugucuuauuuuagguaagc

SEQ ID NO: 591746 - RNA, 64 nt, hsa
ugaaaaacacauacuaugccaccaauugucauauuauuuuuagaugauguaacauagccaucaa

SEQ ID NO: 591747 - RNA, 64 nt, hsa
caauucuguuaaaugaaacguguaucguaaaauguauuuuuauuuuacccacgagaauguuguu

SEQ ID NO: 591748 - RNA, 64 nt, hsa
aaauguauuuuuauuuuacccacgagaauguuguuauuuuuagcaaauagaacucaaugcagug

SEQ ID NO: 591749 - RNA, 64 nt, hsa
guaaaaaaauuaaggucaaugaaagccauucuguuauuuuuagcauucucacuuauuuagacuc

SEQ ID NO: 591750 - RNA, 64 nt, hsa
uccaccaggcaauagacaggagagaggugagaacuauuuuuagaaggaggaaaaguagauacgc

SEQ ID NO: 591751 - RNA, 64 nt, hsa
caggcacacaucgccacacccggcuaauuuuuaguauuuuuaguagagacgggguuucaccgug

SEQ ID NO: 591752 - RNA, 64 nt, hsa
gccaccguguccggccguaguuuauuuuaaaauauauuuuuaaaagcuuuguaaaaauuauguc

SEQ ID NO: 591753 - RNA, 64 nt, hsa
auaggcgagugccaucaugcccggcuaauuuuuguauuuuuaguagagugaggguuucaccaug

SEQ ID NO: 591754 - RNA, 64 nt, hsa
ggauuacaggcaugagccacagugcccggccaaguauuuuuauauuucagaucauaucuacuga

SEQ ID NO: 591755 - RNA, 64 nt, hsa
gguucacuuuuuuuuacauuuauuuuagucuuuauauuuuuauuuuuaagcauugauguacuua

SEQ ID NO: 591756 - RNA, 64 nt, hsa
cuuuuuuuuacauuuauuuuagucuuuauauuuuuauuuuuaagcauugauguacuuaguuguu

SEQ ID NO: 591757 - RNA, 64 nt, hsa
cuuggugcaaaguguaucauguggaauauccucauauuuuuaccauauuuuaagaacuuuaaga

SEQ ID NO: 591758 - RNA, 64 nt, hsa
ucacagcugccauauaaaguucuacucaugccauuauuuuuaugacuucuacguucaguuacaa

SEQ ID NO: 591759 - RNA, 64 nt, hsa
gugcccgccaccaugcccggcugauuucuuuuuguauuuuuaguagagacggaguuucaccgug

SEQ ID NO: 591760 - RNA, 64 nt, hsa
ucauggacuuccucaaaaugaagugcuauuuucuuauuuuuaaucaaauaacuagacauauauc

SEQ ID NO: 591761 - RNA, 64 nt, hsa
uagaggaauagaaguuuauauauauauaauaccauauuuuuaauuucacaaauaaaaaauucaa

SEQ ID NO: 591762 - RNA, 64 nt, hsa
aaacucaaaauaagacaaguaauuuguugauaaauauuuuuaaagauaacucagcauguuugua

SEQ ID NO: 591763 - RNA, 64 nt, hsa
acauuuaaaguguuauauuuuuuauaaaaauguuuauuuuuaaugauaugagaaaaauuuuguu

SEQ ID NO: 591764 - RNA, 64 nt, hsa
gaggaggcugaguuuccagagcuuugcuuucauuuauuuuuauacacauugucucucuauaucu

SEQ ID NO: 591765 - RNA, 64 nt, hsa
uuaagcaagugaaauucugcugcccuccaccauuuauuuuuacagugcuuuguaauuuuuuuca

SEQ ID NO: 591766 - RNA, 64 nt, hsa
aaugggaaagguuuaaaugcuaaccaaagcaauuuauuuuuaauuaauauuuuuagacucugug

SEQ ID NO: 591767 - RNA, 64 nt, hsa
uaaaugcuaaccaaagcaauuuauuuuuaauuaauauuuuuagacucugugcugucauacugaa

SEQ ID NO: 591768 - RNA, 64 nt, hsa
gagcagcacuuagugcuucauagaaagcaaugccuauuuuuaaaguuacaaacgcagauaucua

SEQ ID NO: 591769 - RNA, 64 nt, hsa
ugaaauuauaacaaaagauacuuucuaacaguaguauuuuuagaauggcagcuauaaaguuaac

SEQ ID NO: 591770 - RNA, 64 nt, hsa
aaaugcaaauagauccggugucuaaaugcauucauauuuuuaugauuguuuuguaaauaucuuu

SEQ ID NO: 591771 - RNA, 64 nt, hsa
uuuuuuuuuuuuuuuuuuugacgaagaauguuuuuauuuuuauuuuuuucaugcaugcauucuc

SEQ ID NO: 591772 - RNA, 64 nt, hsa
gguuagggagaggauauaagauuaauggaauguauauuuuuauauaagacguauacggcaccuu

SEQ ID NO: 591773 - RNA, 64 nt, hsa
cuggaaaacaugucuuuagggcugucugcauguuuauuuuuacuucccuggguggacagaauuu

SEQ ID NO: 591774 - RNA, 64 nt, hsa
ucuggugguuuaaaaugugauucuguaacuuuuuuauuuuuauuuuuuugagauaauuucacuc

SEQ ID NO: 591775 - RNA, 64 nt, hsa
acaggcacccgccaccacgccuggcuaauuuuuguauuuuuaguggagaugguguuucaccaug

SEQ ID NO: 591776 - RNA, 64 nt, hsa
uaaggccugaaagcaauuuauaacauaugagucuuauuuuuauuuauagaaauguggaaagcuu

SEQ ID NO: 591777 - RNA, 64 nt, hsa
auuuuuauacaauguucuuucuugcuuuguuuuuuauuuuuauauauuuuuucugacuccuauu

SEQ ID NO: 591778 - RNA, 64 nt, hsa
uucaagagagggcagucaucuuuaaagaacauuuuauuuuuauacaauguucuuucuugcuuug

SEQ ID NO: 591779 - RNA, 64 nt, hsa
gccuuugugcuuuuugucauguuaugcagugaacuauuuuuaaggucuaaucagugauuauuuu

SEQ ID NO: 591780 - RNA, 64 nt, hsa
auauuuaagcagcuugaaugguuuuucuuuucuuuauuuuuaaagaaaugcacuugccuaugau

SEQ ID NO: 591781 - RNA, 64 nt, hsa
uaaauaauaacugaaaagacuauguagugaaauguauuuuuaaaaacuauauucaguaaaagcc

SEQ ID NO: 591782 - RNA, 64 nt, hsa
uuaccucucucuuaaauguuauaaaaaacaauuguauuuuuaagaauguuuauuuaucaaaguc

SEQ ID NO: 591783 - RNA, 64 nt, hsa
aaaaaagauauuugaaguguuuuuauaggagauguauuuuuaucauaguaaaugaucacaauuu

SEQ ID NO: 591784 - RNA, 64 nt, hsa
auaaaaaacaacauagaguacacauauuuauauguauuuuuaaagauaaagaauaucuaaaaug

SEQ ID NO: 591785 - RNA, 64 nt, hsa
cuguggcucuauguugagagcauucucucucuguuauuuuuauuuuauuugcauugcuuaccua

SEQ ID NO: 591786 - RNA, 64 nt, hsa
accuuugaaauauuaaaaucacugucaauauuuuuauuuuuaacucuggauuuugaauuagauu

SEQ ID NO: 591787 - RNA, 64 nt, hsa
auuuauaccuuugaaauauuaaaaucacugucaauauuuuuauuuuuaacucuggauuuugaau

SEQ ID NO: 591788 - RNA, 64 nt, hsa
auuuucuaugauuucuagaaacaaauguaauaaauauuuuuaaaaucuccuuucuacugguuau

SEQ ID NO: 591789 - RNA, 64 nt, hsa
auggauuucaaaucuuuguaauaaaaauuauuuguauuuuuaaguuuuuauuagcuuaaagaaa

SEQ ID NO: 591790 - RNA, 64 nt, hsa
ucacgccauucuccugccucagccaaaccuuugcuauuuuuaaucuucguuggcacuuuccagc

SEQ ID NO: 591791 - RNA, 64 nt, hsa
cuacugaacucuauaguuaguguaauauaauucauauuuuuaugauauuggcacacugagaaau

SEQ ID NO: 591792 - RNA, 64 nt, hsa
aaggagcccuuaaauacuuguuauugacugggguuauuuuuaugcuguagcaaaugugacaggc

SEQ ID NO: 591793 - RNA, 64 nt, hsa
gggaagacugaucuauauauuauauauauauauauauuuuuaaggugaaauacuaaacacuacu

SEQ ID NO: 591794 - RNA, 64 nt, hsa
ucgcauuaguauuaauuuugaaguagcuacaaaguauuuuuaagaaauuauaauuuuaugacug

SEQ ID NO: 591795 - RNA, 64 nt, hsa
acagguaccucuaccaugccuggcugauuuuuuguauuuuuaguagagacaggguuucaccaug

SEQ ID NO: 591796 - RNA, 64 nt, hsa
cacuuugggagccggaaggaggugcuagucauuuuauuuuuacgugaaauagaugaccuauuua

SEQ ID NO: 591797 - RNA, 64 nt, hsa
uacaggagauacguaaaguaggccccacaaauaauauuuuuaaaauacaaaggaucaccacaau

SEQ ID NO: 591798 - RNA, 64 nt, hsa
uccagaccuaguauucuaaguuauuaccacauaguauuuuuauguuacccaucaucuuuaaaaa

SEQ ID NO: 591799 - RNA, 64 nt, hsa
cacuaagcagaauagguauuaguugguuuuuuauuauuuuuaaauuuauauagcucucauguau

SEQ ID NO: 591800 - RNA, 64 nt, hsa
aacugguaaaauaacaauucauacuaucucuacauauuuuuaggauaugaauuuuuuuuuccug

SEQ ID NO: 591801 - RNA, 64 nt, hsa
uuuauguuauuauuccugggagcuuauagcccauuauuuuuacuuuuuuuuuuuaauucagaag

SEQ ID NO: 591802 - RNA, 64 nt, hsa
ugaacuguacacuuuaaaauggaaaauuuauauguauuuuuaccacaauaaacaaaaaacccua

SEQ ID NO: 591803 - RNA, 64 nt, hsa
ggucuuuuuuuuuagauguuugauacauuuuaaguauuuuuaaauagaugaaaauucuaaauga

SEQ ID NO: 591804 - RNA, 64 nt, hsa
caguucucuuuaaagagaagaacuuuuuuauuauuauuuuuaucuccaacugcagguggugucu

SEQ ID NO: 591805 - RNA, 64 nt, hsa
acaugaaccacuccaaaaaucagugcauuuugcauauuuuuaaacaaagacagcuuguugaaua

SEQ ID NO: 591806 - RNA, 64 nt, hsa
uccaaaaagguuugacuggccuccagauuccaguuauuuuuaaaaagcaacuuaccacuaaauc

SEQ ID NO: 591807 - RNA, 64 nt, hsa
guuucuuugguuuuuauuuuguaguccuuucaguuauuuuuaaugugccaaaaauuuguacaug

SEQ ID NO: 591808 - RNA, 64 nt, hsa
auaggaaauuaaauuuguccaaagauuuggagacuauuuuuaaaacauaaauacauaaaauuuc

SEQ ID NO: 591809 - RNA, 64 nt, hsa
uuugauuaaaauuuauauucuuguuuaauaagcuuauuuuuaaacaauuuaaaagcuauuauuc

SEQ ID NO: 591810 - RNA, 64 nt, hsa
aacaauuuaaaagcuauuauucuuagcauuaaccuauuuuuaaagaaaccuuuuuugcuauuga

SEQ ID NO: 591811 - RNA, 64 nt, hsa
guuaagcugccaaaaauuaaagugcaauauuguauauuuuuaagaacaaauuuaaaauagaauu

SEQ ID NO: 591812 - RNA, 64 nt, hsa
aaaugccaugucuauuugauuagucuuauuuuuuuauuuuuacaggcuuaucagucucacuguu

SEQ ID NO: 591813 - RNA, 64 nt, hsa
guguuuuugcuuacccuaagagagguuuucuucuuauuuuuagauaauucaagugcuuagauaa

SEQ ID NO: 591814 - RNA, 64 nt, hsa
aguucagugaaauaggagauacauaguaguauuuuauuuuuaaaauuaauuucucauuugguuu

SEQ ID NO: 591815 - RNA, 64 nt, hsa
cuagaauaguuguaucuaaaucauauuuuaaaauuauuuuuauuuuuaaaaaauuaugguaaaa

SEQ ID NO: 591816 - RNA, 64 nt, hsa
uaguuguaucuaaaucauauuuuaaaauuauuuuuauuuuuaaaaaauuaugguaaaaacauau

SEQ ID NO: 591817 - RNA, 64 nt, hsa
cauuuggaagugguggggacuuuguuuauuuauuuauuuuuaauuuuuuaauuuuauauuauua

SEQ ID NO: 591818 - RNA, 64 nt, hsa
uucaauaacuauggucagggaauuuauaauauuauauuuuuauauacugaacugccauagaugc

SEQ ID NO: 591819 - RNA, 64 nt, hsa
uauugugaaauaauucauuuuauaaauguauaauuauuuuuauaaauuuuauuguuggaaauca

SEQ ID NO: 591820 - RNA, 64 nt, hsa
cucaggcuaguuuguacuaguagaguuuuguuucuauuuuuauuuuuauuaauuuuauuuuuuu

SEQ ID NO: 591821 - RNA, 64 nt, hsa
cuaguuuguacuaguagaguuuuguuucuauuuuuauuuuuauuaauuuuauuuuuuuuaauac

SEQ ID NO: 591822 - RNA, 64 nt, hsa
caaagaagaagaaacagagauggaagaguaaagauauuuuuaaaauggcuagcuauugggcacc

SEQ ID NO: 591823 - RNA, 64 nt, hsa
uguuaucuaaaauuucacacaacuucauuguuuuuauuuuuauauuaugaguuguccaucuuaa

SEQ ID NO: 591824 - RNA, 64 nt, hsa
ccuaguauuuuucuuuaccugaaggagggccauuuauuuuuaauuucacuacauuuuucuuugc

SEQ ID NO: 591825 - RNA, 64 nt, hsa
uugaugcuggauuguuucuagagucacaaugaauuauuuuuaugagauuaccuuauuuuuauau

SEQ ID NO: 591826 - RNA, 64 nt, hsa
agagucacaaugaauuauuuuuaugagauuaccuuauuuuuauauaugacaaacuacuucuaua

SEQ ID NO: 591827 - RNA, 64 nt, hsa
ucucacacacacacacguauacacacacacaguuuauuuuuaauaaaauaggauuauaccacac

SEQ ID NO: 591828 - RNA, 64 nt, hsa
accauuuuauucaccaguggauuuacccuuagaguauuuuuagaucugagcugaugacuuguga

SEQ ID NO: 591829 - RNA, 64 nt, hsa
auauuuguauaguuugagggaugcuauguuaauguauuuuuaauuagauacauauuuuguaaag

SEQ ID NO: 591830 - RNA, 64 nt, hsa
acauauuuuguaaaguguuacuauauuuuaaaguuauuuuuauauguuuuaaaauguuuacucu

SEQ ID NO: 591831 - RNA, 64 nt, hsa
uccuguaugaaauauguuuuauauaaucuccuauuauuuuuaucuuauguuuuguauuguugau

SEQ ID NO: 591832 - RNA, 64 nt, hsa
ucaugcaacuccuaaacucaaagucuaaaucagauauuuuuauuaacaaugacaacuuguugcc

SEQ ID NO: 591833 - RNA, 64 nt, hsa
uuauuuuaugauagcacacuucccuugaucugcuuauuuuuauuccaucaccauuuacccuuuu

SEQ ID NO: 591834 - RNA, 64 nt, hsa
gccaacaagcagucaugacaugaaauaguccuuuuauuuuuauuucgagcuacacacaugcuug

SEQ ID NO: 591835 - RNA, 64 nt, hsa
gcaggcacccgccaccacgccuggcuaauuuuuguauuuuuaguagagacgggguuucaccaug

SEQ ID NO: 591836 - RNA, 64 nt, hsa
gugucagccuuaucaguguuuaagauuuuucuuuuauuuuuaauuuuuuugagacagaaucuca

SEQ ID NO: 591837 - RNA, 64 nt, hsa
ggaacauccuguaacuuuucacugcacuuggcauuauuuuuauaagcugaaugugauaauaagg

SEQ ID NO: 591838 - RNA, 64 nt, hsa
gguaucacuugugaucauuuaucuuucuaaauucuauuuuuaauacuguuccaccaaagugaug

SEQ ID NO: 591839 - RNA, 64 nt, hsa
acaggcacccaccaccacgcccagcuaauuuuuguauuuuuaguagaaaugggguuucaccaug

SEQ ID NO: 591840 - RNA, 64 nt, hsa
caacuuucagauucuguugacauugucuuugugguauuuuuauuucauggguuuuaauuucucu

SEQ ID NO: 591841 - RNA, 64 nt, hsa
caauuucaguauuuuauaguuucuacuuguaaaauauuuuuaauaagaaaaauugguuugcaua

SEQ ID NO: 591842 - RNA, 64 nt, hsa
uguccugcauuauguuuuuuacuugauauaaauguauuuuuacugugauaguccaagugcccug

SEQ ID NO: 591843 - RNA, 64 nt, hsa
cagagcaagaagaugauacuuauuuuugaauuuguauuuuuaaaacuagauuuauagacuuuuu

SEQ ID NO: 591844 - RNA, 64 nt, hsa
uuguauaguugaugagucaauguaaauuuguguuuauuuuuauaugauugaaugaguucuguau

SEQ ID NO: 591845 - RNA, 64 nt, hsa
gccuuuuuuugauuaccuguagugcuuuaaaguauauuuuuaaaagggaggaaaaaaauaacaa

SEQ ID NO: 591846 - RNA, 64 nt, hsa
aaaacucuauguccggcuuuaacuaucuucucuauauuuuuauuucauucacauuaaugagaag

SEQ ID NO: 591847 - RNA, 64 nt, hsa
auuggcagauuguuuuuuccuaaggaaacugcuuuauuuuuauaaaacugccugacaauuauga

SEQ ID NO: 591848 - RNA, 64 nt, hsa
caguuugguuguguaagagaauguugaauacuuauauuuuuaauaaaaguugcaaagguaauca

SEQ ID NO: 591849 - RNA, 64 nt, hsa
ucuguaccauagcgcugcucuuaugccauuuguuuauuuuuauauagcuugaaacauagaggga

SEQ ID NO: 591850 - RNA, 64 nt, hsa
ucuguaauuccuggccacagguccuuauugccauuauuuuuaaguaucuucauuggagaugaac

SEQ ID NO: 591851 - RNA, 64 nt, hsa
caaacccauuucucccgcuucacucuguuucagauauuuuuauuggaaaauguuaggguagagg

SEQ ID NO: 591852 - RNA, 64 nt, hsa
gguacacucuucuucuuuuauuuauuuauuuauuuauuuuuaggccauucuucugguuugccaa

SEQ ID NO: 591853 - RNA, 64 nt, hsa
uucacauaugcaaaaucuguuucuacuacaauguuauuuuuacuaaugccuuauuguugcacuc

SEQ ID NO: 591854 - RNA, 64 nt, hsa
ggugucaggaaaugucaaauauaauuccauuuuuuauuuuuauuuuuuuaagcuuuuggaaaag

SEQ ID NO: 591855 - RNA, 64 nt, hsa
auuucagauauucugcucuauuauauaaacuuuauauuuuuauauuugugaucuaccuugaauu

SEQ ID NO: 591856 - RNA, 64 nt, hsa
cuuuccagggauuuuugaguccuauucaaauuccuauuuuuaaauaauuuccuacacaaaugau

SEQ ID NO: 591857 - RNA, 64 nt, hsa
ucaauggaacccuugcacaaaaaagugugauaaauauuuuuaaauaaaaacuuaauacaaaugu

SEQ ID NO: 591858 - RNA, 64 nt, hsa
caagaaaccacuaggaauugaaggaauauuuggauauuuuuaauccuaagauuuugcccuacaa

SEQ ID NO: 591859 - RNA, 64 nt, hsa
gggaaccaagguuuuugagaagucugccccuauuuauuuuuaguaaguaucaagagguagccug

SEQ ID NO: 591860 - RNA, 64 nt, hsa
auucuagguccuaggaucuagaauuagaucuuuguauuuuuaaugcuuaggggaagaauauaag

SEQ ID NO: 591861 - RNA, 64 nt, hsa
cuuauauuaaugcauacacuuuuguaaagaaguauauuuuuaugaaaagaaacuuuguaaaagu

SEQ ID NO: 591862 - RNA, 64 nt, hsa
uugccuacaauuguggacuuaucauauuuuuauauauuuuuaaauuucuguaccuuuauuguua

SEQ ID NO: 591863 - RNA, 64 nt, hsa
uauaaauuuauugccuacaauuguggacuuaucauauuuuuauauauuuuuaaauuucuguacc

SEQ ID NO: 591864 - RNA, 64 nt, hsa
uucacuccuugcuucaauaugguuuuuuccuauuuauuuuuauuauuuuuuaaucccaaaugug

SEQ ID NO: 591865 - RNA, 64 nt, hsa
ucuaauagguacugccauauuuuucuguguggaguauuuuuauaauuuuaucuguauaagcugu

SEQ ID NO: 591866 - RNA, 64 nt, hsa
ucuguuuauuaugacaaaugaaagagaaaauauauauuuuuaauggaaaguuuguagcauuuuu

SEQ ID NO: 591867 - RNA, 64 nt, hsa
aaauuagaagacugaaaauggacccaugagaguauauuuuuaugagggagcaaaaguuagacug

SEQ ID NO: 591868 - RNA, 64 nt, hsa
uacuagacaucuaggaacauuacaaagcaaagacuauuuuuaugcuuccauaaccuagaauuaa

SEQ ID NO: 591869 - RNA, 64 nt, hsa
cauuuugaaucuucacucccuaccaggcucuuccuauuuuuaaucucuucaccucagaacuaga

SEQ ID NO: 591870 - RNA, 64 nt, hsa
ugauuauguuaugugugcuuuuaugaaagauuguuauuuuuauauaucaagaugauagaaccug

SEQ ID NO: 591871 - RNA, 64 nt, hsa
aaaaacagagcccuagagaaaugcuguuacuuuuuauuuuuacacccaucagauuuaaggaaaa

SEQ ID NO: 591872 - RNA, 64 nt, hsa
aggcaguuaugauuccacuucuccuacauuuaauuauuuuuaauugagaacaacucaugaucac

SEQ ID NO: 591873 - RNA, 64 nt, hsa
cuucauaggaaaacuauauuuagugggcaacaacuauuuuuaugaugggaugggggaguauaua

SEQ ID NO: 591874 - RNA, 64 nt, hsa
aaaaugacaaucaauuugagaaaauagaaauagauauuuuuaaauaaaaccauucacaguuuac

SEQ ID NO: 591875 - RNA, 64 nt, hsa
ccaagcacacaugugugaagggcuauagccaaaguauuuuuacuagccuguaugaaaucacuag

SEQ ID NO: 591876 - RNA, 64 nt, hsa
uauuuuuacuagccuguaugaaaucacuaguccuuauuuuuaaaggucuaugguuucuuggaag

SEQ ID NO: 591877 - RNA, 64 nt, hsa
gcauguucuauuuuuuaacuaaucaccccugauauauuuuuauuuuuauauauccaguuuucau

SEQ ID NO: 591878 - RNA, 64 nt, hsa
ucuauuuuuuaacuaaucaccccugauauauuuuuauuuuuauauauccaguuuucauuuuuuu

SEQ ID NO: 591879 - RNA, 64 nt, hsa
uucaagccugccccucuucugcuuuuuuagacaguauuuuuagagcuggaaagaaauuuucuag

SEQ ID NO: 591880 - RNA, 64 nt, hsa
uacagcacccaccaccacacccagcuaauuuuuguauuuuuaguagagacagggguuucaccac

SEQ ID NO: 591881 - RNA, 64 nt, hsa
auuacagggcccugccaccaagcccagcuaauuguauuuuuaguagagacaggauuucaccaug

SEQ ID NO: 591882 - RNA, 64 nt, hsa
uuuauaaauccuaaaguauauuuguuuaauggccuauuuuuagaugaagaaaaagccaguuggu

SEQ ID NO: 591883 - RNA, 64 nt, hsa
uaaauuugcuguagcaguggggaagagggacggauauuuuuaauugauuaguguuuuuuuccuc

SEQ ID NO: 591884 - RNA, 64 nt, hsa
gcagcaaaccuccuggguuugaaaaauuccaacuuauuuuuaucuuuaauccugacauuagcug

SEQ ID NO: 591885 - RNA, 64 nt, hsa
uacaggugugcaccacuaugccuggcuaauuuuguauuuuuaguagagaugggguuucaccaug

SEQ ID NO: 591886 - RNA, 64 nt, hsa
uauggaauauauauauuuuauauauauauauauauauuuuuauuuuugagauggaguuucacuc

SEQ ID NO: 591887 - RNA, 64 nt, hsa
auauauaauauauauggaauauguauauuauauauauuuuuauauauauaauauauauggaaua

SEQ ID NO: 591888 - RNA, 64 nt, hsa
guacaaaugcauuuccaaacugccuuaaacguuguauuuuuauagacauguuuuuuaaaaaucc

SEQ ID NO: 591889 - RNA, 64 nt, hsa
gaauuuuuauaaauuguaugcuucagaaauaauuuauuuuuaaaaagaaauuaaaaguuuuaaa

SEQ ID NO: 591890 - RNA, 64 nt, hsa
aaaggagcacucaauugcagagauuugaggacauuauuuuuauuuugagcuuuaaaaagaugaa

SEQ ID NO: 591891 - RNA, 64 nt, hsa
aaauuaauauuuauaauggauauuuaaugauuguuauuuuuaaaaaccagcuuauaauuccucg

SEQ ID NO: 591892 - RNA, 64 nt, hsa
uuggguauaaaucaaucccaguuugggaaaagauuauuuuuaagcuuaaaaggcugacaugugc

SEQ ID NO: 591893 - RNA, 64 nt, hsa
aaauaguaaaccuauauuuucauaauucuauguguauuuuuauuuugaauaaacagaaagaaau

SEQ ID NO: 591894 - RNA, 64 nt, hsa
gaggaacugaucucauauauuuguaucagaacuguauuuuuauguuauauuguauaguuugcuc

SEQ ID NO: 591895 - RNA, 64 nt, hsa
auuaguucccuagcuuucucaaugaauacacacauauuuuuacauagcuaugaucguuguguac

SEQ ID NO: 591896 - RNA, 64 nt, hsa
uuggauauauaauaauuuauuuaaccagucucuuuauuuuuauuuauuuauuuuguuuguuuuc

SEQ ID NO: 591897 - RNA, 64 nt, hsa
uagucuagcuuauuuccuuucagucuuuuuucaauauuuuuauaaacauugaguacuuacugaa

SEQ ID NO: 591898 - RNA, 64 nt, hsa
uacaaaucucuggguggaugaucuucuaguacuguauuuuuaaauuaaggaguuuuaguuauaa

SEQ ID NO: 591899 - RNA, 64 nt, hsa
uuuucuuuaaauuguucuuacagugauaucuuacuauuuuuaacugucugggguuucugauaug

SEQ ID NO: 591900 - RNA, 64 nt, hsa
uaaccuauguugagccuugcuuaccagcaaagaauauuuuuaauguggauaucuaauucuaaag

SEQ ID NO: 591901 - RNA, 64 nt, hsa
aaaauagaagcuauuuauuaugagcuucuacagguauuuuuaaauagagcaagcauguugaauu

SEQ ID NO: 591902 - RNA, 64 nt, hsa
guaaaggauguuuuaugaagucacaagauacauauauuuuuauuuugaccuaaauuuguacagu

SEQ ID NO: 591903 - RNA, 64 nt, hsa
uagcuucucagugaacaucagauaguagagaaaguauuuuuaacuguauccaauguguggaugu

SEQ ID NO: 591904 - RNA, 64 nt, hsa
ggauaucuagcaauuuaagaaaauguggaaaaaauauuuuuauugagaaauagcauuuuacuuu

SEQ ID NO: 591905 - RNA, 64 nt, hsa
cuguuacgcuaaacuuuugauucuuuaacacaauuauuuuuaaacacuggcauuuuccaaaacu

SEQ ID NO: 591906 - RNA, 64 nt, hsa
gaugauauuuuaaauugaaaaguuuguuuuaaauuauuuuuacagugaagacuguuuucagcuc

SEQ ID NO: 591907 - RNA, 64 nt, hsa
cuucccauucuuuuacuuagugcauuugugcagauauuuuuaacucuguacaucagaagagagc

SEQ ID NO: 591908 - RNA, 64 nt, hsa
aucugucacuccucuuaucugagaagugaccuuuuauuuuuaagaugacuacagaccuauuuuu

SEQ ID NO: 591909 - RNA, 64 nt, hsa
aagugaccuuuuauuuuuaagaugacuacagaccuauuuuuagauauguuuucaguacaauuuu

SEQ ID NO: 591910 - RNA, 64 nt, hsa
uaauuuuaauucaauaaaugagucaaaauuuguauauuuuuauaaggcuuuuuuauaauagcuu

SEQ ID NO: 591911 - RNA, 64 nt, hsa
uucuacucuguaugcccaugaggucaauugauuuuauuuuuagaucccauaaauaaaugagaac

SEQ ID NO: 591912 - RNA, 64 nt, hsa
aguuagccaauauuuuucuuacugauuuuuaaguuauuuuuacauucugaauauguccuuuuua

SEQ ID NO: 591913 - RNA, 64 nt, hsa
agcagcagcaguaguagucaugcuaauuauauaauauuuuuaauauauacuaugaggcccuauc

SEQ ID NO: 591914 - RNA, 64 nt, hsa
aauuaccaaugccaaggacuguugauuuuguuuuuauuuuuauuuuuucuucuagcuuuucaga

SEQ ID NO: 591915 - RNA, 64 nt, hsa
cucaccuguggccaacuucacuuuguaagacccauauuuuuaacucuucccagggaaaauucau

SEQ ID NO: 591916 - RNA, 64 nt, hsa
ucagcuuucauguuucugauuccagauuggaaaauauuuuuauauggucuguuguauuuuguug

SEQ ID NO: 591917 - RNA, 64 nt, hsa
uugacauuuuccccuuacauuucaaaggcaucacuauuuuuaaauguuuacauauguuuacaug

SEQ ID NO: 591918 - RNA, 64 nt, hsa
gauauaaauuacguagucagcauuaagauaguauuauuuuuaauugcuacuaagugguaacuuu

SEQ ID NO: 591919 - RNA, 64 nt, hsa
uauaggcgugagccaccgcccgggcaaauuuuuguauuuuuaguagagaugggguuucaccgug

SEQ ID NO: 591920 - RNA, 64 nt, hsa
aggugcccaccaccacacccagcuaauuuuuuuguauuuuuaguagagaugggguuucaccaug

SEQ ID NO: 591921 - RNA, 64 nt, hsa
aguuuucauucuguaguucucaccccuuuguucauauuuuuaaagggaagaccuucugcugcuu

SEQ ID NO: 591922 - RNA, 64 nt, hsa
aaaauagucauguauagccucuagcauuuuaaauuauuuuuauuuauuagaaagaaaauauauu

SEQ ID NO: 591923 - RNA, 64 nt, hsa
uuucauaucuggucaaugucauaauauuauuuuguauuuuuauuggaauaaauuaauuuuauga

SEQ ID NO: 591924 - RNA, 64 nt, hsa
auguagccuuuguacugagacaaauuuucauuguuauuuuuagaaagauuuuuugcuaagaaaa

SEQ ID NO: 591925 - RNA, 64 nt, hsa
uuuugucuucagacauuuaguaauauaaaguaccuauuuuuaugcugaaauguuuauacagguu

SEQ ID NO: 591926 - RNA, 64 nt, hsa
uuguaucuauaagaagacugaaaaccauggagauuauuuuuauuggaggaggaagcaucauuca

SEQ ID NO: 591927 - RNA, 64 nt, hsa
aucaugcuacuaauauuuuccaaauaaauauuuuuauuuuuaaaaauaaguguaaaguauauua

SEQ ID NO: 591928 - RNA, 64 nt, hsa
ugaguuaucaugcuacuaauauuuuccaaauaaauauuuuuauuuuuaaaaauaaguguaaagu

SEQ ID NO: 591929 - RNA, 64 nt, hsa
acaucuuccaauaaggggugcuucuuugugacaguauuuuuauuucugacauucauuuuauuug

SEQ ID NO: 591930 - RNA, 64 nt, hsa
ugcuaccacuuugcuguucaagacauaacuuaccuauuuuuagcaccaagaauuauagcguuua

SEQ ID NO: 591931 - RNA, 64 nt, hsa
ccaacugagcauugaaaucucucauuugccgacuuauuuuuauaggaagccaauuaaaaaaaaa

SEQ ID NO: 591932 - RNA, 64 nt, hsa
cugaaccacccaagcaacacuuucuaccuugccuuauuuuuaauuggauucacuguccaaaaug

SEQ ID NO: 591933 - RNA, 64 nt, hsa
acuucaaaaugaaaauauauguucaaagauguuuuauuuuuagaauaguuauaaaaaguauuag

SEQ ID NO: 591934 - RNA, 64 nt, hsa
caucaagacaacuaaaacaaaugauaaaaauguuuauuuuuacacuccagcauaucgggugagu

SEQ ID NO: 591935 - RNA, 64 nt, hsa
uacuucuguuacauaauuaaacuauuucugcuauuauuuuuaaagcaguauuauuuuauaacca

SEQ ID NO: 591936 - RNA, 64 nt, hsa
ccacucccccaaaauacugauuucuuccauggauuauuuuuauaugauuuguacaaauuuuuuc

SEQ ID NO: 591937 - RNA, 64 nt, hsa
gaggaaaagucaaauucauuguuuauuuuuauauuauuuuuaaguuaucugaacaaauacuuuu

SEQ ID NO: 591938 - RNA, 64 nt, hsa
uuuuuuauuuugaggaaaagucaaauucauuguuuauuuuuauauuauuuuuaaguuaucugaa

SEQ ID NO: 591939 - RNA, 64 nt, hsa
acaggcacccaccaccaugcccaacuaauuuuuguauuuuuauagagauaggguuucaccgugu

SEQ ID NO: 591940 - RNA, 64 nt, hsa
guucucaucuauguuaaugaaagaaauuggccuguauuuuuacauucuuguaauaucuuugcca

SEQ ID NO: 591941 - RNA, 64 nt, hsa
augaaucccuauauuuccauuauaguauuuauuguauuuuuauguucugaaaauuacccaugga

SEQ ID NO: 591942 - RNA, 64 nt, hsa
aauacaggcaggaugacacuuuguguuaaaguguuauuuuuauguauuaccuggaaugaggcag

SEQ ID NO: 591943 - RNA, 64 nt, hsa
gucagcuuucuauuaccuggauauggaaggaaacuauuuuuacucugcauguucuguccuaagc

SEQ ID NO: 591944 - RNA, 64 nt, hsa
uaaauguauaucuuuuaugucucuacucagaccauauuuuuaaaggggugccucauuauggggc

SEQ ID NO: 591945 - RNA, 64 nt, hsa
gguguuggagaaagaguuaaagaugaggaagagauauuuuuaguauaugaaguuauccaggacu

SEQ ID NO: 591946 - RNA, 64 nt, hsa
uacuuaccaaaugguuuagagucauaagaugaccuauuuuuauauaaaaguuauauuauagaau

SEQ ID NO: 591947 - RNA, 64 nt, hsa
uuuacuuagcuaucagaagccaaguaugauucuuuauuuuuacuuuuucauuucaagaaauuua

SEQ ID NO: 591948 - RNA, 64 nt, hsa
caauauccuagacccuaguuuuauacuagaguuuuauuuuuagcaaugccuauugcaagugcaa

SEQ ID NO: 591949 - RNA, 64 nt, hsa
acaggugcacaccaccacgccuggcuaauuuuuuuauuuuuauuuuuaguaaaggcgggguuuc

SEQ ID NO: 591950 - RNA, 64 nt, hsa
gcacaccaccacgccuggcuaauuuuuuuauuuuuauuuuuaguaaaggcgggguuucaccaug

SEQ ID NO: 591951 - RNA, 64 nt, hsa
auaggcacacgccaccacgcccagcuaauuuuuauauuuuuaguagagacaggauugcaccaua

SEQ ID NO: 591952 - RNA, 64 nt, hsa
acaggcgaccgccaccacgccuggcuacuuuuuguauuuuuaguagagacaggguuucaccacg

SEQ ID NO: 591953 - RNA, 64 nt, hsa
uaaagagaagacgaaauagugacauaauauauucuauuuuuauacucuuccuauuuuuguagug

SEQ ID NO: 591954 - RNA, 64 nt, hsa
cuucugccuuugauguuacagauuuaauacaguuuauuuuuaaagauagauccuuuuauaggug

SEQ ID NO: 591955 - RNA, 64 nt, hsa
caugccaacaagccauuagacugauucuuccaccuauuuuuaugaaccuccaggaagaaaaaca

SEQ ID NO: 591956 - RNA, 64 nt, hsa
auacauuuuuuaauucauuuguuuuccaccauuauauuuuuauacuuuucaguuagauauacuu

SEQ ID NO: 591957 - RNA, 64 nt, hsa
aacugguauuuuuggugcugauacaagagaaauguauuuuuaaauaucccacauccuggaucuu

SEQ ID NO: 591958 - RNA, 64 nt, hsa
uggaucuuuguuggguauuuaguauauugacauauauuuuuauaaggugagguaacucagaacu

SEQ ID NO: 591959 - RNA, 64 nt, hsa
caggcgccugccaccacgccuggccaauuuuuuguauuuuuaguagagacugcguuucaccaug

SEQ ID NO: 591960 - RNA, 64 nt, hsa
uaaggcuuuucccucaaauuuauuacaaauuuaguauuuuuaguacuugaugacucuaauuaca

SEQ ID NO: 591961 - RNA, 64 nt, hsa
aaagauguaaauuauauauauaguauauuauauauauuuuuaaagcuuuauaugccucaaauau

SEQ ID NO: 591962 - RNA, 64 nt, hsa
uggaucuuuagaccucaucuauaaauugaaauuauauuuuuagucauaagccaaguacaaucua

SEQ ID NO: 591963 - RNA, 64 nt, hsa
uuaggagggauaauagagaaguccauuuaaaaauuauuuuuagaagcuaaagaaaguaauuaug

SEQ ID NO: 591964 - RNA, 64 nt, hsa
caaaaaugguaacugucaugugcacacuguugguuauuuuuaauaagccucuuccuacuagaac

SEQ ID NO: 591965 - RNA, 64 nt, hsa
aacuaucuuuaaaaaaacuuuauuaauaaucauguauuuuuacugaucacauuuugaaaugccu

SEQ ID NO: 591966 - RNA, 64 nt, hsa
cucggagcauuuauuuuguuaauuaaauugcacauauuuuuaaaaguuacguguuccacagaau

SEQ ID NO: 591967 - RNA, 64 nt, hsa
gacacugcacuugauagggacucaaagaauguuauauuuuuaauuaauuucuuuuucucuuccg

SEQ ID NO: 591968 - RNA, 64 nt, hsa
caaucaagucuauggaaaaauuauuuauaaaauguauuuuuaaucauaaguuguucaaauuaaa

SEQ ID NO: 591969 - RNA, 64 nt, hsa
gcacaaagaaaaugcugugugauguauaauguuguauuuuuaaauagggguauagcuauauuuu

SEQ ID NO: 591970 - RNA, 64 nt, hsa
caggcacaugccaccaugccuggcuaauuuuuuguauuuuuaguacagauggguuucauuaugu

SEQ ID NO: 591971 - RNA, 64 nt, hsa
caaaagauuauuuuuugguuccuaaagaaaaagauauuuuuaaucugucaauuauuucagucau

SEQ ID NO: 591972 - RNA, 64 nt, hsa
uguguuuuguaaguugucuauuuugauaauguauuauuuuuauaacuguaaaaaaaguaaauag

SEQ ID NO: 591973 - RNA, 64 nt, hsa
auaggcgccccccaccacgcccaaguaacuuuuguauuuuuaguagagaugggguuuugccuug

SEQ ID NO: 591974 - RNA, 64 nt, hsa
uagggucagucaccaggccuggacugaaggcaguuauuuuuauuauuauuauuauuugcaauga

SEQ ID NO: 591975 - RNA, 64 nt, hsa
auaagugcaaugaauaauuuuccugcuucacuguuauuuuuaauuuaaccuggcaaauuaagug

SEQ ID NO: 591976 - RNA, 64 nt, hsa
ucuucauaauaucuucuauucaaaaucuuuuuuuuauuuuuaagggaauaaaaauuuuaaaaau

SEQ ID NO: 591977 - RNA, 64 nt, hsa
ugcacuggagaagauauguguagaauuuuuguuuuauuuuuaaaauguguaaaacaucuuuugu

SEQ ID NO: 591978 - RNA, 64 nt, hsa
aagaacuuuugaaaauggaaggauuaguauggccuauuuuuaaagcugcuuuguuagguuccuu

SEQ ID NO: 591979 - RNA, 64 nt, hsa
aaaaagagguaauaucagggcuucugcuguuuuuuauuuuuaacauguucauaauuaaaaagua

SEQ ID NO: 591980 - RNA, 64 nt, hsa
caauaauuaucaaaacuuuuaaaauagaugcucauauuuuuaaaauaaaguuuuaaaaauaacu

SEQ ID NO: 591981 - RNA, 64 nt, hsa
uauauuuuuuaaaaucaaugugaaaacauagacuuauuuuuaaauuguaccaaucacaagaaaa

SEQ ID NO: 591982 - RNA, 64 nt, hsa
gaccagcuuuugguauuucauuguuaccaaguucuauuuuuagaauaaaauuguucuccuucua

SEQ ID NO: 591983 - RNA, 64 nt, hsa
cuguuagggauccauuggagcauuaaggagcacauauuuuuauuaacuucuuuugagcuuucaa

SEQ ID NO: 591984 - RNA, 64 nt, hsa
ugaaauauuuacuuaaucuggaaaacaauguaacuauuuuuaaagugguuacaucuauucuugc

SEQ ID NO: 591985 - RNA, 64 nt, hsa
gaaagauaacuguagucaggugaaaggcauucauuauuuuuaagcugaaaaggggauccuugaa

SEQ ID NO: 591986 - RNA, 64 nt, hsa
cuuguucacauacccugaagguaauuuuauauaauauuuuuaauaauuugugcaugaaacaaag

SEQ ID NO: 591987 - RNA, 64 nt, hsa
uuuuauuuuuauauuuaagaaaugaaaauacggguauuuuuaaagauucuccaaaaaguccaga

SEQ ID NO: 591988 - RNA, 64 nt, hsa
gucacaagcugcuggggcggguuuuauuuuauuuuauuuuuauauuuaagaaaugaaaauacgg

SEQ ID NO: 591989 - RNA, 64 nt, hsa
uucucuauucuuuccaugacacccaagggucgccuauuuuuaaaaaguaccacauuccaugacg

SEQ ID NO: 591990 - RNA, 64 nt, hsa
acauaugauuguauuuguguauaggggaaaauauuauuuuuaugccugguaaguggcuuuuugu

SEQ ID NO: 591991 - RNA, 64 nt, hsa
uauuggaggaauacuucugauaauuuauugucuuuauuuuuaucccaggaaauaaaagguuacc

SEQ ID NO: 591992 - RNA, 64 nt, hsa
gacuauaaguucucagccuuuauggaccuaaucuuauuuuuauuuacuugaguaauguuuauuc

SEQ ID NO: 591993 - RNA, 64 nt, hsa
gcugugaauauguauuaacaaauauauacauuucuauuuuuauaauccauaaggauaugccugu

SEQ ID NO: 591994 - RNA, 64 nt, hsa
caaauccauacuugcagaauaauucaucaaauuuuauuuuuaagugaaaaguaaccuuucaggc

SEQ ID NO: 591995 - RNA, 64 nt, hsa
gguauguuuuugccaucugguccacucaauuguauauuuuuauuuugcaaaacaacccaaaacu

SEQ ID NO: 591996 - RNA, 64 nt, hsa
aaaauuugaacacuggcuaaagauaauugcuauuuauuuuuacaagaaguuuauucucauuugg

SEQ ID NO: 591997 - RNA, 64 nt, hsa
guaaacacagucaaaauaauucuaaaucccucgauauuuuuaaagaucuguaaguaacuucaca

SEQ ID NO: 591998 - RNA, 64 nt, hsa
cauugcuuguaaauaauucagcagauuuguaauauauuuuuauauuuugaaauguacuguagau

SEQ ID NO: 591999 - RNA, 64 nt, hsa
gguauuauccauuugaucuauagcaaugugauuuuauuuuuaaaaagaaaagcaguguguuuuc

SEQ ID NO: 592000 - RNA, 64 nt, hsa
aauagaaguguuucagauacauaguuuguaccuguauuuuuauuuuauugccucauguucuugu

SEQ ID NO: 592001 - RNA, 64 nt, hsa
gacauguaacauguuaaaagguuaaacuuauggcuauuuuuaaagggcuauucauuuaaucuga

SEQ ID NO: 592002 - RNA, 64 nt, hsa
aaacaugucuacaaaaauagauuacagcuuauuuuauuuuuaguuaaaucucuuaauacacaga

SEQ ID NO: 592003 - RNA, 64 nt, hsa
auuuauauuucuuauucagaacccuugaugagacuauuuuuaaacauacuagucugcugauaga

SEQ ID NO: 592004 - RNA, 64 nt, hsa
aaaauugacaauaaaagucacucuucuaauugaauauuuuuauauuuuuaugaaacaaaagagc

SEQ ID NO: 592005 - RNA, 64 nt, hsa
caauaaaagucacucuucuaauugaauauuuuuauauuuuuaugaaacaaaagagcauuucuuc

SEQ ID NO: 592006 - RNA, 64 nt, hsa
gacaugaccaugaaggcugcuuguagaauuaguguauuuuuauuaaacuauuuuuuuaaauguc

SEQ ID NO: 592007 - RNA, 64 nt, hsa
uuucuauacuuuuucuguuuuuuaaacaccugcauauuuuuauguaaaucucuaaauuuaaaau

SEQ ID NO: 592008 - RNA, 64 nt, hsa
ugccagccacaccuccacuugccucuuauugucuuauuuuuauauauuuuucuaaauauaugua

SEQ ID NO: 592009 - RNA, 64 nt, hsa
uaccugccaccacgccuggcuaauuuuguuuuuguauuuuuaguagagacgggguuucaccgug

SEQ ID NO: 592010 - RNA, 64 nt, hsa
uuuacucaguuugaaacuauucauuucuacacacuauuuuuaaaaauugccuacuaggugaaac

SEQ ID NO: 592011 - RNA, 64 nt, hsa
ugaaauucaccugauuauuagauaacuuaaaguuuauuuuuaaaagcugacaacuuuuuaugaa

SEQ ID NO: 592012 - RNA, 64 nt, hsa
auguugcauuuuuuucaucuguuguacauaguuguauuuuuaucuaaugccauuuuagaauuuu

SEQ ID NO: 592013 - RNA, 64 nt, hsa
uaguuaaaucguauuauuuuuuucuuaacagaaauauuuuuaaaaaugaaaaaguacucaaaag

SEQ ID NO: 592014 - RNA, 64 nt, hsa
gagaacacagccugauacuuaauuuucuuaaaacuauuuuuaaugauccacuaaacaaagcagg

SEQ ID NO: 592015 - RNA, 64 nt, hsa
ucacacuaccauuauuuccccuucaaacaaauaauauuuuuacagaagcaggagcaaaauaugg

SEQ ID NO: 592016 - RNA, 64 nt, hsa
cgggcgcccgccaccacgcccggcuaauuuuuuguauuuuuaguagagacaggguuucaccgug

SEQ ID NO: 592017 - RNA, 64 nt, hsa
uacaagcaccagccaccaugccuggcuaauuuuguauuuuuaguagagacaggguuucaccaug

SEQ ID NO: 592018 - RNA, 64 nt, hsa
auagcaaucauuaaaaucuugggccagagaacacuauuuuuacauaacaguuucuuaaccuaaa

SEQ ID NO: 592019 - RNA, 64 nt, hsa
uuauggggauucaaauucuaguaauaggcuuuuuuauuuuuauuuuuauacccuuaaccaguuu

SEQ ID NO: 592020 - RNA, 64 nt, hsa
ggauucaaauucuaguaauaggcuuuuuuauuuuuauuuuuauacccuuaaccaguuuaauuuu

SEQ ID NO: 592021 - RNA, 64 nt, hsa
gcuucggggaaacagccaggaaaauggucaagauuauuuuuagagguuauuuuauuggggauuu

SEQ ID NO: 592022 - RNA, 64 nt, hsa
auuggggauuuuaagaacuaauaacaucuugaguuauuuuuaauucagggggauguggaaaggu

SEQ ID NO: 592023 - RNA, 64 nt, hsa
uuuaagucuguguaguauucaacugacuucauaauauuuuuauauucauauacuguuaaugcac

SEQ ID NO: 592024 - RNA, 64 nt, hsa
ucauccauauguuuauacauauauuuacuucauauauuuuuaagucuguguaguauucaacuga

SEQ ID NO: 592025 - RNA, 64 nt, hsa
cauauaacaaauuaauuuuaguacaaaucuuaaauauuuuuaauaaauccuuucauuuuaaaaa

SEQ ID NO: 592026 - RNA, 64 nt, hsa
agaaaaaagcauggcuaaaauguauaaaaugccauauuuuuaaauuuuggacuuuaagcaucuu

SEQ ID NO: 592027 - RNA, 64 nt, hsa
aaccuuuuguauuauacaauagaaauaaagguuuuauuuuuauuaaaugcuuuccuaaaaugau

SEQ ID NO: 592028 - RNA, 64 nt, hsa
gccccacuuauacuauguaaaauuaccaauaaaauauuuuuaugacuacagauuuugcauuuuu

SEQ ID NO: 592029 - RNA, 64 nt, hsa
agagugugauguucuaguuauuuuuuuuuauauauauuuuuaaauguucaauauucaacuauug

SEQ ID NO: 592030 - RNA, 64 nt, hsa
uucaaaacuuuuugaacugacugaauuaacuugguauuuuuaaguugacuuuuuacauaaacuu

SEQ ID NO: 592031 - RNA, 64 nt, hsa
agucagcacucuuuuuagaucuuuguguggcuccuauuuuuauagaaguggagggaugcacuau

SEQ ID NO: 592032 - RNA, 64 nt, hsa
acgggauuuucagaaguuagccugaauuuaacuguauuuuuaaauuuaaccuccauuaacuaag

SEQ ID NO: 592033 - RNA, 64 nt, hsa
ucauucauugcuacauaauuugguucuucuggaauauuuuuauguagcucuuggaguacagcua

SEQ ID NO: 592034 - RNA, 64 nt, hsa
guaaacugauuuuuuguucugauuuuuuuucuaauauuuuuaggaaaauauuaagcuuuauaaa

SEQ ID NO: 592035 - RNA, 64 nt, hsa
cuuagauguagaauccugguguaggguuuuauuuuauuuuuauuuuuugacccaauaaaauguu

SEQ ID NO: 592036 - RNA, 64 nt, hsa
uggcaaaucaaacuuuucuaggaugaagacagcuuauuuuuaaguuguauagucuuaguugguu

SEQ ID NO: 592037 - RNA, 64 nt, hsa
gaaaauuguuauauuuugaaaguacuuauuacauuauuuuuauuuuaguaucuugaugcuccug

SEQ ID NO: 592038 - RNA, 64 nt, hsa
gcugcuuuuuaaaaauauuuuuuuauuuuuuacuuauuuuuaaauuuucucuuuuuauuuauuu

SEQ ID NO: 592039 - RNA, 64 nt, hsa
aaauuacucgggaaguaaacgcuuuuuuuaaaaguauuuuuacugguuuuauaccaauauuaua

SEQ ID NO: 592040 - RNA, 64 nt, hsa
caggcauaagccagugcacccagccgagaauuaguauuuuuauguaugguuaaaccuuggcguc

SEQ ID NO: 592041 - RNA, 64 nt, hsa
acaggugcaugccaccacacccugcuaauuuuuguauuuuuaguagagacggggguuccaccau

SEQ ID NO: 592042 - RNA, 64 nt, hsa
gcuucugaguauaacgaauugggaugucuaaaccuauuuuuauagauguuauuuaaauaaugca

SEQ ID NO: 592043 - RNA, 64 nt, hsa
gggcgccccaccaccacgcccggcuaauuuuuuguauuuuuaguacagacgggguuucauugug

SEQ ID NO: 592044 - RNA, 64 nt, hsa
agaggcgccagccaacacacccggcuaauuuuuguauuuuuaguagagacaggguuuugccaug

SEQ ID NO: 592045 - RNA, 64 nt, hsa
ugaggugaaaaaaucugauguuugaggaaguuuuuauuuuuauuuauuuguuuuguuuuuuuuu

SEQ ID NO: 592046 - RNA, 64 nt, hsa
acaggcaugcaccaccacgcccagcuaauuuuuguauuuuuagcagagacagggaggaaguuuu

SEQ ID NO: 592047 - RNA, 64 nt, hsa
uuuguauuuuuagcagagacagggaggaaguuuuuauuuuuauaaacaaaaucugauguucaga

SEQ ID NO: 592048 - RNA, 64 nt, hsa
uauguuguccugugccauaaagugauauauuuaauauuuuuauucuuugguuuugaacauugua

SEQ ID NO: 592049 - RNA, 64 nt, hsa
gaccauuaccuauuaggaagauuaaaaaugacuguauuuuuaaaggaauaaaucccagugugcc

SEQ ID NO: 592050 - RNA, 64 nt, hsa
uuauauaaucguuauccauuuggguauaaaucuguauuuuuaguuuuuucccuuugauuaguau

SEQ ID NO: 592051 - RNA, 64 nt, hsa
auaggcacccaccaccacaccuggcuaauuuuuguauuuuuaguggagacgggguuucaccaug

SEQ ID NO: 592052 - RNA, 64 nt, hsa
acuaauuuuuguugugguuaguuagaaaaaugguuauuuuuaguggguuuuaauaugugaaaaa

SEQ ID NO: 592053 - RNA, 64 nt, hsa
caggcgcgugccaccacgcccagcuaauuuuuuguauuuuuaguugagacaggguuucacuguc

SEQ ID NO: 592054 - RNA, 64 nt, hsa
uugcuaaugaauuugacuuagaaaagaauugccuuauuuuuaagagauuguuucagugguucac

SEQ ID NO: 592055 - RNA, 64 nt, hsa
augauucaacuacuguuuuuccuucagcugacuuuauuuuuaaacacccuuaaagacagauaua

SEQ ID NO: 592056 - RNA, 64 nt, hsa
uugcugaauuauaaguuuauuuuuuaucaauaaauauuuuuauacuuacauugagugauguguu

SEQ ID NO: 592057 - RNA, 64 nt, hsa
caugugaaacuauguuaaaacugaaggcacuauauauuuuuacauaaaagcuugaacauacaga

SEQ ID NO: 592058 - RNA, 64 nt, hsa
uugaugaaauauacaaauauuuuauuguagcaccuauuuuuauaugcacauuuagcauuccucu

SEQ ID NO: 592059 - RNA, 64 nt, hsa
caaguuuuggguuuuauuagaaaauauuugaaaguauuuuuauuaaugaaccaaaaugacaugu

SEQ ID NO: 592060 - RNA, 64 nt, hsa
auauacugauguauaugguuaucuggguuauaucuauuuuuauguaaacucuauuuuguuuuug

SEQ ID NO: 592061 - RNA, 64 nt, hsa
uucccauuuuccuauuauguuugauaauuauauguauuuuuaaaaacugugagaggaaaaauua

SEQ ID NO: 592062 - RNA, 64 nt, hsa
cagagcccauuuucuccauaaauuuguaacaugcuauuuuuaugugcauguuuuaugaguucaa

SEQ ID NO: 592063 - RNA, 64 nt, hsa
agauaauaaacccccccccucuuuucuuuuucuuuauuuuuauuucuuuuagcuauuugauccu

SEQ ID NO: 592064 - RNA, 64 nt, hsa
gggcuggcacuuuuuuaaauauaaaaauggguguuauuuuuauuuuuauuuguaaagugauuuu

SEQ ID NO: 592065 - RNA, 64 nt, hsa
gcacuuuuuuaaauauaaaaauggguguuauuuuuauuuuuauuuguaaagugauuuuuggucu

SEQ ID NO: 592066 - RNA, 64 nt, hsa
uacgcuuaagguggaaaguguucauugcacaauauauuuuuacugcuuucugaauguagacgga

SEQ ID NO: 592067 - RNA, 64 nt, hsa
auguuuuuaguucugacuuugaauuuauauaaaguauuuuuauaaugacuggucuuccuuaccu

SEQ ID NO: 592068 - RNA, 64 nt, hsa
uuauccaggaauugauacguuuauuaggaaaagauauuuuuauaggcuuggauguuuuuaguuc

SEQ ID NO: 592069 - RNA, 64 nt, hsa
uaaugucaguuuaaguuguccuuuuguuuguuucuauuuuuaaggugaauuuuaauuucuaucu

SEQ ID NO: 592070 - RNA, 64 nt, hsa
gaagugcccaugauucugucaguaaauuugaacauauuuuuauuaguuaaugucaguuuaaguu

SEQ ID NO: 592071 - RNA, 64 nt, hsa
uacucaucuucauguaggaccuaugaaaauugucuauuuuuaucuauauauuuaaaguuuucua

SEQ ID NO: 592072 - RNA, 64 nt, hsa
aguuccuauuuuagcuugcuuacaaagggagcauuauuuuuauuuaaaguauugcuaguaaaug

SEQ ID NO: 592073 - RNA, 64 nt, hsa
auuguggcugaacagcaaaucaaaacaccagaaauauuuuuauauguuaacgucauauuauguu

SEQ ID NO: 592074 - RNA, 64 nt, hsa
ccucuaaaguuaaagucaauacaagaaaacugucuauuuuuagccuaaaguaaaggcugugaag

SEQ ID NO: 592075 - RNA, 64 nt, hsa
uugauuaacugucuacuuaaagucaagguaccuguauuuuuaauccacuaauuuuuuuuuaguu

SEQ ID NO: 592076 - RNA, 64 nt, hsa
gggcugccuaucuguagauagcuguaaaauggaauauuuuuaaaugaaggcaaauaaguacuua

SEQ ID NO: 592077 - RNA, 64 nt, hsa
auuaauauauuuaauuucuauuuaaauuuuagauuauuuuuauuaccauguacugaauuuuuac

SEQ ID NO: 592078 - RNA, 64 nt, hsa
cacucagaauuucuauucuuucuaaaaagagauuuauuuuuaaaucaaugggacucugauauaa

SEQ ID NO: 592079 - RNA, 64 nt, hsa
aaaaauagcugagcuuucuaaaaugauagcucucuauuuuuaaaugaauuugaaaagucgauua

SEQ ID NO: 592080 - RNA, 64 nt, hsa
uuguaauauaacaugggcaaauaucugacuucuguauuuuuaaaaaguugccuucuccaguggc

SEQ ID NO: 592081 - RNA, 64 nt, hsa
uuuuauguaauuaguuauaggcaaaauacuuucauauuuuuagauuagacagacgaaagaccaa

SEQ ID NO: 592082 - RNA, 64 nt, hsa
acauuuuauauguacuauucuuaaagaucacaauuauuuuuaaacuuucuauuuucaaauacuu

SEQ ID NO: 592083 - RNA, 64 nt, hsa
ggucuuuuuagagguauauuccaaaauuuccuuguauuuuuagguuaugcaacuaauaaaaacu

SEQ ID NO: 592084 - RNA, 64 nt, hsa
cagguaaaagucaguaggauggaacauuuuaguguauuuuuacuccuuaaagagcuagaauaca

SEQ ID NO: 592085 - RNA, 64 nt, hsa
auuguuuaagguuauacacucgagcuuaaauagauauuuuuaaccagguguuugguuuuuguuu

SEQ ID NO: 592086 - RNA, 64 nt, hsa
uguuaaaaguaacaaaaccaagucaaacuugguguauuuuuauuuuaaauauuaacucuaaagc

SEQ ID NO: 592087 - RNA, 64 nt, hsa
acaggcgugugccaccacgcccagcuaauuuuuguauuuuuaguagcgaugguguuucacuaca

SEQ ID NO: 592088 - RNA, 64 nt, hsa
acagaugccuaucaccaugccuggguaauuuuuguauuuuuaguugagaugggguuucaccaug

SEQ ID NO: 592089 - RNA, 64 nt, hsa
uacagguaugugccaccaugccuggcuaauuuuguauuuuuaguagagacgggguuucuccaug

SEQ ID NO: 592090 - RNA, 64 nt, hsa
uuuuuuuuucuuucuuucuuuuuauuuuuauuuuuauuuuuauuuuuuuuuaguagagaugagg

SEQ ID NO: 592091 - RNA, 64 nt, hsa
cucaguuuuuuuuuucuuucuuucuuuuuauuuuuauuuuuauuuuuauuuuuuuuuaguagag

SEQ ID NO: 592092 - RNA, 64 nt, hsa
cucaaccucaguuuuuuuuuucuuucuuucuuuuuauuuuuauuuuuauuuuuauuuuuuuuua

SEQ ID NO: 592093 - RNA, 64 nt, hsa
uaauuuuguaauggcuuuuauuuuuagcaauuuuuauuuuuauuuuugaacuuuagguccuucc

SEQ ID NO: 592094 - RNA, 64 nt, hsa
gcuaaaggagggggcuuaauuuuguaauggcuuuuauuuuuagcaauuuuuauuuuuauuuuug

SEQ ID NO: 592095 - RNA, 64 nt, hsa
aagcuccuugagagcaggauccaugucauuccuuuauuuuuauaaauuauucccccuaucauuc

SEQ ID NO: 592096 - RNA, 64 nt, hsa
guugguuauucauaugucuauuuauauguauauuuauuuuuauguauguuacuauguaaauaug

SEQ ID NO: 592097 - RNA, 64 nt, hsa
uauauggcagugguuccauaagauuacaauacuguauuuuuacuguaccuucuuuauguuuaga

SEQ ID NO: 592098 - RNA, 64 nt, hsa
uacauuguucgauguuuguacaggaguaagcauguauuuuuaucaauuuaacacagaucaaagg

SEQ ID NO: 592099 - RNA, 64 nt, hsa
caggcaccugccaccaugcccggcuaaauuuuuguauuuuuaguagagacgggguuucaccgug

SEQ ID NO: 592100 - RNA, 64 nt, hsa
ugaacugaaaaauauguuuucuuacuguuuaauuuauuuuuauuguuugaacaggaagugaaca

SEQ ID NO: 592101 - RNA, 64 nt, hsa
cuauaagcaggauuugaguaauuacagugaauuuuauuuuuaauguauauguuucucuucaggc

SEQ ID NO: 592102 - RNA, 64 nt, hsa
ggcauugaaaagguuaagaaacauaaaugguacauauuuuuaaaguuaaguagcaugcauauau

SEQ ID NO: 592103 - RNA, 64 nt, hsa
gaaaugauucuggaugguucuuugacucuauuuuuauuuuuacuuagagacagggucuugcucu

SEQ ID NO: 592104 - RNA, 64 nt, hsa
aaaaaggaaaugauucuggaugguucuuugacucuauuuuuauuuuuacuuagagacagggucu

SEQ ID NO: 592105 - RNA, 64 nt, hsa
auuauagcaaaacaagaaaaguggacuuuguuguuauuuuuaaaguacaguagggugugaauua

SEQ ID NO: 592106 - RNA, 64 nt, hsa
cuuuuuuuucuuaaaugauauacauauaaacaguuauuuuuauccuauuauaauugucuuuugu

SEQ ID NO: 592107 - RNA, 64 nt, hsa
gaaagcuacggaaccugccauuaguauugugguguauuuuuaagauuaaagguacacugaugga

SEQ ID NO: 592108 - RNA, 64 nt, hsa
cccccucuucuuuguuuuggacccuuaagaauuuuauuuuuaaaggagauugaagccauagaac

SEQ ID NO: 592109 - RNA, 64 nt, hsa
gauacuuauuuugaaauuaauuauaaggcauucauauuuuuaggacugaauucaaagggaaaug

SEQ ID NO: 592110 - RNA, 64 nt, hsa
aaaucacuucaacauuauuugagcauuuacuuuguauuuuuacaaacacauaaacacacagccg

SEQ ID NO: 592111 - RNA, 64 nt, hsa
ucuuccugucuguuccuccccuaauccucuauuuuauuuuuauuuuuuguaaagccaaguagcu

SEQ ID NO: 592112 - RNA, 64 nt, hsa
uauugguugguucauaugauguaggcacuugcuguauuuuuacuggagcucguaauuuuuuaac

SEQ ID NO: 592113 - RNA, 64 nt, hsa
aaaaaccucuuagcuuuucugcaauucaacuuuuuauuuuuauuuuuauuucuaucaaagacgg

SEQ ID NO: 592114 - RNA, 64 nt, hsa
cucuuagcuuuucugcaauucaacuuuuuauuuuuauuuuuauuucuaucaaagacgguagaga

SEQ ID NO: 592115 - RNA, 64 nt, hsa
caggugcccgccaccacgcccagcuaauuuuuuguauuuuuaguagagacgguuucaccguguu

SEQ ID NO: 592116 - RNA, 64 nt, hsa
gaaauuaauuuccuucaauagcauccuaaaacucuauuuuuauuuggggcagaguaauuucauu

SEQ ID NO: 592117 - RNA, 64 nt, hsa
uaauugucuaauguucugaugggaacguaacacuuauuuuuauauaaaaagagacugaguaaac

SEQ ID NO: 592118 - RNA, 64 nt, hsa
uuuacauaacaauaacuuuuuaucaguuacauuuuauuuuuauuuaaacuggccaaaagcaaaa

SEQ ID NO: 592119 - RNA, 64 nt, hsa
aaaacaugacacuguaggcagcaguuuuaagucuuauuuuuacuguuuauauauuugaaugcug

SEQ ID NO: 592120 - RNA, 64 nt, hsa
cagcugccucccaaaggaggggcagccgugcuuauauuuuuaugguuacaauggcacaaaauua

SEQ ID NO: 592121 - RNA, 64 nt, hsa
uguuuuuuuucuaucaucugguauaccauugcuuuauuuuuauaaauuauuuucucauugccau

SEQ ID NO: 592122 - RNA, 64 nt, hsa
uaucaggaaauacugccuguagaguuaguauuucuauuuuuauauaauguuugcacacugaauu

SEQ ID NO: 592123 - RNA, 64 nt, hsa
acaggcacccaccaccaugcccagcuaauuuuuguauuuuuaauagagagcuaauaauuguaua

SEQ ID NO: 592124 - RNA, 64 nt, hsa
guucuugaaauuguggaaugcaugauugacaauauauuuuuaauuuuuauuuuuucaaguaaua

SEQ ID NO: 592125 - RNA, 64 nt, hsa
auaggcaugcgccaccauggccagcuaauuuuuguauuuuuaguagagacgagguuucacugug

SEQ ID NO: 592126 - RNA, 64 nt, hsa
acaggcacacaccaccacgccuggcuaauuuuuguauuuuuaguagagacggguuucaccaugu

SEQ ID NO: 592127 - RNA, 64 nt, hsa; identical to SEQ ID NO: 592114

SEQ ID NO: 592128 - RNA, 64 nt, hsa; identical to SEQ ID NO: 592113

SEQ ID NO: 592129 - RNA, 64 nt, hsa
agccaccgcacccgacggucuuuucaaagcuauuuauuuuuaggacuaugugguaauuucaccu

SEQ ID NO: 592130 - RNA, 64 nt, hsa
acaggugccugccaucacgccuggcuaauuuuuguauuuuuaguagagacggggguucaccaag

SEQ ID NO: 592131 - RNA, 64 nt, hsa
cgcaaccacuaacaauuguggucucuggugaucuuauuuuuaaagccuguauuauuuaaaaugc

SEQ ID NO: 592132 - RNA, 64 nt, hsa
acaggcacaugccaccacgcccggcuaauuuuuguauuuuuaguagagacuggguuucaccaug

SEQ ID NO: 592133 - RNA, 64 nt, hsa
aauuguuguuagagcaaaagucuuacugaauuuguauuuuuaaauuuuucuuggguuaguauuu

SEQ ID NO: 592134 - RNA, 64 nt, hsa
uacuuucgcucucuaaucagcauuucaauguauuuauuuuuaaauuuucucaaaaaguaacuaa

SEQ ID NO: 592135 - RNA, 64 nt, hsa
uaagaguguucaauccgagaugaaucauuugaaguauuuuuauauguauaucuauuuaaaacua

SEQ ID NO: 592136 - RNA, 64 nt, hsa
acaggcaccugccaccacgcccagcuaauuuuuguauuuuuaguggagacagguuucaccaugu

SEQ ID NO: 592137 - RNA, 64 nt, hsa
uucuauaggacaaaaaaacuaauacagacuccuuuauuuuuauauggauauacuaggauuguaa

SEQ ID NO: 592138 - RNA, 64 nt, hsa
auaggcacgugccaccacacccggcuaauuuucauauuuuuaguagagaugggguuucaccaug

SEQ ID NO: 592139 - RNA, 64 nt, hsa
acagauuaagcuaauuucuguagucgcauuuuuauauuuuuaguaucacucuaguaaaaaaacc

SEQ ID NO: 592140 - RNA, 64 nt, hsa
uauaaaaagcauuugaagaaauaguacgacaacuuauuuuuaaucacuuuuaaauaauguguug

SEQ ID NO: 592141 - RNA, 64 nt, hsa
auaugcauaaauggcaaaggaaagaaauaauauauauuuuuaugucauugagcaauauuuuuua

SEQ ID NO: 592142 - RNA, 64 nt, hsa
cuguuucugcauucauaaugcauuuauuggcccauauuuuuauguaaccuguuacaaaauagac

SEQ ID NO: 592143 - RNA, 64 nt, hsa
aguuucucaagacucugaaauauguaaaauucaauauuuuuauauucccagaaauuguuucuua

SEQ ID NO: 592144 - RNA, 64 nt, hsa
ugccaccacgccuggguaauuuuuuuuuuuuuuguauuuuuaguagagaugaguuucaccaugu

SEQ ID NO: 592145 - RNA, 64 nt, hsa
ugaugcugccaaggcgcacuuuuuauuuuuauuuuauuuuuauuuuuuuuuuagcauccuuuug

SEQ ID NO: 592146 - RNA, 64 nt, hsa
ccucauccugaugaugcugccaaggcgcacuuuuuauuuuuauuuuauuuuuauuuuuuuuuua

SEQ ID NO: 592147 - RNA, 64 nt, hsa
acaggcaccugucaccacacccagcuaauuuuuguauuuuuaguagagaugggguuucaccaua

SEQ ID NO: 592148 - RNA, 64 nt, hsa
acagucugaugagacugugccuguuauuguuuuuuauuuuuacucuggauuuuccuugcaucug

SEQ ID NO: 592149 - RNA, 64 nt, hsa
caggcaccugccacgaugccuagcuaauuuuuuguauuuuuaguagagaugaaguuucaccgug

SEQ ID NO: 592150 - RNA, 64 nt, hsa
acaggcaggugccaccaugccuggcucauuuuuguauuuuuaguagagagggcguuuugccaug

SEQ ID NO: 592151 - RNA, 64 nt, hsa
uuugauggauuuuuauuuauauacuuuuuuugcuuauuuuuacuuugaguggaauguucauuaa

SEQ ID NO: 592152 - RNA, 64 nt, hsa
uuugaguggaauguucauuaauguaaauuguauuuauuuuuauacuuuuauuuucacuaguuuu

SEQ ID NO: 592153 - RNA, 64 nt, hsa
acagguuccugcuaccacgcccagcuaauuuuuguauuuuuaguagagacgaggcuucaccaug

SEQ ID NO: 592154 - RNA, 64 nt, hsa
acaggugugugccacuacggcuggcuaauuuuuguauuuuuaguagagacagguuucaccauau

SEQ ID NO: 592155 - RNA, 64 nt, hsa
gggcgucuucaggagggcuucgggguuuugcuuuuauuuuuauuuugucauugcgggguauaug

SEQ ID NO: 592156 - RNA, 64 nt, hsa
acaggcgugagcuaccaugcccggcuaauuuuuguauuuuuaguagagaugggguuucauuaug

SEQ ID NO: 592157 - RNA, 64 nt, hsa
uuuauaguugauuauugcuuuuacaugggaaaguuauuuuuaauuauauauuuguauagucauc

SEQ ID NO: 592158 - RNA, 64 nt, hsa
uuacacaauuuuguuauuguaguuuuuuccauuauauuuuuauaguugauuauugcuuuuacau

SEQ ID NO: 592159 - RNA, 64 nt, hsa
acaggcgugagccagcacgcccagcuaauuuuuguauuuuuaguagagacaggauuucaccaug

SEQ ID NO: 592160 - RNA, 64 nt, hsa
agacuuguuuggagcucuuaauuacaauaucugauauuuuuacagucugaucuuuugacuucua

SEQ ID NO: 592161 - RNA, 64 nt, hsa
auggcaaauguauaaaagaaacaaguuuugguuauauuuuuauauuuguaaaguaaguuugguu

SEQ ID NO: 592162 - RNA, 64 nt, hsa
uugugcucuuauguucucggcuuuuuaaugacuuuauuuuuacaguacuuguucagucacuuga

SEQ ID NO: 592163 - RNA, 64 nt, hsa
uugcagaauuaucuaauagucuuuuuuuggcuaauauuuuuauaacgugguucuuauuuaacug

SEQ ID NO: 592164 - RNA, 64 nt, hsa
ggcccugauccaccuaccugcuaacuccagauauuauuuuuaaguuggagaccuaaaaauaauu

SEQ ID NO: 592165 - RNA, 64 nt, hsa
uuaaggauggugguguauugcucuuuuucagcuuuauuuuuaagaguacagucaggaaaccaac

SEQ ID NO: 592166 - RNA, 64 nt, hsa
ucaugaagaaaucucucccaauacccauuuauccuauuuuuagcaauaauucguuaaugauucc

SEQ ID NO: 592167 - RNA, 64 nt, hsa
cuguacuuuaagcaugaaaagcaauauuucaaaguauuuuuaaacucaacaaaugucaucaaau

SEQ ID NO: 592168 - RNA, 64 nt, hsa
auuuauaaaggaucaaugcugcuguaaauacagguauuuuuaauuuuaaaauuucauuccacca

SEQ ID NO: 592169 - RNA, 64 nt, hsa
guaggcauguaccaccaugcccagcuaauuuuuauauuuuuaguagagaugggguuuugccaua

SEQ ID NO: 592170 - RNA, 64 nt, hsa
acuuuccaucuuaauguaaccuuaugcuauucuguauuuuuacuguauauugcuuuuacaauaa

SEQ ID NO: 592171 - RNA, 64 nt, hsa
acaggcacacgccaccacacccaacuaauuuuuguauuuuuaguagagaugggguuucaccaug

SEQ ID NO: 592172 - RNA, 64 nt, hsa
cagacaugagccaccacgcuuggccgggauaguauauuuuuauagcacuuccccuacugauugc

SEQ ID NO: 592173 - RNA, 64 nt, hsa
agguggccagaugguuccaggacuacaaugucuuuauuuuuaacuguuugccacugcugcccuc

SEQ ID NO: 592174 - RNA, 64 nt, hsa
gagugcuuuuauaaauuauuuuccuuguagauuuuauuuuuaauuuaucucugugaccugccag

SEQ ID NO: 592175 - RNA, 64 nt, hsa
uaagauauauaugugugugugugugcuacauauauauuuuuaagaaaggaccaucucuuuagga

SEQ ID NO: 592176 - RNA, 64 nt, hsa
uauauuuuuaagaaaggaccaucucuuuaggauauauuuuuaaauucuuugaaacacauaacca

SEQ ID NO: 592177 - RNA, 64 nt, hsa
auuuuugggaggagccauagauuccugguuauccuauuuuuaaacaaaauguagacaaagugaa

SEQ ID NO: 592178 - RNA, 64 nt, hsa
uuccuauuguacugcacaaaccauggauuguacauauuuuuauauauuaugucuuauuuuauua

SEQ ID NO: 592179 - RNA, 64 nt, hsa
aaaguccucugugaggaauauucucuauuuuaaauauuuuuaguauguacuguguaugauucau

SEQ ID NO: 592180 - RNA, 64 nt, hsa
uaugauucauuaccauuuugaggggauuuauacauauuuuuagauaaaauuaaaugcucuuauu

SEQ ID NO: 592181 - RNA, 64 nt, hsa
gaaaagauaauaguuauaaaaauuuuaguucauuuauuuuuaaacuccuuucagauuauuuuac

SEQ ID NO: 592182 - RNA, 64 nt, hsa
auucuuuggaagaaggcagagagaggagucuuauuauuuuuaaaugcuccuaguuguauagucu

SEQ ID NO: 592183 - RNA, 64 nt, hsa
gcagcccuccagauuuuguagacauuuuucuuaauauuuuuaacauugugucuuuuaaaagaaa

SEQ ID NO: 592184 - RNA, 64 nt, hsa
cuuucauugcaauuugauacaguauaggcuacaguauuuuuacaggguaaaacuaguuauggca

SEQ ID NO: 592185 - RNA, 64 nt, hsa
acaggcgucggccaccacaccuggcuaauuuuuguauuuuuaguagagacaggguuucaccaug

SEQ ID NO: 592186 - RNA, 64 nt, hsa
uugguuauuagaccaggaaaacuuaauguaauauuauuuuuaaaaucaucuuaaaggauccaag

SEQ ID NO: 592187 - RNA, 64 nt, hsa
uguuguggacaaaaucauacaauucagucaauuuuauuuuuagcauacuguuaaauaucacauc

SEQ ID NO: 592188 - RNA, 64 nt, hsa
ugggcagagguacgcucuuuuauuuuuauauuuauauuuuuauuuuuuugagauagggucuuac

SEQ ID NO: 592189 - RNA, 64 nt, hsa
aaaguuaagggacgugggcagagguacgcucuuuuauuuuuauauuuauauuuuuauuuuuuug

SEQ ID NO: 592190 - RNA, 64 nt, hsa
uuacaggcaugugcaacucacccagcuaauuuuguauuuuuaguagagacaggguuucaccaug

SEQ ID NO: 592191 - RNA, 64 nt, hsa
aguaucaccccaucuuuucuuuccacuugguuuuuauuuuuauuuuuuuuugagacagagucuc

SEQ ID NO: 592192 - RNA, 64 nt, hsa
cauccuuaacagaaacaaaaauauauauauauauuauuuuuaaaaauuagcauugucauacagu

SEQ ID NO: 592193 - RNA, 64 nt, hsa
cuuccugguuuuggauguaaguuuuaaagaaugguauuuuuaauauuuguacacauucuuugag

SEQ ID NO: 592194 - RNA, 64 nt, hsa
ccugaaucagaacgcuggcuuuuauuuauuuuuuuauuuuuaauauuaaaugugcagauaugcu

SEQ ID NO: 592195 - RNA, 64 nt, hsa
caucuggaugccuguuguuuuacuguguauauuuuauuuuuaauauauuaacuuuguggauuca

SEQ ID NO: 592196 - RNA, 64 nt, hsa
uauauccuggcucaguggagugauauuuauguauuauuuuuacuuuucucucagugucuuauau

SEQ ID NO: 592197 - RNA, 64 nt, hsa
uuuaaauacauuuauuuuuauagcagcaauguucuauuuuuagaaacuauauuauaaguacaga

SEQ ID NO: 592198 - RNA, 64 nt, hsa
ccuguuuaaacccgugguuuuuuuuaaauacauuuauuuuuauagcagcaauguucuauuuuua

SEQ ID NO: 592199 - RNA, 64 nt, hsa
auuuucuugcugaaaugacaugaauuguugaguuuauuuuuacacaguaaagaguggagaaaga

SEQ ID NO: 592200 - RNA, 64 nt, hsa
acuguagaagaaaaaguuuauuaccaaacaagaguauuuuuaugaaagaaaaggacaaaccuau

SEQ ID NO: 592201 - RNA, 64 nt, hsa
uucucuugcauugaaacccucuuggauauuacaguauuuuuaauugaaaguccuaauucuguua

SEQ ID NO: 592202 - RNA, 64 nt, hsa
cccacauugguaauaaacauuacaaaauacaauguauuuuuagguaggcauuuuauaaaaugca

SEQ ID NO: 592203 - RNA, 64 nt, hsa
ugcucugauuguauaggugagacucuguuucuguuauuuuuaauugcuguaugaaaugugauca

SEQ ID NO: 592204 - RNA, 64 nt, hsa
acaggugugagccaacaagcccggcuaauuuuuguauuuuuaguagagacaagguuucaccaug

SEQ ID NO: 592205 - RNA, 64 nt, hsa
uacagucacugaacuaguagaugucaauaauuauuauuuuuaaaaauuuuuauuuguuggccgg

SEQ ID NO: 592206 - RNA, 64 nt, hsa
acaggugcaugccaccaugccuggcuaauuuugguauuuuuaguagagaugagguuuugccauu

SEQ ID NO: 592207 - RNA, 64 nt, hsa
uugucagagccuucuucauuuuacaauauuuuguuauuuuuauuuuaccuuuuucauuuuacaa

SEQ ID NO: 592208 - RNA, 64 nt, hsa
uuuauuuuaccuuuuucauuuuacaauauuucguuauuuuuauuuuaccuuuuucauuuuacaa

SEQ ID NO: 592209 - RNA, 64 nt, hsa
cuuuuuuaaaugaauaaugguagccuaaacuuaauauuuuuauaaaguauuguaauauuguuuu

SEQ ID NO: 592210 - RNA, 64 nt, hsa
cuaacuuaauguguauucauuuuaaauuguucuguauuuuuaaauugccaagaaaaacaacuuu

SEQ ID NO: 592211 - RNA, 64 nt, hsa
caggugcccaccaccacgccuggcuaguuuuuuguauuuuuaguagagacgcaguuucaccgug

SEQ ID NO: 592212 - RNA, 64 nt, hsa
acuuauguuuuauaaugauuauaauuuacaugcuuauuuuuaaaauaguauauguggacacaua

SEQ ID NO: 592213 - RNA, 64 nt, hsa
aaauauaguauuagauuguuacuuacguagauuuuauuuuuacuaugccuuaccaaguacaucc

SEQ ID NO: 592214 - RNA, 64 nt, hsa
gugaaaaccauaaaauacauuuuuugcauucuacuauuuuuaggggcaugaaaugaaugaaagc

SEQ ID NO: 592215 - RNA, 64 nt, hsa
cgaucuaagcuuuuaaccccuuuaccacuuugcuuauuuuuaaaaaauuuauuggcaaaacugg

SEQ ID NO: 592216 - RNA, 64 nt, hsa
aaccuauugugaauuccaaaucuaaaaaaagaaauauuuuuaaaauguucuuaagcaaauauau

SEQ ID NO: 592217 - RNA, 64 nt, hsa
ugaaauuuaugguauuugagugugcaagaaaauauauuuuuaaagcuuucauuuuucccccagu

SEQ ID NO: 592218 - RNA, 64 nt, hsa
caggcgcccaccaccacgcccggcuaauuuuuuguauuuuuaauagagacgggguuucacugug

SEQ ID NO: 592219 - RNA, 64 nt, hsa
uucucaauuuugaauuaugcuacucaccaauuuauauuuuuaaagcaaguuguugcuuaucuuu

SEQ ID NO: 592220 - RNA, 64 nt, hsa
uauugcugaucaggcaaaaauaguuuuccaaaguuauuuuuaauaaaguauauacaaaauucuu

SEQ ID NO: 592221 - RNA, 64 nt, hsa
agugaaauuuaaguuuuaaaauacuuucagaauguauuuuuacuacugcaaguuuuuggucuuu

SEQ ID NO: 592222 - RNA, 64 nt, hsa
uauaaacaaguacacaaauuuuucaauuuuuacauauuuuuaaauuacuuaucuucuauccaag

SEQ ID NO: 592223 - RNA, 64 nt, hsa
guaguugauguaaaaccguuuuguggauggaaaauauuuuuauuuuauugcucuuuuaguuugg

SEQ ID NO: 592224 - RNA, 64 nt, hsa
caggcacccaccaccacaccuggcuaauuuuuuguauuuuuaguaaagacaggguuuuaccaug

SEQ ID NO: 592225 - RNA, 64 nt, hsa
guugggagaaucaccaggguuuaaaugucagauuuauuuuuauguggaucccuguguaugcuga

SEQ ID NO: 592226 - RNA, 64 nt, hsa
cuucaauucuuugaugacuuuagaggugaaaaaauauuuuuauggagaugaugcagaaaacucc

SEQ ID NO: 592227 - RNA, 64 nt, hsa
aauauuguauuucgugguaguccuuuccuguagauauuuuuaaugccauuuaaugccauuguca

SEQ ID NO: 592228 - RNA, 64 nt, hsa
ugguuucuugaggauuggacucuugauggauuucuauuuuuauauaacuauacaguaagcauuu

SEQ ID NO: 592229 - RNA, 64 nt, hsa
acaggugcacgccaccaugcuuggcucauuuuuguauuuuuaguagugacagcguuucaccaca

SEQ ID NO: 592230 - RNA, 64 nt, hsa
uaaaaaauggcaccauauuuggccuagcaggauuuauuuuuaugucaucaccucccuugccuuu

SEQ ID NO: 592231 - RNA, 64 nt, hsa
agacuaucaauuggugggauuaggcuugacauuuuauuuuuauaaauauauauuuuuucugaau

SEQ ID NO: 592232 - RNA, 64 nt, hsa
aaaucuucugcuuuuugaaaagugguauguaucauauuuuuauguuucuggugugugaacuuua

SEQ ID NO: 592233 - RNA, 64 nt, hsa
guuuuauauagcauagugguuuuauuuuguuaguuauuuuuaaaggagaagaaauguuacuuuu

SEQ ID NO: 592234 - RNA, 64 nt, hsa
cauuuuuucugaauauuaagugaaaagcaaguucuauuuuuaagaaauagcuuuugcugaggag

SEQ ID NO: 592235 - RNA, 64 nt, hsa
uucaacuuccggauauaaaaacacaaguauugccuauuuuuauagaauuucgccacagaacuua

SEQ ID NO: 592236 - RNA, 64 nt, hsa
guucccuaaaaagguuugucuuccuuuuuuuuuuuauuuuuauuuuucaaaucuauacauuuuc

SEQ ID NO: 592237 - RNA, 64 nt, hsa
aaaucacauaccugcagacaaacuggagcaauguuauuuuuaaaggguuuuuuucaccuccuua

SEQ ID NO: 592238 - RNA, 64 nt, hsa
gaaaacagagccccguucauaaauuuuucaucuuuauuuuuaagguuauacuccucuaaauaac

SEQ ID NO: 592239 - RNA, 64 nt, hsa
cccuuaagccucaucaagaaagguuuguuuauaguauuuuuacuauagcuucauccuugauaac

SEQ ID NO: 592240 - RNA, 64 nt, hsa
caggcacccgccaacacgcccggcuaauuuuuuguauuuuuaguaaagacaggguuucaccgug

SEQ ID NO: 592241 - RNA, 64 nt, hsa
acaggcacccgccaccaugcccagcuaauuuuuguauuuuuaguagagacagaguuucaccaua

SEQ ID NO: 592242 - RNA, 64 nt, hsa
auucuucaucaaaugacuuuuggaguagagauuuuauuuuuauagcaauagaugcacagauauu

SEQ ID NO: 592243 - RNA, 64 nt, hsa
acaggcacccaccaccacauccagcuaauuguuguauuuuuaauagaggcgggguuucgccaug

SEQ ID NO: 592244 - RNA, 64 nt, hsa
uauuaauuguacuucuaugaaauaauaugcagucuauuuuuaaauuauaaauuaugugugaacu

SEQ ID NO: 592245 - RNA, 64 nt, hsa
uuuauuacaagcaauucaauuguacacuuuuaguuauuuuuaaauuuacaauguuauugauuac

SEQ ID NO: 592246 - RNA, 64 nt, hsa
uguaaaaucuauacauuucugaguucugaauaaauauuuuuaaaaauuuuaauauauuuuucuu

SEQ ID NO: 592247 - RNA, 64 nt, hsa
acaggcaugcacuaccacgcuuggcuaauuuuuguauuuuuaguagagaugggguuucacugug

SEQ ID NO: 592248 - RNA, 64 nt, hsa
acaggcgucccccaccacgccuggcuaaauuuuguauuuuuagguggucuugaacuccugaugu

SEQ ID NO: 592249 - RNA, 64 nt, hsa
aucaaugauaacccuguuuauugugggauaucaauauuuuuaaagugccaacacagucaugaua

SEQ ID NO: 592250 - RNA, 64 nt, hsa
cuccauaauuagugccaaccauuagucucguucauauuuuuacaccaggagucaacaaacugug

SEQ ID NO: 592251 - RNA, 64 nt, hsa
acagacgugcgccaccacacccaguucauuuuuguauuuuuaguagagacaguguuuaccaugu

SEQ ID NO: 592252 - RNA, 64 nt, hsa
acaggcguguaccaccauacccagcuaauuuuuguauuuuuaguagagaugggguuucaccacg

SEQ ID NO: 592253 - RNA, 64 nt, hsa
acaggcacauaccacugcacccagcuaauuuuuguauuuuuaguagagaugggguuucacugug

SEQ ID NO: 592254 - RNA, 64 nt, hsa
uucauuguucuucucuuuuuuuauuuauuuuauuuauuuuuauuuuuauuuuuauuugagacag

SEQ ID NO: 592255 - RNA, 64 nt, hsa
guucuucucuuuuuuuauuuauuuuauuuauuuuuauuuuuauuuuuauuugagacagagucuc

SEQ ID NO: 592256 - RNA, 64 nt, hsa
cucuuuuuuuauuuauuuuauuuauuuuuauuuuuauuuuuauuugagacagagucucacucug

SEQ ID NO: 592257 - RNA, 64 nt, hsa
uccuuaguuuacagugcaauuuuaucucaggaauuauuuuuaaaaggaggaggggacauagaaa

SEQ ID NO: 592258 - RNA, 64 nt, hsa
uuugcuacccugcaaccuuauugaguucacuuauuauuuuuagcuauuucuuucgacagaaucc

SEQ ID NO: 592259 - RNA, 64 nt, hsa
acaggcgcccgccaccacgccuggcuaauuuuuguauuuuuaguagagacgggguuucaccauc

SEQ ID NO: 592260 - RNA, 64 nt, hsa
uacaggugugcgccgccacacccagcuaauuuuguauuuuuaguagagacgggguuucaccaug

SEQ ID NO: 592261 - RNA, 64 nt, hsa
caggcacccgccacuacgccuggcuaauuuuuuguauuuuuaguagagacgggguuucaccguu

SEQ ID NO: 592262 - RNA, 64 nt, hsa
uacacauuuagagcguuuuguaauuccuuuuuuauauuuuuaagacuagauuuugagccaugug

SEQ ID NO: 592263 - RNA, 64 nt, hsa
aggugccugccaccacgccuggcuaauuuuuuuguauuuuuaguagagacgggguuucaccgug

SEQ ID NO: 592264 - RNA, 64 nt, hsa
acgggcgugagccaccgcgccuggccaggauuucuauuuuuaauauuuuugggaaaauuuuucc

SEQ ID NO: 592265 - RNA, 64 nt, hsa
acagucuuuuuuuauuuuguauuguuauuuuuauuauuuuuaauuuaaaccugaugacuugcac

SEQ ID NO: 592266 - RNA, 64 nt, hsa
uuguuugagacagucuuuuuuuauuuuguauuguuauuuuuauuauuuuuaauuuaaaccugau

SEQ ID NO: 592267 - RNA, 64 nt, hsa
ggcgcgugccaccacaaccagcuaaauuuuuuuguauuuuuaguagagaugggguuucaccaug

SEQ ID NO: 592268 - RNA, 64 nt, hsa
ugucuagagggcuguguguauauauauuuauauauauuuuuaaauauggaaugcuuuuagguuu

SEQ ID NO: 592269 - RNA, 64 nt, hsa
caggcgcccgccaccacgcccggcucauuuuuuguauuuuuaguggagacgggguuucaccgug

SEQ ID NO: 592270 - RNA, 64 nt, hsa
acaggcacaugccaccacgcccaacuaauuuuuauauuuuuaguagagacgggguuucaccaug

SEQ ID NO: 592271 - RNA, 64 nt, hsa
acaagugcccaccaccaugcccagcuaauuuuuauauuuuuaguagagacaguguuucaccaug

SEQ ID NO: 592272 - RNA, 64 nt, hsa
aauccucuggcccagccucauggcagaauagagguauuuuuaggcuauuuuuguaauauggcuu

SEQ ID NO: 592273 - RNA, 64 nt, hsa
auuuccuuacacucugacaugaaugaauuauuauuauuuuuauuuuucuuuuuuuuuuuacauu

SEQ ID NO: 592274 - RNA, 64 nt, hsa
caggugugcaccaccacacccggcuaauuuuuuuuauuuuuaauagagaugagguuucaccaug

SEQ ID NO: 592275 - RNA, 64 nt, hsa
uuuucugucucucucuuuuuauuuuuuuuauuuuuauuuuuauuuuugagacagagccucgcuc

SEQ ID NO: 592276 - RNA, 64 nt, hsa
guuuccuuuucugucucucucuuuuuauuuuuuuuauuuuuauuuuuauuuuugagacagagcc

SEQ ID NO: 592277 - RNA, 64 nt, hsa
uacagacaugcaccaccacaccugguuaauuuuuuauuuuuauuuuuuguagagacaggugucu

SEQ ID NO: 592278 - RNA, 64 nt, hsa
ggauuacaggugugagccacuguggccgaccuacuauuuuuauuauuuuugagcuagguucuca

SEQ ID NO: 592279 - RNA, 64 nt, hsa
uaggcgugagccaccaugcccagccuaauuuuuguauuuuuaguagagauggaguuucaccaug

SEQ ID NO: 592280 - RNA, 64 nt, hsa
aauaaaaucccuacauuucugaggccugaauaaguauuuuuaaaguuuucuaauauuuauuuuu

SEQ ID NO: 592281 - RNA, 64 nt, hsa
aaauguaaaauuaaauuguuauugauuacaguguuauuuuuauggucauaauaaaaguuaugua

SEQ ID NO: 592282 - RNA, 64 nt, hsa
caaggugcccuccagcaugccuggcugauuuuuguauuuuuaguugaggugagguuucaccaug

SEQ ID NO: 592283 - RNA, 64 nt, hsa
uaaauagaauaguguugaagauaugaaauauggcuauuuuuaauggugacaauuaugacuuuua

SEQ ID NO: 592284 - RNA, 64 nt, hsa
guauuuuucaauuugcauuauuuuuauuguauuuuauuuuuauuguuuuuuuuugaguauuuuc

SEQ ID NO: 592285 - RNA, 64 nt, hsa
aaauaguuguuauacuguauuuuucaauuugcauuauuuuuauuguauuuuauuuuuauuguuu

SEQ ID NO: 592286 - RNA, 64 nt, hsa
uacaggugugagccaccacgccuggcuaauuuuguauuuuuaguagagaugggguuucuccaaa

SEQ ID NO: 592287 - RNA, 64 nt, hsa
uacaggcaugcgccaccaugcccggcuaauuuuguauuuuuaguagagacggaguugcaccaug

SEQ ID NO: 592288 - RNA, 64 nt, hsa
uaagugacaaauuaagucuauauauuaacagaaauauuuuuaaaaaauuagagugaagaaaaau

SEQ ID NO: 592289 - RNA, 64 nt, hsa
uacaggcaugcgccaccaugaccggcuaauuuuauauuuuuaguagagacgggauaucuccgug

SEQ ID NO: 592290 - RNA, 64 nt, hsa
uccacagaguuagcacuccuagucagauacaauguauuuuuacagucuuacagcucaucauuuu

SEQ ID NO: 592291 - RNA, 64 nt, hsa
acaggugcgagccccuacaccuggauaauuuuuguauuuuuaguagagacaggguuucaccugg

SEQ ID NO: 592292 - RNA, 64 nt, hsa
guuuccuuaguaagggacagagccaggauuuuuuuauuuuuauuuuuugagauagcgucucacu

SEQ ID NO: 592293 - RNA, 64 nt, hsa
caggcaugagccaccgugccuggccucauuugaguauuuuuauaaugucucuuuuaaagucuuu

SEQ ID NO: 592294 - RNA, 64 nt, hsa
augccaacacgcccggcuaauuuuuuuuuaaaaauauuuuuaguagagacaggguuucaccauu

SEQ ID NO: 592295 - RNA, 64 nt, hsa
aggcaugcaccaccacagcccagcuaauuuuuuguauuuuuaguagagacagaguuuugcuaug

SEQ ID NO: 592296 - RNA, 64 nt, hsa
caccuucauucucagugauguuuuuugcuuguaguauuuuuaguugacauuguuuucuguucag

SEQ ID NO: 592297 - RNA, 64 nt, hsa
ggcgcccgccaccacgcccggcuaauuuuuuuuguauuuuuaguagagacgggguuucaucgug

SEQ ID NO: 592298 - RNA, 64 nt, hsa
acaggcacaggccauuaugccuggcuaauuuuuguauuuuuaguagagacaggguuucaccaug

SEQ ID NO: 592299 - RNA, 64 nt, hsa
acaggcacgcgccaccaagccaggcuaauuuuuguauuuuuaguagagacgggguuucaccaug

SEQ ID NO: 592300 - RNA, 64 nt, hsa
uuguaucauaauuuacauguagauacucauuucuuauuuuuauuuuuuucucgaggcagaaucu

SEQ ID NO: 592301 - RNA, 64 nt, hsa
caggugcgugccaccaugcccggguaauuuuuuguauuuuuaguagagacuggguuucaccgug

SEQ ID NO: 592302 - RNA, 64 nt, hsa
uuucccagccuguauguucuuuuauuuauuuauuuauuuuuaagauggaaucuugcucugucgc

SEQ ID NO: 592303 - RNA, 64 nt, hsa
uacaggcaugcaccaccacgcccagcuuauuuuguauuuuuaguagagacgggguuucuccgug

SEQ ID NO: 592304 - RNA, 64 nt, hsa
cgccaguuucuaacgcccucaccauuuuuauuuuuauuuuuauuuuuuuugagacagaguuucg

SEQ ID NO: 592305 - RNA, 64 nt, hsa
ccugaucgccaguuucuaacgcccucaccauuuuuauuuuuauuuuuauuuuuuuugagacaga

SEQ ID NO: 592306 - RNA, 64 nt, hsa
auuuugcaugacacauuuuaaaaauaauaaacacuauuuuuagaauaacagaauaucagccucc

SEQ ID NO: 592307 - RNA, 64 nt, hsa
accaccaugcccagcuaauuauuuauuucuuuuguauuuuuaguagagacaggguuucaccaug

SEQ ID NO: 592308 - RNA, 64 nt, hsa
guuuuuuuucuuuggaguuuuugugguauuaaauuauuuuuaaauuauguuuuauuguagaccu

SEQ ID NO: 592309 - RNA, 64 nt, hsa
aggcgcccaccaccaugcccggcuaguuuuuuuguauuuuuaguagagacgggguuucaccaug

SEQ ID NO: 592310 - RNA, 64 nt, hsa
guuaugucuuauuuuuuuccuaaaagauaauguuuauuuuuaaaaaggaaggaaggagcaagug

SEQ ID NO: 592311 - RNA, 64 nt, hsa
ucggaguguacauaaaacagaaaaaaucuucauguauuuuuauuaaauauaacaaugucugagu

SEQ ID NO: 592312 - RNA, 64 nt, hsa
uacaggugugugccaucaugccugacuaauuuuguauuuuuaguagagacaggguuucaccaug

SEQ ID NO: 592313 - RNA, 64 nt, hsa
aggugcccaccaccaagcccugcaaauuuuuuuguauuuuuaguagagacaguguuuugccaug

SEQ ID NO: 592314 - RNA, 64 nt, hsa
uuauuuugccguuugacauuuuuuaugguucauuuauuuuuaauauagagaggaagauugaaua

SEQ ID NO: 592315 - RNA, 64 nt, hsa
caauuguguccugaaaauuguuucaagaauuuaauauuuuuaugaaaauuauuuuauuuaacuu

SEQ ID NO: 592316 - RNA, 64 nt, hsa
auuugaugaacagaaauaaagugauaacaagaguuauuuuuaaacagaacuccucuuacccccc

SEQ ID NO: 592317 - RNA, 64 nt, hsa
uaugaaguaccucauguugaauguuauuguacuguauuuuuaauguaacagugcagaucuuguu

SEQ ID NO: 592318 - RNA, 64 nt, hsa
agucauuuuacauuucaaagcaguguguguuucuuauuuuuauauuuuuaacucuuuauucuug

SEQ ID NO: 592319 - RNA, 64 nt, hsa
uacauuucaaagcaguguguguuucuuauuuuuauauuuuuaacucuuuauucuuggauguaua

SEQ ID NO: 592320 - RNA, 64 nt, hsa
uauauaaauaucacccaaaaggcuuucugcccuauauuuuuaaaauacagaauaguuauauuug

SEQ ID NO: 592321 - RNA, 64 nt, hsa
ccuggcccuaguucuauagggcuuggcuauuuaauauuuuuauggaagaaguguuuaguucugg

SEQ ID NO: 592322 - RNA, 64 nt, hsa
accgggguugacucacggaauuaaauuuuuccucuauuuuuauauccuuuccuguuguggaugu

SEQ ID NO: 592323 - RNA, 50 nt, hsa
uauggaaugcaucuuggugauauuuuuaaauuaauauuuuaaauugcuug

SEQ ID NO: 592324 - RNA, 64 nt, hsa
uuuuaaaguaugugucucuaaaggaagaaauacauauuuuuauuugacuauguuuggaguuuaa

SEQ ID NO: 592325 - RNA, 64 nt, hsa
uacaggcauguaccaccacacccagcuaauuuuguauuuuuaguagagaugggguuucuccaug

SEQ ID NO: 592326 - RNA, 64 nt, hsa
ggagcaagcauuguuucuuuucauuuguuuauuuuauuuuuauuuuuuugagauggaguuucac

SEQ ID NO: 592327 - RNA, 64 nt, hsa
uuuuucuuuguucacugcccaaggacuagaacuguauuuuuaagguuguuuuccccuaaaagga

SEQ ID NO: 592328 - RNA, 64 nt, hsa
auccugaucuuuuuuucauagacaaauguuuuguuauuuuuauaaauuaauuguuuggaacucu

SEQ ID NO: 592329 - RNA, 64 nt, hsa
acagacacagcgccuguccuuuuguaagaauauuuauuuuuauaaaaaaguauaaaguauacag

SEQ ID NO: 592330 - RNA, 64 nt, hsa
uuucaggcaacugaaauucauguuaacauguuuuuauuuuuauugcuuuguauuuuugugguua

SEQ ID NO: 592331 - RNA, 64 nt, hsa
aguaugagaugagaucuaaguaaagguguuaagauauuuuuaagugguaugugaucgugucauu

SEQ ID NO: 592332 - RNA, 64 nt, hsa
acaggcgcacaccaccacgcccaacugauuuuuguauuuuuaguagagacgggguuuccccaug

SEQ ID NO: 592333 - RNA, 64 nt, hsa
gagaaaaauggccugcaaaccuuuuuuaugaugcuauuuuuauuaauauaaaguccuguuuauu

SEQ ID NO: 592334 - RNA, 64 nt, hsa
uaucuagguauaugcuuucucucugcugugaaauuauuuuuagaauuauaaauucacgucuugu

SEQ ID NO: 592335 - RNA, 64 nt, hsa
ucuguguauuugauaaauauuucuuccuacauuauauuuuuagaauauuucagaaauauacauu

SEQ ID NO: 592336 - RNA, 64 nt, hsa
uaaaaauuguguuuacagaugguuuauuugugcauauuuuuacuacugcuuuuccuaaaugcau

SEQ ID NO: 592337 - RNA, 64 nt, hsa
auaaaaacauuauugggaaacuagagaacaccucuauuuuuaaaaggacuuuaacgaagucaaa

SEQ ID NO: 592338 - RNA, 64 nt, hsa
caaaaaauaaguuaaucaggaacuguacggaauauauuuuuaaaaauuuuuguuugguuauauc

SEQ ID NO: 592339 - RNA, 64 nt, hsa
ccaucugaaagugguacuugaucauuuuuaccauuauuuuuaggauguguauuucauuuauuua

SEQ ID NO: 592340 - RNA, 64 nt, hsa
uaaguguuugauaaaaaugaacuguucuaauauuuauuuuuauggcaucucauuuuucaauaca

SEQ ID NO: 592341 - RNA, 64 nt, hsa
uaauuucaauugugcaagacaugugccuuauaauuauuuuuagcuuaaaauuaaacagauuuug

SEQ ID NO: 592342 - RNA, 64 nt, hsa
caggcaugagcuaccacgccuggcuaauuuuuuguauuuuuaguagagacucgguuucaccaug

SEQ ID NO: 592343 - RNA, 64 nt, hsa
uauuuuuuuaacccuacccuuaacccaugaacacuauuuuuaauuaaaguaucugauguaaaau

SEQ ID NO: 592344 - RNA, 64 nt, hsa
caaaggagcgagcaugucguggacacacacagacuauuuuuagauuuucuuuugccuuuugcaa

SEQ ID NO: 592345 - RNA, 64 nt, hsa
cuuuucagagaucaggagggauuuauguagcagcuauuuuuacugcaaaaguaauucacuggaa

SEQ ID NO: 592346 - RNA, 64 nt, hsa
cacuggaaaaaaaauguaauuuguaagaaagcuuuauuuuuaucucagcucuauguaaaguuaa

SEQ ID NO: 592347 - RNA, 64 nt, hsa
ccuguuucauuugcuauauagaaaaagaaacuccuauuuuuaccuugcuggaauuauuggauaa

SEQ ID NO: 592348 - RNA, 64 nt, hsa
uuuuuaccuugcuggaauuauuggauaaaaaagcuauuuuuauaaauucguuaugaauuggaug

SEQ ID NO: 592349 - RNA, 64 nt, hsa
uacaggcaugcgccaccacacccggcuaauuuuguauuuuuaguagagauggguuucuccaugu

SEQ ID NO: 592350 - RNA, 64 nt, hsa
cauuuuacaaacccauaagccuacaauagaugaguauuuuuacuauuuguauuaagugucauaa

SEQ ID NO: 592351 - RNA, 64 nt, hsa
ugccauauuuugcugugagugaccuuaacauuuauauuuuuauaugaauuguuucauguauuua

SEQ ID NO: 592352 - RNA, 64 nt, hsa
aauuuuaaucaaguaacucaaaugugacaaaauuuauuuuuauuuuuugugguuauauucccaa

SEQ ID NO: 592353 - RNA, 64 nt, hsa
accacuguuugaguucuacaagcucaugagaguuuauuuuuauuauaagauguuuuuaauauaa

SEQ ID NO: 592354 - RNA, 64 nt, hsa
aagguauccaaugucgcuguaaauuuuauggcacuauuuuuauuggaggauuuggucagaaugc

SEQ ID NO: 592355 - RNA, 64 nt, hsa
auugcaaaaugcguauuugcauuugggugguuuuuauuuuuauauacguuuauauaaauauaua

SEQ ID NO: 592356 - RNA, 64 nt, hsa
gggaugcaacucgcccuguuuggcaucuaauucuuauuuuuaauuuuuccgcaccuuaucaauu

SEQ ID NO: 592357 - RNA, 64 nt, hsa
auuuuuaaaaguaggcaacuacuuuggguuacaguauuuuuauucauauuuaaacauuuuuaca

SEQ ID NO: 592358 - RNA, 64 nt, hsa
aacuaagacuuucuaugugguuugggcucccucuuauuuuuacaaguuucauuuuuaaaaguag

SEQ ID NO: 592359 - RNA, 64 nt, hsa
guuauaaacuugaauuuauaaagugcugguaaauuauuuuuaaugauuugagugcauguuuuaa

SEQ ID NO: 592360 - RNA, 64 nt, hsa
ugaaaaguuaugaaugugacuaaaucaugacuguuauuuuuauuugcacuugcuggucuuugua

SEQ ID NO: 592361 - RNA, 64 nt, hsa
uacaggcaugcaccaccaugccuggcuaauuuuguauuuuuaguagagaugggguuucuccaug

SEQ ID NO: 592362 - RNA, 64 nt, hsa
caggcacgugugaccaugccgggcuaauuuuuuauauuuuuaguagagagagguuucaccgugu

SEQ ID NO: 592363 - RNA, 64 nt, hsa
caggcaugcaccaccacacuuggccaauguucuguauuuuuaauagggacgggguuuugccaug

SEQ ID NO: 592364 - RNA, 64 nt, hsa
acaggcgugugccaccaugccuggcuaauuuuuguauuuuuaguagagaugggguuucgccaug

SEQ ID NO: 592365 - RNA, 64 nt, hsa
ucuccauuucuuuccagccaugauguuuaguaaauauuuuuaguaccgcacuuagcagacagcu

SEQ ID NO: 592366 - RNA, 64 nt, hsa
uucuugccacaaaaguguccuggcaagagccccuuauuuuuaagacaucaggaagccagaccgc

SEQ ID NO: 592367 - RNA, 64 nt, hsa
uuuugaauguuuuguauguaaaauagcaaguggcuauuuuuaaaguuaaguuuguauaaauagu

SEQ ID NO: 592368 - RNA, 64 nt, hsa
uuuaagcuuaucuugauuuucaaacaugcauagcuauuuuuaucacucuaaucaguaaggcuac

SEQ ID NO: 592369 - RNA, 64 nt, hsa
uucugauucugucacucauuggcuuugagugacauauuuuuauuuccugggccuguuuucucac

SEQ ID NO: 592370 - RNA, 64 nt, hsa
aaugucacucuugcagucuuugaggcaggauaaguauuuuuacauauuuuaagggugcaggagg

SEQ ID NO: 592371 - RNA, 64 nt, hsa
accugugauguauauagaauuaguacuuuauuuuuauuuuuaagagguaaagcauuauguuggg

SEQ ID NO: 592372 - RNA, 64 nt, hsa
uaugguaccugugauguauauagaauuaguacuuuauuuuuauuuuuaagagguaaagcauuau

SEQ ID NO: 592373 - RNA, 64 nt, hsa
aauagugauuaucaggcguugagccuuuuuguaguauuuuuagucuuugauacucuguaagugc

SEQ ID NO: 592374 - RNA, 64 nt, hsa
uuaauccauuccauuuucuaaaacugucauaaacuauuuuuaaucauuuuaaauaaauguaaaa

SEQ ID NO: 592375 - RNA, 64 nt, hsa
aguuaaaauaaaauuuuugaaauuauugucuuaauauuuuuauauaggcugaugucuuugccuc

SEQ ID NO: 592376 - RNA, 64 nt, hsa
ugaacuguguauguaugugugggguuuuuuucuuuauuuuuaaaugaaaauuaagacaccuuuu

SEQ ID NO: 592377 - RNA, 64 nt, hsa
ugagagccuuucaggggggacuaugagaucaaaauauuuuuauuauaaugugaagacauugucu

SEQ ID NO: 592378 - RNA, 64 nt, hsa
uauuacauucaccuuugauuguuuuuuaaaaguuuauuuuuacagaauauauuuaguaccuuuc

SEQ ID NO: 592379 - RNA, 64 nt, hsa
gaugcuugguuuacauuaaauuaugguauuuaacuauuuuuauguuuauacuagguagggucuu

SEQ ID NO: 592380 - RNA, 64 nt, hsa
uauguuucuguguuuuugguaugcuaaauaaagcuauuuuuaaacccaagagauuuuuuuucug

SEQ ID NO: 592381 - RNA, 64 nt, hsa
guggggguguccaggcaguagaucauuuuuugucuauuuuuaaccaaauaagaauaacacucaa

SEQ ID NO: 592382 - RNA, 64 nt, hsa
gaguuauuauaguuauucaaauccauaagcagguuauuuuuauuuuuuuacuguuugaaaagaa

SEQ ID NO: 592383 - RNA, 64 nt, hsa
auagcagcuauuaugaaaucagcuuucauaggccuauuuuuaaaaggaaucugaaauuuaauuc

SEQ ID NO: 592384 - RNA, 64 nt, hsa
acaggcaugcgccacuacaccuggcuaauuuuuguauuuuuaguugagaugggguuuuuccacg

SEQ ID NO: 592385 - RNA, 64 nt, hsa
cccauugaaggcauucuucaacucaguuauguuuuauuuuuauuuguaauauuuccauuugauu

SEQ ID NO: 592386 - RNA, 64 nt, hsa
agcccauaauacccucuaacauauuaaucauaguuauuuuuaacucccugucugauaguuccaa

SEQ ID NO: 592387 - RNA, 64 nt, hsa
agaacgaaugaaguacuauuauugauaacuuauauauuuuuauuuagagcaaucccacaugcuu

SEQ ID NO: 592388 - RNA, 64 nt, hsa
ugagaagcaccauuuaugcagauuuucuucagaauauuuuuaaaagguacagaauccuuaaaau

SEQ ID NO: 592389 - RNA, 64 nt, hsa
aaaauguuugauuuuuaucuugucuagauuggcauauuuuuaacauuuuacuuaagauagcaaa

SEQ ID NO: 592390 - RNA, 64 nt, hsa
ucuucucacagugaucuugugaguuaguuacuuauauuuuuauuagaacucauuauucugggua

SEQ ID NO: 592391 - RNA, 64 nt, hsa
ugguacuuguuuucuaccuccuaaaaauguagcuuauuuuuaggauuuaaaucacuaaguaaau

SEQ ID NO: 592392 - RNA, 64 nt, hsa
gugaucaugagugucauuuuuguucuaagacuaauauuuuuagaucuuuuuacuucaccucaua

SEQ ID NO: 592393 - RNA, 64 nt, hsa
caacauggcuacuugcuuugaggcucaccagaauuauuuuuaagugguuuuaauaaaauaauaa

SEQ ID NO: 592394 - RNA, 64 nt, hsa
aauauagauuaaaucauacuccuaugcuuuagcuuauuuuuacaguuauagaaagcaagaugua

SEQ ID NO: 592395 - RNA, 64 nt, hsa
uucuguuguauuucauuuccaguuuucaggcaguuauuuuuauuauuguacuuuaagcuuuuaa

SEQ ID NO: 592396 - RNA, 64 nt, hsa
gaggugcuuaugcuuagcuugaugaccaggauguuauuuuuaacaaaaugauugcugaaguguu

SEQ ID NO: 592397 - RNA, 64 nt, hsa
uaggaguaaaaaagucuuugcauaaaacaguauuuauuuuuacuuuugugaccacuauuuuaga

SEQ ID NO: 592398 - RNA, 64 nt, hsa
cucaaugcuugcuuuuauuuuaaccaucuuuuacuauuuuuagaaggaaacuagcuuuaguagu

SEQ ID NO: 592399 - RNA, 64 nt, hsa
agaaaauguuuuccccuaauuuuccagagaagccuauuuuuauauuuuuaaaaaacugacaggg

SEQ ID NO: 592400 - RNA, 64 nt, hsa
uuuuccccuaauuuuccagagaagccuauuuuuauauuuuuaaaaaacugacagggcccaguua

SEQ ID NO: 592401 - RNA, 64 nt, hsa
ugguuaaucugacauacauugcaguuacaugcauuauuuuuauuuacaacauuugcuccuuaau

SEQ ID NO: 592402 - RNA, 64 nt, hsa
gcuucuuuugucuggguaauagacauuggacagauauuuuuaguucagauggugauucugaagc

SEQ ID NO: 592403 - RNA, 64 nt, hsa
caggaaaaugcuaaaucugauagauuacgaaauauauuuuuagaacuuguuuagaaaggauuca

SEQ ID NO: 592404 - RNA, 64 nt, hsa
acacuaacaagaggaagcagaauaugagaagccauauuuuuacauaggagucagauacaaaaag

SEQ ID NO: 592405 - RNA, 64 nt, hsa
acaggcgugugagccaccacgcccggccaugaaauauuuuuacuuaaaaauugggaauaagcuu

SEQ ID NO: 592406 - RNA, 64 nt, hsa
auaggcgugcaccaccacaccuggcuaauuuuuguauuuuuaguagagacaggguuucaccaua

SEQ ID NO: 592407 - RNA, 64 nt, hsa
uuacaggcgugagccaccgugcccaaccaugaaauauuuuuacuuaaaaauugggaauaagcuc

SEQ ID NO: 592408 - RNA, 64 nt, hsa
acaggcgcgugccaccacgcccggcuaauuuuuguauuuuuaguagagacaggguuucaccaua

SEQ ID NO: 592409 - RNA, 64 nt, hsa
uuacuuaauucacagauaaguugacuuaacucaguauuuuuauuucaauuaaugaaaacagucc

SEQ ID NO: 592410 - RNA, 64 nt, hsa
aaaaauacacugaauaaaguacaccauauagcauuauuuuuauaggaaauauuucaugucccuu

SEQ ID NO: 592411 - RNA, 64 nt, hsa
gcuauuaguuucuguacugcuauucuauauuuauuauuuuuaaauauaugacauguuuacuacu

SEQ ID NO: 592412 - RNA, 64 nt, hsa
uaauauacaaauuuggauagcuuaauuauaaacauauuuuuauaucaaauauacaguucuaaua

SEQ ID NO: 592413 - RNA, 64 nt, hsa
uggccuuaacuguucaguauugcaauaaaaaauauauuuuuauauguggaaaauugaaauaaga

SEQ ID NO: 592414 - RNA, 64 nt, hsa
aagugugaccaguuuugauauuuauuuaugcuaauauuuuuaacaagucauuucaaaauaugug

SEQ ID NO: 592415 - RNA, 64 nt, hsa
aaacaagcccaccgcuucuguacaugucuaaauauauuuuuagaaguggguaggauugugaauu

SEQ ID NO: 592416 - RNA, 64 nt, hsa
ggaagggagagaggauuucuauucaccuuuaauauauuuuuacaaaaaaagcaaacaauuuaaa

SEQ ID NO: 592417 - RNA, 64 nt, hsa
cacacauauauaggcaguugcaugcuagcauggguauuuuuauaacaauauaacugaguuauau

SEQ ID NO: 592418 - RNA, 64 nt, hsa
cuuugguuuuuccaaccaaggaauuuaaaacuguuauuuuuacagcaaaagaugugcaaaauca

SEQ ID NO: 592419 - RNA, 64 nt, hsa
uuuguaaaugagaugccaguaguguucaaaguuguauuuuuaaaagauaaauauuccuuuuuau

SEQ ID NO: 592420 - RNA, 64 nt, hsa
aaauauguguuggacaagcauagaaagugauuuauauuuuuaaugguuuucaaguggaaguucc

SEQ ID NO: 592421 - RNA, 62 nt, hsa
aauugcuaauacccaguuacuuaugauuuaaaaacaaccaacagaaaacaucccacugacug

SEQ ID NO: 592422 - RNA, 62 nt, hsa
aaauaaaaugaacaucucuugaaaccuguuaaaacaaccaguuaaagccacagauggcuuuc

SEQ ID NO: 592423 - RNA, 62 nt, hsa
guaucccuuuugcuuuucagugucuucucagaaacaaccagcugagaagguaauuaaagucu

SEQ ID NO: 592424 - RNA, 62 nt, hsa
guuucccuuuugcuuuucagugucuucucagaaacaaccagcugagaagguaauuaaagucu

SEQ ID NO: 592425 - RNA, 62 nt, hsa
guaucccuuuugcuuuucagugucuucucagaaacaaccagccucaaagguaauuaaacucu

SEQ ID NO: 592426 - RNA, 62 nt, hsa
guaucccuuuugcuuuucagugucuucucagaaacaaccagccuugaagguaauuaaacucu

SEQ ID NO: 592427 - RNA, 62 nt, hsa
uaucccuuuuugcuuuucagugucuucucagaaacaaccagccuugaagguaauuaaacucu

SEQ ID NO: 592428 - RNA, 62 nt, hsa
ccauagccauguggauuuuuauccaaaggcucaacaaccagagggaauggugagaccugaua

SEQ ID NO: 592429 - RNA, 62 nt, hsa
ggucauauauacauucagaacuuuuauuuuaaaacaaccacaauaacauuaauaauagaaaa

SEQ ID NO: 592430 - RNA, 62 nt, hsa
uguuucuauaaggaaauaauacuuuuuuaaacaacaaccaaaaaaugccuugcugauucacu

SEQ ID NO: 592431 - RNA, 62 nt, hsa
cuauaucauguucucgguauuuuaaaaacaacaacaaccauauuugucacagaaauuuaguu

SEQ ID NO: 592432 - RNA, 62 nt, hsa
guaguucauauguacaccagcuaguggcugugaacaaccauuuaguugguguaaaaaacuuu

SEQ ID NO: 592433 - RNA, 62 nt, hsa
uaagagauguggagucuucgguguuuaaagucaacaaccaugccagggauugaggaggacua

SEQ ID NO: 592434 - RNA, 62 nt, hsa
aauuauauaguauaccauacauuaucauucaaaacaaccauccugcucauaacaucuuugaa

SEQ ID NO: 592435 - RNA, 55 nt, hsa; identical to SEQ ID NO: 194635

SEQ ID NO: 592436 - RNA, 64 nt, hsa; identical to SEQ ID NO: 417042

SEQ ID NO: 592437 - RNA, 64 nt, hsa; identical to SEQ ID NO: 417043

SEQ ID NO: 592438 - RNA, 64 nt, hsa; identical to SEQ ID NO: 417044

SEQ ID NO: 592439 - RNA, 64 nt, hsa; identical to SEQ ID NO: 417045

SEQ ID NO: 592440 - RNA, 64 nt, hsa; identical to SEQ ID NO: 417046

SEQ ID NO: 592441 - RNA, 64 nt, hsa; identical to SEQ ID NO: 417047

SEQ ID NO: 592442 - RNA, 64 nt, hsa; identical to SEQ ID NO: 417048

SEQ ID NO: 592443 - RNA, 64 nt, hsa; identical to SEQ ID NO: 417049

SEQ ID NO: 592444 - RNA, 64 nt, hsa; identical to SEQ ID NO: 417050

SEQ ID NO: 592445 - RNA, 64 nt, hsa; identical to SEQ ID NO: 417051

SEQ ID NO: 592446 - RNA, 64 nt, hsa; identical to SEQ ID NO: 417052

SEQ ID NO: 592447 - RNA, 64 nt, hsa; identical to SEQ ID NO: 417053

SEQ ID NO: 592448 - RNA, 64 nt, hsa; identical to SEQ ID NO: 417054

SEQ ID NO: 592449 - RNA, 64 nt, hsa; identical to SEQ ID NO: 417055

SEQ ID NO: 592450 - RNA, 64 nt, hsa; identical to SEQ ID NO: 417056

SEQ ID NO: 592451 - RNA, 64 nt, hsa; identical to SEQ ID NO: 417057

SEQ ID NO: 592452 - RNA, 64 nt, hsa; identical to SEQ ID NO: 417058

SEQ ID NO: 592453 - RNA, 64 nt, hsa; identical to SEQ ID NO: 417059

SEQ ID NO: 592454 - RNA, 64 nt, hsa; identical to SEQ ID NO: 417060

SEQ ID NO: 592455 - RNA, 64 nt, hsa; identical to SEQ ID NO: 417061

SEQ ID NO: 592456 - RNA, 64 nt, hsa; identical to SEQ ID NO: 417062

SEQ ID NO: 592457 - RNA, 64 nt, hsa; identical to SEQ ID NO: 417063

SEQ ID NO: 592458 - RNA, 64 nt, hsa; identical to SEQ ID NO: 417064

SEQ ID NO: 592459 - RNA, 64 nt, hsa; identical to SEQ ID NO: 417065

SEQ ID NO: 592460 - RNA, 64 nt, hsa; identical to SEQ ID NO: 417066

SEQ ID NO: 592461 - RNA, 64 nt, hsa; identical to SEQ ID NO: 417067

SEQ ID NO: 592462 - RNA, 64 nt, hsa; identical to SEQ ID NO: 417068

SEQ ID NO: 592463 - RNA, 64 nt, hsa; identical to SEQ ID NO: 417069

SEQ ID NO: 592464 - RNA, 64 nt, hsa; identical to SEQ ID NO: 417070

SEQ ID NO: 592465 - RNA, 64 nt, hsa; identical to SEQ ID NO: 417071

SEQ ID NO: 592466 - RNA, 64 nt, hsa; identical to SEQ ID NO: 417072

SEQ ID NO: 592467 - RNA, 64 nt, hsa; identical to SEQ ID NO: 417073

SEQ ID NO: 592468 - RNA, 64 nt, hsa; identical to SEQ ID NO: 417074

SEQ ID NO: 592469 - RNA, 64 nt, hsa; identical to SEQ ID NO: 417075

SEQ ID NO: 592470 - RNA, 64 nt, hsa; identical to SEQ ID NO: 417076

SEQ ID NO: 592471 - RNA, 64 nt, hsa; identical to SEQ ID NO: 417077

SEQ ID NO: 592472 - RNA, 64 nt, hsa; identical to SEQ ID NO: 417078

SEQ ID NO: 592473 - RNA, 64 nt, hsa; identical to SEQ ID NO: 417079

SEQ ID NO: 592474 - RNA, 64 nt, hsa; identical to SEQ ID NO: 417080

SEQ ID NO: 592475 - RNA, 64 nt, hsa; identical to SEQ ID NO: 417081

SEQ ID NO: 592476 - RNA, 64 nt, hsa; identical to SEQ ID NO: 212638

SEQ ID NO: 592477 - RNA, 64 nt, hsa; identical to SEQ ID NO: 212639

SEQ ID NO: 592478 - RNA, 64 nt, hsa; identical to SEQ ID NO: 212640

SEQ ID NO: 592479 - RNA, 64 nt, hsa; identical to SEQ ID NO: 212641

SEQ ID NO: 592480 - RNA, 64 nt, hsa; identical to SEQ ID NO: 212642

SEQ ID NO: 592481 - RNA, 64 nt, hsa; identical to SEQ ID NO: 212643

SEQ ID NO: 592482 - RNA, 64 nt, hsa; identical to SEQ ID NO: 212644

SEQ ID NO: 592483 - RNA, 64 nt, hsa; identical to SEQ ID NO: 212645

SEQ ID NO: 592484 - RNA, 64 nt, hsa; identical to SEQ ID NO: 212646

SEQ ID NO: 592485 - RNA, 64 nt, hsa; identical to SEQ ID NO: 212647

SEQ ID NO: 592486 - RNA, 64 nt, hsa; identical to SEQ ID NO: 212648

SEQ ID NO: 592487 - RNA, 64 nt, hsa; identical to SEQ ID NO: 212649

SEQ ID NO: 592488 - RNA, 64 nt, hsa; identical to SEQ ID NO: 212650

SEQ ID NO: 592489 - RNA, 64 nt, hsa; identical to SEQ ID NO: 212651

SEQ ID NO: 592490 - RNA, 64 nt, hsa; identical to SEQ ID NO: 212652

SEQ ID NO: 592491 - RNA, 64 nt, hsa; identical to SEQ ID NO: 212653

SEQ ID NO: 592492 - RNA, 64 nt, hsa; identical to SEQ ID NO: 212654

SEQ ID NO: 592493 - RNA, 64 nt, hsa; identical to SEQ ID NO: 212655

SEQ ID NO: 592494 - RNA, 64 nt, hsa; identical to SEQ ID NO: 212656

SEQ ID NO: 592495 - RNA, 64 nt, hsa; identical to SEQ ID NO: 212657

SEQ ID NO: 592496 - RNA, 64 nt, hsa; identical to SEQ ID NO: 212658

SEQ ID NO: 592497 - RNA, 64 nt, hsa; identical to SEQ ID NO: 212659

SEQ ID NO: 592498 - RNA, 64 nt, hsa; identical to SEQ ID NO: 212660

SEQ ID NO: 592499 - RNA, 64 nt, hsa; identical to SEQ ID NO: 212661

SEQ ID NO: 592500 - RNA, 64 nt, hsa; identical to SEQ ID NO: 212662

SEQ ID NO: 592501 - RNA, 64 nt, hsa; identical to SEQ ID NO: 212663

SEQ ID NO: 592502 - RNA, 64 nt, hsa; identical to SEQ ID NO: 212664

SEQ ID NO: 592503 - RNA, 64 nt, hsa; identical to SEQ ID NO: 212665

SEQ ID NO: 592504 - RNA, 64 nt, hsa; identical to SEQ ID NO: 212666

SEQ ID NO: 592505 - RNA, 62 nt, hsa; identical to SEQ ID NO: 212667

SEQ ID NO: 592506 - RNA, 64 nt, hsa; identical to SEQ ID NO: 212668

SEQ ID NO: 592507 - RNA, 64 nt, hsa; identical to SEQ ID NO: 212669

SEQ ID NO: 592508 - RNA, 64 nt, hsa; identical to SEQ ID NO: 212670

SEQ ID NO: 592509 - RNA, 64 nt, hsa; identical to SEQ ID NO: 212671

SEQ ID NO: 592510 - RNA, 64 nt, hsa; identical to SEQ ID NO: 212672

SEQ ID NO: 592511 - RNA, 64 nt, hsa; identical to SEQ ID NO: 212673

SEQ ID NO: 592512 - RNA, 64 nt, hsa; identical to SEQ ID NO: 212674

SEQ ID NO: 592513 - RNA, 64 nt, hsa; identical to SEQ ID NO: 212675

SEQ ID NO: 592514 - RNA, 64 nt, hsa; identical to SEQ ID NO: 212676

SEQ ID NO: 592515 - RNA, 64 nt, hsa; identical to SEQ ID NO: 212677

SEQ ID NO: 592516 - RNA, 64 nt, hsa; identical to SEQ ID NO: 212678

SEQ ID NO: 592517 - RNA, 64 nt, hsa; identical to SEQ ID NO: 212679

SEQ ID NO: 592518 - RNA, 64 nt, hsa; identical to SEQ ID NO: 244624

SEQ ID NO: 592519 - RNA, 64 nt, hsa; identical to SEQ ID NO: 244625

SEQ ID NO: 592520 - RNA, 64 nt, hsa; identical to SEQ ID NO: 244626

SEQ ID NO: 592521 - RNA, 64 nt, hsa; identical to SEQ ID NO: 244627

SEQ ID NO: 592522 - RNA, 64 nt, hsa; identical to SEQ ID NO: 244628

SEQ ID NO: 592523 - RNA, 64 nt, hsa; identical to SEQ ID NO: 244629

SEQ ID NO: 592524 - RNA, 64 nt, hsa
uugcucuucaguauguagccuaaaaaaaucuuaauuauuucauggaucaugaagcaaggaugaa

SEQ ID NO: 592525 - RNA, 64 nt, hsa
acaugguuuuuagaauuauaauuauggauucuucuuauuucaugguagguugucuuuaaagaua

SEQ ID NO: 592526 - RNA, 64 nt, hsa
ggccagacauugugcuaugugcauaucauauguauuauuucauuuaauucucacaacaauucug

SEQ ID NO: 592527 - RNA, 64 nt, hsa
auguaaggcauugucccauuuugcauaacuugccuuauuucaucauuaucacuacccauuuagu

SEQ ID NO: 592528 - RNA, 64 nt, hsa
ugacugacugaugucugaaguuugagacgagggauuauuucaggguggggcccaaugugaucua

SEQ ID NO: 592529 - RNA, 64 nt, hsa
ucgacguaccaagaagcacauaaugccuuuguauuuauuucagguugaguuguuuguuuguccu

SEQ ID NO: 592530 - RNA, 64 nt, hsa
cugucauucaacaauuagcuccaggaaauaacaguuauuucaucauaaaacagucccuucaaac

SEQ ID NO: 592531 - RNA, 64 nt, hsa
ggucucuccauaauucagcccaacaaugcuugguuuauuucaaucagcucugacacuuguuuag

SEQ ID NO: 592532 - RNA, 64 nt, hsa
aaguggaaaggguauuagaaguguaacugugcuauuauuucaauaaagaccucuugacauuuaa

SEQ ID NO: 592533 - RNA, 64 nt, hsa
uuuuacuuuaaauuauuuaaauaggcuauuuuauuuauuucaaaugcaguuguauuaguucuca

SEQ ID NO: 592534 - RNA, 64 nt, hsa
cacggaagucuauuccaggccaaccagcccaaaauuauuucaucuuguauucuuuguaaaauuc

SEQ ID NO: 592535 - RNA, 64 nt, hsa
aagaaaacacacgcccugcccugccaccuccccuuuauuucacacugcugcgaucuguucuucu

SEQ ID NO: 592536 - RNA, 64 nt, hsa
caaggccuuuuucauaaacugagccucuuuucaauuauuucaaugggacaggaacuaggauaga

SEQ ID NO: 592537 - RNA, 64 nt, hsa
acaugauacuauucagaggagccagaaguaaaguuuauuucauggauuauuuaugagagcuaau

SEQ ID NO: 592538 - RNA, 64 nt, hsa
cuguccccugcuacaugucuaaguuuacuuguauuuauuucagagaagaacucuaagauguugc

SEQ ID NO: 592539 - RNA, 64 nt, hsa
uucacuaggaacaccucuacuugaaccaauguuuuuauuucauauauuuuauaguuuugaaacu

SEQ ID NO: 592540 - RNA, 64 nt, hsa
gauggggggguguguuggggauucuuuguauuguuuauuucauuuugguuuauuuuaaaagaug

SEQ ID NO: 592541 - RNA, 64 nt, hsa
ggauguaauuuuaaucucuugccauucauuaguguuauuucauuguaaacguuauugugccaaa

SEQ ID NO: 592542 - RNA, 64 nt, hsa
gcagcaucugaagccacaaucuauuauaaauacuuuauuucaacuagaagguacaaucucucag

SEQ ID NO: 592543 - RNA, 64 nt, hsa
auauuacaucaggcuagaaguaauuaauguugauuuauuucaucuacaagcaguuggucccuaa

SEQ ID NO: 592544 - RNA, 64 nt, hsa
augcaaauaauucugcuuuuagagccuuguuauuuuauuucacaaaacaggcauaugucuagga

SEQ ID NO: 592545 - RNA, 64 nt, hsa
acuucacacagucgucuauguuauccagagauuuuuauuucauuuuacauuuuagggcacaguu

SEQ ID NO: 592546 - RNA, 64 nt, hsa
gguuuaagaaauagaauuauaacuguaaagauguuuauuucaggcauuggauauuuuuuacuuu

SEQ ID NO: 592547 - RNA, 64 nt, hsa
uugauacauuuuuguacuaacuagcauuguaaaauuauuucaugauuagaaauuaccuguggau

SEQ ID NO: 592548 - RNA, 64 nt, hsa
acgaaauacuuaacuacuguuuaagugaauugacuuauuucacuuuaguuuuugaacugugauu

SEQ ID NO: 592549 - RNA, 64 nt, hsa
uguacauaaacauuaggcagguugcuuaaccuuuuuauuucaaacucucucaacucuaaagugc

SEQ ID NO: 592550 - RNA, 64 nt, hsa
aacuaauaaauugaauguuuccauguaccucacuuuauuucaguuaacaagauacuuugacuug

SEQ ID NO: 592551 - RNA, 64 nt, hsa
uuuuugguacaucuaaguuuucacuuauaaacuguuauuucaaagcaaacauacuagugauaua

SEQ ID NO: 592552 - RNA, 64 nt, hsa
aggauuuagagaaggagccuaaacugaauuuguguuauuucaguaaaaguuauggaguuauggg

SEQ ID NO: 592553 - RNA, 64 nt, hsa
cugcgcaauccuugauuuaaugaaauuaaauuuuuuauuucaaaagauaggcuucuguuuauca

SEQ ID NO: 592554 - RNA, 64 nt, hsa
cuuauaucuucagaucccuagcagaaaugacuguuuauuucaaacuauguuuuacuuguauaug

SEQ ID NO: 592555 - RNA, 64 nt, hsa
aguuauguguugauugugugguucauuuuuguauuuauuucauuuaaaaucaugugacgcagaa

SEQ ID NO: 592556 - RNA, 64 nt, hsa
uaauucuacauguugucuuaagauggaaauacaguuauuucaucuuuuauucaaggaaguuuua

SEQ ID NO: 592557 - RNA, 64 nt, hsa
cuauugacuuuucaauaaaucagcugcaauccauuuauuucauuuacaaaagauuuauuguaag

SEQ ID NO: 592558 - RNA, 64 nt, hsa
aaccagaaagcuuaaacauuauuauuaaaauaaauuauuucauuugcacacaaugauaauaaug

SEQ ID NO: 592559 - RNA, 64 nt, hsa
uaaagaguacuuguacaaaaaagcuuaucauaaauuauuucaugaaugugaauagauuucuggc

SEQ ID NO: 592560 - RNA, 64 nt, hsa
gugcacgguggacccagacacaucgcacuguggauuauuucauuuuguaacaaaugaacgauau

SEQ ID NO: 592561 - RNA, 64 nt, hsa
cagcgcuaugcaauucuuaauuuucauuaaguuguuauuucaguuuuaaauguaccuucagaau

SEQ ID NO: 592562 - RNA, 64 nt, hsa
uuuaagacucuuaaaauacgguaccuggcaauguuuauuucauaaagaauugugaacuucuuga

SEQ ID NO: 592563 - RNA, 64 nt, hsa
uucuccauauuuuugggggaugacauucagugaauuauuucaguggugacccacugaaaauuaa

SEQ ID NO: 592564 - RNA, 64 nt, hsa
auuuaucauuuuguaauauuaaauuauggcaauuuuauuucaaacuaaaguuugaacaccggaa

SEQ ID NO: 592565 - RNA, 64 nt, hsa
uauucaccacuugagauucauaacauaucaauaguuauuucauaaauauagaaaugaaauaauu

SEQ ID NO: 592566 - RNA, 64 nt, hsa
uuaucccugccagguaucgaguuggaauauccaguuauuucaugucacacaucggcacguauga

SEQ ID NO: 592567 - RNA, 64 nt, hsa
gaaaaaauacugagauagacauguuuaguugaaguuauuucauuucagguuauauuaucuuggg

SEQ ID NO: 592568 - RNA, 64 nt, hsa
aacauauuuggagaaguuuguuugucuuugguguuuauuucaugaauagauugugugcccauuu

SEQ ID NO: 592569 - RNA, 64 nt, hsa
ugaauaaauauaugauagaaguuaaauagaauuuuuauuucauucuuaagaaaaacucauguuu

SEQ ID NO: 592570 - RNA, 64 nt, hsa
ugcuagauauauuaacaugaaggaauggggaagcuuauuucaaucaaagcuaaaauuuucagaa

SEQ ID NO: 592571 - RNA, 64 nt, hsa
auuuauuaugcucaaauauaucuuggcuuugaccuuauuucaacacauucuaagaagccuugac

SEQ ID NO: 592572 - RNA, 64 nt, hsa
ggcagauuuacauauuuaauuuaaaacauuggcuuuauuucauuuugugaugagugauguaucu

SEQ ID NO: 592573 - RNA, 64 nt, hsa
uggaaaaucagugacaucugauuggcagaugagcuuauuucaaaaggaaggguggcuuugcauu

SEQ ID NO: 592574 - RNA, 64 nt, hsa
cuacggaacugcacacucagugggcuguuucugcuuauuucaucuguucuaugcuuccucgugc

SEQ ID NO: 592575 - RNA, 64 nt, hsa
uacacacaacuaaguuaaaauguugaugugaguuuuauuucacauggauggaauaaacuugugg

SEQ ID NO: 592576 - RNA, 64 nt, hsa
aaguuggucaagggcuuaauuuauggaauuucuauuauuucauugguugggaugcuuugccagg

SEQ ID NO: 592577 - RNA, 64 nt, hsa
ccugggugacagagcgagacucugucucaaauaauuauuucacagaggauagcaagcuccagaa

SEQ ID NO: 592578 - RNA, 64 nt, hsa
auggacaauuauggcugugacugcacauuagaaauuauuucacuggccggguguggugguucac

SEQ ID NO: 592579 - RNA, 64 nt, hsa
accaucuuccaauuucauagagauuucucacaaguuauuucauucauaauccaccaugaacagu

SEQ ID NO: 592580 - RNA, 64 nt, hsa
caaaauucaguguuggaagcuuuuucccaagguuuuauuucagauuucuuuuucguuugguuug

SEQ ID NO: 592581 - RNA, 64 nt, hsa
uagugagauuaagaucauccuuauuguuucuaaauuauuucaaucagaugaaagugauacgauu

SEQ ID NO: 592582 - RNA, 64 nt, hsa
uuuauaaauaguauuuuacaucuuauuuuugccuuuauuucauaaguaauuuaaaaaucacugg

SEQ ID NO: 592583 - RNA, 64 nt, hsa
uaaaguggaugaaaugagcaaguaccuaaaaauuuuauuucagauaaaagucaggaguuacugc

SEQ ID NO: 592584 - RNA, 64 nt, hsa
gguguuuagcaaauuguauuacauaaauaaauauuuauuucauggauugaguuauguugcauau

SEQ ID NO: 592585 - RNA, 64 nt, hsa
uucuuaauauuacauacaagaaaaugcaguuagguuauuucaauugacaauucugccuccucuu

SEQ ID NO: 592586 - RNA, 64 nt, hsa
uguuuuugacaauuuuguuugaaauucauauaucuuauuucaaaggauagcauaauaucugcau

SEQ ID NO: 592587 - RNA, 64 nt, hsa
uaguuaagaugucugagagaccaucuccuaucuuuuauuucauucauauccuccgcccuuuuug

SEQ ID NO: 592588 - RNA, 64 nt, hsa
caguauuaaacucuccuuugauauuauguggcuuuuauuucagugccauacauguuauuguuuu

SEQ ID NO: 592589 - RNA, 64 nt, hsa
uguggcauuuggaaaaucuuuaauuauccuaauguuauuucacuugcccuuaugcuuuauuuua

SEQ ID NO: 592590 - RNA, 64 nt, hsa
uacugaaaggggaaccuucgucuuuuuaaauguguuauuucacauuacaauaauauguguagua

SEQ ID NO: 592591 - RNA, 64 nt, hsa
guuuccugcugagcuccaguauuuugauaguuaauuauuucaacuaauauaucuaugucuauau

SEQ ID NO: 592592 - RNA, 64 nt, hsa
aaccuaugaaacuauugauaugugaauagauggguuauuucaaccuguuuuggucacaucacua

SEQ ID NO: 592593 - RNA, 64 nt, hsa
agucaaguagaggcaaugcaaagauucacauaguuuauuucaacuauuuauugaaugauuacua

SEQ ID NO: 592594 - RNA, 62 nt, hsa
agguauuugguguaugccaaagaauaaaggcguuuuauuucacagugacaucuuauuccacu

SEQ ID NO: 592595 - RNA, 64 nt, hsa
ugugcccggcagcaaauuaaguauuugacaaacauuauuucauuaaacgagacugucaaucauu

SEQ ID NO: 592596 - RNA, 64 nt, hsa
uuucaguacacccccuuagagaauagcuuaugaguuauuucacacauuccugagcacauggcug

SEQ ID NO: 592597 - RNA, 64 nt, hsa
uaaauuguacagucaaauguucauugauuucauguuauuucaaagcauuuucuuauuaaaaaua

SEQ ID NO: 592598 - RNA, 64 nt, hsa
aagauuguauuucucugcuuucauuucaauuucauuauuucaaauugcuugucaaaauggccca

SEQ ID NO: 592599 - RNA, 64 nt, hsa
ucaacuagcuguauucguauuaaaaugaagucucuuauuucaauuaccuaguguuguugggaac

SEQ ID NO: 592600 - RNA, 64 nt, hsa
ccuuauucucaauuuaucaauggauacgugcauguuauuucagaauuaugcaaaacgucaaaau

SEQ ID NO: 592601 - RNA, 64 nt, hsa
aggauacucgaaugucagguuuuugguuuuauuauuauuucagaacuagcucagcccaucucua

SEQ ID NO: 592602 - RNA, 64 nt, hsa
auggauauauuguccugccuguguuccagcaugcuuauuucaaacguccaguguugugugugaa

SEQ ID NO: 592603 - RNA, 64 nt, hsa
gagguaaaauagcccuugacaugaugaacaucacuuauuucagcacuuggauugucuggcaaug

SEQ ID NO: 592604 - RNA, 64 nt, hsa
accccauuuguaaacagaugaaaauuuuauuuucuuauuucauuuauaagauggcucaauguau

SEQ ID NO: 592605 - RNA, 64 nt, hsa
uuaaauguuaaaacacuaaauauagagaggggcuuuauuucaaucauagagcaacaacaaaaau

SEQ ID NO: 592606 - RNA, 64 nt, hsa
aauauuuugguuuguucugugccuucaguuuaaauuauuucaggauuuuucagauguuuaaaua

SEQ ID NO: 592607 - RNA, 64 nt, hsa
gcugggguuuauuguaucuguagcaugucacugauuauuucaguuaguuuuauaaugauuuuua

SEQ ID NO: 592608 - RNA, 64 nt, hsa
cauuuguuacaugauauucccuugcaaguaaauuuuauuucauuauauaacuuuuuucaauguu

SEQ ID NO: 592609 - RNA, 64 nt, hsa
gcugugaacaaccauuuaguugguguaaaaaacuuuauuucaauauaaacugacucuggggagc

SEQ ID NO: 592610 - RNA, 64 nt, hsa
uugguuuacaauacagcaagccugaugguuugucuuauuucauucauacugaaaauucuuugca

SEQ ID NO: 592611 - RNA, 64 nt, hsa
aaguuaucaugaaaagguuuauauucacuauucuuuauuucaguguagcacuuuuagagccaaa

SEQ ID NO: 592612 - RNA, 64 nt, hsa
agccauuuuuuauuucaggaaauguaagaaaccauuauuucagguuaugaaaguauaaccaagc

SEQ ID NO: 592613 - RNA, 64 nt, hsa
uuuaaauaaaauaccaauaucaggaagccauuuuuuauuucaggaaauguaagaaaccauuauu

SEQ ID NO: 592614 - RNA, 64 nt, hsa
uaguaaauuuuuuucugccuuggguguugaauuuuuauuucaaaaaaaauguauagaaacuugu

SEQ ID NO: 592615 - RNA, 64 nt, hsa
aaauauuuugcuuuuuagacagcuguaggauauuuuauuucauggguauaccauaacuuuaaga

SEQ ID NO: 592616 - RNA, 64 nt, hsa
uggauaaauguccuuauuuucuucuaguauuuucuuauuucacuuuuacaccuaucuuuaaaag

SEQ ID NO: 592617 - RNA, 64 nt, hsa
aaaggagccaggaaaugugcuucuacuuugccaguuauuucagacagcacuaccaagaggaggu

SEQ ID NO: 592618 - RNA, 64 nt, hsa
uuagaauagugcuauauaucagguaugugaccauuuauuucagaaggcugaacauaagagguuu

SEQ ID NO: 592619 - RNA, 64 nt, hsa
augggggaaaacaggcaacguguucuuguaaccuuuauuucaugaaggacuucuuuuuguuucu

SEQ ID NO: 592620 - RNA, 64 nt, hsa
cuaacuauaaacuuggaucaccuauguuaaaaccuuauuucacauuccacaucauuuuagaauu

SEQ ID NO: 592621 - RNA, 64 nt, hsa
guuucucacauuuuaugcuuucaucuauucagaauuauuucauaguaaaauaaucuacucuuau

SEQ ID NO: 592622 - RNA, 64 nt, hsa
uaagcccuaacagcuuguccaaagauuuaaauucuuauuucaaauuugauuuguccuuuaaggu

SEQ ID NO: 592623 - RNA, 64 nt, hsa
uggguuuccucacauacugaucuaggauuuuaaauuauuucauugcaaaguaauugugucucuc

SEQ ID NO: 592624 - RNA, 64 nt, hsa
gcuucccugaauuacucuuuuaauuaaaacuagauuauuucaaucuagaaaagccuuguugagc

SEQ ID NO: 592625 - RNA, 64 nt, hsa
uaaaccauguggugaaggcuuaagugauuucaguuuauuucaaauacaguuuuccccugacaua

SEQ ID NO: 592626 - RNA, 64 nt, hsa
ucacaaaaugcaagauaugugggaaagccuuuguuuauuucauuggauuucaaagacaugaaag

SEQ ID NO: 592627 - RNA, 64 nt, hsa
gccuggggggcaucugugccuuauuuauacuuauuuauuucaggagcaggggugggaggcaggu

SEQ ID NO: 592628 - RNA, 64 nt, hsa
accguccuuccaaagccagaucuuauuuauuuauuuauuucaguacugggggcgaaacagccag

SEQ ID NO: 592629 - RNA, 64 nt, hsa
auuuuaaacuuuagaugaucauuugguuccauuuuuauuucauuuuuauuuuuguuaaugcaaa

SEQ ID NO: 592630 - RNA, 64 nt, hsa
aagaucauauccauguguaugugguuagacauuuuuauuucauugacuaacccaggacaguuuc

SEQ ID NO: 592631 - RNA, 64 nt, hsa
aacagcuuuaaaaauagccuuaagcaaaaggauguuauuucauuaaauuugguuuaauggaaag

SEQ ID NO: 592632 - RNA, 64 nt, hsa
aggcucugggcucaccauacaacacccacguuguuuauuucaaagaacuuuucagcgaagggag

SEQ ID NO: 592633 - RNA, 64 nt, hsa
uuuuguuuucaugcugcuguauguccaaguauuguuauuucauaauaagacaagaguugcuuuc

SEQ ID NO: 592634 - RNA, 64 nt, hsa
uaauucacagauaaguugacuuaacucaguauuuuuauuucaauuaaugaaaacaguccucuuu

SEQ ID NO: 592635 - RNA, 64 nt, hsa
uauguucacaaaauggaaggcuuucuaccuaaauuuauuucaucugugguccucuuauucucuu

SEQ ID NO: 592636 - RNA, 64 nt, hsa
cugugcuggcagcuuugcccacacauacccagcagcuccccaggcugaaagcagcccuggccca

SEQ ID NO: 592637 - RNA, 64 nt, hsa
uuccuccauccucagaccgugacaucuccccuaggcuccccagcagccaagaggagaggaaugu

SEQ ID NO: 592638 - RNA, 64 nt, hsa
gucaugggcccugaggccccuccugccuggcccugcuccccaguggggaggugacuguguuucc

SEQ ID NO: 592639 - RNA, 64 nt, hsa
cuuccccagcggccaccaacugaccuggggcgcugcuccccacaguccaaauaagcugaaagug

SEQ ID NO: 592640 - RNA, 64 nt, hsa
uguucuuucucucugcccucccuuuccaucuccagcuccccauuuccuuucucaccuccuccuc

SEQ ID NO: 592641 - RNA, 64 nt, hsa
ucgcugaaccccguuugccuguccacacccccucgcuccccaccauuuuuccugaccggccugu

SEQ ID NO: 592642 - RNA, 64 nt, hsa
uggccugaggcuuaccucucggcacuggcauugggcuccccagccggaacugguuaccaaggac

SEQ ID NO: 592643 - RNA, 64 nt, hsa
cacuguuucugccacccuguaacaggccauuaaagcuccccaguguucagccuccuucacuccc

SEQ ID NO: 592644 - RNA, 64 nt, hsa
accaccuagggaccacguuagcugccuuccuugagcuccccaggagucgguuuccacaucugug

SEQ ID NO: 592645 - RNA, 64 nt, hsa
ucccaaaauaaaauucagaagccagguggccugugcuccccaugggugaccucuggaggcagug

SEQ ID NO: 592646 - RNA, 64 nt, hsa
ggggagggcgaagggggugcacaaccagggcaaggcuccccacuuccuuagucccccaugcuca

SEQ ID NO: 592647 - RNA, 64 nt, hsa
gcugcucccaauccuugccccaaacacuuagcuggcuccccaugacuuaaguguguucucuugu

SEQ ID NO: 592648 - RNA, 64 nt, hsa
gcugcccuggcagcugucuucaaggguaggcugagcuccccacccuggagccccugagggcggc

SEQ ID NO: 592649 - RNA, 64 nt, hsa
ccuggccucuugauauaccucgagcuuccccugugcuccccagccccaggaccacuggccccuu

SEQ ID NO: 592650 - RNA, 64 nt, hsa
ugugaagucauugccugcucaagaauguacaguggcuccccaaugccuuggaggccauaaggcc

SEQ ID NO: 592651 - RNA, 64 nt, hsa
cagggcacaggggacuggcugggcccccagggcugcuccccacuugcagcacaaugccuucucc

SEQ ID NO: 592652 - RNA, 64 nt, hsa
ggccucggucuccuccccaugaagugggagcgaggcuccccaauggugcuuuuggcuuuagugu

SEQ ID NO: 592653 - RNA, 64 nt, hsa
ccaugggccuggggccccaagccggggcgucugagcuccccaggcaugaccaaaccucagugga

SEQ ID NO: 592654 - RNA, 64 nt, hsa
agggaggagcccaggggcuuaccucacugagagugcuccccagcaggcauccacuaccccaggg

SEQ ID NO: 592655 - RNA, 64 nt, hsa
aaucuacacuggaagccaacuugcuggcacccccgcuccccaacccuucuugccuggguaggag

SEQ ID NO: 592656 - RNA, 64 nt, hsa
ucucucuagugcugccucacauugggccucagcagcuccccagcaccaauucacaggucacccc

SEQ ID NO: 592657 - RNA, 64 nt, hsa
ccccauauuggcaacacccccagcgccaccccaugcuccccaagaacgcggcucugcgcuggaa

SEQ ID NO: 592658 - RNA, 64 nt, hsa
aucagcaucgcagccacuccagcgccuccccuccgcuccccacgcccccauauuggcaacaccc

SEQ ID NO: 592659 - RNA, 64 nt, hsa
gccccaugccccaguccuuuccuacuccagaaaugcuccccacccccccaaagagggaaaagca

SEQ ID NO: 592660 - RNA, 64 nt, hsa
uccugcccugcagucacauggguguggccuccaagcuccccaggaaagcaguggcagccucugg

SEQ ID NO: 592661 - RNA, 64 nt, hsa
aggugugggcccagccccccuccuuccagccuuugcuccccaucccacguuccacucgcccugc

SEQ ID NO: 592662 - RNA, 64 nt, hsa
agcugcccugcaggucuuggcacaugcacagcaggcuccccauagcuuugucaccacaaagggc

SEQ ID NO: 592663 - RNA, 64 nt, hsa
gauuugucaccagugagcccuuggcacggucucugcuccccaccagggcagcacgggacagaaa

SEQ ID NO: 592664 - RNA, 64 nt, hsa
uccacucuaccaggaagcccuaugacauccucaggcuccccagaccugcagcuugcauggggcc

SEQ ID NO: 592665 - RNA, 64 nt, hsa
agccacagcugaggaguggccgggcaggcagcaggcuccccagccagggcuugacacgcccaca

SEQ ID NO: 592666 - RNA, 64 nt, hsa
uuggcucccccauccucagaacucacaagccauugcuccccagcuggggaaccucaaccucccc

SEQ ID NO: 592667 - RNA, 64 nt, hsa
agagcugccucccgucagggcccacaucaucuaggcuccccagcccccacugugaaggggcugg

SEQ ID NO: 592668 - RNA, 64 nt, hsa
caucucagggaccaugaugucucagucacuccacgcuccccacaggccaacccuggcacagguc

SEQ ID NO: 592669 - RNA, 64 nt, hsa
guggaaggguugggggaagagcuccagccugucugcuccccagcucuguaguggcagaccagcg

SEQ ID NO: 592670 - RNA, 64 nt, hsa
gcuuuauccgggcuugugugcagggcccggcugggcuccccaucugcacauccugaggacagaa

SEQ ID NO: 592671 - RNA, 64 nt, hsa
acccacccccccacccccccccccccgcccacaugcuccccagcuugcaggaggaaucggugag

SEQ ID NO: 592672 - RNA, 64 nt, hsa
gcugggcgauuccgaugcugacccguccuccugggcuccccacccccgcuccccaagugucaca

SEQ ID NO: 592673 - RNA, 64 nt, hsa
gaugcugacccguccuccugggcuccccacccccgcuccccaagugucacacaggcacuuugua

SEQ ID NO: 592674 - RNA, 64 nt, hsa
ggcccaaagauggacccccccuggccuugugacagcuccccaaguguucuccgguggagaaacu

SEQ ID NO: 592675 - RNA, 64 nt, hsa
ccgguggagaaacugcagaggacuggugggcggggcuccccagccaucaccauccuguguacaa

SEQ ID NO: 592676 - RNA, 64 nt, hsa
agcugggagcagccagaggcggugcaagcgcccagcuccccagagcuccccaaccucggaccuc

SEQ ID NO: 592677 - RNA, 64 nt, hsa
agccagaggcggugcaagcgcccagcuccccagagcuccccaaccucggaccucaccgcagggg

SEQ ID NO: 592678 - RNA, 64 nt, hsa
cagcccuuccagagguucgacucccagagguggagcuccccaaggugucagagaugaaacuccc

SEQ ID NO: 592679 - RNA, 64 nt, hsa
ccgaggucaaggugcccaagggaccugaagugaagcuccccaaggcuccugaggucaagcuucc

SEQ ID NO: 592680 - RNA, 64 nt, hsa
cucagccucauguguugguccucugcuccuccuagcuccccagggauguuggggacccagcuug

SEQ ID NO: 592681 - RNA, 64 nt, hsa
aggacacaucuagcugccauugcaaccucacugggcuccccagacucugugugugagaaauuaa

SEQ ID NO: 592682 - RNA, 64 nt, hsa
gaagcaagagcagacuguugggccaacaggagaagcuccccagaguaggggagaagguuggggu

SEQ ID NO: 592683 - RNA, 64 nt, hsa
gcuccuacucugcccucuccaagcuccccuggcggcuccccaccugguugcccaguuccuauug

SEQ ID NO: 592684 - RNA, 64 nt, hsa; identical to SEQ ID NO: 209951

SEQ ID NO: 592685 - RNA, 64 nt, hsa; identical to SEQ ID NO: 209952

SEQ ID NO: 592686 - RNA, 64 nt, hsa; identical to SEQ ID NO: 209953

SEQ ID NO: 592687 - RNA, 64 nt, hsa; identical to SEQ ID NO: 209954

SEQ ID NO: 592688 - RNA, 64 nt, hsa; identical to SEQ ID NO: 209955

SEQ ID NO: 592689 - RNA, 64 nt, hsa; identical to SEQ ID NO: 209956

SEQ ID NO: 592690 - RNA, 64 nt, hsa; identical to SEQ ID NO: 209957

SEQ ID NO: 592691 - RNA, 64 nt, hsa; identical to SEQ ID NO: 209958

SEQ ID NO: 592692 - RNA, 64 nt, hsa; identical to SEQ ID NO: 209959

SEQ ID NO: 592693 - RNA, 64 nt, hsa; identical to SEQ ID NO: 209960

SEQ ID NO: 592694 - RNA, 64 nt, hsa; identical to SEQ ID NO: 209961

SEQ ID NO: 592695 - RNA, 64 nt, hsa; identical to SEQ ID NO: 209962

SEQ ID NO: 592696 - RNA, 64 nt, hsa; identical to SEQ ID NO: 209963

SEQ ID NO: 592697 - RNA, 64 nt, hsa; identical to SEQ ID NO: 209964

SEQ ID NO: 592698 - RNA, 64 nt, hsa; identical to SEQ ID NO: 209965

SEQ ID NO: 592699 - RNA, 64 nt, hsa; identical to SEQ ID NO: 209966

SEQ ID NO: 592700 - RNA, 64 nt, hsa; identical to SEQ ID NO: 209967

SEQ ID NO: 592701 - RNA, 64 nt, hsa; identical to SEQ ID NO: 209968

SEQ ID NO: 592702 - RNA, 64 nt, hsa; identical to SEQ ID NO: 209969

SEQ ID NO: 592703 - RNA, 64 nt, hsa; identical to SEQ ID NO: 209970

SEQ ID NO: 592704 - RNA, 64 nt, hsa; identical to SEQ ID NO: 209971

SEQ ID NO: 592705 - RNA, 64 nt, hsa; identical to SEQ ID NO: 209972

SEQ ID NO: 592706 - RNA, 64 nt, hsa; identical to SEQ ID NO: 209973

SEQ ID NO: 592707 - RNA, 64 nt, hsa; identical to SEQ ID NO: 209974

SEQ ID NO: 592708 - RNA, 64 nt, hsa; identical to SEQ ID NO: 209975

SEQ ID NO: 592709 - RNA, 64 nt, hsa; identical to SEQ ID NO: 209976

SEQ ID NO: 592710 - RNA, 64 nt, hsa; identical to SEQ ID NO: 209977

SEQ ID NO: 592711 - RNA, 64 nt, hsa; identical to SEQ ID NO: 209978

SEQ ID NO: 592712 - RNA, 64 nt, hsa; identical to SEQ ID NO: 209979

SEQ ID NO: 592713 - RNA, 64 nt, hsa; identical to SEQ ID NO: 209980

SEQ ID NO: 592714 - RNA, 64 nt, hsa; identical to SEQ ID NO: 209981

SEQ ID NO: 592715 - RNA, 64 nt, hsa; identical to SEQ ID NO: 209982

SEQ ID NO: 592716 - RNA, 64 nt, hsa; identical to SEQ ID NO: 209983

SEQ ID NO: 592717 - RNA, 64 nt, hsa; identical to SEQ ID NO: 209984

SEQ ID NO: 592718 - RNA, 64 nt, hsa; identical to SEQ ID NO: 209985

SEQ ID NO: 592719 - RNA, 64 nt, hsa; identical to SEQ ID NO: 209986

SEQ ID NO: 592720 - RNA, 64 nt, hsa; identical to SEQ ID NO: 209987

SEQ ID NO: 592721 - RNA, 64 nt, hsa; identical to SEQ ID NO: 209988

SEQ ID NO: 592722 - RNA, 64 nt, hsa; identical to SEQ ID NO: 209989

SEQ ID NO: 592723 - RNA, 64 nt, hsa; identical to SEQ ID NO: 209990

SEQ ID NO: 592724 - RNA, 64 nt, hsa; identical to SEQ ID NO: 209991

SEQ ID NO: 592725 - RNA, 64 nt, hsa; identical to SEQ ID NO: 209992

SEQ ID NO: 592726 - RNA, 64 nt, hsa; identical to SEQ ID NO: 209993

SEQ ID NO: 592727 - RNA, 64 nt, hsa; identical to SEQ ID NO: 209994

SEQ ID NO: 592728 - RNA, 64 nt, hsa; identical to SEQ ID NO: 209995

SEQ ID NO: 592729 - RNA, 64 nt, hsa; identical to SEQ ID NO: 209996

SEQ ID NO: 592730 - RNA, 64 nt, hsa; identical to SEQ ID NO: 209997

SEQ ID NO: 592731 - RNA, 64 nt, hsa; identical to SEQ ID NO: 209998

SEQ ID NO: 592732 - RNA, 64 nt, hsa; identical to SEQ ID NO: 209999

SEQ ID NO: 592733 - RNA, 64 nt, hsa; identical to SEQ ID NO: 210000

SEQ ID NO: 592734 - RNA, 64 nt, hsa; identical to SEQ ID NO: 210001

SEQ ID NO: 592735 - RNA, 64 nt, hsa; identical to SEQ ID NO: 210002

SEQ ID NO: 592736 - RNA, 64 nt, hsa; identical to SEQ ID NO: 210003

SEQ ID NO: 592737 - RNA, 64 nt, hsa; identical to SEQ ID NO: 210004

SEQ ID NO: 592738 - RNA, 64 nt, hsa; identical to SEQ ID NO: 210005

SEQ ID NO: 592739 - RNA, 64 nt, hsa; identical to SEQ ID NO: 210006

SEQ ID NO: 592740 - RNA, 64 nt, hsa; identical to SEQ ID NO: 210007

SEQ ID NO: 592741 - RNA, 64 nt, hsa; identical to SEQ ID NO: 210008

SEQ ID NO: 592742 - RNA, 64 nt, hsa; identical to SEQ ID NO: 210009

SEQ ID NO: 592743 - RNA, 64 nt, hsa; identical to SEQ ID NO: 210010

SEQ ID NO: 592744 - RNA, 64 nt, hsa; identical to SEQ ID NO: 210011

SEQ ID NO: 592745 - RNA, 64 nt, hsa; identical to SEQ ID NO: 210012

SEQ ID NO: 592746 - RNA, 64 nt, hsa; identical to SEQ ID NO: 210013

SEQ ID NO: 592747 - RNA, 64 nt, hsa; identical to SEQ ID NO: 210014

SEQ ID NO: 592748 - RNA, 64 nt, hsa; identical to SEQ ID NO: 210015

SEQ ID NO: 592749 - RNA, 64 nt, hsa; identical to SEQ ID NO: 210016

SEQ ID NO: 592750 - RNA, 64 nt, hsa; identical to SEQ ID NO: 210017

SEQ ID NO: 592751 - RNA, 64 nt, hsa; identical to SEQ ID NO: 210018

SEQ ID NO: 592752 - RNA, 64 nt, hsa; identical to SEQ ID NO: 210019

SEQ ID NO: 592753 - RNA, 64 nt, hsa; identical to SEQ ID NO: 210020

SEQ ID NO: 592754 - RNA, 64 nt, hsa; identical to SEQ ID NO: 210021

SEQ ID NO: 592755 - RNA, 64 nt, hsa; identical to SEQ ID NO: 210022

SEQ ID NO: 592756 - RNA, 64 nt, hsa; identical to SEQ ID NO: 210023

SEQ ID NO: 592757 - RNA, 64 nt, hsa; identical to SEQ ID NO: 210024

SEQ ID NO: 592758 - RNA, 64 nt, hsa; identical to SEQ ID NO: 210025

SEQ ID NO: 592759 - RNA, 64 nt, hsa; identical to SEQ ID NO: 210026

SEQ ID NO: 592760 - RNA, 64 nt, hsa; identical to SEQ ID NO: 210027

SEQ ID NO: 592761 - RNA, 64 nt, hsa; identical to SEQ ID NO: 210028

SEQ ID NO: 592762 - RNA, 64 nt, hsa; identical to SEQ ID NO: 210029

SEQ ID NO: 592763 - RNA, 64 nt, hsa; identical to SEQ ID NO: 210030

SEQ ID NO: 592764 - RNA, 64 nt, hsa; identical to SEQ ID NO: 210031

SEQ ID NO: 592765 - RNA, 64 nt, hsa; identical to SEQ ID NO: 210032

SEQ ID NO: 592766 - RNA, 64 nt, hsa; identical to SEQ ID NO: 210033

SEQ ID NO: 592767 - RNA, 64 nt, hsa; identical to SEQ ID NO: 210034

SEQ ID NO: 592768 - RNA, 64 nt, hsa; identical to SEQ ID NO: 210035

SEQ ID NO: 592769 - RNA, 64 nt, hsa; identical to SEQ ID NO: 210036

SEQ ID NO: 592770 - RNA, 64 nt, hsa; identical to SEQ ID NO: 210037

SEQ ID NO: 592771 - RNA, 64 nt, hsa; identical to SEQ ID NO: 210038

SEQ ID NO: 592772 - RNA, 64 nt, hsa; identical to SEQ ID NO: 210039

SEQ ID NO: 592773 - RNA, 64 nt, hsa; identical to SEQ ID NO: 210040

SEQ ID NO: 592774 - RNA, 64 nt, hsa; identical to SEQ ID NO: 210041

SEQ ID NO: 592775 - RNA, 64 nt, hsa; identical to SEQ ID NO: 210042

SEQ ID NO: 592776 - RNA, 64 nt, hsa; identical to SEQ ID NO: 210043

SEQ ID NO: 592777 - RNA, 64 nt, hsa; identical to SEQ ID NO: 210044

SEQ ID NO: 592778 - RNA, 64 nt, hsa; identical to SEQ ID NO: 210045

SEQ ID NO: 592779 - RNA, 64 nt, hsa; identical to SEQ ID NO: 210046

SEQ ID NO: 592780 - RNA, 64 nt, hsa; identical to SEQ ID NO: 210047

SEQ ID NO: 592781 - RNA, 64 nt, hsa; identical to SEQ ID NO: 210048

SEQ ID NO: 592782 - RNA, 64 nt, hsa; identical to SEQ ID NO: 210049

SEQ ID NO: 592783 - RNA, 64 nt, hsa; identical to SEQ ID NO: 210050

SEQ ID NO: 592784 - RNA, 64 nt, hsa; identical to SEQ ID NO: 210051

SEQ ID NO: 592785 - RNA, 64 nt, hsa; identical to SEQ ID NO: 210052

SEQ ID NO: 592786 - RNA, 56 nt, hsa; identical to SEQ ID NO: 210053

SEQ ID NO: 592787 - RNA, 64 nt, hsa; identical to SEQ ID NO: 210054

SEQ ID NO: 592788 - RNA, 64 nt, hsa; identical to SEQ ID NO: 210055

SEQ ID NO: 592789 - RNA, 64 nt, hsa; identical to SEQ ID NO: 210056

SEQ ID NO: 592790 - RNA, 64 nt, hsa; identical to SEQ ID NO: 210057

SEQ ID NO: 592791 - RNA, 64 nt, hsa; identical to SEQ ID NO: 210058

SEQ ID NO: 592792 - RNA, 64 nt, hsa; identical to SEQ ID NO: 210059

SEQ ID NO: 592793 - RNA, 64 nt, hsa; identical to SEQ ID NO: 210060

SEQ ID NO: 592794 - RNA, 64 nt, hsa; identical to SEQ ID NO: 210061

SEQ ID NO: 592795 - RNA, 64 nt, hsa; identical to SEQ ID NO: 210062

SEQ ID NO: 592796 - RNA, 64 nt, hsa; identical to SEQ ID NO: 210063

SEQ ID NO: 592797 - RNA, 64 nt, hsa; identical to SEQ ID NO: 210064

SEQ ID NO: 592798 - RNA, 64 nt, hsa; identical to SEQ ID NO: 210065

SEQ ID NO: 592799 - RNA, 64 nt, hsa; identical to SEQ ID NO: 210066

SEQ ID NO: 592800 - RNA, 64 nt, hsa; identical to SEQ ID NO: 210067

SEQ ID NO: 592801 - RNA, 64 nt, hsa; identical to SEQ ID NO: 210068

SEQ ID NO: 592802 - RNA, 64 nt, hsa; identical to SEQ ID NO: 210069

SEQ ID NO: 592803 - RNA, 64 nt, hsa; identical to SEQ ID NO: 210070

SEQ ID NO: 592804 - RNA, 55 nt, hsa; identical to SEQ ID NO: 210071

SEQ ID NO: 592805 - RNA, 64 nt, hsa; identical to SEQ ID NO: 210072

SEQ ID NO: 592806 - RNA, 64 nt, hsa; identical to SEQ ID NO: 210073

SEQ ID NO: 592807 - RNA, 64 nt, hsa; identical to SEQ ID NO: 210074

SEQ ID NO: 592808 - RNA, 64 nt, hsa; identical to SEQ ID NO: 210075

SEQ ID NO: 592809 - RNA, 64 nt, hsa; identical to SEQ ID NO: 210076

SEQ ID NO: 592810 - RNA, 64 nt, hsa; identical to SEQ ID NO: 210077

SEQ ID NO: 592811 - RNA, 64 nt, hsa; identical to SEQ ID NO: 210078

SEQ ID NO: 592812 - RNA, 64 nt, hsa; identical to SEQ ID NO: 210079

SEQ ID NO: 592813 - RNA, 64 nt, hsa; identical to SEQ ID NO: 210080

SEQ ID NO: 592814 - RNA, 64 nt, hsa; identical to SEQ ID NO: 210081

SEQ ID NO: 592815 - RNA, 64 nt, hsa; identical to SEQ ID NO: 210082

SEQ ID NO: 592816 - RNA, 64 nt, hsa; identical to SEQ ID NO: 210083

SEQ ID NO: 592817 - RNA, 64 nt, hsa; identical to SEQ ID NO: 210084

SEQ ID NO: 592818 - RNA, 64 nt, hsa; identical to SEQ ID NO: 210085

SEQ ID NO: 592819 - RNA, 64 nt, hsa; identical to SEQ ID NO: 210086

SEQ ID NO: 592820 - RNA, 64 nt, hsa; identical to SEQ ID NO: 210087

SEQ ID NO: 592821 - RNA, 64 nt, hsa; identical to SEQ ID NO: 210088

SEQ ID NO: 592822 - RNA, 64 nt, hsa; identical to SEQ ID NO: 210089

SEQ ID NO: 592823 - RNA, 64 nt, hsa; identical to SEQ ID NO: 210090

SEQ ID NO: 592824 - RNA, 64 nt, hsa; identical to SEQ ID NO: 210091

SEQ ID NO: 592825 - RNA, 64 nt, hsa; identical to SEQ ID NO: 210092

SEQ ID NO: 592826 - RNA, 64 nt, hsa; identical to SEQ ID NO: 210093

SEQ ID NO: 592827 - RNA, 64 nt, hsa; identical to SEQ ID NO: 210094

SEQ ID NO: 592828 - RNA, 64 nt, hsa; identical to SEQ ID NO: 210095

SEQ ID NO: 592829 - RNA, 64 nt, hsa; identical to SEQ ID NO: 210096

SEQ ID NO: 592830 - RNA, 64 nt, hsa; identical to SEQ ID NO: 210097

SEQ ID NO: 592831 - RNA, 64 nt, hsa; identical to SEQ ID NO: 210098

SEQ ID NO: 592832 - RNA, 64 nt, hsa; identical to SEQ ID NO: 210099

SEQ ID NO: 592833 - RNA, 64 nt, hsa; identical to SEQ ID NO: 210100

SEQ ID NO: 592834 - RNA, 64 nt, hsa; identical to SEQ ID NO: 210101

SEQ ID NO: 592835 - RNA, 64 nt, hsa; identical to SEQ ID NO: 210102

SEQ ID NO: 592836 - RNA, 64 nt, hsa; identical to SEQ ID NO: 210103

SEQ ID NO: 592837 - RNA, 64 nt, hsa; identical to SEQ ID NO: 210104

SEQ ID NO: 592838 - RNA, 64 nt, hsa; identical to SEQ ID NO: 210105

SEQ ID NO: 592839 - RNA, 64 nt, hsa; identical to SEQ ID NO: 210106

SEQ ID NO: 592840 - RNA, 64 nt, hsa; identical to SEQ ID NO: 210107

SEQ ID NO: 592841 - RNA, 64 nt, hsa; identical to SEQ ID NO: 210108

SEQ ID NO: 592842 - RNA, 64 nt, hsa; identical to SEQ ID NO: 210109

SEQ ID NO: 592843 - RNA, 64 nt, hsa; identical to SEQ ID NO: 210110

SEQ ID NO: 592844 - RNA, 64 nt, hsa; identical to SEQ ID NO: 210111

SEQ ID NO: 592845 - RNA, 64 nt, hsa; identical to SEQ ID NO: 210112

SEQ ID NO: 592846 - RNA, 64 nt, hsa; identical to SEQ ID NO: 210113

SEQ ID NO: 592847 - RNA, 63 nt, hsa; identical to SEQ ID NO: 210114

SEQ ID NO: 592848 - RNA, 60 nt, hsa; identical to SEQ ID NO: 210115

SEQ ID NO: 592849 - RNA, 57 nt, hsa; identical to SEQ ID NO: 210116

SEQ ID NO: 592850 - RNA, 64 nt, hsa; identical to SEQ ID NO: 210117

SEQ ID NO: 592851 - RNA, 64 nt, hsa; identical to SEQ ID NO: 210118

SEQ ID NO: 592852 - RNA, 64 nt, hsa; identical to SEQ ID NO: 210119

SEQ ID NO: 592853 - RNA, 64 nt, hsa; identical to SEQ ID NO: 210120

SEQ ID NO: 592854 - RNA, 64 nt, hsa; identical to SEQ ID NO: 210121

SEQ ID NO: 592855 - RNA, 64 nt, hsa; identical to SEQ ID NO: 210122

SEQ ID NO: 592856 - RNA, 64 nt, hsa; identical to SEQ ID NO: 210123

SEQ ID NO: 592857 - RNA, 64 nt, hsa; identical to SEQ ID NO: 210124

SEQ ID NO: 592858 - RNA, 64 nt, hsa; identical to SEQ ID NO: 210125

SEQ ID NO: 592859 - RNA, 64 nt, hsa; identical to SEQ ID NO: 210126

SEQ ID NO: 592860 - RNA, 64 nt, hsa; identical to SEQ ID NO: 210127

SEQ ID NO: 592861 - RNA, 64 nt, hsa; identical to SEQ ID NO: 210128

SEQ ID NO: 592862 - RNA, 64 nt, hsa; identical to SEQ ID NO: 210129

SEQ ID NO: 592863 - RNA, 64 nt, hsa; identical to SEQ ID NO: 210130

SEQ ID NO: 592864 - RNA, 64 nt, hsa; identical to SEQ ID NO: 210131

SEQ ID NO: 592865 - RNA, 64 nt, hsa; identical to SEQ ID NO: 169280

SEQ ID NO: 592866 - RNA, 64 nt, hsa; identical to SEQ ID NO: 169281

SEQ ID NO: 592867 - RNA, 64 nt, hsa; identical to SEQ ID NO: 169282

SEQ ID NO: 592868 - RNA, 64 nt, hsa; identical to SEQ ID NO: 169283

SEQ ID NO: 592869 - RNA, 64 nt, hsa; identical to SEQ ID NO: 169284

SEQ ID NO: 592870 - RNA, 64 nt, hsa; identical to SEQ ID NO: 169285

SEQ ID NO: 592871 - RNA, 64 nt, hsa; identical to SEQ ID NO: 169286

SEQ ID NO: 592872 - RNA, 64 nt, hsa; identical to SEQ ID NO: 169287

SEQ ID NO: 592873 - RNA, 64 nt, hsa; identical to SEQ ID NO: 169288

SEQ ID NO: 592874 - RNA, 64 nt, hsa; identical to SEQ ID NO: 169289

SEQ ID NO: 592875 - RNA, 64 nt, hsa; identical to SEQ ID NO: 169290

SEQ ID NO: 592876 - RNA, 64 nt, hsa; identical to SEQ ID NO: 169291

SEQ ID NO: 592877 - RNA, 64 nt, hsa; identical to SEQ ID NO: 169292

SEQ ID NO: 592878 - RNA, 64 nt, hsa; identical to SEQ ID NO: 169293

SEQ ID NO: 592879 - RNA, 64 nt, hsa; identical to SEQ ID NO: 169294

SEQ ID NO: 592880 - RNA, 64 nt, hsa; identical to SEQ ID NO: 169295

SEQ ID NO: 592881 - RNA, 64 nt, hsa; identical to SEQ ID NO: 169296

SEQ ID NO: 592882 - RNA, 64 nt, hsa; identical to SEQ ID NO: 169297

SEQ ID NO: 592883 - RNA, 64 nt, hsa; identical to SEQ ID NO: 169298

SEQ ID NO: 592884 - RNA, 64 nt, hsa; identical to SEQ ID NO: 169299

SEQ ID NO: 592885 - RNA, 64 nt, hsa; identical to SEQ ID NO: 169300

SEQ ID NO: 592886 - RNA, 64 nt, hsa; identical to SEQ ID NO: 169301

SEQ ID NO: 592887 - RNA, 64 nt, hsa; identical to SEQ ID NO: 169302

SEQ ID NO: 592888 - RNA, 64 nt, hsa; identical to SEQ ID NO: 169303

SEQ ID NO: 592889 - RNA, 64 nt, hsa; identical to SEQ ID NO: 169304

SEQ ID NO: 592890 - RNA, 64 nt, hsa; identical to SEQ ID NO: 169305

SEQ ID NO: 592891 - RNA, 64 nt, hsa; identical to SEQ ID NO: 169306

SEQ ID NO: 592892 - RNA, 64 nt, hsa; identical to SEQ ID NO: 169307

SEQ ID NO: 592893 - RNA, 64 nt, hsa; identical to SEQ ID NO: 143712

SEQ ID NO: 592894 - RNA, 64 nt, hsa; identical to SEQ ID NO: 143713

SEQ ID NO: 592895 - RNA, 64 nt, hsa; identical to SEQ ID NO: 143714

SEQ ID NO: 592896 - RNA, 64 nt, hsa; identical to SEQ ID NO: 143715

SEQ ID NO: 592897 - RNA, 64 nt, hsa; identical to SEQ ID NO: 143716

SEQ ID NO: 592898 - RNA, 64 nt, hsa; identical to SEQ ID NO: 143717

SEQ ID NO: 592899 - RNA, 64 nt, hsa; identical to SEQ ID NO: 143718

SEQ ID NO: 592900 - RNA, 64 nt, hsa; identical to SEQ ID NO: 143719

SEQ ID NO: 592901 - RNA, 64 nt, hsa; identical to SEQ ID NO: 143720

SEQ ID NO: 592902 - RNA, 64 nt, hsa; identical to SEQ ID NO: 143721

SEQ ID NO: 592903 - RNA, 64 nt, hsa; identical to SEQ ID NO: 143722

SEQ ID NO: 592904 - RNA, 64 nt, hsa; identical to SEQ ID NO: 143723

SEQ ID NO: 592905 - RNA, 64 nt, hsa; identical to SEQ ID NO: 143724

SEQ ID NO: 592906 - RNA, 64 nt, hsa; identical to SEQ ID NO: 143725

SEQ ID NO: 592907 - RNA, 64 nt, hsa; identical to SEQ ID NO: 143726

SEQ ID NO: 592908 - RNA, 64 nt, hsa; identical to SEQ ID NO: 143727

SEQ ID NO: 592909 - RNA, 64 nt, hsa; identical to SEQ ID NO: 143728

SEQ ID NO: 592910 - RNA, 64 nt, hsa; identical to SEQ ID NO: 143729

SEQ ID NO: 592911 - RNA, 64 nt, hsa; identical to SEQ ID NO: 143730

SEQ ID NO: 592912 - RNA, 64 nt, hsa; identical to SEQ ID NO: 143731

SEQ ID NO: 592913 - RNA, 64 nt, hsa; identical to SEQ ID NO: 143732

SEQ ID NO: 592914 - RNA, 64 nt, hsa; identical to SEQ ID NO: 143733

SEQ ID NO: 592915 - RNA, 64 nt, hsa; identical to SEQ ID NO: 143734

SEQ ID NO: 592916 - RNA, 64 nt, hsa; identical to SEQ ID NO: 143735

SEQ ID NO: 592917 - RNA, 64 nt, hsa; identical to SEQ ID NO: 143736

SEQ ID NO: 592918 - RNA, 64 nt, hsa; identical to SEQ ID NO: 143737

SEQ ID NO: 592919 - RNA, 64 nt, hsa; identical to SEQ ID NO: 143738

SEQ ID NO: 592920 - RNA, 64 nt, hsa; identical to SEQ ID NO: 143739

SEQ ID NO: 592921 - RNA, 64 nt, hsa; identical to SEQ ID NO: 143740

SEQ ID NO: 592922 - RNA, 64 nt, hsa; identical to SEQ ID NO: 143741

SEQ ID NO: 592923 - RNA, 64 nt, hsa; identical to SEQ ID NO: 143742

SEQ ID NO: 592924 - RNA, 64 nt, hsa; identical to SEQ ID NO: 143743

SEQ ID NO: 592925 - RNA, 64 nt, hsa; identical to SEQ ID NO: 143744

SEQ ID NO: 592926 - RNA, 64 nt, hsa; identical to SEQ ID NO: 143745

SEQ ID NO: 592927 - RNA, 64 nt, hsa; identical to SEQ ID NO: 143746

SEQ ID NO: 592928 - RNA, 64 nt, hsa; identical to SEQ ID NO: 143747

SEQ ID NO: 592929 - RNA, 64 nt, hsa; identical to SEQ ID NO: 143748

SEQ ID NO: 592930 - RNA, 64 nt, hsa; identical to SEQ ID NO: 143749

SEQ ID NO: 592931 - RNA, 64 nt, hsa; identical to SEQ ID NO: 143750

SEQ ID NO: 592932 - RNA, 64 nt, hsa; identical to SEQ ID NO: 143751

SEQ ID NO: 592933 - RNA, 64 nt, hsa; identical to SEQ ID NO: 143752

SEQ ID NO: 592934 - RNA, 64 nt, hsa; identical to SEQ ID NO: 143753

SEQ ID NO: 592935 - RNA, 64 nt, hsa; identical to SEQ ID NO: 143754

SEQ ID NO: 592936 - RNA, 64 nt, hsa; identical to SEQ ID NO: 143755

SEQ ID NO: 592937 - RNA, 64 nt, hsa; identical to SEQ ID NO: 143756

SEQ ID NO: 592938 - RNA, 64 nt, hsa; identical to SEQ ID NO: 143757

SEQ ID NO: 592939 - RNA, 64 nt, hsa; identical to SEQ ID NO: 143758

SEQ ID NO: 592940 - RNA, 64 nt, hsa; identical to SEQ ID NO: 143759

SEQ ID NO: 592941 - RNA, 64 nt, hsa; identical to SEQ ID NO: 143760

SEQ ID NO: 592942 - RNA, 64 nt, hsa; identical to SEQ ID NO: 143761

SEQ ID NO: 592943 - RNA, 64 nt, hsa; identical to SEQ ID NO: 143762

SEQ ID NO: 592944 - RNA, 64 nt, hsa; identical to SEQ ID NO: 143763

SEQ ID NO: 592945 - RNA, 64 nt, hsa; identical to SEQ ID NO: 143764

SEQ ID NO: 592946 - RNA, 64 nt, hsa; identical to SEQ ID NO: 143765

SEQ ID NO: 592947 - RNA, 64 nt, hsa; identical to SEQ ID NO: 143766

SEQ ID NO: 592948 - RNA, 64 nt, hsa; identical to SEQ ID NO: 143767

SEQ ID NO: 592949 - RNA, 64 nt, hsa; identical to SEQ ID NO: 143768

SEQ ID NO: 592950 - RNA, 64 nt, hsa; identical to SEQ ID NO: 143769

SEQ ID NO: 592951 - RNA, 64 nt, hsa; identical to SEQ ID NO: 143770

SEQ ID NO: 592952 - RNA, 64 nt, hsa; identical to SEQ ID NO: 143771

SEQ ID NO: 592953 - RNA, 64 nt, hsa; identical to SEQ ID NO: 143772

SEQ ID NO: 592954 - RNA, 64 nt, hsa; identical to SEQ ID NO: 143773

SEQ ID NO: 592955 - RNA, 64 nt, hsa; identical to SEQ ID NO: 143774

SEQ ID NO: 592956 - RNA, 64 nt, hsa; identical to SEQ ID NO: 143775

SEQ ID NO: 592957 - RNA, 64 nt, hsa; identical to SEQ ID NO: 143776

SEQ ID NO: 592958 - RNA, 64 nt, hsa; identical to SEQ ID NO: 143777

SEQ ID NO: 592959 - RNA, 64 nt, hsa; identical to SEQ ID NO: 143778

SEQ ID NO: 592960 - RNA, 64 nt, hsa; identical to SEQ ID NO: 143779

SEQ ID NO: 592961 - RNA, 64 nt, hsa; identical to SEQ ID NO: 143780

SEQ ID NO: 592962 - RNA, 64 nt, hsa; identical to SEQ ID NO: 143781

SEQ ID NO: 592963 - RNA, 64 nt, hsa; identical to SEQ ID NO: 143782

SEQ ID NO: 592964 - RNA, 64 nt, hsa; identical to SEQ ID NO: 143783

SEQ ID NO: 592965 - RNA, 64 nt, hsa; identical to SEQ ID NO: 143784

SEQ ID NO: 592966 - RNA, 64 nt, hsa; identical to SEQ ID NO: 143785

SEQ ID NO: 592967 - RNA, 64 nt, hsa; identical to SEQ ID NO: 143786

SEQ ID NO: 592968 - RNA, 64 nt, hsa; identical to SEQ ID NO: 143787

SEQ ID NO: 592969 - RNA, 64 nt, hsa; identical to SEQ ID NO: 143788

SEQ ID NO: 592970 - RNA, 64 nt, hsa; identical to SEQ ID NO: 143789

SEQ ID NO: 592971 - RNA, 57 nt, hsa; identical to SEQ ID NO: 143790

SEQ ID NO: 592972 - RNA, 64 nt, hsa; identical to SEQ ID NO: 143791

SEQ ID NO: 592973 - RNA, 64 nt, hsa; identical to SEQ ID NO: 143792

SEQ ID NO: 592974 - RNA, 64 nt, hsa; identical to SEQ ID NO: 143793

SEQ ID NO: 592975 - RNA, 64 nt, hsa; identical to SEQ ID NO: 143794

SEQ ID NO: 592976 - RNA, 64 nt, hsa; identical to SEQ ID NO: 143795

SEQ ID NO: 592977 - RNA, 64 nt, hsa; identical to SEQ ID NO: 143796

SEQ ID NO: 592978 - RNA, 64 nt, hsa; identical to SEQ ID NO: 143797

SEQ ID NO: 592979 - RNA, 64 nt, hsa; identical to SEQ ID NO: 143798

SEQ ID NO: 592980 - RNA, 64 nt, hsa; identical to SEQ ID NO: 143799

SEQ ID NO: 592981 - RNA, 64 nt, hsa; identical to SEQ ID NO: 143800

SEQ ID NO: 592982 - RNA, 64 nt, hsa; identical to SEQ ID NO: 143801

SEQ ID NO: 592983 - RNA, 64 nt, hsa; identical to SEQ ID NO: 143802

SEQ ID NO: 592984 - RNA, 64 nt, hsa; identical to SEQ ID NO: 143803

SEQ ID NO: 592985 - RNA, 64 nt, hsa; identical to SEQ ID NO: 143804

SEQ ID NO: 592986 - RNA, 64 nt, hsa; identical to SEQ ID NO: 143805

SEQ ID NO: 592987 - RNA, 64 nt, hsa; identical to SEQ ID NO: 143806

SEQ ID NO: 592988 - RNA, 64 nt, hsa; identical to SEQ ID NO: 143807

SEQ ID NO: 592989 - RNA, 64 nt, hsa; identical to SEQ ID NO: 143808

SEQ ID NO: 592990 - RNA, 64 nt, hsa; identical to SEQ ID NO: 143809

SEQ ID NO: 592991 - RNA, 64 nt, hsa; identical to SEQ ID NO: 143810

SEQ ID NO: 592992 - RNA, 64 nt, hsa; identical to SEQ ID NO: 143811

SEQ ID NO: 592993 - RNA, 64 nt, hsa; identical to SEQ ID NO: 143812

SEQ ID NO: 592994 - RNA, 64 nt, hsa
cgaauguaggaccucugaguggcuguauaauuguuaauucaaaugaaauucauuuaaacaguug

SEQ ID NO: 592995 - RNA, 64 nt, hsa
caauuuaaaaaaucacguuagccuccaaaccauuuaauucaaaugaacccaucaacuggaugcc

SEQ ID NO: 592996 - RNA, 64 nt, hsa
uaagauucuauauuuccuaucuaaaauguuguuguaauucaauuuaaauguguucauguacagu

SEQ ID NO: 592997 - RNA, 64 nt, hsa
uuauaauuaauacagauguuuuacuguuuauuucuaauucaaacacuuaaguagcuuuauuguu

SEQ ID NO: 592998 - RNA, 64 nt, hsa
uuaauuuuuuuuccuuaaagauuggaguauuuuauaauucaaggagcauacaaaacaaugguug

SEQ ID NO: 592999 - RNA, 64 nt, hsa
aacuuuguuguguguaggaaacaugaaggcauguuaauucaauauaaaugaccuuugauuucau

SEQ ID NO: 593000 - RNA, 64 nt, hsa
agccucagaguauuucauauaaauuuucucuaucuaauucaaacauaucuccccaugauacacc

SEQ ID NO: 593001 - RNA, 64 nt, hsa
aaggcaaagcagggaauagaggcaauuagcuagauaauucaagcagaaauccauuuucaucgaa

SEQ ID NO: 593002 - RNA, 64 nt, hsa
uggauucuguggauucuuuaaaccugugugcuaauaauucaaacaauguugcauuaauuguaua

SEQ ID NO: 593003 - RNA, 64 nt, hsa
gaccuuaauuccaggaaagcacagaggacaaaguuaauucaaaaagaggcgcuagaucaagguc

SEQ ID NO: 593004 - RNA, 64 nt, hsa
uuggaauguuauuauaaacucuuagauauuuauauaauucaaaagaaugcauguuucacauugu

SEQ ID NO: 593005 - RNA, 64 nt, hsa
cuuuuaaaguguuacuuuuuguaaacgacaagaauaauucaauuuuaaagacucaaggugguca

SEQ ID NO: 593006 - RNA, 64 nt, hsa
ucuuuugaagaucuaugguugacuaauuaaacaauaauucaaguagagugucccagaaaaaaac

SEQ ID NO: 593007 - RNA, 64 nt, hsa
ucaagugaguucuuaguauuuuauaucagcaaaauaauucaauuuugcagguugcaaacaaaua

SEQ ID NO: 593008 - RNA, 64 nt, hsa
uuaaauaaucuuuucuagcuuaauauuuuaauucuaauucaaacaacucugagguuuugguuuc

SEQ ID NO: 593009 - RNA, 64 nt, hsa
uaacuauucuugaaaugguauugaaaaauaccguuaauucaaauugacagagauugauaaaaag

SEQ ID NO: 593010 - RNA, 64 nt, hsa
gacaguccuuaaugcugaaaacacagagaauggguaauucaagaggccuuucuuuuaaaauaga

SEQ ID NO: 593011 - RNA, 64 nt, hsa
gcaaucuguguacugaacauaguagauugacaucuaauucaagauuacaacaucuguuacauuc

SEQ ID NO: 593012 - RNA, 64 nt, hsa; identical to SEQ ID NO: 48734

SEQ ID NO: 593013 - RNA, 64 nt, hsa; identical to SEQ ID NO: 48735

SEQ ID NO: 593014 - RNA, 64 nt, hsa; identical to SEQ ID NO: 48736

SEQ ID NO: 593015 - RNA, 64 nt, hsa; identical to SEQ ID NO: 48737

SEQ ID NO: 593016 - RNA, 64 nt, hsa; identical to SEQ ID NO: 48738

SEQ ID NO: 593017 - RNA, 64 nt, hsa; identical to SEQ ID NO: 48739

SEQ ID NO: 593018 - RNA, 64 nt, hsa; identical to SEQ ID NO: 48740

SEQ ID NO: 593019 - RNA, 64 nt, hsa; identical to SEQ ID NO: 48741

SEQ ID NO: 593020 - RNA, 64 nt, hsa; identical to SEQ ID NO: 48742

SEQ ID NO: 593021 - RNA, 64 nt, hsa; identical to SEQ ID NO: 48743

SEQ ID NO: 593022 - RNA, 64 nt, hsa; identical to SEQ ID NO: 48744

SEQ ID NO: 593023 - RNA, 64 nt, hsa; identical to SEQ ID NO: 48745

SEQ ID NO: 593024 - RNA, 64 nt, hsa; identical to SEQ ID NO: 48746

SEQ ID NO: 593025 - RNA, 64 nt, hsa; identical to SEQ ID NO: 48747

SEQ ID NO: 593026 - RNA, 64 nt, hsa; identical to SEQ ID NO: 48748

SEQ ID NO: 593027 - RNA, 64 nt, hsa
augagcccaggcauagaggacuagagcccaggugcacgguuagcuucacagcaacagggagcua

SEQ ID NO: 593028 - RNA, 64 nt, hsa
guaagcuguaacuugucauuuuaauuuuguuuaacacgguuacugacuuagaugauguauuaaa

SEQ ID NO: 593029 - RNA, 64 nt, hsa
caggugcacacaccuccacagugaccucugugcacacgguuaccaccaacuggcuggcccuccu

SEQ ID NO: 593030 - RNA, 64 nt, hsa
ugucucgagcccauugguagggucauacaaagcccacgguuacaagcagugguaggauugcagc

SEQ ID NO: 593031 - RNA, 64 nt, hsa
gugguuggauaaaaucaagaaaaggcugaaugagcacgguuacccccaaguggagggguuugua

SEQ ID NO: 593032 - RNA, 64 nt, hsa
gaugauguacaaauugcucuuccagguaauccaccacgguuaacuggaaaagcacuuucagucu

SEQ ID NO: 593033 - RNA, 64 nt, hsa
ccuugccuucacauaccugauguuuaaauuuugucacgguuagucuccaaacuucucaacuuug

SEQ ID NO: 593034 - RNA, 64 nt, hsa
gaguugauagugaauugaauuuucauuaaacagucacgguuagaagaagcuaauauuugaaaca

SEQ ID NO: 593035 - RNA, 64 nt, hsa
gauucaagcagucggagcagccagaacuuucuuucacgguuacuguuccugaaaagaaaaagcc

SEQ ID NO: 593036 - RNA, 64 nt, hsa
uuuuggaauguuuacuuuuggacuggguuuguaacacgguuaaaggcaaugagaaacaagcaga

SEQ ID NO: 593037 - RNA, 64 nt, hsa
uaaaaagaugauggaagguguggugacuaagggccacgguuauugggugaaauuugagauugua

SEQ ID NO: 593038 - RNA, 64 nt, hsa
ccuggacacucugucucgaaaaaaagaaaagaaacacgguuaauaacauauaaauauguaugca

SEQ ID NO: 593039 - RNA, 64 nt, hsa
ggagcccugccucccacugccugacuuccugccacacgguuaaugcugcagcaacaccgacugc

SEQ ID NO: 593040 - RNA, 64 nt, hsa
aagugcagccagcaauuuauuuucauuguuggcccacgguuaguccauaaucuagagccauugu

SEQ ID NO: 593041 - RNA, 64 nt, hsa
aagcucaugcuccccuacgguacaggcugagguacacgguuagcaaaaccaugggaaggggaau

SEQ ID NO: 593042 - RNA, 64 nt, hsa
gggaagcacgggcgacuggacagcagccgccgggcacgguuaugggggcggggugggcggggag

SEQ ID NO: 593043 - RNA, 64 nt, hsa
ucucagugucccuaucuguaagaucaacaagaaacacgguuaagggaggucgucacuggggugg

SEQ ID NO: 593044 - RNA, 64 nt, hsa
gacuucagcauagaucacaggaaaucacauggcacacgguuaaacacguauggcuucaaaucca

SEQ ID NO: 593045 - RNA, 64 nt, hsa
uuuagaaguucaaagugacaauguauagggcuuucacgguuaauggacuuguuaccaaaccuua

SEQ ID NO: 593046 - RNA, 64 nt, hsa
uguaucuguaacacuggcacugaaauaaagaccacacgguuaaagaaaucuuuccauauuguac

SEQ ID NO: 593047 - RNA, 64 nt, hsa
aggggugaguggccguggcugugggcagcauccacacgguuagccgugcaugcacuuuguggcc

SEQ ID NO: 593048 - RNA, 64 nt, hsa
caagucgggaucucagaggaaauugcagugauuccacgguuaggccccccugggggggcugccu

SEQ ID NO: 593049 - RNA, 64 nt, hsa
ggggcaggaaagcaugcauugaaaaauuucuaaccacgguuauuuaagcauaaucugaaaacau

SEQ ID NO: 593050 - RNA, 64 nt, hsa
gggaccagacgugaugcuggaaggugggcgucgucacgguuaaagagaaaugggcucgucccga

SEQ ID NO: 593051 - RNA, 64 nt, hsa
ccacaucuggaaauaaggaugaucauagcuaccucacgguuacauugcaaagccuuacucuaaa

SEQ ID NO: 593052 - RNA, 64 nt, hsa
ugaucucaucaguucugagcgggucauggggcaacacgguuagcggggagagcacgggguagcc

SEQ ID NO: 593053 - RNA, 64 nt, hsa
gucuguggagaggauuuucuugguuacuuguauucacgguuaauuuacaacccaaacagcaaaa

SEQ ID NO: 593054 - RNA, 64 nt, hsa
aggcauagcccugauccuucuggaaggcauagaacacgguuacagcugguucuguagaaagagg

SEQ ID NO: 593055 - RNA, 64 nt, hsa
uuugccaggauuuuguugugcugagauugccaaucacgguuaaacacaaaguguuuuuauagaa

SEQ ID NO: 593056 - RNA, 63 nt, hsa
ucuuuuauaacuuuguuagguuuuugaagcugcaaacacuacaaugcuuugagggggucugug

SEQ ID NO: 593057 - RNA, 63 nt, hsa
uuuucuuuagcuuacauuuuaaacauacacaauaaacacuaauccuccaaacuuucacuguuu

SEQ ID NO: 593058 - RNA, 63 nt, hsa
cuauguuugugaaaaacauaucauguaauucaaaaacacuauugauauugaauaccagauacc

SEQ ID NO: 593059 - RNA, 63 nt, hsa
ucaguguuaacaacaaucaugauaauuaaauuaaaacacuaguuuguucacuuguaggacugc

SEQ ID NO: 593060 - RNA, 63 nt, hsa
gcaagcaucaagugucaaucaaaacugaagaugaaacacuaaugaauguugaauucucaugcu

SEQ ID NO: 593061 - RNA, 63 nt, hsa
acuucuacauaacacaaaccaguggucaaauguaaacacuauauuguagauuuacuguagguu

SEQ ID NO: 593062 - RNA, 63 nt, hsa
gaguguguucaaagaucaacauauuuaacuuuuaaacacuaucucaaagccagcauaauuaac

SEQ ID NO: 593063 - RNA, 63 nt, hsa
agguguucccuggaaaggucaagugagucugggaaacacuaugucuguacaccucuugaaggu

SEQ ID NO: 593064 - RNA, 63 nt, hsa
auuuuuuucuggaaacacuagauguuaucaaucaaacacuaaaauguaccauacaaaucccuu

SEQ ID NO: 593065 - RNA, 63 nt, hsa
ucuucauuaugaacaagaugaauuuuuuucuggaaacacuagauguuaucaaucaaacacuaa

SEQ ID NO: 593066 - RNA, 63 nt, hsa
ccuuaauguaauuuacuuauaaugccagaaggaaaacacuauuuucauacccuacuuuuucug

SEQ ID NO: 593067 - RNA, 63 nt, hsa
auauauauauauauauuuuuaaggugaaauacuaaacacuacuuucugucuguggauucugua

SEQ ID NO: 593068 - RNA, 63 nt, hsa
aaauaauuuuccacaguuccaaacgauaggcucaaacacuagagcugcuaguaaaaagaagac

SEQ ID NO: 593069 - RNA, 63 nt, hsa
aauaaaagcagaauguauaucaucccaucugaaaaacacuaauuauugacaugugcaucugua

SEQ ID NO: 593070 - RNA, 63 nt, hsa
ucuuucuaaaauggaacuuguuaaaaaguguucaaacacuaucccuaaugccugcggcagaau

SEQ ID NO: 593071 - RNA, 63 nt, hsa
agaaauuauuuaaauuacuuuauaguaauuauuaaacacuaauuuuuguacugucauugaagg

SEQ ID NO: 593072 - RNA, 63 nt, hsa
caaaaguauuugcaguacaaaagaaacuauaucaaacacuauguuaaaugacaaguguuuaug

SEQ ID NO: 593073 - RNA, 63 nt, hsa
uacacacacguauuuccuugagauaaacaagauaaacacuaggugcuuuugaauuuuuuucac

SEQ ID NO: 593074 - RNA, 63 nt, hsa
accuuauuuugauuaaaucuuuuccaauuuugcaaacacuacaguauacugcaacacaaaaga

SEQ ID NO: 593075 - RNA, 63 nt, hsa
cuuauuuuucuuggacccaaacugucaggguauaaacacuauuuguuucuuuuuuaaaacauc

SEQ ID NO: 593076 - RNA, 63 nt, hsa
gacagaaggagauggaaugaucaaaucacagagaaacacuaaaauuacuaaaucuacaacagc

SEQ ID NO: 593077 - RNA, 63 nt, hsa
uuuugcuuuuaugcuuuaaagaaugcaugcccaaaacacuacuaccaacaagaggauuuuuua

SEQ ID NO: 593078 - RNA, 63 nt, hsa
gaaauauuuagcuucaggaauacugcucguuauaaacacuacuaaaaaaacaguuuauauuuu

SEQ ID NO: 593079 - RNA, 63 nt, hsa
uauuguuaauuguauucacccuaauaaucuaugaaacacuaggucuuacuucuucuaucuaac

SEQ ID NO: 593080 - RNA, 63 nt, hsa
uuucccaauguuuugucauggcuauuucuacucaaacacuaaucccccauucucuaaucacca

SEQ ID NO: 593081 - RNA, 63 nt, hsa
aauugaauauugaaaaauugacaaauuguguacaaacacuaaaaaaaacuuguuuaaauugua

SEQ ID NO: 593082 - RNA, 63 nt, hsa
auuuacagcaaaauauugaauaaccauugacaaaaacacuauuauuuuuuguaccaaaaauac

SEQ ID NO: 593083 - RNA, 63 nt, hsa
agaauacauuuuaccagcaaaccuaaggaugacaaacacuauccacaucugaaaacuaccaca

SEQ ID NO: 593084 - RNA, 63 nt, hsa
gcuucuuaguucaaaaagaauucugaguuuuucaaacacuagucuagagguggacauugucag

SEQ ID NO: 593085 - RNA, 63 nt, hsa
cuuggaccuuggucaguugugcuauucauuauuaaacacuaaaacuuuggcgguucuugcaua

SEQ ID NO: 593086 - RNA, 63 nt, hsa
aucaacgacuuguaguagacucaaguuuuuaaaaaacacuauuuuacuuaaacuguuucuuau

SEQ ID NO: 593087 - RNA, 63 nt, hsa
cuuuuaauuuuauauaugacagcauuuaaaugcaaacacuaccaugaauuuaauguauaaaau

SEQ ID NO: 593088 - RNA, 63 nt, hsa
uugaagaaucauuguuagaagcauuuccaaacaaaacacuaagcaaaaugggaauuaggcuua

SEQ ID NO: 593089 - RNA, 63 nt, hsa
cuggaaagauguuuucaaggaauuugaaccauaaaacacuaucugaugcacagaacaccucua

SEQ ID NO: 593090 - RNA, 63 nt, hsa
uuuauucauccauccauucaacaaguauuugcuaaacacuaacuuaagcuaaugcuaggguag

SEQ ID NO: 593091 - RNA, 63 nt, hsa
uuucaguaacugaauuugugcacaaaacauucuaaacacuagugaagccuguuucguugaacu

SEQ ID NO: 593092 - RNA, 63 nt, hsa
uaaacacaaaaauaaauuuuuuuucauuuccagaaacacuauuuauuuaugguuuuuuuuuuu

SEQ ID NO: 593093 - RNA, 63 nt, hsa
guugaucuuuagccugucucacaccaguucagaaaacacuagacccaggauugaaaaagcaaa

SEQ ID NO: 593094 - RNA, 64 nt, hsa
aagcuguauccucuaaccacgagacccucaaccagcccaacaucuuccauggacacaugacauu

SEQ ID NO: 593095 - RNA, 64 nt, hsa
uuuuuaaugggccaccuccccacaacagaauucugcccaacacaggagauuucuauaguuauug

SEQ ID NO: 593096 - RNA, 64 nt, hsa
ggcggcgguggcacugaagagauagcuuucaagggcccaacacuuugcacuucggcuggcugug

SEQ ID NO: 593097 - RNA, 51 nt, hsa
ugaucaccaucuacuccuaaugcccaacagcaucacggcacucugggacag

SEQ ID NO: 593098 - RNA, 64 nt, hsa
auaggggaggguuaauaagacuccaacccuaauggcccaacagggaaauucucauuuuggucga

SEQ ID NO: 593099 - RNA, 64 nt, hsa
uguucauagagcuagaaaguagcaucucaugauggcccaacaaucucuguugccaguuaaaggu

SEQ ID NO: 593100 - RNA, 64 nt, hsa
ccugaucucucagccccaaacacccacccaauuggcccaacacugucugccccucgggguguca

SEQ ID NO: 593101 - RNA, 64 nt, hsa
uaguggagcugggggcucucagugguuaaacaaugcccaacaaccaaccagcuggcccuugguc

SEQ ID NO: 593102 - RNA, 64 nt, hsa
ugugagaccuacccuguaacgccugccccucucagcccaacaucagcuuccucuuucucccuug

SEQ ID NO: 593103 - RNA, 64 nt, hsa
gaagaccuccgaccccagcgccaggcuccucggagcccaacagucccaagggggcaggagacgg

SEQ ID NO: 593104 - RNA, 64 nt, hsa; identical to SEQ ID NO: 578935

SEQ ID NO: 593105 - RNA, 64 nt, hsa; identical to SEQ ID NO: 578936

SEQ ID NO: 593106 - RNA, 64 nt, hsa; identical to SEQ ID NO: 578937

SEQ ID NO: 593107 - RNA, 64 nt, hsa; identical to SEQ ID NO: 578938

SEQ ID NO: 593108 - RNA, 64 nt, hsa; identical to SEQ ID NO: 578939

SEQ ID NO: 593109 - RNA, 64 nt, hsa; identical to SEQ ID NO: 578940

SEQ ID NO: 593110 - RNA, 64 nt, hsa; identical to SEQ ID NO: 578941

SEQ ID NO: 593111 - RNA, 64 nt, hsa; identical to SEQ ID NO: 578942

SEQ ID NO: 593112 - RNA, 64 nt, hsa; identical to SEQ ID NO: 70765

SEQ ID NO: 593113 - RNA, 64 nt, hsa; identical to SEQ ID NO: 70766

SEQ ID NO: 593114 - RNA, 64 nt, hsa; identical to SEQ ID NO: 70767

SEQ ID NO: 593115 - RNA, 64 nt, hsa; identical to SEQ ID NO: 70768

SEQ ID NO: 593116 - RNA, 64 nt, hsa; identical to SEQ ID NO: 70769

SEQ ID NO: 593117 - RNA, 64 nt, hsa; identical to SEQ ID NO: 70770

SEQ ID NO: 593118 - RNA, 64 nt, hsa; identical to SEQ ID NO: 70771

SEQ ID NO: 593119 - RNA, 64 nt, hsa; identical to SEQ ID NO: 70772

SEQ ID NO: 593120 - RNA, 64 nt, hsa; identical to SEQ ID NO: 70773

SEQ ID NO: 593121 - RNA, 64 nt, hsa; identical to SEQ ID NO: 70774

SEQ ID NO: 593122 - RNA, 64 nt, hsa; identical to SEQ ID NO: 70775

SEQ ID NO: 593123 - RNA, 64 nt, hsa; identical to SEQ ID NO: 70776

SEQ ID NO: 593124 - RNA, 64 nt, hsa; identical to SEQ ID NO: 70777

SEQ ID NO: 593125 - RNA, 64 nt, hsa; identical to SEQ ID NO: 70778

SEQ ID NO: 593126 - RNA, 64 nt, hsa; identical to SEQ ID NO: 70779

SEQ ID NO: 593127 - RNA, 64 nt, hsa; identical to SEQ ID NO: 70780

SEQ ID NO: 593128 - RNA, 64 nt, hsa; identical to SEQ ID NO: 70781

SEQ ID NO: 593129 - RNA, 64 nt, hsa; identical to SEQ ID NO: 70782

SEQ ID NO: 593130 - RNA, 64 nt, hsa; identical to SEQ ID NO: 70783

SEQ ID NO: 593131 - RNA, 64 nt, hsa; identical to SEQ ID NO: 70784

SEQ ID NO: 593132 - RNA, 64 nt, hsa; identical to SEQ ID NO: 70785

SEQ ID NO: 593133 - RNA, 64 nt, hsa; identical to SEQ ID NO: 70786

SEQ ID NO: 593134 - RNA, 64 nt, hsa; identical to SEQ ID NO: 70787

SEQ ID NO: 593135 - RNA, 64 nt, hsa; identical to SEQ ID NO: 70788

SEQ ID NO: 593136 - RNA, 64 nt, hsa; identical to SEQ ID NO: 70789

SEQ ID NO: 593137 - RNA, 64 nt, hsa; identical to SEQ ID NO: 70790

SEQ ID NO: 593138 - RNA, 64 nt, hsa; identical to SEQ ID NO: 70791

SEQ ID NO: 593139 - RNA, 64 nt, hsa; identical to SEQ ID NO: 70792

SEQ ID NO: 593140 - RNA, 64 nt, hsa; identical to SEQ ID NO: 70793

SEQ ID NO: 593141 - RNA, 64 nt, hsa; identical to SEQ ID NO: 70794

SEQ ID NO: 593142 - RNA, 64 nt, hsa; identical to SEQ ID NO: 70795

SEQ ID NO: 593143 - RNA, 64 nt, hsa; identical to SEQ ID NO: 70796

SEQ ID NO: 593144 - RNA, 64 nt, hsa; identical to SEQ ID NO: 70797

SEQ ID NO: 593145 - RNA, 64 nt, hsa; identical to SEQ ID NO: 70798

SEQ ID NO: 593146 - RNA, 64 nt, hsa; identical to SEQ ID NO: 70799

SEQ ID NO: 593147 - RNA, 64 nt, hsa; identical to SEQ ID NO: 70800

SEQ ID NO: 593148 - RNA, 64 nt, hsa; identical to SEQ ID NO: 70801

SEQ ID NO: 593149 - RNA, 64 nt, hsa; identical to SEQ ID NO: 70802

SEQ ID NO: 593150 - RNA, 64 nt, hsa; identical to SEQ ID NO: 70803

SEQ ID NO: 593151 - RNA, 64 nt, hsa; identical to SEQ ID NO: 70804

SEQ ID NO: 593152 - RNA, 64 nt, hsa; identical to SEQ ID NO: 70805

SEQ ID NO: 593153 - RNA, 64 nt, hsa; identical to SEQ ID NO: 70806

SEQ ID NO: 593154 - RNA, 64 nt, hsa; identical to SEQ ID NO: 70807

SEQ ID NO: 593155 - RNA, 64 nt, hsa; identical to SEQ ID NO: 70808

SEQ ID NO: 593156 - RNA, 64 nt, hsa; identical to SEQ ID NO: 70809

SEQ ID NO: 593157 - RNA, 64 nt, hsa; identical to SEQ ID NO: 70810

SEQ ID NO: 593158 - RNA, 64 nt, hsa; identical to SEQ ID NO: 70811

SEQ ID NO: 593159 - RNA, 64 nt, hsa; identical to SEQ ID NO: 70812

SEQ ID NO: 593160 - RNA, 64 nt, hsa; identical to SEQ ID NO: 70813

SEQ ID NO: 593161 - RNA, 64 nt, hsa; identical to SEQ ID NO: 70814

SEQ ID NO: 593162 - RNA, 64 nt, hsa; identical to SEQ ID NO: 70814

SEQ ID NO: 593163 - RNA, 64 nt, hsa; identical to SEQ ID NO: 70816

SEQ ID NO: 593164 - RNA, 64 nt, hsa; identical to SEQ ID NO: 70817

SEQ ID NO: 593165 - RNA, 64 nt, hsa; identical to SEQ ID NO: 70818

SEQ ID NO: 593166 - RNA, 64 nt, hsa; identical to SEQ ID NO: 70819

SEQ ID NO: 593167 - RNA, 64 nt, hsa; identical to SEQ ID NO: 70820

SEQ ID NO: 593168 - RNA, 64 nt, hsa; identical to SEQ ID NO: 70821

SEQ ID NO: 593169 - RNA, 64 nt, hsa; identical to SEQ ID NO: 70822

SEQ ID NO: 593170 - RNA, 64 nt, hsa; identical to SEQ ID NO: 70823

SEQ ID NO: 593171 - RNA, 64 nt, hsa; identical to SEQ ID NO: 70824

SEQ ID NO: 593172 - RNA, 64 nt, hsa; identical to SEQ ID NO: 70825

SEQ ID NO: 593173 - RNA, 64 nt, hsa; identical to SEQ ID NO: 70826

SEQ ID NO: 593174 - RNA, 64 nt, hsa; identical to SEQ ID NO: 70827

SEQ ID NO: 593175 - RNA, 64 nt, hsa; identical to SEQ ID NO: 70828

SEQ ID NO: 593176 - RNA, 64 nt, hsa; identical to SEQ ID NO: 70829

SEQ ID NO: 593177 - RNA, 64 nt, hsa
caauaaagggauggcccuccuggcuucagcauccugcagguagagcagccucauuccuucacaa

SEQ ID NO: 593178 - RNA, 64 nt, hsa
ugucuugagcaggcaccaucccuguccccuugcuugcagguagaauuggcacagaguuaagguu

SEQ ID NO: 593179 - RNA, 64 nt, hsa
uuagugauguguuacccaggaugcagcaggugugugcagguaucuugcucucuaggccugugug

SEQ ID NO: 593180 - RNA, 64 nt, hsa
acugccccagucuuugacugguuacccuccucucugcagguagguuuuucuggaugauaggaca

SEQ ID NO: 593181 - RNA, 64 nt, hsa
gugaccagucagaauaaugucaaagugcuuacagugcagguagugauaugugcaucuacugcag

SEQ ID NO: 593182 - RNA, 64 nt, hsa
ugugacagcuucuguagcacuaaagugcuuauagugcagguaguguuuaguuaucuacugcauu

SEQ ID NO: 593183 - RNA, 64 nt, hsa
ggcagcuucuacuuucuggaauugaauccucggcugcagguagagcacccuuguacagagaugg

SEQ ID NO: 593184 - RNA, 64 nt, hsa
gggauaagauugcaucuuccauaguggcucaaacugcagguaucccaacucuucccuggagcgg

SEQ ID NO: 593185 - RNA, 64 nt, hsa; identical to SEQ ID NO: 212929

SEQ ID NO: 593186 - RNA, 64 nt, hsa; identical to SEQ ID NO: 212930

SEQ ID NO: 593187 - RNA, 64 nt, hsa; identical to SEQ ID NO: 212931

SEQ ID NO: 593188 - RNA, 64 nt, hsa; identical to SEQ ID NO: 212932

SEQ ID NO: 593189 - RNA, 64 nt, hsa; identical to SEQ ID NO: 212933

SEQ ID NO: 593190 - RNA, 64 nt, hsa; identical to SEQ ID NO: 212934

SEQ ID NO: 593191 - RNA, 64 nt, hsa; identical to SEQ ID NO: 212935

SEQ ID NO: 593192 - RNA, 64 nt, hsa; identical to SEQ ID NO: 212936

SEQ ID NO: 593193 - RNA, 64 nt, hsa; identical to SEQ ID NO: 212937

SEQ ID NO: 593194 - RNA, 64 nt, hsa; identical to SEQ ID NO: 212938

SEQ ID NO: 593195 - RNA, 64 nt, hsa; identical to SEQ ID NO: 212939

SEQ ID NO: 593196 - RNA, 64 nt, hsa; identical to SEQ ID NO: 212940

SEQ ID NO: 593197 - RNA, 64 nt, hsa; identical to SEQ ID NO: 212941

SEQ ID NO: 593198 - RNA, 64 nt, hsa; identical to SEQ ID NO: 212942

SEQ ID NO: 593199 - RNA, 64 nt, hsa; identical to SEQ ID NO: 212943

SEQ ID NO: 593200 - RNA, 64 nt, hsa; identical to SEQ ID NO: 212944

SEQ ID NO: 593201 - RNA, 64 nt, hsa; identical to SEQ ID NO: 212945

SEQ ID NO: 593202 - RNA, 64 nt, hsa; identical to SEQ ID NO: 212946

SEQ ID NO: 593203 - RNA, 64 nt, hsa; identical to SEQ ID NO: 212947

SEQ ID NO: 593204 - RNA, 64 nt, hsa; identical to SEQ ID NO: 212948

SEQ ID NO: 593205 - RNA, 64 nt, hsa; identical to SEQ ID NO: 212949

SEQ ID NO: 593206 - RNA, 64 nt, hsa; identical to SEQ ID NO: 212950

SEQ ID NO: 593207 - RNA, 64 nt, hsa; identical to SEQ ID NO: 212951

SEQ ID NO: 593208 - RNA, 64 nt, hsa; identical to SEQ ID NO: 212952

SEQ ID NO: 593209 - RNA, 64 nt, hsa; identical to SEQ ID NO: 212953

SEQ ID NO: 593210 - RNA, 64 nt, hsa; identical to SEQ ID NO: 212954

SEQ ID NO: 593211 - RNA, 64 nt, hsa; identical to SEQ ID NO: 212955

SEQ ID NO: 593212 - RNA, 64 nt, hsa; identical to SEQ ID NO: 212956

SEQ ID NO: 593213 - RNA, 64 nt, hsa; identical to SEQ ID NO: 212957

SEQ ID NO: 593214 - RNA, 64 nt, hsa
uuggucucacucugucucucuaccuggucaucuucaaggcuaagaaaacaaacaagcuacauuc

SEQ ID NO: 593215 - RNA, 64 nt, hsa
gagccuugggaauaguuuggcagguuuaacaucccaaggcuaaccuaacguaguugggaaaggu

SEQ ID NO: 593216 - RNA, 64 nt, hsa
gucaucgccacucaaguaggacaaggguccuacccaaggcuaggaccgcccugcggaaacagaa

SEQ ID NO: 593217 - RNA, 64 nt, hsa
ugugggguauuuguuucuacuccagccuggcaggcaaggcuaaaaccugagauuaucgaucuau

SEQ ID NO: 593218 - RNA, 64 nt, hsa
ucugcuuauaagaagugagagagaagaaaaaucaugucccaaguucugagaauuguucacacuu

SEQ ID NO: 593219 - RNA, 64 nt, hsa
cuccuuuuuccuuccuugaagaaaaauucuuggcugucccaaggauucuucauguauauugcaa

SEQ ID NO: 593220 - RNA, 64 nt, hsa
uggaaaagaaaguacagaacaaacccugugucacugucccaaguugcuaagugaacagaacuau

SEQ ID NO: 593221 - RNA, 64 nt, hsa
aauugaaguuucagagcuacacaaacacuuuuucugucccaaccguucccucacagcaaagcaa

SEQ ID NO: 593222 - RNA, 64 nt, hsa
aggaugucucaaauuuccaguaaauaaauuuuaaugucccaaaauacccacuaugucuguaugu

SEQ ID NO: 593223 - RNA, 64 nt, hsa
auuuguuugaaccuuauccugugaaagcauuaucugucccaaacaguauaugccuuuuaucagg

SEQ ID NO: 593224 - RNA, 64 nt, hsa
cuuggucagugaaaagaugcuacuauauugcuuuugucccaaagugaguaaaauccccuagagc

SEQ ID NO: 593225 - RNA, 64 nt, hsa
uuuacauuggauacucuguaaguaggagguacuuugucccaaaaagauguauaagaauguacua

SEQ ID NO: 593226 - RNA, 64 nt, hsa
cucucuucuagugucuaucuuuaucauaaccugaugucccaaacuugugacaaguucuuuuggc

SEQ ID NO: 593227 - RNA, 64 nt, hsa
acugggaaaucuuacaaggaguugaaaagauuaaugucccaaccugaugagauuacggccuuga

SEQ ID NO: 593228 - RNA, 64 nt, hsa
aucauccugcagacagacaauaauucuggagauacugguggaaguuccaaguccaauaagacac

SEQ ID NO: 593229 - RNA, 64 nt, hsa
uaugagcuugcucauuaauuuugaaaagauguaccugguggauaucuagcuaguaauauauucu

SEQ ID NO: 593230 - RNA, 64 nt, hsa
ucuuuuuugccaugaguaggagccccuaguggggcugguggacagcuuuggaagagguguccug

SEQ ID NO: 593231 - RNA, 64 nt, hsa
ggggcacugcgccugcugcccuuuccuggcagggcugguggagucuucccucaaagcaugccuu

SEQ ID NO: 593232 - RNA, 64 nt, hsa
cugccuuaugaccuaggacugaugcuguggggugcugguggagcagcugaugucguguuuacag

SEQ ID NO: 593233 - RNA, 64 nt, hsa
acuuccucaugggggcuugcucauaccgccccuccugguggauguguguguuuauuauguggag

SEQ ID NO: 593234 - RNA, 64 nt, hsa
cuguaaaauguuaguuuugguaauuuuuuuucugcugguggauuuacauauuaaauuuuuucug

SEQ ID NO: 593235 - RNA, 64 nt, hsa
ucugcugguggauuuacauauuaaauuuuuucugcugguggauaaacauuaaaauuaaucaugu

SEQ ID NO: 593236 - RNA, 64 nt, hsa
cuugcaguggugcuccaagggucgcugccgcucccugguggagcugacccccauagcagcagug

SEQ ID NO: 593237 - RNA, 64 nt, hsa
ugggaggugucagagcccagcucaugcacaucagcugguggagcaggccuggccuuggagaacg

SEQ ID NO: 593238 - RNA, 64 nt, hsa
ccaccugagcgaguaaugucaacuucgggagggucugguggacuuucuccccacuccccaaguc

SEQ ID NO: 593239 - RNA, 64 nt, hsa
ggugaugugacuuuucuucuuacaugcugaaucacugguggaaacguuaggauaagcaagaauu

SEQ ID NO: 593240 - RNA, 64 nt, hsa
auacaugaaaauuccaguuauuaacacacucaaacugguggagcuuguucacccuaggaagggg

SEQ ID NO: 593241 - RNA, 64 nt, hsa
uaacaaugguggccaccugggucccagcacuuggcugguggagagauuuuuuucauuauggagc

SEQ ID NO: 593242 - RNA, 64 nt, hsa
aggacacucagcaaaaauaaguagcuaccuacuacugguggauucuuuuccuuauagugaauuu

SEQ ID NO: 593243 - RNA, 64 nt, hsa
gcaaaagagggacaggaggaaaaugaaaccuguucugguggaaaugaaaaccaagagcuacaag

SEQ ID NO: 593244 - RNA, 64 nt, hsa
cuggcacugauaccccucuuggugggcagcugcucugguggaguugggaagggauaggaccugg

SEQ ID NO: 593245 - RNA, 64 nt, hsa
gugccuccagggagccuuccuggucccaggaccucugguggagggccauggcguggaccuucac

SEQ ID NO: 593246 - RNA, 64 nt, hsa
gcauuucuaacaggcuccugcccccaagacugcucugguggaaaauccagccugggagccccug

SEQ ID NO: 593247 - RNA, 64 nt, hsa
aaagcgaugguugacgucugcuguggguuuccuccugguggagugccugucugugucacacacu

SEQ ID NO: 593248 - RNA, 64 nt, hsa
gugguaugagagggauggcucacgaggcuuggaccugguggagggugcccggcagacgugugag

SEQ ID NO: 593249 - RNA, 64 nt, hsa
guggugugagaggaacggcucacgagacuuggaccugguggagggugcccagcagacguggugu

SEQ ID NO: 593250 - RNA, 64 nt, hsa
aaaguccuaaccccugcucggggccccacggaugcugguggacugugugccccugguggaggug

SEQ ID NO: 593251 - RNA, 64 nt, hsa
cccucccugcaggaugcugguggacugugugccccugguggagguggacgacaugaugaucaug

SEQ ID NO: 593252 - RNA, 64 nt, hsa
ccaggguggcuuccagcuaccccugacuuagagccugguggaggugugguucuucagaagucag

SEQ ID NO: 593253 - RNA, 64 nt, hsa
acgccuguaaucccagcacuuugggaggccgaggcugguggaucacgaggucaagaguucaaga

SEQ ID NO: 593254 - RNA, 64 nt, hsa
ggacuuuguccaagucucacacuaaacaugcccgggcuucgaugugccuggaggauuuccccac

SEQ ID NO: 593255 - RNA, 64 nt, hsa
gcuggccaccccaguguuuggaaaaaaaucucugggcuucgacugcugccagggaggagcugcu

SEQ ID NO: 593256 - RNA, 64 nt, hsa
cucuuagaacaagguggggcugccuaggagaaggggcuucgaagcagccaggacucuuccuacc

SEQ ID NO: 593257 - RNA, 64 nt, hsa
uggucccagacucucaggacaugcccagcucaggggcuucgagccacaggccuggccucauaug

SEQ ID NO: 593258 - RNA, 64 nt, hsa
cguaucuccuuucgcugcccaaccccgcagccugggcuucgaaggcgacccgcccaccauccug

SEQ ID NO: 593259 - RNA, 64 nt, hsa
ugagcugcauugauguggacuucauagacacaaaggcuucgaagcacaagccaaauaugucaau

SEQ ID NO: 593260 - RNA, 64 nt, hsa
accgggcccagcaggcaaagagagaggccucccuggcuucgagugucaggggagccgcguuccc

SEQ ID NO: 593261 - RNA, 64 nt, hsa
uguggcuacucauuggucuaugaggacgaugacaggcuucgacucugugguuucuaaagcauau

SEQ ID NO: 593262 - RNA, 64 nt, hsa
gggaggcugaggcaggagaaucgcuugagccccaggcuucgaggcugcagugagcuaugauuac

SEQ ID NO: 593263 - RNA, 64 nt, hsa
acccguguuuuguuugaacagcagugucccaucuggcuucgacccaacaaaguucauuaaccug

SEQ ID NO: 593264 - RNA, 64 nt, hsa
gccaaaacgccuggcgccgccaccgucgggggcuggcuucgaggacgcccgccugccucgcggg

SEQ ID NO: 593265 - RNA, 64 nt, hsa
aaugcugcaggaaacgauugccaacuauacgaauggcuucgaggagauaaacugaaauuugcua

SEQ ID NO: 593266 - RNA, 64 nt, hsa
gaaagaacaaugucagccacaucaggaccgcuggggcuucgagucugcccuaauuuggguuugu

SEQ ID NO: 593267 - RNA, 64 nt, hsa
guggcaaaggacucacccccgcacaggcccgccuggcuucgaguuggaacccggacacuugccc

SEQ ID NO: 593268 - RNA, 64 nt, hsa
uuuuauugucaugaacaugaaauacaaacacgauggcuucgaaaugucuuucaauaaauguuuc

SEQ ID NO: 593269 - RNA, 64 nt, hsa
gccugagcaggucucugugggccgaccagaggggggcuucgagguggucccugguacuggggug

SEQ ID NO: 593270 - RNA, 64 nt, hsa
acagcagaaagccaugagagcaggggaaacaaggggcuucgagcacgcuccaugccaggaggca

SEQ ID NO: 593271 - RNA, 64 nt, hsa
ccauugcuuagcuaacuuuuucauucugucacuuggcuucgauuuuuauauuuuccuauuauau

SEQ ID NO: 593272 - RNA, 64 nt, hsa
aauacgggggaccaagcuuuguccaagugaagcaggcuucgacuccuucugagaggucuggugu

SEQ ID NO: 593273 - RNA, 64 nt, hsa
cuagugggaaauguguagaacuguuaacugagauggcuucgagucuuccuucuggaaucuguua

SEQ ID NO: 593274 - RNA, 64 nt, hsa
ccgggacucuaaaaaaaaauuguaauucaugauaggcuucgauuuccugugacacucugaagac

SEQ ID NO: 593275 - RNA, 64 nt, hsa
acagcugaacaugccgcuguccgaggucugcgagggcuucgacgaggagggccgcaacauuagc

SEQ ID NO: 593276 - RNA, 64 nt, hsa
aacacaacagggcacagcaaauacgacuucauuuggcuucgaguuccccaggcgcuguagacac

SEQ ID NO: 593277 - RNA, 64 nt, hsa
auauugccaaagugguuuccagaaaggcacugcuggcuucgacuccuauaagcagcacgugggc

SEQ ID NO: 593278 - RNA, 64 nt, hsa
ccucagcccgcgcagaaugugcucgcugccccgcggcuucgagccccaagcucccgaggacuug

SEQ ID NO: 593279 - RNA, 64 nt, hsa
agcccuguacgagcagcgggccgagccacgcagcggcuucgaggagcuggugcguugccccacc

SEQ ID NO: 593280 - RNA, 64 nt, hsa
cugagucccgcagggcugcggaggggcgcgcuggggcuucgaccuggcugcacuaacccaggcu

SEQ ID NO: 593281 - RNA, 64 nt, hsa
gagcccuugggcaggcauguuuggagaugagagaggcuucgagagggugggugcugggccacag

SEQ ID NO: 593282 - RNA, 64 nt, hsa
ucuuuggauguugauguguguuucucucacccucggcuucgauggucuuguucagagcugcaua

SEQ ID NO: 593283 - RNA, 64 nt, hsa
ggagccagacuagccccgcccaccaacgagucccggcuucgaguagugauacgcaugaacaaag

SEQ ID NO: 593284 - RNA, 64 nt, hsa
cccauccucccucugccaggcacuaugugucuggggcuucgauccuugggugcaggcagggcug

SEQ ID NO: 593285 - RNA, 64 nt, hsa
cguggguaaggggccccccugggauggggagaagggcuucgaagauaaacugagcuccauuccc

SEQ ID NO: 593286 - RNA, 64 nt, hsa
cauagucgcaugcucgcaucuuuguuuuuaaucuggcuucgaacauagcacaaguaacuugaau

SEQ ID NO: 593287 - RNA, 64 nt, hsa
ggucuccacguguaugaugggguucucaggcccaggcuucgaccagaggacccucugccaccac

SEQ ID NO: 593288 - RNA, 64 nt, hsa
ugaugggcugggcccuccgcacggcccgccagcuggcuucgaggaaccuccaggagagaagugc

SEQ ID NO: 593289 - RNA, 64 nt, hsa
cuuagcuuggggcuggcugcauucccccaggaugggcuucgagaaagacaaacuugucuggaaa

SEQ ID NO: 593290 - RNA, 64 nt, hsa; identical to SEQ ID NO: 267307

SEQ ID NO: 593291 - RNA, 64 nt, hsa; identical to SEQ ID NO: 267308

SEQ ID NO: 593292 - RNA, 64 nt, hsa; identical to SEQ ID NO: 267309

SEQ ID NO: 593293 - RNA, 64 nt, hsa; identical to SEQ ID NO: 267310

SEQ ID NO: 593294 - RNA, 64 nt, hsa; identical to SEQ ID NO: 267311

SEQ ID NO: 593295 - RNA, 64 nt, hsa; identical to SEQ ID NO: 267312

SEQ ID NO: 593296 - RNA, 64 nt, hsa; identical to SEQ ID NO: 267313

SEQ ID NO: 593297 - RNA, 64 nt, hsa; identical to SEQ ID NO: 267314

SEQ ID NO: 593298 - RNA, 64 nt, hsa; identical to SEQ ID NO: 267315

SEQ ID NO: 593299 - RNA, 64 nt, hsa; identical to SEQ ID NO: 267316

SEQ ID NO: 593300 - RNA, 64 nt, hsa; identical to SEQ ID NO: 267317

SEQ ID NO: 593301 - RNA, 64 nt, hsa; identical to SEQ ID NO: 267318

SEQ ID NO: 593302 - RNA, 64 nt, hsa; identical to SEQ ID NO: 267319

SEQ ID NO: 593303 - RNA, 64 nt, hsa; identical to SEQ ID NO: 267320

SEQ ID NO: 593304 - RNA, 64 nt, hsa; identical to SEQ ID NO: 267321

SEQ ID NO: 593305 - RNA, 64 nt, hsa; identical to SEQ ID NO: 267322

SEQ ID NO: 593306 - RNA, 64 nt, hsa; identical to SEQ ID NO: 267323

SEQ ID NO: 593307 - RNA, 64 nt, hsa; identical to SEQ ID NO: 267324

SEQ ID NO: 593308 - RNA, 64 nt, hsa; identical to SEQ ID NO: 267325

SEQ ID NO: 593309 - RNA, 64 nt, hsa; identical to SEQ ID NO: 267326

SEQ ID NO: 593310 - RNA, 64 nt, hsa; identical to SEQ ID NO: 267327

SEQ ID NO: 593311 - RNA, 64 nt, hsa; identical to SEQ ID NO: 267328

SEQ ID NO: 593312 - RNA, 64 nt, hsa; identical to SEQ ID NO: 267329

SEQ ID NO: 593313 - RNA, 64 nt, hsa; identical to SEQ ID NO: 267330

SEQ ID NO: 593314 - RNA, 64 nt, hsa; identical to SEQ ID NO: 267331

SEQ ID NO: 593315 - RNA, 64 nt, hsa; identical to SEQ ID NO: 267332

SEQ ID NO: 593316 - RNA, 64 nt, hsa; identical to SEQ ID NO: 267333

SEQ ID NO: 593317 - RNA, 64 nt, hsa; identical to SEQ ID NO: 267334

SEQ ID NO: 593318 - RNA, 64 nt, hsa; identical to SEQ ID NO: 267335

SEQ ID NO: 593319 - RNA, 64 nt, hsa; identical to SEQ ID NO: 267336

SEQ ID NO: 593320 - RNA, 64 nt, hsa; identical to SEQ ID NO: 267337

SEQ ID NO: 593321 - RNA, 64 nt, hsa; identical to SEQ ID NO: 267338

SEQ ID NO: 593322 - RNA, 64 nt, hsa; identical to SEQ ID NO: 267339

SEQ ID NO: 593323 - RNA, 64 nt, hsa; identical to SEQ ID NO: 267340

SEQ ID NO: 593324 - RNA, 64 nt, hsa; identical to SEQ ID NO: 267341

SEQ ID NO: 593325 - RNA, 64 nt, hsa; identical to SEQ ID NO: 267342

SEQ ID NO: 593326 - RNA, 64 nt, hsa; identical to SEQ ID NO: 267343

SEQ ID NO: 593327 - RNA, 64 nt, hsa; identical to SEQ ID NO: 267344

SEQ ID NO: 593328 - RNA, 64 nt, hsa; identical to SEQ ID NO: 267345

SEQ ID NO: 593329 - RNA, 64 nt, hsa; identical to SEQ ID NO: 267346

SEQ ID NO: 593330 - RNA, 64 nt, hsa; identical to SEQ ID NO: 267347

SEQ ID NO: 593331 - RNA, 64 nt, hsa; identical to SEQ ID NO: 267348

SEQ ID NO: 593332 - RNA, 64 nt, hsa; identical to SEQ ID NO: 267349

SEQ ID NO: 593333 - RNA, 64 nt, hsa; identical to SEQ ID NO: 267350

SEQ ID NO: 593334 - RNA, 64 nt, hsa; identical to SEQ ID NO: 267351

SEQ ID NO: 593335 - RNA, 64 nt, hsa; identical to SEQ ID NO: 267352

SEQ ID NO: 593336 - RNA, 64 nt, hsa; identical to SEQ ID NO: 267353

SEQ ID NO: 593337 - RNA, 64 nt, hsa; identical to SEQ ID NO: 267354

SEQ ID NO: 593338 - RNA, 64 nt, hsa; identical to SEQ ID NO: 267355

SEQ ID NO: 593339 - RNA, 64 nt, hsa; identical to SEQ ID NO: 267356

SEQ ID NO: 593340 - RNA, 64 nt, hsa; identical to SEQ ID NO: 267357

SEQ ID NO: 593341 - RNA, 64 nt, hsa; identical to SEQ ID NO: 267358

SEQ ID NO: 593342 - RNA, 64 nt, hsa; identical to SEQ ID NO: 267359

SEQ ID NO: 593343 - RNA, 64 nt, hsa; identical to SEQ ID NO: 267360

SEQ ID NO: 593344 - RNA, 64 nt, hsa; identical to SEQ ID NO: 267361

SEQ ID NO: 593345 - RNA, 63 nt, hsa; identical to SEQ ID NO: 267362

SEQ ID NO: 593346 - RNA, 64 nt, hsa; identical to SEQ ID NO: 267363

SEQ ID NO: 593347 - RNA, 64 nt, hsa; identical to SEQ ID NO: 267364

SEQ ID NO: 593348 - RNA, 64 nt, hsa; identical to SEQ ID NO: 267365

SEQ ID NO: 593349 - RNA, 64 nt, hsa; identical to SEQ ID NO: 267366

SEQ ID NO: 593350 - RNA, 64 nt, hsa; identical to SEQ ID NO: 267367

SEQ ID NO: 593351 - RNA, 64 nt, hsa; identical to SEQ ID NO: 267368

SEQ ID NO: 593352 - RNA, 64 nt, hsa; identical to SEQ ID NO: 267369

SEQ ID NO: 593353 - RNA, 64 nt, hsa; identical to SEQ ID NO: 267370

SEQ ID NO: 593354 - RNA, 64 nt, hsa; identical to SEQ ID NO: 267371

SEQ ID NO: 593355 - RNA, 64 nt, hsa; identical to SEQ ID NO: 267372

SEQ ID NO: 593356 - RNA, 64 nt, hsa; identical to SEQ ID NO: 267373

SEQ ID NO: 593357 - RNA, 64 nt, hsa; identical to SEQ ID NO: 267374

SEQ ID NO: 593358 - RNA, 64 nt, hsa; identical to SEQ ID NO: 267375

SEQ ID NO: 593359 - RNA, 64 nt, hsa; identical to SEQ ID NO: 267376

SEQ ID NO: 593360 - RNA, 64 nt, hsa; identical to SEQ ID NO: 267377

SEQ ID NO: 593361 - RNA, 64 nt, hsa; identical to SEQ ID NO: 267378

SEQ ID NO: 593362 - RNA, 64 nt, hsa; identical to SEQ ID NO: 267379

SEQ ID NO: 593363 - RNA, 64 nt, hsa; identical to SEQ ID NO: 267380

SEQ ID NO: 593364 - RNA, 64 nt, hsa; identical to SEQ ID NO: 267381

SEQ ID NO: 593365 - RNA, 64 nt, hsa; identical to SEQ ID NO: 267382

SEQ ID NO: 593366 - RNA, 64 nt, hsa; identical to SEQ ID NO: 267383

SEQ ID NO: 593367 - RNA, 64 nt, hsa; identical to SEQ ID NO: 267384

SEQ ID NO: 593368 - RNA, 64 nt, hsa; identical to SEQ ID NO: 267385

SEQ ID NO: 593369 - RNA, 64 nt, hsa; identical to SEQ ID NO: 267386

SEQ ID NO: 593370 - RNA, 64 nt, hsa; identical to SEQ ID NO: 267387

SEQ ID NO: 593371 - RNA, 64 nt, hsa; identical to SEQ ID NO: 267388

SEQ ID NO: 593372 - RNA, 64 nt, hsa; identical to SEQ ID NO: 267389

SEQ ID NO: 593373 - RNA, 64 nt, hsa; identical to SEQ ID NO: 267390

SEQ ID NO: 593374 - RNA, 64 nt, hsa; identical to SEQ ID NO: 267391

SEQ ID NO: 593375 - RNA, 64 nt, hsa; identical to SEQ ID NO: 267392

SEQ ID NO: 593376 - RNA, 64 nt, hsa; identical to SEQ ID NO: 267393

SEQ ID NO: 593377 - RNA, 64 nt, hsa; identical to SEQ ID NO: 267394

SEQ ID NO: 593378 - RNA, 64 nt, hsa; identical to SEQ ID NO: 267395

SEQ ID NO: 593379 - RNA, 64 nt, hsa; identical to SEQ ID NO: 267396

SEQ ID NO: 593380 - RNA, 64 nt, hsa; identical to SEQ ID NO: 267397

SEQ ID NO: 593381 - RNA, 64 nt, hsa; identical to SEQ ID NO: 267398

SEQ ID NO: 593382 - RNA, 64 nt, hsa; identical to SEQ ID NO: 267399

SEQ ID NO: 593383 - RNA, 64 nt, hsa; identical to SEQ ID NO: 267400

SEQ ID NO: 593384 - RNA, 64 nt, hsa; identical to SEQ ID NO: 267401

SEQ ID NO: 593385 - RNA, 64 nt, hsa; identical to SEQ ID NO: 267402

SEQ ID NO: 593386 - RNA, 64 nt, hsa; identical to SEQ ID NO: 267403

SEQ ID NO: 593387 - RNA, 64 nt, hsa; identical to SEQ ID NO: 267404

SEQ ID NO: 593388 - RNA, 64 nt, hsa; identical to SEQ ID NO: 267405

SEQ ID NO: 593389 - RNA, 64 nt, hsa; identical to SEQ ID NO: 267406

SEQ ID NO: 593390 - RNA, 64 nt, hsa; identical to SEQ ID NO: 267407

SEQ ID NO: 593391 - RNA, 64 nt, hsa; identical to SEQ ID NO: 267408

SEQ ID NO: 593392 - RNA, 64 nt, hsa; identical to SEQ ID NO: 267409

SEQ ID NO: 593393 - RNA, 64 nt, hsa; identical to SEQ ID NO: 267410

SEQ ID NO: 593394 - RNA, 64 nt, hsa; identical to SEQ ID NO: 267411

SEQ ID NO: 593395 - RNA, 64 nt, hsa; identical to SEQ ID NO: 267412

SEQ ID NO: 593396 - RNA, 64 nt, hsa; identical to SEQ ID NO: 267413

SEQ ID NO: 593397 - RNA, 64 nt, hsa; identical to SEQ ID NO: 267414

SEQ ID NO: 593398 - RNA, 64 nt, hsa; identical to SEQ ID NO: 267415

SEQ ID NO: 593399 - RNA, 64 nt, hsa; identical to SEQ ID NO: 267416

SEQ ID NO: 593400 - RNA, 64 nt, hsa; identical to SEQ ID NO: 267417

SEQ ID NO: 593401 - RNA, 64 nt, hsa; identical to SEQ ID NO: 267418

SEQ ID NO: 593402 - RNA, 64 nt, hsa; identical to SEQ ID NO: 267419

SEQ ID NO: 593403 - RNA, 64 nt, hsa; identical to SEQ ID NO: 267420

SEQ ID NO: 593404 - RNA, 64 nt, hsa; identical to SEQ ID NO: 267421

SEQ ID NO: 593405 - RNA, 64 nt, hsa; identical to SEQ ID NO: 267422

SEQ ID NO: 593406 - RNA, 64 nt, hsa; identical to SEQ ID NO: 267423

SEQ ID NO: 593407 - RNA, 64 nt, hsa; identical to SEQ ID NO: 267424

SEQ ID NO: 593408 - RNA, 64 nt, hsa; identical to SEQ ID NO: 267425

SEQ ID NO: 593409 - RNA, 64 nt, hsa; identical to SEQ ID NO: 267426

SEQ ID NO: 593410 - RNA, 64 nt, hsa; identical to SEQ ID NO: 267427

SEQ ID NO: 593411 - RNA, 64 nt, hsa; identical to SEQ ID NO: 267428

SEQ ID NO: 593412 - RNA, 64 nt, hsa; identical to SEQ ID NO: 267429

SEQ ID NO: 593413 - RNA, 64 nt, hsa; identical to SEQ ID NO: 267430

SEQ ID NO: 593414 - RNA, 64 nt, hsa; identical to SEQ ID NO: 267431

SEQ ID NO: 593415 - RNA, 64 nt, hsa; identical to SEQ ID NO: 267432

SEQ ID NO: 593416 - RNA, 64 nt, hsa; identical to SEQ ID NO: 267433

SEQ ID NO: 593417 - RNA, 64 nt, hsa; identical to SEQ ID NO: 267434

SEQ ID NO: 593418 - RNA, 64 nt, hsa; identical to SEQ ID NO: 267435

SEQ ID NO: 593419 - RNA, 64 nt, hsa; identical to SEQ ID NO: 267436

SEQ ID NO: 593420 - RNA, 64 nt, hsa; identical to SEQ ID NO: 267437

SEQ ID NO: 593421 - RNA, 64 nt, hsa; identical to SEQ ID NO: 267438

SEQ ID NO: 593422 - RNA, 64 nt, hsa; identical to SEQ ID NO: 267439

SEQ ID NO: 593423 - RNA, 64 nt, hsa; identical to SEQ ID NO: 267440

SEQ ID NO: 593424 - RNA, 64 nt, hsa; identical to SEQ ID NO: 267441

SEQ ID NO: 593425 - RNA, 64 nt, hsa; identical to SEQ ID NO: 267442

SEQ ID NO: 593426 - RNA, 64 nt, hsa; identical to SEQ ID NO: 267443

SEQ ID NO: 593427 - RNA, 64 nt, hsa; identical to SEQ ID NO: 267444

SEQ ID NO: 593428 - RNA, 64 nt, hsa; identical to SEQ ID NO: 267445

SEQ ID NO: 593429 - RNA, 64 nt, hsa; identical to SEQ ID NO: 267446

SEQ ID NO: 593430 - RNA, 64 nt, hsa; identical to SEQ ID NO: 267447

SEQ ID NO: 593431 - RNA, 64 nt, hsa; identical to SEQ ID NO: 267448

SEQ ID NO: 593432 - RNA, 64 nt, hsa; identical to SEQ ID NO: 267449

SEQ ID NO: 593433 - RNA, 64 nt, hsa; identical to SEQ ID NO: 267450

SEQ ID NO: 593434 - RNA, 64 nt, hsa; identical to SEQ ID NO: 267451

SEQ ID NO: 593435 - RNA, 64 nt, hsa; identical to SEQ ID NO: 267452

SEQ ID NO: 593436 - RNA, 64 nt, hsa; identical to SEQ ID NO: 267453

SEQ ID NO: 593437 - RNA, 64 nt, hsa; identical to SEQ ID NO: 267454

SEQ ID NO: 593438 - RNA, 64 nt, hsa; identical to SEQ ID NO: 267455

SEQ ID NO: 593439 - RNA, 64 nt, hsa; identical to SEQ ID NO: 267456

SEQ ID NO: 593440 - RNA, 64 nt, hsa; identical to SEQ ID NO: 267457

SEQ ID NO: 593441 - RNA, 64 nt, hsa; identical to SEQ ID NO: 267458

SEQ ID NO: 593442 - RNA, 64 nt, hsa; identical to SEQ ID NO: 267459

SEQ ID NO: 593443 - RNA, 64 nt, hsa; identical to SEQ ID NO: 267460

SEQ ID NO: 593444 - RNA, 64 nt, hsa; identical to SEQ ID NO: 267461

SEQ ID NO: 593445 - RNA, 64 nt, hsa; identical to SEQ ID NO: 267462

SEQ ID NO: 593446 - RNA, 64 nt, hsa; identical to SEQ ID NO: 267463

SEQ ID NO: 593447 - RNA, 64 nt, hsa; identical to SEQ ID NO: 267464

SEQ ID NO: 593448 - RNA, 64 nt, hsa; identical to SEQ ID NO: 267465

SEQ ID NO: 593449 - RNA, 64 nt, hsa; identical to SEQ ID NO: 267466

SEQ ID NO: 593450 - RNA, 64 nt, hsa; identical to SEQ ID NO: 267467

SEQ ID NO: 593451 - RNA, 64 nt, hsa; identical to SEQ ID NO: 267468

SEQ ID NO: 593452 - RNA, 64 nt, hsa; identical to SEQ ID NO: 267469

SEQ ID NO: 593453 - RNA, 64 nt, hsa; identical to SEQ ID NO: 267470

SEQ ID NO: 593454 - RNA, 64 nt, hsa; identical to SEQ ID NO: 267471

SEQ ID NO: 593455 - RNA, 64 nt, hsa; identical to SEQ ID NO: 267472

SEQ ID NO: 593456 - RNA, 64 nt, hsa; identical to SEQ ID NO: 267473

SEQ ID NO: 593457 - RNA, 64 nt, hsa; identical to SEQ ID NO: 267474

SEQ ID NO: 593458 - RNA, 64 nt, hsa; identical to SEQ ID NO: 267475

SEQ ID NO: 593459 - RNA, 64 nt, hsa; identical to SEQ ID NO: 267476

SEQ ID NO: 593460 - RNA, 64 nt, hsa; identical to SEQ ID NO: 267477

SEQ ID NO: 593461 - RNA, 64 nt, hsa; identical to SEQ ID NO: 267478

SEQ ID NO: 593462 - RNA, 64 nt, hsa; identical to SEQ ID NO: 267479

SEQ ID NO: 593463 - RNA, 64 nt, hsa; identical to SEQ ID NO: 267480

SEQ ID NO: 593464 - RNA, 64 nt, hsa; identical to SEQ ID NO: 267481

SEQ ID NO: 593465 - RNA, 64 nt, hsa; identical to SEQ ID NO: 267482

SEQ ID NO: 593466 - RNA, 64 nt, hsa; identical to SEQ ID NO: 267483

SEQ ID NO: 593467 - RNA, 64 nt, hsa; identical to SEQ ID NO: 267484

SEQ ID NO: 593468 - RNA, 64 nt, hsa; identical to SEQ ID NO: 267485

SEQ ID NO: 593469 - RNA, 64 nt, hsa; identical to SEQ ID NO: 267486

SEQ ID NO: 593470 - RNA, 64 nt, hsa; identical to SEQ ID NO: 267487

SEQ ID NO: 593471 - RNA, 64 nt, hsa; identical to SEQ ID NO: 267488

SEQ ID NO: 593472 - RNA, 64 nt, hsa; identical to SEQ ID NO: 267489

SEQ ID NO: 593473 - RNA, 64 nt, hsa; identical to SEQ ID NO: 267490

SEQ ID NO: 593474 - RNA, 64 nt, hsa; identical to SEQ ID NO: 267491

SEQ ID NO: 593475 - RNA, 64 nt, hsa; identical to SEQ ID NO: 267492

SEQ ID NO: 593476 - RNA, 64 nt, hsa; identical to SEQ ID NO: 267493

SEQ ID NO: 593477 - RNA, 64 nt, hsa; identical to SEQ ID NO: 267494

SEQ ID NO: 593478 - RNA, 64 nt, hsa; identical to SEQ ID NO: 267495

SEQ ID NO: 593479 - RNA, 64 nt, hsa; identical to SEQ ID NO: 267496

SEQ ID NO: 593480 - RNA, 64 nt, hsa; identical to SEQ ID NO: 267497

SEQ ID NO: 593481 - RNA, 64 nt, hsa; identical to SEQ ID NO: 267498

SEQ ID NO: 593482 - RNA, 64 nt, hsa; identical to SEQ ID NO: 267499

SEQ ID NO: 593483 - RNA, 64 nt, hsa; identical to SEQ ID NO: 267500

SEQ ID NO: 593484 - RNA, 64 nt, hsa; identical to SEQ ID NO: 267501

SEQ ID NO: 593485 - RNA, 64 nt, hsa; identical to SEQ ID NO: 267502

SEQ ID NO: 593486 - RNA, 64 nt, hsa; identical to SEQ ID NO: 267503

SEQ ID NO: 593487 - RNA, 64 nt, hsa; identical to SEQ ID NO: 267504

SEQ ID NO: 593488 - RNA, 64 nt, hsa; identical to SEQ ID NO: 267505

SEQ ID NO: 593489 - RNA, 64 nt, hsa; identical to SEQ ID NO: 267506

SEQ ID NO: 593490 - RNA, 64 nt, hsa; identical to SEQ ID NO: 267507

SEQ ID NO: 593491 - RNA, 64 nt, hsa; identical to SEQ ID NO: 267508

SEQ ID NO: 593492 - RNA, 64 nt, hsa; identical to SEQ ID NO: 267509

SEQ ID NO: 593493 - RNA, 64 nt, hsa; identical to SEQ ID NO: 267510

SEQ ID NO: 593494 - RNA, 64 nt, hsa; identical to SEQ ID NO: 267511

SEQ ID NO: 593495 - RNA, 64 nt, hsa; identical to SEQ ID NO: 267512

SEQ ID NO: 593496 - RNA, 64 nt, hsa; identical to SEQ ID NO: 267513

SEQ ID NO: 593497 - RNA, 64 nt, hsa; identical to SEQ ID NO: 267514

SEQ ID NO: 593498 - RNA, 64 nt, hsa; identical to SEQ ID NO: 267515

SEQ ID NO: 593499 - RNA, 64 nt, hsa; identical to SEQ ID NO: 267516

SEQ ID NO: 593500 - RNA, 64 nt, hsa; identical to SEQ ID NO: 267517

SEQ ID NO: 593501 - RNA, 64 nt, hsa; identical to SEQ ID NO: 267518

SEQ ID NO: 593502 - RNA, 64 nt, hsa; identical to SEQ ID NO: 267519

SEQ ID NO: 593503 - RNA, 64 nt, hsa; identical to SEQ ID NO: 267520

SEQ ID NO: 593504 - RNA, 64 nt, hsa; identical to SEQ ID NO: 267521

SEQ ID NO: 593505 - RNA, 64 nt, hsa; identical to SEQ ID NO: 267522

SEQ ID NO: 593506 - RNA, 64 nt, hsa; identical to SEQ ID NO: 267523

SEQ ID NO: 593507 - RNA, 64 nt, hsa; identical to SEQ ID NO: 267524

SEQ ID NO: 593508 - RNA, 64 nt, hsa; identical to SEQ ID NO: 267525

SEQ ID NO: 593509 - RNA, 64 nt, hsa; identical to SEQ ID NO: 267526

SEQ ID NO: 593510 - RNA, 64 nt, hsa; identical to SEQ ID NO: 267527

SEQ ID NO: 593511 - RNA, 64 nt, hsa; identical to SEQ ID NO: 267528

SEQ ID NO: 593512 - RNA, 64 nt, hsa; identical to SEQ ID NO: 267529

SEQ ID NO: 593513 - RNA, 64 nt, hsa; identical to SEQ ID NO: 267530

SEQ ID NO: 593514 - RNA, 64 nt, hsa; identical to SEQ ID NO: 267531

SEQ ID NO: 593515 - RNA, 64 nt, hsa; identical to SEQ ID NO: 267532

SEQ ID NO: 593516 - RNA, 64 nt, hsa; identical to SEQ ID NO: 267533

SEQ ID NO: 593517 - RNA, 64 nt, hsa; identical to SEQ ID NO: 267534

SEQ ID NO: 593518 - RNA, 64 nt, hsa; identical to SEQ ID NO: 267535

SEQ ID NO: 593519 - RNA, 64 nt, hsa; identical to SEQ ID NO: 267536

SEQ ID NO: 593520 - RNA, 64 nt, hsa; identical to SEQ ID NO: 267537

SEQ ID NO: 593521 - RNA, 64 nt, hsa; identical to SEQ ID NO: 267538

SEQ ID NO: 593522 - RNA, 64 nt, hsa; identical to SEQ ID NO: 267539

SEQ ID NO: 593523 - RNA, 64 nt, hsa; identical to SEQ ID NO: 267540

SEQ ID NO: 593524 - RNA, 64 nt, hsa; identical to SEQ ID NO: 267541

SEQ ID NO: 593525 - RNA, 64 nt, hsa; identical to SEQ ID NO: 267542

SEQ ID NO: 593526 - RNA, 64 nt, hsa; identical to SEQ ID NO: 267543

SEQ ID NO: 593527 - RNA, 64 nt, hsa; identical to SEQ ID NO: 267544

SEQ ID NO: 593528 - RNA, 64 nt, hsa; identical to SEQ ID NO: 267545

SEQ ID NO: 593529 - RNA, 64 nt, hsa; identical to SEQ ID NO: 267546

SEQ ID NO: 593530 - RNA, 64 nt, hsa; identical to SEQ ID NO: 267547

SEQ ID NO: 593531 - RNA, 64 nt, hsa; identical to SEQ ID NO: 267548

SEQ ID NO: 593532 - RNA, 64 nt, hsa; identical to SEQ ID NO: 267549

SEQ ID NO: 593533 - RNA, 64 nt, hsa; identical to SEQ ID NO: 267550

SEQ ID NO: 593534 - RNA, 64 nt, hsa; identical to SEQ ID NO: 267551

SEQ ID NO: 593535 - RNA, 64 nt, hsa; identical to SEQ ID NO: 267552

SEQ ID NO: 593536 - RNA, 64 nt, hsa; identical to SEQ ID NO: 267553

SEQ ID NO: 593537 - RNA, 64 nt, hsa; identical to SEQ ID NO: 267554

SEQ ID NO: 593538 - RNA, 64 nt, hsa; identical to SEQ ID NO: 267555

SEQ ID NO: 593539 - RNA, 64 nt, hsa; identical to SEQ ID NO: 267556

SEQ ID NO: 593540 - RNA, 64 nt, hsa; identical to SEQ ID NO: 267557

SEQ ID NO: 593541 - RNA, 64 nt, hsa; identical to SEQ ID NO: 267558

SEQ ID NO: 593542 - RNA, 64 nt, hsa; identical to SEQ ID NO: 267559

SEQ ID NO: 593543 - RNA, 64 nt, hsa; identical to SEQ ID NO: 267560

SEQ ID NO: 593544 - RNA, 64 nt, hsa; identical to SEQ ID NO: 267561

SEQ ID NO: 593545 - RNA, 64 nt, hsa; identical to SEQ ID NO: 267562

SEQ ID NO: 593546 - RNA, 64 nt, hsa; identical to SEQ ID NO: 267563

SEQ ID NO: 593547 - RNA, 64 nt, hsa; identical to SEQ ID NO: 267564

SEQ ID NO: 593548 - RNA, 64 nt, hsa; identical to SEQ ID NO: 267565

SEQ ID NO: 593549 - RNA, 64 nt, hsa; identical to SEQ ID NO: 267566

SEQ ID NO: 593550 - RNA, 64 nt, hsa; identical to SEQ ID NO: 267567

SEQ ID NO: 593551 - RNA, 64 nt, hsa; identical to SEQ ID NO: 267568

SEQ ID NO: 593552 - RNA, 64 nt, hsa; identical to SEQ ID NO: 267569

SEQ ID NO: 593553 - RNA, 64 nt, hsa; identical to SEQ ID NO: 267570

SEQ ID NO: 593554 - RNA, 64 nt, hsa; identical to SEQ ID NO: 267571

SEQ ID NO: 593555 - RNA, 64 nt, hsa; identical to SEQ ID NO: 267572

SEQ ID NO: 593556 - RNA, 64 nt, hsa; identical to SEQ ID NO: 267573

SEQ ID NO: 593557 - RNA, 64 nt, hsa; identical to SEQ ID NO: 267574

SEQ ID NO: 593558 - RNA, 64 nt, hsa; identical to SEQ ID NO: 267575

SEQ ID NO: 593559 - RNA, 64 nt, hsa; identical to SEQ ID NO: 267576

SEQ ID NO: 593560 - RNA, 64 nt, hsa; identical to SEQ ID NO: 267577

SEQ ID NO: 593561 - RNA, 64 nt, hsa; identical to SEQ ID NO: 267578

SEQ ID NO: 593562 - RNA, 64 nt, hsa; identical to SEQ ID NO: 267579

SEQ ID NO: 593563 - RNA, 64 nt, hsa; identical to SEQ ID NO: 267580

SEQ ID NO: 593564 - RNA, 64 nt, hsa; identical to SEQ ID NO: 267581

SEQ ID NO: 593565 - RNA, 64 nt, hsa; identical to SEQ ID NO: 267582

SEQ ID NO: 593566 - RNA, 64 nt, hsa; identical to SEQ ID NO: 267583

SEQ ID NO: 593567 - RNA, 64 nt, hsa; identical to SEQ ID NO: 267584

SEQ ID NO: 593568 - RNA, 64 nt, hsa; identical to SEQ ID NO: 267585

SEQ ID NO: 593569 - RNA, 64 nt, hsa; identical to SEQ ID NO: 267586

SEQ ID NO: 593570 - RNA, 64 nt, hsa; identical to SEQ ID NO: 267587

SEQ ID NO: 593571 - RNA, 64 nt, hsa; identical to SEQ ID NO: 267588

SEQ ID NO: 593572 - RNA, 64 nt, hsa; identical to SEQ ID NO: 267589

SEQ ID NO: 593573 - RNA, 64 nt, hsa; identical to SEQ ID NO: 267590

SEQ ID NO: 593574 - RNA, 64 nt, hsa; identical to SEQ ID NO: 267591

SEQ ID NO: 593575 - RNA, 64 nt, hsa; identical to SEQ ID NO: 267592

SEQ ID NO: 593576 - RNA, 64 nt, hsa; identical to SEQ ID NO: 267593

SEQ ID NO: 593577 - RNA, 64 nt, hsa; identical to SEQ ID NO: 267594

SEQ ID NO: 593578 - RNA, 64 nt, hsa; identical to SEQ ID NO: 267595

SEQ ID NO: 593579 - RNA, 64 nt, hsa; identical to SEQ ID NO: 267596

SEQ ID NO: 593580 - RNA, 64 nt, hsa; identical to SEQ ID NO: 267597

SEQ ID NO: 593581 - RNA, 64 nt, hsa; identical to SEQ ID NO: 267598

SEQ ID NO: 593582 - RNA, 64 nt, hsa; identical to SEQ ID NO: 267599

SEQ ID NO: 593583 - RNA, 64 nt, hsa; identical to SEQ ID NO: 267600

SEQ ID NO: 593584 - RNA, 64 nt, hsa; identical to SEQ ID NO: 267601

SEQ ID NO: 593585 - RNA, 64 nt, hsa; identical to SEQ ID NO: 267602

SEQ ID NO: 593586 - RNA, 64 nt, hsa; identical to SEQ ID NO: 267603

SEQ ID NO: 593587 - RNA, 64 nt, hsa; identical to SEQ ID NO: 267604

SEQ ID NO: 593588 - RNA, 64 nt, hsa; identical to SEQ ID NO: 267605

SEQ ID NO: 593589 - RNA, 64 nt, hsa; identical to SEQ ID NO: 267606

SEQ ID NO: 593590 - RNA, 64 nt, hsa; identical to SEQ ID NO: 267607

SEQ ID NO: 593591 - RNA, 64 nt, hsa; identical to SEQ ID NO: 267608

SEQ ID NO: 593592 - RNA, 64 nt, hsa; identical to SEQ ID NO: 267609

SEQ ID NO: 593593 - RNA, 64 nt, hsa; identical to SEQ ID NO: 267610

SEQ ID NO: 593594 - RNA, 64 nt, hsa; identical to SEQ ID NO: 267611

SEQ ID NO: 593595 - RNA, 64 nt, hsa; identical to SEQ ID NO: 267612

SEQ ID NO: 593596 - RNA, 64 nt, hsa; identical to SEQ ID NO: 267613

SEQ ID NO: 593597 - RNA, 64 nt, hsa; identical to SEQ ID NO: 267614

SEQ ID NO: 593598 - RNA, 64 nt, hsa; identical to SEQ ID NO: 267615

SEQ ID NO: 593599 - RNA, 64 nt, hsa; identical to SEQ ID NO: 267616

SEQ ID NO: 593600 - RNA, 64 nt, hsa; identical to SEQ ID NO: 267617

SEQ ID NO: 593601 - RNA, 64 nt, hsa; identical to SEQ ID NO: 267618

SEQ ID NO: 593602 - RNA, 64 nt, hsa; identical to SEQ ID NO: 267619

SEQ ID NO: 593603 - RNA, 64 nt, hsa; identical to SEQ ID NO: 267620

SEQ ID NO: 593604 - RNA, 64 nt, hsa; identical to SEQ ID NO: 267621

SEQ ID NO: 593605 - RNA, 64 nt, hsa; identical to SEQ ID NO: 267622

SEQ ID NO: 593606 - RNA, 64 nt, hsa; identical to SEQ ID NO: 267623

SEQ ID NO: 593607 - RNA, 64 nt, hsa; identical to SEQ ID NO: 267624

SEQ ID NO: 593608 - RNA, 64 nt, hsa; identical to SEQ ID NO: 267625

SEQ ID NO: 593609 - RNA, 64 nt, hsa; identical to SEQ ID NO: 267626

SEQ ID NO: 593610 - RNA, 64 nt, hsa; identical to SEQ ID NO: 267627

SEQ ID NO: 593611 - RNA, 64 nt, hsa; identical to SEQ ID NO: 267628

SEQ ID NO: 593612 - RNA, 64 nt, hsa; identical to SEQ ID NO: 267629

SEQ ID NO: 593613 - RNA, 64 nt, hsa; identical to SEQ ID NO: 267630

SEQ ID NO: 593614 - RNA, 64 nt, hsa; identical to SEQ ID NO: 267631

SEQ ID NO: 593615 - RNA, 64 nt, hsa; identical to SEQ ID NO: 267632

SEQ ID NO: 593616 - RNA, 64 nt, hsa; identical to SEQ ID NO: 267633

SEQ ID NO: 593617 - RNA, 64 nt, hsa; identical to SEQ ID NO: 267634

SEQ ID NO: 593618 - RNA, 64 nt, hsa; identical to SEQ ID NO: 267635

SEQ ID NO: 593619 - RNA, 64 nt, hsa; identical to SEQ ID NO: 267636

SEQ ID NO: 593620 - RNA, 64 nt, hsa; identical to SEQ ID NO: 267637

SEQ ID NO: 593621 - RNA, 64 nt, hsa; identical to SEQ ID NO: 267638

SEQ ID NO: 593622 - RNA, 64 nt, hsa; identical to SEQ ID NO: 267639

SEQ ID NO: 593623 - RNA, 64 nt, hsa; identical to SEQ ID NO: 267640

SEQ ID NO: 593624 - RNA, 64 nt, hsa; identical to SEQ ID NO: 267641

SEQ ID NO: 593625 - RNA, 64 nt, hsa; identical to SEQ ID NO: 267642

SEQ ID NO: 593626 - RNA, 64 nt, hsa; identical to SEQ ID NO: 267643

SEQ ID NO: 593627 - RNA, 64 nt, hsa; identical to SEQ ID NO: 267644

SEQ ID NO: 593628 - RNA, 64 nt, hsa; identical to SEQ ID NO: 267645

SEQ ID NO: 593629 - RNA, 64 nt, hsa; identical to SEQ ID NO: 267646

SEQ ID NO: 593630 - RNA, 64 nt, hsa; identical to SEQ ID NO: 267647

SEQ ID NO: 593631 - RNA, 64 nt, hsa; identical to SEQ ID NO: 267648

SEQ ID NO: 593632 - RNA, 64 nt, hsa; identical to SEQ ID NO: 267649

SEQ ID NO: 593633 - RNA, 64 nt, hsa; identical to SEQ ID NO: 267650

SEQ ID NO: 593634 - RNA, 64 nt, hsa; identical to SEQ ID NO: 267651

SEQ ID NO: 593635 - RNA, 64 nt, hsa; identical to SEQ ID NO: 267652

SEQ ID NO: 593636 - RNA, 64 nt, hsa; identical to SEQ ID NO: 267653

SEQ ID NO: 593637 - RNA, 64 nt, hsa; identical to SEQ ID NO: 267654

SEQ ID NO: 593638 - RNA, 64 nt, hsa; identical to SEQ ID NO: 267655

SEQ ID NO: 593639 - RNA, 64 nt, hsa; identical to SEQ ID NO: 267656

SEQ ID NO: 593640 - RNA, 64 nt, hsa; identical to SEQ ID NO: 267657

SEQ ID NO: 593641 - RNA, 64 nt, hsa; identical to SEQ ID NO: 267658

SEQ ID NO: 593642 - RNA, 64 nt, hsa; identical to SEQ ID NO: 267659

SEQ ID NO: 593643 - RNA, 64 nt, hsa; identical to SEQ ID NO: 267660

SEQ ID NO: 593644 - RNA, 64 nt, hsa; identical to SEQ ID NO: 267661

SEQ ID NO: 593645 - RNA, 64 nt, hsa; identical to SEQ ID NO: 267662

SEQ ID NO: 593646 - RNA, 64 nt, hsa; identical to SEQ ID NO: 267663

SEQ ID NO: 593647 - RNA, 64 nt, hsa; identical to SEQ ID NO: 267664

SEQ ID NO: 593648 - RNA, 64 nt, hsa; identical to SEQ ID NO: 267665

SEQ ID NO: 593649 - RNA, 64 nt, hsa; identical to SEQ ID NO: 267666

SEQ ID NO: 593650 - RNA, 64 nt, hsa; identical to SEQ ID NO: 267667

SEQ ID NO: 593651 - RNA, 64 nt, hsa; identical to SEQ ID NO: 267668

SEQ ID NO: 593652 - RNA, 64 nt, hsa; identical to SEQ ID NO: 267669

SEQ ID NO: 593653 - RNA, 64 nt, hsa; identical to SEQ ID NO: 267670

SEQ ID NO: 593654 - RNA, 64 nt, hsa; identical to SEQ ID NO: 267671

SEQ ID NO: 593655 - RNA, 64 nt, hsa; identical to SEQ ID NO: 267672

SEQ ID NO: 593656 - RNA, 64 nt, hsa; identical to SEQ ID NO: 267673

SEQ ID NO: 593657 - RNA, 64 nt, hsa; identical to SEQ ID NO: 267674

SEQ ID NO: 593658 - RNA, 64 nt, hsa; identical to SEQ ID NO: 267675

SEQ ID NO: 593659 - RNA, 64 nt, hsa; identical to SEQ ID NO: 267676

SEQ ID NO: 593660 - RNA, 64 nt, hsa; identical to SEQ ID NO: 267677

SEQ ID NO: 593661 - RNA, 64 nt, hsa; identical to SEQ ID NO: 267678

SEQ ID NO: 593662 - RNA, 64 nt, hsa; identical to SEQ ID NO: 267679

SEQ ID NO: 593663 - RNA, 64 nt, hsa; identical to SEQ ID NO: 267680

SEQ ID NO: 593664 - RNA, 64 nt, hsa; identical to SEQ ID NO: 267681

SEQ ID NO: 593665 - RNA, 64 nt, hsa; identical to SEQ ID NO: 267682

SEQ ID NO: 593666 - RNA, 64 nt, hsa; identical to SEQ ID NO: 267683

SEQ ID NO: 593667 - RNA, 64 nt, hsa; identical to SEQ ID NO: 267684

SEQ ID NO: 593668 - RNA, 64 nt, hsa; identical to SEQ ID NO: 267685

SEQ ID NO: 593669 - RNA, 64 nt, hsa; identical to SEQ ID NO: 267686

SEQ ID NO: 593670 - RNA, 64 nt, hsa; identical to SEQ ID NO: 267687

SEQ ID NO: 593671 - RNA, 64 nt, hsa; identical to SEQ ID NO: 267688

SEQ ID NO: 593672 - RNA, 64 nt, hsa; identical to SEQ ID NO: 267689

SEQ ID NO: 593673 - RNA, 64 nt, hsa; identical to SEQ ID NO: 267690

SEQ ID NO: 593674 - RNA, 64 nt, hsa; identical to SEQ ID NO: 267691

SEQ ID NO: 593675 - RNA, 64 nt, hsa; identical to SEQ ID NO: 267692

SEQ ID NO: 593676 - RNA, 64 nt, hsa; identical to SEQ ID NO: 267693

SEQ ID NO: 593677 - RNA, 64 nt, hsa; identical to SEQ ID NO: 267694

SEQ ID NO: 593678 - RNA, 64 nt, hsa; identical to SEQ ID NO: 267695

SEQ ID NO: 593679 - RNA, 64 nt, hsa; identical to SEQ ID NO: 267696

SEQ ID NO: 593680 - RNA, 64 nt, hsa; identical to SEQ ID NO: 267697

SEQ ID NO: 593681 - RNA, 64 nt, hsa; identical to SEQ ID NO: 267698

SEQ ID NO: 593682 - RNA, 64 nt, hsa; identical to SEQ ID NO: 267699

SEQ ID NO: 593683 - RNA, 64 nt, hsa; identical to SEQ ID NO: 267700

SEQ ID NO: 593684 - RNA, 64 nt, hsa; identical to SEQ ID NO: 267701

SEQ ID NO: 593685 - RNA, 64 nt, hsa; identical to SEQ ID NO: 267702

SEQ ID NO: 593686 - RNA, 64 nt, hsa; identical to SEQ ID NO: 267703

SEQ ID NO: 593687 - RNA, 64 nt, hsa; identical to SEQ ID NO: 267704

SEQ ID NO: 593688 - RNA, 64 nt, hsa; identical to SEQ ID NO: 267705

SEQ ID NO: 593689 - RNA, 64 nt, hsa; identical to SEQ ID NO: 267706

SEQ ID NO: 593690 - RNA, 64 nt, hsa; identical to SEQ ID NO: 267707

SEQ ID NO: 593691 - RNA, 64 nt, hsa; identical to SEQ ID NO: 267708

SEQ ID NO: 593692 - RNA, 64 nt, hsa; identical to SEQ ID NO: 267709

SEQ ID NO: 593693 - RNA, 64 nt, hsa; identical to SEQ ID NO: 267710

SEQ ID NO: 593694 - RNA, 64 nt, hsa; identical to SEQ ID NO: 267711

SEQ ID NO: 593695 - RNA, 64 nt, hsa; identical to SEQ ID NO: 267712

SEQ ID NO: 593696 - RNA, 64 nt, hsa; identical to SEQ ID NO: 267713

SEQ ID NO: 593697 - RNA, 64 nt, hsa; identical to SEQ ID NO: 267714

SEQ ID NO: 593698 - RNA, 64 nt, hsa; identical to SEQ ID NO: 267715

SEQ ID NO: 593699 - RNA, 64 nt, hsa; identical to SEQ ID NO: 267716

SEQ ID NO: 593700 - RNA, 64 nt, hsa; identical to SEQ ID NO: 267717

SEQ ID NO: 593701 - RNA, 64 nt, hsa; identical to SEQ ID NO: 267718

SEQ ID NO: 593702 - RNA, 64 nt, hsa; identical to SEQ ID NO: 267719

SEQ ID NO: 593703 - RNA, 64 nt, hsa; identical to SEQ ID NO: 267720

SEQ ID NO: 593704 - RNA, 64 nt, hsa; identical to SEQ ID NO: 267721

SEQ ID NO: 593705 - RNA, 64 nt, hsa; identical to SEQ ID NO: 267722

SEQ ID NO: 593706 - RNA, 64 nt, hsa; identical to SEQ ID NO: 267723

SEQ ID NO: 593707 - RNA, 64 nt, hsa; identical to SEQ ID NO: 267724

SEQ ID NO: 593708 - RNA, 64 nt, hsa; identical to SEQ ID NO: 267725

SEQ ID NO: 593709 - RNA, 64 nt, hsa; identical to SEQ ID NO: 267726

SEQ ID NO: 593710 - RNA, 64 nt, hsa; identical to SEQ ID NO: 267727

SEQ ID NO: 593711 - RNA, 64 nt, hsa; identical to SEQ ID NO: 267728

SEQ ID NO: 593712 - RNA, 64 nt, hsa; identical to SEQ ID NO: 267729

SEQ ID NO: 593713 - RNA, 64 nt, hsa; identical to SEQ ID NO: 267730

SEQ ID NO: 593714 - RNA, 64 nt, hsa; identical to SEQ ID NO: 267731

SEQ ID NO: 593715 - RNA, 64 nt, hsa; identical to SEQ ID NO: 267732

SEQ ID NO: 593716 - RNA, 64 nt, hsa; identical to SEQ ID NO: 267733

SEQ ID NO: 593717 - RNA, 64 nt, hsa; identical to SEQ ID NO: 267734

SEQ ID NO: 593718 - RNA, 64 nt, hsa; identical to SEQ ID NO: 267735

SEQ ID NO: 593719 - RNA, 64 nt, hsa; identical to SEQ ID NO: 267736

SEQ ID NO: 593720 - RNA, 64 nt, hsa; identical to SEQ ID NO: 267737

SEQ ID NO: 593721 - RNA, 64 nt, hsa; identical to SEQ ID NO: 267738

SEQ ID NO: 593722 - RNA, 64 nt, hsa; identical to SEQ ID NO: 267739

SEQ ID NO: 593723 - RNA, 64 nt, hsa; identical to SEQ ID NO: 267740

SEQ ID NO: 593724 - RNA, 64 nt, hsa; identical to SEQ ID NO: 267741

SEQ ID NO: 593725 - RNA, 64 nt, hsa; identical to SEQ ID NO: 267742

SEQ ID NO: 593726 - RNA, 64 nt, hsa; identical to SEQ ID NO: 267743

SEQ ID NO: 593727 - RNA, 64 nt, hsa; identical to SEQ ID NO: 267744

SEQ ID NO: 593728 - RNA, 64 nt, hsa; identical to SEQ ID NO: 267745

SEQ ID NO: 593729 - RNA, 64 nt, hsa; identical to SEQ ID NO: 267746

SEQ ID NO: 593730 - RNA, 64 nt, hsa; identical to SEQ ID NO: 267747

SEQ ID NO: 593731 - RNA, 64 nt, hsa; identical to SEQ ID NO: 267748

SEQ ID NO: 593732 - RNA, 64 nt, hsa; identical to SEQ ID NO: 267749

SEQ ID NO: 593733 - RNA, 64 nt, hsa; identical to SEQ ID NO: 267750

SEQ ID NO: 593734 - RNA, 64 nt, hsa; identical to SEQ ID NO: 267751

SEQ ID NO: 593735 - RNA, 64 nt, hsa; identical to SEQ ID NO: 267752

SEQ ID NO: 593736 - RNA, 64 nt, hsa; identical to SEQ ID NO: 267753

SEQ ID NO: 593737 - RNA, 64 nt, hsa; identical to SEQ ID NO: 267754

SEQ ID NO: 593738 - RNA, 64 nt, hsa; identical to SEQ ID NO: 267755

SEQ ID NO: 593739 - RNA, 64 nt, hsa; identical to SEQ ID NO: 267756

SEQ ID NO: 593740 - RNA, 64 nt, hsa; identical to SEQ ID NO: 267757

SEQ ID NO: 593741 - RNA, 64 nt, hsa; identical to SEQ ID NO: 267758

SEQ ID NO: 593742 - RNA, 64 nt, hsa; identical to SEQ ID NO: 267759

SEQ ID NO: 593743 - RNA, 64 nt, hsa; identical to SEQ ID NO: 267760

SEQ ID NO: 593744 - RNA, 64 nt, hsa; identical to SEQ ID NO: 267761

SEQ ID NO: 593745 - RNA, 64 nt, hsa; identical to SEQ ID NO: 267762

SEQ ID NO: 593746 - RNA, 64 nt, hsa; identical to SEQ ID NO: 267763

SEQ ID NO: 593747 - RNA, 64 nt, hsa; identical to SEQ ID NO: 267764

SEQ ID NO: 593748 - RNA, 64 nt, hsa; identical to SEQ ID NO: 267765

SEQ ID NO: 593749 - RNA, 64 nt, hsa; identical to SEQ ID NO: 267766

SEQ ID NO: 593750 - RNA, 64 nt, hsa; identical to SEQ ID NO: 267767

SEQ ID NO: 593751 - RNA, 64 nt, hsa; identical to SEQ ID NO: 267768

SEQ ID NO: 593752 - RNA, 64 nt, hsa; identical to SEQ ID NO: 267769

SEQ ID NO: 593753 - RNA, 64 nt, hsa; identical to SEQ ID NO: 267770

SEQ ID NO: 593754 - RNA, 64 nt, hsa; identical to SEQ ID NO: 267771

SEQ ID NO: 593755 - RNA, 64 nt, hsa; identical to SEQ ID NO: 267772

SEQ ID NO: 593756 - RNA, 64 nt, hsa; identical to SEQ ID NO: 267773

SEQ ID NO: 593757 - RNA, 64 nt, hsa; identical to SEQ ID NO: 267774

SEQ ID NO: 593758 - RNA, 64 nt, hsa; identical to SEQ ID NO: 267775

SEQ ID NO: 593759 - RNA, 64 nt, hsa; identical to SEQ ID NO: 267776

SEQ ID NO: 593760 - RNA, 64 nt, hsa; identical to SEQ ID NO: 267777

SEQ ID NO: 593761 - RNA, 64 nt, hsa; identical to SEQ ID NO: 267778

SEQ ID NO: 593762 - RNA, 64 nt, hsa; identical to SEQ ID NO: 267779

SEQ ID NO: 593763 - RNA, 64 nt, hsa; identical to SEQ ID NO: 267780

SEQ ID NO: 593764 - RNA, 64 nt, hsa; identical to SEQ ID NO: 267781

SEQ ID NO: 593765 - RNA, 64 nt, hsa; identical to SEQ ID NO: 267782

SEQ ID NO: 593766 - RNA, 64 nt, hsa; identical to SEQ ID NO: 267783

SEQ ID NO: 593767 - RNA, 64 nt, hsa; identical to SEQ ID NO: 267784

SEQ ID NO: 593768 - RNA, 64 nt, hsa; identical to SEQ ID NO: 267785

SEQ ID NO: 593769 - RNA, 64 nt, hsa; identical to SEQ ID NO: 267786

SEQ ID NO: 593770 - RNA, 64 nt, hsa; identical to SEQ ID NO: 267787

SEQ ID NO: 593771 - RNA, 64 nt, hsa; identical to SEQ ID NO: 267788

SEQ ID NO: 593772 - RNA, 64 nt, hsa; identical to SEQ ID NO: 267789

SEQ ID NO: 593773 - RNA, 64 nt, hsa; identical to SEQ ID NO: 267790

SEQ ID NO: 593774 - RNA, 64 nt, hsa; identical to SEQ ID NO: 267791

SEQ ID NO: 593775 - RNA, 64 nt, hsa; identical to SEQ ID NO: 267792

SEQ ID NO: 593776 - RNA, 64 nt, hsa; identical to SEQ ID NO: 267793

SEQ ID NO: 593777 - RNA, 64 nt, hsa; identical to SEQ ID NO: 267794

SEQ ID NO: 593778 - RNA, 64 nt, hsa; identical to SEQ ID NO: 267795

SEQ ID NO: 593779 - RNA, 64 nt, hsa; identical to SEQ ID NO: 267796

SEQ ID NO: 593780 - RNA, 64 nt, hsa; identical to SEQ ID NO: 267797

SEQ ID NO: 593781 - RNA, 64 nt, hsa; identical to SEQ ID NO: 267798

SEQ ID NO: 593782 - RNA, 64 nt, hsa; identical to SEQ ID NO: 267799

SEQ ID NO: 593783 - RNA, 64 nt, hsa; identical to SEQ ID NO: 267800

SEQ ID NO: 593784 - RNA, 64 nt, hsa; identical to SEQ ID NO: 267801

SEQ ID NO: 593785 - RNA, 64 nt, hsa; identical to SEQ ID NO: 267802

SEQ ID NO: 593786 - RNA, 64 nt, hsa; identical to SEQ ID NO: 267803

SEQ ID NO: 593787 - RNA, 64 nt, hsa; identical to SEQ ID NO: 267804

SEQ ID NO: 593788 - RNA, 64 nt, hsa; identical to SEQ ID NO: 267805

SEQ ID NO: 593789 - RNA, 64 nt, hsa; identical to SEQ ID NO: 267806

SEQ ID NO: 593790 - RNA, 64 nt, hsa; identical to SEQ ID NO: 267807

SEQ ID NO: 593791 - RNA, 64 nt, hsa; identical to SEQ ID NO: 267808

SEQ ID NO: 593792 - RNA, 64 nt, hsa; identical to SEQ ID NO: 267809

SEQ ID NO: 593793 - RNA, 64 nt, hsa; identical to SEQ ID NO: 267810

SEQ ID NO: 593794 - RNA, 64 nt, hsa; identical to SEQ ID NO: 267811

SEQ ID NO: 593795 - RNA, 64 nt, hsa; identical to SEQ ID NO: 267812

SEQ ID NO: 593796 - RNA, 64 nt, hsa; identical to SEQ ID NO: 267813

SEQ ID NO: 593797 - RNA, 64 nt, hsa; identical to SEQ ID NO: 267814

SEQ ID NO: 593798 - RNA, 64 nt, hsa; identical to SEQ ID NO: 267815

SEQ ID NO: 593799 - RNA, 64 nt, hsa; identical to SEQ ID NO: 267816

SEQ ID NO: 593800 - RNA, 64 nt, hsa; identical to SEQ ID NO: 267817

SEQ ID NO: 593801 - RNA, 64 nt, hsa; identical to SEQ ID NO: 267818

SEQ ID NO: 593802 - RNA, 64 nt, hsa; identical to SEQ ID NO: 267819

SEQ ID NO: 593803 - RNA, 64 nt, hsa; identical to SEQ ID NO: 267820

SEQ ID NO: 593804 - RNA, 64 nt, hsa; identical to SEQ ID NO: 267821

SEQ ID NO: 593805 - RNA, 64 nt, hsa; identical to SEQ ID NO: 267822

SEQ ID NO: 593806 - RNA, 64 nt, hsa; identical to SEQ ID NO: 267823

SEQ ID NO: 593807 - RNA, 64 nt, hsa; identical to SEQ ID NO: 267824

SEQ ID NO: 593808 - RNA, 64 nt, hsa; identical to SEQ ID NO: 267825

SEQ ID NO: 593809 - RNA, 64 nt, hsa; identical to SEQ ID NO: 267826

SEQ ID NO: 593810 - RNA, 64 nt, hsa; identical to SEQ ID NO: 267827

SEQ ID NO: 593811 - RNA, 64 nt, hsa; identical to SEQ ID NO: 267828

SEQ ID NO: 593812 - RNA, 64 nt, hsa; identical to SEQ ID NO: 267829

SEQ ID NO: 593813 - RNA, 64 nt, hsa; identical to SEQ ID NO: 267830

SEQ ID NO: 593814 - RNA, 64 nt, hsa; identical to SEQ ID NO: 267831

SEQ ID NO: 593815 - RNA, 64 nt, hsa; identical to SEQ ID NO: 267832

SEQ ID NO: 593816 - RNA, 64 nt, hsa; identical to SEQ ID NO: 267833

SEQ ID NO: 593817 - RNA, 64 nt, hsa; identical to SEQ ID NO: 267834

SEQ ID NO: 593818 - RNA, 64 nt, hsa; identical to SEQ ID NO: 267835

SEQ ID NO: 593819 - RNA, 64 nt, hsa; identical to SEQ ID NO: 267836

SEQ ID NO: 593820 - RNA, 64 nt, hsa; identical to SEQ ID NO: 267837

SEQ ID NO: 593821 - RNA, 64 nt, hsa; identical to SEQ ID NO: 267838

SEQ ID NO: 593822 - RNA, 64 nt, hsa; identical to SEQ ID NO: 267839

SEQ ID NO: 593823 - RNA, 64 nt, hsa; identical to SEQ ID NO: 267840

SEQ ID NO: 593824 - RNA, 64 nt, hsa; identical to SEQ ID NO: 267841

SEQ ID NO: 593825 - RNA, 64 nt, hsa; identical to SEQ ID NO: 267842

SEQ ID NO: 593826 - RNA, 64 nt, hsa; identical to SEQ ID NO: 267843

SEQ ID NO: 593827 - RNA, 64 nt, hsa; identical to SEQ ID NO: 267844

SEQ ID NO: 593828 - RNA, 64 nt, hsa; identical to SEQ ID NO: 267845

SEQ ID NO: 593829 - RNA, 64 nt, hsa; identical to SEQ ID NO: 267846

SEQ ID NO: 593830 - RNA, 64 nt, hsa; identical to SEQ ID NO: 267847

SEQ ID NO: 593831 - RNA, 64 nt, hsa; identical to SEQ ID NO: 267848

SEQ ID NO: 593832 - RNA, 64 nt, hsa; identical to SEQ ID NO: 267849

SEQ ID NO: 593833 - RNA, 64 nt, hsa; identical to SEQ ID NO: 267850

SEQ ID NO: 593834 - RNA, 64 nt, hsa; identical to SEQ ID NO: 267851

SEQ ID NO: 593835 - RNA, 64 nt, hsa; identical to SEQ ID NO: 267852

SEQ ID NO: 593836 - RNA, 64 nt, hsa; identical to SEQ ID NO: 267853

SEQ ID NO: 593837 - RNA, 64 nt, hsa; identical to SEQ ID NO: 267854

SEQ ID NO: 593838 - RNA, 64 nt, hsa; identical to SEQ ID NO: 267855

SEQ ID NO: 593839 - RNA, 64 nt, hsa; identical to SEQ ID NO: 267856

SEQ ID NO: 593840 - RNA, 64 nt, hsa; identical to SEQ ID NO: 267857

SEQ ID NO: 593841 - RNA, 64 nt, hsa; identical to SEQ ID NO: 267858

SEQ ID NO: 593842 - RNA, 64 nt, hsa; identical to SEQ ID NO: 267859

SEQ ID NO: 593843 - RNA, 64 nt, hsa; identical to SEQ ID NO: 267860

SEQ ID NO: 593844 - RNA, 64 nt, hsa; identical to SEQ ID NO: 267861

SEQ ID NO: 593845 - RNA, 64 nt, hsa; identical to SEQ ID NO: 267862

SEQ ID NO: 593846 - RNA, 64 nt, hsa; identical to SEQ ID NO: 267863

SEQ ID NO: 593847 - RNA, 64 nt, hsa; identical to SEQ ID NO: 267864

SEQ ID NO: 593848 - RNA, 64 nt, hsa; identical to SEQ ID NO: 267865

SEQ ID NO: 593849 - RNA, 64 nt, hsa; identical to SEQ ID NO: 267866

SEQ ID NO: 593850 - RNA, 64 nt, hsa; identical to SEQ ID NO: 267867

SEQ ID NO: 593851 - RNA, 64 nt, hsa; identical to SEQ ID NO: 267868

SEQ ID NO: 593852 - RNA, 64 nt, hsa; identical to SEQ ID NO: 267869

SEQ ID NO: 593853 - RNA, 64 nt, hsa; identical to SEQ ID NO: 267870

SEQ ID NO: 593854 - RNA, 64 nt, hsa; identical to SEQ ID NO: 267871

SEQ ID NO: 593855 - RNA, 64 nt, hsa; identical to SEQ ID NO: 267872

SEQ ID NO: 593856 - RNA, 64 nt, hsa; identical to SEQ ID NO: 267873

SEQ ID NO: 593857 - RNA, 64 nt, hsa; identical to SEQ ID NO: 267874

SEQ ID NO: 593858 - RNA, 64 nt, hsa; identical to SEQ ID NO: 267875

SEQ ID NO: 593859 - RNA, 64 nt, hsa; identical to SEQ ID NO: 267876

SEQ ID NO: 593860 - RNA, 64 nt, hsa; identical to SEQ ID NO: 267877

SEQ ID NO: 593861 - RNA, 64 nt, hsa; identical to SEQ ID NO: 267878

SEQ ID NO: 593862 - RNA, 64 nt, hsa; identical to SEQ ID NO: 267879

SEQ ID NO: 593863 - RNA, 64 nt, hsa; identical to SEQ ID NO: 267880

SEQ ID NO: 593864 - RNA, 64 nt, hsa; identical to SEQ ID NO: 267881

SEQ ID NO: 593865 - RNA, 64 nt, hsa; identical to SEQ ID NO: 267882

SEQ ID NO: 593866 - RNA, 64 nt, hsa; identical to SEQ ID NO: 267883

SEQ ID NO: 593867 - RNA, 64 nt, hsa; identical to SEQ ID NO: 267884

SEQ ID NO: 593868 - RNA, 64 nt, hsa; identical to SEQ ID NO: 267885

SEQ ID NO: 593869 - RNA, 64 nt, hsa; identical to SEQ ID NO: 267886

SEQ ID NO: 593870 - RNA, 64 nt, hsa; identical to SEQ ID NO: 267887

SEQ ID NO: 593871 - RNA, 64 nt, hsa; identical to SEQ ID NO: 267888

SEQ ID NO: 593872 - RNA, 64 nt, hsa; identical to SEQ ID NO: 267889

SEQ ID NO: 593873 - RNA, 64 nt, hsa; identical to SEQ ID NO: 267890

SEQ ID NO: 593874 - RNA, 64 nt, hsa; identical to SEQ ID NO: 267891

SEQ ID NO: 593875 - RNA, 64 nt, hsa; identical to SEQ ID NO: 267892

SEQ ID NO: 593876 - RNA, 64 nt, hsa; identical to SEQ ID NO: 267893

SEQ ID NO: 593877 - RNA, 64 nt, hsa; identical to SEQ ID NO: 267894

SEQ ID NO: 593878 - RNA, 64 nt, hsa; identical to SEQ ID NO: 267895

SEQ ID NO: 593879 - RNA, 64 nt, hsa; identical to SEQ ID NO: 267896

SEQ ID NO: 593880 - RNA, 64 nt, hsa; identical to SEQ ID NO: 267897

SEQ ID NO: 593881 - RNA, 64 nt, hsa; identical to SEQ ID NO: 267898

SEQ ID NO: 593882 - RNA, 64 nt, hsa; identical to SEQ ID NO: 267899

SEQ ID NO: 593883 - RNA, 64 nt, hsa; identical to SEQ ID NO: 267900

SEQ ID NO: 593884 - RNA, 64 nt, hsa; identical to SEQ ID NO: 267901

SEQ ID NO: 593885 - RNA, 64 nt, hsa; identical to SEQ ID NO: 267902

SEQ ID NO: 593886 - RNA, 64 nt, hsa; identical to SEQ ID NO: 267903

SEQ ID NO: 593887 - RNA, 64 nt, hsa; identical to SEQ ID NO: 267904

SEQ ID NO: 593888 - RNA, 64 nt, hsa; identical to SEQ ID NO: 267905

SEQ ID NO: 593889 - RNA, 64 nt, hsa; identical to SEQ ID NO: 267906

SEQ ID NO: 593890 - RNA, 64 nt, hsa; identical to SEQ ID NO: 267907

SEQ ID NO: 593891 - RNA, 64 nt, hsa; identical to SEQ ID NO: 267908

SEQ ID NO: 593892 - RNA, 64 nt, hsa; identical to SEQ ID NO: 267909

SEQ ID NO: 593893 - RNA, 64 nt, hsa; identical to SEQ ID NO: 267910

SEQ ID NO: 593894 - RNA, 64 nt, hsa; identical to SEQ ID NO: 267911

SEQ ID NO: 593895 - RNA, 64 nt, hsa; identical to SEQ ID NO: 267912

SEQ ID NO: 593896 - RNA, 64 nt, hsa; identical to SEQ ID NO: 267913

SEQ ID NO: 593897 - RNA, 64 nt, hsa; identical to SEQ ID NO: 267914

SEQ ID NO: 593898 - RNA, 64 nt, hsa; identical to SEQ ID NO: 267915

SEQ ID NO: 593899 - RNA, 64 nt, hsa; identical to SEQ ID NO: 267916

SEQ ID NO: 593900 - RNA, 64 nt, hsa; identical to SEQ ID NO: 267917

SEQ ID NO: 593901 - RNA, 64 nt, hsa; identical to SEQ ID NO: 267918

SEQ ID NO: 593902 - RNA, 64 nt, hsa; identical to SEQ ID NO: 267919

SEQ ID NO: 593903 - RNA, 64 nt, hsa; identical to SEQ ID NO: 267920

SEQ ID NO: 593904 - RNA, 64 nt, hsa; identical to SEQ ID NO: 267921

SEQ ID NO: 593905 - RNA, 64 nt, hsa; identical to SEQ ID NO: 267922

SEQ ID NO: 593906 - RNA, 64 nt, hsa; identical to SEQ ID NO: 267923

SEQ ID NO: 593907 - RNA, 64 nt, hsa; identical to SEQ ID NO: 267924

SEQ ID NO: 593908 - RNA, 64 nt, hsa; identical to SEQ ID NO: 267925

SEQ ID NO: 593909 - RNA, 64 nt, hsa; identical to SEQ ID NO: 267926

SEQ ID NO: 593910 - RNA, 64 nt, hsa; identical to SEQ ID NO: 267927

SEQ ID NO: 593911 - RNA, 64 nt, hsa; identical to SEQ ID NO: 267928

SEQ ID NO: 593912 - RNA, 64 nt, hsa; identical to SEQ ID NO: 267929

SEQ ID NO: 593913 - RNA, 64 nt, hsa; identical to SEQ ID NO: 267930

SEQ ID NO: 593914 - RNA, 64 nt, hsa; identical to SEQ ID NO: 267931

SEQ ID NO: 593915 - RNA, 64 nt, hsa; identical to SEQ ID NO: 267932

SEQ ID NO: 593916 - RNA, 64 nt, hsa; identical to SEQ ID NO: 267933

SEQ ID NO: 593917 - RNA, 64 nt, hsa; identical to SEQ ID NO: 267934

SEQ ID NO: 593918 - RNA, 64 nt, hsa; identical to SEQ ID NO: 267935

SEQ ID NO: 593919 - RNA, 64 nt, hsa; identical to SEQ ID NO: 267936

SEQ ID NO: 593920 - RNA, 64 nt, hsa; identical to SEQ ID NO: 267937

SEQ ID NO: 593921 - RNA, 64 nt, hsa; identical to SEQ ID NO: 267938

SEQ ID NO: 593922 - RNA, 64 nt, hsa; identical to SEQ ID NO: 267939

SEQ ID NO: 593923 - RNA, 64 nt, hsa; identical to SEQ ID NO: 267940

SEQ ID NO: 593924 - RNA, 64 nt, hsa; identical to SEQ ID NO: 267941

SEQ ID NO: 593925 - RNA, 64 nt, hsa; identical to SEQ ID NO: 267942

SEQ ID NO: 593926 - RNA, 64 nt, hsa; identical to SEQ ID NO: 267943

SEQ ID NO: 593927 - RNA, 64 nt, hsa; identical to SEQ ID NO: 267944

SEQ ID NO: 593928 - RNA, 64 nt, hsa; identical to SEQ ID NO: 267945

SEQ ID NO: 593929 - RNA, 64 nt, hsa; identical to SEQ ID NO: 267946

SEQ ID NO: 593930 - RNA, 64 nt, hsa; identical to SEQ ID NO: 267947

SEQ ID NO: 593931 - RNA, 64 nt, hsa; identical to SEQ ID NO: 267948

SEQ ID NO: 593932 - RNA, 64 nt, hsa; identical to SEQ ID NO: 267949

SEQ ID NO: 593933 - RNA, 64 nt, hsa; identical to SEQ ID NO: 267950

SEQ ID NO: 593934 - RNA, 64 nt, hsa; identical to SEQ ID NO: 267951

SEQ ID NO: 593935 - RNA, 64 nt, hsa; identical to SEQ ID NO: 267952

SEQ ID NO: 593936 - RNA, 64 nt, hsa; identical to SEQ ID NO: 267953

SEQ ID NO: 593937 - RNA, 64 nt, hsa; identical to SEQ ID NO: 267954

SEQ ID NO: 593938 - RNA, 64 nt, hsa; identical to SEQ ID NO: 267955

SEQ ID NO: 593939 - RNA, 64 nt, hsa; identical to SEQ ID NO: 267956

SEQ ID NO: 593940 - RNA, 64 nt, hsa; identical to SEQ ID NO: 267957

SEQ ID NO: 593941 - RNA, 64 nt, hsa; identical to SEQ ID NO: 267958

SEQ ID NO: 593942 - RNA, 64 nt, hsa; identical to SEQ ID NO: 267959

SEQ ID NO: 593943 - RNA, 64 nt, hsa; identical to SEQ ID NO: 267960

SEQ ID NO: 593944 - RNA, 64 nt, hsa; identical to SEQ ID NO: 267961

SEQ ID NO: 593945 - RNA, 64 nt, hsa; identical to SEQ ID NO: 267962

SEQ ID NO: 593946 - RNA, 64 nt, hsa; identical to SEQ ID NO: 267963

SEQ ID NO: 593947 - RNA, 64 nt, hsa; identical to SEQ ID NO: 267964

SEQ ID NO: 593948 - RNA, 64 nt, hsa; identical to SEQ ID NO: 267965

SEQ ID NO: 593949 - RNA, 64 nt, hsa; identical to SEQ ID NO: 267966

SEQ ID NO: 593950 - RNA, 64 nt, hsa; identical to SEQ ID NO: 267967

SEQ ID NO: 593951 - RNA, 64 nt, hsa; identical to SEQ ID NO: 267968

SEQ ID NO: 593952 - RNA, 64 nt, hsa; identical to SEQ ID NO: 267969

SEQ ID NO: 593953 - RNA, 64 nt, hsa; identical to SEQ ID NO: 267970

SEQ ID NO: 593954 - RNA, 64 nt, hsa; identical to SEQ ID NO: 267971

SEQ ID NO: 593955 - RNA, 64 nt, hsa; identical to SEQ ID NO: 267972

SEQ ID NO: 593956 - RNA, 64 nt, hsa; identical to SEQ ID NO: 267973

SEQ ID NO: 593957 - RNA, 64 nt, hsa; identical to SEQ ID NO: 267974

SEQ ID NO: 593958 - RNA, 64 nt, hsa; identical to SEQ ID NO: 267975

SEQ ID NO: 593959 - RNA, 64 nt, hsa; identical to SEQ ID NO: 267976

SEQ ID NO: 593960 - RNA, 64 nt, hsa; identical to SEQ ID NO: 267977

SEQ ID NO: 593961 - RNA, 64 nt, hsa; identical to SEQ ID NO: 267978

SEQ ID NO: 593962 - RNA, 64 nt, hsa; identical to SEQ ID NO: 267979

SEQ ID NO: 593963 - RNA, 64 nt, hsa; identical to SEQ ID NO: 267980

SEQ ID NO: 593964 - RNA, 64 nt, hsa; identical to SEQ ID NO: 267981

SEQ ID NO: 593965 - RNA, 64 nt, hsa; identical to SEQ ID NO: 267982

SEQ ID NO: 593966 - RNA, 64 nt, hsa; identical to SEQ ID NO: 267983

SEQ ID NO: 593967 - RNA, 64 nt, hsa; identical to SEQ ID NO: 267984

SEQ ID NO: 593968 - RNA, 64 nt, hsa; identical to SEQ ID NO: 267985

SEQ ID NO: 593969 - RNA, 63 nt, hsa; identical to SEQ ID NO: 267986

SEQ ID NO: 593970 - RNA, 64 nt, hsa; identical to SEQ ID NO: 267987

SEQ ID NO: 593971 - RNA, 64 nt, hsa; identical to SEQ ID NO: 267988

SEQ ID NO: 593972 - RNA, 64 nt, hsa; identical to SEQ ID NO: 267989

SEQ ID NO: 593973 - RNA, 64 nt, hsa; identical to SEQ ID NO: 267990

SEQ ID NO: 593974 - RNA, 64 nt, hsa; identical to SEQ ID NO: 267991

SEQ ID NO: 593975 - RNA, 64 nt, hsa; identical to SEQ ID NO: 267992

SEQ ID NO: 593976 - RNA, 64 nt, hsa; identical to SEQ ID NO: 267993

SEQ ID NO: 593977 - RNA, 64 nt, hsa; identical to SEQ ID NO: 267994

SEQ ID NO: 593978 - RNA, 64 nt, hsa; identical to SEQ ID NO: 267995

SEQ ID NO: 593979 - RNA, 64 nt, hsa; identical to SEQ ID NO: 267996

SEQ ID NO: 593980 - RNA, 64 nt, hsa; identical to SEQ ID NO: 267997

SEQ ID NO: 593981 - RNA, 64 nt, hsa; identical to SEQ ID NO: 267998

SEQ ID NO: 593982 - RNA, 64 nt, hsa; identical to SEQ ID NO: 267999

SEQ ID NO: 593983 - RNA, 64 nt, hsa; identical to SEQ ID NO: 268000

SEQ ID NO: 593984 - RNA, 64 nt, hsa; identical to SEQ ID NO: 268001

SEQ ID NO: 593985 - RNA, 64 nt, hsa; identical to SEQ ID NO: 268002

SEQ ID NO: 593986 - RNA, 64 nt, hsa; identical to SEQ ID NO: 268003

SEQ ID NO: 593987 - RNA, 64 nt, hsa; identical to SEQ ID NO: 268004

SEQ ID NO: 593988 - RNA, 64 nt, hsa; identical to SEQ ID NO: 268005

SEQ ID NO: 593989 - RNA, 64 nt, hsa; identical to SEQ ID NO: 268006

SEQ ID NO: 593990 - RNA, 64 nt, hsa; identical to SEQ ID NO: 268007

SEQ ID NO: 593991 - RNA, 64 nt, hsa; identical to SEQ ID NO: 268008

SEQ ID NO: 593992 - RNA, 64 nt, hsa; identical to SEQ ID NO: 268009

SEQ ID NO: 593993 - RNA, 64 nt, hsa; identical to SEQ ID NO: 268010

SEQ ID NO: 593994 - RNA, 64 nt, hsa; identical to SEQ ID NO: 268011

SEQ ID NO: 593995 - RNA, 64 nt, hsa; identical to SEQ ID NO: 268012

SEQ ID NO: 593996 - RNA, 64 nt, hsa; identical to SEQ ID NO: 268013

SEQ ID NO: 593997 - RNA, 64 nt, hsa; identical to SEQ ID NO: 268014

SEQ ID NO: 593998 - RNA, 64 nt, hsa; identical to SEQ ID NO: 268015

SEQ ID NO: 593999 - RNA, 64 nt, hsa; identical to SEQ ID NO: 268016

SEQ ID NO: 594000 - RNA, 64 nt, hsa; identical to SEQ ID NO: 268017

SEQ ID NO: 594001 - RNA, 64 nt, hsa; identical to SEQ ID NO: 268018

SEQ ID NO: 594002 - RNA, 64 nt, hsa; identical to SEQ ID NO: 268019

SEQ ID NO: 594003 - RNA, 64 nt, hsa; identical to SEQ ID NO: 268020

SEQ ID NO: 594004 - RNA, 64 nt, hsa; identical to SEQ ID NO: 268021

SEQ ID NO: 594005 - RNA, 64 nt, hsa; identical to SEQ ID NO: 268022

SEQ ID NO: 594006 - RNA, 64 nt, hsa; identical to SEQ ID NO: 268023

SEQ ID NO: 594007 - RNA, 64 nt, hsa; identical to SEQ ID NO: 268024

SEQ ID NO: 594008 - RNA, 64 nt, hsa; identical to SEQ ID NO: 268025

SEQ ID NO: 594009 - RNA, 64 nt, hsa; identical to SEQ ID NO: 268026

SEQ ID NO: 594010 - RNA, 64 nt, hsa; identical to SEQ ID NO: 268027

SEQ ID NO: 594011 - RNA, 64 nt, hsa; identical to SEQ ID NO: 268028

SEQ ID NO: 594012 - RNA, 64 nt, hsa; identical to SEQ ID NO: 268029

SEQ ID NO: 594013 - RNA, 64 nt, hsa; identical to SEQ ID NO: 268030

SEQ ID NO: 594014 - RNA, 64 nt, hsa; identical to SEQ ID NO: 268031

SEQ ID NO: 594015 - RNA, 64 nt, hsa; identical to SEQ ID NO: 268032

SEQ ID NO: 594016 - RNA, 64 nt, hsa; identical to SEQ ID NO: 268033

SEQ ID NO: 594017 - RNA, 64 nt, hsa; identical to SEQ ID NO: 268034

SEQ ID NO: 594018 - RNA, 64 nt, hsa; identical to SEQ ID NO: 268035

SEQ ID NO: 594019 - RNA, 64 nt, hsa; identical to SEQ ID NO: 268036

SEQ ID NO: 594020 - RNA, 64 nt, hsa; identical to SEQ ID NO: 268037

SEQ ID NO: 594021 - RNA, 64 nt, hsa; identical to SEQ ID NO: 268038

SEQ ID NO: 594022 - RNA, 64 nt, hsa; identical to SEQ ID NO: 268039

SEQ ID NO: 594023 - RNA, 64 nt, hsa; identical to SEQ ID NO: 268040

SEQ ID NO: 594024 - RNA, 64 nt, hsa; identical to SEQ ID NO: 268041

SEQ ID NO: 594025 - RNA, 64 nt, hsa; identical to SEQ ID NO: 268042

SEQ ID NO: 594026 - RNA, 64 nt, hsa; identical to SEQ ID NO: 268043

SEQ ID NO: 594027 - RNA, 64 nt, hsa; identical to SEQ ID NO: 268044

SEQ ID NO: 594028 - RNA, 64 nt, hsa; identical to SEQ ID NO: 268045

SEQ ID NO: 594029 - RNA, 64 nt, hsa; identical to SEQ ID NO: 268046

SEQ ID NO: 594030 - RNA, 64 nt, hsa; identical to SEQ ID NO: 268047

SEQ ID NO: 594031 - RNA, 64 nt, hsa; identical to SEQ ID NO: 268048

SEQ ID NO: 594032 - RNA, 64 nt, hsa; identical to SEQ ID NO: 268049

SEQ ID NO: 594033 - RNA, 64 nt, hsa; identical to SEQ ID NO: 268050

SEQ ID NO: 594034 - RNA, 64 nt, hsa; identical to SEQ ID NO: 268051

SEQ ID NO: 594035 - RNA, 64 nt, hsa; identical to SEQ ID NO: 268052

SEQ ID NO: 594036 - RNA, 64 nt, hsa; identical to SEQ ID NO: 268053

SEQ ID NO: 594037 - RNA, 64 nt, hsa; identical to SEQ ID NO: 268054

SEQ ID NO: 594038 - RNA, 64 nt, hsa; identical to SEQ ID NO: 268055

SEQ ID NO: 594039 - RNA, 64 nt, hsa; identical to SEQ ID NO: 268056

SEQ ID NO: 594040 - RNA, 64 nt, hsa; identical to SEQ ID NO: 268057

SEQ ID NO: 594041 - RNA, 64 nt, hsa; identical to SEQ ID NO: 268058

SEQ ID NO: 594042 - RNA, 64 nt, hsa; identical to SEQ ID NO: 268059

SEQ ID NO: 594043 - RNA, 64 nt, hsa; identical to SEQ ID NO: 268060

SEQ ID NO: 594044 - RNA, 64 nt, hsa; identical to SEQ ID NO: 268061

SEQ ID NO: 594045 - RNA, 64 nt, hsa; identical to SEQ ID NO: 268062

SEQ ID NO: 594046 - RNA, 64 nt, hsa; identical to SEQ ID NO: 268063

SEQ ID NO: 594047 - RNA, 64 nt, hsa; identical to SEQ ID NO: 268064

SEQ ID NO: 594048 - RNA, 64 nt, hsa; identical to SEQ ID NO: 268065

SEQ ID NO: 594049 - RNA, 64 nt, hsa; identical to SEQ ID NO: 268066

SEQ ID NO: 594050 - RNA, 64 nt, hsa; identical to SEQ ID NO: 268067

SEQ ID NO: 594051 - RNA, 64 nt, hsa; identical to SEQ ID NO: 268068

SEQ ID NO: 594052 - RNA, 64 nt, hsa; identical to SEQ ID NO: 268069

SEQ ID NO: 594053 - RNA, 64 nt, hsa; identical to SEQ ID NO: 268070

SEQ ID NO: 594054 - RNA, 64 nt, hsa; identical to SEQ ID NO: 268071

SEQ ID NO: 594055 - RNA, 64 nt, hsa; identical to SEQ ID NO: 268072

SEQ ID NO: 594056 - RNA, 64 nt, hsa; identical to SEQ ID NO: 268073

SEQ ID NO: 594057 - RNA, 64 nt, hsa; identical to SEQ ID NO: 268074

SEQ ID NO: 594058 - RNA, 64 nt, hsa; identical to SEQ ID NO: 268075

SEQ ID NO: 594059 - RNA, 64 nt, hsa; identical to SEQ ID NO: 268076

SEQ ID NO: 594060 - RNA, 64 nt, hsa; identical to SEQ ID NO: 268077

SEQ ID NO: 594061 - RNA, 64 nt, hsa; identical to SEQ ID NO: 268078

SEQ ID NO: 594062 - RNA, 64 nt, hsa; identical to SEQ ID NO: 268079

SEQ ID NO: 594063 - RNA, 64 nt, hsa; identical to SEQ ID NO: 268080

SEQ ID NO: 594064 - RNA, 64 nt, hsa; identical to SEQ ID NO: 268081

SEQ ID NO: 594065 - RNA, 64 nt, hsa; identical to SEQ ID NO: 268082

SEQ ID NO: 594066 - RNA, 64 nt, hsa; identical to SEQ ID NO: 268083

SEQ ID NO: 594067 - RNA, 64 nt, hsa; identical to SEQ ID NO: 268084

SEQ ID NO: 594068 - RNA, 64 nt, hsa; identical to SEQ ID NO: 268085

SEQ ID NO: 594069 - RNA, 64 nt, hsa; identical to SEQ ID NO: 268086

SEQ ID NO: 594070 - RNA, 64 nt, hsa; identical to SEQ ID NO: 268087

SEQ ID NO: 594071 - RNA, 64 nt, hsa; identical to SEQ ID NO: 268088

SEQ ID NO: 594072 - RNA, 64 nt, hsa; identical to SEQ ID NO: 268089

SEQ ID NO: 594073 - RNA, 64 nt, hsa; identical to SEQ ID NO: 268090

SEQ ID NO: 594074 - RNA, 64 nt, hsa; identical to SEQ ID NO: 268091

SEQ ID NO: 594075 - RNA, 64 nt, hsa; identical to SEQ ID NO: 268092

SEQ ID NO: 594076 - RNA, 64 nt, hsa; identical to SEQ ID NO: 268093

SEQ ID NO: 594077 - RNA, 64 nt, hsa; identical to SEQ ID NO: 268094

SEQ ID NO: 594078 - RNA, 64 nt, hsa; identical to SEQ ID NO: 268095

SEQ ID NO: 594079 - RNA, 64 nt, hsa; identical to SEQ ID NO: 268096

SEQ ID NO: 594080 - RNA, 64 nt, hsa; identical to SEQ ID NO: 268097

SEQ ID NO: 594081 - RNA, 64 nt, hsa; identical to SEQ ID NO: 268098

SEQ ID NO: 594082 - RNA, 64 nt, hsa; identical to SEQ ID NO: 268099

SEQ ID NO: 594083 - RNA, 64 nt, hsa; identical to SEQ ID NO: 268100

SEQ ID NO: 594084 - RNA, 64 nt, hsa; identical to SEQ ID NO: 268101

SEQ ID NO: 594085 - RNA, 64 nt, hsa; identical to SEQ ID NO: 268102

SEQ ID NO: 594086 - RNA, 64 nt, hsa; identical to SEQ ID NO: 268103

SEQ ID NO: 594087 - RNA, 64 nt, hsa; identical to SEQ ID NO: 268104

SEQ ID NO: 594088 - RNA, 64 nt, hsa; identical to SEQ ID NO: 268105

SEQ ID NO: 594089 - RNA, 64 nt, hsa; identical to SEQ ID NO: 268106

SEQ ID NO: 594090 - RNA, 64 nt, hsa; identical to SEQ ID NO: 268107

SEQ ID NO: 594091 - RNA, 64 nt, hsa; identical to SEQ ID NO: 268108

SEQ ID NO: 594092 - RNA, 64 nt, hsa; identical to SEQ ID NO: 268109

SEQ ID NO: 594093 - RNA, 64 nt, hsa; identical to SEQ ID NO: 268110

SEQ ID NO: 594094 - RNA, 64 nt, hsa; identical to SEQ ID NO: 268111

SEQ ID NO: 594095 - RNA, 64 nt, hsa; identical to SEQ ID NO: 268112

SEQ ID NO: 594096 - RNA, 64 nt, hsa; identical to SEQ ID NO: 268113

SEQ ID NO: 594097 - RNA, 64 nt, hsa; identical to SEQ ID NO: 268114

SEQ ID NO: 594098 - RNA, 64 nt, hsa; identical to SEQ ID NO: 268115

SEQ ID NO: 594099 - RNA, 64 nt, hsa; identical to SEQ ID NO: 268116

SEQ ID NO: 594100 - RNA, 64 nt, hsa; identical to SEQ ID NO: 268117

SEQ ID NO: 594101 - RNA, 64 nt, hsa; identical to SEQ ID NO: 268118

SEQ ID NO: 594102 - RNA, 64 nt, hsa; identical to SEQ ID NO: 268119

SEQ ID NO: 594103 - RNA, 64 nt, hsa; identical to SEQ ID NO: 268120

SEQ ID NO: 594104 - RNA, 64 nt, hsa; identical to SEQ ID NO: 268121

SEQ ID NO: 594105 - RNA, 64 nt, hsa; identical to SEQ ID NO: 268122

SEQ ID NO: 594106 - RNA, 64 nt, hsa; identical to SEQ ID NO: 268123

SEQ ID NO: 594107 - RNA, 64 nt, hsa; identical to SEQ ID NO: 268124

SEQ ID NO: 594108 - RNA, 64 nt, hsa; identical to SEQ ID NO: 268125

SEQ ID NO: 594109 - RNA, 64 nt, hsa; identical to SEQ ID NO: 268126

SEQ ID NO: 594110 - RNA, 64 nt, hsa; identical to SEQ ID NO: 268127

SEQ ID NO: 594111 - RNA, 64 nt, hsa; identical to SEQ ID NO: 268128

SEQ ID NO: 594112 - RNA, 64 nt, hsa; identical to SEQ ID NO: 268129

SEQ ID NO: 594113 - RNA, 64 nt, hsa; identical to SEQ ID NO: 268130

SEQ ID NO: 594114 - RNA, 64 nt, hsa; identical to SEQ ID NO: 268131

SEQ ID NO: 594115 - RNA, 64 nt, hsa; identical to SEQ ID NO: 268132

SEQ ID NO: 594116 - RNA, 64 nt, hsa; identical to SEQ ID NO: 268133

SEQ ID NO: 594117 - RNA, 64 nt, hsa; identical to SEQ ID NO: 268134

SEQ ID NO: 594118 - RNA, 64 nt, hsa; identical to SEQ ID NO: 268135

SEQ ID NO: 594119 - RNA, 64 nt, hsa; identical to SEQ ID NO: 268136

SEQ ID NO: 594120 - RNA, 64 nt, hsa; identical to SEQ ID NO: 268137

SEQ ID NO: 594121 - RNA, 64 nt, hsa; identical to SEQ ID NO: 268138

SEQ ID NO: 594122 - RNA, 64 nt, hsa; identical to SEQ ID NO: 268139

SEQ ID NO: 594123 - RNA, 64 nt, hsa; identical to SEQ ID NO: 268140

SEQ ID NO: 594124 - RNA, 64 nt, hsa; identical to SEQ ID NO: 268141

SEQ ID NO: 594125 - RNA, 64 nt, hsa; identical to SEQ ID NO: 268142

SEQ ID NO: 594126 - RNA, 64 nt, hsa; identical to SEQ ID NO: 268143

SEQ ID NO: 594127 - RNA, 64 nt, hsa; identical to SEQ ID NO: 268144

SEQ ID NO: 594128 - RNA, 64 nt, hsa; identical to SEQ ID NO: 268145

SEQ ID NO: 594129 - RNA, 64 nt, hsa; identical to SEQ ID NO: 268146

SEQ ID NO: 594130 - RNA, 64 nt, hsa; identical to SEQ ID NO: 268147

SEQ ID NO: 594131 - RNA, 64 nt, hsa; identical to SEQ ID NO: 268148

SEQ ID NO: 594132 - RNA, 64 nt, hsa; identical to SEQ ID NO: 268149

SEQ ID NO: 594133 - RNA, 64 nt, hsa; identical to SEQ ID NO: 268150

SEQ ID NO: 594134 - RNA, 64 nt, hsa; identical to SEQ ID NO: 268151

SEQ ID NO: 594135 - RNA, 64 nt, hsa; identical to SEQ ID NO: 268152

SEQ ID NO: 594136 - RNA, 64 nt, hsa; identical to SEQ ID NO: 268153

SEQ ID NO: 594137 - RNA, 64 nt, hsa; identical to SEQ ID NO: 268154

SEQ ID NO: 594138 - RNA, 64 nt, hsa; identical to SEQ ID NO: 268155

SEQ ID NO: 594139 - RNA, 64 nt, hsa; identical to SEQ ID NO: 268156

SEQ ID NO: 594140 - RNA, 64 nt, hsa; identical to SEQ ID NO: 268157

SEQ ID NO: 594141 - RNA, 64 nt, hsa; identical to SEQ ID NO: 268158

SEQ ID NO: 594142 - RNA, 64 nt, hsa; identical to SEQ ID NO: 268159

SEQ ID NO: 594143 - RNA, 64 nt, hsa; identical to SEQ ID NO: 268160

SEQ ID NO: 594144 - RNA, 64 nt, hsa; identical to SEQ ID NO: 268161

SEQ ID NO: 594145 - RNA, 64 nt, hsa; identical to SEQ ID NO: 268162

SEQ ID NO: 594146 - RNA, 64 nt, hsa; identical to SEQ ID NO: 268163

SEQ ID NO: 594147 - RNA, 64 nt, hsa; identical to SEQ ID NO: 268164

SEQ ID NO: 594148 - RNA, 64 nt, hsa; identical to SEQ ID NO: 268165

SEQ ID NO: 594149 - RNA, 64 nt, hsa; identical to SEQ ID NO: 268166

SEQ ID NO: 594150 - RNA, 64 nt, hsa; identical to SEQ ID NO: 268167

SEQ ID NO: 594151 - RNA, 64 nt, hsa; identical to SEQ ID NO: 268168

SEQ ID NO: 594152 - RNA, 64 nt, hsa; identical to SEQ ID NO: 268169

SEQ ID NO: 594153 - RNA, 64 nt, hsa; identical to SEQ ID NO: 268170

SEQ ID NO: 594154 - RNA, 64 nt, hsa; identical to SEQ ID NO: 268171

SEQ ID NO: 594155 - RNA, 64 nt, hsa; identical to SEQ ID NO: 268172

SEQ ID NO: 594156 - RNA, 64 nt, hsa; identical to SEQ ID NO: 268173

SEQ ID NO: 594157 - RNA, 64 nt, hsa; identical to SEQ ID NO: 268174

SEQ ID NO: 594158 - RNA, 64 nt, hsa; identical to SEQ ID NO: 268175

SEQ ID NO: 594159 - RNA, 64 nt, hsa; identical to SEQ ID NO: 268176

SEQ ID NO: 594160 - RNA, 64 nt, hsa; identical to SEQ ID NO: 268177

SEQ ID NO: 594161 - RNA, 64 nt, hsa; identical to SEQ ID NO: 268178

SEQ ID NO: 594162 - RNA, 64 nt, hsa; identical to SEQ ID NO: 268179

SEQ ID NO: 594163 - RNA, 64 nt, hsa; identical to SEQ ID NO: 268180

SEQ ID NO: 594164 - RNA, 64 nt, hsa; identical to SEQ ID NO: 268181

SEQ ID NO: 594165 - RNA, 64 nt, hsa; identical to SEQ ID NO: 268182

SEQ ID NO: 594166 - RNA, 64 nt, hsa; identical to SEQ ID NO: 268183

SEQ ID NO: 594167 - RNA, 64 nt, hsa; identical to SEQ ID NO: 268184

SEQ ID NO: 594168 - RNA, 64 nt, hsa; identical to SEQ ID NO: 268185

SEQ ID NO: 594169 - RNA, 64 nt, hsa; identical to SEQ ID NO: 268186

SEQ ID NO: 594170 - RNA, 64 nt, hsa; identical to SEQ ID NO: 268187

SEQ ID NO: 594171 - RNA, 64 nt, hsa; identical to SEQ ID NO: 268188

SEQ ID NO: 594172 - RNA, 64 nt, hsa; identical to SEQ ID NO: 268189

SEQ ID NO: 594173 - RNA, 64 nt, hsa; identical to SEQ ID NO: 268190

SEQ ID NO: 594174 - RNA, 64 nt, hsa; identical to SEQ ID NO: 268191

SEQ ID NO: 594175 - RNA, 64 nt, hsa; identical to SEQ ID NO: 268192

SEQ ID NO: 594176 - RNA, 64 nt, hsa; identical to SEQ ID NO: 268193

SEQ ID NO: 594177 - RNA, 64 nt, hsa; identical to SEQ ID NO: 268194

SEQ ID NO: 594178 - RNA, 64 nt, hsa; identical to SEQ ID NO: 268195

SEQ ID NO: 594179 - RNA, 64 nt, hsa; identical to SEQ ID NO: 268196

SEQ ID NO: 594180 - RNA, 64 nt, hsa; identical to SEQ ID NO: 268197

SEQ ID NO: 594181 - RNA, 64 nt, hsa; identical to SEQ ID NO: 268198

SEQ ID NO: 594182 - RNA, 64 nt, hsa; identical to SEQ ID NO: 268199

SEQ ID NO: 594183 - RNA, 64 nt, hsa; identical to SEQ ID NO: 268200

SEQ ID NO: 594184 - RNA, 64 nt, hsa; identical to SEQ ID NO: 268201

SEQ ID NO: 594185 - RNA, 64 nt, hsa; identical to SEQ ID NO: 268202

SEQ ID NO: 594186 - RNA, 64 nt, hsa; identical to SEQ ID NO: 268203

SEQ ID NO: 594187 - RNA, 64 nt, hsa; identical to SEQ ID NO: 268204

SEQ ID NO: 594188 - RNA, 64 nt, hsa; identical to SEQ ID NO: 268205

SEQ ID NO: 594189 - RNA, 64 nt, hsa; identical to SEQ ID NO: 268206

SEQ ID NO: 594190 - RNA, 64 nt, hsa; identical to SEQ ID NO: 268207

SEQ ID NO: 594191 - RNA, 64 nt, hsa; identical to SEQ ID NO: 268208

SEQ ID NO: 594192 - RNA, 64 nt, hsa; identical to SEQ ID NO: 268209

SEQ ID NO: 594193 - RNA, 64 nt, hsa; identical to SEQ ID NO: 268210

SEQ ID NO: 594194 - RNA, 64 nt, hsa; identical to SEQ ID NO: 268211

SEQ ID NO: 594195 - RNA, 64 nt, hsa; identical to SEQ ID NO: 268212

SEQ ID NO: 594196 - RNA, 64 nt, hsa; identical to SEQ ID NO: 268213

SEQ ID NO: 594197 - RNA, 64 nt, hsa; identical to SEQ ID NO: 268214

SEQ ID NO: 594198 - RNA, 64 nt, hsa; identical to SEQ ID NO: 268215

SEQ ID NO: 594199 - RNA, 64 nt, hsa; identical to SEQ ID NO: 268216

SEQ ID NO: 594200 - RNA, 64 nt, hsa; identical to SEQ ID NO: 268217

SEQ ID NO: 594201 - RNA, 64 nt, hsa; identical to SEQ ID NO: 268218

SEQ ID NO: 594202 - RNA, 64 nt, hsa; identical to SEQ ID NO: 268219

SEQ ID NO: 594203 - RNA, 64 nt, hsa; identical to SEQ ID NO: 268220

SEQ ID NO: 594204 - RNA, 64 nt, hsa; identical to SEQ ID NO: 268221

SEQ ID NO: 594205 - RNA, 64 nt, hsa; identical to SEQ ID NO: 268222

SEQ ID NO: 594206 - RNA, 64 nt, hsa; identical to SEQ ID NO: 268223

SEQ ID NO: 594207 - RNA, 64 nt, hsa; identical to SEQ ID NO: 268224

SEQ ID NO: 594208 - RNA, 64 nt, hsa; identical to SEQ ID NO: 268225

SEQ ID NO: 594209 - RNA, 64 nt, hsa; identical to SEQ ID NO: 268226

SEQ ID NO: 594210 - RNA, 64 nt, hsa; identical to SEQ ID NO: 268227

SEQ ID NO: 594211 - RNA, 64 nt, hsa; identical to SEQ ID NO: 268228

SEQ ID NO: 594212 - RNA, 64 nt, hsa; identical to SEQ ID NO: 268229

SEQ ID NO: 594213 - RNA, 64 nt, hsa; identical to SEQ ID NO: 268230

SEQ ID NO: 594214 - RNA, 64 nt, hsa; identical to SEQ ID NO: 268231

SEQ ID NO: 594215 - RNA, 64 nt, hsa; identical to SEQ ID NO: 268232

SEQ ID NO: 594216 - RNA, 64 nt, hsa; identical to SEQ ID NO: 268233

SEQ ID NO: 594217 - RNA, 64 nt, hsa; identical to SEQ ID NO: 268234

SEQ ID NO: 594218 - RNA, 64 nt, hsa; identical to SEQ ID NO: 268235

SEQ ID NO: 594219 - RNA, 64 nt, hsa; identical to SEQ ID NO: 268236

SEQ ID NO: 594220 - RNA, 64 nt, hsa; identical to SEQ ID NO: 268237

SEQ ID NO: 594221 - RNA, 64 nt, hsa; identical to SEQ ID NO: 268238

SEQ ID NO: 594222 - RNA, 64 nt, hsa; identical to SEQ ID NO: 268239

SEQ ID NO: 594223 - RNA, 64 nt, hsa; identical to SEQ ID NO: 268240

SEQ ID NO: 594224 - RNA, 64 nt, hsa; identical to SEQ ID NO: 268241

SEQ ID NO: 594225 - RNA, 64 nt, hsa; identical to SEQ ID NO: 268242

SEQ ID NO: 594226 - RNA, 64 nt, hsa; identical to SEQ ID NO: 268243

SEQ ID NO: 594227 - RNA, 64 nt, hsa; identical to SEQ ID NO: 268244

SEQ ID NO: 594228 - RNA, 64 nt, hsa; identical to SEQ ID NO: 268245

SEQ ID NO: 594229 - RNA, 64 nt, hsa; identical to SEQ ID NO: 268246

SEQ ID NO: 594230 - RNA, 64 nt, hsa; identical to SEQ ID NO: 268247

SEQ ID NO: 594231 - RNA, 64 nt, hsa; identical to SEQ ID NO: 268248

SEQ ID NO: 594232 - RNA, 64 nt, hsa; identical to SEQ ID NO: 268249

SEQ ID NO: 594233 - RNA, 64 nt, hsa; identical to SEQ ID NO: 268250

SEQ ID NO: 594234 - RNA, 64 nt, hsa; identical to SEQ ID NO: 268251

SEQ ID NO: 594235 - RNA, 64 nt, hsa; identical to SEQ ID NO: 268252

SEQ ID NO: 594236 - RNA, 64 nt, hsa; identical to SEQ ID NO: 268253

SEQ ID NO: 594237 - RNA, 64 nt, hsa; identical to SEQ ID NO: 268254

SEQ ID NO: 594238 - RNA, 64 nt, hsa; identical to SEQ ID NO: 268255

SEQ ID NO: 594239 - RNA, 64 nt, hsa; identical to SEQ ID NO: 268256

SEQ ID NO: 594240 - RNA, 64 nt, hsa; identical to SEQ ID NO: 268257

SEQ ID NO: 594241 - RNA, 64 nt, hsa; identical to SEQ ID NO: 268258

SEQ ID NO: 594242 - RNA, 64 nt, hsa; identical to SEQ ID NO: 268259

SEQ ID NO: 594243 - RNA, 64 nt, hsa; identical to SEQ ID NO: 268260

SEQ ID NO: 594244 - RNA, 64 nt, hsa; identical to SEQ ID NO: 268261

SEQ ID NO: 594245 - RNA, 64 nt, hsa; identical to SEQ ID NO: 268262

SEQ ID NO: 594246 - RNA, 64 nt, hsa; identical to SEQ ID NO: 268263

SEQ ID NO: 594247 - RNA, 64 nt, hsa; identical to SEQ ID NO: 268264

SEQ ID NO: 594248 - RNA, 64 nt, hsa; identical to SEQ ID NO: 268265

SEQ ID NO: 594249 - RNA, 64 nt, hsa; identical to SEQ ID NO: 268266

SEQ ID NO: 594250 - RNA, 64 nt, hsa; identical to SEQ ID NO: 268267

SEQ ID NO: 594251 - RNA, 64 nt, hsa; identical to SEQ ID NO: 268268

SEQ ID NO: 594252 - RNA, 64 nt, hsa; identical to SEQ ID NO: 268269

SEQ ID NO: 594253 - RNA, 64 nt, hsa; identical to SEQ ID NO: 268270

SEQ ID NO: 594254 - RNA, 64 nt, hsa; identical to SEQ ID NO: 268271

SEQ ID NO: 594255 - RNA, 64 nt, hsa; identical to SEQ ID NO: 268272

SEQ ID NO: 594256 - RNA, 64 nt, hsa; identical to SEQ ID NO: 268273

SEQ ID NO: 594257 - RNA, 64 nt, hsa; identical to SEQ ID NO: 268274

SEQ ID NO: 594258 - RNA, 64 nt, hsa; identical to SEQ ID NO: 268275

SEQ ID NO: 594259 - RNA, 64 nt, hsa; identical to SEQ ID NO: 268276

SEQ ID NO: 594260 - RNA, 64 nt, hsa; identical to SEQ ID NO: 268277

SEQ ID NO: 594261 - RNA, 64 nt, hsa; identical to SEQ ID NO: 268278

SEQ ID NO: 594262 - RNA, 64 nt, hsa; identical to SEQ ID NO: 268279

SEQ ID NO: 594263 - RNA, 64 nt, hsa; identical to SEQ ID NO: 268280

SEQ ID NO: 594264 - RNA, 64 nt, hsa; identical to SEQ ID NO: 268281

SEQ ID NO: 594265 - RNA, 64 nt, hsa; identical to SEQ ID NO: 268282

SEQ ID NO: 594266 - RNA, 64 nt, hsa; identical to SEQ ID NO: 268283

SEQ ID NO: 594267 - RNA, 64 nt, hsa; identical to SEQ ID NO: 268284

SEQ ID NO: 594268 - RNA, 64 nt, hsa; identical to SEQ ID NO: 268285

SEQ ID NO: 594269 - RNA, 64 nt, hsa; identical to SEQ ID NO: 268286

SEQ ID NO: 594270 - RNA, 64 nt, hsa; identical to SEQ ID NO: 268287

SEQ ID NO: 594271 - RNA, 64 nt, hsa; identical to SEQ ID NO: 268288

SEQ ID NO: 594272 - RNA, 64 nt, hsa; identical to SEQ ID NO: 268289

SEQ ID NO: 594273 - RNA, 64 nt, hsa; identical to SEQ ID NO: 268290

SEQ ID NO: 594274 - RNA, 64 nt, hsa; identical to SEQ ID NO: 268291

SEQ ID NO: 594275 - RNA, 64 nt, hsa; identical to SEQ ID NO: 268292

SEQ ID NO: 594276 - RNA, 64 nt, hsa; identical to SEQ ID NO: 268293

SEQ ID NO: 594277 - RNA, 64 nt, hsa; identical to SEQ ID NO: 268294

SEQ ID NO: 594278 - RNA, 64 nt, hsa; identical to SEQ ID NO: 268295

SEQ ID NO: 594279 - RNA, 64 nt, hsa; identical to SEQ ID NO: 268296

SEQ ID NO: 594280 - RNA, 64 nt, hsa; identical to SEQ ID NO: 268297

SEQ ID NO: 594281 - RNA, 64 nt, hsa; identical to SEQ ID NO: 268298

SEQ ID NO: 594282 - RNA, 64 nt, hsa; identical to SEQ ID NO: 268299

SEQ ID NO: 594283 - RNA, 64 nt, hsa; identical to SEQ ID NO: 268300

SEQ ID NO: 594284 - RNA, 64 nt, hsa; identical to SEQ ID NO: 268301

SEQ ID NO: 594285 - RNA, 64 nt, hsa; identical to SEQ ID NO: 268302

SEQ ID NO: 594286 - RNA, 64 nt, hsa; identical to SEQ ID NO: 268303

SEQ ID NO: 594287 - RNA, 64 nt, hsa; identical to SEQ ID NO: 268304

SEQ ID NO: 594288 - RNA, 64 nt, hsa; identical to SEQ ID NO: 268305

SEQ ID NO: 594289 - RNA, 64 nt, hsa; identical to SEQ ID NO: 268306

SEQ ID NO: 594290 - RNA, 64 nt, hsa; identical to SEQ ID NO: 268307

SEQ ID NO: 594291 - RNA, 64 nt, hsa; identical to SEQ ID NO: 268308

SEQ ID NO: 594292 - RNA, 64 nt, hsa; identical to SEQ ID NO: 268309

SEQ ID NO: 594293 - RNA, 64 nt, hsa; identical to SEQ ID NO: 268310

SEQ ID NO: 594294 - RNA, 64 nt, hsa; identical to SEQ ID NO: 268311

SEQ ID NO: 594295 - RNA, 64 nt, hsa; identical to SEQ ID NO: 268312

SEQ ID NO: 594296 - RNA, 64 nt, hsa; identical to SEQ ID NO: 268313

SEQ ID NO: 594297 - RNA, 64 nt, hsa; identical to SEQ ID NO: 268314

SEQ ID NO: 594298 - RNA, 64 nt, hsa; identical to SEQ ID NO: 268315

SEQ ID NO: 594299 - RNA, 64 nt, hsa; identical to SEQ ID NO: 268316

SEQ ID NO: 594300 - RNA, 64 nt, hsa; identical to SEQ ID NO: 268317

SEQ ID NO: 594301 - RNA, 64 nt, hsa; identical to SEQ ID NO: 268318

SEQ ID NO: 594302 - RNA, 64 nt, hsa; identical to SEQ ID NO: 268319

SEQ ID NO: 594303 - RNA, 64 nt, hsa; identical to SEQ ID NO: 268320

SEQ ID NO: 594304 - RNA, 64 nt, hsa; identical to SEQ ID NO: 268321

SEQ ID NO: 594305 - RNA, 64 nt, hsa; identical to SEQ ID NO: 268322

SEQ ID NO: 594306 - RNA, 64 nt, hsa; identical to SEQ ID NO: 268323

SEQ ID NO: 594307 - RNA, 64 nt, hsa; identical to SEQ ID NO: 268324

SEQ ID NO: 594308 - RNA, 64 nt, hsa; identical to SEQ ID NO: 268325

SEQ ID NO: 594309 - RNA, 64 nt, hsa; identical to SEQ ID NO: 268326

SEQ ID NO: 594310 - RNA, 64 nt, hsa; identical to SEQ ID NO: 268327

SEQ ID NO: 594311 - RNA, 64 nt, hsa; identical to SEQ ID NO: 268328

SEQ ID NO: 594312 - RNA, 64 nt, hsa; identical to SEQ ID NO: 268329

SEQ ID NO: 594313 - RNA, 64 nt, hsa; identical to SEQ ID NO: 268330

SEQ ID NO: 594314 - RNA, 64 nt, hsa; identical to SEQ ID NO: 268331

SEQ ID NO: 594315 - RNA, 64 nt, hsa; identical to SEQ ID NO: 268332

SEQ ID NO: 594316 - RNA, 64 nt, hsa; identical to SEQ ID NO: 268333

SEQ ID NO: 594317 - RNA, 64 nt, hsa; identical to SEQ ID NO: 268334

SEQ ID NO: 594318 - RNA, 64 nt, hsa; identical to SEQ ID NO: 268335

SEQ ID NO: 594319 - RNA, 64 nt, hsa; identical to SEQ ID NO: 268336

SEQ ID NO: 594320 - RNA, 64 nt, hsa; identical to SEQ ID NO: 268337

SEQ ID NO: 594321 - RNA, 64 nt, hsa; identical to SEQ ID NO: 268338

SEQ ID NO: 594322 - RNA, 64 nt, hsa; identical to SEQ ID NO: 268339

SEQ ID NO: 594323 - RNA, 64 nt, hsa; identical to SEQ ID NO: 268340

SEQ ID NO: 594324 - RNA, 64 nt, hsa; identical to SEQ ID NO: 268341

SEQ ID NO: 594325 - RNA, 64 nt, hsa; identical to SEQ ID NO: 268342

SEQ ID NO: 594326 - RNA, 64 nt, hsa; identical to SEQ ID NO: 268343

SEQ ID NO: 594327 - RNA, 64 nt, hsa; identical to SEQ ID NO: 268344

SEQ ID NO: 594328 - RNA, 64 nt, hsa; identical to SEQ ID NO: 268345

SEQ ID NO: 594329 - RNA, 64 nt, hsa; identical to SEQ ID NO: 268346

SEQ ID NO: 594330 - RNA, 64 nt, hsa; identical to SEQ ID NO: 268347

SEQ ID NO: 594331 - RNA, 64 nt, hsa; identical to SEQ ID NO: 268348

SEQ ID NO: 594332 - RNA, 64 nt, hsa; identical to SEQ ID NO: 268349

SEQ ID NO: 594333 - RNA, 64 nt, hsa; identical to SEQ ID NO: 268350

SEQ ID NO: 594334 - RNA, 64 nt, hsa; identical to SEQ ID NO: 268351

SEQ ID NO: 594335 - RNA, 64 nt, hsa; identical to SEQ ID NO: 268352

SEQ ID NO: 594336 - RNA, 64 nt, hsa; identical to SEQ ID NO: 268353

SEQ ID NO: 594337 - RNA, 64 nt, hsa; identical to SEQ ID NO: 268354

SEQ ID NO: 594338 - RNA, 64 nt, hsa; identical to SEQ ID NO: 268355

SEQ ID NO: 594339 - RNA, 64 nt, hsa; identical to SEQ ID NO: 268356

SEQ ID NO: 594340 - RNA, 64 nt, hsa; identical to SEQ ID NO: 268357

SEQ ID NO: 594341 - RNA, 64 nt, hsa; identical to SEQ ID NO: 268358

SEQ ID NO: 594342 - RNA, 64 nt, hsa; identical to SEQ ID NO: 268359

SEQ ID NO: 594343 - RNA, 64 nt, hsa; identical to SEQ ID NO: 268360

SEQ ID NO: 594344 - RNA, 64 nt, hsa; identical to SEQ ID NO: 268361

SEQ ID NO: 594345 - RNA, 64 nt, hsa; identical to SEQ ID NO: 268362

SEQ ID NO: 594346 - RNA, 64 nt, hsa; identical to SEQ ID NO: 268363

SEQ ID NO: 594347 - RNA, 64 nt, hsa; identical to SEQ ID NO: 268364

SEQ ID NO: 594348 - RNA, 64 nt, hsa; identical to SEQ ID NO: 268365

SEQ ID NO: 594349 - RNA, 64 nt, hsa; identical to SEQ ID NO: 268366

SEQ ID NO: 594350 - RNA, 64 nt, hsa; identical to SEQ ID NO: 268367

SEQ ID NO: 594351 - RNA, 64 nt, hsa; identical to SEQ ID NO: 268368

SEQ ID NO: 594352 - RNA, 64 nt, hsa; identical to SEQ ID NO: 268369

SEQ ID NO: 594353 - RNA, 64 nt, hsa; identical to SEQ ID NO: 268370

SEQ ID NO: 594354 - RNA, 64 nt, hsa; identical to SEQ ID NO: 268371

SEQ ID NO: 594355 - RNA, 64 nt, hsa; identical to SEQ ID NO: 268372

SEQ ID NO: 594356 - RNA, 64 nt, hsa; identical to SEQ ID NO: 268373

SEQ ID NO: 594357 - RNA, 64 nt, hsa; identical to SEQ ID NO: 268374

SEQ ID NO: 594358 - RNA, 64 nt, hsa; identical to SEQ ID NO: 268375

SEQ ID NO: 594359 - RNA, 64 nt, hsa; identical to SEQ ID NO: 268376

SEQ ID NO: 594360 - RNA, 64 nt, hsa; identical to SEQ ID NO: 268377

SEQ ID NO: 594361 - RNA, 64 nt, hsa; identical to SEQ ID NO: 268378

SEQ ID NO: 594362 - RNA, 64 nt, hsa; identical to SEQ ID NO: 268379

SEQ ID NO: 594363 - RNA, 64 nt, hsa; identical to SEQ ID NO: 268380

SEQ ID NO: 594364 - RNA, 64 nt, hsa; identical to SEQ ID NO: 268381

SEQ ID NO: 594365 - RNA, 64 nt, hsa; identical to SEQ ID NO: 268382

SEQ ID NO: 594366 - RNA, 64 nt, hsa; identical to SEQ ID NO: 268383

SEQ ID NO: 594367 - RNA, 64 nt, hsa; identical to SEQ ID NO: 268384

SEQ ID NO: 594368 - RNA, 64 nt, hsa; identical to SEQ ID NO: 268385

SEQ ID NO: 594369 - RNA, 64 nt, hsa; identical to SEQ ID NO: 268386

SEQ ID NO: 594370 - RNA, 64 nt, hsa; identical to SEQ ID NO: 268387

SEQ ID NO: 594371 - RNA, 64 nt, hsa; identical to SEQ ID NO: 268388

SEQ ID NO: 594372 - RNA, 64 nt, hsa; identical to SEQ ID NO: 268389

SEQ ID NO: 594373 - RNA, 64 nt, hsa; identical to SEQ ID NO: 268390

SEQ ID NO: 594374 - RNA, 64 nt, hsa; identical to SEQ ID NO: 268391

SEQ ID NO: 594375 - RNA, 64 nt, hsa; identical to SEQ ID NO: 268392

SEQ ID NO: 594376 - RNA, 64 nt, hsa; identical to SEQ ID NO: 268393

SEQ ID NO: 594377 - RNA, 64 nt, hsa; identical to SEQ ID NO: 268394

SEQ ID NO: 594378 - RNA, 64 nt, hsa; identical to SEQ ID NO: 268395

SEQ ID NO: 594379 - RNA, 64 nt, hsa; identical to SEQ ID NO: 268396

SEQ ID NO: 594380 - RNA, 64 nt, hsa; identical to SEQ ID NO: 268397

SEQ ID NO: 594381 - RNA, 64 nt, hsa; identical to SEQ ID NO: 268398

SEQ ID NO: 594382 - RNA, 64 nt, hsa; identical to SEQ ID NO: 268399

SEQ ID NO: 594383 - RNA, 64 nt, hsa; identical to SEQ ID NO: 268400

SEQ ID NO: 594384 - RNA, 64 nt, hsa; identical to SEQ ID NO: 268401

SEQ ID NO: 594385 - RNA, 64 nt, hsa; identical to SEQ ID NO: 268402

SEQ ID NO: 594386 - RNA, 64 nt, hsa; identical to SEQ ID NO: 268403

SEQ ID NO: 594387 - RNA, 64 nt, hsa; identical to SEQ ID NO: 268404

SEQ ID NO: 594388 - RNA, 64 nt, hsa; identical to SEQ ID NO: 268405

SEQ ID NO: 594389 - RNA, 64 nt, hsa; identical to SEQ ID NO: 268406

SEQ ID NO: 594390 - RNA, 64 nt, hsa; identical to SEQ ID NO: 268407

SEQ ID NO: 594391 - RNA, 64 nt, hsa; identical to SEQ ID NO: 268408

SEQ ID NO: 594392 - RNA, 64 nt, hsa; identical to SEQ ID NO: 268409

SEQ ID NO: 594393 - RNA, 64 nt, hsa; identical to SEQ ID NO: 268410

SEQ ID NO: 594394 - RNA, 64 nt, hsa; identical to SEQ ID NO: 268411

SEQ ID NO: 594395 - RNA, 64 nt, hsa; identical to SEQ ID NO: 268412

SEQ ID NO: 594396 - RNA, 64 nt, hsa; identical to SEQ ID NO: 268413

SEQ ID NO: 594397 - RNA, 64 nt, hsa; identical to SEQ ID NO: 268414

SEQ ID NO: 594398 - RNA, 64 nt, hsa; identical to SEQ ID NO: 268415

SEQ ID NO: 594399 - RNA, 64 nt, hsa; identical to SEQ ID NO: 268416

SEQ ID NO: 594400 - RNA, 64 nt, hsa; identical to SEQ ID NO: 268417

SEQ ID NO: 594401 - RNA, 64 nt, hsa; identical to SEQ ID NO: 268418

SEQ ID NO: 594402 - RNA, 64 nt, hsa; identical to SEQ ID NO: 268419

SEQ ID NO: 594403 - RNA, 64 nt, hsa; identical to SEQ ID NO: 268420

SEQ ID NO: 594404 - RNA, 64 nt, hsa; identical to SEQ ID NO: 268421

SEQ ID NO: 594405 - RNA, 64 nt, hsa; identical to SEQ ID NO: 268422

SEQ ID NO: 594406 - RNA, 64 nt, hsa; identical to SEQ ID NO: 268423

SEQ ID NO: 594407 - RNA, 64 nt, hsa; identical to SEQ ID NO: 268424

SEQ ID NO: 594408 - RNA, 64 nt, hsa; identical to SEQ ID NO: 268425

SEQ ID NO: 594409 - RNA, 64 nt, hsa; identical to SEQ ID NO: 268426

SEQ ID NO: 594410 - RNA, 64 nt, hsa; identical to SEQ ID NO: 268427

SEQ ID NO: 594411 - RNA, 64 nt, hsa; identical to SEQ ID NO: 268428

SEQ ID NO: 594412 - RNA, 64 nt, hsa; identical to SEQ ID NO: 268429

SEQ ID NO: 594413 - RNA, 64 nt, hsa; identical to SEQ ID NO: 268430

SEQ ID NO: 594414 - RNA, 64 nt, hsa; identical to SEQ ID NO: 268431

SEQ ID NO: 594415 - RNA, 64 nt, hsa; identical to SEQ ID NO: 268432

SEQ ID NO: 594416 - RNA, 64 nt, hsa; identical to SEQ ID NO: 268433

SEQ ID NO: 594417 - RNA, 64 nt, hsa; identical to SEQ ID NO: 268434

SEQ ID NO: 594418 - RNA, 64 nt, hsa; identical to SEQ ID NO: 268435

SEQ ID NO: 594419 - RNA, 64 nt, hsa; identical to SEQ ID NO: 268436

SEQ ID NO: 594420 - RNA, 64 nt, hsa; identical to SEQ ID NO: 268437

SEQ ID NO: 594421 - RNA, 64 nt, hsa; identical to SEQ ID NO: 268438

SEQ ID NO: 594422 - RNA, 64 nt, hsa; identical to SEQ ID NO: 268439

SEQ ID NO: 594423 - RNA, 64 nt, hsa; identical to SEQ ID NO: 268440

SEQ ID NO: 594424 - RNA, 64 nt, hsa; identical to SEQ ID NO: 268441

SEQ ID NO: 594425 - RNA, 64 nt, hsa; identical to SEQ ID NO: 268442

SEQ ID NO: 594426 - RNA, 64 nt, hsa; identical to SEQ ID NO: 268443

SEQ ID NO: 594427 - RNA, 64 nt, hsa; identical to SEQ ID NO: 268444

SEQ ID NO: 594428 - RNA, 64 nt, hsa; identical to SEQ ID NO: 268445

SEQ ID NO: 594429 - RNA, 64 nt, hsa; identical to SEQ ID NO: 268446

SEQ ID NO: 594430 - RNA, 64 nt, hsa; identical to SEQ ID NO: 268447

SEQ ID NO: 594431 - RNA, 64 nt, hsa; identical to SEQ ID NO: 268448

SEQ ID NO: 594432 - RNA, 64 nt, hsa; identical to SEQ ID NO: 268449

SEQ ID NO: 594433 - RNA, 64 nt, hsa; identical to SEQ ID NO: 268450

SEQ ID NO: 594434 - RNA, 64 nt, hsa; identical to SEQ ID NO: 268451

SEQ ID NO: 594435 - RNA, 64 nt, hsa; identical to SEQ ID NO: 268452

SEQ ID NO: 594436 - RNA, 64 nt, hsa; identical to SEQ ID NO: 268453

SEQ ID NO: 594437 - RNA, 64 nt, hsa; identical to SEQ ID NO: 268454

SEQ ID NO: 594438 - RNA, 64 nt, hsa; identical to SEQ ID NO: 268455

SEQ ID NO: 594439 - RNA, 64 nt, hsa; identical to SEQ ID NO: 268456

SEQ ID NO: 594440 - RNA, 64 nt, hsa; identical to SEQ ID NO: 268457

SEQ ID NO: 594441 - RNA, 64 nt, hsa; identical to SEQ ID NO: 268458

SEQ ID NO: 594442 - RNA, 64 nt, hsa; identical to SEQ ID NO: 268459

SEQ ID NO: 594443 - RNA, 64 nt, hsa; identical to SEQ ID NO: 268460

SEQ ID NO: 594444 - RNA, 64 nt, hsa; identical to SEQ ID NO: 268461

SEQ ID NO: 594445 - RNA, 64 nt, hsa; identical to SEQ ID NO: 268462

SEQ ID NO: 594446 - RNA, 64 nt, hsa; identical to SEQ ID NO: 268463

SEQ ID NO: 594447 - RNA, 64 nt, hsa; identical to SEQ ID NO: 268464

SEQ ID NO: 594448 - RNA, 64 nt, hsa; identical to SEQ ID NO: 268465

SEQ ID NO: 594449 - RNA, 64 nt, hsa; identical to SEQ ID NO: 268466

SEQ ID NO: 594450 - RNA, 64 nt, hsa; identical to SEQ ID NO: 268467

SEQ ID NO: 594451 - RNA, 64 nt, hsa; identical to SEQ ID NO: 268468

SEQ ID NO: 594452 - RNA, 64 nt, hsa; identical to SEQ ID NO: 268469

SEQ ID NO: 594453 - RNA, 64 nt, hsa; identical to SEQ ID NO: 268470

SEQ ID NO: 594454 - RNA, 64 nt, hsa; identical to SEQ ID NO: 268471

SEQ ID NO: 594455 - RNA, 64 nt, hsa; identical to SEQ ID NO: 268472

SEQ ID NO: 594456 - RNA, 64 nt, hsa; identical to SEQ ID NO: 268473

SEQ ID NO: 594457 - RNA, 64 nt, hsa; identical to SEQ ID NO: 268474

SEQ ID NO: 594458 - RNA, 64 nt, hsa; identical to SEQ ID NO: 268475

SEQ ID NO: 594459 - RNA, 64 nt, hsa; identical to SEQ ID NO: 268476

SEQ ID NO: 594460 - RNA, 64 nt, hsa; identical to SEQ ID NO: 268477

SEQ ID NO: 594461 - RNA, 64 nt, hsa; identical to SEQ ID NO: 268478

SEQ ID NO: 594462 - RNA, 64 nt, hsa; identical to SEQ ID NO: 268479

SEQ ID NO: 594463 - RNA, 64 nt, hsa; identical to SEQ ID NO: 268480

SEQ ID NO: 594464 - RNA, 64 nt, hsa; identical to SEQ ID NO: 268481

SEQ ID NO: 594465 - RNA, 64 nt, hsa; identical to SEQ ID NO: 268482

SEQ ID NO: 594466 - RNA, 64 nt, hsa; identical to SEQ ID NO: 268483

SEQ ID NO: 594467 - RNA, 64 nt, hsa; identical to SEQ ID NO: 268484

SEQ ID NO: 594468 - RNA, 64 nt, hsa; identical to SEQ ID NO: 268485

SEQ ID NO: 594469 - RNA, 64 nt, hsa; identical to SEQ ID NO: 268486

SEQ ID NO: 594470 - RNA, 64 nt, hsa; identical to SEQ ID NO: 268487

SEQ ID NO: 594471 - RNA, 64 nt, hsa; identical to SEQ ID NO: 268488

SEQ ID NO: 594472 - RNA, 64 nt, hsa; identical to SEQ ID NO: 268489

SEQ ID NO: 594473 - RNA, 64 nt, hsa; identical to SEQ ID NO: 268490

SEQ ID NO: 594474 - RNA, 64 nt, hsa; identical to SEQ ID NO: 268491

SEQ ID NO: 594475 - RNA, 64 nt, hsa; identical to SEQ ID NO: 268492

SEQ ID NO: 594476 - RNA, 64 nt, hsa; identical to SEQ ID NO: 268493

SEQ ID NO: 594477 - RNA, 64 nt, hsa; identical to SEQ ID NO: 268494

SEQ ID NO: 594478 - RNA, 64 nt, hsa; identical to SEQ ID NO: 268495

SEQ ID NO: 594479 - RNA, 64 nt, hsa; identical to SEQ ID NO: 268496

SEQ ID NO: 594480 - RNA, 64 nt, hsa; identical to SEQ ID NO: 268497

SEQ ID NO: 594481 - RNA, 64 nt, hsa; identical to SEQ ID NO: 268498

SEQ ID NO: 594482 - RNA, 64 nt, hsa; identical to SEQ ID NO: 268499

SEQ ID NO: 594483 - RNA, 64 nt, hsa; identical to SEQ ID NO: 268500

SEQ ID NO: 594484 - RNA, 64 nt, hsa; identical to SEQ ID NO: 268501

SEQ ID NO: 594485 - RNA, 64 nt, hsa; identical to SEQ ID NO: 268502

SEQ ID NO: 594486 - RNA, 64 nt, hsa; identical to SEQ ID NO: 268503

SEQ ID NO: 594487 - RNA, 64 nt, hsa; identical to SEQ ID NO: 268504

SEQ ID NO: 594488 - RNA, 64 nt, hsa; identical to SEQ ID NO: 268505

SEQ ID NO: 594489 - RNA, 64 nt, hsa; identical to SEQ ID NO: 268506

SEQ ID NO: 594490 - RNA, 64 nt, hsa; identical to SEQ ID NO: 268507

SEQ ID NO: 594491 - RNA, 64 nt, hsa; identical to SEQ ID NO: 268508

SEQ ID NO: 594492 - RNA, 64 nt, hsa; identical to SEQ ID NO: 268509

SEQ ID NO: 594493 - RNA, 64 nt, hsa; identical to SEQ ID NO: 268510

SEQ ID NO: 594494 - RNA, 64 nt, hsa; identical to SEQ ID NO: 268511

SEQ ID NO: 594495 - RNA, 64 nt, hsa; identical to SEQ ID NO: 268512

SEQ ID NO: 594496 - RNA, 64 nt, hsa; identical to SEQ ID NO: 268513

SEQ ID NO: 594497 - RNA, 64 nt, hsa; identical to SEQ ID NO: 268514

SEQ ID NO: 594498 - RNA, 64 nt, hsa; identical to SEQ ID NO: 268515

SEQ ID NO: 594499 - RNA, 54 nt, hsa; identical to SEQ ID NO: 268516

SEQ ID NO: 594500 - RNA, 64 nt, hsa; identical to SEQ ID NO: 268517

SEQ ID NO: 594501 - RNA, 64 nt, hsa; identical to SEQ ID NO: 268518

SEQ ID NO: 594502 - RNA, 64 nt, hsa; identical to SEQ ID NO: 268519

SEQ ID NO: 594503 - RNA, 64 nt, hsa; identical to SEQ ID NO: 268520

SEQ ID NO: 594504 - RNA, 64 nt, hsa; identical to SEQ ID NO: 268521

SEQ ID NO: 594505 - RNA, 64 nt, hsa; identical to SEQ ID NO: 268522

SEQ ID NO: 594506 - RNA, 64 nt, hsa; identical to SEQ ID NO: 268523

SEQ ID NO: 594507 - RNA, 64 nt, hsa; identical to SEQ ID NO: 268524

SEQ ID NO: 594508 - RNA, 64 nt, hsa; identical to SEQ ID NO: 268525

SEQ ID NO: 594509 - RNA, 64 nt, hsa; identical to SEQ ID NO: 268526

SEQ ID NO: 594510 - RNA, 64 nt, hsa; identical to SEQ ID NO: 268527

SEQ ID NO: 594511 - RNA, 64 nt, hsa; identical to SEQ ID NO: 268528

SEQ ID NO: 594512 - RNA, 64 nt, hsa; identical to SEQ ID NO: 268529

SEQ ID NO: 594513 - RNA, 64 nt, hsa; identical to SEQ ID NO: 268530

SEQ ID NO: 594514 - RNA, 64 nt, hsa; identical to SEQ ID NO: 268531

SEQ ID NO: 594515 - RNA, 57 nt, hsa; identical to SEQ ID NO: 268532

SEQ ID NO: 594516 - RNA, 64 nt, hsa; identical to SEQ ID NO: 268533

SEQ ID NO: 594517 - RNA, 64 nt, hsa; identical to SEQ ID NO: 268534

SEQ ID NO: 594518 - RNA, 64 nt, hsa; identical to SEQ ID NO: 268535

SEQ ID NO: 594519 - RNA, 64 nt, hsa; identical to SEQ ID NO: 268536

SEQ ID NO: 594520 - RNA, 64 nt, hsa; identical to SEQ ID NO: 268537

SEQ ID NO: 594521 - RNA, 64 nt, hsa; identical to SEQ ID NO: 268538

SEQ ID NO: 594522 - RNA, 64 nt, hsa; identical to SEQ ID NO: 268539

SEQ ID NO: 594523 - RNA, 64 nt, hsa; identical to SEQ ID NO: 268540

SEQ ID NO: 594524 - RNA, 64 nt, hsa; identical to SEQ ID NO: 268541

SEQ ID NO: 594525 - RNA, 64 nt, hsa; identical to SEQ ID NO: 268542

SEQ ID NO: 594526 - RNA, 64 nt, hsa; identical to SEQ ID NO: 268543

SEQ ID NO: 594527 - RNA, 64 nt, hsa; identical to SEQ ID NO: 268544

SEQ ID NO: 594528 - RNA, 64 nt, hsa; identical to SEQ ID NO: 268545

SEQ ID NO: 594529 - RNA, 64 nt, hsa; identical to SEQ ID NO: 268546

SEQ ID NO: 594530 - RNA, 64 nt, hsa; identical to SEQ ID NO: 268547

SEQ ID NO: 594531 - RNA, 64 nt, hsa; identical to SEQ ID NO: 268548

SEQ ID NO: 594532 - RNA, 64 nt, hsa; identical to SEQ ID NO: 268549

SEQ ID NO: 594533 - RNA, 64 nt, hsa; identical to SEQ ID NO: 268550

SEQ ID NO: 594534 - RNA, 64 nt, hsa; identical to SEQ ID NO: 268551

SEQ ID NO: 594535 - RNA, 64 nt, hsa; identical to SEQ ID NO: 268552

SEQ ID NO: 594536 - RNA, 64 nt, hsa; identical to SEQ ID NO: 268553

SEQ ID NO: 594537 - RNA, 64 nt, hsa; identical to SEQ ID NO: 268554

SEQ ID NO: 594538 - RNA, 64 nt, hsa; identical to SEQ ID NO: 268555

SEQ ID NO: 594539 - RNA, 64 nt, hsa; identical to SEQ ID NO: 268556

SEQ ID NO: 594540 - RNA, 64 nt, hsa; identical to SEQ ID NO: 268557

SEQ ID NO: 594541 - RNA, 64 nt, hsa; identical to SEQ ID NO: 268558

SEQ ID NO: 594542 - RNA, 64 nt, hsa; identical to SEQ ID NO: 268559

SEQ ID NO: 594543 - RNA, 64 nt, hsa; identical to SEQ ID NO: 268560

SEQ ID NO: 594544 - RNA, 64 nt, hsa; identical to SEQ ID NO: 268561

SEQ ID NO: 594545 - RNA, 64 nt, hsa; identical to SEQ ID NO: 268562

SEQ ID NO: 594546 - RNA, 64 nt, hsa; identical to SEQ ID NO: 268563

SEQ ID NO: 594547 - RNA, 64 nt, hsa; identical to SEQ ID NO: 268564

SEQ ID NO: 594548 - RNA, 64 nt, hsa; identical to SEQ ID NO: 268565

SEQ ID NO: 594549 - RNA, 64 nt, hsa; identical to SEQ ID NO: 268566

SEQ ID NO: 594550 - RNA, 64 nt, hsa; identical to SEQ ID NO: 268567

SEQ ID NO: 594551 - RNA, 64 nt, hsa; identical to SEQ ID NO: 268568

SEQ ID NO: 594552 - RNA, 64 nt, hsa; identical to SEQ ID NO: 268569

SEQ ID NO: 594553 - RNA, 64 nt, hsa; identical to SEQ ID NO: 268570

SEQ ID NO: 594554 - RNA, 64 nt, hsa; identical to SEQ ID NO: 268571

SEQ ID NO: 594555 - RNA, 64 nt, hsa; identical to SEQ ID NO: 268572

SEQ ID NO: 594556 - RNA, 64 nt, hsa; identical to SEQ ID NO: 268573

SEQ ID NO: 594557 - RNA, 64 nt, hsa; identical to SEQ ID NO: 268574

SEQ ID NO: 594558 - RNA, 64 nt, hsa; identical to SEQ ID NO: 268575

SEQ ID NO: 594559 - RNA, 64 nt, hsa; identical to SEQ ID NO: 268576

SEQ ID NO: 594560 - RNA, 64 nt, hsa; identical to SEQ ID NO: 268577

SEQ ID NO: 594561 - RNA, 64 nt, hsa; identical to SEQ ID NO: 268578

SEQ ID NO: 594562 - RNA, 64 nt, hsa; identical to SEQ ID NO: 268579

SEQ ID NO: 594563 - RNA, 64 nt, hsa; identical to SEQ ID NO: 268580

SEQ ID NO: 594564 - RNA, 64 nt, hsa; identical to SEQ ID NO: 268581

SEQ ID NO: 594565 - RNA, 64 nt, hsa; identical to SEQ ID NO: 268582

SEQ ID NO: 594566 - RNA, 64 nt, hsa; identical to SEQ ID NO: 268583

SEQ ID NO: 594567 - RNA, 64 nt, hsa; identical to SEQ ID NO: 268584

SEQ ID NO: 594568 - RNA, 64 nt, hsa; identical to SEQ ID NO: 268585

SEQ ID NO: 594569 - RNA, 64 nt, hsa; identical to SEQ ID NO: 268586

SEQ ID NO: 594570 - RNA, 64 nt, hsa; identical to SEQ ID NO: 268587

SEQ ID NO: 594571 - RNA, 64 nt, hsa; identical to SEQ ID NO: 268588

SEQ ID NO: 594572 - RNA, 64 nt, hsa; identical to SEQ ID NO: 268589

SEQ ID NO: 594573 - RNA, 64 nt, hsa; identical to SEQ ID NO: 268590

SEQ ID NO: 594574 - RNA, 64 nt, hsa; identical to SEQ ID NO: 268591

SEQ ID NO: 594575 - RNA, 64 nt, hsa; identical to SEQ ID NO: 268592

SEQ ID NO: 594576 - RNA, 64 nt, hsa; identical to SEQ ID NO: 268593

SEQ ID NO: 594577 - RNA, 64 nt, hsa; identical to SEQ ID NO: 268594

SEQ ID NO: 594578 - RNA, 64 nt, hsa; identical to SEQ ID NO: 268595

SEQ ID NO: 594579 - RNA, 64 nt, hsa; identical to SEQ ID NO: 268596

SEQ ID NO: 594580 - RNA, 64 nt, hsa; identical to SEQ ID NO: 268597

SEQ ID NO: 594581 - RNA, 64 nt, hsa; identical to SEQ ID NO: 268598

SEQ ID NO: 594582 - RNA, 64 nt, hsa; identical to SEQ ID NO: 268599

SEQ ID NO: 594583 - RNA, 64 nt, hsa; identical to SEQ ID NO: 268600

SEQ ID NO: 594584 - RNA, 64 nt, hsa; identical to SEQ ID NO: 268601

SEQ ID NO: 594585 - RNA, 64 nt, hsa; identical to SEQ ID NO: 268602

SEQ ID NO: 594586 - RNA, 64 nt, hsa; identical to SEQ ID NO: 268603

SEQ ID NO: 594587 - RNA, 64 nt, hsa; identical to SEQ ID NO: 268604

SEQ ID NO: 594588 - RNA, 64 nt, hsa; identical to SEQ ID NO: 268605

SEQ ID NO: 594589 - RNA, 64 nt, hsa; identical to SEQ ID NO: 268606

SEQ ID NO: 594590 - RNA, 64 nt, hsa; identical to SEQ ID NO: 268607

SEQ ID NO: 594591 - RNA, 64 nt, hsa; identical to SEQ ID NO: 268608

SEQ ID NO: 594592 - RNA, 64 nt, hsa; identical to SEQ ID NO: 268609

SEQ ID NO: 594593 - RNA, 64 nt, hsa; identical to SEQ ID NO: 268610

SEQ ID NO: 594594 - RNA, 64 nt, hsa; identical to SEQ ID NO: 268611

SEQ ID NO: 594595 - RNA, 64 nt, hsa; identical to SEQ ID NO: 268612

SEQ ID NO: 594596 - RNA, 64 nt, hsa; identical to SEQ ID NO: 268613

SEQ ID NO: 594597 - RNA, 64 nt, hsa; identical to SEQ ID NO: 268614

SEQ ID NO: 594598 - RNA, 64 nt, hsa; identical to SEQ ID NO: 268615

SEQ ID NO: 594599 - RNA, 64 nt, hsa; identical to SEQ ID NO: 268616

SEQ ID NO: 594600 - RNA, 64 nt, hsa; identical to SEQ ID NO: 268617

SEQ ID NO: 594601 - RNA, 64 nt, hsa; identical to SEQ ID NO: 268618

SEQ ID NO: 594602 - RNA, 64 nt, hsa; identical to SEQ ID NO: 268619

SEQ ID NO: 594603 - RNA, 64 nt, hsa; identical to SEQ ID NO: 268620

SEQ ID NO: 594604 - RNA, 64 nt, hsa; identical to SEQ ID NO: 268621

SEQ ID NO: 594605 - RNA, 64 nt, hsa; identical to SEQ ID NO: 268622

SEQ ID NO: 594606 - RNA, 64 nt, hsa; identical to SEQ ID NO: 268623

SEQ ID NO: 594607 - RNA, 64 nt, hsa; identical to SEQ ID NO: 268624

SEQ ID NO: 594608 - RNA, 64 nt, hsa; identical to SEQ ID NO: 268625

SEQ ID NO: 594609 - RNA, 64 nt, hsa; identical to SEQ ID NO: 268626

SEQ ID NO: 594610 - RNA, 64 nt, hsa; identical to SEQ ID NO: 268627

SEQ ID NO: 594611 - RNA, 64 nt, hsa; identical to SEQ ID NO: 268628

SEQ ID NO: 594612 - RNA, 64 nt, hsa; identical to SEQ ID NO: 268629

SEQ ID NO: 594613 - RNA, 64 nt, hsa; identical to SEQ ID NO: 268630

SEQ ID NO: 594614 - RNA, 64 nt, hsa; identical to SEQ ID NO: 268631

SEQ ID NO: 594615 - RNA, 64 nt, hsa; identical to SEQ ID NO: 268632

SEQ ID NO: 594616 - RNA, 64 nt, hsa; identical to SEQ ID NO: 268633

SEQ ID NO: 594617 - RNA, 64 nt, hsa; identical to SEQ ID NO: 268634

SEQ ID NO: 594618 - RNA, 64 nt, hsa; identical to SEQ ID NO: 268635

SEQ ID NO: 594619 - RNA, 64 nt, hsa; identical to SEQ ID NO: 268636

SEQ ID NO: 594620 - RNA, 64 nt, hsa; identical to SEQ ID NO: 268637

SEQ ID NO: 594621 - RNA, 64 nt, hsa; identical to SEQ ID NO: 268638

SEQ ID NO: 594622 - RNA, 64 nt, hsa; identical to SEQ ID NO: 268639

SEQ ID NO: 594623 - RNA, 64 nt, hsa; identical to SEQ ID NO: 268640

SEQ ID NO: 594624 - RNA, 64 nt, hsa; identical to SEQ ID NO: 268641

SEQ ID NO: 594625 - RNA, 64 nt, hsa; identical to SEQ ID NO: 268642

SEQ ID NO: 594626 - RNA, 64 nt, hsa; identical to SEQ ID NO: 268643

SEQ ID NO: 594627 - RNA, 64 nt, hsa; identical to SEQ ID NO: 268644

SEQ ID NO: 594628 - RNA, 64 nt, hsa; identical to SEQ ID NO: 268645

SEQ ID NO: 594629 - RNA, 64 nt, hsa; identical to SEQ ID NO: 268646

SEQ ID NO: 594630 - RNA, 64 nt, hsa; identical to SEQ ID NO: 268647

SEQ ID NO: 594631 - RNA, 64 nt, hsa; identical to SEQ ID NO: 268648

SEQ ID NO: 594632 - RNA, 64 nt, hsa; identical to SEQ ID NO: 268649

SEQ ID NO: 594633 - RNA, 64 nt, hsa; identical to SEQ ID NO: 268650

SEQ ID NO: 594634 - RNA, 64 nt, hsa; identical to SEQ ID NO: 268651

SEQ ID NO: 594635 - RNA, 64 nt, hsa; identical to SEQ ID NO: 268652

SEQ ID NO: 594636 - RNA, 64 nt, hsa; identical to SEQ ID NO: 268653

SEQ ID NO: 594637 - RNA, 64 nt, hsa; identical to SEQ ID NO: 268654

SEQ ID NO: 594638 - RNA, 64 nt, hsa; identical to SEQ ID NO: 268655

SEQ ID NO: 594639 - RNA, 64 nt, hsa; identical to SEQ ID NO: 268656

SEQ ID NO: 594640 - RNA, 64 nt, hsa; identical to SEQ ID NO: 268657

SEQ ID NO: 594641 - RNA, 64 nt, hsa; identical to SEQ ID NO: 268658

SEQ ID NO: 594642 - RNA, 64 nt, hsa; identical to SEQ ID NO: 268659

SEQ ID NO: 594643 - RNA, 64 nt, hsa; identical to SEQ ID NO: 268660

SEQ ID NO: 594644 - RNA, 64 nt, hsa; identical to SEQ ID NO: 268661

SEQ ID NO: 594645 - RNA, 64 nt, hsa; identical to SEQ ID NO: 268662

SEQ ID NO: 594646 - RNA, 64 nt, hsa; identical to SEQ ID NO: 268663

SEQ ID NO: 594647 - RNA, 64 nt, hsa; identical to SEQ ID NO: 268664

SEQ ID NO: 594648 - RNA, 64 nt, hsa; identical to SEQ ID NO: 268665

SEQ ID NO: 594649 - RNA, 64 nt, hsa; identical to SEQ ID NO: 268666

SEQ ID NO: 594650 - RNA, 64 nt, hsa; identical to SEQ ID NO: 268667

SEQ ID NO: 594651 - RNA, 64 nt, hsa; identical to SEQ ID NO: 268668

SEQ ID NO: 594652 - RNA, 64 nt, hsa; identical to SEQ ID NO: 268669

SEQ ID NO: 594653 - RNA, 64 nt, hsa; identical to SEQ ID NO: 268670

SEQ ID NO: 594654 - RNA, 64 nt, hsa; identical to SEQ ID NO: 268671

SEQ ID NO: 594655 - RNA, 64 nt, hsa; identical to SEQ ID NO: 268672

SEQ ID NO: 594656 - RNA, 64 nt, hsa; identical to SEQ ID NO: 268673

SEQ ID NO: 594657 - RNA, 64 nt, hsa; identical to SEQ ID NO: 268674

SEQ ID NO: 594658 - RNA, 64 nt, hsa; identical to SEQ ID NO: 268675

SEQ ID NO: 594659 - RNA, 64 nt, hsa; identical to SEQ ID NO: 268676

SEQ ID NO: 594660 - RNA, 64 nt, hsa; identical to SEQ ID NO: 268677

SEQ ID NO: 594661 - RNA, 64 nt, hsa; identical to SEQ ID NO: 268678

SEQ ID NO: 594662 - RNA, 64 nt, hsa; identical to SEQ ID NO: 268679

SEQ ID NO: 594663 - RNA, 64 nt, hsa; identical to SEQ ID NO: 268680

SEQ ID NO: 594664 - RNA, 64 nt, hsa; identical to SEQ ID NO: 268681

SEQ ID NO: 594665 - RNA, 64 nt, hsa; identical to SEQ ID NO: 268682

SEQ ID NO: 594666 - RNA, 64 nt, hsa; identical to SEQ ID NO: 268683

SEQ ID NO: 594667 - RNA, 64 nt, hsa; identical to SEQ ID NO: 268684

SEQ ID NO: 594668 - RNA, 64 nt, hsa; identical to SEQ ID NO: 268685

SEQ ID NO: 594669 - RNA, 64 nt, hsa; identical to SEQ ID NO: 268686

SEQ ID NO: 594670 - RNA, 64 nt, hsa; identical to SEQ ID NO: 268687

SEQ ID NO: 594671 - RNA, 64 nt, hsa; identical to SEQ ID NO: 268688

SEQ ID NO: 594672 - RNA, 64 nt, hsa; identical to SEQ ID NO: 268689

SEQ ID NO: 594673 - RNA, 64 nt, hsa; identical to SEQ ID NO: 268690

SEQ ID NO: 594674 - RNA, 64 nt, hsa; identical to SEQ ID NO: 268691

SEQ ID NO: 594675 - RNA, 64 nt, hsa; identical to SEQ ID NO: 268692

SEQ ID NO: 594676 - RNA, 64 nt, hsa; identical to SEQ ID NO: 268693

SEQ ID NO: 594677 - RNA, 64 nt, hsa; identical to SEQ ID NO: 268694

SEQ ID NO: 594678 - RNA, 64 nt, hsa; identical to SEQ ID NO: 268695

SEQ ID NO: 594679 - RNA, 64 nt, hsa; identical to SEQ ID NO: 268696

SEQ ID NO: 594680 - RNA, 64 nt, hsa; identical to SEQ ID NO: 268697

SEQ ID NO: 594681 - RNA, 64 nt, hsa; identical to SEQ ID NO: 268698

SEQ ID NO: 594682 - RNA, 64 nt, hsa; identical to SEQ ID NO: 268699

SEQ ID NO: 594683 - RNA, 64 nt, hsa; identical to SEQ ID NO: 268700

SEQ ID NO: 594684 - RNA, 64 nt, hsa; identical to SEQ ID NO: 268701

SEQ ID NO: 594685 - RNA, 64 nt, hsa; identical to SEQ ID NO: 268702

SEQ ID NO: 594686 - RNA, 64 nt, hsa; identical to SEQ ID NO: 268703

SEQ ID NO: 594687 - RNA, 64 nt, hsa; identical to SEQ ID NO: 268704

SEQ ID NO: 594688 - RNA, 64 nt, hsa; identical to SEQ ID NO: 268705

SEQ ID NO: 594689 - RNA, 64 nt, hsa; identical to SEQ ID NO: 268706

SEQ ID NO: 594690 - RNA, 64 nt, hsa; identical to SEQ ID NO: 268707

SEQ ID NO: 594691 - RNA, 64 nt, hsa; identical to SEQ ID NO: 268708

SEQ ID NO: 594692 - RNA, 64 nt, hsa; identical to SEQ ID NO: 268709

SEQ ID NO: 594693 - RNA, 64 nt, hsa; identical to SEQ ID NO: 268710

SEQ ID NO: 594694 - RNA, 64 nt, hsa; identical to SEQ ID NO: 268711

SEQ ID NO: 594695 - RNA, 64 nt, hsa; identical to SEQ ID NO: 268712

SEQ ID NO: 594696 - RNA, 64 nt, hsa; identical to SEQ ID NO: 268713

SEQ ID NO: 594697 - RNA, 64 nt, hsa; identical to SEQ ID NO: 268714

SEQ ID NO: 594698 - RNA, 64 nt, hsa; identical to SEQ ID NO: 268715

SEQ ID NO: 594699 - RNA, 64 nt, hsa; identical to SEQ ID NO: 268716

SEQ ID NO: 594700 - RNA, 64 nt, hsa; identical to SEQ ID NO: 268717

SEQ ID NO: 594701 - RNA, 64 nt, hsa; identical to SEQ ID NO: 268718

SEQ ID NO: 594702 - RNA, 64 nt, hsa; identical to SEQ ID NO: 268719

SEQ ID NO: 594703 - RNA, 64 nt, hsa; identical to SEQ ID NO: 268720

SEQ ID NO: 594704 - RNA, 64 nt, hsa; identical to SEQ ID NO: 268721

SEQ ID NO: 594705 - RNA, 64 nt, hsa; identical to SEQ ID NO: 268722

SEQ ID NO: 594706 - RNA, 64 nt, hsa; identical to SEQ ID NO: 268723

SEQ ID NO: 594707 - RNA, 64 nt, hsa; identical to SEQ ID NO: 268724

SEQ ID NO: 594708 - RNA, 64 nt, hsa; identical to SEQ ID NO: 268725

SEQ ID NO: 594709 - RNA, 64 nt, hsa; identical to SEQ ID NO: 268726

SEQ ID NO: 594710 - RNA, 64 nt, hsa; identical to SEQ ID NO: 268727

SEQ ID NO: 594711 - RNA, 64 nt, hsa; identical to SEQ ID NO: 268728

SEQ ID NO: 594712 - RNA, 64 nt, hsa; identical to SEQ ID NO: 268729

SEQ ID NO: 594713 - RNA, 64 nt, hsa; identical to SEQ ID NO: 268730

SEQ ID NO: 594714 - RNA, 64 nt, hsa; identical to SEQ ID NO: 268731

SEQ ID NO: 594715 - RNA, 64 nt, hsa; identical to SEQ ID NO: 268732

SEQ ID NO: 594716 - RNA, 64 nt, hsa; identical to SEQ ID NO: 268733

SEQ ID NO: 594717 - RNA, 64 nt, hsa; identical to SEQ ID NO: 268734

SEQ ID NO: 594718 - RNA, 64 nt, hsa; identical to SEQ ID NO: 268735

SEQ ID NO: 594719 - RNA, 64 nt, hsa; identical to SEQ ID NO: 268736

SEQ ID NO: 594720 - RNA, 64 nt, hsa; identical to SEQ ID NO: 268737

SEQ ID NO: 594721 - RNA, 64 nt, hsa; identical to SEQ ID NO: 268738

SEQ ID NO: 594722 - RNA, 64 nt, hsa; identical to SEQ ID NO: 268739

SEQ ID NO: 594723 - RNA, 64 nt, hsa; identical to SEQ ID NO: 268740

SEQ ID NO: 594724 - RNA, 64 nt, hsa; identical to SEQ ID NO: 268741

SEQ ID NO: 594725 - RNA, 64 nt, hsa; identical to SEQ ID NO: 268742

SEQ ID NO: 594726 - RNA, 64 nt, hsa; identical to SEQ ID NO: 268743

SEQ ID NO: 594727 - RNA, 64 nt, hsa; identical to SEQ ID NO: 268744

SEQ ID NO: 594728 - RNA, 64 nt, hsa; identical to SEQ ID NO: 268745

SEQ ID NO: 594729 - RNA, 64 nt, hsa; identical to SEQ ID NO: 268746

SEQ ID NO: 594730 - RNA, 64 nt, hsa; identical to SEQ ID NO: 268747

SEQ ID NO: 594731 - RNA, 64 nt, hsa; identical to SEQ ID NO: 268748

SEQ ID NO: 594732 - RNA, 64 nt, hsa; identical to SEQ ID NO: 268749

SEQ ID NO: 594733 - RNA, 64 nt, hsa; identical to SEQ ID NO: 268750

SEQ ID NO: 594734 - RNA, 64 nt, hsa; identical to SEQ ID NO: 268751

SEQ ID NO: 594735 - RNA, 64 nt, hsa; identical to SEQ ID NO: 268752

SEQ ID NO: 594736 - RNA, 64 nt, hsa; identical to SEQ ID NO: 268753

SEQ ID NO: 594737 - RNA, 64 nt, hsa; identical to SEQ ID NO: 268754

SEQ ID NO: 594738 - RNA, 64 nt, hsa; identical to SEQ ID NO: 268755

SEQ ID NO: 594739 - RNA, 64 nt, hsa; identical to SEQ ID NO: 268756

SEQ ID NO: 594740 - RNA, 64 nt, hsa; identical to SEQ ID NO: 268757

SEQ ID NO: 594741 - RNA, 64 nt, hsa; identical to SEQ ID NO: 268758

SEQ ID NO: 594742 - RNA, 64 nt, hsa; identical to SEQ ID NO: 268759

SEQ ID NO: 594743 - RNA, 64 nt, hsa; identical to SEQ ID NO: 268760

SEQ ID NO: 594744 - RNA, 64 nt, hsa; identical to SEQ ID NO: 268761

SEQ ID NO: 594745 - RNA, 64 nt, hsa; identical to SEQ ID NO: 268762

SEQ ID NO: 594746 - RNA, 64 nt, hsa; identical to SEQ ID NO: 268763

SEQ ID NO: 594747 - RNA, 64 nt, hsa; identical to SEQ ID NO: 268764

SEQ ID NO: 594748 - RNA, 64 nt, hsa; identical to SEQ ID NO: 268765

SEQ ID NO: 594749 - RNA, 64 nt, hsa; identical to SEQ ID NO: 268766

SEQ ID NO: 594750 - RNA, 64 nt, hsa; identical to SEQ ID NO: 268767

SEQ ID NO: 594751 - RNA, 64 nt, hsa; identical to SEQ ID NO: 268768

SEQ ID NO: 594752 - RNA, 64 nt, hsa; identical to SEQ ID NO: 268769

SEQ ID NO: 594753 - RNA, 64 nt, hsa; identical to SEQ ID NO: 268770

SEQ ID NO: 594754 - RNA, 64 nt, hsa; identical to SEQ ID NO: 268771

SEQ ID NO: 594755 - RNA, 64 nt, hsa; identical to SEQ ID NO: 268772

SEQ ID NO: 594756 - RNA, 64 nt, hsa; identical to SEQ ID NO: 268773

SEQ ID NO: 594757 - RNA, 64 nt, hsa; identical to SEQ ID NO: 268774

SEQ ID NO: 594758 - RNA, 64 nt, hsa; identical to SEQ ID NO: 268775

SEQ ID NO: 594759 - RNA, 64 nt, hsa; identical to SEQ ID NO: 268776

SEQ ID NO: 594760 - RNA, 64 nt, hsa; identical to SEQ ID NO: 268777

SEQ ID NO: 594761 - RNA, 64 nt, hsa; identical to SEQ ID NO: 268778

SEQ ID NO: 594762 - RNA, 64 nt, hsa; identical to SEQ ID NO: 268779

SEQ ID NO: 594763 - RNA, 64 nt, hsa; identical to SEQ ID NO: 268780

SEQ ID NO: 594764 - RNA, 64 nt, hsa; identical to SEQ ID NO: 268781

SEQ ID NO: 594765 - RNA, 64 nt, hsa; identical to SEQ ID NO: 268782

SEQ ID NO: 594766 - RNA, 64 nt, hsa; identical to SEQ ID NO: 268783

SEQ ID NO: 594767 - RNA, 64 nt, hsa; identical to SEQ ID NO: 268784

SEQ ID NO: 594768 - RNA, 64 nt, hsa; identical to SEQ ID NO: 268785

SEQ ID NO: 594769 - RNA, 64 nt, hsa; identical to SEQ ID NO: 268786

SEQ ID NO: 594770 - RNA, 64 nt, hsa; identical to SEQ ID NO: 268787

SEQ ID NO: 594771 - RNA, 64 nt, hsa; identical to SEQ ID NO: 268788

SEQ ID NO: 594772 - RNA, 64 nt, hsa; identical to SEQ ID NO: 268789

SEQ ID NO: 594773 - RNA, 64 nt, hsa; identical to SEQ ID NO: 268790

SEQ ID NO: 594774 - RNA, 64 nt, hsa; identical to SEQ ID NO: 268791

SEQ ID NO: 594775 - RNA, 64 nt, hsa; identical to SEQ ID NO: 268792

SEQ ID NO: 594776 - RNA, 64 nt, hsa; identical to SEQ ID NO: 268793

SEQ ID NO: 594777 - RNA, 64 nt, hsa; identical to SEQ ID NO: 268794

SEQ ID NO: 594778 - RNA, 64 nt, hsa; identical to SEQ ID NO: 268795

SEQ ID NO: 594779 - RNA, 64 nt, hsa; identical to SEQ ID NO: 268796

SEQ ID NO: 594780 - RNA, 64 nt, hsa; identical to SEQ ID NO: 268797

SEQ ID NO: 594781 - RNA, 64 nt, hsa; identical to SEQ ID NO: 268798

SEQ ID NO: 594782 - RNA, 64 nt, hsa; identical to SEQ ID NO: 268799

SEQ ID NO: 594783 - RNA, 64 nt, hsa; identical to SEQ ID NO: 268800

SEQ ID NO: 594784 - RNA, 64 nt, hsa; identical to SEQ ID NO: 268801

SEQ ID NO: 594785 - RNA, 64 nt, hsa; identical to SEQ ID NO: 268802

SEQ ID NO: 594786 - RNA, 64 nt, hsa; identical to SEQ ID NO: 268803

SEQ ID NO: 594787 - RNA, 64 nt, hsa; identical to SEQ ID NO: 268804

SEQ ID NO: 594788 - RNA, 64 nt, hsa; identical to SEQ ID NO: 268805

SEQ ID NO: 594789 - RNA, 64 nt, hsa; identical to SEQ ID NO: 268806

SEQ ID NO: 594790 - RNA, 64 nt, hsa; identical to SEQ ID NO: 268807

SEQ ID NO: 594791 - RNA, 64 nt, hsa; identical to SEQ ID NO: 268808

SEQ ID NO: 594792 - RNA, 64 nt, hsa; identical to SEQ ID NO: 268809

SEQ ID NO: 594793 - RNA, 64 nt, hsa; identical to SEQ ID NO: 268810

SEQ ID NO: 594794 - RNA, 64 nt, hsa; identical to SEQ ID NO: 268811

SEQ ID NO: 594795 - RNA, 64 nt, hsa; identical to SEQ ID NO: 268812

SEQ ID NO: 594796 - RNA, 64 nt, hsa; identical to SEQ ID NO: 268813

SEQ ID NO: 594797 - RNA, 64 nt, hsa; identical to SEQ ID NO: 268814

SEQ ID NO: 594798 - RNA, 64 nt, hsa; identical to SEQ ID NO: 268815

SEQ ID NO: 594799 - RNA, 64 nt, hsa; identical to SEQ ID NO: 268816

SEQ ID NO: 594800 - RNA, 64 nt, hsa; identical to SEQ ID NO: 268817

SEQ ID NO: 594801 - RNA, 64 nt, hsa; identical to SEQ ID NO: 268818

SEQ ID NO: 594802 - RNA, 64 nt, hsa; identical to SEQ ID NO: 268819

SEQ ID NO: 594803 - RNA, 64 nt, hsa; identical to SEQ ID NO: 268820

SEQ ID NO: 594804 - RNA, 64 nt, hsa; identical to SEQ ID NO: 268821

SEQ ID NO: 594805 - RNA, 64 nt, hsa; identical to SEQ ID NO: 268822

SEQ ID NO: 594806 - RNA, 64 nt, hsa; identical to SEQ ID NO: 268823

SEQ ID NO: 594807 - RNA, 64 nt, hsa; identical to SEQ ID NO: 268824

SEQ ID NO: 594808 - RNA, 64 nt, hsa; identical to SEQ ID NO: 268825

SEQ ID NO: 594809 - RNA, 64 nt, hsa; identical to SEQ ID NO: 268826

SEQ ID NO: 594810 - RNA, 64 nt, hsa; identical to SEQ ID NO: 268827

SEQ ID NO: 594811 - RNA, 64 nt, hsa; identical to SEQ ID NO: 268828

SEQ ID NO: 594812 - RNA, 64 nt, hsa; identical to SEQ ID NO: 268829

SEQ ID NO: 594813 - RNA, 64 nt, hsa; identical to SEQ ID NO: 268830

SEQ ID NO: 594814 - RNA, 64 nt, hsa; identical to SEQ ID NO: 268831

SEQ ID NO: 594815 - RNA, 64 nt, hsa; identical to SEQ ID NO: 268832

SEQ ID NO: 594816 - RNA, 64 nt, hsa; identical to SEQ ID NO: 268833

SEQ ID NO: 594817 - RNA, 64 nt, hsa; identical to SEQ ID NO: 268834

SEQ ID NO: 594818 - RNA, 64 nt, hsa; identical to SEQ ID NO: 268835

SEQ ID NO: 594819 - RNA, 64 nt, hsa; identical to SEQ ID NO: 268836

SEQ ID NO: 594820 - RNA, 64 nt, hsa; identical to SEQ ID NO: 268837

SEQ ID NO: 594821 - RNA, 64 nt, hsa; identical to SEQ ID NO: 268838

SEQ ID NO: 594822 - RNA, 64 nt, hsa; identical to SEQ ID NO: 268839

SEQ ID NO: 594823 - RNA, 64 nt, hsa; identical to SEQ ID NO: 268840

SEQ ID NO: 594824 - RNA, 64 nt, hsa; identical to SEQ ID NO: 268841

SEQ ID NO: 594825 - RNA, 64 nt, hsa; identical to SEQ ID NO: 268842

SEQ ID NO: 594826 - RNA, 64 nt, hsa; identical to SEQ ID NO: 268843

SEQ ID NO: 594827 - RNA, 64 nt, hsa; identical to SEQ ID NO: 268844

SEQ ID NO: 594828 - RNA, 64 nt, hsa; identical to SEQ ID NO: 268845

SEQ ID NO: 594829 - RNA, 64 nt, hsa; identical to SEQ ID NO: 268846

SEQ ID NO: 594830 - RNA, 64 nt, hsa; identical to SEQ ID NO: 268847

SEQ ID NO: 594831 - RNA, 64 nt, hsa; identical to SEQ ID NO: 268848

SEQ ID NO: 594832 - RNA, 64 nt, hsa; identical to SEQ ID NO: 268849

SEQ ID NO: 594833 - RNA, 64 nt, hsa; identical to SEQ ID NO: 268457

SEQ ID NO: 594834 - RNA, 64 nt, hsa; identical to SEQ ID NO: 268458

SEQ ID NO: 594835 - RNA, 64 nt, hsa; identical to SEQ ID NO: 268852

SEQ ID NO: 594836 - RNA, 64 nt, hsa; identical to SEQ ID NO: 268853

SEQ ID NO: 594837 - RNA, 64 nt, hsa; identical to SEQ ID NO: 268854

SEQ ID NO: 594838 - RNA, 64 nt, hsa; identical to SEQ ID NO: 268855

SEQ ID NO: 594839 - RNA, 64 nt, hsa; identical to SEQ ID NO: 268856

SEQ ID NO: 594840 - RNA, 64 nt, hsa; identical to SEQ ID NO: 268857

SEQ ID NO: 594841 - RNA, 64 nt, hsa; identical to SEQ ID NO: 268858

SEQ ID NO: 594842 - RNA, 64 nt, hsa; identical to SEQ ID NO: 268859

SEQ ID NO: 594843 - RNA, 64 nt, hsa; identical to SEQ ID NO: 268860

SEQ ID NO: 594844 - RNA, 64 nt, hsa; identical to SEQ ID NO: 268861

SEQ ID NO: 594845 - RNA, 64 nt, hsa; identical to SEQ ID NO: 268862

SEQ ID NO: 594846 - RNA, 64 nt, hsa; identical to SEQ ID NO: 268863

SEQ ID NO: 594847 - RNA, 64 nt, hsa; identical to SEQ ID NO: 268864

SEQ ID NO: 594848 - RNA, 64 nt, hsa; identical to SEQ ID NO: 268865

SEQ ID NO: 594849 - RNA, 64 nt, hsa; identical to SEQ ID NO: 268866

SEQ ID NO: 594850 - RNA, 64 nt, hsa; identical to SEQ ID NO: 268867

SEQ ID NO: 594851 - RNA, 64 nt, hsa; identical to SEQ ID NO: 268868

SEQ ID NO: 594852 - RNA, 64 nt, hsa; identical to SEQ ID NO: 268869

SEQ ID NO: 594853 - RNA, 64 nt, hsa; identical to SEQ ID NO: 268870

SEQ ID NO: 594854 - RNA, 64 nt, hsa; identical to SEQ ID NO: 268871

SEQ ID NO: 594855 - RNA, 64 nt, hsa; identical to SEQ ID NO: 268872

SEQ ID NO: 594856 - RNA, 64 nt, hsa; identical to SEQ ID NO: 268873

SEQ ID NO: 594857 - RNA, 64 nt, hsa; identical to SEQ ID NO: 268874

SEQ ID NO: 594858 - RNA, 64 nt, hsa; identical to SEQ ID NO: 268875

SEQ ID NO: 594859 - RNA, 64 nt, hsa; identical to SEQ ID NO: 268876

SEQ ID NO: 594860 - RNA, 64 nt, hsa; identical to SEQ ID NO: 268877

SEQ ID NO: 594861 - RNA, 64 nt, hsa; identical to SEQ ID NO: 268878

SEQ ID NO: 594862 - RNA, 64 nt, hsa; identical to SEQ ID NO: 268879

SEQ ID NO: 594863 - RNA, 64 nt, hsa; identical to SEQ ID NO: 268880

SEQ ID NO: 594864 - RNA, 64 nt, hsa; identical to SEQ ID NO: 268881

SEQ ID NO: 594865 - RNA, 64 nt, hsa; identical to SEQ ID NO: 268882

SEQ ID NO: 594866 - RNA, 64 nt, hsa; identical to SEQ ID NO: 268883

SEQ ID NO: 594867 - RNA, 64 nt, hsa; identical to SEQ ID NO: 268884

SEQ ID NO: 594868 - RNA, 64 nt, hsa; identical to SEQ ID NO: 268885

SEQ ID NO: 594869 - RNA, 64 nt, hsa; identical to SEQ ID NO: 268886

SEQ ID NO: 594870 - RNA, 64 nt, hsa; identical to SEQ ID NO: 268887

SEQ ID NO: 594871 - RNA, 64 nt, hsa; identical to SEQ ID NO: 268888

SEQ ID NO: 594872 - RNA, 64 nt, hsa; identical to SEQ ID NO: 268889

SEQ ID NO: 594873 - RNA, 64 nt, hsa; identical to SEQ ID NO: 268890

SEQ ID NO: 594874 - RNA, 64 nt, hsa; identical to SEQ ID NO: 268891

SEQ ID NO: 594875 - RNA, 64 nt, hsa; identical to SEQ ID NO: 268892

SEQ ID NO: 594876 - RNA, 64 nt, hsa; identical to SEQ ID NO: 268893

SEQ ID NO: 594877 - RNA, 64 nt, hsa; identical to SEQ ID NO: 268894

SEQ ID NO: 594878 - RNA, 64 nt, hsa; identical to SEQ ID NO: 268895

SEQ ID NO: 594879 - RNA, 64 nt, hsa; identical to SEQ ID NO: 268896

SEQ ID NO: 594880 - RNA, 64 nt, hsa; identical to SEQ ID NO: 268897

SEQ ID NO: 594881 - RNA, 64 nt, hsa; identical to SEQ ID NO: 268898

SEQ ID NO: 594882 - RNA, 64 nt, hsa; identical to SEQ ID NO: 268899

SEQ ID NO: 594883 - RNA, 64 nt, hsa; identical to SEQ ID NO: 268900

SEQ ID NO: 594884 - RNA, 64 nt, hsa; identical to SEQ ID NO: 268901

SEQ ID NO: 594885 - RNA, 64 nt, hsa; identical to SEQ ID NO: 268902

SEQ ID NO: 594886 - RNA, 64 nt, hsa; identical to SEQ ID NO: 268903

SEQ ID NO: 594887 - RNA, 64 nt, hsa; identical to SEQ ID NO: 268904

SEQ ID NO: 594888 - RNA, 64 nt, hsa; identical to SEQ ID NO: 268905

SEQ ID NO: 594889 - RNA, 64 nt, hsa; identical to SEQ ID NO: 268906

SEQ ID NO: 594890 - RNA, 64 nt, hsa; identical to SEQ ID NO: 268907

SEQ ID NO: 594891 - RNA, 64 nt, hsa; identical to SEQ ID NO: 268908

SEQ ID NO: 594892 - RNA, 64 nt, hsa; identical to SEQ ID NO: 268909

SEQ ID NO: 594893 - RNA, 64 nt, hsa; identical to SEQ ID NO: 268910

SEQ ID NO: 594894 - RNA, 64 nt, hsa; identical to SEQ ID NO: 268911

SEQ ID NO: 594895 - RNA, 64 nt, hsa; identical to SEQ ID NO: 268912

SEQ ID NO: 594896 - RNA, 64 nt, hsa; identical to SEQ ID NO: 268913

SEQ ID NO: 594897 - RNA, 64 nt, hsa; identical to SEQ ID NO: 268914

SEQ ID NO: 594898 - RNA, 64 nt, hsa; identical to SEQ ID NO: 268915

SEQ ID NO: 594899 - RNA, 64 nt, hsa; identical to SEQ ID NO: 268916

SEQ ID NO: 594900 - RNA, 64 nt, hsa; identical to SEQ ID NO: 268917

SEQ ID NO: 594901 - RNA, 64 nt, hsa; identical to SEQ ID NO: 268918

SEQ ID NO: 594902 - RNA, 64 nt, hsa; identical to SEQ ID NO: 268919

SEQ ID NO: 594903 - RNA, 64 nt, hsa; identical to SEQ ID NO: 268920

SEQ ID NO: 594904 - RNA, 64 nt, hsa; identical to SEQ ID NO: 268921

SEQ ID NO: 594905 - RNA, 64 nt, hsa; identical to SEQ ID NO: 268922

SEQ ID NO: 594906 - RNA, 64 nt, hsa; identical to SEQ ID NO: 268923

SEQ ID NO: 594907 - RNA, 64 nt, hsa; identical to SEQ ID NO: 268924

SEQ ID NO: 594908 - RNA, 64 nt, hsa; identical to SEQ ID NO: 268925

SEQ ID NO: 594909 - RNA, 64 nt, hsa; identical to SEQ ID NO: 268926

SEQ ID NO: 594910 - RNA, 64 nt, hsa; identical to SEQ ID NO: 268927

SEQ ID NO: 594911 - RNA, 64 nt, hsa; identical to SEQ ID NO: 268928

SEQ ID NO: 594912 - RNA, 64 nt, hsa; identical to SEQ ID NO: 268929

SEQ ID NO: 594913 - RNA, 64 nt, hsa; identical to SEQ ID NO: 268930

SEQ ID NO: 594914 - RNA, 64 nt, hsa; identical to SEQ ID NO: 268931

SEQ ID NO: 594915 - RNA, 64 nt, hsa; identical to SEQ ID NO: 268932

SEQ ID NO: 594916 - RNA, 64 nt, hsa; identical to SEQ ID NO: 268933

SEQ ID NO: 594917 - RNA, 64 nt, hsa; identical to SEQ ID NO: 268934

SEQ ID NO: 594918 - RNA, 64 nt, hsa; identical to SEQ ID NO: 268935

SEQ ID NO: 594919 - RNA, 64 nt, hsa; identical to SEQ ID NO: 268936

SEQ ID NO: 594920 - RNA, 64 nt, hsa; identical to SEQ ID NO: 268937

SEQ ID NO: 594921 - RNA, 64 nt, hsa; identical to SEQ ID NO: 268938

SEQ ID NO: 594922 - RNA, 64 nt, hsa; identical to SEQ ID NO: 268939

SEQ ID NO: 594923 - RNA, 64 nt, hsa; identical to SEQ ID NO: 268940

SEQ ID NO: 594924 - RNA, 64 nt, hsa; identical to SEQ ID NO: 268941

SEQ ID NO: 594925 - RNA, 64 nt, hsa; identical to SEQ ID NO: 268942

SEQ ID NO: 594926 - RNA, 64 nt, hsa; identical to SEQ ID NO: 268943

SEQ ID NO: 594927 - RNA, 64 nt, hsa; identical to SEQ ID NO: 268944

SEQ ID NO: 594928 - RNA, 64 nt, hsa; identical to SEQ ID NO: 268945

SEQ ID NO: 594929 - RNA, 64 nt, hsa; identical to SEQ ID NO: 268946

SEQ ID NO: 594930 - RNA, 64 nt, hsa; identical to SEQ ID NO: 268947

SEQ ID NO: 594931 - RNA, 64 nt, hsa; identical to SEQ ID NO: 268948

SEQ ID NO: 594932 - RNA, 64 nt, hsa; identical to SEQ ID NO: 268949

SEQ ID NO: 594933 - RNA, 64 nt, hsa; identical to SEQ ID NO: 268950

SEQ ID NO: 594934 - RNA, 64 nt, hsa; identical to SEQ ID NO: 268951

SEQ ID NO: 594935 - RNA, 64 nt, hsa; identical to SEQ ID NO: 268952

SEQ ID NO: 594936 - RNA, 64 nt, hsa; identical to SEQ ID NO: 268953

SEQ ID NO: 594937 - RNA, 64 nt, hsa; identical to SEQ ID NO: 268954

SEQ ID NO: 594938 - RNA, 64 nt, hsa; identical to SEQ ID NO: 268955

SEQ ID NO: 594939 - RNA, 64 nt, hsa; identical to SEQ ID NO: 268956

SEQ ID NO: 594940 - RNA, 64 nt, hsa; identical to SEQ ID NO: 268957

SEQ ID NO: 594941 - RNA, 64 nt, hsa; identical to SEQ ID NO: 268958

SEQ ID NO: 594942 - RNA, 64 nt, hsa; identical to SEQ ID NO: 268959

SEQ ID NO: 594943 - RNA, 64 nt, hsa; identical to SEQ ID NO: 268960

SEQ ID NO: 594944 - RNA, 64 nt, hsa; identical to SEQ ID NO: 268961

SEQ ID NO: 594945 - RNA, 64 nt, hsa; identical to SEQ ID NO: 268962

SEQ ID NO: 594946 - RNA, 64 nt, hsa; identical to SEQ ID NO: 268963

SEQ ID NO: 594947 - RNA, 64 nt, hsa; identical to SEQ ID NO: 268964

SEQ ID NO: 594948 - RNA, 64 nt, hsa; identical to SEQ ID NO: 268965

SEQ ID NO: 594949 - RNA, 64 nt, hsa; identical to SEQ ID NO: 268966

SEQ ID NO: 594950 - RNA, 64 nt, hsa; identical to SEQ ID NO: 268967

SEQ ID NO: 594951 - RNA, 64 nt, hsa; identical to SEQ ID NO: 268968

SEQ ID NO: 594952 - RNA, 64 nt, hsa; identical to SEQ ID NO: 268969

SEQ ID NO: 594953 - RNA, 64 nt, hsa; identical to SEQ ID NO: 268970

SEQ ID NO: 594954 - RNA, 64 nt, hsa; identical to SEQ ID NO: 268971

SEQ ID NO: 594955 - RNA, 64 nt, hsa; identical to SEQ ID NO: 268972

SEQ ID NO: 594956 - RNA, 64 nt, hsa; identical to SEQ ID NO: 268973

SEQ ID NO: 594957 - RNA, 64 nt, hsa; identical to SEQ ID NO: 268974

SEQ ID NO: 594958 - RNA, 64 nt, hsa; identical to SEQ ID NO: 268975

SEQ ID NO: 594959 - RNA, 64 nt, hsa; identical to SEQ ID NO: 268976

SEQ ID NO: 594960 - RNA, 64 nt, hsa; identical to SEQ ID NO: 268977

SEQ ID NO: 594961 - RNA, 64 nt, hsa; identical to SEQ ID NO: 268978

SEQ ID NO: 594962 - RNA, 64 nt, hsa; identical to SEQ ID NO: 268979

SEQ ID NO: 594963 - RNA, 64 nt, hsa; identical to SEQ ID NO: 268980

SEQ ID NO: 594964 - RNA, 64 nt, hsa; identical to SEQ ID NO: 268981

SEQ ID NO: 594965 - RNA, 64 nt, hsa; identical to SEQ ID NO: 268982

SEQ ID NO: 594966 - RNA, 64 nt, hsa; identical to SEQ ID NO: 268983

SEQ ID NO: 594967 - RNA, 64 nt, hsa; identical to SEQ ID NO: 268984

SEQ ID NO: 594968 - RNA, 64 nt, hsa; identical to SEQ ID NO: 268985

SEQ ID NO: 594969 - RNA, 64 nt, hsa; identical to SEQ ID NO: 268986

SEQ ID NO: 594970 - RNA, 64 nt, hsa; identical to SEQ ID NO: 268987

SEQ ID NO: 594971 - RNA, 64 nt, hsa; identical to SEQ ID NO: 268988

SEQ ID NO: 594972 - RNA, 64 nt, hsa; identical to SEQ ID NO: 268989

SEQ ID NO: 594973 - RNA, 64 nt, hsa; identical to SEQ ID NO: 268990

SEQ ID NO: 594974 - RNA, 64 nt, hsa; identical to SEQ ID NO: 268991

SEQ ID NO: 594975 - RNA, 64 nt, hsa; identical to SEQ ID NO: 268992

SEQ ID NO: 594976 - RNA, 64 nt, hsa; identical to SEQ ID NO: 268993

SEQ ID NO: 594977 - RNA, 64 nt, hsa; identical to SEQ ID NO: 268994

SEQ ID NO: 594978 - RNA, 64 nt, hsa; identical to SEQ ID NO: 268995

SEQ ID NO: 594979 - RNA, 64 nt, hsa; identical to SEQ ID NO: 268996

SEQ ID NO: 594980 - RNA, 64 nt, hsa; identical to SEQ ID NO: 268997

SEQ ID NO: 594981 - RNA, 64 nt, hsa; identical to SEQ ID NO: 268998

SEQ ID NO: 594982 - RNA, 64 nt, hsa; identical to SEQ ID NO: 268999

SEQ ID NO: 594983 - RNA, 64 nt, hsa; identical to SEQ ID NO: 269000

SEQ ID NO: 594984 - RNA, 64 nt, hsa; identical to SEQ ID NO: 269001

SEQ ID NO: 594985 - RNA, 64 nt, hsa; identical to SEQ ID NO: 269002

SEQ ID NO: 594986 - RNA, 64 nt, hsa; identical to SEQ ID NO: 269003

SEQ ID NO: 594987 - RNA, 64 nt, hsa; identical to SEQ ID NO: 269004

SEQ ID NO: 594988 - RNA, 64 nt, hsa; identical to SEQ ID NO: 269005

SEQ ID NO: 594989 - RNA, 64 nt, hsa; identical to SEQ ID NO: 269006

SEQ ID NO: 594990 - RNA, 64 nt, hsa; identical to SEQ ID NO: 269007

SEQ ID NO: 594991 - RNA, 64 nt, hsa; identical to SEQ ID NO: 269008

SEQ ID NO: 594992 - RNA, 64 nt, hsa; identical to SEQ ID NO: 269009

SEQ ID NO: 594993 - RNA, 64 nt, hsa; identical to SEQ ID NO: 269010

SEQ ID NO: 594994 - RNA, 64 nt, hsa; identical to SEQ ID NO: 269011

SEQ ID NO: 594995 - RNA, 64 nt, hsa; identical to SEQ ID NO: 269012

SEQ ID NO: 594996 - RNA, 64 nt, hsa; identical to SEQ ID NO: 269013

SEQ ID NO: 594997 - RNA, 64 nt, hsa; identical to SEQ ID NO: 269014

SEQ ID NO: 594998 - RNA, 64 nt, hsa; identical to SEQ ID NO: 269015

SEQ ID NO: 594999 - RNA, 64 nt, hsa; identical to SEQ ID NO: 269016

SEQ ID NO: 595000 - RNA, 64 nt, hsa; identical to SEQ ID NO: 269017

SEQ ID NO: 595001 - RNA, 64 nt, hsa; identical to SEQ ID NO: 269018

SEQ ID NO: 595002 - RNA, 64 nt, hsa; identical to SEQ ID NO: 269019

SEQ ID NO: 595003 - RNA, 64 nt, hsa; identical to SEQ ID NO: 269020

SEQ ID NO: 595004 - RNA, 64 nt, hsa; identical to SEQ ID NO: 269021

SEQ ID NO: 595005 - RNA, 64 nt, hsa; identical to SEQ ID NO: 269022

SEQ ID NO: 595006 - RNA, 64 nt, hsa; identical to SEQ ID NO: 269023

SEQ ID NO: 595007 - RNA, 64 nt, hsa; identical to SEQ ID NO: 269024

SEQ ID NO: 595008 - RNA, 64 nt, hsa; identical to SEQ ID NO: 269025

SEQ ID NO: 595009 - RNA, 64 nt, hsa; identical to SEQ ID NO: 269026

SEQ ID NO: 595010 - RNA, 64 nt, hsa; identical to SEQ ID NO: 269027

SEQ ID NO: 595011 - RNA, 64 nt, hsa; identical to SEQ ID NO: 269028

SEQ ID NO: 595012 - RNA, 64 nt, hsa; identical to SEQ ID NO: 269029

SEQ ID NO: 595013 - RNA, 64 nt, hsa; identical to SEQ ID NO: 269030

SEQ ID NO: 595014 - RNA, 64 nt, hsa; identical to SEQ ID NO: 269031

SEQ ID NO: 595015 - RNA, 64 nt, hsa; identical to SEQ ID NO: 269032

SEQ ID NO: 595016 - RNA, 64 nt, hsa; identical to SEQ ID NO: 269033

SEQ ID NO: 595017 - RNA, 64 nt, hsa; identical to SEQ ID NO: 269034

SEQ ID NO: 595018 - RNA, 64 nt, hsa; identical to SEQ ID NO: 269035

SEQ ID NO: 595019 - RNA, 64 nt, hsa; identical to SEQ ID NO: 269036

SEQ ID NO: 595020 - RNA, 64 nt, hsa; identical to SEQ ID NO: 269037

SEQ ID NO: 595021 - RNA, 64 nt, hsa; identical to SEQ ID NO: 269038

SEQ ID NO: 595022 - RNA, 64 nt, hsa; identical to SEQ ID NO: 269039

SEQ ID NO: 595023 - RNA, 64 nt, hsa; identical to SEQ ID NO: 269040

SEQ ID NO: 595024 - RNA, 64 nt, hsa; identical to SEQ ID NO: 269041

SEQ ID NO: 595025 - RNA, 64 nt, hsa; identical to SEQ ID NO: 269042

SEQ ID NO: 595026 - RNA, 64 nt, hsa; identical to SEQ ID NO: 269043

SEQ ID NO: 595027 - RNA, 64 nt, hsa; identical to SEQ ID NO: 269044

SEQ ID NO: 595028 - RNA, 64 nt, hsa; identical to SEQ ID NO: 269045

SEQ ID NO: 595029 - RNA, 64 nt, hsa; identical to SEQ ID NO: 269046

SEQ ID NO: 595030 - RNA, 64 nt, hsa; identical to SEQ ID NO: 269047

SEQ ID NO: 595031 - RNA, 64 nt, hsa; identical to SEQ ID NO: 269048

SEQ ID NO: 595032 - RNA, 64 nt, hsa; identical to SEQ ID NO: 269049

SEQ ID NO: 595033 - RNA, 64 nt, hsa; identical to SEQ ID NO: 269050

SEQ ID NO: 595034 - RNA, 64 nt, hsa; identical to SEQ ID NO: 269051

SEQ ID NO: 595035 - RNA, 64 nt, hsa; identical to SEQ ID NO: 269052

SEQ ID NO: 595036 - RNA, 64 nt, hsa; identical to SEQ ID NO: 269053

SEQ ID NO: 595037 - RNA, 64 nt, hsa; identical to SEQ ID NO: 269054

SEQ ID NO: 595038 - RNA, 64 nt, hsa; identical to SEQ ID NO: 269055

SEQ ID NO: 595039 - RNA, 64 nt, hsa; identical to SEQ ID NO: 269056

SEQ ID NO: 595040 - RNA, 64 nt, hsa; identical to SEQ ID NO: 269057

SEQ ID NO: 595041 - RNA, 64 nt, hsa; identical to SEQ ID NO: 269058

SEQ ID NO: 595042 - RNA, 64 nt, hsa; identical to SEQ ID NO: 269059

SEQ ID NO: 595043 - RNA, 64 nt, hsa; identical to SEQ ID NO: 269060

SEQ ID NO: 595044 - RNA, 64 nt, hsa; identical to SEQ ID NO: 269061

SEQ ID NO: 595045 - RNA, 64 nt, hsa; identical to SEQ ID NO: 269062

SEQ ID NO: 595046 - RNA, 64 nt, hsa; identical to SEQ ID NO: 269063

SEQ ID NO: 595047 - RNA, 64 nt, hsa; identical to SEQ ID NO: 269064

SEQ ID NO: 595048 - RNA, 64 nt, hsa; identical to SEQ ID NO: 269065

SEQ ID NO: 595049 - RNA, 64 nt, hsa; identical to SEQ ID NO: 269066

SEQ ID NO: 595050 - RNA, 64 nt, hsa; identical to SEQ ID NO: 269067

SEQ ID NO: 595051 - RNA, 64 nt, hsa; identical to SEQ ID NO: 269068

SEQ ID NO: 595052 - RNA, 64 nt, hsa; identical to SEQ ID NO: 269069

SEQ ID NO: 595053 - RNA, 64 nt, hsa; identical to SEQ ID NO: 269070

SEQ ID NO: 595054 - RNA, 64 nt, hsa; identical to SEQ ID NO: 269071

SEQ ID NO: 595055 - RNA, 64 nt, hsa; identical to SEQ ID NO: 269072

SEQ ID NO: 595056 - RNA, 64 nt, hsa; identical to SEQ ID NO: 269073

SEQ ID NO: 595057 - RNA, 64 nt, hsa; identical to SEQ ID NO: 269074

SEQ ID NO: 595058 - RNA, 64 nt, hsa; identical to SEQ ID NO: 269075

SEQ ID NO: 595059 - RNA, 64 nt, hsa; identical to SEQ ID NO: 269076

SEQ ID NO: 595060 - RNA, 64 nt, hsa; identical to SEQ ID NO: 269077

SEQ ID NO: 595061 - RNA, 64 nt, hsa; identical to SEQ ID NO: 269078

SEQ ID NO: 595062 - RNA, 64 nt, hsa; identical to SEQ ID NO: 269079

SEQ ID NO: 595063 - RNA, 64 nt, hsa; identical to SEQ ID NO: 269080

SEQ ID NO: 595064 - RNA, 64 nt, hsa; identical to SEQ ID NO: 269081

SEQ ID NO: 595065 - RNA, 64 nt, hsa; identical to SEQ ID NO: 269082

SEQ ID NO: 595066 - RNA, 64 nt, hsa; identical to SEQ ID NO: 269083

SEQ ID NO: 595067 - RNA, 64 nt, hsa; identical to SEQ ID NO: 269084

SEQ ID NO: 595068 - RNA, 64 nt, hsa; identical to SEQ ID NO: 269085

SEQ ID NO: 595069 - RNA, 64 nt, hsa; identical to SEQ ID NO: 269086

SEQ ID NO: 595070 - RNA, 64 nt, hsa; identical to SEQ ID NO: 269087

SEQ ID NO: 595071 - RNA, 64 nt, hsa; identical to SEQ ID NO: 269088

SEQ ID NO: 595072 - RNA, 64 nt, hsa; identical to SEQ ID NO: 269089

SEQ ID NO: 595073 - RNA, 64 nt, hsa; identical to SEQ ID NO: 269090

SEQ ID NO: 595074 - RNA, 64 nt, hsa; identical to SEQ ID NO: 269091

SEQ ID NO: 595075 - RNA, 64 nt, hsa; identical to SEQ ID NO: 269092

SEQ ID NO: 595076 - RNA, 64 nt, hsa; identical to SEQ ID NO: 269093

SEQ ID NO: 595077 - RNA, 64 nt, hsa; identical to SEQ ID NO: 269094

SEQ ID NO: 595078 - RNA, 64 nt, hsa; identical to SEQ ID NO: 269095

SEQ ID NO: 595079 - RNA, 64 nt, hsa; identical to SEQ ID NO: 269096

SEQ ID NO: 595080 - RNA, 64 nt, hsa; identical to SEQ ID NO: 269097

SEQ ID NO: 595081 - RNA, 64 nt, hsa; identical to SEQ ID NO: 269098

SEQ ID NO: 595082 - RNA, 64 nt, hsa; identical to SEQ ID NO: 269099

SEQ ID NO: 595083 - RNA, 64 nt, hsa; identical to SEQ ID NO: 269100

SEQ ID NO: 595084 - RNA, 64 nt, hsa; identical to SEQ ID NO: 269101

SEQ ID NO: 595085 - RNA, 64 nt, hsa; identical to SEQ ID NO: 269102

SEQ ID NO: 595086 - RNA, 64 nt, hsa; identical to SEQ ID NO: 269103

SEQ ID NO: 595087 - RNA, 55 nt, hsa; identical to SEQ ID NO: 269104

SEQ ID NO: 595088 - RNA, 64 nt, hsa; identical to SEQ ID NO: 269105

SEQ ID NO: 595089 - RNA, 64 nt, hsa; identical to SEQ ID NO: 269106

SEQ ID NO: 595090 - RNA, 64 nt, hsa; identical to SEQ ID NO: 269107

SEQ ID NO: 595091 - RNA, 64 nt, hsa; identical to SEQ ID NO: 269108

SEQ ID NO: 595092 - RNA, 64 nt, hsa; identical to SEQ ID NO: 269109

SEQ ID NO: 595093 - RNA, 64 nt, hsa; identical to SEQ ID NO: 269110

SEQ ID NO: 595094 - RNA, 64 nt, hsa; identical to SEQ ID NO: 269111

SEQ ID NO: 595095 - RNA, 64 nt, hsa; identical to SEQ ID NO: 269112

SEQ ID NO: 595096 - RNA, 64 nt, hsa; identical to SEQ ID NO: 269113

SEQ ID NO: 595097 - RNA, 64 nt, hsa; identical to SEQ ID NO: 269114

SEQ ID NO: 595098 - RNA, 64 nt, hsa; identical to SEQ ID NO: 269115

SEQ ID NO: 595099 - RNA, 64 nt, hsa; identical to SEQ ID NO: 269116

SEQ ID NO: 595100 - RNA, 64 nt, hsa; identical to SEQ ID NO: 269117

SEQ ID NO: 595101 - RNA, 64 nt, hsa; identical to SEQ ID NO: 269118

SEQ ID NO: 595102 - RNA, 64 nt, hsa; identical to SEQ ID NO: 269119

SEQ ID NO: 595103 - RNA, 64 nt, hsa; identical to SEQ ID NO: 269120

SEQ ID NO: 595104 - RNA, 64 nt, hsa; identical to SEQ ID NO: 269121

SEQ ID NO: 595105 - RNA, 64 nt, hsa; identical to SEQ ID NO: 269122

SEQ ID NO: 595106 - RNA, 64 nt, hsa; identical to SEQ ID NO: 269123

SEQ ID NO: 595107 - RNA, 64 nt, hsa; identical to SEQ ID NO: 269124

SEQ ID NO: 595108 - RNA, 64 nt, hsa; identical to SEQ ID NO: 269125

SEQ ID NO: 595109 - RNA, 64 nt, hsa; identical to SEQ ID NO: 269126

SEQ ID NO: 595110 - RNA, 64 nt, hsa; identical to SEQ ID NO: 269127

SEQ ID NO: 595111 - RNA, 64 nt, hsa; identical to SEQ ID NO: 269128

SEQ ID NO: 595112 - RNA, 64 nt, hsa; identical to SEQ ID NO: 269129

SEQ ID NO: 595113 - RNA, 64 nt, hsa; identical to SEQ ID NO: 269130

SEQ ID NO: 595114 - RNA, 64 nt, hsa; identical to SEQ ID NO: 269131

SEQ ID NO: 595115 - RNA, 64 nt, hsa; identical to SEQ ID NO: 269132

SEQ ID NO: 595116 - RNA, 64 nt, hsa; identical to SEQ ID NO: 269133

SEQ ID NO: 595117 - RNA, 64 nt, hsa; identical to SEQ ID NO: 269134

SEQ ID NO: 595118 - RNA, 64 nt, hsa; identical to SEQ ID NO: 269135

SEQ ID NO: 595119 - RNA, 64 nt, hsa; identical to SEQ ID NO: 269136

SEQ ID NO: 595120 - RNA, 64 nt, hsa; identical to SEQ ID NO: 269137

SEQ ID NO: 595121 - RNA, 64 nt, hsa; identical to SEQ ID NO: 269138

SEQ ID NO: 595122 - RNA, 64 nt, hsa; identical to SEQ ID NO: 269139

SEQ ID NO: 595123 - RNA, 64 nt, hsa; identical to SEQ ID NO: 269140

SEQ ID NO: 595124 - RNA, 64 nt, hsa; identical to SEQ ID NO: 269141

SEQ ID NO: 595125 - RNA, 64 nt, hsa; identical to SEQ ID NO: 269142

SEQ ID NO: 595126 - RNA, 64 nt, hsa; identical to SEQ ID NO: 269143

SEQ ID NO: 595127 - RNA, 64 nt, hsa; identical to SEQ ID NO: 269144

SEQ ID NO: 595128 - RNA, 64 nt, hsa; identical to SEQ ID NO: 269145

SEQ ID NO: 595129 - RNA, 64 nt, hsa; identical to SEQ ID NO: 269146

SEQ ID NO: 595130 - RNA, 64 nt, hsa; identical to SEQ ID NO: 269147

SEQ ID NO: 595131 - RNA, 64 nt, hsa; identical to SEQ ID NO: 269148

SEQ ID NO: 595132 - RNA, 64 nt, hsa; identical to SEQ ID NO: 269149

SEQ ID NO: 595133 - RNA, 64 nt, hsa; identical to SEQ ID NO: 269150

SEQ ID NO: 595134 - RNA, 64 nt, hsa; identical to SEQ ID NO: 269151

SEQ ID NO: 595135 - RNA, 64 nt, hsa; identical to SEQ ID NO: 269152

SEQ ID NO: 595136 - RNA, 64 nt, hsa; identical to SEQ ID NO: 269153

SEQ ID NO: 595137 - RNA, 64 nt, hsa; identical to SEQ ID NO: 269154

SEQ ID NO: 595138 - RNA, 64 nt, hsa; identical to SEQ ID NO: 269155

SEQ ID NO: 595139 - RNA, 64 nt, hsa; identical to SEQ ID NO: 269156

SEQ ID NO: 595140 - RNA, 64 nt, hsa; identical to SEQ ID NO: 269157

SEQ ID NO: 595141 - RNA, 64 nt, hsa; identical to SEQ ID NO: 269158

SEQ ID NO: 595142 - RNA, 64 nt, hsa; identical to SEQ ID NO: 269159

SEQ ID NO: 595143 - RNA, 64 nt, hsa; identical to SEQ ID NO: 269160

SEQ ID NO: 595144 - RNA, 64 nt, hsa; identical to SEQ ID NO: 269161

SEQ ID NO: 595145 - RNA, 64 nt, hsa; identical to SEQ ID NO: 269162

SEQ ID NO: 595146 - RNA, 64 nt, hsa; identical to SEQ ID NO: 269163

SEQ ID NO: 595147 - RNA, 64 nt, hsa; identical to SEQ ID NO: 269164

SEQ ID NO: 595148 - RNA, 64 nt, hsa; identical to SEQ ID NO: 269165

SEQ ID NO: 595149 - RNA, 64 nt, hsa; identical to SEQ ID NO: 269166

SEQ ID NO: 595150 - RNA, 64 nt, hsa; identical to SEQ ID NO: 269167

SEQ ID NO: 595151 - RNA, 64 nt, hsa; identical to SEQ ID NO: 269168

SEQ ID NO: 595152 - RNA, 64 nt, hsa; identical to SEQ ID NO: 269169

SEQ ID NO: 595153 - RNA, 64 nt, hsa; identical to SEQ ID NO: 269170

SEQ ID NO: 595154 - RNA, 64 nt, hsa; identical to SEQ ID NO: 269171

SEQ ID NO: 595155 - RNA, 64 nt, hsa; identical to SEQ ID NO: 269172

SEQ ID NO: 595156 - RNA, 64 nt, hsa; identical to SEQ ID NO: 269173

SEQ ID NO: 595157 - RNA, 64 nt, hsa; identical to SEQ ID NO: 269174

SEQ ID NO: 595158 - RNA, 64 nt, hsa; identical to SEQ ID NO: 269175

SEQ ID NO: 595159 - RNA, 64 nt, hsa; identical to SEQ ID NO: 269176

SEQ ID NO: 595160 - RNA, 64 nt, hsa; identical to SEQ ID NO: 269177

SEQ ID NO: 595161 - RNA, 64 nt, hsa; identical to SEQ ID NO: 269178

SEQ ID NO: 595162 - RNA, 64 nt, hsa; identical to SEQ ID NO: 269179

SEQ ID NO: 595163 - RNA, 64 nt, hsa; identical to SEQ ID NO: 269180

SEQ ID NO: 595164 - RNA, 64 nt, hsa; identical to SEQ ID NO: 269181

SEQ ID NO: 595165 - RNA, 64 nt, hsa; identical to SEQ ID NO: 269182

SEQ ID NO: 595166 - RNA, 64 nt, hsa; identical to SEQ ID NO: 269183

SEQ ID NO: 595167 - RNA, 64 nt, hsa; identical to SEQ ID NO: 269184

SEQ ID NO: 595168 - RNA, 64 nt, hsa; identical to SEQ ID NO: 269185

SEQ ID NO: 595169 - RNA, 64 nt, hsa; identical to SEQ ID NO: 269186

SEQ ID NO: 595170 - RNA, 64 nt, hsa; identical to SEQ ID NO: 269187

SEQ ID NO: 595171 - RNA, 64 nt, hsa; identical to SEQ ID NO: 269188

SEQ ID NO: 595172 - RNA, 64 nt, hsa; identical to SEQ ID NO: 269189

SEQ ID NO: 595173 - RNA, 64 nt, hsa; identical to SEQ ID NO: 269190

SEQ ID NO: 595174 - RNA, 64 nt, hsa; identical to SEQ ID NO: 269191

SEQ ID NO: 595175 - RNA, 64 nt, hsa; identical to SEQ ID NO: 269192

SEQ ID NO: 595176 - RNA, 64 nt, hsa; identical to SEQ ID NO: 269193

SEQ ID NO: 595177 - RNA, 64 nt, hsa; identical to SEQ ID NO: 269194

SEQ ID NO: 595178 - RNA, 64 nt, hsa; identical to SEQ ID NO: 269195

SEQ ID NO: 595179 - RNA, 64 nt, hsa; identical to SEQ ID NO: 269196

SEQ ID NO: 595180 - RNA, 64 nt, hsa; identical to SEQ ID NO: 269197

SEQ ID NO: 595181 - RNA, 64 nt, hsa; identical to SEQ ID NO: 269198

SEQ ID NO: 595182 - RNA, 64 nt, hsa; identical to SEQ ID NO: 269199

SEQ ID NO: 595183 - RNA, 64 nt, hsa; identical to SEQ ID NO: 269200

SEQ ID NO: 595184 - RNA, 64 nt, hsa; identical to SEQ ID NO: 269201

SEQ ID NO: 595185 - RNA, 64 nt, hsa; identical to SEQ ID NO: 269202

SEQ ID NO: 595186 - RNA, 64 nt, hsa; identical to SEQ ID NO: 269203

SEQ ID NO: 595187 - RNA, 64 nt, hsa; identical to SEQ ID NO: 269204

SEQ ID NO: 595188 - RNA, 64 nt, hsa; identical to SEQ ID NO: 269205

SEQ ID NO: 595189 - RNA, 64 nt, hsa; identical to SEQ ID NO: 269206

SEQ ID NO: 595190 - RNA, 64 nt, hsa; identical to SEQ ID NO: 269207

SEQ ID NO: 595191 - RNA, 64 nt, hsa; identical to SEQ ID NO: 269208

SEQ ID NO: 595192 - RNA, 64 nt, hsa; identical to SEQ ID NO: 269209

SEQ ID NO: 595193 - RNA, 64 nt, hsa; identical to SEQ ID NO: 269210

SEQ ID NO: 595194 - RNA, 64 nt, hsa; identical to SEQ ID NO: 269211

SEQ ID NO: 595195 - RNA, 64 nt, hsa; identical to SEQ ID NO: 269212

SEQ ID NO: 595196 - RNA, 64 nt, hsa; identical to SEQ ID NO: 269213

SEQ ID NO: 595197 - RNA, 64 nt, hsa; identical to SEQ ID NO: 269214

SEQ ID NO: 595198 - RNA, 64 nt, hsa; identical to SEQ ID NO: 269215

SEQ ID NO: 595199 - RNA, 64 nt, hsa; identical to SEQ ID NO: 269216

SEQ ID NO: 595200 - RNA, 64 nt, hsa; identical to SEQ ID NO: 269217

SEQ ID NO: 595201 - RNA, 64 nt, hsa; identical to SEQ ID NO: 269218

SEQ ID NO: 595202 - RNA, 64 nt, hsa; identical to SEQ ID NO: 269219

SEQ ID NO: 595203 - RNA, 64 nt, hsa; identical to SEQ ID NO: 269220

SEQ ID NO: 595204 - RNA, 64 nt, hsa; identical to SEQ ID NO: 269221

SEQ ID NO: 595205 - RNA, 64 nt, hsa; identical to SEQ ID NO: 269222

SEQ ID NO: 595206 - RNA, 64 nt, hsa; identical to SEQ ID NO: 269223

SEQ ID NO: 595207 - RNA, 64 nt, hsa; identical to SEQ ID NO: 269224

SEQ ID NO: 595208 - RNA, 64 nt, hsa; identical to SEQ ID NO: 269225

SEQ ID NO: 595209 - RNA, 64 nt, hsa; identical to SEQ ID NO: 269226

SEQ ID NO: 595210 - RNA, 64 nt, hsa; identical to SEQ ID NO: 269227

SEQ ID NO: 595211 - RNA, 64 nt, hsa; identical to SEQ ID NO: 269228

SEQ ID NO: 595212 - RNA, 64 nt, hsa; identical to SEQ ID NO: 269229

SEQ ID NO: 595213 - RNA, 64 nt, hsa; identical to SEQ ID NO: 269230

SEQ ID NO: 595214 - RNA, 64 nt, hsa; identical to SEQ ID NO: 269231

SEQ ID NO: 595215 - RNA, 64 nt, hsa; identical to SEQ ID NO: 269232

SEQ ID NO: 595216 - RNA, 64 nt, hsa; identical to SEQ ID NO: 269233

SEQ ID NO: 595217 - RNA, 64 nt, hsa; identical to SEQ ID NO: 269234

SEQ ID NO: 595218 - RNA, 64 nt, hsa; identical to SEQ ID NO: 269235

SEQ ID NO: 595219 - RNA, 64 nt, hsa; identical to SEQ ID NO: 269236

SEQ ID NO: 595220 - RNA, 64 nt, hsa; identical to SEQ ID NO: 269237

SEQ ID NO: 595221 - RNA, 64 nt, hsa; identical to SEQ ID NO: 269238

SEQ ID NO: 595222 - RNA, 64 nt, hsa; identical to SEQ ID NO: 269239

SEQ ID NO: 595223 - RNA, 64 nt, hsa; identical to SEQ ID NO: 269240

SEQ ID NO: 595224 - RNA, 64 nt, hsa; identical to SEQ ID NO: 269241

SEQ ID NO: 595225 - RNA, 64 nt, hsa; identical to SEQ ID NO: 269242

SEQ ID NO: 595226 - RNA, 64 nt, hsa; identical to SEQ ID NO: 269243

SEQ ID NO: 595227 - RNA, 64 nt, hsa; identical to SEQ ID NO: 269244

SEQ ID NO: 595228 - RNA, 64 nt, hsa; identical to SEQ ID NO: 269245

SEQ ID NO: 595229 - RNA, 64 nt, hsa; identical to SEQ ID NO: 269246

SEQ ID NO: 595230 - RNA, 64 nt, hsa; identical to SEQ ID NO: 269247

SEQ ID NO: 595231 - RNA, 64 nt, hsa; identical to SEQ ID NO: 269248

SEQ ID NO: 595232 - RNA, 64 nt, hsa; identical to SEQ ID NO: 269249

SEQ ID NO: 595233 - RNA, 64 nt, hsa; identical to SEQ ID NO: 269250

SEQ ID NO: 595234 - RNA, 64 nt, hsa; identical to SEQ ID NO: 269251

SEQ ID NO: 595235 - RNA, 64 nt, hsa; identical to SEQ ID NO: 269252

SEQ ID NO: 595236 - RNA, 64 nt, hsa; identical to SEQ ID NO: 269253

SEQ ID NO: 595237 - RNA, 64 nt, hsa; identical to SEQ ID NO: 269254

SEQ ID NO: 595238 - RNA, 64 nt, hsa; identical to SEQ ID NO: 269255

SEQ ID NO: 595239 - RNA, 64 nt, hsa; identical to SEQ ID NO: 269256

SEQ ID NO: 595240 - RNA, 64 nt, hsa; identical to SEQ ID NO: 269257

SEQ ID NO: 595241 - RNA, 64 nt, hsa; identical to SEQ ID NO: 269258

SEQ ID NO: 595242 - RNA, 64 nt, hsa; identical to SEQ ID NO: 269259

SEQ ID NO: 595243 - RNA, 64 nt, hsa; identical to SEQ ID NO: 269260

SEQ ID NO: 595244 - RNA, 64 nt, hsa; identical to SEQ ID NO: 269261

SEQ ID NO: 595245 - RNA, 64 nt, hsa; identical to SEQ ID NO: 269262

SEQ ID NO: 595246 - RNA, 64 nt, hsa; identical to SEQ ID NO: 269263

SEQ ID NO: 595247 - RNA, 64 nt, hsa; identical to SEQ ID NO: 269264

SEQ ID NO: 595248 - RNA, 64 nt, hsa; identical to SEQ ID NO: 269265

SEQ ID NO: 595249 - RNA, 64 nt, hsa; identical to SEQ ID NO: 269266

SEQ ID NO: 595250 - RNA, 64 nt, hsa; identical to SEQ ID NO: 269267

SEQ ID NO: 595251 - RNA, 64 nt, hsa; identical to SEQ ID NO: 269268

SEQ ID NO: 595252 - RNA, 64 nt, hsa; identical to SEQ ID NO: 269269

SEQ ID NO: 595253 - RNA, 64 nt, hsa; identical to SEQ ID NO: 269270

SEQ ID NO: 595254 - RNA, 64 nt, hsa; identical to SEQ ID NO: 269271

SEQ ID NO: 595255 - RNA, 64 nt, hsa; identical to SEQ ID NO: 269272

SEQ ID NO: 595256 - RNA, 64 nt, hsa; identical to SEQ ID NO: 269273

SEQ ID NO: 595257 - RNA, 64 nt, hsa; identical to SEQ ID NO: 269274

SEQ ID NO: 595258 - RNA, 64 nt, hsa; identical to SEQ ID NO: 269275

SEQ ID NO: 595259 - RNA, 64 nt, hsa; identical to SEQ ID NO: 269276

SEQ ID NO: 595260 - RNA, 64 nt, hsa; identical to SEQ ID NO: 269277

SEQ ID NO: 595261 - RNA, 64 nt, hsa; identical to SEQ ID NO: 269278

SEQ ID NO: 595262 - RNA, 64 nt, hsa; identical to SEQ ID NO: 269279

SEQ ID NO: 595263 - RNA, 64 nt, hsa; identical to SEQ ID NO: 269280

SEQ ID NO: 595264 - RNA, 64 nt, hsa; identical to SEQ ID NO: 269281

SEQ ID NO: 595265 - RNA, 64 nt, hsa; identical to SEQ ID NO: 269282

SEQ ID NO: 595266 - RNA, 64 nt, hsa; identical to SEQ ID NO: 269283

SEQ ID NO: 595267 - RNA, 64 nt, hsa; identical to SEQ ID NO: 269284

SEQ ID NO: 595268 - RNA, 64 nt, hsa; identical to SEQ ID NO: 269285

SEQ ID NO: 595269 - RNA, 64 nt, hsa; identical to SEQ ID NO: 269286

SEQ ID NO: 595270 - RNA, 64 nt, hsa; identical to SEQ ID NO: 269287

SEQ ID NO: 595271 - RNA, 64 nt, hsa; identical to SEQ ID NO: 269288

SEQ ID NO: 595272 - RNA, 64 nt, hsa; identical to SEQ ID NO: 269289

SEQ ID NO: 595273 - RNA, 64 nt, hsa; identical to SEQ ID NO: 269290

SEQ ID NO: 595274 - RNA, 64 nt, hsa; identical to SEQ ID NO: 269291

SEQ ID NO: 595275 - RNA, 64 nt, hsa; identical to SEQ ID NO: 269292

SEQ ID NO: 595276 - RNA, 64 nt, hsa; identical to SEQ ID NO: 269293

SEQ ID NO: 595277 - RNA, 64 nt, hsa; identical to SEQ ID NO: 269294

SEQ ID NO: 595278 - RNA, 64 nt, hsa; identical to SEQ ID NO: 269295

SEQ ID NO: 595279 - RNA, 64 nt, hsa; identical to SEQ ID NO: 269296

SEQ ID NO: 595280 - RNA, 64 nt, hsa; identical to SEQ ID NO: 269297

SEQ ID NO: 595281 - RNA, 64 nt, hsa; identical to SEQ ID NO: 269298

SEQ ID NO: 595282 - RNA, 64 nt, hsa; identical to SEQ ID NO: 269299

SEQ ID NO: 595283 - RNA, 64 nt, hsa; identical to SEQ ID NO: 269300

SEQ ID NO: 595284 - RNA, 64 nt, hsa; identical to SEQ ID NO: 269301

SEQ ID NO: 595285 - RNA, 64 nt, hsa; identical to SEQ ID NO: 269302

SEQ ID NO: 595286 - RNA, 64 nt, hsa; identical to SEQ ID NO: 269303

SEQ ID NO: 595287 - RNA, 64 nt, hsa; identical to SEQ ID NO: 269304

SEQ ID NO: 595288 - RNA, 64 nt, hsa; identical to SEQ ID NO: 269305

SEQ ID NO: 595289 - RNA, 64 nt, hsa; identical to SEQ ID NO: 269306

SEQ ID NO: 595290 - RNA, 64 nt, hsa; identical to SEQ ID NO: 269307

SEQ ID NO: 595291 - RNA, 64 nt, hsa; identical to SEQ ID NO: 269308

SEQ ID NO: 595292 - RNA, 64 nt, hsa; identical to SEQ ID NO: 269309

SEQ ID NO: 595293 - RNA, 64 nt, hsa; identical to SEQ ID NO: 269310

SEQ ID NO: 595294 - RNA, 64 nt, hsa; identical to SEQ ID NO: 269311

SEQ ID NO: 595295 - RNA, 64 nt, hsa; identical to SEQ ID NO: 269312

SEQ ID NO: 595296 - RNA, 64 nt, hsa; identical to SEQ ID NO: 269313

SEQ ID NO: 595297 - RNA, 64 nt, hsa; identical to SEQ ID NO: 269314

SEQ ID NO: 595298 - RNA, 64 nt, hsa; identical to SEQ ID NO: 269315

SEQ ID NO: 595299 - RNA, 64 nt, hsa; identical to SEQ ID NO: 269316

SEQ ID NO: 595300 - RNA, 64 nt, hsa; identical to SEQ ID NO: 269317

SEQ ID NO: 595301 - RNA, 64 nt, hsa; identical to SEQ ID NO: 269318

SEQ ID NO: 595302 - RNA, 64 nt, hsa; identical to SEQ ID NO: 269319

SEQ ID NO: 595303 - RNA, 64 nt, hsa; identical to SEQ ID NO: 269320

SEQ ID NO: 595304 - RNA, 64 nt, hsa; identical to SEQ ID NO: 269321

SEQ ID NO: 595305 - RNA, 64 nt, hsa; identical to SEQ ID NO: 269322

SEQ ID NO: 595306 - RNA, 64 nt, hsa; identical to SEQ ID NO: 269323

SEQ ID NO: 595307 - RNA, 64 nt, hsa; identical to SEQ ID NO: 269324

SEQ ID NO: 595308 - RNA, 64 nt, hsa; identical to SEQ ID NO: 269325

SEQ ID NO: 595309 - RNA, 64 nt, hsa; identical to SEQ ID NO: 269326

SEQ ID NO: 595310 - RNA, 64 nt, hsa; identical to SEQ ID NO: 269327

SEQ ID NO: 595311 - RNA, 64 nt, hsa; identical to SEQ ID NO: 269328

SEQ ID NO: 595312 - RNA, 64 nt, hsa; identical to SEQ ID NO: 269329

SEQ ID NO: 595313 - RNA, 64 nt, hsa; identical to SEQ ID NO: 269330

SEQ ID NO: 595314 - RNA, 64 nt, hsa; identical to SEQ ID NO: 269331

SEQ ID NO: 595315 - RNA, 64 nt, hsa; identical to SEQ ID NO: 269332

SEQ ID NO: 595316 - RNA, 64 nt, hsa; identical to SEQ ID NO: 269333

SEQ ID NO: 595317 - RNA, 64 nt, hsa; identical to SEQ ID NO: 269334

SEQ ID NO: 595318 - RNA, 64 nt, hsa; identical to SEQ ID NO: 269335

SEQ ID NO: 595319 - RNA, 64 nt, hsa; identical to SEQ ID NO: 269336

SEQ ID NO: 595320 - RNA, 64 nt, hsa; identical to SEQ ID NO: 269337

SEQ ID NO: 595321 - RNA, 64 nt, hsa; identical to SEQ ID NO: 269338

SEQ ID NO: 595322 - RNA, 64 nt, hsa; identical to SEQ ID NO: 269339

SEQ ID NO: 595323 - RNA, 64 nt, hsa; identical to SEQ ID NO: 269340

SEQ ID NO: 595324 - RNA, 64 nt, hsa; identical to SEQ ID NO: 269341

SEQ ID NO: 595325 - RNA, 64 nt, hsa; identical to SEQ ID NO: 269342

SEQ ID NO: 595326 - RNA, 64 nt, hsa; identical to SEQ ID NO: 269343

SEQ ID NO: 595327 - RNA, 64 nt, hsa; identical to SEQ ID NO: 269344

SEQ ID NO: 595328 - RNA, 64 nt, hsa; identical to SEQ ID NO: 269345

SEQ ID NO: 595329 - RNA, 64 nt, hsa; identical to SEQ ID NO: 269346

SEQ ID NO: 595330 - RNA, 64 nt, hsa; identical to SEQ ID NO: 269347

SEQ ID NO: 595331 - RNA, 64 nt, hsa; identical to SEQ ID NO: 269348

SEQ ID NO: 595332 - RNA, 64 nt, hsa; identical to SEQ ID NO: 269349

SEQ ID NO: 595333 - RNA, 64 nt, hsa; identical to SEQ ID NO: 269350

SEQ ID NO: 595334 - RNA, 64 nt, hsa; identical to SEQ ID NO: 269351

SEQ ID NO: 595335 - RNA, 64 nt, hsa; identical to SEQ ID NO: 269352

SEQ ID NO: 595336 - RNA, 64 nt, hsa; identical to SEQ ID NO: 269353

SEQ ID NO: 595337 - RNA, 64 nt, hsa; identical to SEQ ID NO: 269354

SEQ ID NO: 595338 - RNA, 64 nt, hsa; identical to SEQ ID NO: 269355

SEQ ID NO: 595339 - RNA, 64 nt, hsa; identical to SEQ ID NO: 269356

SEQ ID NO: 595340 - RNA, 64 nt, hsa; identical to SEQ ID NO: 269357

SEQ ID NO: 595341 - RNA, 64 nt, hsa; identical to SEQ ID NO: 269358

SEQ ID NO: 595342 - RNA, 64 nt, hsa; identical to SEQ ID NO: 269359

SEQ ID NO: 595343 - RNA, 64 nt, hsa; identical to SEQ ID NO: 269360

SEQ ID NO: 595344 - RNA, 64 nt, hsa; identical to SEQ ID NO: 269361

SEQ ID NO: 595345 - RNA, 64 nt, hsa; identical to SEQ ID NO: 269362

SEQ ID NO: 595346 - RNA, 64 nt, hsa; identical to SEQ ID NO: 269363

SEQ ID NO: 595347 - RNA, 64 nt, hsa; identical to SEQ ID NO: 269364

SEQ ID NO: 595348 - RNA, 64 nt, hsa; identical to SEQ ID NO: 269365

SEQ ID NO: 595349 - RNA, 64 nt, hsa; identical to SEQ ID NO: 269366

SEQ ID NO: 595350 - RNA, 64 nt, hsa; identical to SEQ ID NO: 269367

SEQ ID NO: 595351 - RNA, 64 nt, hsa; identical to SEQ ID NO: 269368

SEQ ID NO: 595352 - RNA, 64 nt, hsa; identical to SEQ ID NO: 269369

SEQ ID NO: 595353 - RNA, 64 nt, hsa; identical to SEQ ID NO: 269370

SEQ ID NO: 595354 - RNA, 64 nt, hsa; identical to SEQ ID NO: 269371

SEQ ID NO: 595355 - RNA, 64 nt, hsa; identical to SEQ ID NO: 269372

SEQ ID NO: 595356 - RNA, 64 nt, hsa; identical to SEQ ID NO: 269373

SEQ ID NO: 595357 - RNA, 64 nt, hsa; identical to SEQ ID NO: 269374

SEQ ID NO: 595358 - RNA, 64 nt, hsa; identical to SEQ ID NO: 269375

SEQ ID NO: 595359 - RNA, 64 nt, hsa; identical to SEQ ID NO: 269376

SEQ ID NO: 595360 - RNA, 64 nt, hsa; identical to SEQ ID NO: 269377

SEQ ID NO: 595361 - RNA, 64 nt, hsa; identical to SEQ ID NO: 269378

SEQ ID NO: 595362 - RNA, 64 nt, hsa; identical to SEQ ID NO: 269379

SEQ ID NO: 595363 - RNA, 64 nt, hsa; identical to SEQ ID NO: 269380

SEQ ID NO: 595364 - RNA, 64 nt, hsa; identical to SEQ ID NO: 269381

SEQ ID NO: 595365 - RNA, 64 nt, hsa; identical to SEQ ID NO: 269382

SEQ ID NO: 595366 - RNA, 64 nt, hsa; identical to SEQ ID NO: 269383

SEQ ID NO: 595367 - RNA, 64 nt, hsa; identical to SEQ ID NO: 269384

SEQ ID NO: 595368 - RNA, 64 nt, hsa; identical to SEQ ID NO: 269385

SEQ ID NO: 595369 - RNA, 64 nt, hsa; identical to SEQ ID NO: 269386

SEQ ID NO: 595370 - RNA, 64 nt, hsa; identical to SEQ ID NO: 269387

SEQ ID NO: 595371 - RNA, 64 nt, hsa; identical to SEQ ID NO: 269388

SEQ ID NO: 595372 - RNA, 64 nt, hsa; identical to SEQ ID NO: 269389

SEQ ID NO: 595373 - RNA, 64 nt, hsa; identical to SEQ ID NO: 269390

SEQ ID NO: 595374 - RNA, 64 nt, hsa; identical to SEQ ID NO: 269391

SEQ ID NO: 595375 - RNA, 64 nt, hsa; identical to SEQ ID NO: 269392

SEQ ID NO: 595376 - RNA, 64 nt, hsa; identical to SEQ ID NO: 269393

SEQ ID NO: 595377 - RNA, 64 nt, hsa; identical to SEQ ID NO: 269394

SEQ ID NO: 595378 - RNA, 64 nt, hsa; identical to SEQ ID NO: 269395

SEQ ID NO: 595379 - RNA, 64 nt, hsa; identical to SEQ ID NO: 269396

SEQ ID NO: 595380 - RNA, 64 nt, hsa; identical to SEQ ID NO: 269397

SEQ ID NO: 595381 - RNA, 64 nt, hsa; identical to SEQ ID NO: 269398

SEQ ID NO: 595382 - RNA, 64 nt, hsa; identical to SEQ ID NO: 269399

SEQ ID NO: 595383 - RNA, 64 nt, hsa; identical to SEQ ID NO: 269400

SEQ ID NO: 595384 - RNA, 64 nt, hsa; identical to SEQ ID NO: 269401

SEQ ID NO: 595385 - RNA, 64 nt, hsa; identical to SEQ ID NO: 269402

SEQ ID NO: 595386 - RNA, 64 nt, hsa; identical to SEQ ID NO: 269403

SEQ ID NO: 595387 - RNA, 64 nt, hsa; identical to SEQ ID NO: 269404

SEQ ID NO: 595388 - RNA, 64 nt, hsa; identical to SEQ ID NO: 269405

SEQ ID NO: 595389 - RNA, 64 nt, hsa; identical to SEQ ID NO: 269406

SEQ ID NO: 595390 - RNA, 64 nt, hsa; identical to SEQ ID NO: 269407

SEQ ID NO: 595391 - RNA, 64 nt, hsa; identical to SEQ ID NO: 269408

SEQ ID NO: 595392 - RNA, 64 nt, hsa; identical to SEQ ID NO: 269409

SEQ ID NO: 595393 - RNA, 64 nt, hsa; identical to SEQ ID NO: 269410

SEQ ID NO: 595394 - RNA, 64 nt, hsa; identical to SEQ ID NO: 269411

SEQ ID NO: 595395 - RNA, 64 nt, hsa; identical to SEQ ID NO: 269412

SEQ ID NO: 595396 - RNA, 64 nt, hsa; identical to SEQ ID NO: 269413

SEQ ID NO: 595397 - RNA, 64 nt, hsa; identical to SEQ ID NO: 269414

SEQ ID NO: 595398 - RNA, 64 nt, hsa; identical to SEQ ID NO: 269415

SEQ ID NO: 595399 - RNA, 64 nt, hsa; identical to SEQ ID NO: 269416

SEQ ID NO: 595400 - RNA, 64 nt, hsa; identical to SEQ ID NO: 269417

SEQ ID NO: 595401 - RNA, 64 nt, hsa; identical to SEQ ID NO: 269418

SEQ ID NO: 595402 - RNA, 64 nt, hsa; identical to SEQ ID NO: 269419

SEQ ID NO: 595403 - RNA, 64 nt, hsa; identical to SEQ ID NO: 269420

SEQ ID NO: 595404 - RNA, 64 nt, hsa; identical to SEQ ID NO: 269421

SEQ ID NO: 595405 - RNA, 64 nt, hsa; identical to SEQ ID NO: 269422

SEQ ID NO: 595406 - RNA, 64 nt, hsa; identical to SEQ ID NO: 269423

SEQ ID NO: 595407 - RNA, 64 nt, hsa; identical to SEQ ID NO: 269424

SEQ ID NO: 595408 - RNA, 64 nt, hsa; identical to SEQ ID NO: 269425

SEQ ID NO: 595409 - RNA, 64 nt, hsa; identical to SEQ ID NO: 269426

SEQ ID NO: 595410 - RNA, 64 nt, hsa; identical to SEQ ID NO: 269427

SEQ ID NO: 595411 - RNA, 64 nt, hsa; identical to SEQ ID NO: 269428

SEQ ID NO: 595412 - RNA, 64 nt, hsa; identical to SEQ ID NO: 269429

SEQ ID NO: 595413 - RNA, 56 nt, hsa; identical to SEQ ID NO: 269430

SEQ ID NO: 595414 - RNA, 64 nt, hsa; identical to SEQ ID NO: 269431

SEQ ID NO: 595415 - RNA, 64 nt, hsa; identical to SEQ ID NO: 269432

SEQ ID NO: 595416 - RNA, 64 nt, hsa; identical to SEQ ID NO: 269433

SEQ ID NO: 595417 - RNA, 64 nt, hsa; identical to SEQ ID NO: 269434

SEQ ID NO: 595418 - RNA, 64 nt, hsa; identical to SEQ ID NO: 269435

SEQ ID NO: 595419 - RNA, 64 nt, hsa; identical to SEQ ID NO: 269436

SEQ ID NO: 595420 - RNA, 64 nt, hsa; identical to SEQ ID NO: 269437

SEQ ID NO: 595421 - RNA, 64 nt, hsa; identical to SEQ ID NO: 269438

SEQ ID NO: 595422 - RNA, 64 nt, hsa; identical to SEQ ID NO: 269439

SEQ ID NO: 595423 - RNA, 64 nt, hsa; identical to SEQ ID NO: 269440

SEQ ID NO: 595424 - RNA, 64 nt, hsa; identical to SEQ ID NO: 269441

SEQ ID NO: 595425 - RNA, 64 nt, hsa; identical to SEQ ID NO: 269442

SEQ ID NO: 595426 - RNA, 64 nt, hsa; identical to SEQ ID NO: 269443

SEQ ID NO: 595427 - RNA, 64 nt, hsa; identical to SEQ ID NO: 269444

SEQ ID NO: 595428 - RNA, 64 nt, hsa; identical to SEQ ID NO: 269445

SEQ ID NO: 595429 - RNA, 64 nt, hsa; identical to SEQ ID NO: 269446

SEQ ID NO: 595430 - RNA, 64 nt, hsa; identical to SEQ ID NO: 269447

SEQ ID NO: 595431 - RNA, 64 nt, hsa; identical to SEQ ID NO: 269448

SEQ ID NO: 595432 - RNA, 64 nt, hsa; identical to SEQ ID NO: 269449

SEQ ID NO: 595433 - RNA, 64 nt, hsa; identical to SEQ ID NO: 269450

SEQ ID NO: 595434 - RNA, 64 nt, hsa; identical to SEQ ID NO: 269451

SEQ ID NO: 595435 - RNA, 64 nt, hsa; identical to SEQ ID NO: 269452

SEQ ID NO: 595436 - RNA, 64 nt, hsa; identical to SEQ ID NO: 269453

SEQ ID NO: 595437 - RNA, 64 nt, hsa; identical to SEQ ID NO: 269454

SEQ ID NO: 595438 - RNA, 64 nt, hsa; identical to SEQ ID NO: 269455

SEQ ID NO: 595439 - RNA, 64 nt, hsa; identical to SEQ ID NO: 269456

SEQ ID NO: 595440 - RNA, 64 nt, hsa; identical to SEQ ID NO: 269457

SEQ ID NO: 595441 - RNA, 64 nt, hsa; identical to SEQ ID NO: 269458

SEQ ID NO: 595442 - RNA, 64 nt, hsa; identical to SEQ ID NO: 269459

SEQ ID NO: 595443 - RNA, 64 nt, hsa; identical to SEQ ID NO: 269460

SEQ ID NO: 595444 - RNA, 64 nt, hsa; identical to SEQ ID NO: 269461

SEQ ID NO: 595445 - RNA, 64 nt, hsa; identical to SEQ ID NO: 269462

SEQ ID NO: 595446 - RNA, 64 nt, hsa; identical to SEQ ID NO: 269463

SEQ ID NO: 595447 - RNA, 64 nt, hsa; identical to SEQ ID NO: 269464

SEQ ID NO: 595448 - RNA, 64 nt, hsa; identical to SEQ ID NO: 269465

SEQ ID NO: 595449 - RNA, 64 nt, hsa; identical to SEQ ID NO: 269466

SEQ ID NO: 595450 - RNA, 64 nt, hsa; identical to SEQ ID NO: 269467

SEQ ID NO: 595451 - RNA, 64 nt, hsa; identical to SEQ ID NO: 269468

SEQ ID NO: 595452 - RNA, 64 nt, hsa; identical to SEQ ID NO: 269469

SEQ ID NO: 595453 - RNA, 64 nt, hsa; identical to SEQ ID NO: 269470

SEQ ID NO: 595454 - RNA, 56 nt, hsa; identical to SEQ ID NO: 269471

SEQ ID NO: 595455 - RNA, 64 nt, hsa; identical to SEQ ID NO: 269472

SEQ ID NO: 595456 - RNA, 64 nt, hsa; identical to SEQ ID NO: 269473

SEQ ID NO: 595457 - RNA, 64 nt, hsa; identical to SEQ ID NO: 269474

SEQ ID NO: 595458 - RNA, 64 nt, hsa; identical to SEQ ID NO: 269475

SEQ ID NO: 595459 - RNA, 64 nt, hsa; identical to SEQ ID NO: 269476

SEQ ID NO: 595460 - RNA, 64 nt, hsa; identical to SEQ ID NO: 269477

SEQ ID NO: 595461 - RNA, 64 nt, hsa; identical to SEQ ID NO: 269478

SEQ ID NO: 595462 - RNA, 64 nt, hsa; identical to SEQ ID NO: 269479

SEQ ID NO: 595463 - RNA, 64 nt, hsa; identical to SEQ ID NO: 269480

SEQ ID NO: 595464 - RNA, 64 nt, hsa; identical to SEQ ID NO: 269481

SEQ ID NO: 595465 - RNA, 64 nt, hsa; identical to SEQ ID NO: 269482

SEQ ID NO: 595466 - RNA, 64 nt, hsa; identical to SEQ ID NO: 269483

SEQ ID NO: 595467 - RNA, 64 nt, hsa; identical to SEQ ID NO: 269484

SEQ ID NO: 595468 - RNA, 64 nt, hsa; identical to SEQ ID NO: 269485

SEQ ID NO: 595469 - RNA, 64 nt, hsa; identical to SEQ ID NO: 269486

SEQ ID NO: 595470 - RNA, 64 nt, hsa; identical to SEQ ID NO: 269487

SEQ ID NO: 595471 - RNA, 64 nt, hsa; identical to SEQ ID NO: 269488

SEQ ID NO: 595472 - RNA, 64 nt, hsa; identical to SEQ ID NO: 269489

SEQ ID NO: 595473 - RNA, 64 nt, hsa; identical to SEQ ID NO: 269490

SEQ ID NO: 595474 - RNA, 64 nt, hsa; identical to SEQ ID NO: 269491

SEQ ID NO: 595475 - RNA, 64 nt, hsa; identical to SEQ ID NO: 269492

SEQ ID NO: 595476 - RNA, 64 nt, hsa; identical to SEQ ID NO: 269493

SEQ ID NO: 595477 - RNA, 64 nt, hsa; identical to SEQ ID NO: 269494

SEQ ID NO: 595478 - RNA, 64 nt, hsa; identical to SEQ ID NO: 269495

SEQ ID NO: 595479 - RNA, 64 nt, hsa; identical to SEQ ID NO: 269496

SEQ ID NO: 595480 - RNA, 64 nt, hsa; identical to SEQ ID NO: 269497

SEQ ID NO: 595481 - RNA, 64 nt, hsa; identical to SEQ ID NO: 269498

SEQ ID NO: 595482 - RNA, 64 nt, hsa; identical to SEQ ID NO: 269499

SEQ ID NO: 595483 - RNA, 64 nt, hsa; identical to SEQ ID NO: 269500

SEQ ID NO: 595484 - RNA, 64 nt, hsa; identical to SEQ ID NO: 269501

SEQ ID NO: 595485 - RNA, 64 nt, hsa; identical to SEQ ID NO: 269502

SEQ ID NO: 595486 - RNA, 64 nt, hsa; identical to SEQ ID NO: 269503

SEQ ID NO: 595487 - RNA, 64 nt, hsa; identical to SEQ ID NO: 269504

SEQ ID NO: 595488 - RNA, 64 nt, hsa; identical to SEQ ID NO: 269505

SEQ ID NO: 595489 - RNA, 64 nt, hsa; identical to SEQ ID NO: 269506

SEQ ID NO: 595490 - RNA, 64 nt, hsa; identical to SEQ ID NO: 269507

SEQ ID NO: 595491 - RNA, 64 nt, hsa; identical to SEQ ID NO: 269476

SEQ ID NO: 595492 - RNA, 64 nt, hsa; identical to SEQ ID NO: 269509

SEQ ID NO: 595493 - RNA, 64 nt, hsa; identical to SEQ ID NO: 269510

SEQ ID NO: 595494 - RNA, 64 nt, hsa; identical to SEQ ID NO: 269511

SEQ ID NO: 595495 - RNA, 64 nt, hsa; identical to SEQ ID NO: 269512

SEQ ID NO: 595496 - RNA, 64 nt, hsa; identical to SEQ ID NO: 269513

SEQ ID NO: 595497 - RNA, 64 nt, hsa; identical to SEQ ID NO: 269514

SEQ ID NO: 595498 - RNA, 64 nt, hsa; identical to SEQ ID NO: 269515

SEQ ID NO: 595499 - RNA, 64 nt, hsa; identical to SEQ ID NO: 269516

SEQ ID NO: 595500 - RNA, 64 nt, hsa; identical to SEQ ID NO: 269517

SEQ ID NO: 595501 - RNA, 64 nt, hsa; identical to SEQ ID NO: 269518

SEQ ID NO: 595502 - RNA, 64 nt, hsa; identical to SEQ ID NO: 269519

SEQ ID NO: 595503 - RNA, 64 nt, hsa; identical to SEQ ID NO: 269520

SEQ ID NO: 595504 - RNA, 64 nt, hsa; identical to SEQ ID NO: 269521

SEQ ID NO: 595505 - RNA, 64 nt, hsa; identical to SEQ ID NO: 269522

SEQ ID NO: 595506 - RNA, 64 nt, hsa; identical to SEQ ID NO: 269523

SEQ ID NO: 595507 - RNA, 64 nt, hsa; identical to SEQ ID NO: 269524

SEQ ID NO: 595508 - RNA, 64 nt, hsa; identical to SEQ ID NO: 269525

SEQ ID NO: 595509 - RNA, 64 nt, hsa; identical to SEQ ID NO: 269526

SEQ ID NO: 595510 - RNA, 64 nt, hsa; identical to SEQ ID NO: 269527

SEQ ID NO: 595511 - RNA, 64 nt, hsa; identical to SEQ ID NO: 269528

SEQ ID NO: 595512 - RNA, 64 nt, hsa; identical to SEQ ID NO: 269529

SEQ ID NO: 595513 - RNA, 64 nt, hsa; identical to SEQ ID NO: 269530

SEQ ID NO: 595514 - RNA, 64 nt, hsa; identical to SEQ ID NO: 269531

SEQ ID NO: 595515 - RNA, 64 nt, hsa; identical to SEQ ID NO: 269532

SEQ ID NO: 595516 - RNA, 64 nt, hsa; identical to SEQ ID NO: 269533

SEQ ID NO: 595517 - RNA, 64 nt, hsa; identical to SEQ ID NO: 269534

SEQ ID NO: 595518 - RNA, 64 nt, hsa; identical to SEQ ID NO: 269535

SEQ ID NO: 595519 - RNA, 64 nt, hsa; identical to SEQ ID NO: 269536

SEQ ID NO: 595520 - RNA, 64 nt, hsa; identical to SEQ ID NO: 269537

SEQ ID NO: 595521 - RNA, 64 nt, hsa; identical to SEQ ID NO: 269538

SEQ ID NO: 595522 - RNA, 64 nt, hsa; identical to SEQ ID NO: 269539

SEQ ID NO: 595523 - RNA, 64 nt, hsa; identical to SEQ ID NO: 269540

SEQ ID NO: 595524 - RNA, 64 nt, hsa; identical to SEQ ID NO: 269541

SEQ ID NO: 595525 - RNA, 64 nt, hsa; identical to SEQ ID NO: 269542

SEQ ID NO: 595526 - RNA, 64 nt, hsa; identical to SEQ ID NO: 269543

SEQ ID NO: 595527 - RNA, 64 nt, hsa; identical to SEQ ID NO: 269544

SEQ ID NO: 595528 - RNA, 64 nt, hsa; identical to SEQ ID NO: 269545

SEQ ID NO: 595529 - RNA, 64 nt, hsa; identical to SEQ ID NO: 269546

SEQ ID NO: 595530 - RNA, 64 nt, hsa; identical to SEQ ID NO: 269547

SEQ ID NO: 595531 - RNA, 64 nt, hsa; identical to SEQ ID NO: 269548

SEQ ID NO: 595532 - RNA, 64 nt, hsa; identical to SEQ ID NO: 269549

SEQ ID NO: 595533 - RNA, 64 nt, hsa; identical to SEQ ID NO: 269550

SEQ ID NO: 595534 - RNA, 64 nt, hsa; identical to SEQ ID NO: 269551

SEQ ID NO: 595535 - RNA, 64 nt, hsa; identical to SEQ ID NO: 269552

SEQ ID NO: 595536 - RNA, 64 nt, hsa; identical to SEQ ID NO: 269553

SEQ ID NO: 595537 - RNA, 64 nt, hsa; identical to SEQ ID NO: 269554

SEQ ID NO: 595538 - RNA, 64 nt, hsa; identical to SEQ ID NO: 269555

SEQ ID NO: 595539 - RNA, 64 nt, hsa; identical to SEQ ID NO: 269556

SEQ ID NO: 595540 - RNA, 64 nt, hsa; identical to SEQ ID NO: 269557

SEQ ID NO: 595541 - RNA, 64 nt, hsa; identical to SEQ ID NO: 269558

SEQ ID NO: 595542 - RNA, 64 nt, hsa; identical to SEQ ID NO: 269559

SEQ ID NO: 595543 - RNA, 64 nt, hsa; identical to SEQ ID NO: 269560

SEQ ID NO: 595544 - RNA, 64 nt, hsa; identical to SEQ ID NO: 269561

SEQ ID NO: 595545 - RNA, 64 nt, hsa; identical to SEQ ID NO: 269562

SEQ ID NO: 595546 - RNA, 64 nt, hsa; identical to SEQ ID NO: 269563

SEQ ID NO: 595547 - RNA, 64 nt, hsa; identical to SEQ ID NO: 269564

SEQ ID NO: 595548 - RNA, 64 nt, hsa; identical to SEQ ID NO: 269565

SEQ ID NO: 595549 - RNA, 64 nt, hsa; identical to SEQ ID NO: 269566

SEQ ID NO: 595550 - RNA, 64 nt, hsa; identical to SEQ ID NO: 269567

SEQ ID NO: 595551 - RNA, 64 nt, hsa; identical to SEQ ID NO: 269568

SEQ ID NO: 595552 - RNA, 64 nt, hsa; identical to SEQ ID NO: 269569

SEQ ID NO: 595553 - RNA, 64 nt, hsa; identical to SEQ ID NO: 269570

SEQ ID NO: 595554 - RNA, 64 nt, hsa; identical to SEQ ID NO: 269571

SEQ ID NO: 595555 - RNA, 64 nt, hsa; identical to SEQ ID NO: 269572

SEQ ID NO: 595556 - RNA, 64 nt, hsa; identical to SEQ ID NO: 269573

SEQ ID NO: 595557 - RNA, 64 nt, hsa; identical to SEQ ID NO: 269574

SEQ ID NO: 595558 - RNA, 64 nt, hsa; identical to SEQ ID NO: 269575

SEQ ID NO: 595559 - RNA, 64 nt, hsa; identical to SEQ ID NO: 269576

SEQ ID NO: 595560 - RNA, 64 nt, hsa; identical to SEQ ID NO: 269577

SEQ ID NO: 595561 - RNA, 64 nt, hsa; identical to SEQ ID NO: 269578

SEQ ID NO: 595562 - RNA, 64 nt, hsa; identical to SEQ ID NO: 269579

SEQ ID NO: 595563 - RNA, 64 nt, hsa; identical to SEQ ID NO: 269580

SEQ ID NO: 595564 - RNA, 64 nt, hsa; identical to SEQ ID NO: 269581

SEQ ID NO: 595565 - RNA, 64 nt, hsa; identical to SEQ ID NO: 269582

SEQ ID NO: 595566 - RNA, 64 nt, hsa; identical to SEQ ID NO: 269583

SEQ ID NO: 595567 - RNA, 64 nt, hsa; identical to SEQ ID NO: 269584

SEQ ID NO: 595568 - RNA, 64 nt, hsa; identical to SEQ ID NO: 269585

SEQ ID NO: 595569 - RNA, 64 nt, hsa; identical to SEQ ID NO: 269586

SEQ ID NO: 595570 - RNA, 64 nt, hsa; identical to SEQ ID NO: 269587

SEQ ID NO: 595571 - RNA, 64 nt, hsa; identical to SEQ ID NO: 269588

SEQ ID NO: 595572 - RNA, 64 nt, hsa; identical to SEQ ID NO: 269589

SEQ ID NO: 595573 - RNA, 64 nt, hsa; identical to SEQ ID NO: 269590

SEQ ID NO: 595574 - RNA, 64 nt, hsa; identical to SEQ ID NO: 269591

SEQ ID NO: 595575 - RNA, 64 nt, hsa; identical to SEQ ID NO: 269592

SEQ ID NO: 595576 - RNA, 64 nt, hsa; identical to SEQ ID NO: 269593

SEQ ID NO: 595577 - RNA, 64 nt, hsa; identical to SEQ ID NO: 269594

SEQ ID NO: 595578 - RNA, 64 nt, hsa; identical to SEQ ID NO: 269595

SEQ ID NO: 595579 - RNA, 64 nt, hsa; identical to SEQ ID NO: 269596

SEQ ID NO: 595580 - RNA, 64 nt, hsa; identical to SEQ ID NO: 269597

SEQ ID NO: 595581 - RNA, 64 nt, hsa; identical to SEQ ID NO: 269598

SEQ ID NO: 595582 - RNA, 64 nt, hsa; identical to SEQ ID NO: 269599

SEQ ID NO: 595583 - RNA, 64 nt, hsa; identical to SEQ ID NO: 269600

SEQ ID NO: 595584 - RNA, 64 nt, hsa; identical to SEQ ID NO: 269601

SEQ ID NO: 595585 - RNA, 64 nt, hsa; identical to SEQ ID NO: 269602

SEQ ID NO: 595586 - RNA, 64 nt, hsa; identical to SEQ ID NO: 269603

SEQ ID NO: 595587 - RNA, 64 nt, hsa; identical to SEQ ID NO: 269604

SEQ ID NO: 595588 - RNA, 64 nt, hsa; identical to SEQ ID NO: 269605

SEQ ID NO: 595589 - RNA, 64 nt, hsa; identical to SEQ ID NO: 269606

SEQ ID NO: 595590 - RNA, 64 nt, hsa; identical to SEQ ID NO: 269607

SEQ ID NO: 595591 - RNA, 64 nt, hsa; identical to SEQ ID NO: 269608

SEQ ID NO: 595592 - RNA, 64 nt, hsa; identical to SEQ ID NO: 269609

SEQ ID NO: 595593 - RNA, 64 nt, hsa; identical to SEQ ID NO: 269610

SEQ ID NO: 595594 - RNA, 64 nt, hsa; identical to SEQ ID NO: 269611

SEQ ID NO: 595595 - RNA, 64 nt, hsa; identical to SEQ ID NO: 269612

SEQ ID NO: 595596 - RNA, 64 nt, hsa; identical to SEQ ID NO: 269613

SEQ ID NO: 595597 - RNA, 64 nt, hsa; identical to SEQ ID NO: 269614

SEQ ID NO: 595598 - RNA, 64 nt, hsa; identical to SEQ ID NO: 269615

SEQ ID NO: 595599 - RNA, 64 nt, hsa; identical to SEQ ID NO: 269616

SEQ ID NO: 595600 - RNA, 64 nt, hsa; identical to SEQ ID NO: 269617

SEQ ID NO: 595601 - RNA, 64 nt, hsa; identical to SEQ ID NO: 269618

SEQ ID NO: 595602 - RNA, 64 nt, hsa; identical to SEQ ID NO: 269619

SEQ ID NO: 595603 - RNA, 64 nt, hsa; identical to SEQ ID NO: 269620

SEQ ID NO: 595604 - RNA, 64 nt, hsa; identical to SEQ ID NO: 269621

SEQ ID NO: 595605 - RNA, 64 nt, hsa; identical to SEQ ID NO: 269622

SEQ ID NO: 595606 - RNA, 64 nt, hsa; identical to SEQ ID NO: 269623

SEQ ID NO: 595607 - RNA, 64 nt, hsa; identical to SEQ ID NO: 269624

SEQ ID NO: 595608 - RNA, 64 nt, hsa; identical to SEQ ID NO: 269625

SEQ ID NO: 595609 - RNA, 64 nt, hsa; identical to SEQ ID NO: 269626

SEQ ID NO: 595610 - RNA, 64 nt, hsa; identical to SEQ ID NO: 269627

SEQ ID NO: 595611 - RNA, 64 nt, hsa; identical to SEQ ID NO: 269628

SEQ ID NO: 595612 - RNA, 64 nt, hsa; identical to SEQ ID NO: 269629

SEQ ID NO: 595613 - RNA, 64 nt, hsa; identical to SEQ ID NO: 269630

SEQ ID NO: 595614 - RNA, 64 nt, hsa; identical to SEQ ID NO: 269631

SEQ ID NO: 595615 - RNA, 64 nt, hsa; identical to SEQ ID NO: 269632

SEQ ID NO: 595616 - RNA, 64 nt, hsa; identical to SEQ ID NO: 269633

SEQ ID NO: 595617 - RNA, 64 nt, hsa; identical to SEQ ID NO: 269634

SEQ ID NO: 595618 - RNA, 64 nt, hsa; identical to SEQ ID NO: 269635

SEQ ID NO: 595619 - RNA, 64 nt, hsa; identical to SEQ ID NO: 269636

SEQ ID NO: 595620 - RNA, 64 nt, hsa; identical to SEQ ID NO: 269637

SEQ ID NO: 595621 - RNA, 64 nt, hsa; identical to SEQ ID NO: 269638

SEQ ID NO: 595622 - RNA, 64 nt, hsa; identical to SEQ ID NO: 269639

SEQ ID NO: 595623 - RNA, 64 nt, hsa; identical to SEQ ID NO: 269640

SEQ ID NO: 595624 - RNA, 64 nt, hsa; identical to SEQ ID NO: 269641

SEQ ID NO: 595625 - RNA, 64 nt, hsa; identical to SEQ ID NO: 269642

SEQ ID NO: 595626 - RNA, 64 nt, hsa; identical to SEQ ID NO: 269643

SEQ ID NO: 595627 - RNA, 64 nt, hsa; identical to SEQ ID NO: 269644

SEQ ID NO: 595628 - RNA, 64 nt, hsa; identical to SEQ ID NO: 269645

SEQ ID NO: 595629 - RNA, 64 nt, hsa; identical to SEQ ID NO: 269646

SEQ ID NO: 595630 - RNA, 64 nt, hsa; identical to SEQ ID NO: 269647

SEQ ID NO: 595631 - RNA, 64 nt, hsa; identical to SEQ ID NO: 269648

SEQ ID NO: 595632 - RNA, 64 nt, hsa; identical to SEQ ID NO: 269649

SEQ ID NO: 595633 - RNA, 64 nt, hsa; identical to SEQ ID NO: 269650

SEQ ID NO: 595634 - RNA, 64 nt, hsa; identical to SEQ ID NO: 269651

SEQ ID NO: 595635 - RNA, 64 nt, hsa; identical to SEQ ID NO: 269652

SEQ ID NO: 595636 - RNA, 64 nt, hsa; identical to SEQ ID NO: 269653

SEQ ID NO: 595637 - RNA, 64 nt, hsa; identical to SEQ ID NO: 269654

SEQ ID NO: 595638 - RNA, 64 nt, hsa; identical to SEQ ID NO: 269655

SEQ ID NO: 595639 - RNA, 64 nt, hsa; identical to SEQ ID NO: 269656

SEQ ID NO: 595640 - RNA, 64 nt, hsa; identical to SEQ ID NO: 269657

SEQ ID NO: 595641 - RNA, 64 nt, hsa; identical to SEQ ID NO: 269658

SEQ ID NO: 595642 - RNA, 64 nt, hsa; identical to SEQ ID NO: 269659

SEQ ID NO: 595643 - RNA, 64 nt, hsa; identical to SEQ ID NO: 269660

SEQ ID NO: 595644 - RNA, 64 nt, hsa; identical to SEQ ID NO: 269661

SEQ ID NO: 595645 - RNA, 64 nt, hsa; identical to SEQ ID NO: 269662

SEQ ID NO: 595646 - RNA, 64 nt, hsa; identical to SEQ ID NO: 269663

SEQ ID NO: 595647 - RNA, 64 nt, hsa; identical to SEQ ID NO: 269664

SEQ ID NO: 595648 - RNA, 64 nt, hsa; identical to SEQ ID NO: 269665

SEQ ID NO: 595649 - RNA, 64 nt, hsa; identical to SEQ ID NO: 269666

SEQ ID NO: 595650 - RNA, 64 nt, hsa; identical to SEQ ID NO: 269667

SEQ ID NO: 595651 - RNA, 64 nt, hsa; identical to SEQ ID NO: 269668

SEQ ID NO: 595652 - RNA, 64 nt, hsa; identical to SEQ ID NO: 269669

SEQ ID NO: 595653 - RNA, 64 nt, hsa; identical to SEQ ID NO: 269670

SEQ ID NO: 595654 - RNA, 64 nt, hsa; identical to SEQ ID NO: 269671

SEQ ID NO: 595655 - RNA, 64 nt, hsa; identical to SEQ ID NO: 269672

SEQ ID NO: 595656 - RNA, 64 nt, hsa; identical to SEQ ID NO: 269673

SEQ ID NO: 595657 - RNA, 64 nt, hsa; identical to SEQ ID NO: 269674

SEQ ID NO: 595658 - RNA, 64 nt, hsa; identical to SEQ ID NO: 269675

SEQ ID NO: 595659 - RNA, 64 nt, hsa; identical to SEQ ID NO: 269676

SEQ ID NO: 595660 - RNA, 64 nt, hsa; identical to SEQ ID NO: 269677

SEQ ID NO: 595661 - RNA, 64 nt, hsa; identical to SEQ ID NO: 269678

SEQ ID NO: 595662 - RNA, 64 nt, hsa; identical to SEQ ID NO: 269679

SEQ ID NO: 595663 - RNA, 64 nt, hsa; identical to SEQ ID NO: 269680

SEQ ID NO: 595664 - RNA, 64 nt, hsa; identical to SEQ ID NO: 269681

SEQ ID NO: 595665 - RNA, 64 nt, hsa; identical to SEQ ID NO: 269682

SEQ ID NO: 595666 - RNA, 64 nt, hsa; identical to SEQ ID NO: 269683

SEQ ID NO: 595667 - RNA, 64 nt, hsa; identical to SEQ ID NO: 269684

SEQ ID NO: 595668 - RNA, 64 nt, hsa; identical to SEQ ID NO: 269685

SEQ ID NO: 595669 - RNA, 64 nt, hsa; identical to SEQ ID NO: 269686

SEQ ID NO: 595670 - RNA, 64 nt, hsa; identical to SEQ ID NO: 269687

SEQ ID NO: 595671 - RNA, 64 nt, hsa; identical to SEQ ID NO: 269688

SEQ ID NO: 595672 - RNA, 64 nt, hsa; identical to SEQ ID NO: 269689

SEQ ID NO: 595673 - RNA, 64 nt, hsa; identical to SEQ ID NO: 269690

SEQ ID NO: 595674 - RNA, 64 nt, hsa; identical to SEQ ID NO: 269691

SEQ ID NO: 595675 - RNA, 64 nt, hsa; identical to SEQ ID NO: 269692

SEQ ID NO: 595676 - RNA, 64 nt, hsa; identical to SEQ ID NO: 269693

SEQ ID NO: 595677 - RNA, 64 nt, hsa; identical to SEQ ID NO: 269694

SEQ ID NO: 595678 - RNA, 64 nt, hsa; identical to SEQ ID NO: 269695

SEQ ID NO: 595679 - RNA, 64 nt, hsa; identical to SEQ ID NO: 269696

SEQ ID NO: 595680 - RNA, 64 nt, hsa; identical to SEQ ID NO: 269697

SEQ ID NO: 595681 - RNA, 64 nt, hsa; identical to SEQ ID NO: 269698

SEQ ID NO: 595682 - RNA, 64 nt, hsa; identical to SEQ ID NO: 269699

SEQ ID NO: 595683 - RNA, 64 nt, hsa; identical to SEQ ID NO: 269700

SEQ ID NO: 595684 - RNA, 64 nt, hsa; identical to SEQ ID NO: 269701

SEQ ID NO: 595685 - RNA, 64 nt, hsa; identical to SEQ ID NO: 269702

SEQ ID NO: 595686 - RNA, 64 nt, hsa; identical to SEQ ID NO: 269703

SEQ ID NO: 595687 - RNA, 64 nt, hsa; identical to SEQ ID NO: 269704

SEQ ID NO: 595688 - RNA, 64 nt, hsa; identical to SEQ ID NO: 269705

SEQ ID NO: 595689 - RNA, 64 nt, hsa; identical to SEQ ID NO: 269706

SEQ ID NO: 595690 - RNA, 64 nt, hsa; identical to SEQ ID NO: 269707

SEQ ID NO: 595691 - RNA, 64 nt, hsa; identical to SEQ ID NO: 269708

SEQ ID NO: 595692 - RNA, 64 nt, hsa; identical to SEQ ID NO: 269709

SEQ ID NO: 595693 - RNA, 64 nt, hsa; identical to SEQ ID NO: 269710

SEQ ID NO: 595694 - RNA, 64 nt, hsa; identical to SEQ ID NO: 269711

SEQ ID NO: 595695 - RNA, 64 nt, hsa; identical to SEQ ID NO: 269712

SEQ ID NO: 595696 - RNA, 64 nt, hsa; identical to SEQ ID NO: 269713

SEQ ID NO: 595697 - RNA, 64 nt, hsa; identical to SEQ ID NO: 269714

SEQ ID NO: 595698 - RNA, 64 nt, hsa; identical to SEQ ID NO: 269715

SEQ ID NO: 595699 - RNA, 64 nt, hsa; identical to SEQ ID NO: 269716

SEQ ID NO: 595700 - RNA, 64 nt, hsa; identical to SEQ ID NO: 269717

SEQ ID NO: 595701 - RNA, 64 nt, hsa; identical to SEQ ID NO: 269718

SEQ ID NO: 595702 - RNA, 64 nt, hsa; identical to SEQ ID NO: 269719

SEQ ID NO: 595703 - RNA, 64 nt, hsa; identical to SEQ ID NO: 269720

SEQ ID NO: 595704 - RNA, 64 nt, hsa; identical to SEQ ID NO: 269721

SEQ ID NO: 595705 - RNA, 64 nt, hsa; identical to SEQ ID NO: 269722

SEQ ID NO: 595706 - RNA, 64 nt, hsa; identical to SEQ ID NO: 269723

SEQ ID NO: 595707 - RNA, 64 nt, hsa; identical to SEQ ID NO: 269724

SEQ ID NO: 595708 - RNA, 64 nt, hsa; identical to SEQ ID NO: 269725

SEQ ID NO: 595709 - RNA, 64 nt, hsa; identical to SEQ ID NO: 269726

SEQ ID NO: 595710 - RNA, 64 nt, hsa; identical to SEQ ID NO: 269727

SEQ ID NO: 595711 - RNA, 64 nt, hsa; identical to SEQ ID NO: 269728

SEQ ID NO: 595712 - RNA, 64 nt, hsa; identical to SEQ ID NO: 269729

SEQ ID NO: 595713 - RNA, 64 nt, hsa; identical to SEQ ID NO: 269730

SEQ ID NO: 595714 - RNA, 64 nt, hsa; identical to SEQ ID NO: 269731

SEQ ID NO: 595715 - RNA, 64 nt, hsa; identical to SEQ ID NO: 269732

SEQ ID NO: 595716 - RNA, 64 nt, hsa; identical to SEQ ID NO: 269733

SEQ ID NO: 595717 - RNA, 64 nt, hsa; identical to SEQ ID NO: 269734

SEQ ID NO: 595718 - RNA, 64 nt, hsa; identical to SEQ ID NO: 269735

SEQ ID NO: 595719 - RNA, 64 nt, hsa; identical to SEQ ID NO: 269736

SEQ ID NO: 595720 - RNA, 64 nt, hsa; identical to SEQ ID NO: 269737

SEQ ID NO: 595721 - RNA, 64 nt, hsa; identical to SEQ ID NO: 269738

SEQ ID NO: 595722 - RNA, 64 nt, hsa; identical to SEQ ID NO: 269739

SEQ ID NO: 595723 - RNA, 64 nt, hsa; identical to SEQ ID NO: 269740

SEQ ID NO: 595724 - RNA, 64 nt, hsa; identical to SEQ ID NO: 269741

SEQ ID NO: 595725 - RNA, 64 nt, hsa; identical to SEQ ID NO: 269742

SEQ ID NO: 595726 - RNA, 64 nt, hsa; identical to SEQ ID NO: 269743

SEQ ID NO: 595727 - RNA, 64 nt, hsa; identical to SEQ ID NO: 269744

SEQ ID NO: 595728 - RNA, 64 nt, hsa; identical to SEQ ID NO: 269745

SEQ ID NO: 595729 - RNA, 64 nt, hsa; identical to SEQ ID NO: 269746

SEQ ID NO: 595730 - RNA, 64 nt, hsa; identical to SEQ ID NO: 269747

SEQ ID NO: 595731 - RNA, 64 nt, hsa; identical to SEQ ID NO: 269748

SEQ ID NO: 595732 - RNA, 64 nt, hsa; identical to SEQ ID NO: 269749

SEQ ID NO: 595733 - RNA, 64 nt, hsa; identical to SEQ ID NO: 269750

SEQ ID NO: 595734 - RNA, 64 nt, hsa; identical to SEQ ID NO: 269751

SEQ ID NO: 595735 - RNA, 64 nt, hsa; identical to SEQ ID NO: 269752

SEQ ID NO: 595736 - RNA, 64 nt, hsa; identical to SEQ ID NO: 269753

SEQ ID NO: 595737 - RNA, 64 nt, hsa; identical to SEQ ID NO: 269754

SEQ ID NO: 595738 - RNA, 64 nt, hsa; identical to SEQ ID NO: 269755

SEQ ID NO: 595739 - RNA, 64 nt, hsa; identical to SEQ ID NO: 269756

SEQ ID NO: 595740 - RNA, 64 nt, hsa; identical to SEQ ID NO: 269757

SEQ ID NO: 595741 - RNA, 64 nt, hsa; identical to SEQ ID NO: 269758

SEQ ID NO: 595742 - RNA, 64 nt, hsa; identical to SEQ ID NO: 269759

SEQ ID NO: 595743 - RNA, 64 nt, hsa; identical to SEQ ID NO: 269760

SEQ ID NO: 595744 - RNA, 64 nt, hsa; identical to SEQ ID NO: 269761

SEQ ID NO: 595745 - RNA, 64 nt, hsa; identical to SEQ ID NO: 269762

SEQ ID NO: 595746 - RNA, 64 nt, hsa; identical to SEQ ID NO: 269763

SEQ ID NO: 595747 - RNA, 64 nt, hsa; identical to SEQ ID NO: 269764

SEQ ID NO: 595748 - RNA, 64 nt, hsa; identical to SEQ ID NO: 269765

SEQ ID NO: 595749 - RNA, 64 nt, hsa; identical to SEQ ID NO: 269766

SEQ ID NO: 595750 - RNA, 64 nt, hsa; identical to SEQ ID NO: 269767

SEQ ID NO: 595751 - RNA, 64 nt, hsa; identical to SEQ ID NO: 269768

SEQ ID NO: 595752 - RNA, 64 nt, hsa; identical to SEQ ID NO: 269769

SEQ ID NO: 595753 - RNA, 64 nt, hsa; identical to SEQ ID NO: 269770

SEQ ID NO: 595754 - RNA, 64 nt, hsa; identical to SEQ ID NO: 269771

SEQ ID NO: 595755 - RNA, 64 nt, hsa; identical to SEQ ID NO: 269772

SEQ ID NO: 595756 - RNA, 64 nt, hsa; identical to SEQ ID NO: 269773

SEQ ID NO: 595757 - RNA, 64 nt, hsa; identical to SEQ ID NO: 269774

SEQ ID NO: 595758 - RNA, 64 nt, hsa; identical to SEQ ID NO: 269775

SEQ ID NO: 595759 - RNA, 64 nt, hsa; identical to SEQ ID NO: 269776

SEQ ID NO: 595760 - RNA, 64 nt, hsa; identical to SEQ ID NO: 269777

SEQ ID NO: 595761 - RNA, 64 nt, hsa; identical to SEQ ID NO: 269778

SEQ ID NO: 595762 - RNA, 64 nt, hsa; identical to SEQ ID NO: 269779

SEQ ID NO: 595763 - RNA, 64 nt, hsa; identical to SEQ ID NO: 269780

SEQ ID NO: 595764 - RNA, 64 nt, hsa; identical to SEQ ID NO: 269781

SEQ ID NO: 595765 - RNA, 64 nt, hsa; identical to SEQ ID NO: 269782

SEQ ID NO: 595766 - RNA, 64 nt, hsa; identical to SEQ ID NO: 269783

SEQ ID NO: 595767 - RNA, 64 nt, hsa; identical to SEQ ID NO: 269784

SEQ ID NO: 595768 - RNA, 64 nt, hsa; identical to SEQ ID NO: 269785

SEQ ID NO: 595769 - RNA, 64 nt, hsa; identical to SEQ ID NO: 269786

SEQ ID NO: 595770 - RNA, 64 nt, hsa; identical to SEQ ID NO: 269787

SEQ ID NO: 595771 - RNA, 64 nt, hsa; identical to SEQ ID NO: 269788

SEQ ID NO: 595772 - RNA, 64 nt, hsa; identical to SEQ ID NO: 269789

SEQ ID NO: 595773 - RNA, 64 nt, hsa; identical to SEQ ID NO: 269790

SEQ ID NO: 595774 - RNA, 64 nt, hsa; identical to SEQ ID NO: 269791

SEQ ID NO: 595775 - RNA, 64 nt, hsa; identical to SEQ ID NO: 269792

SEQ ID NO: 595776 - RNA, 64 nt, hsa; identical to SEQ ID NO: 269793

SEQ ID NO: 595777 - RNA, 64 nt, hsa; identical to SEQ ID NO: 269794

SEQ ID NO: 595778 - RNA, 64 nt, hsa; identical to SEQ ID NO: 269795

SEQ ID NO: 595779 - RNA, 64 nt, hsa; identical to SEQ ID NO: 269796

SEQ ID NO: 595780 - RNA, 64 nt, hsa; identical to SEQ ID NO: 269797

SEQ ID NO: 595781 - RNA, 64 nt, hsa; identical to SEQ ID NO: 269798

SEQ ID NO: 595782 - RNA, 64 nt, hsa; identical to SEQ ID NO: 269799

SEQ ID NO: 595783 - RNA, 64 nt, hsa; identical to SEQ ID NO: 269800

SEQ ID NO: 595784 - RNA, 64 nt, hsa; identical to SEQ ID NO: 269801

SEQ ID NO: 595785 - RNA, 64 nt, hsa; identical to SEQ ID NO: 269802

SEQ ID NO: 595786 - RNA, 64 nt, hsa; identical to SEQ ID NO: 269803

SEQ ID NO: 595787 - RNA, 64 nt, hsa; identical to SEQ ID NO: 269804

SEQ ID NO: 595788 - RNA, 64 nt, hsa; identical to SEQ ID NO: 269805

SEQ ID NO: 595789 - RNA, 64 nt, hsa; identical to SEQ ID NO: 269806

SEQ ID NO: 595790 - RNA, 64 nt, hsa; identical to SEQ ID NO: 269807

SEQ ID NO: 595791 - RNA, 64 nt, hsa; identical to SEQ ID NO: 269808

SEQ ID NO: 595792 - RNA, 64 nt, hsa; identical to SEQ ID NO: 269809

SEQ ID NO: 595793 - RNA, 64 nt, hsa; identical to SEQ ID NO: 269810

SEQ ID NO: 595794 - RNA, 64 nt, hsa; identical to SEQ ID NO: 269811

SEQ ID NO: 595795 - RNA, 64 nt, hsa; identical to SEQ ID NO: 269812

SEQ ID NO: 595796 - RNA, 64 nt, hsa; identical to SEQ ID NO: 269813

SEQ ID NO: 595797 - RNA, 64 nt, hsa; identical to SEQ ID NO: 269814

SEQ ID NO: 595798 - RNA, 64 nt, hsa; identical to SEQ ID NO: 269815

SEQ ID NO: 595799 - RNA, 64 nt, hsa; identical to SEQ ID NO: 269816

SEQ ID NO: 595800 - RNA, 64 nt, hsa; identical to SEQ ID NO: 269817

SEQ ID NO: 595801 - RNA, 64 nt, hsa; identical to SEQ ID NO: 269818

SEQ ID NO: 595802 - RNA, 64 nt, hsa; identical to SEQ ID NO: 269819

SEQ ID NO: 595803 - RNA, 64 nt, hsa; identical to SEQ ID NO: 269820

SEQ ID NO: 595804 - RNA, 64 nt, hsa; identical to SEQ ID NO: 269821

SEQ ID NO: 595805 - RNA, 64 nt, hsa; identical to SEQ ID NO: 269822

SEQ ID NO: 595806 - RNA, 52 nt, hsa; identical to SEQ ID NO: 269823

SEQ ID NO: 595807 - RNA, 64 nt, hsa; identical to SEQ ID NO: 269824

SEQ ID NO: 595808 - RNA, 64 nt, hsa; identical to SEQ ID NO: 269825

SEQ ID NO: 595809 - RNA, 64 nt, hsa; identical to SEQ ID NO: 269826

SEQ ID NO: 595810 - RNA, 64 nt, hsa; identical to SEQ ID NO: 269827

SEQ ID NO: 595811 - RNA, 64 nt, hsa; identical to SEQ ID NO: 269828

SEQ ID NO: 595812 - RNA, 64 nt, hsa; identical to SEQ ID NO: 269829

SEQ ID NO: 595813 - RNA, 64 nt, hsa; identical to SEQ ID NO: 269830

SEQ ID NO: 595814 - RNA, 64 nt, hsa; identical to SEQ ID NO: 269831

SEQ ID NO: 595815 - RNA, 64 nt, hsa; identical to SEQ ID NO: 269832

SEQ ID NO: 595816 - RNA, 64 nt, hsa; identical to SEQ ID NO: 269833

SEQ ID NO: 595817 - RNA, 64 nt, hsa; identical to SEQ ID NO: 269834

SEQ ID NO: 595818 - RNA, 64 nt, hsa; identical to SEQ ID NO: 269835

SEQ ID NO: 595819 - RNA, 64 nt, hsa; identical to SEQ ID NO: 269836

SEQ ID NO: 595820 - RNA, 64 nt, hsa; identical to SEQ ID NO: 269837

SEQ ID NO: 595821 - RNA, 64 nt, hsa; identical to SEQ ID NO: 269838

SEQ ID NO: 595822 - RNA, 64 nt, hsa; identical to SEQ ID NO: 269839

SEQ ID NO: 595823 - RNA, 64 nt, hsa; identical to SEQ ID NO: 269840

SEQ ID NO: 595824 - RNA, 64 nt, hsa; identical to SEQ ID NO: 269841

SEQ ID NO: 595825 - RNA, 64 nt, hsa; identical to SEQ ID NO: 269842

SEQ ID NO: 595826 - RNA, 64 nt, hsa; identical to SEQ ID NO: 269843

SEQ ID NO: 595827 - RNA, 64 nt, hsa; identical to SEQ ID NO: 269844

SEQ ID NO: 595828 - RNA, 64 nt, hsa; identical to SEQ ID NO: 269845

SEQ ID NO: 595829 - RNA, 64 nt, hsa; identical to SEQ ID NO: 269846

SEQ ID NO: 595830 - RNA, 64 nt, hsa; identical to SEQ ID NO: 269847

SEQ ID NO: 595831 - RNA, 64 nt, hsa; identical to SEQ ID NO: 269848

SEQ ID NO: 595832 - RNA, 64 nt, hsa; identical to SEQ ID NO: 269849

SEQ ID NO: 595833 - RNA, 64 nt, hsa; identical to SEQ ID NO: 269850

SEQ ID NO: 595834 - RNA, 64 nt, hsa; identical to SEQ ID NO: 269851

SEQ ID NO: 595835 - RNA, 64 nt, hsa; identical to SEQ ID NO: 269852

SEQ ID NO: 595836 - RNA, 64 nt, hsa; identical to SEQ ID NO: 269853

SEQ ID NO: 595837 - RNA, 64 nt, hsa; identical to SEQ ID NO: 269854

SEQ ID NO: 595838 - RNA, 64 nt, hsa; identical to SEQ ID NO: 269855

SEQ ID NO: 595839 - RNA, 64 nt, hsa; identical to SEQ ID NO: 269856

SEQ ID NO: 595840 - RNA, 64 nt, hsa; identical to SEQ ID NO: 269857

SEQ ID NO: 595841 - RNA, 64 nt, hsa; identical to SEQ ID NO: 269858

SEQ ID NO: 595842 - RNA, 64 nt, hsa; identical to SEQ ID NO: 269859

SEQ ID NO: 595843 - RNA, 64 nt, hsa; identical to SEQ ID NO: 269860

SEQ ID NO: 595844 - RNA, 64 nt, hsa; identical to SEQ ID NO: 269861

SEQ ID NO: 595845 - RNA, 64 nt, hsa; identical to SEQ ID NO: 269862

SEQ ID NO: 595846 - RNA, 64 nt, hsa; identical to SEQ ID NO: 269863

SEQ ID NO: 595847 - RNA, 64 nt, hsa; identical to SEQ ID NO: 269864

SEQ ID NO: 595848 - RNA, 64 nt, hsa; identical to SEQ ID NO: 269865

SEQ ID NO: 595849 - RNA, 64 nt, hsa; identical to SEQ ID NO: 269866

SEQ ID NO: 595850 - RNA, 64 nt, hsa; identical to SEQ ID NO: 269867

SEQ ID NO: 595851 - RNA, 64 nt, hsa; identical to SEQ ID NO: 269868

SEQ ID NO: 595852 - RNA, 64 nt, hsa; identical to SEQ ID NO: 269869

SEQ ID NO: 595853 - RNA, 64 nt, hsa; identical to SEQ ID NO: 269870

SEQ ID NO: 595854 - RNA, 64 nt, hsa; identical to SEQ ID NO: 269871

SEQ ID NO: 595855 - RNA, 64 nt, hsa; identical to SEQ ID NO: 269872

SEQ ID NO: 595856 - RNA, 64 nt, hsa; identical to SEQ ID NO: 269873

SEQ ID NO: 595857 - RNA, 64 nt, hsa; identical to SEQ ID NO: 269874

SEQ ID NO: 595858 - RNA, 64 nt, hsa; identical to SEQ ID NO: 269875

SEQ ID NO: 595859 - RNA, 64 nt, hsa; identical to SEQ ID NO: 269876

SEQ ID NO: 595860 - RNA, 64 nt, hsa; identical to SEQ ID NO: 269877

SEQ ID NO: 595861 - RNA, 64 nt, hsa; identical to SEQ ID NO: 269878

SEQ ID NO: 595862 - RNA, 64 nt, hsa; identical to SEQ ID NO: 269879

SEQ ID NO: 595863 - RNA, 64 nt, hsa; identical to SEQ ID NO: 269880

SEQ ID NO: 595864 - RNA, 64 nt, hsa; identical to SEQ ID NO: 269881

SEQ ID NO: 595865 - RNA, 64 nt, hsa; identical to SEQ ID NO: 269882

SEQ ID NO: 595866 - RNA, 64 nt, hsa; identical to SEQ ID NO: 269883

SEQ ID NO: 595867 - RNA, 64 nt, hsa; identical to SEQ ID NO: 269884

SEQ ID NO: 595868 - RNA, 64 nt, hsa; identical to SEQ ID NO: 269885

SEQ ID NO: 595869 - RNA, 64 nt, hsa; identical to SEQ ID NO: 269886

SEQ ID NO: 595870 - RNA, 64 nt, hsa; identical to SEQ ID NO: 269887

SEQ ID NO: 595871 - RNA, 64 nt, hsa; identical to SEQ ID NO: 269888

SEQ ID NO: 595872 - RNA, 64 nt, hsa; identical to SEQ ID NO: 269889

SEQ ID NO: 595873 - RNA, 64 nt, hsa; identical to SEQ ID NO: 269890

SEQ ID NO: 595874 - RNA, 64 nt, hsa; identical to SEQ ID NO: 269891

SEQ ID NO: 595875 - RNA, 64 nt, hsa; identical to SEQ ID NO: 269892

SEQ ID NO: 595876 - RNA, 64 nt, hsa; identical to SEQ ID NO: 269893

SEQ ID NO: 595877 - RNA, 64 nt, hsa; identical to SEQ ID NO: 269894

SEQ ID NO: 595878 - RNA, 64 nt, hsa; identical to SEQ ID NO: 269895

SEQ ID NO: 595879 - RNA, 64 nt, hsa; identical to SEQ ID NO: 269896

SEQ ID NO: 595880 - RNA, 64 nt, hsa; identical to SEQ ID NO: 269897

SEQ ID NO: 595881 - RNA, 64 nt, hsa; identical to SEQ ID NO: 269898

SEQ ID NO: 595882 - RNA, 64 nt, hsa; identical to SEQ ID NO: 269899

SEQ ID NO: 595883 - RNA, 64 nt, hsa; identical to SEQ ID NO: 269900

SEQ ID NO: 595884 - RNA, 64 nt, hsa; identical to SEQ ID NO: 269901

SEQ ID NO: 595885 - RNA, 64 nt, hsa; identical to SEQ ID NO: 269902

SEQ ID NO: 595886 - RNA, 64 nt, hsa; identical to SEQ ID NO: 269903

SEQ ID NO: 595887 - RNA, 64 nt, hsa; identical to SEQ ID NO: 269904

SEQ ID NO: 595888 - RNA, 64 nt, hsa; identical to SEQ ID NO: 269905

SEQ ID NO: 595889 - RNA, 64 nt, hsa; identical to SEQ ID NO: 269906

SEQ ID NO: 595890 - RNA, 64 nt, hsa; identical to SEQ ID NO: 269907

SEQ ID NO: 595891 - RNA, 64 nt, hsa; identical to SEQ ID NO: 269908

SEQ ID NO: 595892 - RNA, 64 nt, hsa; identical to SEQ ID NO: 269909

SEQ ID NO: 595893 - RNA, 64 nt, hsa; identical to SEQ ID NO: 269910

SEQ ID NO: 595894 - RNA, 64 nt, hsa; identical to SEQ ID NO: 269911

SEQ ID NO: 595895 - RNA, 64 nt, hsa; identical to SEQ ID NO: 269912

SEQ ID NO: 595896 - RNA, 64 nt, hsa; identical to SEQ ID NO: 269913

SEQ ID NO: 595897 - RNA, 64 nt, hsa; identical to SEQ ID NO: 269914

SEQ ID NO: 595898 - RNA, 64 nt, hsa; identical to SEQ ID NO: 269915

SEQ ID NO: 595899 - RNA, 64 nt, hsa; identical to SEQ ID NO: 269916

SEQ ID NO: 595900 - RNA, 64 nt, hsa; identical to SEQ ID NO: 269917

SEQ ID NO: 595901 - RNA, 64 nt, hsa; identical to SEQ ID NO: 269918

SEQ ID NO: 595902 - RNA, 64 nt, hsa; identical to SEQ ID NO: 269919

SEQ ID NO: 595903 - RNA, 64 nt, hsa; identical to SEQ ID NO: 269920

SEQ ID NO: 595904 - RNA, 64 nt, hsa; identical to SEQ ID NO: 269921

SEQ ID NO: 595905 - RNA, 64 nt, hsa; identical to SEQ ID NO: 269922

SEQ ID NO: 595906 - RNA, 64 nt, hsa; identical to SEQ ID NO: 269923

SEQ ID NO: 595907 - RNA, 64 nt, hsa; identical to SEQ ID NO: 269924

SEQ ID NO: 595908 - RNA, 64 nt, hsa; identical to SEQ ID NO: 269925

SEQ ID NO: 595909 - RNA, 64 nt, hsa; identical to SEQ ID NO: 269926

SEQ ID NO: 595910 - RNA, 64 nt, hsa; identical to SEQ ID NO: 269927

SEQ ID NO: 595911 - RNA, 64 nt, hsa; identical to SEQ ID NO: 269928

SEQ ID NO: 595912 - RNA, 64 nt, hsa; identical to SEQ ID NO: 269929

SEQ ID NO: 595913 - RNA, 64 nt, hsa; identical to SEQ ID NO: 269930

SEQ ID NO: 595914 - RNA, 64 nt, hsa; identical to SEQ ID NO: 269931

SEQ ID NO: 595915 - RNA, 64 nt, hsa; identical to SEQ ID NO: 269932

SEQ ID NO: 595916 - RNA, 64 nt, hsa; identical to SEQ ID NO: 269933

SEQ ID NO: 595917 - RNA, 64 nt, hsa; identical to SEQ ID NO: 269934

SEQ ID NO: 595918 - RNA, 64 nt, hsa; identical to SEQ ID NO: 269935

SEQ ID NO: 595919 - RNA, 64 nt, hsa; identical to SEQ ID NO: 269936

SEQ ID NO: 595920 - RNA, 64 nt, hsa; identical to SEQ ID NO: 269937

SEQ ID NO: 595921 - RNA, 64 nt, hsa; identical to SEQ ID NO: 269938

SEQ ID NO: 595922 - RNA, 64 nt, hsa; identical to SEQ ID NO: 269939

SEQ ID NO: 595923 - RNA, 64 nt, hsa; identical to SEQ ID NO: 269940

SEQ ID NO: 595924 - RNA, 64 nt, hsa; identical to SEQ ID NO: 269941

SEQ ID NO: 595925 - RNA, 64 nt, hsa; identical to SEQ ID NO: 269942

SEQ ID NO: 595926 - RNA, 64 nt, hsa; identical to SEQ ID NO: 269943

SEQ ID NO: 595927 - RNA, 64 nt, hsa; identical to SEQ ID NO: 269944

SEQ ID NO: 595928 - RNA, 64 nt, hsa; identical to SEQ ID NO: 269945

SEQ ID NO: 595929 - RNA, 64 nt, hsa; identical to SEQ ID NO: 269946

SEQ ID NO: 595930 - RNA, 64 nt, hsa; identical to SEQ ID NO: 269947

SEQ ID NO: 595931 - RNA, 64 nt, hsa; identical to SEQ ID NO: 269948

SEQ ID NO: 595932 - RNA, 64 nt, hsa; identical to SEQ ID NO: 269949

SEQ ID NO: 595933 - RNA, 64 nt, hsa; identical to SEQ ID NO: 269950

SEQ ID NO: 595934 - RNA, 64 nt, hsa; identical to SEQ ID NO: 269951

SEQ ID NO: 595935 - RNA, 64 nt, hsa; identical to SEQ ID NO: 269952

SEQ ID NO: 595936 - RNA, 64 nt, hsa; identical to SEQ ID NO: 269953

SEQ ID NO: 595937 - RNA, 64 nt, hsa; identical to SEQ ID NO: 269954

SEQ ID NO: 595938 - RNA, 64 nt, hsa; identical to SEQ ID NO: 269955

SEQ ID NO: 595939 - RNA, 64 nt, hsa; identical to SEQ ID NO: 269956

SEQ ID NO: 595940 - RNA, 64 nt, hsa; identical to SEQ ID NO: 269957

SEQ ID NO: 595941 - RNA, 64 nt, hsa; identical to SEQ ID NO: 269958

SEQ ID NO: 595942 - RNA, 64 nt, hsa; identical to SEQ ID NO: 269959

SEQ ID NO: 595943 - RNA, 64 nt, hsa; identical to SEQ ID NO: 269960

SEQ ID NO: 595944 - RNA, 64 nt, hsa; identical to SEQ ID NO: 269961

SEQ ID NO: 595945 - RNA, 64 nt, hsa; identical to SEQ ID NO: 269962

SEQ ID NO: 595946 - RNA, 64 nt, hsa; identical to SEQ ID NO: 269963

SEQ ID NO: 595947 - RNA, 64 nt, hsa; identical to SEQ ID NO: 269964

SEQ ID NO: 595948 - RNA, 64 nt, hsa; identical to SEQ ID NO: 269965

SEQ ID NO: 595949 - RNA, 64 nt, hsa; identical to SEQ ID NO: 269966

SEQ ID NO: 595950 - RNA, 64 nt, hsa; identical to SEQ ID NO: 269967

SEQ ID NO: 595951 - RNA, 64 nt, hsa; identical to SEQ ID NO: 269968

SEQ ID NO: 595952 - RNA, 64 nt, hsa; identical to SEQ ID NO: 269969

SEQ ID NO: 595953 - RNA, 64 nt, hsa; identical to SEQ ID NO: 269970

SEQ ID NO: 595954 - RNA, 64 nt, hsa; identical to SEQ ID NO: 269971

SEQ ID NO: 595955 - RNA, 64 nt, hsa; identical to SEQ ID NO: 269972

SEQ ID NO: 595956 - RNA, 64 nt, hsa; identical to SEQ ID NO: 269973

SEQ ID NO: 595957 - RNA, 64 nt, hsa; identical to SEQ ID NO: 269974

SEQ ID NO: 595958 - RNA, 64 nt, hsa; identical to SEQ ID NO: 269975

SEQ ID NO: 595959 - RNA, 64 nt, hsa; identical to SEQ ID NO: 269976

SEQ ID NO: 595960 - RNA, 64 nt, hsa; identical to SEQ ID NO: 269977

SEQ ID NO: 595961 - RNA, 64 nt, hsa; identical to SEQ ID NO: 269978

SEQ ID NO: 595962 - RNA, 64 nt, hsa; identical to SEQ ID NO: 269979

SEQ ID NO: 595963 - RNA, 64 nt, hsa; identical to SEQ ID NO: 269980

SEQ ID NO: 595964 - RNA, 64 nt, hsa; identical to SEQ ID NO: 269981

SEQ ID NO: 595965 - RNA, 64 nt, hsa; identical to SEQ ID NO: 269982

SEQ ID NO: 595966 - RNA, 64 nt, hsa; identical to SEQ ID NO: 269983

SEQ ID NO: 595967 - RNA, 64 nt, hsa; identical to SEQ ID NO: 269984

SEQ ID NO: 595968 - RNA, 64 nt, hsa; identical to SEQ ID NO: 269985

SEQ ID NO: 595969 - RNA, 64 nt, hsa; identical to SEQ ID NO: 269986

SEQ ID NO: 595970 - RNA, 64 nt, hsa; identical to SEQ ID NO: 269987

SEQ ID NO: 595971 - RNA, 64 nt, hsa; identical to SEQ ID NO: 269988

SEQ ID NO: 595972 - RNA, 64 nt, hsa; identical to SEQ ID NO: 269989

SEQ ID NO: 595973 - RNA, 64 nt, hsa; identical to SEQ ID NO: 269990

SEQ ID NO: 595974 - RNA, 64 nt, hsa; identical to SEQ ID NO: 269991

SEQ ID NO: 595975 - RNA, 64 nt, hsa; identical to SEQ ID NO: 269992

SEQ ID NO: 595976 - RNA, 64 nt, hsa; identical to SEQ ID NO: 269993

SEQ ID NO: 595977 - RNA, 64 nt, hsa; identical to SEQ ID NO: 269994

SEQ ID NO: 595978 - RNA, 64 nt, hsa; identical to SEQ ID NO: 269995

SEQ ID NO: 595979 - RNA, 64 nt, hsa; identical to SEQ ID NO: 269996

SEQ ID NO: 595980 - RNA, 64 nt, hsa; identical to SEQ ID NO: 269997

SEQ ID NO: 595981 - RNA, 64 nt, hsa; identical to SEQ ID NO: 269998

SEQ ID NO: 595982 - RNA, 64 nt, hsa; identical to SEQ ID NO: 269999

SEQ ID NO: 595983 - RNA, 64 nt, hsa; identical to SEQ ID NO: 270000

SEQ ID NO: 595984 - RNA, 64 nt, hsa; identical to SEQ ID NO: 270001

SEQ ID NO: 595985 - RNA, 64 nt, hsa; identical to SEQ ID NO: 270002

SEQ ID NO: 595986 - RNA, 59 nt, hsa; identical to SEQ ID NO: 270003

SEQ ID NO: 595987 - RNA, 64 nt, hsa; identical to SEQ ID NO: 270004

SEQ ID NO: 595988 - RNA, 64 nt, hsa; identical to SEQ ID NO: 270005

SEQ ID NO: 595989 - RNA, 64 nt, hsa; identical to SEQ ID NO: 270006

SEQ ID NO: 595990 - RNA, 64 nt, hsa; identical to SEQ ID NO: 270007

SEQ ID NO: 595991 - RNA, 64 nt, hsa; identical to SEQ ID NO: 270008

SEQ ID NO: 595992 - RNA, 64 nt, hsa; identical to SEQ ID NO: 270009

SEQ ID NO: 595993 - RNA, 64 nt, hsa; identical to SEQ ID NO: 270010

SEQ ID NO: 595994 - RNA, 64 nt, hsa; identical to SEQ ID NO: 270011

SEQ ID NO: 595995 - RNA, 64 nt, hsa; identical to SEQ ID NO: 270012

SEQ ID NO: 595996 - RNA, 64 nt, hsa; identical to SEQ ID NO: 270013

SEQ ID NO: 595997 - RNA, 64 nt, hsa; identical to SEQ ID NO: 270014

SEQ ID NO: 595998 - RNA, 64 nt, hsa; identical to SEQ ID NO: 270015

SEQ ID NO: 595999 - RNA, 64 nt, hsa; identical to SEQ ID NO: 270016

SEQ ID NO: 596000 - RNA, 64 nt, hsa; identical to SEQ ID NO: 270017

SEQ ID NO: 596001 - RNA, 64 nt, hsa; identical to SEQ ID NO: 270018

SEQ ID NO: 596002 - RNA, 64 nt, hsa; identical to SEQ ID NO: 270019

SEQ ID NO: 596003 - RNA, 64 nt, hsa; identical to SEQ ID NO: 270020

SEQ ID NO: 596004 - RNA, 64 nt, hsa; identical to SEQ ID NO: 270021

SEQ ID NO: 596005 - RNA, 64 nt, hsa; identical to SEQ ID NO: 270022

SEQ ID NO: 596006 - RNA, 64 nt, hsa; identical to SEQ ID NO: 270023

SEQ ID NO: 596007 - RNA, 64 nt, hsa; identical to SEQ ID NO: 270024

SEQ ID NO: 596008 - RNA, 64 nt, hsa; identical to SEQ ID NO: 270025

SEQ ID NO: 596009 - RNA, 64 nt, hsa; identical to SEQ ID NO: 270026

SEQ ID NO: 596010 - RNA, 64 nt, hsa; identical to SEQ ID NO: 270027

SEQ ID NO: 596011 - RNA, 64 nt, hsa; identical to SEQ ID NO: 270028

SEQ ID NO: 596012 - RNA, 64 nt, hsa; identical to SEQ ID NO: 270029

SEQ ID NO: 596013 - RNA, 64 nt, hsa; identical to SEQ ID NO: 270030

SEQ ID NO: 596014 - RNA, 64 nt, hsa; identical to SEQ ID NO: 270031

SEQ ID NO: 596015 - RNA, 64 nt, hsa; identical to SEQ ID NO: 270032

SEQ ID NO: 596016 - RNA, 64 nt, hsa; identical to SEQ ID NO: 270033

SEQ ID NO: 596017 - RNA, 64 nt, hsa; identical to SEQ ID NO: 270034

SEQ ID NO: 596018 - RNA, 64 nt, hsa; identical to SEQ ID NO: 270035

SEQ ID NO: 596019 - RNA, 64 nt, hsa; identical to SEQ ID NO: 270036

SEQ ID NO: 596020 - RNA, 64 nt, hsa; identical to SEQ ID NO: 269952

SEQ ID NO: 596021 - RNA, 64 nt, hsa; identical to SEQ ID NO: 270038

SEQ ID NO: 596022 - RNA, 64 nt, hsa; identical to SEQ ID NO: 270039

SEQ ID NO: 596023 - RNA, 64 nt, hsa; identical to SEQ ID NO: 270040

SEQ ID NO: 596024 - RNA, 64 nt, hsa; identical to SEQ ID NO: 270041

SEQ ID NO: 596025 - RNA, 64 nt, hsa; identical to SEQ ID NO: 270042

SEQ ID NO: 596026 - RNA, 64 nt, hsa; identical to SEQ ID NO: 270043

SEQ ID NO: 596027 - RNA, 64 nt, hsa; identical to SEQ ID NO: 270044

SEQ ID NO: 596028 - RNA, 64 nt, hsa; identical to SEQ ID NO: 270045

SEQ ID NO: 596029 - RNA, 64 nt, hsa; identical to SEQ ID NO: 270042

SEQ ID NO: 596030 - RNA, 64 nt, hsa; identical to SEQ ID NO: 270043

SEQ ID NO: 596031 - RNA, 64 nt, hsa; identical to SEQ ID NO: 270044

SEQ ID NO: 596032 - RNA, 64 nt, hsa; identical to SEQ ID NO: 270045

SEQ ID NO: 596033 - RNA, 64 nt, hsa; identical to SEQ ID NO: 270050

SEQ ID NO: 596034 - RNA, 64 nt, hsa; identical to SEQ ID NO: 270051

SEQ ID NO: 596035 - RNA, 64 nt, hsa; identical to SEQ ID NO: 270052

SEQ ID NO: 596036 - RNA, 64 nt, hsa; identical to SEQ ID NO: 270053

SEQ ID NO: 596037 - RNA, 64 nt, hsa; identical to SEQ ID NO: 270054

SEQ ID NO: 596038 - RNA, 64 nt, hsa; identical to SEQ ID NO: 270055

SEQ ID NO: 596039 - RNA, 64 nt, hsa; identical to SEQ ID NO: 593254

SEQ ID NO: 596040 - RNA, 64 nt, hsa; identical to SEQ ID NO: 593255

SEQ ID NO: 596041 - RNA, 64 nt, hsa; identical to SEQ ID NO: 593256

SEQ ID NO: 596042 - RNA, 64 nt, hsa; identical to SEQ ID NO: 593257

SEQ ID NO: 596043 - RNA, 64 nt, hsa; identical to SEQ ID NO: 593258

SEQ ID NO: 596044 - RNA, 64 nt, hsa; identical to SEQ ID NO: 593259

SEQ ID NO: 596045 - RNA, 64 nt, hsa; identical to SEQ ID NO: 593260

SEQ ID NO: 596046 - RNA, 64 nt, hsa; identical to SEQ ID NO: 593261

SEQ ID NO: 596047 - RNA, 64 nt, hsa; identical to SEQ ID NO: 593262

SEQ ID NO: 596048 - RNA, 64 nt, hsa; identical to SEQ ID NO: 593263

SEQ ID NO: 596049 - RNA, 64 nt, hsa; identical to SEQ ID NO: 593264

SEQ ID NO: 596050 - RNA, 64 nt, hsa; identical to SEQ ID NO: 593265

SEQ ID NO: 596051 - RNA, 64 nt, hsa; identical to SEQ ID NO: 593266

SEQ ID NO: 596052 - RNA, 64 nt, hsa; identical to SEQ ID NO: 593267

SEQ ID NO: 596053 - RNA, 64 nt, hsa; identical to SEQ ID NO: 593268

SEQ ID NO: 596054 - RNA, 64 nt, hsa; identical to SEQ ID NO: 593269

SEQ ID NO: 596055 - RNA, 64 nt, hsa; identical to SEQ ID NO: 593270

SEQ ID NO: 596056 - RNA, 64 nt, hsa; identical to SEQ ID NO: 593271

SEQ ID NO: 596057 - RNA, 64 nt, hsa; identical to SEQ ID NO: 593272

SEQ ID NO: 596058 - RNA, 64 nt, hsa; identical to SEQ ID NO: 593273

SEQ ID NO: 596059 - RNA, 64 nt, hsa; identical to SEQ ID NO: 593274

SEQ ID NO: 596060 - RNA, 64 nt, hsa; identical to SEQ ID NO: 593275

SEQ ID NO: 596061 - RNA, 64 nt, hsa; identical to SEQ ID NO: 593276

SEQ ID NO: 596062 - RNA, 64 nt, hsa; identical to SEQ ID NO: 593277

SEQ ID NO: 596063 - RNA, 64 nt, hsa; identical to SEQ ID NO: 593278

SEQ ID NO: 596064 - RNA, 64 nt, hsa; identical to SEQ ID NO: 593279

SEQ ID NO: 596065 - RNA, 64 nt, hsa; identical to SEQ ID NO: 593280

SEQ ID NO: 596066 - RNA, 64 nt, hsa; identical to SEQ ID NO: 593281

SEQ ID NO: 596067 - RNA, 64 nt, hsa; identical to SEQ ID NO: 593282

SEQ ID NO: 596068 - RNA, 64 nt, hsa; identical to SEQ ID NO: 593283

SEQ ID NO: 596069 - RNA, 64 nt, hsa; identical to SEQ ID NO: 593284

SEQ ID NO: 596070 - RNA, 64 nt, hsa; identical to SEQ ID NO: 593285

SEQ ID NO: 596071 - RNA, 64 nt, hsa; identical to SEQ ID NO: 593286

SEQ ID NO: 596072 - RNA, 64 nt, hsa; identical to SEQ ID NO: 593287

SEQ ID NO: 596073 - RNA, 64 nt, hsa; identical to SEQ ID NO: 593288

SEQ ID NO: 596074 - RNA, 64 nt, hsa; identical to SEQ ID NO: 593289

SEQ ID NO: 596075 - RNA, 64 nt, hsa; identical to SEQ ID NO: 267307

SEQ ID NO: 596076 - RNA, 64 nt, hsa; identical to SEQ ID NO: 267308

SEQ ID NO: 596077 - RNA, 64 nt, hsa; identical to SEQ ID NO: 267309

SEQ ID NO: 596078 - RNA, 64 nt, hsa; identical to SEQ ID NO: 267310

SEQ ID NO: 596079 - RNA, 64 nt, hsa; identical to SEQ ID NO: 267311

SEQ ID NO: 596080 - RNA, 64 nt, hsa; identical to SEQ ID NO: 267312

SEQ ID NO: 596081 - RNA, 64 nt, hsa; identical to SEQ ID NO: 267313

SEQ ID NO: 596082 - RNA, 64 nt, hsa; identical to SEQ ID NO: 267314

SEQ ID NO: 596083 - RNA, 64 nt, hsa; identical to SEQ ID NO: 267315

SEQ ID NO: 596084 - RNA, 64 nt, hsa; identical to SEQ ID NO: 267316

SEQ ID NO: 596085 - RNA, 64 nt, hsa; identical to SEQ ID NO: 267317

SEQ ID NO: 596086 - RNA, 64 nt, hsa; identical to SEQ ID NO: 267318

SEQ ID NO: 596087 - RNA, 64 nt, hsa; identical to SEQ ID NO: 267319

SEQ ID NO: 596088 - RNA, 64 nt, hsa; identical to SEQ ID NO: 267320

SEQ ID NO: 596089 - RNA, 64 nt, hsa; identical to SEQ ID NO: 267321

SEQ ID NO: 596090 - RNA, 64 nt, hsa; identical to SEQ ID NO: 267322

SEQ ID NO: 596091 - RNA, 64 nt, hsa; identical to SEQ ID NO: 267323

SEQ ID NO: 596092 - RNA, 64 nt, hsa; identical to SEQ ID NO: 267324

SEQ ID NO: 596093 - RNA, 64 nt, hsa; identical to SEQ ID NO: 267325

SEQ ID NO: 596094 - RNA, 64 nt, hsa; identical to SEQ ID NO: 267326

SEQ ID NO: 596095 - RNA, 64 nt, hsa; identical to SEQ ID NO: 267327

SEQ ID NO: 596096 - RNA, 64 nt, hsa; identical to SEQ ID NO: 267328

SEQ ID NO: 596097 - RNA, 64 nt, hsa; identical to SEQ ID NO: 267329

SEQ ID NO: 596098 - RNA, 64 nt, hsa; identical to SEQ ID NO: 267330

SEQ ID NO: 596099 - RNA, 64 nt, hsa; identical to SEQ ID NO: 267331

SEQ ID NO: 596100 - RNA, 64 nt, hsa; identical to SEQ ID NO: 267332

SEQ ID NO: 596101 - RNA, 64 nt, hsa; identical to SEQ ID NO: 267333

SEQ ID NO: 596102 - RNA, 64 nt, hsa; identical to SEQ ID NO: 267334

SEQ ID NO: 596103 - RNA, 64 nt, hsa; identical to SEQ ID NO: 267335

SEQ ID NO: 596104 - RNA, 64 nt, hsa; identical to SEQ ID NO: 267336

SEQ ID NO: 596105 - RNA, 64 nt, hsa; identical to SEQ ID NO: 267337

SEQ ID NO: 596106 - RNA, 64 nt, hsa; identical to SEQ ID NO: 267338

SEQ ID NO: 596107 - RNA, 64 nt, hsa; identical to SEQ ID NO: 267339

SEQ ID NO: 596108 - RNA, 64 nt, hsa; identical to SEQ ID NO: 267340

SEQ ID NO: 596109 - RNA, 64 nt, hsa; identical to SEQ ID NO: 267341

SEQ ID NO: 596110 - RNA, 64 nt, hsa; identical to SEQ ID NO: 267342

SEQ ID NO: 596111 - RNA, 64 nt, hsa; identical to SEQ ID NO: 267343

SEQ ID NO: 596112 - RNA, 64 nt, hsa; identical to SEQ ID NO: 267344

SEQ ID NO: 596113 - RNA, 64 nt, hsa; identical to SEQ ID NO: 267345

SEQ ID NO: 596114 - RNA, 64 nt, hsa; identical to SEQ ID NO: 267346

SEQ ID NO: 596115 - RNA, 64 nt, hsa; identical to SEQ ID NO: 267347

SEQ ID NO: 596116 - RNA, 64 nt, hsa; identical to SEQ ID NO: 267348

SEQ ID NO: 596117 - RNA, 64 nt, hsa; identical to SEQ ID NO: 267349

SEQ ID NO: 596118 - RNA, 64 nt, hsa; identical to SEQ ID NO: 267350

SEQ ID NO: 596119 - RNA, 64 nt, hsa; identical to SEQ ID NO: 267351

SEQ ID NO: 596120 - RNA, 64 nt, hsa; identical to SEQ ID NO: 267352

SEQ ID NO: 596121 - RNA, 64 nt, hsa; identical to SEQ ID NO: 267353

SEQ ID NO: 596122 - RNA, 64 nt, hsa; identical to SEQ ID NO: 267354

SEQ ID NO: 596123 - RNA, 64 nt, hsa; identical to SEQ ID NO: 267355

SEQ ID NO: 596124 - RNA, 64 nt, hsa; identical to SEQ ID NO: 267356

SEQ ID NO: 596125 - RNA, 64 nt, hsa; identical to SEQ ID NO: 267357

SEQ ID NO: 596126 - RNA, 64 nt, hsa; identical to SEQ ID NO: 267358

SEQ ID NO: 596127 - RNA, 64 nt, hsa; identical to SEQ ID NO: 267359

SEQ ID NO: 596128 - RNA, 64 nt, hsa; identical to SEQ ID NO: 267360

SEQ ID NO: 596129 - RNA, 64 nt, hsa; identical to SEQ ID NO: 267361

SEQ ID NO: 596130 - RNA, 63 nt, hsa; identical to SEQ ID NO: 267362

SEQ ID NO: 596131 - RNA, 64 nt, hsa; identical to SEQ ID NO: 267363

SEQ ID NO: 596132 - RNA, 64 nt, hsa; identical to SEQ ID NO: 267364

SEQ ID NO: 596133 - RNA, 64 nt, hsa; identical to SEQ ID NO: 267365

SEQ ID NO: 596134 - RNA, 64 nt, hsa; identical to SEQ ID NO: 267366

SEQ ID NO: 596135 - RNA, 64 nt, hsa; identical to SEQ ID NO: 267367

SEQ ID NO: 596136 - RNA, 64 nt, hsa; identical to SEQ ID NO: 267368

SEQ ID NO: 596137 - RNA, 64 nt, hsa; identical to SEQ ID NO: 267369

SEQ ID NO: 596138 - RNA, 64 nt, hsa; identical to SEQ ID NO: 267370

SEQ ID NO: 596139 - RNA, 64 nt, hsa; identical to SEQ ID NO: 267371

SEQ ID NO: 596140 - RNA, 64 nt, hsa; identical to SEQ ID NO: 267372

SEQ ID NO: 596141 - RNA, 64 nt, hsa; identical to SEQ ID NO: 267373

SEQ ID NO: 596142 - RNA, 64 nt, hsa; identical to SEQ ID NO: 267374

SEQ ID NO: 596143 - RNA, 64 nt, hsa; identical to SEQ ID NO: 267375

SEQ ID NO: 596144 - RNA, 64 nt, hsa; identical to SEQ ID NO: 267376

SEQ ID NO: 596145 - RNA, 64 nt, hsa; identical to SEQ ID NO: 267377

SEQ ID NO: 596146 - RNA, 64 nt, hsa; identical to SEQ ID NO: 267378

SEQ ID NO: 596147 - RNA, 64 nt, hsa; identical to SEQ ID NO: 267379

SEQ ID NO: 596148 - RNA, 64 nt, hsa; identical to SEQ ID NO: 267380

SEQ ID NO: 596149 - RNA, 64 nt, hsa; identical to SEQ ID NO: 267381

SEQ ID NO: 596150 - RNA, 64 nt, hsa; identical to SEQ ID NO: 267382

SEQ ID NO: 596151 - RNA, 64 nt, hsa; identical to SEQ ID NO: 267383

SEQ ID NO: 596152 - RNA, 64 nt, hsa; identical to SEQ ID NO: 267384

SEQ ID NO: 596153 - RNA, 64 nt, hsa; identical to SEQ ID NO: 267385

SEQ ID NO: 596154 - RNA, 64 nt, hsa; identical to SEQ ID NO: 267386

SEQ ID NO: 596155 - RNA, 64 nt, hsa; identical to SEQ ID NO: 267387

SEQ ID NO: 596156 - RNA, 64 nt, hsa; identical to SEQ ID NO: 267388

SEQ ID NO: 596157 - RNA, 64 nt, hsa; identical to SEQ ID NO: 267389

SEQ ID NO: 596158 - RNA, 64 nt, hsa; identical to SEQ ID NO: 267390

SEQ ID NO: 596159 - RNA, 64 nt, hsa; identical to SEQ ID NO: 267391

SEQ ID NO: 596160 - RNA, 64 nt, hsa; identical to SEQ ID NO: 267392

SEQ ID NO: 596161 - RNA, 64 nt, hsa; identical to SEQ ID NO: 267393

SEQ ID NO: 596162 - RNA, 64 nt, hsa; identical to SEQ ID NO: 267394

SEQ ID NO: 596163 - RNA, 64 nt, hsa; identical to SEQ ID NO: 267395

SEQ ID NO: 596164 - RNA, 64 nt, hsa; identical to SEQ ID NO: 267396

SEQ ID NO: 596165 - RNA, 64 nt, hsa; identical to SEQ ID NO: 267397

SEQ ID NO: 596166 - RNA, 64 nt, hsa; identical to SEQ ID NO: 267398

SEQ ID NO: 596167 - RNA, 64 nt, hsa; identical to SEQ ID NO: 267399

SEQ ID NO: 596168 - RNA, 64 nt, hsa; identical to SEQ ID NO: 267400

SEQ ID NO: 596169 - RNA, 64 nt, hsa; identical to SEQ ID NO: 267401

SEQ ID NO: 596170 - RNA, 64 nt, hsa; identical to SEQ ID NO: 267402

SEQ ID NO: 596171 - RNA, 64 nt, hsa; identical to SEQ ID NO: 267403

SEQ ID NO: 596172 - RNA, 64 nt, hsa; identical to SEQ ID NO: 267404

SEQ ID NO: 596173 - RNA, 64 nt, hsa; identical to SEQ ID NO: 267405

SEQ ID NO: 596174 - RNA, 64 nt, hsa; identical to SEQ ID NO: 267406

SEQ ID NO: 596175 - RNA, 64 nt, hsa; identical to SEQ ID NO: 267407

SEQ ID NO: 596176 - RNA, 64 nt, hsa; identical to SEQ ID NO: 267408

SEQ ID NO: 596177 - RNA, 64 nt, hsa; identical to SEQ ID NO: 267409

SEQ ID NO: 596178 - RNA, 64 nt, hsa; identical to SEQ ID NO: 267410

SEQ ID NO: 596179 - RNA, 64 nt, hsa; identical to SEQ ID NO: 267411

SEQ ID NO: 596180 - RNA, 64 nt, hsa; identical to SEQ ID NO: 267412

SEQ ID NO: 596181 - RNA, 64 nt, hsa; identical to SEQ ID NO: 267413

SEQ ID NO: 596182 - RNA, 64 nt, hsa; identical to SEQ ID NO: 267414

SEQ ID NO: 596183 - RNA, 64 nt, hsa; identical to SEQ ID NO: 267415

SEQ ID NO: 596184 - RNA, 64 nt, hsa; identical to SEQ ID NO: 267416

SEQ ID NO: 596185 - RNA, 64 nt, hsa; identical to SEQ ID NO: 267417

SEQ ID NO: 596186 - RNA, 64 nt, hsa; identical to SEQ ID NO: 267418

SEQ ID NO: 596187 - RNA, 64 nt, hsa; identical to SEQ ID NO: 267419

SEQ ID NO: 596188 - RNA, 64 nt, hsa; identical to SEQ ID NO: 267420

SEQ ID NO: 596189 - RNA, 64 nt, hsa; identical to SEQ ID NO: 267421

SEQ ID NO: 596190 - RNA, 64 nt, hsa; identical to SEQ ID NO: 267422

SEQ ID NO: 596191 - RNA, 64 nt, hsa; identical to SEQ ID NO: 267423

SEQ ID NO: 596192 - RNA, 64 nt, hsa; identical to SEQ ID NO: 267424

SEQ ID NO: 596193 - RNA, 64 nt, hsa; identical to SEQ ID NO: 267425

SEQ ID NO: 596194 - RNA, 64 nt, hsa; identical to SEQ ID NO: 267426

SEQ ID NO: 596195 - RNA, 64 nt, hsa; identical to SEQ ID NO: 267427

SEQ ID NO: 596196 - RNA, 64 nt, hsa; identical to SEQ ID NO: 267428

SEQ ID NO: 596197 - RNA, 64 nt, hsa; identical to SEQ ID NO: 267429

SEQ ID NO: 596198 - RNA, 64 nt, hsa; identical to SEQ ID NO: 267430

SEQ ID NO: 596199 - RNA, 64 nt, hsa; identical to SEQ ID NO: 267431

SEQ ID NO: 596200 - RNA, 64 nt, hsa; identical to SEQ ID NO: 267432

SEQ ID NO: 596201 - RNA, 64 nt, hsa; identical to SEQ ID NO: 267433

SEQ ID NO: 596202 - RNA, 64 nt, hsa; identical to SEQ ID NO: 267434

SEQ ID NO: 596203 - RNA, 64 nt, hsa; identical to SEQ ID NO: 267435

SEQ ID NO: 596204 - RNA, 64 nt, hsa; identical to SEQ ID NO: 267436

SEQ ID NO: 596205 - RNA, 64 nt, hsa; identical to SEQ ID NO: 267437

SEQ ID NO: 596206 - RNA, 64 nt, hsa; identical to SEQ ID NO: 267438

SEQ ID NO: 596207 - RNA, 64 nt, hsa; identical to SEQ ID NO: 267439

SEQ ID NO: 596208 - RNA, 64 nt, hsa; identical to SEQ ID NO: 267440

SEQ ID NO: 596209 - RNA, 64 nt, hsa; identical to SEQ ID NO: 267441

SEQ ID NO: 596210 - RNA, 64 nt, hsa; identical to SEQ ID NO: 267442

SEQ ID NO: 596211 - RNA, 64 nt, hsa; identical to SEQ ID NO: 267443

SEQ ID NO: 596212 - RNA, 64 nt, hsa; identical to SEQ ID NO: 267444

SEQ ID NO: 596213 - RNA, 64 nt, hsa; identical to SEQ ID NO: 267445

SEQ ID NO: 596214 - RNA, 64 nt, hsa; identical to SEQ ID NO: 267446

SEQ ID NO: 596215 - RNA, 64 nt, hsa; identical to SEQ ID NO: 267447

SEQ ID NO: 596216 - RNA, 64 nt, hsa; identical to SEQ ID NO: 267448

SEQ ID NO: 596217 - RNA, 64 nt, hsa; identical to SEQ ID NO: 267449

SEQ ID NO: 596218 - RNA, 64 nt, hsa; identical to SEQ ID NO: 267450

SEQ ID NO: 596219 - RNA, 64 nt, hsa; identical to SEQ ID NO: 267451

SEQ ID NO: 596220 - RNA, 64 nt, hsa; identical to SEQ ID NO: 267452

SEQ ID NO: 596221 - RNA, 64 nt, hsa; identical to SEQ ID NO: 267453

SEQ ID NO: 596222 - RNA, 64 nt, hsa; identical to SEQ ID NO: 267454

SEQ ID NO: 596223 - RNA, 64 nt, hsa; identical to SEQ ID NO: 267455

SEQ ID NO: 596224 - RNA, 64 nt, hsa; identical to SEQ ID NO: 267456

SEQ ID NO: 596225 - RNA, 64 nt, hsa; identical to SEQ ID NO: 267457

SEQ ID NO: 596226 - RNA, 64 nt, hsa; identical to SEQ ID NO: 267458

SEQ ID NO: 596227 - RNA, 64 nt, hsa; identical to SEQ ID NO: 267459

SEQ ID NO: 596228 - RNA, 64 nt, hsa; identical to SEQ ID NO: 267460

SEQ ID NO: 596229 - RNA, 64 nt, hsa; identical to SEQ ID NO: 267461

SEQ ID NO: 596230 - RNA, 64 nt, hsa; identical to SEQ ID NO: 267462

SEQ ID NO: 596231 - RNA, 64 nt, hsa; identical to SEQ ID NO: 267463

SEQ ID NO: 596232 - RNA, 64 nt, hsa; identical to SEQ ID NO: 267464

SEQ ID NO: 596233 - RNA, 64 nt, hsa; identical to SEQ ID NO: 267465

SEQ ID NO: 596234 - RNA, 64 nt, hsa; identical to SEQ ID NO: 267466

SEQ ID NO: 596235 - RNA, 64 nt, hsa; identical to SEQ ID NO: 267467

SEQ ID NO: 596236 - RNA, 64 nt, hsa; identical to SEQ ID NO: 267468

SEQ ID NO: 596237 - RNA, 64 nt, hsa; identical to SEQ ID NO: 267469

SEQ ID NO: 596238 - RNA, 64 nt, hsa; identical to SEQ ID NO: 267470

SEQ ID NO: 596239 - RNA, 64 nt, hsa; identical to SEQ ID NO: 267471

SEQ ID NO: 596240 - RNA, 64 nt, hsa; identical to SEQ ID NO: 267472

SEQ ID NO: 596241 - RNA, 64 nt, hsa; identical to SEQ ID NO: 267473

SEQ ID NO: 596242 - RNA, 64 nt, hsa; identical to SEQ ID NO: 267474

SEQ ID NO: 596243 - RNA, 64 nt, hsa; identical to SEQ ID NO: 267475

SEQ ID NO: 596244 - RNA, 64 nt, hsa; identical to SEQ ID NO: 267476

SEQ ID NO: 596245 - RNA, 64 nt, hsa; identical to SEQ ID NO: 267477

SEQ ID NO: 596246 - RNA, 64 nt, hsa; identical to SEQ ID NO: 267478

SEQ ID NO: 596247 - RNA, 64 nt, hsa; identical to SEQ ID NO: 267479

SEQ ID NO: 596248 - RNA, 64 nt, hsa; identical to SEQ ID NO: 267480

SEQ ID NO: 596249 - RNA, 64 nt, hsa; identical to SEQ ID NO: 267481

SEQ ID NO: 596250 - RNA, 64 nt, hsa; identical to SEQ ID NO: 267482

SEQ ID NO: 596251 - RNA, 64 nt, hsa; identical to SEQ ID NO: 267483

SEQ ID NO: 596252 - RNA, 64 nt, hsa; identical to SEQ ID NO: 267484

SEQ ID NO: 596253 - RNA, 64 nt, hsa; identical to SEQ ID NO: 267485

SEQ ID NO: 596254 - RNA, 64 nt, hsa; identical to SEQ ID NO: 267486

SEQ ID NO: 596255 - RNA, 64 nt, hsa; identical to SEQ ID NO: 267487

SEQ ID NO: 596256 - RNA, 64 nt, hsa; identical to SEQ ID NO: 267488

SEQ ID NO: 596257 - RNA, 64 nt, hsa; identical to SEQ ID NO: 267489

SEQ ID NO: 596258 - RNA, 64 nt, hsa; identical to SEQ ID NO: 267490

SEQ ID NO: 596259 - RNA, 64 nt, hsa; identical to SEQ ID NO: 267491

SEQ ID NO: 596260 - RNA, 64 nt, hsa; identical to SEQ ID NO: 267492

SEQ ID NO: 596261 - RNA, 64 nt, hsa; identical to SEQ ID NO: 267493

SEQ ID NO: 596262 - RNA, 64 nt, hsa; identical to SEQ ID NO: 267494

SEQ ID NO: 596263 - RNA, 64 nt, hsa; identical to SEQ ID NO: 267495

SEQ ID NO: 596264 - RNA, 64 nt, hsa; identical to SEQ ID NO: 267496

SEQ ID NO: 596265 - RNA, 64 nt, hsa; identical to SEQ ID NO: 267497

SEQ ID NO: 596266 - RNA, 64 nt, hsa; identical to SEQ ID NO: 267498

SEQ ID NO: 596267 - RNA, 64 nt, hsa; identical to SEQ ID NO: 267499

SEQ ID NO: 596268 - RNA, 64 nt, hsa; identical to SEQ ID NO: 267500

SEQ ID NO: 596269 - RNA, 64 nt, hsa; identical to SEQ ID NO: 267501

SEQ ID NO: 596270 - RNA, 64 nt, hsa; identical to SEQ ID NO: 267502

SEQ ID NO: 596271 - RNA, 64 nt, hsa; identical to SEQ ID NO: 267503

SEQ ID NO: 596272 - RNA, 64 nt, hsa; identical to SEQ ID NO: 267504

SEQ ID NO: 596273 - RNA, 64 nt, hsa; identical to SEQ ID NO: 267505

SEQ ID NO: 596274 - RNA, 64 nt, hsa; identical to SEQ ID NO: 267506

SEQ ID NO: 596275 - RNA, 64 nt, hsa; identical to SEQ ID NO: 267507

SEQ ID NO: 596276 - RNA, 64 nt, hsa; identical to SEQ ID NO: 267508

SEQ ID NO: 596277 - RNA, 64 nt, hsa; identical to SEQ ID NO: 267509

SEQ ID NO: 596278 - RNA, 64 nt, hsa; identical to SEQ ID NO: 267510

SEQ ID NO: 596279 - RNA, 64 nt, hsa; identical to SEQ ID NO: 267511

SEQ ID NO: 596280 - RNA, 64 nt, hsa; identical to SEQ ID NO: 267512

SEQ ID NO: 596281 - RNA, 64 nt, hsa; identical to SEQ ID NO: 267513

SEQ ID NO: 596282 - RNA, 64 nt, hsa; identical to SEQ ID NO: 267514

SEQ ID NO: 596283 - RNA, 64 nt, hsa; identical to SEQ ID NO: 267515

SEQ ID NO: 596284 - RNA, 64 nt, hsa; identical to SEQ ID NO: 267516

SEQ ID NO: 596285 - RNA, 64 nt, hsa; identical to SEQ ID NO: 267517

SEQ ID NO: 596286 - RNA, 64 nt, hsa; identical to SEQ ID NO: 267518

SEQ ID NO: 596287 - RNA, 64 nt, hsa; identical to SEQ ID NO: 267519

SEQ ID NO: 596288 - RNA, 64 nt, hsa; identical to SEQ ID NO: 267520

SEQ ID NO: 596289 - RNA, 64 nt, hsa; identical to SEQ ID NO: 267521

SEQ ID NO: 596290 - RNA, 64 nt, hsa; identical to SEQ ID NO: 267522

SEQ ID NO: 596291 - RNA, 64 nt, hsa; identical to SEQ ID NO: 267523

SEQ ID NO: 596292 - RNA, 64 nt, hsa; identical to SEQ ID NO: 267524

SEQ ID NO: 596293 - RNA, 64 nt, hsa; identical to SEQ ID NO: 267525

SEQ ID NO: 596294 - RNA, 64 nt, hsa; identical to SEQ ID NO: 267526

SEQ ID NO: 596295 - RNA, 64 nt, hsa; identical to SEQ ID NO: 267527

SEQ ID NO: 596296 - RNA, 64 nt, hsa; identical to SEQ ID NO: 267528

SEQ ID NO: 596297 - RNA, 64 nt, hsa; identical to SEQ ID NO: 267529

SEQ ID NO: 596298 - RNA, 64 nt, hsa; identical to SEQ ID NO: 267530

SEQ ID NO: 596299 - RNA, 64 nt, hsa; identical to SEQ ID NO: 267531

SEQ ID NO: 596300 - RNA, 64 nt, hsa; identical to SEQ ID NO: 267532

SEQ ID NO: 596301 - RNA, 64 nt, hsa; identical to SEQ ID NO: 267533

SEQ ID NO: 596302 - RNA, 64 nt, hsa; identical to SEQ ID NO: 267534

SEQ ID NO: 596303 - RNA, 64 nt, hsa; identical to SEQ ID NO: 267535

SEQ ID NO: 596304 - RNA, 64 nt, hsa; identical to SEQ ID NO: 267536

SEQ ID NO: 596305 - RNA, 64 nt, hsa; identical to SEQ ID NO: 267537

SEQ ID NO: 596306 - RNA, 64 nt, hsa; identical to SEQ ID NO: 267538

SEQ ID NO: 596307 - RNA, 64 nt, hsa; identical to SEQ ID NO: 267539

SEQ ID NO: 596308 - RNA, 64 nt, hsa; identical to SEQ ID NO: 267540

SEQ ID NO: 596309 - RNA, 64 nt, hsa; identical to SEQ ID NO: 267541

SEQ ID NO: 596310 - RNA, 64 nt, hsa; identical to SEQ ID NO: 267542

SEQ ID NO: 596311 - RNA, 64 nt, hsa; identical to SEQ ID NO: 267543

SEQ ID NO: 596312 - RNA, 64 nt, hsa; identical to SEQ ID NO: 267544

SEQ ID NO: 596313 - RNA, 64 nt, hsa; identical to SEQ ID NO: 267545

SEQ ID NO: 596314 - RNA, 64 nt, hsa; identical to SEQ ID NO: 267546

SEQ ID NO: 596315 - RNA, 64 nt, hsa; identical to SEQ ID NO: 267547

SEQ ID NO: 596316 - RNA, 64 nt, hsa; identical to SEQ ID NO: 267548

SEQ ID NO: 596317 - RNA, 64 nt, hsa; identical to SEQ ID NO: 267549

SEQ ID NO: 596318 - RNA, 64 nt, hsa; identical to SEQ ID NO: 267550

SEQ ID NO: 596319 - RNA, 64 nt, hsa; identical to SEQ ID NO: 267551

SEQ ID NO: 596320 - RNA, 64 nt, hsa; identical to SEQ ID NO: 267552

SEQ ID NO: 596321 - RNA, 64 nt, hsa; identical to SEQ ID NO: 267553

SEQ ID NO: 596322 - RNA, 64 nt, hsa; identical to SEQ ID NO: 267554

SEQ ID NO: 596323 - RNA, 64 nt, hsa; identical to SEQ ID NO: 267555

SEQ ID NO: 596324 - RNA, 64 nt, hsa; identical to SEQ ID NO: 267556

SEQ ID NO: 596325 - RNA, 64 nt, hsa; identical to SEQ ID NO: 267557

SEQ ID NO: 596326 - RNA, 64 nt, hsa; identical to SEQ ID NO: 267558

SEQ ID NO: 596327 - RNA, 64 nt, hsa; identical to SEQ ID NO: 267559

SEQ ID NO: 596328 - RNA, 64 nt, hsa; identical to SEQ ID NO: 267560

SEQ ID NO: 596329 - RNA, 64 nt, hsa; identical to SEQ ID NO: 267561

SEQ ID NO: 596330 - RNA, 64 nt, hsa; identical to SEQ ID NO: 267562

SEQ ID NO: 596331 - RNA, 64 nt, hsa; identical to SEQ ID NO: 267563

SEQ ID NO: 596332 - RNA, 64 nt, hsa; identical to SEQ ID NO: 267564

SEQ ID NO: 596333 - RNA, 64 nt, hsa; identical to SEQ ID NO: 267565

SEQ ID NO: 596334 - RNA, 64 nt, hsa; identical to SEQ ID NO: 267566

SEQ ID NO: 596335 - RNA, 64 nt, hsa; identical to SEQ ID NO: 267567

SEQ ID NO: 596336 - RNA, 64 nt, hsa; identical to SEQ ID NO: 267568

SEQ ID NO: 596337 - RNA, 64 nt, hsa; identical to SEQ ID NO: 267569

SEQ ID NO: 596338 - RNA, 64 nt, hsa; identical to SEQ ID NO: 267570

SEQ ID NO: 596339 - RNA, 64 nt, hsa; identical to SEQ ID NO: 267571

SEQ ID NO: 596340 - RNA, 64 nt, hsa; identical to SEQ ID NO: 267572

SEQ ID NO: 596341 - RNA, 64 nt, hsa; identical to SEQ ID NO: 267573

SEQ ID NO: 596342 - RNA, 64 nt, hsa; identical to SEQ ID NO: 267574

SEQ ID NO: 596343 - RNA, 64 nt, hsa; identical to SEQ ID NO: 267575

SEQ ID NO: 596344 - RNA, 64 nt, hsa; identical to SEQ ID NO: 267576

SEQ ID NO: 596345 - RNA, 64 nt, hsa; identical to SEQ ID NO: 267577

SEQ ID NO: 596346 - RNA, 64 nt, hsa; identical to SEQ ID NO: 267578

SEQ ID NO: 596347 - RNA, 64 nt, hsa; identical to SEQ ID NO: 267579

SEQ ID NO: 596348 - RNA, 64 nt, hsa; identical to SEQ ID NO: 267580

SEQ ID NO: 596349 - RNA, 64 nt, hsa; identical to SEQ ID NO: 267581

SEQ ID NO: 596350 - RNA, 64 nt, hsa; identical to SEQ ID NO: 267582

SEQ ID NO: 596351 - RNA, 64 nt, hsa; identical to SEQ ID NO: 267583

SEQ ID NO: 596352 - RNA, 64 nt, hsa; identical to SEQ ID NO: 267584

SEQ ID NO: 596353 - RNA, 64 nt, hsa; identical to SEQ ID NO: 267585

SEQ ID NO: 596354 - RNA, 64 nt, hsa; identical to SEQ ID NO: 267586

SEQ ID NO: 596355 - RNA, 64 nt, hsa; identical to SEQ ID NO: 267587

SEQ ID NO: 596356 - RNA, 64 nt, hsa; identical to SEQ ID NO: 267588

SEQ ID NO: 596357 - RNA, 64 nt, hsa; identical to SEQ ID NO: 267589

SEQ ID NO: 596358 - RNA, 64 nt, hsa; identical to SEQ ID NO: 267590

SEQ ID NO: 596359 - RNA, 64 nt, hsa; identical to SEQ ID NO: 267591

SEQ ID NO: 596360 - RNA, 64 nt, hsa; identical to SEQ ID NO: 267592

SEQ ID NO: 596361 - RNA, 64 nt, hsa; identical to SEQ ID NO: 267593

SEQ ID NO: 596362 - RNA, 64 nt, hsa; identical to SEQ ID NO: 267594

SEQ ID NO: 596363 - RNA, 64 nt, hsa; identical to SEQ ID NO: 267595

SEQ ID NO: 596364 - RNA, 64 nt, hsa; identical to SEQ ID NO: 267596

SEQ ID NO: 596365 - RNA, 64 nt, hsa; identical to SEQ ID NO: 267597

SEQ ID NO: 596366 - RNA, 64 nt, hsa; identical to SEQ ID NO: 267598

SEQ ID NO: 596367 - RNA, 64 nt, hsa; identical to SEQ ID NO: 267599

SEQ ID NO: 596368 - RNA, 64 nt, hsa; identical to SEQ ID NO: 267600

SEQ ID NO: 596369 - RNA, 64 nt, hsa; identical to SEQ ID NO: 267601

SEQ ID NO: 596370 - RNA, 64 nt, hsa; identical to SEQ ID NO: 267602

SEQ ID NO: 596371 - RNA, 64 nt, hsa; identical to SEQ ID NO: 267603

SEQ ID NO: 596372 - RNA, 64 nt, hsa; identical to SEQ ID NO: 267604

SEQ ID NO: 596373 - RNA, 64 nt, hsa; identical to SEQ ID NO: 267605

SEQ ID NO: 596374 - RNA, 64 nt, hsa; identical to SEQ ID NO: 267606

SEQ ID NO: 596375 - RNA, 64 nt, hsa; identical to SEQ ID NO: 267607

SEQ ID NO: 596376 - RNA, 64 nt, hsa; identical to SEQ ID NO: 267608

SEQ ID NO: 596377 - RNA, 64 nt, hsa; identical to SEQ ID NO: 267609

SEQ ID NO: 596378 - RNA, 64 nt, hsa; identical to SEQ ID NO: 267610

SEQ ID NO: 596379 - RNA, 64 nt, hsa; identical to SEQ ID NO: 267611

SEQ ID NO: 596380 - RNA, 64 nt, hsa; identical to SEQ ID NO: 267612

SEQ ID NO: 596381 - RNA, 64 nt, hsa; identical to SEQ ID NO: 267613

SEQ ID NO: 596382 - RNA, 64 nt, hsa; identical to SEQ ID NO: 267614

SEQ ID NO: 596383 - RNA, 64 nt, hsa; identical to SEQ ID NO: 267615

SEQ ID NO: 596384 - RNA, 64 nt, hsa; identical to SEQ ID NO: 267616

SEQ ID NO: 596385 - RNA, 64 nt, hsa; identical to SEQ ID NO: 267617

SEQ ID NO: 596386 - RNA, 64 nt, hsa; identical to SEQ ID NO: 267618

SEQ ID NO: 596387 - RNA, 64 nt, hsa; identical to SEQ ID NO: 267619

SEQ ID NO: 596388 - RNA, 64 nt, hsa; identical to SEQ ID NO: 267620

SEQ ID NO: 596389 - RNA, 64 nt, hsa; identical to SEQ ID NO: 267621

SEQ ID NO: 596390 - RNA, 64 nt, hsa; identical to SEQ ID NO: 267622

SEQ ID NO: 596391 - RNA, 64 nt, hsa; identical to SEQ ID NO: 267623

SEQ ID NO: 596392 - RNA, 64 nt, hsa; identical to SEQ ID NO: 267624

SEQ ID NO: 596393 - RNA, 64 nt, hsa; identical to SEQ ID NO: 267625

SEQ ID NO: 596394 - RNA, 64 nt, hsa; identical to SEQ ID NO: 267626

SEQ ID NO: 596395 - RNA, 64 nt, hsa; identical to SEQ ID NO: 267627

SEQ ID NO: 596396 - RNA, 64 nt, hsa; identical to SEQ ID NO: 267628

SEQ ID NO: 596397 - RNA, 64 nt, hsa; identical to SEQ ID NO: 267629

SEQ ID NO: 596398 - RNA, 64 nt, hsa; identical to SEQ ID NO: 267630

SEQ ID NO: 596399 - RNA, 64 nt, hsa; identical to SEQ ID NO: 267631

SEQ ID NO: 596400 - RNA, 64 nt, hsa; identical to SEQ ID NO: 267632

SEQ ID NO: 596401 - RNA, 64 nt, hsa; identical to SEQ ID NO: 267633

SEQ ID NO: 596402 - RNA, 64 nt, hsa; identical to SEQ ID NO: 267634

SEQ ID NO: 596403 - RNA, 64 nt, hsa; identical to SEQ ID NO: 267635

SEQ ID NO: 596404 - RNA, 64 nt, hsa; identical to SEQ ID NO: 267636

SEQ ID NO: 596405 - RNA, 64 nt, hsa; identical to SEQ ID NO: 267637

SEQ ID NO: 596406 - RNA, 64 nt, hsa; identical to SEQ ID NO: 267638

SEQ ID NO: 596407 - RNA, 64 nt, hsa; identical to SEQ ID NO: 267639

SEQ ID NO: 596408 - RNA, 64 nt, hsa; identical to SEQ ID NO: 267640

SEQ ID NO: 596409 - RNA, 64 nt, hsa; identical to SEQ ID NO: 267641

SEQ ID NO: 596410 - RNA, 64 nt, hsa; identical to SEQ ID NO: 267642

SEQ ID NO: 596411 - RNA, 64 nt, hsa; identical to SEQ ID NO: 267643

SEQ ID NO: 596412 - RNA, 64 nt, hsa; identical to SEQ ID NO: 267644

SEQ ID NO: 596413 - RNA, 64 nt, hsa; identical to SEQ ID NO: 267645

SEQ ID NO: 596414 - RNA, 64 nt, hsa; identical to SEQ ID NO: 267646

SEQ ID NO: 596415 - RNA, 64 nt, hsa; identical to SEQ ID NO: 267647

SEQ ID NO: 596416 - RNA, 64 nt, hsa; identical to SEQ ID NO: 267648

SEQ ID NO: 596417 - RNA, 64 nt, hsa; identical to SEQ ID NO: 267649

SEQ ID NO: 596418 - RNA, 64 nt, hsa; identical to SEQ ID NO: 267650

SEQ ID NO: 596419 - RNA, 64 nt, hsa; identical to SEQ ID NO: 267651

SEQ ID NO: 596420 - RNA, 64 nt, hsa; identical to SEQ ID NO: 267652

SEQ ID NO: 596421 - RNA, 64 nt, hsa; identical to SEQ ID NO: 267653

SEQ ID NO: 596422 - RNA, 64 nt, hsa; identical to SEQ ID NO: 267654

SEQ ID NO: 596423 - RNA, 64 nt, hsa; identical to SEQ ID NO: 267655

SEQ ID NO: 596424 - RNA, 64 nt, hsa; identical to SEQ ID NO: 267656

SEQ ID NO: 596425 - RNA, 64 nt, hsa; identical to SEQ ID NO: 267657

SEQ ID NO: 596426 - RNA, 64 nt, hsa; identical to SEQ ID NO: 267658

SEQ ID NO: 596427 - RNA, 64 nt, hsa; identical to SEQ ID NO: 267659

SEQ ID NO: 596428 - RNA, 64 nt, hsa; identical to SEQ ID NO: 267660

SEQ ID NO: 596429 - RNA, 64 nt, hsa; identical to SEQ ID NO: 267661

SEQ ID NO: 596430 - RNA, 64 nt, hsa; identical to SEQ ID NO: 267662

SEQ ID NO: 596431 - RNA, 64 nt, hsa; identical to SEQ ID NO: 267663

SEQ ID NO: 596432 - RNA, 64 nt, hsa; identical to SEQ ID NO: 267664

SEQ ID NO: 596433 - RNA, 64 nt, hsa; identical to SEQ ID NO: 267665

SEQ ID NO: 596434 - RNA, 64 nt, hsa; identical to SEQ ID NO: 267666

SEQ ID NO: 596435 - RNA, 64 nt, hsa; identical to SEQ ID NO: 267667

SEQ ID NO: 596436 - RNA, 64 nt, hsa; identical to SEQ ID NO: 267668

SEQ ID NO: 596437 - RNA, 64 nt, hsa; identical to SEQ ID NO: 267669

SEQ ID NO: 596438 - RNA, 64 nt, hsa; identical to SEQ ID NO: 267670

SEQ ID NO: 596439 - RNA, 64 nt, hsa; identical to SEQ ID NO: 267671

SEQ ID NO: 596440 - RNA, 64 nt, hsa; identical to SEQ ID NO: 267672

SEQ ID NO: 596441 - RNA, 64 nt, hsa; identical to SEQ ID NO: 267673

SEQ ID NO: 596442 - RNA, 64 nt, hsa; identical to SEQ ID NO: 267674

SEQ ID NO: 596443 - RNA, 64 nt, hsa; identical to SEQ ID NO: 267675

SEQ ID NO: 596444 - RNA, 64 nt, hsa; identical to SEQ ID NO: 267676

SEQ ID NO: 596445 - RNA, 64 nt, hsa; identical to SEQ ID NO: 267677

SEQ ID NO: 596446 - RNA, 64 nt, hsa; identical to SEQ ID NO: 267678

SEQ ID NO: 596447 - RNA, 64 nt, hsa; identical to SEQ ID NO: 267679

SEQ ID NO: 596448 - RNA, 64 nt, hsa; identical to SEQ ID NO: 267680

SEQ ID NO: 596449 - RNA, 64 nt, hsa; identical to SEQ ID NO: 267681

SEQ ID NO: 596450 - RNA, 64 nt, hsa; identical to SEQ ID NO: 267682

SEQ ID NO: 596451 - RNA, 64 nt, hsa; identical to SEQ ID NO: 267683

SEQ ID NO: 596452 - RNA, 64 nt, hsa; identical to SEQ ID NO: 267684

SEQ ID NO: 596453 - RNA, 64 nt, hsa; identical to SEQ ID NO: 267685

SEQ ID NO: 596454 - RNA, 64 nt, hsa; identical to SEQ ID NO: 267686

SEQ ID NO: 596455 - RNA, 64 nt, hsa; identical to SEQ ID NO: 267687

SEQ ID NO: 596456 - RNA, 64 nt, hsa; identical to SEQ ID NO: 267688

SEQ ID NO: 596457 - RNA, 64 nt, hsa; identical to SEQ ID NO: 267689

SEQ ID NO: 596458 - RNA, 64 nt, hsa; identical to SEQ ID NO: 267690

SEQ ID NO: 596459 - RNA, 64 nt, hsa; identical to SEQ ID NO: 267691

SEQ ID NO: 596460 - RNA, 64 nt, hsa; identical to SEQ ID NO: 267692

SEQ ID NO: 596461 - RNA, 64 nt, hsa; identical to SEQ ID NO: 267693

SEQ ID NO: 596462 - RNA, 64 nt, hsa; identical to SEQ ID NO: 267694

SEQ ID NO: 596463 - RNA, 64 nt, hsa; identical to SEQ ID NO: 267695

SEQ ID NO: 596464 - RNA, 64 nt, hsa; identical to SEQ ID NO: 267696

SEQ ID NO: 596465 - RNA, 64 nt, hsa; identical to SEQ ID NO: 267697

SEQ ID NO: 596466 - RNA, 64 nt, hsa; identical to SEQ ID NO: 267698

SEQ ID NO: 596467 - RNA, 64 nt, hsa; identical to SEQ ID NO: 267699

SEQ ID NO: 596468 - RNA, 64 nt, hsa; identical to SEQ ID NO: 267700

SEQ ID NO: 596469 - RNA, 64 nt, hsa; identical to SEQ ID NO: 267701

SEQ ID NO: 596470 - RNA, 64 nt, hsa; identical to SEQ ID NO: 267702

SEQ ID NO: 596471 - RNA, 64 nt, hsa; identical to SEQ ID NO: 267703

SEQ ID NO: 596472 - RNA, 64 nt, hsa; identical to SEQ ID NO: 267704

SEQ ID NO: 596473 - RNA, 64 nt, hsa; identical to SEQ ID NO: 267705

SEQ ID NO: 596474 - RNA, 64 nt, hsa; identical to SEQ ID NO: 267706

SEQ ID NO: 596475 - RNA, 64 nt, hsa; identical to SEQ ID NO: 267707

SEQ ID NO: 596476 - RNA, 64 nt, hsa; identical to SEQ ID NO: 267708

SEQ ID NO: 596477 - RNA, 64 nt, hsa; identical to SEQ ID NO: 267709

SEQ ID NO: 596478 - RNA, 64 nt, hsa; identical to SEQ ID NO: 267710

SEQ ID NO: 596479 - RNA, 64 nt, hsa; identical to SEQ ID NO: 267711

SEQ ID NO: 596480 - RNA, 64 nt, hsa; identical to SEQ ID NO: 267712

SEQ ID NO: 596481 - RNA, 64 nt, hsa; identical to SEQ ID NO: 267713

SEQ ID NO: 596482 - RNA, 64 nt, hsa; identical to SEQ ID NO: 267714

SEQ ID NO: 596483 - RNA, 64 nt, hsa; identical to SEQ ID NO: 267715

SEQ ID NO: 596484 - RNA, 64 nt, hsa; identical to SEQ ID NO: 267716

SEQ ID NO: 596485 - RNA, 64 nt, hsa; identical to SEQ ID NO: 267717

SEQ ID NO: 596486 - RNA, 64 nt, hsa; identical to SEQ ID NO: 267718

SEQ ID NO: 596487 - RNA, 64 nt, hsa; identical to SEQ ID NO: 267719

SEQ ID NO: 596488 - RNA, 64 nt, hsa; identical to SEQ ID NO: 267720

SEQ ID NO: 596489 - RNA, 64 nt, hsa; identical to SEQ ID NO: 267721

SEQ ID NO: 596490 - RNA, 64 nt, hsa; identical to SEQ ID NO: 267722

SEQ ID NO: 596491 - RNA, 64 nt, hsa; identical to SEQ ID NO: 267723

SEQ ID NO: 596492 - RNA, 64 nt, hsa; identical to SEQ ID NO: 267724

SEQ ID NO: 596493 - RNA, 64 nt, hsa; identical to SEQ ID NO: 267725

SEQ ID NO: 596494 - RNA, 64 nt, hsa; identical to SEQ ID NO: 267726

SEQ ID NO: 596495 - RNA, 64 nt, hsa; identical to SEQ ID NO: 267727

SEQ ID NO: 596496 - RNA, 64 nt, hsa; identical to SEQ ID NO: 267728

SEQ ID NO: 596497 - RNA, 64 nt, hsa; identical to SEQ ID NO: 267729

SEQ ID NO: 596498 - RNA, 64 nt, hsa; identical to SEQ ID NO: 267730

SEQ ID NO: 596499 - RNA, 64 nt, hsa; identical to SEQ ID NO: 267731

SEQ ID NO: 596500 - RNA, 64 nt, hsa; identical to SEQ ID NO: 267732

SEQ ID NO: 596501 - RNA, 64 nt, hsa; identical to SEQ ID NO: 267733

SEQ ID NO: 596502 - RNA, 64 nt, hsa; identical to SEQ ID NO: 267734

SEQ ID NO: 596503 - RNA, 64 nt, hsa; identical to SEQ ID NO: 267735

SEQ ID NO: 596504 - RNA, 64 nt, hsa; identical to SEQ ID NO: 267736

SEQ ID NO: 596505 - RNA, 64 nt, hsa; identical to SEQ ID NO: 267737

SEQ ID NO: 596506 - RNA, 64 nt, hsa; identical to SEQ ID NO: 267738

SEQ ID NO: 596507 - RNA, 64 nt, hsa; identical to SEQ ID NO: 267739

SEQ ID NO: 596508 - RNA, 64 nt, hsa; identical to SEQ ID NO: 267740

SEQ ID NO: 596509 - RNA, 64 nt, hsa; identical to SEQ ID NO: 267741

SEQ ID NO: 596510 - RNA, 64 nt, hsa; identical to SEQ ID NO: 267742

SEQ ID NO: 596511 - RNA, 64 nt, hsa; identical to SEQ ID NO: 267743

SEQ ID NO: 596512 - RNA, 64 nt, hsa; identical to SEQ ID NO: 267744

SEQ ID NO: 596513 - RNA, 64 nt, hsa; identical to SEQ ID NO: 267745

SEQ ID NO: 596514 - RNA, 64 nt, hsa; identical to SEQ ID NO: 267746

SEQ ID NO: 596515 - RNA, 64 nt, hsa; identical to SEQ ID NO: 267747

SEQ ID NO: 596516 - RNA, 64 nt, hsa; identical to SEQ ID NO: 267748

SEQ ID NO: 596517 - RNA, 64 nt, hsa; identical to SEQ ID NO: 267749

SEQ ID NO: 596518 - RNA, 64 nt, hsa; identical to SEQ ID NO: 267750

SEQ ID NO: 596519 - RNA, 64 nt, hsa; identical to SEQ ID NO: 267751

SEQ ID NO: 596520 - RNA, 64 nt, hsa; identical to SEQ ID NO: 267752

SEQ ID NO: 596521 - RNA, 64 nt, hsa; identical to SEQ ID NO: 267753

SEQ ID NO: 596522 - RNA, 64 nt, hsa; identical to SEQ ID NO: 267754

SEQ ID NO: 596523 - RNA, 64 nt, hsa; identical to SEQ ID NO: 267755

SEQ ID NO: 596524 - RNA, 64 nt, hsa; identical to SEQ ID NO: 267756

SEQ ID NO: 596525 - RNA, 64 nt, hsa; identical to SEQ ID NO: 267757

SEQ ID NO: 596526 - RNA, 64 nt, hsa; identical to SEQ ID NO: 267758

SEQ ID NO: 596527 - RNA, 64 nt, hsa; identical to SEQ ID NO: 267759

SEQ ID NO: 596528 - RNA, 64 nt, hsa; identical to SEQ ID NO: 267760

SEQ ID NO: 596529 - RNA, 64 nt, hsa; identical to SEQ ID NO: 267761

SEQ ID NO: 596530 - RNA, 64 nt, hsa; identical to SEQ ID NO: 267762

SEQ ID NO: 596531 - RNA, 64 nt, hsa; identical to SEQ ID NO: 267763

SEQ ID NO: 596532 - RNA, 64 nt, hsa; identical to SEQ ID NO: 267764

SEQ ID NO: 596533 - RNA, 64 nt, hsa; identical to SEQ ID NO: 267765

SEQ ID NO: 596534 - RNA, 64 nt, hsa; identical to SEQ ID NO: 267766

SEQ ID NO: 596535 - RNA, 64 nt, hsa; identical to SEQ ID NO: 267767

SEQ ID NO: 596536 - RNA, 64 nt, hsa; identical to SEQ ID NO: 267768

SEQ ID NO: 596537 - RNA, 64 nt, hsa; identical to SEQ ID NO: 267769

SEQ ID NO: 596538 - RNA, 64 nt, hsa; identical to SEQ ID NO: 267770

SEQ ID NO: 596539 - RNA, 64 nt, hsa; identical to SEQ ID NO: 267771

SEQ ID NO: 596540 - RNA, 64 nt, hsa; identical to SEQ ID NO: 267772

SEQ ID NO: 596541 - RNA, 64 nt, hsa; identical to SEQ ID NO: 267773

SEQ ID NO: 596542 - RNA, 64 nt, hsa; identical to SEQ ID NO: 267774

SEQ ID NO: 596543 - RNA, 64 nt, hsa; identical to SEQ ID NO: 267775

SEQ ID NO: 596544 - RNA, 64 nt, hsa; identical to SEQ ID NO: 267776

SEQ ID NO: 596545 - RNA, 64 nt, hsa; identical to SEQ ID NO: 267777

SEQ ID NO: 596546 - RNA, 64 nt, hsa; identical to SEQ ID NO: 267778

SEQ ID NO: 596547 - RNA, 64 nt, hsa; identical to SEQ ID NO: 267779

SEQ ID NO: 596548 - RNA, 64 nt, hsa; identical to SEQ ID NO: 267780

SEQ ID NO: 596549 - RNA, 64 nt, hsa; identical to SEQ ID NO: 267781

SEQ ID NO: 596550 - RNA, 64 nt, hsa; identical to SEQ ID NO: 267782

SEQ ID NO: 596551 - RNA, 64 nt, hsa; identical to SEQ ID NO: 267783

SEQ ID NO: 596552 - RNA, 64 nt, hsa; identical to SEQ ID NO: 267784

SEQ ID NO: 596553 - RNA, 64 nt, hsa; identical to SEQ ID NO: 267785

SEQ ID NO: 596554 - RNA, 64 nt, hsa; identical to SEQ ID NO: 267786

SEQ ID NO: 596555 - RNA, 64 nt, hsa; identical to SEQ ID NO: 267787

SEQ ID NO: 596556 - RNA, 64 nt, hsa; identical to SEQ ID NO: 267788

SEQ ID NO: 596557 - RNA, 64 nt, hsa; identical to SEQ ID NO: 267789

SEQ ID NO: 596558 - RNA, 64 nt, hsa; identical to SEQ ID NO: 267790

SEQ ID NO: 596559 - RNA, 64 nt, hsa; identical to SEQ ID NO: 267791

SEQ ID NO: 596560 - RNA, 64 nt, hsa; identical to SEQ ID NO: 267792

SEQ ID NO: 596561 - RNA, 64 nt, hsa; identical to SEQ ID NO: 267793

SEQ ID NO: 596562 - RNA, 64 nt, hsa; identical to SEQ ID NO: 267794

SEQ ID NO: 596563 - RNA, 64 nt, hsa; identical to SEQ ID NO: 267795

SEQ ID NO: 596564 - RNA, 64 nt, hsa; identical to SEQ ID NO: 267796

SEQ ID NO: 596565 - RNA, 64 nt, hsa; identical to SEQ ID NO: 267797

SEQ ID NO: 596566 - RNA, 64 nt, hsa; identical to SEQ ID NO: 267798

SEQ ID NO: 596567 - RNA, 64 nt, hsa; identical to SEQ ID NO: 267799

SEQ ID NO: 596568 - RNA, 64 nt, hsa; identical to SEQ ID NO: 267800

SEQ ID NO: 596569 - RNA, 64 nt, hsa; identical to SEQ ID NO: 267801

SEQ ID NO: 596570 - RNA, 64 nt, hsa; identical to SEQ ID NO: 267802

SEQ ID NO: 596571 - RNA, 64 nt, hsa; identical to SEQ ID NO: 267803

SEQ ID NO: 596572 - RNA, 64 nt, hsa; identical to SEQ ID NO: 267804

SEQ ID NO: 596573 - RNA, 64 nt, hsa; identical to SEQ ID NO: 267805

SEQ ID NO: 596574 - RNA, 64 nt, hsa; identical to SEQ ID NO: 267806

SEQ ID NO: 596575 - RNA, 64 nt, hsa; identical to SEQ ID NO: 267807

SEQ ID NO: 596576 - RNA, 64 nt, hsa; identical to SEQ ID NO: 267808

SEQ ID NO: 596577 - RNA, 64 nt, hsa; identical to SEQ ID NO: 267809

SEQ ID NO: 596578 - RNA, 64 nt, hsa; identical to SEQ ID NO: 267810

SEQ ID NO: 596579 - RNA, 64 nt, hsa; identical to SEQ ID NO: 267811

SEQ ID NO: 596580 - RNA, 64 nt, hsa; identical to SEQ ID NO: 267812

SEQ ID NO: 596581 - RNA, 64 nt, hsa; identical to SEQ ID NO: 267813

SEQ ID NO: 596582 - RNA, 64 nt, hsa; identical to SEQ ID NO: 267814

SEQ ID NO: 596583 - RNA, 64 nt, hsa; identical to SEQ ID NO: 267815

SEQ ID NO: 596584 - RNA, 64 nt, hsa; identical to SEQ ID NO: 267816

SEQ ID NO: 596585 - RNA, 64 nt, hsa; identical to SEQ ID NO: 267817

SEQ ID NO: 596586 - RNA, 64 nt, hsa; identical to SEQ ID NO: 267818

SEQ ID NO: 596587 - RNA, 64 nt, hsa; identical to SEQ ID NO: 267819

SEQ ID NO: 596588 - RNA, 64 nt, hsa; identical to SEQ ID NO: 267820

SEQ ID NO: 596589 - RNA, 64 nt, hsa; identical to SEQ ID NO: 267821

SEQ ID NO: 596590 - RNA, 64 nt, hsa; identical to SEQ ID NO: 267822

SEQ ID NO: 596591 - RNA, 64 nt, hsa; identical to SEQ ID NO: 267823

SEQ ID NO: 596592 - RNA, 64 nt, hsa; identical to SEQ ID NO: 267824

SEQ ID NO: 596593 - RNA, 64 nt, hsa; identical to SEQ ID NO: 267825

SEQ ID NO: 596594 - RNA, 64 nt, hsa; identical to SEQ ID NO: 267826

SEQ ID NO: 596595 - RNA, 64 nt, hsa; identical to SEQ ID NO: 267827

SEQ ID NO: 596596 - RNA, 64 nt, hsa; identical to SEQ ID NO: 267828

SEQ ID NO: 596597 - RNA, 64 nt, hsa; identical to SEQ ID NO: 267829

SEQ ID NO: 596598 - RNA, 64 nt, hsa; identical to SEQ ID NO: 267830

SEQ ID NO: 596599 - RNA, 64 nt, hsa; identical to SEQ ID NO: 267831

SEQ ID NO: 596600 - RNA, 64 nt, hsa; identical to SEQ ID NO: 267832

SEQ ID NO: 596601 - RNA, 64 nt, hsa; identical to SEQ ID NO: 267833

SEQ ID NO: 596602 - RNA, 64 nt, hsa; identical to SEQ ID NO: 267834

SEQ ID NO: 596603 - RNA, 64 nt, hsa; identical to SEQ ID NO: 267835

SEQ ID NO: 596604 - RNA, 64 nt, hsa; identical to SEQ ID NO: 267836

SEQ ID NO: 596605 - RNA, 64 nt, hsa; identical to SEQ ID NO: 267837

SEQ ID NO: 596606 - RNA, 64 nt, hsa; identical to SEQ ID NO: 267838

SEQ ID NO: 596607 - RNA, 64 nt, hsa; identical to SEQ ID NO: 267839

SEQ ID NO: 596608 - RNA, 64 nt, hsa; identical to SEQ ID NO: 267840

SEQ ID NO: 596609 - RNA, 64 nt, hsa; identical to SEQ ID NO: 267841

SEQ ID NO: 596610 - RNA, 64 nt, hsa; identical to SEQ ID NO: 267842

SEQ ID NO: 596611 - RNA, 64 nt, hsa; identical to SEQ ID NO: 267843

SEQ ID NO: 596612 - RNA, 64 nt, hsa; identical to SEQ ID NO: 267844

SEQ ID NO: 596613 - RNA, 64 nt, hsa; identical to SEQ ID NO: 267845

SEQ ID NO: 596614 - RNA, 64 nt, hsa; identical to SEQ ID NO: 267846

SEQ ID NO: 596615 - RNA, 64 nt, hsa; identical to SEQ ID NO: 267847

SEQ ID NO: 596616 - RNA, 64 nt, hsa; identical to SEQ ID NO: 267848

SEQ ID NO: 596617 - RNA, 64 nt, hsa; identical to SEQ ID NO: 267849

SEQ ID NO: 596618 - RNA, 64 nt, hsa; identical to SEQ ID NO: 267850

SEQ ID NO: 596619 - RNA, 64 nt, hsa; identical to SEQ ID NO: 267851

SEQ ID NO: 596620 - RNA, 64 nt, hsa; identical to SEQ ID NO: 267852

SEQ ID NO: 596621 - RNA, 64 nt, hsa; identical to SEQ ID NO: 267853

SEQ ID NO: 596622 - RNA, 64 nt, hsa; identical to SEQ ID NO: 267854

SEQ ID NO: 596623 - RNA, 64 nt, hsa; identical to SEQ ID NO: 267855

SEQ ID NO: 596624 - RNA, 64 nt, hsa; identical to SEQ ID NO: 267856

SEQ ID NO: 596625 - RNA, 64 nt, hsa; identical to SEQ ID NO: 267857

SEQ ID NO: 596626 - RNA, 64 nt, hsa; identical to SEQ ID NO: 267858

SEQ ID NO: 596627 - RNA, 64 nt, hsa; identical to SEQ ID NO: 267859

SEQ ID NO: 596628 - RNA, 64 nt, hsa; identical to SEQ ID NO: 267860

SEQ ID NO: 596629 - RNA, 64 nt, hsa; identical to SEQ ID NO: 267861

SEQ ID NO: 596630 - RNA, 64 nt, hsa; identical to SEQ ID NO: 267862

SEQ ID NO: 596631 - RNA, 64 nt, hsa; identical to SEQ ID NO: 267863

SEQ ID NO: 596632 - RNA, 64 nt, hsa; identical to SEQ ID NO: 267864

SEQ ID NO: 596633 - RNA, 64 nt, hsa; identical to SEQ ID NO: 267865

SEQ ID NO: 596634 - RNA, 64 nt, hsa; identical to SEQ ID NO: 267866

SEQ ID NO: 596635 - RNA, 64 nt, hsa; identical to SEQ ID NO: 267867

SEQ ID NO: 596636 - RNA, 64 nt, hsa; identical to SEQ ID NO: 267868

SEQ ID NO: 596637 - RNA, 64 nt, hsa; identical to SEQ ID NO: 267869

SEQ ID NO: 596638 - RNA, 64 nt, hsa; identical to SEQ ID NO: 267870

SEQ ID NO: 596639 - RNA, 64 nt, hsa; identical to SEQ ID NO: 267871

SEQ ID NO: 596640 - RNA, 64 nt, hsa; identical to SEQ ID NO: 267872

SEQ ID NO: 596641 - RNA, 64 nt, hsa; identical to SEQ ID NO: 267873

SEQ ID NO: 596642 - RNA, 64 nt, hsa; identical to SEQ ID NO: 267874

SEQ ID NO: 596643 - RNA, 64 nt, hsa; identical to SEQ ID NO: 267875

SEQ ID NO: 596644 - RNA, 64 nt, hsa; identical to SEQ ID NO: 267876

SEQ ID NO: 596645 - RNA, 64 nt, hsa; identical to SEQ ID NO: 267877

SEQ ID NO: 596646 - RNA, 64 nt, hsa; identical to SEQ ID NO: 267878

SEQ ID NO: 596647 - RNA, 64 nt, hsa; identical to SEQ ID NO: 267879

SEQ ID NO: 596648 - RNA, 64 nt, hsa; identical to SEQ ID NO: 267880

SEQ ID NO: 596649 - RNA, 64 nt, hsa; identical to SEQ ID NO: 267881

SEQ ID NO: 596650 - RNA, 64 nt, hsa; identical to SEQ ID NO: 267882

SEQ ID NO: 596651 - RNA, 64 nt, hsa; identical to SEQ ID NO: 267883

SEQ ID NO: 596652 - RNA, 64 nt, hsa; identical to SEQ ID NO: 267884

SEQ ID NO: 596653 - RNA, 64 nt, hsa; identical to SEQ ID NO: 267885

SEQ ID NO: 596654 - RNA, 64 nt, hsa; identical to SEQ ID NO: 267886

SEQ ID NO: 596655 - RNA, 64 nt, hsa; identical to SEQ ID NO: 267887

SEQ ID NO: 596656 - RNA, 64 nt, hsa; identical to SEQ ID NO: 267888

SEQ ID NO: 596657 - RNA, 64 nt, hsa; identical to SEQ ID NO: 267889

SEQ ID NO: 596658 - RNA, 64 nt, hsa; identical to SEQ ID NO: 267890

SEQ ID NO: 596659 - RNA, 64 nt, hsa; identical to SEQ ID NO: 267891

SEQ ID NO: 596660 - RNA, 64 nt, hsa; identical to SEQ ID NO: 267892

SEQ ID NO: 596661 - RNA, 64 nt, hsa; identical to SEQ ID NO: 267893

SEQ ID NO: 596662 - RNA, 64 nt, hsa; identical to SEQ ID NO: 267894

SEQ ID NO: 596663 - RNA, 64 nt, hsa; identical to SEQ ID NO: 267895

SEQ ID NO: 596664 - RNA, 64 nt, hsa; identical to SEQ ID NO: 267896

SEQ ID NO: 596665 - RNA, 64 nt, hsa; identical to SEQ ID NO: 267897

SEQ ID NO: 596666 - RNA, 64 nt, hsa; identical to SEQ ID NO: 267898

SEQ ID NO: 596667 - RNA, 64 nt, hsa; identical to SEQ ID NO: 267899

SEQ ID NO: 596668 - RNA, 64 nt, hsa; identical to SEQ ID NO: 267900

SEQ ID NO: 596669 - RNA, 64 nt, hsa; identical to SEQ ID NO: 267901

SEQ ID NO: 596670 - RNA, 64 nt, hsa; identical to SEQ ID NO: 267902

SEQ ID NO: 596671 - RNA, 64 nt, hsa; identical to SEQ ID NO: 267903

SEQ ID NO: 596672 - RNA, 64 nt, hsa; identical to SEQ ID NO: 267904

SEQ ID NO: 596673 - RNA, 64 nt, hsa; identical to SEQ ID NO: 267905

SEQ ID NO: 596674 - RNA, 64 nt, hsa; identical to SEQ ID NO: 267906

SEQ ID NO: 596675 - RNA, 64 nt, hsa; identical to SEQ ID NO: 267907

SEQ ID NO: 596676 - RNA, 64 nt, hsa; identical to SEQ ID NO: 267908

SEQ ID NO: 596677 - RNA, 64 nt, hsa; identical to SEQ ID NO: 267909

SEQ ID NO: 596678 - RNA, 64 nt, hsa; identical to SEQ ID NO: 267910

SEQ ID NO: 596679 - RNA, 64 nt, hsa; identical to SEQ ID NO: 267911

SEQ ID NO: 596680 - RNA, 64 nt, hsa; identical to SEQ ID NO: 267912

SEQ ID NO: 596681 - RNA, 64 nt, hsa; identical to SEQ ID NO: 267913

SEQ ID NO: 596682 - RNA, 64 nt, hsa; identical to SEQ ID NO: 267914

SEQ ID NO: 596683 - RNA, 64 nt, hsa; identical to SEQ ID NO: 267915

SEQ ID NO: 596684 - RNA, 64 nt, hsa; identical to SEQ ID NO: 267916

SEQ ID NO: 596685 - RNA, 64 nt, hsa; identical to SEQ ID NO: 267917

SEQ ID NO: 596686 - RNA, 64 nt, hsa; identical to SEQ ID NO: 267918

SEQ ID NO: 596687 - RNA, 64 nt, hsa; identical to SEQ ID NO: 267919

SEQ ID NO: 596688 - RNA, 64 nt, hsa; identical to SEQ ID NO: 267920

SEQ ID NO: 596689 - RNA, 64 nt, hsa; identical to SEQ ID NO: 267921

SEQ ID NO: 596690 - RNA, 64 nt, hsa; identical to SEQ ID NO: 267922

SEQ ID NO: 596691 - RNA, 64 nt, hsa; identical to SEQ ID NO: 267923

SEQ ID NO: 596692 - RNA, 64 nt, hsa; identical to SEQ ID NO: 267924

SEQ ID NO: 596693 - RNA, 64 nt, hsa; identical to SEQ ID NO: 267925

SEQ ID NO: 596694 - RNA, 64 nt, hsa; identical to SEQ ID NO: 267926

SEQ ID NO: 596695 - RNA, 64 nt, hsa; identical to SEQ ID NO: 267927

SEQ ID NO: 596696 - RNA, 64 nt, hsa; identical to SEQ ID NO: 267928

SEQ ID NO: 596697 - RNA, 64 nt, hsa; identical to SEQ ID NO: 267929

SEQ ID NO: 596698 - RNA, 64 nt, hsa; identical to SEQ ID NO: 267930

SEQ ID NO: 596699 - RNA, 64 nt, hsa; identical to SEQ ID NO: 267931

SEQ ID NO: 596700 - RNA, 64 nt, hsa; identical to SEQ ID NO: 267932

SEQ ID NO: 596701 - RNA, 64 nt, hsa; identical to SEQ ID NO: 267933

SEQ ID NO: 596702 - RNA, 64 nt, hsa; identical to SEQ ID NO: 267934

SEQ ID NO: 596703 - RNA, 64 nt, hsa; identical to SEQ ID NO: 267935

SEQ ID NO: 596704 - RNA, 64 nt, hsa; identical to SEQ ID NO: 267936

SEQ ID NO: 596705 - RNA, 64 nt, hsa; identical to SEQ ID NO: 267937

SEQ ID NO: 596706 - RNA, 64 nt, hsa; identical to SEQ ID NO: 267938

SEQ ID NO: 596707 - RNA, 64 nt, hsa; identical to SEQ ID NO: 267939

SEQ ID NO: 596708 - RNA, 64 nt, hsa; identical to SEQ ID NO: 267940

SEQ ID NO: 596709 - RNA, 64 nt, hsa; identical to SEQ ID NO: 267941

SEQ ID NO: 596710 - RNA, 64 nt, hsa; identical to SEQ ID NO: 267942

SEQ ID NO: 596711 - RNA, 64 nt, hsa; identical to SEQ ID NO: 267943

SEQ ID NO: 596712 - RNA, 64 nt, hsa; identical to SEQ ID NO: 267944

SEQ ID NO: 596713 - RNA, 64 nt, hsa; identical to SEQ ID NO: 267945

SEQ ID NO: 596714 - RNA, 64 nt, hsa; identical to SEQ ID NO: 267946

SEQ ID NO: 596715 - RNA, 64 nt, hsa; identical to SEQ ID NO: 267947

SEQ ID NO: 596716 - RNA, 64 nt, hsa; identical to SEQ ID NO: 267948

SEQ ID NO: 596717 - RNA, 64 nt, hsa; identical to SEQ ID NO: 267949

SEQ ID NO: 596718 - RNA, 64 nt, hsa; identical to SEQ ID NO: 267950

SEQ ID NO: 596719 - RNA, 64 nt, hsa; identical to SEQ ID NO: 267951

SEQ ID NO: 596720 - RNA, 64 nt, hsa; identical to SEQ ID NO: 267952

SEQ ID NO: 596721 - RNA, 64 nt, hsa; identical to SEQ ID NO: 267953

SEQ ID NO: 596722 - RNA, 64 nt, hsa; identical to SEQ ID NO: 267954

SEQ ID NO: 596723 - RNA, 64 nt, hsa; identical to SEQ ID NO: 267955

SEQ ID NO: 596724 - RNA, 64 nt, hsa; identical to SEQ ID NO: 267956

SEQ ID NO: 596725 - RNA, 64 nt, hsa; identical to SEQ ID NO: 267957

SEQ ID NO: 596726 - RNA, 64 nt, hsa; identical to SEQ ID NO: 267958

SEQ ID NO: 596727 - RNA, 64 nt, hsa; identical to SEQ ID NO: 267959

SEQ ID NO: 596728 - RNA, 64 nt, hsa; identical to SEQ ID NO: 267960

SEQ ID NO: 596729 - RNA, 64 nt, hsa; identical to SEQ ID NO: 267961

SEQ ID NO: 596730 - RNA, 64 nt, hsa; identical to SEQ ID NO: 267962

SEQ ID NO: 596731 - RNA, 64 nt, hsa; identical to SEQ ID NO: 267963

SEQ ID NO: 596732 - RNA, 64 nt, hsa; identical to SEQ ID NO: 267964

SEQ ID NO: 596733 - RNA, 64 nt, hsa; identical to SEQ ID NO: 267965

SEQ ID NO: 596734 - RNA, 64 nt, hsa; identical to SEQ ID NO: 267966

SEQ ID NO: 596735 - RNA, 64 nt, hsa; identical to SEQ ID NO: 267967

SEQ ID NO: 596736 - RNA, 64 nt, hsa; identical to SEQ ID NO: 267968

SEQ ID NO: 596737 - RNA, 64 nt, hsa; identical to SEQ ID NO: 267969

SEQ ID NO: 596738 - RNA, 64 nt, hsa; identical to SEQ ID NO: 267970

SEQ ID NO: 596739 - RNA, 64 nt, hsa; identical to SEQ ID NO: 267971

SEQ ID NO: 596740 - RNA, 64 nt, hsa; identical to SEQ ID NO: 267972

SEQ ID NO: 596741 - RNA, 64 nt, hsa; identical to SEQ ID NO: 267973

SEQ ID NO: 596742 - RNA, 64 nt, hsa; identical to SEQ ID NO: 267974

SEQ ID NO: 596743 - RNA, 64 nt, hsa; identical to SEQ ID NO: 267975

SEQ ID NO: 596744 - RNA, 64 nt, hsa; identical to SEQ ID NO: 267976

SEQ ID NO: 596745 - RNA, 64 nt, hsa; identical to SEQ ID NO: 267977

SEQ ID NO: 596746 - RNA, 64 nt, hsa; identical to SEQ ID NO: 267978

SEQ ID NO: 596747 - RNA, 64 nt, hsa; identical to SEQ ID NO: 267979

SEQ ID NO: 596748 - RNA, 64 nt, hsa; identical to SEQ ID NO: 267980

SEQ ID NO: 596749 - RNA, 64 nt, hsa; identical to SEQ ID NO: 267981

SEQ ID NO: 596750 - RNA, 64 nt, hsa; identical to SEQ ID NO: 267982

SEQ ID NO: 596751 - RNA, 64 nt, hsa; identical to SEQ ID NO: 267983

SEQ ID NO: 596752 - RNA, 64 nt, hsa; identical to SEQ ID NO: 267984

SEQ ID NO: 596753 - RNA, 64 nt, hsa; identical to SEQ ID NO: 267985

SEQ ID NO: 596754 - RNA, 63 nt, hsa; identical to SEQ ID NO: 267986

SEQ ID NO: 596755 - RNA, 64 nt, hsa; identical to SEQ ID NO: 267987

SEQ ID NO: 596756 - RNA, 64 nt, hsa; identical to SEQ ID NO: 267988

SEQ ID NO: 596757 - RNA, 64 nt, hsa; identical to SEQ ID NO: 267989

SEQ ID NO: 596758 - RNA, 64 nt, hsa; identical to SEQ ID NO: 267990

SEQ ID NO: 596759 - RNA, 64 nt, hsa; identical to SEQ ID NO: 267991

SEQ ID NO: 596760 - RNA, 64 nt, hsa; identical to SEQ ID NO: 267992

SEQ ID NO: 596761 - RNA, 64 nt, hsa; identical to SEQ ID NO: 267993

SEQ ID NO: 596762 - RNA, 64 nt, hsa; identical to SEQ ID NO: 267994

SEQ ID NO: 596763 - RNA, 64 nt, hsa; identical to SEQ ID NO: 267995

SEQ ID NO: 596764 - RNA, 64 nt, hsa; identical to SEQ ID NO: 267996

SEQ ID NO: 596765 - RNA, 64 nt, hsa; identical to SEQ ID NO: 267997

SEQ ID NO: 596766 - RNA, 64 nt, hsa; identical to SEQ ID NO: 267998

SEQ ID NO: 596767 - RNA, 64 nt, hsa; identical to SEQ ID NO: 267999

SEQ ID NO: 596768 - RNA, 64 nt, hsa; identical to SEQ ID NO: 268000

SEQ ID NO: 596769 - RNA, 64 nt, hsa; identical to SEQ ID NO: 268001

SEQ ID NO: 596770 - RNA, 64 nt, hsa; identical to SEQ ID NO: 268002

SEQ ID NO: 596771 - RNA, 64 nt, hsa; identical to SEQ ID NO: 268003

SEQ ID NO: 596772 - RNA, 64 nt, hsa; identical to SEQ ID NO: 268004

SEQ ID NO: 596773 - RNA, 64 nt, hsa; identical to SEQ ID NO: 268005

SEQ ID NO: 596774 - RNA, 64 nt, hsa; identical to SEQ ID NO: 268006

SEQ ID NO: 596775 - RNA, 64 nt, hsa; identical to SEQ ID NO: 268007

SEQ ID NO: 596776 - RNA, 64 nt, hsa; identical to SEQ ID NO: 268008

SEQ ID NO: 596777 - RNA, 64 nt, hsa; identical to SEQ ID NO: 268009

SEQ ID NO: 596778 - RNA, 64 nt, hsa; identical to SEQ ID NO: 268010

SEQ ID NO: 596779 - RNA, 64 nt, hsa; identical to SEQ ID NO: 268011

SEQ ID NO: 596780 - RNA, 64 nt, hsa; identical to SEQ ID NO: 268012

SEQ ID NO: 596781 - RNA, 64 nt, hsa; identical to SEQ ID NO: 268013

SEQ ID NO: 596782 - RNA, 64 nt, hsa; identical to SEQ ID NO: 268014

SEQ ID NO: 596783 - RNA, 64 nt, hsa; identical to SEQ ID NO: 268015

SEQ ID NO: 596784 - RNA, 64 nt, hsa; identical to SEQ ID NO: 268016

SEQ ID NO: 596785 - RNA, 64 nt, hsa; identical to SEQ ID NO: 268017

SEQ ID NO: 596786 - RNA, 64 nt, hsa; identical to SEQ ID NO: 268018

SEQ ID NO: 596787 - RNA, 64 nt, hsa; identical to SEQ ID NO: 268019

SEQ ID NO: 596788 - RNA, 64 nt, hsa; identical to SEQ ID NO: 268020

SEQ ID NO: 596789 - RNA, 64 nt, hsa; identical to SEQ ID NO: 268021

SEQ ID NO: 596790 - RNA, 64 nt, hsa; identical to SEQ ID NO: 268022

SEQ ID NO: 596791 - RNA, 64 nt, hsa; identical to SEQ ID NO: 268023

SEQ ID NO: 596792 - RNA, 64 nt, hsa; identical to SEQ ID NO: 268024

SEQ ID NO: 596793 - RNA, 64 nt, hsa; identical to SEQ ID NO: 268025

SEQ ID NO: 596794 - RNA, 64 nt, hsa; identical to SEQ ID NO: 268026

SEQ ID NO: 596795 - RNA, 64 nt, hsa; identical to SEQ ID NO: 268027

SEQ ID NO: 596796 - RNA, 64 nt, hsa; identical to SEQ ID NO: 268028

SEQ ID NO: 596797 - RNA, 64 nt, hsa; identical to SEQ ID NO: 268029

SEQ ID NO: 596798 - RNA, 64 nt, hsa; identical to SEQ ID NO: 268030

SEQ ID NO: 596799 - RNA, 64 nt, hsa; identical to SEQ ID NO: 268031

SEQ ID NO: 596800 - RNA, 64 nt, hsa; identical to SEQ ID NO: 268032

SEQ ID NO: 596801 - RNA, 64 nt, hsa; identical to SEQ ID NO: 268033

SEQ ID NO: 596802 - RNA, 64 nt, hsa; identical to SEQ ID NO: 268034

SEQ ID NO: 596803 - RNA, 64 nt, hsa; identical to SEQ ID NO: 268035

SEQ ID NO: 596804 - RNA, 64 nt, hsa; identical to SEQ ID NO: 268036

SEQ ID NO: 596805 - RNA, 64 nt, hsa; identical to SEQ ID NO: 268037

SEQ ID NO: 596806 - RNA, 64 nt, hsa; identical to SEQ ID NO: 268038

SEQ ID NO: 596807 - RNA, 64 nt, hsa; identical to SEQ ID NO: 268039

SEQ ID NO: 596808 - RNA, 64 nt, hsa; identical to SEQ ID NO: 268040

SEQ ID NO: 596809 - RNA, 64 nt, hsa; identical to SEQ ID NO: 268041

SEQ ID NO: 596810 - RNA, 64 nt, hsa; identical to SEQ ID NO: 268042

SEQ ID NO: 596811 - RNA, 64 nt, hsa; identical to SEQ ID NO: 268043

SEQ ID NO: 596812 - RNA, 64 nt, hsa; identical to SEQ ID NO: 268044

SEQ ID NO: 596813 - RNA, 64 nt, hsa; identical to SEQ ID NO: 268045

SEQ ID NO: 596814 - RNA, 64 nt, hsa; identical to SEQ ID NO: 268046

SEQ ID NO: 596815 - RNA, 64 nt, hsa; identical to SEQ ID NO: 268047

SEQ ID NO: 596816 - RNA, 64 nt, hsa; identical to SEQ ID NO: 268048

SEQ ID NO: 596817 - RNA, 64 nt, hsa; identical to SEQ ID NO: 268049

SEQ ID NO: 596818 - RNA, 64 nt, hsa; identical to SEQ ID NO: 268050

SEQ ID NO: 596819 - RNA, 64 nt, hsa; identical to SEQ ID NO: 268051

SEQ ID NO: 596820 - RNA, 64 nt, hsa; identical to SEQ ID NO: 268052

SEQ ID NO: 596821 - RNA, 64 nt, hsa; identical to SEQ ID NO: 268053

SEQ ID NO: 596822 - RNA, 64 nt, hsa; identical to SEQ ID NO: 268054

SEQ ID NO: 596823 - RNA, 64 nt, hsa; identical to SEQ ID NO: 268055

SEQ ID NO: 596824 - RNA, 64 nt, hsa; identical to SEQ ID NO: 268056

SEQ ID NO: 596825 - RNA, 64 nt, hsa; identical to SEQ ID NO: 268057

SEQ ID NO: 596826 - RNA, 64 nt, hsa; identical to SEQ ID NO: 268058

SEQ ID NO: 596827 - RNA, 64 nt, hsa; identical to SEQ ID NO: 268059

SEQ ID NO: 596828 - RNA, 64 nt, hsa; identical to SEQ ID NO: 268060

SEQ ID NO: 596829 - RNA, 64 nt, hsa; identical to SEQ ID NO: 268061

SEQ ID NO: 596830 - RNA, 64 nt, hsa; identical to SEQ ID NO: 268062

SEQ ID NO: 596831 - RNA, 64 nt, hsa; identical to SEQ ID NO: 268063

SEQ ID NO: 596832 - RNA, 64 nt, hsa; identical to SEQ ID NO: 268064

SEQ ID NO: 596833 - RNA, 64 nt, hsa; identical to SEQ ID NO: 268065

SEQ ID NO: 596834 - RNA, 64 nt, hsa; identical to SEQ ID NO: 268066

SEQ ID NO: 596835 - RNA, 64 nt, hsa; identical to SEQ ID NO: 268067

SEQ ID NO: 596836 - RNA, 64 nt, hsa; identical to SEQ ID NO: 268068

SEQ ID NO: 596837 - RNA, 64 nt, hsa; identical to SEQ ID NO: 268069

SEQ ID NO: 596838 - RNA, 64 nt, hsa; identical to SEQ ID NO: 268070

SEQ ID NO: 596839 - RNA, 64 nt, hsa; identical to SEQ ID NO: 268071

SEQ ID NO: 596840 - RNA, 64 nt, hsa; identical to SEQ ID NO: 268072

SEQ ID NO: 596841 - RNA, 64 nt, hsa; identical to SEQ ID NO: 268073

SEQ ID NO: 596842 - RNA, 64 nt, hsa; identical to SEQ ID NO: 268074

SEQ ID NO: 596843 - RNA, 64 nt, hsa; identical to SEQ ID NO: 268075

SEQ ID NO: 596844 - RNA, 64 nt, hsa; identical to SEQ ID NO: 268076

SEQ ID NO: 596845 - RNA, 64 nt, hsa; identical to SEQ ID NO: 268077

SEQ ID NO: 596846 - RNA, 64 nt, hsa; identical to SEQ ID NO: 268078

SEQ ID NO: 596847 - RNA, 64 nt, hsa; identical to SEQ ID NO: 268079

SEQ ID NO: 596848 - RNA, 64 nt, hsa; identical to SEQ ID NO: 268080

SEQ ID NO: 596849 - RNA, 64 nt, hsa; identical to SEQ ID NO: 268081

SEQ ID NO: 596850 - RNA, 64 nt, hsa; identical to SEQ ID NO: 268082

SEQ ID NO: 596851 - RNA, 64 nt, hsa; identical to SEQ ID NO: 268083

SEQ ID NO: 596852 - RNA, 64 nt, hsa; identical to SEQ ID NO: 268084

SEQ ID NO: 596853 - RNA, 64 nt, hsa; identical to SEQ ID NO: 268085

SEQ ID NO: 596854 - RNA, 64 nt, hsa; identical to SEQ ID NO: 268086

SEQ ID NO: 596855 - RNA, 64 nt, hsa; identical to SEQ ID NO: 268087

SEQ ID NO: 596856 - RNA, 64 nt, hsa; identical to SEQ ID NO: 268088

SEQ ID NO: 596857 - RNA, 64 nt, hsa; identical to SEQ ID NO: 268089

SEQ ID NO: 596858 - RNA, 64 nt, hsa; identical to SEQ ID NO: 268090

SEQ ID NO: 596859 - RNA, 64 nt, hsa; identical to SEQ ID NO: 268091

SEQ ID NO: 596860 - RNA, 64 nt, hsa; identical to SEQ ID NO: 268092

SEQ ID NO: 596861 - RNA, 64 nt, hsa; identical to SEQ ID NO: 268093

SEQ ID NO: 596862 - RNA, 64 nt, hsa; identical to SEQ ID NO: 268094

SEQ ID NO: 596863 - RNA, 64 nt, hsa; identical to SEQ ID NO: 268095

SEQ ID NO: 596864 - RNA, 64 nt, hsa; identical to SEQ ID NO: 268096

SEQ ID NO: 596865 - RNA, 64 nt, hsa; identical to SEQ ID NO: 268097

SEQ ID NO: 596866 - RNA, 64 nt, hsa; identical to SEQ ID NO: 268098

SEQ ID NO: 596867 - RNA, 64 nt, hsa; identical to SEQ ID NO: 268099

SEQ ID NO: 596868 - RNA, 64 nt, hsa; identical to SEQ ID NO: 268100

SEQ ID NO: 596869 - RNA, 64 nt, hsa; identical to SEQ ID NO: 268101

SEQ ID NO: 596870 - RNA, 64 nt, hsa; identical to SEQ ID NO: 268102

SEQ ID NO: 596871 - RNA, 64 nt, hsa; identical to SEQ ID NO: 268103

SEQ ID NO: 596872 - RNA, 64 nt, hsa; identical to SEQ ID NO: 268104

SEQ ID NO: 596873 - RNA, 64 nt, hsa; identical to SEQ ID NO: 268105

SEQ ID NO: 596874 - RNA, 64 nt, hsa; identical to SEQ ID NO: 268106

SEQ ID NO: 596875 - RNA, 64 nt, hsa; identical to SEQ ID NO: 268107

SEQ ID NO: 596876 - RNA, 64 nt, hsa; identical to SEQ ID NO: 268108

SEQ ID NO: 596877 - RNA, 64 nt, hsa; identical to SEQ ID NO: 268109

SEQ ID NO: 596878 - RNA, 64 nt, hsa; identical to SEQ ID NO: 268110

SEQ ID NO: 596879 - RNA, 64 nt, hsa; identical to SEQ ID NO: 268111

SEQ ID NO: 596880 - RNA, 64 nt, hsa; identical to SEQ ID NO: 268112

SEQ ID NO: 596881 - RNA, 64 nt, hsa; identical to SEQ ID NO: 268113

SEQ ID NO: 596882 - RNA, 64 nt, hsa; identical to SEQ ID NO: 268114

SEQ ID NO: 596883 - RNA, 64 nt, hsa; identical to SEQ ID NO: 268115

SEQ ID NO: 596884 - RNA, 64 nt, hsa; identical to SEQ ID NO: 268116

SEQ ID NO: 596885 - RNA, 64 nt, hsa; identical to SEQ ID NO: 268117

SEQ ID NO: 596886 - RNA, 64 nt, hsa; identical to SEQ ID NO: 268118

SEQ ID NO: 596887 - RNA, 64 nt, hsa; identical to SEQ ID NO: 268119

SEQ ID NO: 596888 - RNA, 64 nt, hsa; identical to SEQ ID NO: 268120

SEQ ID NO: 596889 - RNA, 64 nt, hsa; identical to SEQ ID NO: 268121

SEQ ID NO: 596890 - RNA, 64 nt, hsa; identical to SEQ ID NO: 268122

SEQ ID NO: 596891 - RNA, 64 nt, hsa; identical to SEQ ID NO: 268123

SEQ ID NO: 596892 - RNA, 64 nt, hsa; identical to SEQ ID NO: 268124

SEQ ID NO: 596893 - RNA, 64 nt, hsa; identical to SEQ ID NO: 268125

SEQ ID NO: 596894 - RNA, 64 nt, hsa; identical to SEQ ID NO: 268126

SEQ ID NO: 596895 - RNA, 64 nt, hsa; identical to SEQ ID NO: 268127

SEQ ID NO: 596896 - RNA, 64 nt, hsa; identical to SEQ ID NO: 268128

SEQ ID NO: 596897 - RNA, 64 nt, hsa; identical to SEQ ID NO: 268129

SEQ ID NO: 596898 - RNA, 64 nt, hsa; identical to SEQ ID NO: 268130

SEQ ID NO: 596899 - RNA, 64 nt, hsa; identical to SEQ ID NO: 268131

SEQ ID NO: 596900 - RNA, 64 nt, hsa; identical to SEQ ID NO: 268132

SEQ ID NO: 596901 - RNA, 64 nt, hsa; identical to SEQ ID NO: 268133

SEQ ID NO: 596902 - RNA, 64 nt, hsa; identical to SEQ ID NO: 268134

SEQ ID NO: 596903 - RNA, 64 nt, hsa; identical to SEQ ID NO: 268135

SEQ ID NO: 596904 - RNA, 64 nt, hsa; identical to SEQ ID NO: 268136

SEQ ID NO: 596905 - RNA, 64 nt, hsa; identical to SEQ ID NO: 268137

SEQ ID NO: 596906 - RNA, 64 nt, hsa; identical to SEQ ID NO: 268138

SEQ ID NO: 596907 - RNA, 64 nt, hsa; identical to SEQ ID NO: 268139

SEQ ID NO: 596908 - RNA, 64 nt, hsa; identical to SEQ ID NO: 268140

SEQ ID NO: 596909 - RNA, 64 nt, hsa; identical to SEQ ID NO: 268141

SEQ ID NO: 596910 - RNA, 64 nt, hsa; identical to SEQ ID NO: 268142

SEQ ID NO: 596911 - RNA, 64 nt, hsa; identical to SEQ ID NO: 268143

SEQ ID NO: 596912 - RNA, 64 nt, hsa; identical to SEQ ID NO: 268144

SEQ ID NO: 596913 - RNA, 64 nt, hsa; identical to SEQ ID NO: 268145

SEQ ID NO: 596914 - RNA, 64 nt, hsa; identical to SEQ ID NO: 268146

SEQ ID NO: 596915 - RNA, 64 nt, hsa; identical to SEQ ID NO: 268147

SEQ ID NO: 596916 - RNA, 64 nt, hsa; identical to SEQ ID NO: 268148

SEQ ID NO: 596917 - RNA, 64 nt, hsa; identical to SEQ ID NO: 268149

SEQ ID NO: 596918 - RNA, 64 nt, hsa; identical to SEQ ID NO: 268150

SEQ ID NO: 596919 - RNA, 64 nt, hsa; identical to SEQ ID NO: 268151

SEQ ID NO: 596920 - RNA, 64 nt, hsa; identical to SEQ ID NO: 268152

SEQ ID NO: 596921 - RNA, 64 nt, hsa; identical to SEQ ID NO: 268153

SEQ ID NO: 596922 - RNA, 64 nt, hsa; identical to SEQ ID NO: 268154

SEQ ID NO: 596923 - RNA, 64 nt, hsa; identical to SEQ ID NO: 268155

SEQ ID NO: 596924 - RNA, 64 nt, hsa; identical to SEQ ID NO: 268156

SEQ ID NO: 596925 - RNA, 64 nt, hsa; identical to SEQ ID NO: 268157

SEQ ID NO: 596926 - RNA, 64 nt, hsa; identical to SEQ ID NO: 268158

SEQ ID NO: 596927 - RNA, 64 nt, hsa; identical to SEQ ID NO: 268159

SEQ ID NO: 596928 - RNA, 64 nt, hsa; identical to SEQ ID NO: 268160

SEQ ID NO: 596929 - RNA, 64 nt, hsa; identical to SEQ ID NO: 268161

SEQ ID NO: 596930 - RNA, 64 nt, hsa; identical to SEQ ID NO: 268162

SEQ ID NO: 596931 - RNA, 64 nt, hsa; identical to SEQ ID NO: 268163

SEQ ID NO: 596932 - RNA, 64 nt, hsa; identical to SEQ ID NO: 268164

SEQ ID NO: 596933 - RNA, 64 nt, hsa; identical to SEQ ID NO: 268165

SEQ ID NO: 596934 - RNA, 64 nt, hsa; identical to SEQ ID NO: 268166

SEQ ID NO: 596935 - RNA, 64 nt, hsa; identical to SEQ ID NO: 268167

SEQ ID NO: 596936 - RNA, 64 nt, hsa; identical to SEQ ID NO: 268168

SEQ ID NO: 596937 - RNA, 64 nt, hsa; identical to SEQ ID NO: 268169

SEQ ID NO: 596938 - RNA, 64 nt, hsa; identical to SEQ ID NO: 268170

SEQ ID NO: 596939 - RNA, 64 nt, hsa; identical to SEQ ID NO: 268171

SEQ ID NO: 596940 - RNA, 64 nt, hsa; identical to SEQ ID NO: 268172

SEQ ID NO: 596941 - RNA, 64 nt, hsa; identical to SEQ ID NO: 268173

SEQ ID NO: 596942 - RNA, 64 nt, hsa; identical to SEQ ID NO: 268174

SEQ ID NO: 596943 - RNA, 64 nt, hsa; identical to SEQ ID NO: 268175

SEQ ID NO: 596944 - RNA, 64 nt, hsa; identical to SEQ ID NO: 268176

SEQ ID NO: 596945 - RNA, 64 nt, hsa; identical to SEQ ID NO: 268177

SEQ ID NO: 596946 - RNA, 64 nt, hsa; identical to SEQ ID NO: 268178

SEQ ID NO: 596947 - RNA, 64 nt, hsa; identical to SEQ ID NO: 268179

SEQ ID NO: 596948 - RNA, 64 nt, hsa; identical to SEQ ID NO: 268180

SEQ ID NO: 596949 - RNA, 64 nt, hsa; identical to SEQ ID NO: 268181

SEQ ID NO: 596950 - RNA, 64 nt, hsa; identical to SEQ ID NO: 268182

SEQ ID NO: 596951 - RNA, 64 nt, hsa; identical to SEQ ID NO: 268183

SEQ ID NO: 596952 - RNA, 64 nt, hsa; identical to SEQ ID NO: 268184

SEQ ID NO: 596953 - RNA, 64 nt, hsa; identical to SEQ ID NO: 268185

SEQ ID NO: 596954 - RNA, 64 nt, hsa; identical to SEQ ID NO: 268186

SEQ ID NO: 596955 - RNA, 64 nt, hsa; identical to SEQ ID NO: 268187

SEQ ID NO: 596956 - RNA, 64 nt, hsa; identical to SEQ ID NO: 268188

SEQ ID NO: 596957 - RNA, 64 nt, hsa; identical to SEQ ID NO: 268189

SEQ ID NO: 596958 - RNA, 64 nt, hsa; identical to SEQ ID NO: 268190

SEQ ID NO: 596959 - RNA, 64 nt, hsa; identical to SEQ ID NO: 268191

SEQ ID NO: 596960 - RNA, 64 nt, hsa; identical to SEQ ID NO: 268192

SEQ ID NO: 596961 - RNA, 64 nt, hsa; identical to SEQ ID NO: 268193

SEQ ID NO: 596962 - RNA, 64 nt, hsa; identical to SEQ ID NO: 268194

SEQ ID NO: 596963 - RNA, 64 nt, hsa; identical to SEQ ID NO: 268195

SEQ ID NO: 596964 - RNA, 64 nt, hsa; identical to SEQ ID NO: 268196

SEQ ID NO: 596965 - RNA, 64 nt, hsa; identical to SEQ ID NO: 268197

SEQ ID NO: 596966 - RNA, 64 nt, hsa; identical to SEQ ID NO: 268198

SEQ ID NO: 596967 - RNA, 64 nt, hsa; identical to SEQ ID NO: 268199

SEQ ID NO: 596968 - RNA, 64 nt, hsa; identical to SEQ ID NO: 268200

SEQ ID NO: 596969 - RNA, 64 nt, hsa; identical to SEQ ID NO: 268201

SEQ ID NO: 596970 - RNA, 64 nt, hsa; identical to SEQ ID NO: 268202

SEQ ID NO: 596971 - RNA, 64 nt, hsa; identical to SEQ ID NO: 268203

SEQ ID NO: 596972 - RNA, 64 nt, hsa; identical to SEQ ID NO: 268204

SEQ ID NO: 596973 - RNA, 64 nt, hsa; identical to SEQ ID NO: 268205

SEQ ID NO: 596974 - RNA, 64 nt, hsa; identical to SEQ ID NO: 268206

SEQ ID NO: 596975 - RNA, 64 nt, hsa; identical to SEQ ID NO: 268207

SEQ ID NO: 596976 - RNA, 64 nt, hsa; identical to SEQ ID NO: 268208

SEQ ID NO: 596977 - RNA, 64 nt, hsa; identical to SEQ ID NO: 268209

SEQ ID NO: 596978 - RNA, 64 nt, hsa; identical to SEQ ID NO: 268210

SEQ ID NO: 596979 - RNA, 64 nt, hsa; identical to SEQ ID NO: 268211

SEQ ID NO: 596980 - RNA, 64 nt, hsa; identical to SEQ ID NO: 268212

SEQ ID NO: 596981 - RNA, 64 nt, hsa; identical to SEQ ID NO: 268213

SEQ ID NO: 596982 - RNA, 64 nt, hsa; identical to SEQ ID NO: 268214

SEQ ID NO: 596983 - RNA, 64 nt, hsa; identical to SEQ ID NO: 268215

SEQ ID NO: 596984 - RNA, 64 nt, hsa; identical to SEQ ID NO: 268216

SEQ ID NO: 596985 - RNA, 64 nt, hsa; identical to SEQ ID NO: 268217

SEQ ID NO: 596986 - RNA, 64 nt, hsa; identical to SEQ ID NO: 268218

SEQ ID NO: 596987 - RNA, 64 nt, hsa; identical to SEQ ID NO: 268219

SEQ ID NO: 596988 - RNA, 64 nt, hsa; identical to SEQ ID NO: 268220

SEQ ID NO: 596989 - RNA, 64 nt, hsa; identical to SEQ ID NO: 268221

SEQ ID NO: 596990 - RNA, 64 nt, hsa; identical to SEQ ID NO: 268222

SEQ ID NO: 596991 - RNA, 64 nt, hsa; identical to SEQ ID NO: 268223

SEQ ID NO: 596992 - RNA, 64 nt, hsa; identical to SEQ ID NO: 268224

SEQ ID NO: 596993 - RNA, 64 nt, hsa; identical to SEQ ID NO: 268225

SEQ ID NO: 596994 - RNA, 64 nt, hsa; identical to SEQ ID NO: 268226

SEQ ID NO: 596995 - RNA, 64 nt, hsa; identical to SEQ ID NO: 268227

SEQ ID NO: 596996 - RNA, 64 nt, hsa; identical to SEQ ID NO: 268228

SEQ ID NO: 596997 - RNA, 64 nt, hsa; identical to SEQ ID NO: 268229

SEQ ID NO: 596998 - RNA, 64 nt, hsa; identical to SEQ ID NO: 268230

SEQ ID NO: 596999 - RNA, 64 nt, hsa; identical to SEQ ID NO: 268231

SEQ ID NO: 597000 - RNA, 64 nt, hsa; identical to SEQ ID NO: 268232

SEQ ID NO: 597001 - RNA, 64 nt, hsa; identical to SEQ ID NO: 268233

SEQ ID NO: 597002 - RNA, 64 nt, hsa; identical to SEQ ID NO: 268234

SEQ ID NO: 597003 - RNA, 64 nt, hsa; identical to SEQ ID NO: 268235

SEQ ID NO: 597004 - RNA, 64 nt, hsa; identical to SEQ ID NO: 268236

SEQ ID NO: 597005 - RNA, 64 nt, hsa; identical to SEQ ID NO: 268237

SEQ ID NO: 597006 - RNA, 64 nt, hsa; identical to SEQ ID NO: 268238

SEQ ID NO: 597007 - RNA, 64 nt, hsa; identical to SEQ ID NO: 268239

SEQ ID NO: 597008 - RNA, 64 nt, hsa; identical to SEQ ID NO: 268240

SEQ ID NO: 597009 - RNA, 64 nt, hsa; identical to SEQ ID NO: 268241

SEQ ID NO: 597010 - RNA, 64 nt, hsa; identical to SEQ ID NO: 268242

SEQ ID NO: 597011 - RNA, 64 nt, hsa; identical to SEQ ID NO: 268243

SEQ ID NO: 597012 - RNA, 64 nt, hsa; identical to SEQ ID NO: 268244

SEQ ID NO: 597013 - RNA, 64 nt, hsa; identical to SEQ ID NO: 268245

SEQ ID NO: 597014 - RNA, 64 nt, hsa; identical to SEQ ID NO: 268246

SEQ ID NO: 597015 - RNA, 64 nt, hsa; identical to SEQ ID NO: 268247

SEQ ID NO: 597016 - RNA, 64 nt, hsa; identical to SEQ ID NO: 268248

SEQ ID NO: 597017 - RNA, 64 nt, hsa; identical to SEQ ID NO: 268249

SEQ ID NO: 597018 - RNA, 64 nt, hsa; identical to SEQ ID NO: 268250

SEQ ID NO: 597019 - RNA, 64 nt, hsa; identical to SEQ ID NO: 268251

SEQ ID NO: 597020 - RNA, 64 nt, hsa; identical to SEQ ID NO: 268252

SEQ ID NO: 597021 - RNA, 64 nt, hsa; identical to SEQ ID NO: 268253

SEQ ID NO: 597022 - RNA, 64 nt, hsa; identical to SEQ ID NO: 268254

SEQ ID NO: 597023 - RNA, 64 nt, hsa; identical to SEQ ID NO: 268255

SEQ ID NO: 597024 - RNA, 64 nt, hsa; identical to SEQ ID NO: 268256

SEQ ID NO: 597025 - RNA, 64 nt, hsa; identical to SEQ ID NO: 268257

SEQ ID NO: 597026 - RNA, 64 nt, hsa; identical to SEQ ID NO: 268258

SEQ ID NO: 597027 - RNA, 64 nt, hsa; identical to SEQ ID NO: 268259

SEQ ID NO: 597028 - RNA, 64 nt, hsa; identical to SEQ ID NO: 268260

SEQ ID NO: 597029 - RNA, 64 nt, hsa; identical to SEQ ID NO: 268261

SEQ ID NO: 597030 - RNA, 64 nt, hsa; identical to SEQ ID NO: 268262

SEQ ID NO: 597031 - RNA, 64 nt, hsa; identical to SEQ ID NO: 268263

SEQ ID NO: 597032 - RNA, 64 nt, hsa; identical to SEQ ID NO: 268264

SEQ ID NO: 597033 - RNA, 64 nt, hsa; identical to SEQ ID NO: 268265

SEQ ID NO: 597034 - RNA, 64 nt, hsa; identical to SEQ ID NO: 268266

SEQ ID NO: 597035 - RNA, 64 nt, hsa; identical to SEQ ID NO: 268267

SEQ ID NO: 597036 - RNA, 64 nt, hsa; identical to SEQ ID NO: 268268

SEQ ID NO: 597037 - RNA, 64 nt, hsa; identical to SEQ ID NO: 268269

SEQ ID NO: 597038 - RNA, 64 nt, hsa; identical to SEQ ID NO: 268270

SEQ ID NO: 597039 - RNA, 64 nt, hsa; identical to SEQ ID NO: 268271

SEQ ID NO: 597040 - RNA, 64 nt, hsa; identical to SEQ ID NO: 268272

SEQ ID NO: 597041 - RNA, 64 nt, hsa; identical to SEQ ID NO: 268273

SEQ ID NO: 597042 - RNA, 64 nt, hsa; identical to SEQ ID NO: 268274

SEQ ID NO: 597043 - RNA, 64 nt, hsa; identical to SEQ ID NO: 268275

SEQ ID NO: 597044 - RNA, 64 nt, hsa; identical to SEQ ID NO: 268276

SEQ ID NO: 597045 - RNA, 64 nt, hsa; identical to SEQ ID NO: 268277

SEQ ID NO: 597046 - RNA, 64 nt, hsa; identical to SEQ ID NO: 268278

SEQ ID NO: 597047 - RNA, 64 nt, hsa; identical to SEQ ID NO: 268279

SEQ ID NO: 597048 - RNA, 64 nt, hsa; identical to SEQ ID NO: 268280

SEQ ID NO: 597049 - RNA, 64 nt, hsa; identical to SEQ ID NO: 268281

SEQ ID NO: 597050 - RNA, 64 nt, hsa; identical to SEQ ID NO: 268282

SEQ ID NO: 597051 - RNA, 64 nt, hsa; identical to SEQ ID NO: 268283

SEQ ID NO: 597052 - RNA, 64 nt, hsa; identical to SEQ ID NO: 268284

SEQ ID NO: 597053 - RNA, 64 nt, hsa; identical to SEQ ID NO: 268285

SEQ ID NO: 597054 - RNA, 64 nt, hsa; identical to SEQ ID NO: 268286

SEQ ID NO: 597055 - RNA, 64 nt, hsa; identical to SEQ ID NO: 268287

SEQ ID NO: 597056 - RNA, 64 nt, hsa; identical to SEQ ID NO: 268288

SEQ ID NO: 597057 - RNA, 64 nt, hsa; identical to SEQ ID NO: 268289

SEQ ID NO: 597058 - RNA, 64 nt, hsa; identical to SEQ ID NO: 268290

SEQ ID NO: 597059 - RNA, 64 nt, hsa; identical to SEQ ID NO: 268291

SEQ ID NO: 597060 - RNA, 64 nt, hsa; identical to SEQ ID NO: 268292

SEQ ID NO: 597061 - RNA, 64 nt, hsa; identical to SEQ ID NO: 268293

SEQ ID NO: 597062 - RNA, 64 nt, hsa; identical to SEQ ID NO: 268294

SEQ ID NO: 597063 - RNA, 64 nt, hsa; identical to SEQ ID NO: 268295

SEQ ID NO: 597064 - RNA, 64 nt, hsa; identical to SEQ ID NO: 268296

SEQ ID NO: 597065 - RNA, 64 nt, hsa; identical to SEQ ID NO: 268297

SEQ ID NO: 597066 - RNA, 64 nt, hsa; identical to SEQ ID NO: 268298

SEQ ID NO: 597067 - RNA, 64 nt, hsa; identical to SEQ ID NO: 268299

SEQ ID NO: 597068 - RNA, 64 nt, hsa; identical to SEQ ID NO: 268300

SEQ ID NO: 597069 - RNA, 64 nt, hsa; identical to SEQ ID NO: 268301

SEQ ID NO: 597070 - RNA, 64 nt, hsa; identical to SEQ ID NO: 268302

SEQ ID NO: 597071 - RNA, 64 nt, hsa; identical to SEQ ID NO: 268303

SEQ ID NO: 597072 - RNA, 64 nt, hsa; identical to SEQ ID NO: 268304

SEQ ID NO: 597073 - RNA, 64 nt, hsa; identical to SEQ ID NO: 268305

SEQ ID NO: 597074 - RNA, 64 nt, hsa; identical to SEQ ID NO: 268306

SEQ ID NO: 597075 - RNA, 64 nt, hsa; identical to SEQ ID NO: 268307

SEQ ID NO: 597076 - RNA, 64 nt, hsa; identical to SEQ ID NO: 268308

SEQ ID NO: 597077 - RNA, 64 nt, hsa; identical to SEQ ID NO: 268309

SEQ ID NO: 597078 - RNA, 64 nt, hsa; identical to SEQ ID NO: 268310

SEQ ID NO: 597079 - RNA, 64 nt, hsa; identical to SEQ ID NO: 268311

SEQ ID NO: 597080 - RNA, 64 nt, hsa; identical to SEQ ID NO: 268312

SEQ ID NO: 597081 - RNA, 64 nt, hsa; identical to SEQ ID NO: 268313

SEQ ID NO: 597082 - RNA, 64 nt, hsa; identical to SEQ ID NO: 268314

SEQ ID NO: 597083 - RNA, 64 nt, hsa; identical to SEQ ID NO: 268315

SEQ ID NO: 597084 - RNA, 64 nt, hsa; identical to SEQ ID NO: 268316

SEQ ID NO: 597085 - RNA, 64 nt, hsa; identical to SEQ ID NO: 268317

SEQ ID NO: 597086 - RNA, 64 nt, hsa; identical to SEQ ID NO: 268318

SEQ ID NO: 597087 - RNA, 64 nt, hsa; identical to SEQ ID NO: 268319

SEQ ID NO: 597088 - RNA, 64 nt, hsa; identical to SEQ ID NO: 268320

SEQ ID NO: 597089 - RNA, 64 nt, hsa; identical to SEQ ID NO: 268321

SEQ ID NO: 597090 - RNA, 64 nt, hsa; identical to SEQ ID NO: 268322

SEQ ID NO: 597091 - RNA, 64 nt, hsa; identical to SEQ ID NO: 268323

SEQ ID NO: 597092 - RNA, 64 nt, hsa; identical to SEQ ID NO: 268324

SEQ ID NO: 597093 - RNA, 64 nt, hsa; identical to SEQ ID NO: 268325

SEQ ID NO: 597094 - RNA, 64 nt, hsa; identical to SEQ ID NO: 268326

SEQ ID NO: 597095 - RNA, 64 nt, hsa; identical to SEQ ID NO: 268327

SEQ ID NO: 597096 - RNA, 64 nt, hsa; identical to SEQ ID NO: 268328

SEQ ID NO: 597097 - RNA, 64 nt, hsa; identical to SEQ ID NO: 268329

SEQ ID NO: 597098 - RNA, 64 nt, hsa; identical to SEQ ID NO: 268330

SEQ ID NO: 597099 - RNA, 64 nt, hsa; identical to SEQ ID NO: 268331

SEQ ID NO: 597100 - RNA, 64 nt, hsa; identical to SEQ ID NO: 268332

SEQ ID NO: 597101 - RNA, 64 nt, hsa; identical to SEQ ID NO: 268333

SEQ ID NO: 597102 - RNA, 64 nt, hsa; identical to SEQ ID NO: 268334

SEQ ID NO: 597103 - RNA, 64 nt, hsa; identical to SEQ ID NO: 268335

SEQ ID NO: 597104 - RNA, 64 nt, hsa; identical to SEQ ID NO: 268336

SEQ ID NO: 597105 - RNA, 64 nt, hsa; identical to SEQ ID NO: 268337

SEQ ID NO: 597106 - RNA, 64 nt, hsa; identical to SEQ ID NO: 268338

SEQ ID NO: 597107 - RNA, 64 nt, hsa; identical to SEQ ID NO: 268339

SEQ ID NO: 597108 - RNA, 64 nt, hsa; identical to SEQ ID NO: 268340

SEQ ID NO: 597109 - RNA, 64 nt, hsa; identical to SEQ ID NO: 268341

SEQ ID NO: 597110 - RNA, 64 nt, hsa; identical to SEQ ID NO: 268342

SEQ ID NO: 597111 - RNA, 64 nt, hsa; identical to SEQ ID NO: 268343

SEQ ID NO: 597112 - RNA, 64 nt, hsa; identical to SEQ ID NO: 268344

SEQ ID NO: 597113 - RNA, 64 nt, hsa; identical to SEQ ID NO: 268345

SEQ ID NO: 597114 - RNA, 64 nt, hsa; identical to SEQ ID NO: 268346

SEQ ID NO: 597115 - RNA, 64 nt, hsa; identical to SEQ ID NO: 268347

SEQ ID NO: 597116 - RNA, 64 nt, hsa; identical to SEQ ID NO: 268348

SEQ ID NO: 597117 - RNA, 64 nt, hsa; identical to SEQ ID NO: 268349

SEQ ID NO: 597118 - RNA, 64 nt, hsa; identical to SEQ ID NO: 268350

SEQ ID NO: 597119 - RNA, 64 nt, hsa; identical to SEQ ID NO: 268351

SEQ ID NO: 597120 - RNA, 64 nt, hsa; identical to SEQ ID NO: 268352

SEQ ID NO: 597121 - RNA, 64 nt, hsa; identical to SEQ ID NO: 268353

SEQ ID NO: 597122 - RNA, 64 nt, hsa; identical to SEQ ID NO: 268354

SEQ ID NO: 597123 - RNA, 64 nt, hsa; identical to SEQ ID NO: 268355

SEQ ID NO: 597124 - RNA, 64 nt, hsa; identical to SEQ ID NO: 268356

SEQ ID NO: 597125 - RNA, 64 nt, hsa; identical to SEQ ID NO: 268357

SEQ ID NO: 597126 - RNA, 64 nt, hsa; identical to SEQ ID NO: 268358

SEQ ID NO: 597127 - RNA, 64 nt, hsa; identical to SEQ ID NO: 268359

SEQ ID NO: 597128 - RNA, 64 nt, hsa; identical to SEQ ID NO: 268360

SEQ ID NO: 597129 - RNA, 64 nt, hsa; identical to SEQ ID NO: 268361

SEQ ID NO: 597130 - RNA, 64 nt, hsa; identical to SEQ ID NO: 268362

SEQ ID NO: 597131 - RNA, 64 nt, hsa; identical to SEQ ID NO: 268363

SEQ ID NO: 597132 - RNA, 64 nt, hsa; identical to SEQ ID NO: 268364

SEQ ID NO: 597133 - RNA, 64 nt, hsa; identical to SEQ ID NO: 268365

SEQ ID NO: 597134 - RNA, 64 nt, hsa; identical to SEQ ID NO: 268366

SEQ ID NO: 597135 - RNA, 64 nt, hsa; identical to SEQ ID NO: 268367

SEQ ID NO: 597136 - RNA, 64 nt, hsa; identical to SEQ ID NO: 268368

SEQ ID NO: 597137 - RNA, 64 nt, hsa; identical to SEQ ID NO: 268369

SEQ ID NO: 597138 - RNA, 64 nt, hsa; identical to SEQ ID NO: 268370

SEQ ID NO: 597139 - RNA, 64 nt, hsa; identical to SEQ ID NO: 268371

SEQ ID NO: 597140 - RNA, 64 nt, hsa; identical to SEQ ID NO: 268372

SEQ ID NO: 597141 - RNA, 64 nt, hsa; identical to SEQ ID NO: 268373

SEQ ID NO: 597142 - RNA, 64 nt, hsa; identical to SEQ ID NO: 268374

SEQ ID NO: 597143 - RNA, 64 nt, hsa; identical to SEQ ID NO: 268375

SEQ ID NO: 597144 - RNA, 64 nt, hsa; identical to SEQ ID NO: 268376

SEQ ID NO: 597145 - RNA, 64 nt, hsa; identical to SEQ ID NO: 268377

SEQ ID NO: 597146 - RNA, 64 nt, hsa; identical to SEQ ID NO: 268378

SEQ ID NO: 597147 - RNA, 64 nt, hsa; identical to SEQ ID NO: 268379

SEQ ID NO: 597148 - RNA, 64 nt, hsa; identical to SEQ ID NO: 268380

SEQ ID NO: 597149 - RNA, 64 nt, hsa; identical to SEQ ID NO: 268381

SEQ ID NO: 597150 - RNA, 64 nt, hsa; identical to SEQ ID NO: 268382

SEQ ID NO: 597151 - RNA, 64 nt, hsa; identical to SEQ ID NO: 268383

SEQ ID NO: 597152 - RNA, 64 nt, hsa; identical to SEQ ID NO: 268384

SEQ ID NO: 597153 - RNA, 64 nt, hsa; identical to SEQ ID NO: 268385

SEQ ID NO: 597154 - RNA, 64 nt, hsa; identical to SEQ ID NO: 268386

SEQ ID NO: 597155 - RNA, 64 nt, hsa; identical to SEQ ID NO: 268387

SEQ ID NO: 597156 - RNA, 64 nt, hsa; identical to SEQ ID NO: 268388

SEQ ID NO: 597157 - RNA, 64 nt, hsa; identical to SEQ ID NO: 268389

SEQ ID NO: 597158 - RNA, 64 nt, hsa; identical to SEQ ID NO: 268390

SEQ ID NO: 597159 - RNA, 64 nt, hsa; identical to SEQ ID NO: 268391

SEQ ID NO: 597160 - RNA, 64 nt, hsa; identical to SEQ ID NO: 268392

SEQ ID NO: 597161 - RNA, 64 nt, hsa; identical to SEQ ID NO: 268393

SEQ ID NO: 597162 - RNA, 64 nt, hsa; identical to SEQ ID NO: 268394

SEQ ID NO: 597163 - RNA, 64 nt, hsa; identical to SEQ ID NO: 268395

SEQ ID NO: 597164 - RNA, 64 nt, hsa; identical to SEQ ID NO: 268396

SEQ ID NO: 597165 - RNA, 64 nt, hsa; identical to SEQ ID NO: 268397

SEQ ID NO: 597166 - RNA, 64 nt, hsa; identical to SEQ ID NO: 268398

SEQ ID NO: 597167 - RNA, 64 nt, hsa; identical to SEQ ID NO: 268399

SEQ ID NO: 597168 - RNA, 64 nt, hsa; identical to SEQ ID NO: 268400

SEQ ID NO: 597169 - RNA, 64 nt, hsa; identical to SEQ ID NO: 268401

SEQ ID NO: 597170 - RNA, 64 nt, hsa; identical to SEQ ID NO: 268402

SEQ ID NO: 597171 - RNA, 64 nt, hsa; identical to SEQ ID NO: 268403

SEQ ID NO: 597172 - RNA, 64 nt, hsa; identical to SEQ ID NO: 268404

SEQ ID NO: 597173 - RNA, 64 nt, hsa; identical to SEQ ID NO: 268405

SEQ ID NO: 597174 - RNA, 64 nt, hsa; identical to SEQ ID NO: 268406

SEQ ID NO: 597175 - RNA, 64 nt, hsa; identical to SEQ ID NO: 268407

SEQ ID NO: 597176 - RNA, 64 nt, hsa; identical to SEQ ID NO: 268408

SEQ ID NO: 597177 - RNA, 64 nt, hsa; identical to SEQ ID NO: 268409

SEQ ID NO: 597178 - RNA, 64 nt, hsa; identical to SEQ ID NO: 268410

SEQ ID NO: 597179 - RNA, 64 nt, hsa; identical to SEQ ID NO: 268411

SEQ ID NO: 597180 - RNA, 64 nt, hsa; identical to SEQ ID NO: 268412

SEQ ID NO: 597181 - RNA, 64 nt, hsa; identical to SEQ ID NO: 268413

SEQ ID NO: 597182 - RNA, 64 nt, hsa; identical to SEQ ID NO: 268414

SEQ ID NO: 597183 - RNA, 64 nt, hsa; identical to SEQ ID NO: 268415

SEQ ID NO: 597184 - RNA, 64 nt, hsa; identical to SEQ ID NO: 268416

SEQ ID NO: 597185 - RNA, 64 nt, hsa; identical to SEQ ID NO: 268417

SEQ ID NO: 597186 - RNA, 64 nt, hsa; identical to SEQ ID NO: 268418

SEQ ID NO: 597187 - RNA, 64 nt, hsa; identical to SEQ ID NO: 268419

SEQ ID NO: 597188 - RNA, 64 nt, hsa; identical to SEQ ID NO: 268420

SEQ ID NO: 597189 - RNA, 64 nt, hsa; identical to SEQ ID NO: 268421

SEQ ID NO: 597190 - RNA, 64 nt, hsa; identical to SEQ ID NO: 268422

SEQ ID NO: 597191 - RNA, 64 nt, hsa; identical to SEQ ID NO: 268423

SEQ ID NO: 597192 - RNA, 64 nt, hsa; identical to SEQ ID NO: 268424

SEQ ID NO: 597193 - RNA, 64 nt, hsa; identical to SEQ ID NO: 268425

SEQ ID NO: 597194 - RNA, 64 nt, hsa; identical to SEQ ID NO: 268426

SEQ ID NO: 597195 - RNA, 64 nt, hsa; identical to SEQ ID NO: 268427

SEQ ID NO: 597196 - RNA, 64 nt, hsa; identical to SEQ ID NO: 268428

SEQ ID NO: 597197 - RNA, 64 nt, hsa; identical to SEQ ID NO: 268429

SEQ ID NO: 597198 - RNA, 64 nt, hsa; identical to SEQ ID NO: 268430

SEQ ID NO: 597199 - RNA, 64 nt, hsa; identical to SEQ ID NO: 268431

SEQ ID NO: 597200 - RNA, 64 nt, hsa; identical to SEQ ID NO: 268432

SEQ ID NO: 597201 - RNA, 64 nt, hsa; identical to SEQ ID NO: 268433

SEQ ID NO: 597202 - RNA, 64 nt, hsa; identical to SEQ ID NO: 268434

SEQ ID NO: 597203 - RNA, 64 nt, hsa; identical to SEQ ID NO: 268435

SEQ ID NO: 597204 - RNA, 64 nt, hsa; identical to SEQ ID NO: 268436

SEQ ID NO: 597205 - RNA, 64 nt, hsa; identical to SEQ ID NO: 268437

SEQ ID NO: 597206 - RNA, 64 nt, hsa; identical to SEQ ID NO: 268438

SEQ ID NO: 597207 - RNA, 64 nt, hsa; identical to SEQ ID NO: 268439

SEQ ID NO: 597208 - RNA, 64 nt, hsa; identical to SEQ ID NO: 268440

SEQ ID NO: 597209 - RNA, 64 nt, hsa; identical to SEQ ID NO: 268441

SEQ ID NO: 597210 - RNA, 64 nt, hsa; identical to SEQ ID NO: 268442

SEQ ID NO: 597211 - RNA, 64 nt, hsa; identical to SEQ ID NO: 268443

SEQ ID NO: 597212 - RNA, 64 nt, hsa; identical to SEQ ID NO: 268444

SEQ ID NO: 597213 - RNA, 64 nt, hsa; identical to SEQ ID NO: 268445

SEQ ID NO: 597214 - RNA, 64 nt, hsa; identical to SEQ ID NO: 268446

SEQ ID NO: 597215 - RNA, 64 nt, hsa; identical to SEQ ID NO: 268447

SEQ ID NO: 597216 - RNA, 64 nt, hsa; identical to SEQ ID NO: 268448

SEQ ID NO: 597217 - RNA, 64 nt, hsa; identical to SEQ ID NO: 268449

SEQ ID NO: 597218 - RNA, 64 nt, hsa; identical to SEQ ID NO: 268450

SEQ ID NO: 597219 - RNA, 64 nt, hsa; identical to SEQ ID NO: 268451

SEQ ID NO: 597220 - RNA, 64 nt, hsa; identical to SEQ ID NO: 268452

SEQ ID NO: 597221 - RNA, 64 nt, hsa; identical to SEQ ID NO: 268453

SEQ ID NO: 597222 - RNA, 64 nt, hsa; identical to SEQ ID NO: 268454

SEQ ID NO: 597223 - RNA, 64 nt, hsa; identical to SEQ ID NO: 268455

SEQ ID NO: 597224 - RNA, 64 nt, hsa; identical to SEQ ID NO: 268456

SEQ ID NO: 597225 - RNA, 64 nt, hsa; identical to SEQ ID NO: 268457

SEQ ID NO: 597226 - RNA, 64 nt, hsa; identical to SEQ ID NO: 268458

SEQ ID NO: 597227 - RNA, 64 nt, hsa; identical to SEQ ID NO: 268459

SEQ ID NO: 597228 - RNA, 64 nt, hsa; identical to SEQ ID NO: 268460

SEQ ID NO: 597229 - RNA, 64 nt, hsa; identical to SEQ ID NO: 268461

SEQ ID NO: 597230 - RNA, 64 nt, hsa; identical to SEQ ID NO: 268462

SEQ ID NO: 597231 - RNA, 64 nt, hsa; identical to SEQ ID NO: 268463

SEQ ID NO: 597232 - RNA, 64 nt, hsa; identical to SEQ ID NO: 268464

SEQ ID NO: 597233 - RNA, 64 nt, hsa; identical to SEQ ID NO: 268465

SEQ ID NO: 597234 - RNA, 64 nt, hsa; identical to SEQ ID NO: 268466

SEQ ID NO: 597235 - RNA, 64 nt, hsa; identical to SEQ ID NO: 268467

SEQ ID NO: 597236 - RNA, 64 nt, hsa; identical to SEQ ID NO: 268468

SEQ ID NO: 597237 - RNA, 64 nt, hsa; identical to SEQ ID NO: 268469

SEQ ID NO: 597238 - RNA, 64 nt, hsa; identical to SEQ ID NO: 268470

SEQ ID NO: 597239 - RNA, 64 nt, hsa; identical to SEQ ID NO: 268471

SEQ ID NO: 597240 - RNA, 64 nt, hsa; identical to SEQ ID NO: 268472

SEQ ID NO: 597241 - RNA, 64 nt, hsa; identical to SEQ ID NO: 268473

SEQ ID NO: 597242 - RNA, 64 nt, hsa; identical to SEQ ID NO: 268474

SEQ ID NO: 597243 - RNA, 64 nt, hsa; identical to SEQ ID NO: 268475

SEQ ID NO: 597244 - RNA, 64 nt, hsa; identical to SEQ ID NO: 268476

SEQ ID NO: 597245 - RNA, 64 nt, hsa; identical to SEQ ID NO: 268477

SEQ ID NO: 597246 - RNA, 64 nt, hsa; identical to SEQ ID NO: 268478

SEQ ID NO: 597247 - RNA, 64 nt, hsa; identical to SEQ ID NO: 268479

SEQ ID NO: 597248 - RNA, 64 nt, hsa; identical to SEQ ID NO: 268480

SEQ ID NO: 597249 - RNA, 64 nt, hsa; identical to SEQ ID NO: 268481

SEQ ID NO: 597250 - RNA, 64 nt, hsa; identical to SEQ ID NO: 268482

SEQ ID NO: 597251 - RNA, 64 nt, hsa; identical to SEQ ID NO: 268483

SEQ ID NO: 597252 - RNA, 64 nt, hsa; identical to SEQ ID NO: 268484

SEQ ID NO: 597253 - RNA, 64 nt, hsa; identical to SEQ ID NO: 268485

SEQ ID NO: 597254 - RNA, 64 nt, hsa; identical to SEQ ID NO: 268486

SEQ ID NO: 597255 - RNA, 64 nt, hsa; identical to SEQ ID NO: 268487

SEQ ID NO: 597256 - RNA, 64 nt, hsa; identical to SEQ ID NO: 268488

SEQ ID NO: 597257 - RNA, 64 nt, hsa; identical to SEQ ID NO: 268489

SEQ ID NO: 597258 - RNA, 64 nt, hsa; identical to SEQ ID NO: 268490

SEQ ID NO: 597259 - RNA, 64 nt, hsa; identical to SEQ ID NO: 268491

SEQ ID NO: 597260 - RNA, 64 nt, hsa; identical to SEQ ID NO: 268492

SEQ ID NO: 597261 - RNA, 64 nt, hsa; identical to SEQ ID NO: 268493

SEQ ID NO: 597262 - RNA, 64 nt, hsa; identical to SEQ ID NO: 268494

SEQ ID NO: 597263 - RNA, 64 nt, hsa; identical to SEQ ID NO: 268495

SEQ ID NO: 597264 - RNA, 64 nt, hsa; identical to SEQ ID NO: 268496

SEQ ID NO: 597265 - RNA, 64 nt, hsa; identical to SEQ ID NO: 268497

SEQ ID NO: 597266 - RNA, 64 nt, hsa; identical to SEQ ID NO: 268498

SEQ ID NO: 597267 - RNA, 64 nt, hsa; identical to SEQ ID NO: 268499

SEQ ID NO: 597268 - RNA, 64 nt, hsa; identical to SEQ ID NO: 268500

SEQ ID NO: 597269 - RNA, 64 nt, hsa; identical to SEQ ID NO: 268501

SEQ ID NO: 597270 - RNA, 64 nt, hsa; identical to SEQ ID NO: 268502

SEQ ID NO: 597271 - RNA, 64 nt, hsa; identical to SEQ ID NO: 268503

SEQ ID NO: 597272 - RNA, 64 nt, hsa; identical to SEQ ID NO: 268504

SEQ ID NO: 597273 - RNA, 64 nt, hsa; identical to SEQ ID NO: 268505

SEQ ID NO: 597274 - RNA, 64 nt, hsa; identical to SEQ ID NO: 268506

SEQ ID NO: 597275 - RNA, 64 nt, hsa; identical to SEQ ID NO: 268507

SEQ ID NO: 597276 - RNA, 64 nt, hsa; identical to SEQ ID NO: 268508

SEQ ID NO: 597277 - RNA, 64 nt, hsa; identical to SEQ ID NO: 268509

SEQ ID NO: 597278 - RNA, 64 nt, hsa; identical to SEQ ID NO: 268510

SEQ ID NO: 597279 - RNA, 64 nt, hsa; identical to SEQ ID NO: 268511

SEQ ID NO: 597280 - RNA, 64 nt, hsa; identical to SEQ ID NO: 268512

SEQ ID NO: 597281 - RNA, 64 nt, hsa; identical to SEQ ID NO: 268513

SEQ ID NO: 597282 - RNA, 64 nt, hsa; identical to SEQ ID NO: 268514

SEQ ID NO: 597283 - RNA, 64 nt, hsa; identical to SEQ ID NO: 268515

SEQ ID NO: 597284 - RNA, 54 nt, hsa; identical to SEQ ID NO: 268516

SEQ ID NO: 597285 - RNA, 64 nt, hsa; identical to SEQ ID NO: 268517

SEQ ID NO: 597286 - RNA, 64 nt, hsa; identical to SEQ ID NO: 268518

SEQ ID NO: 597287 - RNA, 64 nt, hsa; identical to SEQ ID NO: 268519

SEQ ID NO: 597288 - RNA, 64 nt, hsa; identical to SEQ ID NO: 268520

SEQ ID NO: 597289 - RNA, 64 nt, hsa; identical to SEQ ID NO: 268521

SEQ ID NO: 597290 - RNA, 64 nt, hsa; identical to SEQ ID NO: 268522

SEQ ID NO: 597291 - RNA, 64 nt, hsa; identical to SEQ ID NO: 268523

SEQ ID NO: 597292 - RNA, 64 nt, hsa; identical to SEQ ID NO: 268524

SEQ ID NO: 597293 - RNA, 64 nt, hsa; identical to SEQ ID NO: 268525

SEQ ID NO: 597294 - RNA, 64 nt, hsa; identical to SEQ ID NO: 268526

SEQ ID NO: 597295 - RNA, 64 nt, hsa; identical to SEQ ID NO: 268527

SEQ ID NO: 597296 - RNA, 64 nt, hsa; identical to SEQ ID NO: 268528

SEQ ID NO: 597297 - RNA, 64 nt, hsa; identical to SEQ ID NO: 268529

SEQ ID NO: 597298 - RNA, 64 nt, hsa; identical to SEQ ID NO: 268530

SEQ ID NO: 597299 - RNA, 64 nt, hsa; identical to SEQ ID NO: 268531

SEQ ID NO: 597300 - RNA, 57 nt, hsa; identical to SEQ ID NO: 268532

SEQ ID NO: 597301 - RNA, 64 nt, hsa; identical to SEQ ID NO: 268533

SEQ ID NO: 597302 - RNA, 64 nt, hsa; identical to SEQ ID NO: 268534

SEQ ID NO: 597303 - RNA, 64 nt, hsa; identical to SEQ ID NO: 268535

SEQ ID NO: 597304 - RNA, 64 nt, hsa; identical to SEQ ID NO: 268536

SEQ ID NO: 597305 - RNA, 64 nt, hsa; identical to SEQ ID NO: 268537

SEQ ID NO: 597306 - RNA, 64 nt, hsa; identical to SEQ ID NO: 268538

SEQ ID NO: 597307 - RNA, 64 nt, hsa; identical to SEQ ID NO: 268539

SEQ ID NO: 597308 - RNA, 64 nt, hsa; identical to SEQ ID NO: 268540

SEQ ID NO: 597309 - RNA, 64 nt, hsa; identical to SEQ ID NO: 268541

SEQ ID NO: 597310 - RNA, 64 nt, hsa; identical to SEQ ID NO: 268542

SEQ ID NO: 597311 - RNA, 64 nt, hsa; identical to SEQ ID NO: 268543

SEQ ID NO: 597312 - RNA, 64 nt, hsa; identical to SEQ ID NO: 268544

SEQ ID NO: 597313 - RNA, 64 nt, hsa; identical to SEQ ID NO: 268545

SEQ ID NO: 597314 - RNA, 64 nt, hsa; identical to SEQ ID NO: 268546

SEQ ID NO: 597315 - RNA, 64 nt, hsa; identical to SEQ ID NO: 268547

SEQ ID NO: 597316 - RNA, 64 nt, hsa; identical to SEQ ID NO: 268548

SEQ ID NO: 597317 - RNA, 64 nt, hsa; identical to SEQ ID NO: 268549

SEQ ID NO: 597318 - RNA, 64 nt, hsa; identical to SEQ ID NO: 268550

SEQ ID NO: 597319 - RNA, 64 nt, hsa; identical to SEQ ID NO: 268551

SEQ ID NO: 597320 - RNA, 64 nt, hsa; identical to SEQ ID NO: 268552

SEQ ID NO: 597321 - RNA, 64 nt, hsa; identical to SEQ ID NO: 268553

SEQ ID NO: 597322 - RNA, 64 nt, hsa; identical to SEQ ID NO: 268554

SEQ ID NO: 597323 - RNA, 64 nt, hsa; identical to SEQ ID NO: 268555

SEQ ID NO: 597324 - RNA, 64 nt, hsa; identical to SEQ ID NO: 268556

SEQ ID NO: 597325 - RNA, 64 nt, hsa; identical to SEQ ID NO: 268557

SEQ ID NO: 597326 - RNA, 64 nt, hsa; identical to SEQ ID NO: 268558

SEQ ID NO: 597327 - RNA, 64 nt, hsa; identical to SEQ ID NO: 268559

SEQ ID NO: 597328 - RNA, 64 nt, hsa; identical to SEQ ID NO: 268560

SEQ ID NO: 597329 - RNA, 64 nt, hsa; identical to SEQ ID NO: 268561

SEQ ID NO: 597330 - RNA, 64 nt, hsa; identical to SEQ ID NO: 268562

SEQ ID NO: 597331 - RNA, 64 nt, hsa; identical to SEQ ID NO: 268563

SEQ ID NO: 597332 - RNA, 64 nt, hsa; identical to SEQ ID NO: 268564

SEQ ID NO: 597333 - RNA, 64 nt, hsa; identical to SEQ ID NO: 268565

SEQ ID NO: 597334 - RNA, 64 nt, hsa; identical to SEQ ID NO: 268566

SEQ ID NO: 597335 - RNA, 64 nt, hsa; identical to SEQ ID NO: 268567

SEQ ID NO: 597336 - RNA, 64 nt, hsa; identical to SEQ ID NO: 268568

SEQ ID NO: 597337 - RNA, 64 nt, hsa; identical to SEQ ID NO: 268569

SEQ ID NO: 597338 - RNA, 64 nt, hsa; identical to SEQ ID NO: 268570

SEQ ID NO: 597339 - RNA, 64 nt, hsa; identical to SEQ ID NO: 268571

SEQ ID NO: 597340 - RNA, 64 nt, hsa; identical to SEQ ID NO: 268572

SEQ ID NO: 597341 - RNA, 64 nt, hsa; identical to SEQ ID NO: 268573

SEQ ID NO: 597342 - RNA, 64 nt, hsa; identical to SEQ ID NO: 268574

SEQ ID NO: 597343 - RNA, 64 nt, hsa; identical to SEQ ID NO: 268575

SEQ ID NO: 597344 - RNA, 64 nt, hsa; identical to SEQ ID NO: 268576

SEQ ID NO: 597345 - RNA, 64 nt, hsa; identical to SEQ ID NO: 268577

SEQ ID NO: 597346 - RNA, 64 nt, hsa; identical to SEQ ID NO: 268578

SEQ ID NO: 597347 - RNA, 64 nt, hsa; identical to SEQ ID NO: 268579

SEQ ID NO: 597348 - RNA, 64 nt, hsa; identical to SEQ ID NO: 268580

SEQ ID NO: 597349 - RNA, 64 nt, hsa; identical to SEQ ID NO: 268581

SEQ ID NO: 597350 - RNA, 64 nt, hsa; identical to SEQ ID NO: 268582

SEQ ID NO: 597351 - RNA, 64 nt, hsa; identical to SEQ ID NO: 268583

SEQ ID NO: 597352 - RNA, 64 nt, hsa; identical to SEQ ID NO: 268584

SEQ ID NO: 597353 - RNA, 64 nt, hsa; identical to SEQ ID NO: 268585

SEQ ID NO: 597354 - RNA, 64 nt, hsa; identical to SEQ ID NO: 268586

SEQ ID NO: 597355 - RNA, 64 nt, hsa; identical to SEQ ID NO: 268587

SEQ ID NO: 597356 - RNA, 64 nt, hsa; identical to SEQ ID NO: 268588

SEQ ID NO: 597357 - RNA, 64 nt, hsa; identical to SEQ ID NO: 268589

SEQ ID NO: 597358 - RNA, 64 nt, hsa; identical to SEQ ID NO: 268590

SEQ ID NO: 597359 - RNA, 64 nt, hsa; identical to SEQ ID NO: 268591

SEQ ID NO: 597360 - RNA, 64 nt, hsa; identical to SEQ ID NO: 268592

SEQ ID NO: 597361 - RNA, 64 nt, hsa; identical to SEQ ID NO: 268593

SEQ ID NO: 597362 - RNA, 64 nt, hsa; identical to SEQ ID NO: 268594

SEQ ID NO: 597363 - RNA, 64 nt, hsa; identical to SEQ ID NO: 268595

SEQ ID NO: 597364 - RNA, 64 nt, hsa; identical to SEQ ID NO: 268596

SEQ ID NO: 597365 - RNA, 64 nt, hsa; identical to SEQ ID NO: 268597

SEQ ID NO: 597366 - RNA, 64 nt, hsa; identical to SEQ ID NO: 268598

SEQ ID NO: 597367 - RNA, 64 nt, hsa; identical to SEQ ID NO: 268599

SEQ ID NO: 597368 - RNA, 64 nt, hsa; identical to SEQ ID NO: 268600

SEQ ID NO: 597369 - RNA, 64 nt, hsa; identical to SEQ ID NO: 268601

SEQ ID NO: 597370 - RNA, 64 nt, hsa; identical to SEQ ID NO: 268602

SEQ ID NO: 597371 - RNA, 64 nt, hsa; identical to SEQ ID NO: 268603

SEQ ID NO: 597372 - RNA, 64 nt, hsa; identical to SEQ ID NO: 268604

SEQ ID NO: 597373 - RNA, 64 nt, hsa; identical to SEQ ID NO: 268605

SEQ ID NO: 597374 - RNA, 64 nt, hsa; identical to SEQ ID NO: 268606

SEQ ID NO: 597375 - RNA, 64 nt, hsa; identical to SEQ ID NO: 268607

SEQ ID NO: 597376 - RNA, 64 nt, hsa; identical to SEQ ID NO: 268608

SEQ ID NO: 597377 - RNA, 64 nt, hsa; identical to SEQ ID NO: 268609

SEQ ID NO: 597378 - RNA, 64 nt, hsa; identical to SEQ ID NO: 268610

SEQ ID NO: 597379 - RNA, 64 nt, hsa; identical to SEQ ID NO: 268611

SEQ ID NO: 597380 - RNA, 64 nt, hsa; identical to SEQ ID NO: 268612

SEQ ID NO: 597381 - RNA, 64 nt, hsa; identical to SEQ ID NO: 268613

SEQ ID NO: 597382 - RNA, 64 nt, hsa; identical to SEQ ID NO: 268614

SEQ ID NO: 597383 - RNA, 64 nt, hsa; identical to SEQ ID NO: 268615

SEQ ID NO: 597384 - RNA, 64 nt, hsa; identical to SEQ ID NO: 268616

SEQ ID NO: 597385 - RNA, 64 nt, hsa; identical to SEQ ID NO: 268617

SEQ ID NO: 597386 - RNA, 64 nt, hsa; identical to SEQ ID NO: 268618

SEQ ID NO: 597387 - RNA, 64 nt, hsa; identical to SEQ ID NO: 268619

SEQ ID NO: 597388 - RNA, 64 nt, hsa; identical to SEQ ID NO: 268620

SEQ ID NO: 597389 - RNA, 64 nt, hsa; identical to SEQ ID NO: 268621

SEQ ID NO: 597390 - RNA, 64 nt, hsa; identical to SEQ ID NO: 268622

SEQ ID NO: 597391 - RNA, 64 nt, hsa; identical to SEQ ID NO: 268623

SEQ ID NO: 597392 - RNA, 64 nt, hsa; identical to SEQ ID NO: 268624

SEQ ID NO: 597393 - RNA, 64 nt, hsa; identical to SEQ ID NO: 268625

SEQ ID NO: 597394 - RNA, 64 nt, hsa; identical to SEQ ID NO: 268626

SEQ ID NO: 597395 - RNA, 64 nt, hsa; identical to SEQ ID NO: 268627

SEQ ID NO: 597396 - RNA, 64 nt, hsa; identical to SEQ ID NO: 268628

SEQ ID NO: 597397 - RNA, 64 nt, hsa; identical to SEQ ID NO: 268629

SEQ ID NO: 597398 - RNA, 64 nt, hsa; identical to SEQ ID NO: 268630

SEQ ID NO: 597399 - RNA, 64 nt, hsa; identical to SEQ ID NO: 268631

SEQ ID NO: 597400 - RNA, 64 nt, hsa; identical to SEQ ID NO: 268632

SEQ ID NO: 597401 - RNA, 64 nt, hsa; identical to SEQ ID NO: 268633

SEQ ID NO: 597402 - RNA, 64 nt, hsa; identical to SEQ ID NO: 268634

SEQ ID NO: 597403 - RNA, 64 nt, hsa; identical to SEQ ID NO: 268635

SEQ ID NO: 597404 - RNA, 64 nt, hsa; identical to SEQ ID NO: 268636

SEQ ID NO: 597405 - RNA, 64 nt, hsa; identical to SEQ ID NO: 268637

SEQ ID NO: 597406 - RNA, 64 nt, hsa; identical to SEQ ID NO: 268638

SEQ ID NO: 597407 - RNA, 64 nt, hsa; identical to SEQ ID NO: 268639

SEQ ID NO: 597408 - RNA, 64 nt, hsa; identical to SEQ ID NO: 268640

SEQ ID NO: 597409 - RNA, 64 nt, hsa; identical to SEQ ID NO: 268641

SEQ ID NO: 597410 - RNA, 64 nt, hsa; identical to SEQ ID NO: 268642

SEQ ID NO: 597411 - RNA, 64 nt, hsa; identical to SEQ ID NO: 268643

SEQ ID NO: 597412 - RNA, 64 nt, hsa; identical to SEQ ID NO: 268644

SEQ ID NO: 597413 - RNA, 64 nt, hsa; identical to SEQ ID NO: 268645

SEQ ID NO: 597414 - RNA, 64 nt, hsa; identical to SEQ ID NO: 268646

SEQ ID NO: 597415 - RNA, 64 nt, hsa; identical to SEQ ID NO: 268647

SEQ ID NO: 597416 - RNA, 64 nt, hsa; identical to SEQ ID NO: 268648

SEQ ID NO: 597417 - RNA, 64 nt, hsa; identical to SEQ ID NO: 268649

SEQ ID NO: 597418 - RNA, 64 nt, hsa; identical to SEQ ID NO: 268650

SEQ ID NO: 597419 - RNA, 64 nt, hsa; identical to SEQ ID NO: 268651

SEQ ID NO: 597420 - RNA, 64 nt, hsa; identical to SEQ ID NO: 268652

SEQ ID NO: 597421 - RNA, 64 nt, hsa; identical to SEQ ID NO: 268653

SEQ ID NO: 597422 - RNA, 64 nt, hsa; identical to SEQ ID NO: 268654

SEQ ID NO: 597423 - RNA, 64 nt, hsa; identical to SEQ ID NO: 268655

SEQ ID NO: 597424 - RNA, 64 nt, hsa; identical to SEQ ID NO: 268656

SEQ ID NO: 597425 - RNA, 64 nt, hsa; identical to SEQ ID NO: 268657

SEQ ID NO: 597426 - RNA, 64 nt, hsa; identical to SEQ ID NO: 268658

SEQ ID NO: 597427 - RNA, 64 nt, hsa; identical to SEQ ID NO: 268659

SEQ ID NO: 597428 - RNA, 64 nt, hsa; identical to SEQ ID NO: 268660

SEQ ID NO: 597429 - RNA, 64 nt, hsa; identical to SEQ ID NO: 268661

SEQ ID NO: 597430 - RNA, 64 nt, hsa; identical to SEQ ID NO: 268662

SEQ ID NO: 597431 - RNA, 64 nt, hsa; identical to SEQ ID NO: 268663

SEQ ID NO: 597432 - RNA, 64 nt, hsa; identical to SEQ ID NO: 268664

SEQ ID NO: 597433 - RNA, 64 nt, hsa; identical to SEQ ID NO: 268665

SEQ ID NO: 597434 - RNA, 64 nt, hsa; identical to SEQ ID NO: 268666

SEQ ID NO: 597435 - RNA, 64 nt, hsa; identical to SEQ ID NO: 268667

SEQ ID NO: 597436 - RNA, 64 nt, hsa; identical to SEQ ID NO: 268668

SEQ ID NO: 597437 - RNA, 64 nt, hsa; identical to SEQ ID NO: 268669

SEQ ID NO: 597438 - RNA, 64 nt, hsa; identical to SEQ ID NO: 268670

SEQ ID NO: 597439 - RNA, 64 nt, hsa; identical to SEQ ID NO: 268671

SEQ ID NO: 597440 - RNA, 64 nt, hsa; identical to SEQ ID NO: 268672

SEQ ID NO: 597441 - RNA, 64 nt, hsa; identical to SEQ ID NO: 268673

SEQ ID NO: 597442 - RNA, 64 nt, hsa; identical to SEQ ID NO: 268674

SEQ ID NO: 597443 - RNA, 64 nt, hsa; identical to SEQ ID NO: 268675

SEQ ID NO: 597444 - RNA, 64 nt, hsa; identical to SEQ ID NO: 268676

SEQ ID NO: 597445 - RNA, 64 nt, hsa; identical to SEQ ID NO: 268677

SEQ ID NO: 597446 - RNA, 64 nt, hsa; identical to SEQ ID NO: 268678

SEQ ID NO: 597447 - RNA, 64 nt, hsa; identical to SEQ ID NO: 268679

SEQ ID NO: 597448 - RNA, 64 nt, hsa; identical to SEQ ID NO: 268680

SEQ ID NO: 597449 - RNA, 64 nt, hsa; identical to SEQ ID NO: 268681

SEQ ID NO: 597450 - RNA, 64 nt, hsa; identical to SEQ ID NO: 268682

SEQ ID NO: 597451 - RNA, 64 nt, hsa; identical to SEQ ID NO: 268683

SEQ ID NO: 597452 - RNA, 64 nt, hsa; identical to SEQ ID NO: 268684

SEQ ID NO: 597453 - RNA, 64 nt, hsa; identical to SEQ ID NO: 268685

SEQ ID NO: 597454 - RNA, 64 nt, hsa; identical to SEQ ID NO: 268686

SEQ ID NO: 597455 - RNA, 64 nt, hsa; identical to SEQ ID NO: 268687

SEQ ID NO: 597456 - RNA, 64 nt, hsa; identical to SEQ ID NO: 268688

SEQ ID NO: 597457 - RNA, 64 nt, hsa; identical to SEQ ID NO: 268689

SEQ ID NO: 597458 - RNA, 64 nt, hsa; identical to SEQ ID NO: 268690

SEQ ID NO: 597459 - RNA, 64 nt, hsa; identical to SEQ ID NO: 268691

SEQ ID NO: 597460 - RNA, 64 nt, hsa; identical to SEQ ID NO: 268692

SEQ ID NO: 597461 - RNA, 64 nt, hsa; identical to SEQ ID NO: 268693

SEQ ID NO: 597462 - RNA, 64 nt, hsa; identical to SEQ ID NO: 268694

SEQ ID NO: 597463 - RNA, 64 nt, hsa; identical to SEQ ID NO: 268695

SEQ ID NO: 597464 - RNA, 64 nt, hsa; identical to SEQ ID NO: 268696

SEQ ID NO: 597465 - RNA, 64 nt, hsa; identical to SEQ ID NO: 268697

SEQ ID NO: 597466 - RNA, 64 nt, hsa; identical to SEQ ID NO: 268698

SEQ ID NO: 597467 - RNA, 64 nt, hsa; identical to SEQ ID NO: 268699

SEQ ID NO: 597468 - RNA, 64 nt, hsa; identical to SEQ ID NO: 268700

SEQ ID NO: 597469 - RNA, 64 nt, hsa; identical to SEQ ID NO: 268701

SEQ ID NO: 597470 - RNA, 64 nt, hsa; identical to SEQ ID NO: 268702

SEQ ID NO: 597471 - RNA, 64 nt, hsa; identical to SEQ ID NO: 268703

SEQ ID NO: 597472 - RNA, 64 nt, hsa; identical to SEQ ID NO: 268704

SEQ ID NO: 597473 - RNA, 64 nt, hsa; identical to SEQ ID NO: 268705

SEQ ID NO: 597474 - RNA, 64 nt, hsa; identical to SEQ ID NO: 268706

SEQ ID NO: 597475 - RNA, 64 nt, hsa; identical to SEQ ID NO: 268707

SEQ ID NO: 597476 - RNA, 64 nt, hsa; identical to SEQ ID NO: 268708

SEQ ID NO: 597477 - RNA, 64 nt, hsa; identical to SEQ ID NO: 268709

SEQ ID NO: 597478 - RNA, 64 nt, hsa; identical to SEQ ID NO: 268710

SEQ ID NO: 597479 - RNA, 64 nt, hsa; identical to SEQ ID NO: 268711

SEQ ID NO: 597480 - RNA, 64 nt, hsa; identical to SEQ ID NO: 268712

SEQ ID NO: 597481 - RNA, 64 nt, hsa; identical to SEQ ID NO: 268713

SEQ ID NO: 597482 - RNA, 64 nt, hsa; identical to SEQ ID NO: 268714

SEQ ID NO: 597483 - RNA, 64 nt, hsa; identical to SEQ ID NO: 268715

SEQ ID NO: 597484 - RNA, 64 nt, hsa; identical to SEQ ID NO: 268716

SEQ ID NO: 597485 - RNA, 64 nt, hsa; identical to SEQ ID NO: 268717

SEQ ID NO: 597486 - RNA, 64 nt, hsa; identical to SEQ ID NO: 268718

SEQ ID NO: 597487 - RNA, 64 nt, hsa; identical to SEQ ID NO: 268719

SEQ ID NO: 597488 - RNA, 64 nt, hsa; identical to SEQ ID NO: 268720

SEQ ID NO: 597489 - RNA, 64 nt, hsa; identical to SEQ ID NO: 268721

SEQ ID NO: 597490 - RNA, 64 nt, hsa; identical to SEQ ID NO: 268722

SEQ ID NO: 597491 - RNA, 64 nt, hsa; identical to SEQ ID NO: 268723

SEQ ID NO: 597492 - RNA, 64 nt, hsa; identical to SEQ ID NO: 268724

SEQ ID NO: 597493 - RNA, 64 nt, hsa; identical to SEQ ID NO: 268725

SEQ ID NO: 597494 - RNA, 64 nt, hsa; identical to SEQ ID NO: 268726

SEQ ID NO: 597495 - RNA, 64 nt, hsa; identical to SEQ ID NO: 268727

SEQ ID NO: 597496 - RNA, 64 nt, hsa; identical to SEQ ID NO: 268728

SEQ ID NO: 597497 - RNA, 64 nt, hsa; identical to SEQ ID NO: 268729

SEQ ID NO: 597498 - RNA, 64 nt, hsa; identical to SEQ ID NO: 268730

SEQ ID NO: 597499 - RNA, 64 nt, hsa; identical to SEQ ID NO: 268731

SEQ ID NO: 597500 - RNA, 64 nt, hsa; identical to SEQ ID NO: 268732

SEQ ID NO: 597501 - RNA, 64 nt, hsa; identical to SEQ ID NO: 268733

SEQ ID NO: 597502 - RNA, 64 nt, hsa; identical to SEQ ID NO: 268734

SEQ ID NO: 597503 - RNA, 64 nt, hsa; identical to SEQ ID NO: 268735

SEQ ID NO: 597504 - RNA, 64 nt, hsa; identical to SEQ ID NO: 268736

SEQ ID NO: 597505 - RNA, 64 nt, hsa; identical to SEQ ID NO: 268737

SEQ ID NO: 597506 - RNA, 64 nt, hsa; identical to SEQ ID NO: 268738

SEQ ID NO: 597507 - RNA, 64 nt, hsa; identical to SEQ ID NO: 268739

SEQ ID NO: 597508 - RNA, 64 nt, hsa; identical to SEQ ID NO: 268740

SEQ ID NO: 597509 - RNA, 64 nt, hsa; identical to SEQ ID NO: 268741

SEQ ID NO: 597510 - RNA, 64 nt, hsa; identical to SEQ ID NO: 268742

SEQ ID NO: 597511 - RNA, 64 nt, hsa; identical to SEQ ID NO: 268743

SEQ ID NO: 597512 - RNA, 64 nt, hsa; identical to SEQ ID NO: 268744

SEQ ID NO: 597513 - RNA, 64 nt, hsa; identical to SEQ ID NO: 268745

SEQ ID NO: 597514 - RNA, 64 nt, hsa; identical to SEQ ID NO: 268746

SEQ ID NO: 597515 - RNA, 64 nt, hsa; identical to SEQ ID NO: 268747

SEQ ID NO: 597516 - RNA, 64 nt, hsa; identical to SEQ ID NO: 268748

SEQ ID NO: 597517 - RNA, 64 nt, hsa; identical to SEQ ID NO: 268749

SEQ ID NO: 597518 - RNA, 64 nt, hsa; identical to SEQ ID NO: 268750

SEQ ID NO: 597519 - RNA, 64 nt, hsa; identical to SEQ ID NO: 268751

SEQ ID NO: 597520 - RNA, 64 nt, hsa; identical to SEQ ID NO: 268752

SEQ ID NO: 597521 - RNA, 64 nt, hsa; identical to SEQ ID NO: 268753

SEQ ID NO: 597522 - RNA, 64 nt, hsa; identical to SEQ ID NO: 268754

SEQ ID NO: 597523 - RNA, 64 nt, hsa; identical to SEQ ID NO: 268755

SEQ ID NO: 597524 - RNA, 64 nt, hsa; identical to SEQ ID NO: 268756

SEQ ID NO: 597525 - RNA, 64 nt, hsa; identical to SEQ ID NO: 268757

SEQ ID NO: 597526 - RNA, 64 nt, hsa; identical to SEQ ID NO: 268758

SEQ ID NO: 597527 - RNA, 64 nt, hsa; identical to SEQ ID NO: 268759

SEQ ID NO: 597528 - RNA, 64 nt, hsa; identical to SEQ ID NO: 268760

SEQ ID NO: 597529 - RNA, 64 nt, hsa; identical to SEQ ID NO: 268761

SEQ ID NO: 597530 - RNA, 64 nt, hsa; identical to SEQ ID NO: 268762

SEQ ID NO: 597531 - RNA, 64 nt, hsa; identical to SEQ ID NO: 268763

SEQ ID NO: 597532 - RNA, 64 nt, hsa; identical to SEQ ID NO: 268764

SEQ ID NO: 597533 - RNA, 64 nt, hsa; identical to SEQ ID NO: 268765

SEQ ID NO: 597534 - RNA, 64 nt, hsa; identical to SEQ ID NO: 268766

SEQ ID NO: 597535 - RNA, 64 nt, hsa; identical to SEQ ID NO: 268767

SEQ ID NO: 597536 - RNA, 64 nt, hsa; identical to SEQ ID NO: 268768

SEQ ID NO: 597537 - RNA, 64 nt, hsa; identical to SEQ ID NO: 268769

SEQ ID NO: 597538 - RNA, 64 nt, hsa; identical to SEQ ID NO: 268770

SEQ ID NO: 597539 - RNA, 64 nt, hsa; identical to SEQ ID NO: 268771

SEQ ID NO: 597540 - RNA, 64 nt, hsa; identical to SEQ ID NO: 268772

SEQ ID NO: 597541 - RNA, 64 nt, hsa; identical to SEQ ID NO: 268773

SEQ ID NO: 597542 - RNA, 64 nt, hsa; identical to SEQ ID NO: 268774

SEQ ID NO: 597543 - RNA, 64 nt, hsa; identical to SEQ ID NO: 268775

SEQ ID NO: 597544 - RNA, 64 nt, hsa; identical to SEQ ID NO: 268776

SEQ ID NO: 597545 - RNA, 64 nt, hsa; identical to SEQ ID NO: 268777

SEQ ID NO: 597546 - RNA, 64 nt, hsa; identical to SEQ ID NO: 268778

SEQ ID NO: 597547 - RNA, 64 nt, hsa; identical to SEQ ID NO: 268779

SEQ ID NO: 597548 - RNA, 64 nt, hsa; identical to SEQ ID NO: 268780

SEQ ID NO: 597549 - RNA, 64 nt, hsa; identical to SEQ ID NO: 268781

SEQ ID NO: 597550 - RNA, 64 nt, hsa; identical to SEQ ID NO: 268782

SEQ ID NO: 597551 - RNA, 64 nt, hsa; identical to SEQ ID NO: 268783

SEQ ID NO: 597552 - RNA, 64 nt, hsa; identical to SEQ ID NO: 268784

SEQ ID NO: 597553 - RNA, 64 nt, hsa; identical to SEQ ID NO: 268785

SEQ ID NO: 597554 - RNA, 64 nt, hsa; identical to SEQ ID NO: 268786

SEQ ID NO: 597555 - RNA, 64 nt, hsa; identical to SEQ ID NO: 268787

SEQ ID NO: 597556 - RNA, 64 nt, hsa; identical to SEQ ID NO: 268788

SEQ ID NO: 597557 - RNA, 64 nt, hsa; identical to SEQ ID NO: 268789

SEQ ID NO: 597558 - RNA, 64 nt, hsa; identical to SEQ ID NO: 268790

SEQ ID NO: 597559 - RNA, 64 nt, hsa; identical to SEQ ID NO: 268791

SEQ ID NO: 597560 - RNA, 64 nt, hsa; identical to SEQ ID NO: 268792

SEQ ID NO: 597561 - RNA, 64 nt, hsa; identical to SEQ ID NO: 268793

SEQ ID NO: 597562 - RNA, 64 nt, hsa; identical to SEQ ID NO: 268794

SEQ ID NO: 597563 - RNA, 64 nt, hsa; identical to SEQ ID NO: 268795

SEQ ID NO: 597564 - RNA, 64 nt, hsa; identical to SEQ ID NO: 268796

SEQ ID NO: 597565 - RNA, 64 nt, hsa; identical to SEQ ID NO: 268797

SEQ ID NO: 597566 - RNA, 64 nt, hsa; identical to SEQ ID NO: 268798

SEQ ID NO: 597567 - RNA, 64 nt, hsa; identical to SEQ ID NO: 268799

SEQ ID NO: 597568 - RNA, 64 nt, hsa; identical to SEQ ID NO: 268800

SEQ ID NO: 597569 - RNA, 64 nt, hsa; identical to SEQ ID NO: 268801

SEQ ID NO: 597570 - RNA, 64 nt, hsa; identical to SEQ ID NO: 268802

SEQ ID NO: 597571 - RNA, 64 nt, hsa; identical to SEQ ID NO: 268803

SEQ ID NO: 597572 - RNA, 64 nt, hsa; identical to SEQ ID NO: 268804

SEQ ID NO: 597573 - RNA, 64 nt, hsa; identical to SEQ ID NO: 268805

SEQ ID NO: 597574 - RNA, 64 nt, hsa; identical to SEQ ID NO: 268806

SEQ ID NO: 597575 - RNA, 64 nt, hsa; identical to SEQ ID NO: 268807

SEQ ID NO: 597576 - RNA, 64 nt, hsa; identical to SEQ ID NO: 268808

SEQ ID NO: 597577 - RNA, 64 nt, hsa; identical to SEQ ID NO: 268809

SEQ ID NO: 597578 - RNA, 64 nt, hsa; identical to SEQ ID NO: 268810

SEQ ID NO: 597579 - RNA, 64 nt, hsa; identical to SEQ ID NO: 268811

SEQ ID NO: 597580 - RNA, 64 nt, hsa; identical to SEQ ID NO: 268812

SEQ ID NO: 597581 - RNA, 64 nt, hsa; identical to SEQ ID NO: 268813

SEQ ID NO: 597582 - RNA, 64 nt, hsa; identical to SEQ ID NO: 268814

SEQ ID NO: 597583 - RNA, 64 nt, hsa; identical to SEQ ID NO: 268815

SEQ ID NO: 597584 - RNA, 64 nt, hsa; identical to SEQ ID NO: 268816

SEQ ID NO: 597585 - RNA, 64 nt, hsa; identical to SEQ ID NO: 268817

SEQ ID NO: 597586 - RNA, 64 nt, hsa; identical to SEQ ID NO: 268818

SEQ ID NO: 597587 - RNA, 64 nt, hsa; identical to SEQ ID NO: 268819

SEQ ID NO: 597588 - RNA, 64 nt, hsa; identical to SEQ ID NO: 268820

SEQ ID NO: 597589 - RNA, 64 nt, hsa; identical to SEQ ID NO: 268821

SEQ ID NO: 597590 - RNA, 64 nt, hsa; identical to SEQ ID NO: 268822

SEQ ID NO: 597591 - RNA, 64 nt, hsa; identical to SEQ ID NO: 268823

SEQ ID NO: 597592 - RNA, 64 nt, hsa; identical to SEQ ID NO: 268824

SEQ ID NO: 597593 - RNA, 64 nt, hsa; identical to SEQ ID NO: 268825

SEQ ID NO: 597594 - RNA, 64 nt, hsa; identical to SEQ ID NO: 268826

SEQ ID NO: 597595 - RNA, 64 nt, hsa; identical to SEQ ID NO: 268827

SEQ ID NO: 597596 - RNA, 64 nt, hsa; identical to SEQ ID NO: 268828

SEQ ID NO: 597597 - RNA, 64 nt, hsa; identical to SEQ ID NO: 268829

SEQ ID NO: 597598 - RNA, 64 nt, hsa; identical to SEQ ID NO: 268830

SEQ ID NO: 597599 - RNA, 64 nt, hsa; identical to SEQ ID NO: 268831

SEQ ID NO: 597600 - RNA, 64 nt, hsa; identical to SEQ ID NO: 268832

SEQ ID NO: 597601 - RNA, 64 nt, hsa; identical to SEQ ID NO: 268833

SEQ ID NO: 597602 - RNA, 64 nt, hsa; identical to SEQ ID NO: 268834

SEQ ID NO: 597603 - RNA, 64 nt, hsa; identical to SEQ ID NO: 268835

SEQ ID NO: 597604 - RNA, 64 nt, hsa; identical to SEQ ID NO: 268836

SEQ ID NO: 597605 - RNA, 64 nt, hsa; identical to SEQ ID NO: 268837

SEQ ID NO: 597606 - RNA, 64 nt, hsa; identical to SEQ ID NO: 268838

SEQ ID NO: 597607 - RNA, 64 nt, hsa; identical to SEQ ID NO: 268839

SEQ ID NO: 597608 - RNA, 64 nt, hsa; identical to SEQ ID NO: 268840

SEQ ID NO: 597609 - RNA, 64 nt, hsa; identical to SEQ ID NO: 268841

SEQ ID NO: 597610 - RNA, 64 nt, hsa; identical to SEQ ID NO: 268842

SEQ ID NO: 597611 - RNA, 64 nt, hsa; identical to SEQ ID NO: 268843

SEQ ID NO: 597612 - RNA, 64 nt, hsa; identical to SEQ ID NO: 268844

SEQ ID NO: 597613 - RNA, 64 nt, hsa; identical to SEQ ID NO: 268845

SEQ ID NO: 597614 - RNA, 64 nt, hsa; identical to SEQ ID NO: 268846

SEQ ID NO: 597615 - RNA, 64 nt, hsa; identical to SEQ ID NO: 268847

SEQ ID NO: 597616 - RNA, 64 nt, hsa; identical to SEQ ID NO: 268848

SEQ ID NO: 597617 - RNA, 64 nt, hsa; identical to SEQ ID NO: 268849

SEQ ID NO: 597618 - RNA, 64 nt, hsa; identical to SEQ ID NO: 268457

SEQ ID NO: 597619 - RNA, 64 nt, hsa; identical to SEQ ID NO: 268458

SEQ ID NO: 597620 - RNA, 64 nt, hsa; identical to SEQ ID NO: 268852

SEQ ID NO: 597621 - RNA, 64 nt, hsa; identical to SEQ ID NO: 268853

SEQ ID NO: 597622 - RNA, 64 nt, hsa; identical to SEQ ID NO: 268854

SEQ ID NO: 597623 - RNA, 64 nt, hsa; identical to SEQ ID NO: 268855

SEQ ID NO: 597624 - RNA, 64 nt, hsa; identical to SEQ ID NO: 268856

SEQ ID NO: 597625 - RNA, 64 nt, hsa; identical to SEQ ID NO: 268857

SEQ ID NO: 597626 - RNA, 64 nt, hsa; identical to SEQ ID NO: 268858

SEQ ID NO: 597627 - RNA, 64 nt, hsa; identical to SEQ ID NO: 268859

SEQ ID NO: 597628 - RNA, 64 nt, hsa; identical to SEQ ID NO: 268860

SEQ ID NO: 597629 - RNA, 64 nt, hsa; identical to SEQ ID NO: 268861

SEQ ID NO: 597630 - RNA, 64 nt, hsa; identical to SEQ ID NO: 268862

SEQ ID NO: 597631 - RNA, 64 nt, hsa; identical to SEQ ID NO: 268863

SEQ ID NO: 597632 - RNA, 64 nt, hsa; identical to SEQ ID NO: 268864

SEQ ID NO: 597633 - RNA, 64 nt, hsa; identical to SEQ ID NO: 268865

SEQ ID NO: 597634 - RNA, 64 nt, hsa; identical to SEQ ID NO: 268866

SEQ ID NO: 597635 - RNA, 64 nt, hsa; identical to SEQ ID NO: 268867

SEQ ID NO: 597636 - RNA, 64 nt, hsa; identical to SEQ ID NO: 268868

SEQ ID NO: 597637 - RNA, 64 nt, hsa; identical to SEQ ID NO: 268869

SEQ ID NO: 597638 - RNA, 64 nt, hsa; identical to SEQ ID NO: 268870

SEQ ID NO: 597639 - RNA, 64 nt, hsa; identical to SEQ ID NO: 268871

SEQ ID NO: 597640 - RNA, 64 nt, hsa; identical to SEQ ID NO: 268872

SEQ ID NO: 597641 - RNA, 64 nt, hsa; identical to SEQ ID NO: 268873

SEQ ID NO: 597642 - RNA, 64 nt, hsa; identical to SEQ ID NO: 268874

SEQ ID NO: 597643 - RNA, 64 nt, hsa; identical to SEQ ID NO: 268875

SEQ ID NO: 597644 - RNA, 64 nt, hsa; identical to SEQ ID NO: 268876

SEQ ID NO: 597645 - RNA, 64 nt, hsa; identical to SEQ ID NO: 268877

SEQ ID NO: 597646 - RNA, 64 nt, hsa; identical to SEQ ID NO: 268878

SEQ ID NO: 597647 - RNA, 64 nt, hsa; identical to SEQ ID NO: 268879

SEQ ID NO: 597648 - RNA, 64 nt, hsa; identical to SEQ ID NO: 268880

SEQ ID NO: 597649 - RNA, 64 nt, hsa; identical to SEQ ID NO: 268881

SEQ ID NO: 597650 - RNA, 64 nt, hsa; identical to SEQ ID NO: 268882

SEQ ID NO: 597651 - RNA, 64 nt, hsa; identical to SEQ ID NO: 268883

SEQ ID NO: 597652 - RNA, 64 nt, hsa; identical to SEQ ID NO: 268884

SEQ ID NO: 597653 - RNA, 64 nt, hsa; identical to SEQ ID NO: 268885

SEQ ID NO: 597654 - RNA, 64 nt, hsa; identical to SEQ ID NO: 268886

SEQ ID NO: 597655 - RNA, 64 nt, hsa; identical to SEQ ID NO: 268887

SEQ ID NO: 597656 - RNA, 64 nt, hsa; identical to SEQ ID NO: 268888

SEQ ID NO: 597657 - RNA, 64 nt, hsa; identical to SEQ ID NO: 268889

SEQ ID NO: 597658 - RNA, 64 nt, hsa; identical to SEQ ID NO: 268890

SEQ ID NO: 597659 - RNA, 64 nt, hsa; identical to SEQ ID NO: 268891

SEQ ID NO: 597660 - RNA, 64 nt, hsa; identical to SEQ ID NO: 268892

SEQ ID NO: 597661 - RNA, 64 nt, hsa; identical to SEQ ID NO: 268893

SEQ ID NO: 597662 - RNA, 64 nt, hsa; identical to SEQ ID NO: 268894

SEQ ID NO: 597663 - RNA, 64 nt, hsa; identical to SEQ ID NO: 268895

SEQ ID NO: 597664 - RNA, 64 nt, hsa; identical to SEQ ID NO: 268896

SEQ ID NO: 597665 - RNA, 64 nt, hsa; identical to SEQ ID NO: 268897

SEQ ID NO: 597666 - RNA, 64 nt, hsa; identical to SEQ ID NO: 268898

SEQ ID NO: 597667 - RNA, 64 nt, hsa; identical to SEQ ID NO: 268899

SEQ ID NO: 597668 - RNA, 64 nt, hsa; identical to SEQ ID NO: 268900

SEQ ID NO: 597669 - RNA, 64 nt, hsa; identical to SEQ ID NO: 268901

SEQ ID NO: 597670 - RNA, 64 nt, hsa; identical to SEQ ID NO: 268902

SEQ ID NO: 597671 - RNA, 64 nt, hsa; identical to SEQ ID NO: 268903

SEQ ID NO: 597672 - RNA, 64 nt, hsa; identical to SEQ ID NO: 268904

SEQ ID NO: 597673 - RNA, 64 nt, hsa; identical to SEQ ID NO: 268905

SEQ ID NO: 597674 - RNA, 64 nt, hsa; identical to SEQ ID NO: 268906

SEQ ID NO: 597675 - RNA, 64 nt, hsa; identical to SEQ ID NO: 268907

SEQ ID NO: 597676 - RNA, 64 nt, hsa; identical to SEQ ID NO: 268908

SEQ ID NO: 597677 - RNA, 64 nt, hsa; identical to SEQ ID NO: 268909

SEQ ID NO: 597678 - RNA, 64 nt, hsa; identical to SEQ ID NO: 268910

SEQ ID NO: 597679 - RNA, 64 nt, hsa; identical to SEQ ID NO: 268911

SEQ ID NO: 597680 - RNA, 64 nt, hsa; identical to SEQ ID NO: 268912

SEQ ID NO: 597681 - RNA, 64 nt, hsa; identical to SEQ ID NO: 268913

SEQ ID NO: 597682 - RNA, 64 nt, hsa; identical to SEQ ID NO: 268914

SEQ ID NO: 597683 - RNA, 64 nt, hsa; identical to SEQ ID NO: 268915

SEQ ID NO: 597684 - RNA, 64 nt, hsa; identical to SEQ ID NO: 268916

SEQ ID NO: 597685 - RNA, 64 nt, hsa; identical to SEQ ID NO: 268917

SEQ ID NO: 597686 - RNA, 64 nt, hsa; identical to SEQ ID NO: 268918

SEQ ID NO: 597687 - RNA, 64 nt, hsa; identical to SEQ ID NO: 268919

SEQ ID NO: 597688 - RNA, 64 nt, hsa; identical to SEQ ID NO: 268920

SEQ ID NO: 597689 - RNA, 64 nt, hsa; identical to SEQ ID NO: 268921

SEQ ID NO: 597690 - RNA, 64 nt, hsa; identical to SEQ ID NO: 268922

SEQ ID NO: 597691 - RNA, 64 nt, hsa; identical to SEQ ID NO: 268923

SEQ ID NO: 597692 - RNA, 64 nt, hsa; identical to SEQ ID NO: 268924

SEQ ID NO: 597693 - RNA, 64 nt, hsa; identical to SEQ ID NO: 268925

SEQ ID NO: 597694 - RNA, 64 nt, hsa; identical to SEQ ID NO: 268926

SEQ ID NO: 597695 - RNA, 64 nt, hsa; identical to SEQ ID NO: 268927

SEQ ID NO: 597696 - RNA, 64 nt, hsa; identical to SEQ ID NO: 268928

SEQ ID NO: 597697 - RNA, 64 nt, hsa; identical to SEQ ID NO: 268929

SEQ ID NO: 597698 - RNA, 64 nt, hsa; identical to SEQ ID NO: 268930

SEQ ID NO: 597699 - RNA, 64 nt, hsa; identical to SEQ ID NO: 268931

SEQ ID NO: 597700 - RNA, 64 nt, hsa; identical to SEQ ID NO: 268932

SEQ ID NO: 597701 - RNA, 64 nt, hsa; identical to SEQ ID NO: 268933

SEQ ID NO: 597702 - RNA, 64 nt, hsa; identical to SEQ ID NO: 268934

SEQ ID NO: 597703 - RNA, 64 nt, hsa; identical to SEQ ID NO: 268935

SEQ ID NO: 597704 - RNA, 64 nt, hsa; identical to SEQ ID NO: 268936

SEQ ID NO: 597705 - RNA, 64 nt, hsa; identical to SEQ ID NO: 268937

SEQ ID NO: 597706 - RNA, 64 nt, hsa; identical to SEQ ID NO: 268938

SEQ ID NO: 597707 - RNA, 64 nt, hsa; identical to SEQ ID NO: 268939

SEQ ID NO: 597708 - RNA, 64 nt, hsa; identical to SEQ ID NO: 268940

SEQ ID NO: 597709 - RNA, 64 nt, hsa; identical to SEQ ID NO: 268941

SEQ ID NO: 597710 - RNA, 64 nt, hsa; identical to SEQ ID NO: 268942

SEQ ID NO: 597711 - RNA, 64 nt, hsa; identical to SEQ ID NO: 268943

SEQ ID NO: 597712 - RNA, 64 nt, hsa; identical to SEQ ID NO: 268944

SEQ ID NO: 597713 - RNA, 64 nt, hsa; identical to SEQ ID NO: 268945

SEQ ID NO: 597714 - RNA, 64 nt, hsa; identical to SEQ ID NO: 268946

SEQ ID NO: 597715 - RNA, 64 nt, hsa; identical to SEQ ID NO: 268947

SEQ ID NO: 597716 - RNA, 64 nt, hsa; identical to SEQ ID NO: 268948

SEQ ID NO: 597717 - RNA, 64 nt, hsa; identical to SEQ ID NO: 268949

SEQ ID NO: 597718 - RNA, 64 nt, hsa; identical to SEQ ID NO: 268950

SEQ ID NO: 597719 - RNA, 64 nt, hsa; identical to SEQ ID NO: 268951

SEQ ID NO: 597720 - RNA, 64 nt, hsa; identical to SEQ ID NO: 268952

SEQ ID NO: 597721 - RNA, 64 nt, hsa; identical to SEQ ID NO: 268953

SEQ ID NO: 597722 - RNA, 64 nt, hsa; identical to SEQ ID NO: 268954

SEQ ID NO: 597723 - RNA, 64 nt, hsa; identical to SEQ ID NO: 268955

SEQ ID NO: 597724 - RNA, 64 nt, hsa; identical to SEQ ID NO: 268956

SEQ ID NO: 597725 - RNA, 64 nt, hsa; identical to SEQ ID NO: 268957

SEQ ID NO: 597726 - RNA, 64 nt, hsa; identical to SEQ ID NO: 268958

SEQ ID NO: 597727 - RNA, 64 nt, hsa; identical to SEQ ID NO: 268959

SEQ ID NO: 597728 - RNA, 64 nt, hsa; identical to SEQ ID NO: 268960

SEQ ID NO: 597729 - RNA, 64 nt, hsa; identical to SEQ ID NO: 268961

SEQ ID NO: 597730 - RNA, 64 nt, hsa; identical to SEQ ID NO: 268962

SEQ ID NO: 597731 - RNA, 64 nt, hsa; identical to SEQ ID NO: 268963

SEQ ID NO: 597732 - RNA, 64 nt, hsa; identical to SEQ ID NO: 268964

SEQ ID NO: 597733 - RNA, 64 nt, hsa; identical to SEQ ID NO: 268965

SEQ ID NO: 597734 - RNA, 64 nt, hsa; identical to SEQ ID NO: 268966

SEQ ID NO: 597735 - RNA, 64 nt, hsa; identical to SEQ ID NO: 268967

SEQ ID NO: 597736 - RNA, 64 nt, hsa; identical to SEQ ID NO: 268968

SEQ ID NO: 597737 - RNA, 64 nt, hsa; identical to SEQ ID NO: 268969

SEQ ID NO: 597738 - RNA, 64 nt, hsa; identical to SEQ ID NO: 268970

SEQ ID NO: 597739 - RNA, 64 nt, hsa; identical to SEQ ID NO: 268971

SEQ ID NO: 597740 - RNA, 64 nt, hsa; identical to SEQ ID NO: 268972

SEQ ID NO: 597741 - RNA, 64 nt, hsa; identical to SEQ ID NO: 268973

SEQ ID NO: 597742 - RNA, 64 nt, hsa; identical to SEQ ID NO: 268974

SEQ ID NO: 597743 - RNA, 64 nt, hsa; identical to SEQ ID NO: 268975

SEQ ID NO: 597744 - RNA, 64 nt, hsa; identical to SEQ ID NO: 268976

SEQ ID NO: 597745 - RNA, 64 nt, hsa; identical to SEQ ID NO: 268977

SEQ ID NO: 597746 - RNA, 64 nt, hsa; identical to SEQ ID NO: 268978

SEQ ID NO: 597747 - RNA, 64 nt, hsa; identical to SEQ ID NO: 268979

SEQ ID NO: 597748 - RNA, 64 nt, hsa; identical to SEQ ID NO: 268980

SEQ ID NO: 597749 - RNA, 64 nt, hsa; identical to SEQ ID NO: 268981

SEQ ID NO: 597750 - RNA, 64 nt, hsa; identical to SEQ ID NO: 268982

SEQ ID NO: 597751 - RNA, 64 nt, hsa; identical to SEQ ID NO: 268983

SEQ ID NO: 597752 - RNA, 64 nt, hsa; identical to SEQ ID NO: 268984

SEQ ID NO: 597753 - RNA, 64 nt, hsa; identical to SEQ ID NO: 268985

SEQ ID NO: 597754 - RNA, 64 nt, hsa; identical to SEQ ID NO: 268986

SEQ ID NO: 597755 - RNA, 64 nt, hsa; identical to SEQ ID NO: 268987

SEQ ID NO: 597756 - RNA, 64 nt, hsa; identical to SEQ ID NO: 268988

SEQ ID NO: 597757 - RNA, 64 nt, hsa; identical to SEQ ID NO: 268989

SEQ ID NO: 597758 - RNA, 64 nt, hsa; identical to SEQ ID NO: 268990

SEQ ID NO: 597759 - RNA, 64 nt, hsa; identical to SEQ ID NO: 268991

SEQ ID NO: 597760 - RNA, 64 nt, hsa; identical to SEQ ID NO: 268992

SEQ ID NO: 597761 - RNA, 64 nt, hsa; identical to SEQ ID NO: 268993

SEQ ID NO: 597762 - RNA, 64 nt, hsa; identical to SEQ ID NO: 268994

SEQ ID NO: 597763 - RNA, 64 nt, hsa; identical to SEQ ID NO: 268995

SEQ ID NO: 597764 - RNA, 64 nt, hsa; identical to SEQ ID NO: 268996

SEQ ID NO: 597765 - RNA, 64 nt, hsa; identical to SEQ ID NO: 268997

SEQ ID NO: 597766 - RNA, 64 nt, hsa; identical to SEQ ID NO: 268998

SEQ ID NO: 597767 - RNA, 64 nt, hsa; identical to SEQ ID NO: 268999

SEQ ID NO: 597768 - RNA, 64 nt, hsa; identical to SEQ ID NO: 269000

SEQ ID NO: 597769 - RNA, 64 nt, hsa; identical to SEQ ID NO: 269001

SEQ ID NO: 597770 - RNA, 64 nt, hsa; identical to SEQ ID NO: 269002

SEQ ID NO: 597771 - RNA, 64 nt, hsa; identical to SEQ ID NO: 269003

SEQ ID NO: 597772 - RNA, 64 nt, hsa; identical to SEQ ID NO: 269004

SEQ ID NO: 597773 - RNA, 64 nt, hsa; identical to SEQ ID NO: 269005

SEQ ID NO: 597774 - RNA, 64 nt, hsa; identical to SEQ ID NO: 269006

SEQ ID NO: 597775 - RNA, 64 nt, hsa; identical to SEQ ID NO: 269007

SEQ ID NO: 597776 - RNA, 64 nt, hsa; identical to SEQ ID NO: 269008

SEQ ID NO: 597777 - RNA, 64 nt, hsa; identical to SEQ ID NO: 269009

SEQ ID NO: 597778 - RNA, 64 nt, hsa; identical to SEQ ID NO: 269010

SEQ ID NO: 597779 - RNA, 64 nt, hsa; identical to SEQ ID NO: 269011

SEQ ID NO: 597780 - RNA, 64 nt, hsa; identical to SEQ ID NO: 269012

SEQ ID NO: 597781 - RNA, 64 nt, hsa; identical to SEQ ID NO: 269013

SEQ ID NO: 597782 - RNA, 64 nt, hsa; identical to SEQ ID NO: 269014

SEQ ID NO: 597783 - RNA, 64 nt, hsa; identical to SEQ ID NO: 269015

SEQ ID NO: 597784 - RNA, 64 nt, hsa; identical to SEQ ID NO: 269016

SEQ ID NO: 597785 - RNA, 64 nt, hsa; identical to SEQ ID NO: 269017

SEQ ID NO: 597786 - RNA, 64 nt, hsa; identical to SEQ ID NO: 269018

SEQ ID NO: 597787 - RNA, 64 nt, hsa; identical to SEQ ID NO: 269019

SEQ ID NO: 597788 - RNA, 64 nt, hsa; identical to SEQ ID NO: 269020

SEQ ID NO: 597789 - RNA, 64 nt, hsa; identical to SEQ ID NO: 269021

SEQ ID NO: 597790 - RNA, 64 nt, hsa; identical to SEQ ID NO: 269022

SEQ ID NO: 597791 - RNA, 64 nt, hsa; identical to SEQ ID NO: 269023

SEQ ID NO: 597792 - RNA, 64 nt, hsa; identical to SEQ ID NO: 269024

SEQ ID NO: 597793 - RNA, 64 nt, hsa; identical to SEQ ID NO: 269025

SEQ ID NO: 597794 - RNA, 64 nt, hsa; identical to SEQ ID NO: 269026

SEQ ID NO: 597795 - RNA, 64 nt, hsa; identical to SEQ ID NO: 269027

SEQ ID NO: 597796 - RNA, 64 nt, hsa; identical to SEQ ID NO: 269028

SEQ ID NO: 597797 - RNA, 64 nt, hsa; identical to SEQ ID NO: 269029

SEQ ID NO: 597798 - RNA, 64 nt, hsa; identical to SEQ ID NO: 269030

SEQ ID NO: 597799 - RNA, 64 nt, hsa; identical to SEQ ID NO: 269031

SEQ ID NO: 597800 - RNA, 64 nt, hsa; identical to SEQ ID NO: 269032

SEQ ID NO: 597801 - RNA, 64 nt, hsa; identical to SEQ ID NO: 269033

SEQ ID NO: 597802 - RNA, 64 nt, hsa; identical to SEQ ID NO: 269034

SEQ ID NO: 597803 - RNA, 64 nt, hsa; identical to SEQ ID NO: 269035

SEQ ID NO: 597804 - RNA, 64 nt, hsa; identical to SEQ ID NO: 269036

SEQ ID NO: 597805 - RNA, 64 nt, hsa; identical to SEQ ID NO: 269037

SEQ ID NO: 597806 - RNA, 64 nt, hsa; identical to SEQ ID NO: 269038

SEQ ID NO: 597807 - RNA, 64 nt, hsa; identical to SEQ ID NO: 269039

SEQ ID NO: 597808 - RNA, 64 nt, hsa; identical to SEQ ID NO: 269040

SEQ ID NO: 597809 - RNA, 64 nt, hsa; identical to SEQ ID NO: 269041

SEQ ID NO: 597810 - RNA, 64 nt, hsa; identical to SEQ ID NO: 269042

SEQ ID NO: 597811 - RNA, 64 nt, hsa; identical to SEQ ID NO: 269043

SEQ ID NO: 597812 - RNA, 64 nt, hsa; identical to SEQ ID NO: 269044

SEQ ID NO: 597813 - RNA, 64 nt, hsa; identical to SEQ ID NO: 269045

SEQ ID NO: 597814 - RNA, 64 nt, hsa; identical to SEQ ID NO: 269046

SEQ ID NO: 597815 - RNA, 64 nt, hsa; identical to SEQ ID NO: 269047

SEQ ID NO: 597816 - RNA, 64 nt, hsa; identical to SEQ ID NO: 269048

SEQ ID NO: 597817 - RNA, 64 nt, hsa; identical to SEQ ID NO: 269049

SEQ ID NO: 597818 - RNA, 64 nt, hsa; identical to SEQ ID NO: 269050

SEQ ID NO: 597819 - RNA, 64 nt, hsa; identical to SEQ ID NO: 269051

SEQ ID NO: 597820 - RNA, 64 nt, hsa; identical to SEQ ID NO: 269052

SEQ ID NO: 597821 - RNA, 64 nt, hsa; identical to SEQ ID NO: 269053

SEQ ID NO: 597822 - RNA, 64 nt, hsa; identical to SEQ ID NO: 269054

SEQ ID NO: 597823 - RNA, 64 nt, hsa; identical to SEQ ID NO: 269055

SEQ ID NO: 597824 - RNA, 64 nt, hsa; identical to SEQ ID NO: 269056

SEQ ID NO: 597825 - RNA, 64 nt, hsa; identical to SEQ ID NO: 269057

SEQ ID NO: 597826 - RNA, 64 nt, hsa; identical to SEQ ID NO: 269058

SEQ ID NO: 597827 - RNA, 64 nt, hsa; identical to SEQ ID NO: 269059

SEQ ID NO: 597828 - RNA, 64 nt, hsa; identical to SEQ ID NO: 269060

SEQ ID NO: 597829 - RNA, 64 nt, hsa; identical to SEQ ID NO: 269061

SEQ ID NO: 597830 - RNA, 64 nt, hsa; identical to SEQ ID NO: 269062

SEQ ID NO: 597831 - RNA, 64 nt, hsa; identical to SEQ ID NO: 269063

SEQ ID NO: 597832 - RNA, 64 nt, hsa; identical to SEQ ID NO: 269064

SEQ ID NO: 597833 - RNA, 64 nt, hsa; identical to SEQ ID NO: 269065

SEQ ID NO: 597834 - RNA, 64 nt, hsa; identical to SEQ ID NO: 269066

SEQ ID NO: 597835 - RNA, 64 nt, hsa; identical to SEQ ID NO: 269067

SEQ ID NO: 597836 - RNA, 64 nt, hsa; identical to SEQ ID NO: 269068

SEQ ID NO: 597837 - RNA, 64 nt, hsa; identical to SEQ ID NO: 269069

SEQ ID NO: 597838 - RNA, 64 nt, hsa; identical to SEQ ID NO: 269070

SEQ ID NO: 597839 - RNA, 64 nt, hsa; identical to SEQ ID NO: 269071

SEQ ID NO: 597840 - RNA, 64 nt, hsa; identical to SEQ ID NO: 269072

SEQ ID NO: 597841 - RNA, 64 nt, hsa; identical to SEQ ID NO: 269073

SEQ ID NO: 597842 - RNA, 64 nt, hsa; identical to SEQ ID NO: 269074

SEQ ID NO: 597843 - RNA, 64 nt, hsa; identical to SEQ ID NO: 269075

SEQ ID NO: 597844 - RNA, 64 nt, hsa; identical to SEQ ID NO: 269076

SEQ ID NO: 597845 - RNA, 64 nt, hsa; identical to SEQ ID NO: 269077

SEQ ID NO: 597846 - RNA, 64 nt, hsa; identical to SEQ ID NO: 269078

SEQ ID NO: 597847 - RNA, 64 nt, hsa; identical to SEQ ID NO: 269079

SEQ ID NO: 597848 - RNA, 64 nt, hsa; identical to SEQ ID NO: 269080

SEQ ID NO: 597849 - RNA, 64 nt, hsa; identical to SEQ ID NO: 269081

SEQ ID NO: 597850 - RNA, 64 nt, hsa; identical to SEQ ID NO: 269082

SEQ ID NO: 597851 - RNA, 64 nt, hsa; identical to SEQ ID NO: 269083

SEQ ID NO: 597852 - RNA, 64 nt, hsa; identical to SEQ ID NO: 269084

SEQ ID NO: 597853 - RNA, 64 nt, hsa; identical to SEQ ID NO: 269085

SEQ ID NO: 597854 - RNA, 64 nt, hsa; identical to SEQ ID NO: 269086

SEQ ID NO: 597855 - RNA, 64 nt, hsa; identical to SEQ ID NO: 269087

SEQ ID NO: 597856 - RNA, 64 nt, hsa; identical to SEQ ID NO: 269088

SEQ ID NO: 597857 - RNA, 64 nt, hsa; identical to SEQ ID NO: 269089

SEQ ID NO: 597858 - RNA, 64 nt, hsa; identical to SEQ ID NO: 269090

SEQ ID NO: 597859 - RNA, 64 nt, hsa; identical to SEQ ID NO: 269091

SEQ ID NO: 597860 - RNA, 64 nt, hsa; identical to SEQ ID NO: 269092

SEQ ID NO: 597861 - RNA, 64 nt, hsa; identical to SEQ ID NO: 269093

SEQ ID NO: 597862 - RNA, 64 nt, hsa; identical to SEQ ID NO: 269094

SEQ ID NO: 597863 - RNA, 64 nt, hsa; identical to SEQ ID NO: 269095

SEQ ID NO: 597864 - RNA, 64 nt, hsa; identical to SEQ ID NO: 269096

SEQ ID NO: 597865 - RNA, 64 nt, hsa; identical to SEQ ID NO: 269097

SEQ ID NO: 597866 - RNA, 64 nt, hsa; identical to SEQ ID NO: 269098

SEQ ID NO: 597867 - RNA, 64 nt, hsa; identical to SEQ ID NO: 269099

SEQ ID NO: 597868 - RNA, 64 nt, hsa; identical to SEQ ID NO: 269100

SEQ ID NO: 597869 - RNA, 64 nt, hsa; identical to SEQ ID NO: 269101

SEQ ID NO: 597870 - RNA, 64 nt, hsa; identical to SEQ ID NO: 269102

SEQ ID NO: 597871 - RNA, 64 nt, hsa; identical to SEQ ID NO: 269103

SEQ ID NO: 597872 - RNA, 55 nt, hsa; identical to SEQ ID NO: 269104

SEQ ID NO: 597873 - RNA, 64 nt, hsa; identical to SEQ ID NO: 269105

SEQ ID NO: 597874 - RNA, 64 nt, hsa; identical to SEQ ID NO: 269106

SEQ ID NO: 597875 - RNA, 64 nt, hsa; identical to SEQ ID NO: 269107

SEQ ID NO: 597876 - RNA, 64 nt, hsa; identical to SEQ ID NO: 269108

SEQ ID NO: 597877 - RNA, 64 nt, hsa; identical to SEQ ID NO: 269109

SEQ ID NO: 597878 - RNA, 64 nt, hsa; identical to SEQ ID NO: 269110

SEQ ID NO: 597879 - RNA, 64 nt, hsa; identical to SEQ ID NO: 269111

SEQ ID NO: 597880 - RNA, 64 nt, hsa; identical to SEQ ID NO: 269112

SEQ ID NO: 597881 - RNA, 64 nt, hsa; identical to SEQ ID NO: 269113

SEQ ID NO: 597882 - RNA, 64 nt, hsa; identical to SEQ ID NO: 269114

SEQ ID NO: 597883 - RNA, 64 nt, hsa; identical to SEQ ID NO: 269115

SEQ ID NO: 597884 - RNA, 64 nt, hsa; identical to SEQ ID NO: 269116

SEQ ID NO: 597885 - RNA, 64 nt, hsa; identical to SEQ ID NO: 269117

SEQ ID NO: 597886 - RNA, 64 nt, hsa; identical to SEQ ID NO: 269118

SEQ ID NO: 597887 - RNA, 64 nt, hsa; identical to SEQ ID NO: 269119

SEQ ID NO: 597888 - RNA, 64 nt, hsa; identical to SEQ ID NO: 269120

SEQ ID NO: 597889 - RNA, 64 nt, hsa; identical to SEQ ID NO: 269121

SEQ ID NO: 597890 - RNA, 64 nt, hsa; identical to SEQ ID NO: 269122

SEQ ID NO: 597891 - RNA, 64 nt, hsa; identical to SEQ ID NO: 269123

SEQ ID NO: 597892 - RNA, 64 nt, hsa; identical to SEQ ID NO: 269124

SEQ ID NO: 597893 - RNA, 64 nt, hsa; identical to SEQ ID NO: 269125

SEQ ID NO: 597894 - RNA, 64 nt, hsa; identical to SEQ ID NO: 269126

SEQ ID NO: 597895 - RNA, 64 nt, hsa; identical to SEQ ID NO: 269127

SEQ ID NO: 597896 - RNA, 64 nt, hsa; identical to SEQ ID NO: 269128

SEQ ID NO: 597897 - RNA, 64 nt, hsa; identical to SEQ ID NO: 269129

SEQ ID NO: 597898 - RNA, 64 nt, hsa; identical to SEQ ID NO: 269130

SEQ ID NO: 597899 - RNA, 64 nt, hsa; identical to SEQ ID NO: 269131

SEQ ID NO: 597900 - RNA, 64 nt, hsa; identical to SEQ ID NO: 269132

SEQ ID NO: 597901 - RNA, 64 nt, hsa; identical to SEQ ID NO: 269133

SEQ ID NO: 597902 - RNA, 64 nt, hsa; identical to SEQ ID NO: 269134

SEQ ID NO: 597903 - RNA, 64 nt, hsa; identical to SEQ ID NO: 269135

SEQ ID NO: 597904 - RNA, 64 nt, hsa; identical to SEQ ID NO: 269136

SEQ ID NO: 597905 - RNA, 64 nt, hsa; identical to SEQ ID NO: 269137

SEQ ID NO: 597906 - RNA, 64 nt, hsa; identical to SEQ ID NO: 269138

SEQ ID NO: 597907 - RNA, 64 nt, hsa; identical to SEQ ID NO: 269139

SEQ ID NO: 597908 - RNA, 64 nt, hsa; identical to SEQ ID NO: 269140

SEQ ID NO: 597909 - RNA, 64 nt, hsa; identical to SEQ ID NO: 269141

SEQ ID NO: 597910 - RNA, 64 nt, hsa; identical to SEQ ID NO: 269142

SEQ ID NO: 597911 - RNA, 64 nt, hsa; identical to SEQ ID NO: 269143

SEQ ID NO: 597912 - RNA, 64 nt, hsa; identical to SEQ ID NO: 269144

SEQ ID NO: 597913 - RNA, 64 nt, hsa; identical to SEQ ID NO: 269145

SEQ ID NO: 597914 - RNA, 64 nt, hsa; identical to SEQ ID NO: 269146

SEQ ID NO: 597915 - RNA, 64 nt, hsa; identical to SEQ ID NO: 269147

SEQ ID NO: 597916 - RNA, 64 nt, hsa; identical to SEQ ID NO: 269148

SEQ ID NO: 597917 - RNA, 64 nt, hsa; identical to SEQ ID NO: 269149

SEQ ID NO: 597918 - RNA, 64 nt, hsa; identical to SEQ ID NO: 269150

SEQ ID NO: 597919 - RNA, 64 nt, hsa; identical to SEQ ID NO: 269151

SEQ ID NO: 597920 - RNA, 64 nt, hsa; identical to SEQ ID NO: 269152

SEQ ID NO: 597921 - RNA, 64 nt, hsa; identical to SEQ ID NO: 269153

SEQ ID NO: 597922 - RNA, 64 nt, hsa; identical to SEQ ID NO: 269154

SEQ ID NO: 597923 - RNA, 64 nt, hsa; identical to SEQ ID NO: 269155

SEQ ID NO: 597924 - RNA, 64 nt, hsa; identical to SEQ ID NO: 269156

SEQ ID NO: 597925 - RNA, 64 nt, hsa; identical to SEQ ID NO: 269157

SEQ ID NO: 597926 - RNA, 64 nt, hsa; identical to SEQ ID NO: 269158

SEQ ID NO: 597927 - RNA, 64 nt, hsa; identical to SEQ ID NO: 269159

SEQ ID NO: 597928 - RNA, 64 nt, hsa; identical to SEQ ID NO: 269160

SEQ ID NO: 597929 - RNA, 64 nt, hsa; identical to SEQ ID NO: 269161

SEQ ID NO: 597930 - RNA, 64 nt, hsa; identical to SEQ ID NO: 269162

SEQ ID NO: 597931 - RNA, 64 nt, hsa; identical to SEQ ID NO: 269163

SEQ ID NO: 597932 - RNA, 64 nt, hsa; identical to SEQ ID NO: 269164

SEQ ID NO: 597933 - RNA, 64 nt, hsa; identical to SEQ ID NO: 269165

SEQ ID NO: 597934 - RNA, 64 nt, hsa; identical to SEQ ID NO: 269166

SEQ ID NO: 597935 - RNA, 64 nt, hsa; identical to SEQ ID NO: 269167

SEQ ID NO: 597936 - RNA, 64 nt, hsa; identical to SEQ ID NO: 269168

SEQ ID NO: 597937 - RNA, 64 nt, hsa; identical to SEQ ID NO: 269169

SEQ ID NO: 597938 - RNA, 64 nt, hsa; identical to SEQ ID NO: 269170

SEQ ID NO: 597939 - RNA, 64 nt, hsa; identical to SEQ ID NO: 269171

SEQ ID NO: 597940 - RNA, 64 nt, hsa; identical to SEQ ID NO: 269172

SEQ ID NO: 597941 - RNA, 64 nt, hsa; identical to SEQ ID NO: 269173

SEQ ID NO: 597942 - RNA, 64 nt, hsa; identical to SEQ ID NO: 269174

SEQ ID NO: 597943 - RNA, 64 nt, hsa; identical to SEQ ID NO: 269175

SEQ ID NO: 597944 - RNA, 64 nt, hsa; identical to SEQ ID NO: 269176

SEQ ID NO: 597945 - RNA, 64 nt, hsa; identical to SEQ ID NO: 269177

SEQ ID NO: 597946 - RNA, 64 nt, hsa; identical to SEQ ID NO: 269178

SEQ ID NO: 597947 - RNA, 64 nt, hsa; identical to SEQ ID NO: 269179

SEQ ID NO: 597948 - RNA, 64 nt, hsa; identical to SEQ ID NO: 269180

SEQ ID NO: 597949 - RNA, 64 nt, hsa; identical to SEQ ID NO: 269181

SEQ ID NO: 597950 - RNA, 64 nt, hsa; identical to SEQ ID NO: 269182

SEQ ID NO: 597951 - RNA, 64 nt, hsa; identical to SEQ ID NO: 269183

SEQ ID NO: 597952 - RNA, 64 nt, hsa; identical to SEQ ID NO: 269184

SEQ ID NO: 597953 - RNA, 64 nt, hsa; identical to SEQ ID NO: 269185

SEQ ID NO: 597954 - RNA, 64 nt, hsa; identical to SEQ ID NO: 269186

SEQ ID NO: 597955 - RNA, 64 nt, hsa; identical to SEQ ID NO: 269187

SEQ ID NO: 597956 - RNA, 64 nt, hsa; identical to SEQ ID NO: 269188

SEQ ID NO: 597957 - RNA, 64 nt, hsa; identical to SEQ ID NO: 269189

SEQ ID NO: 597958 - RNA, 64 nt, hsa; identical to SEQ ID NO: 269190

SEQ ID NO: 597959 - RNA, 64 nt, hsa; identical to SEQ ID NO: 269191

SEQ ID NO: 597960 - RNA, 64 nt, hsa; identical to SEQ ID NO: 269192

SEQ ID NO: 597961 - RNA, 64 nt, hsa; identical to SEQ ID NO: 269193

SEQ ID NO: 597962 - RNA, 64 nt, hsa; identical to SEQ ID NO: 269194

SEQ ID NO: 597963 - RNA, 64 nt, hsa; identical to SEQ ID NO: 269195

SEQ ID NO: 597964 - RNA, 64 nt, hsa; identical to SEQ ID NO: 269196

SEQ ID NO: 597965 - RNA, 64 nt, hsa; identical to SEQ ID NO: 269197

SEQ ID NO: 597966 - RNA, 64 nt, hsa; identical to SEQ ID NO: 269198

SEQ ID NO: 597967 - RNA, 64 nt, hsa; identical to SEQ ID NO: 269199

SEQ ID NO: 597968 - RNA, 64 nt, hsa; identical to SEQ ID NO: 269200

SEQ ID NO: 597969 - RNA, 64 nt, hsa; identical to SEQ ID NO: 269201

SEQ ID NO: 597970 - RNA, 64 nt, hsa; identical to SEQ ID NO: 269202

SEQ ID NO: 597971 - RNA, 64 nt, hsa; identical to SEQ ID NO: 269203

SEQ ID NO: 597972 - RNA, 64 nt, hsa; identical to SEQ ID NO: 269204

SEQ ID NO: 597973 - RNA, 64 nt, hsa; identical to SEQ ID NO: 269205

SEQ ID NO: 597974 - RNA, 64 nt, hsa; identical to SEQ ID NO: 269206

SEQ ID NO: 597975 - RNA, 64 nt, hsa; identical to SEQ ID NO: 269207

SEQ ID NO: 597976 - RNA, 64 nt, hsa; identical to SEQ ID NO: 269208

SEQ ID NO: 597977 - RNA, 64 nt, hsa; identical to SEQ ID NO: 269209

SEQ ID NO: 597978 - RNA, 64 nt, hsa; identical to SEQ ID NO: 269210

SEQ ID NO: 597979 - RNA, 64 nt, hsa; identical to SEQ ID NO: 269211

SEQ ID NO: 597980 - RNA, 64 nt, hsa; identical to SEQ ID NO: 269212

SEQ ID NO: 597981 - RNA, 64 nt, hsa; identical to SEQ ID NO: 269213

SEQ ID NO: 597982 - RNA, 64 nt, hsa; identical to SEQ ID NO: 269214

SEQ ID NO: 597983 - RNA, 64 nt, hsa; identical to SEQ ID NO: 269215

SEQ ID NO: 597984 - RNA, 64 nt, hsa; identical to SEQ ID NO: 269216

SEQ ID NO: 597985 - RNA, 64 nt, hsa; identical to SEQ ID NO: 269217

SEQ ID NO: 597986 - RNA, 64 nt, hsa; identical to SEQ ID NO: 269218

SEQ ID NO: 597987 - RNA, 64 nt, hsa; identical to SEQ ID NO: 269219

SEQ ID NO: 597988 - RNA, 64 nt, hsa; identical to SEQ ID NO: 269220

SEQ ID NO: 597989 - RNA, 64 nt, hsa; identical to SEQ ID NO: 269221

SEQ ID NO: 597990 - RNA, 64 nt, hsa; identical to SEQ ID NO: 269222

SEQ ID NO: 597991 - RNA, 64 nt, hsa; identical to SEQ ID NO: 269223

SEQ ID NO: 597992 - RNA, 64 nt, hsa; identical to SEQ ID NO: 269224

SEQ ID NO: 597993 - RNA, 64 nt, hsa; identical to SEQ ID NO: 269225

SEQ ID NO: 597994 - RNA, 64 nt, hsa; identical to SEQ ID NO: 269226

SEQ ID NO: 597995 - RNA, 64 nt, hsa; identical to SEQ ID NO: 269227

SEQ ID NO: 597996 - RNA, 64 nt, hsa; identical to SEQ ID NO: 269228

SEQ ID NO: 597997 - RNA, 64 nt, hsa; identical to SEQ ID NO: 269229

SEQ ID NO: 597998 - RNA, 64 nt, hsa; identical to SEQ ID NO: 269230

SEQ ID NO: 597999 - RNA, 64 nt, hsa; identical to SEQ ID NO: 269231

SEQ ID NO: 598000 - RNA, 64 nt, hsa; identical to SEQ ID NO: 269232

SEQ ID NO: 598001 - RNA, 64 nt, hsa; identical to SEQ ID NO: 269233

SEQ ID NO: 598002 - RNA, 64 nt, hsa; identical to SEQ ID NO: 269234

SEQ ID NO: 598003 - RNA, 64 nt, hsa; identical to SEQ ID NO: 269235

SEQ ID NO: 598004 - RNA, 64 nt, hsa; identical to SEQ ID NO: 269236

SEQ ID NO: 598005 - RNA, 64 nt, hsa; identical to SEQ ID NO: 269237

SEQ ID NO: 598006 - RNA, 64 nt, hsa; identical to SEQ ID NO: 269238

SEQ ID NO: 598007 - RNA, 64 nt, hsa; identical to SEQ ID NO: 269239

SEQ ID NO: 598008 - RNA, 64 nt, hsa; identical to SEQ ID NO: 269240

SEQ ID NO: 598009 - RNA, 64 nt, hsa; identical to SEQ ID NO: 269241

SEQ ID NO: 598010 - RNA, 64 nt, hsa; identical to SEQ ID NO: 269242

SEQ ID NO: 598011 - RNA, 64 nt, hsa; identical to SEQ ID NO: 269243

SEQ ID NO: 598012 - RNA, 64 nt, hsa; identical to SEQ ID NO: 269244

SEQ ID NO: 598013 - RNA, 64 nt, hsa; identical to SEQ ID NO: 269245

SEQ ID NO: 598014 - RNA, 64 nt, hsa; identical to SEQ ID NO: 269246

SEQ ID NO: 598015 - RNA, 64 nt, hsa; identical to SEQ ID NO: 269247

SEQ ID NO: 598016 - RNA, 64 nt, hsa; identical to SEQ ID NO: 269248

SEQ ID NO: 598017 - RNA, 64 nt, hsa; identical to SEQ ID NO: 269249

SEQ ID NO: 598018 - RNA, 64 nt, hsa; identical to SEQ ID NO: 269250

SEQ ID NO: 598019 - RNA, 64 nt, hsa; identical to SEQ ID NO: 269251

SEQ ID NO: 598020 - RNA, 64 nt, hsa; identical to SEQ ID NO: 269252

SEQ ID NO: 598021 - RNA, 64 nt, hsa; identical to SEQ ID NO: 269253

SEQ ID NO: 598022 - RNA, 64 nt, hsa; identical to SEQ ID NO: 269254

SEQ ID NO: 598023 - RNA, 64 nt, hsa; identical to SEQ ID NO: 269255

SEQ ID NO: 598024 - RNA, 64 nt, hsa; identical to SEQ ID NO: 269256

SEQ ID NO: 598025 - RNA, 64 nt, hsa; identical to SEQ ID NO: 269257

SEQ ID NO: 598026 - RNA, 64 nt, hsa; identical to SEQ ID NO: 269258

SEQ ID NO: 598027 - RNA, 64 nt, hsa; identical to SEQ ID NO: 269259

SEQ ID NO: 598028 - RNA, 64 nt, hsa; identical to SEQ ID NO: 269260

SEQ ID NO: 598029 - RNA, 64 nt, hsa; identical to SEQ ID NO: 269261

SEQ ID NO: 598030 - RNA, 64 nt, hsa; identical to SEQ ID NO: 269262

SEQ ID NO: 598031 - RNA, 64 nt, hsa; identical to SEQ ID NO: 269263

SEQ ID NO: 598032 - RNA, 64 nt, hsa; identical to SEQ ID NO: 269264

SEQ ID NO: 598033 - RNA, 64 nt, hsa; identical to SEQ ID NO: 269265

SEQ ID NO: 598034 - RNA, 64 nt, hsa; identical to SEQ ID NO: 269266

SEQ ID NO: 598035 - RNA, 64 nt, hsa; identical to SEQ ID NO: 269267

SEQ ID NO: 598036 - RNA, 64 nt, hsa; identical to SEQ ID NO: 269268

SEQ ID NO: 598037 - RNA, 64 nt, hsa; identical to SEQ ID NO: 269269

SEQ ID NO: 598038 - RNA, 64 nt, hsa; identical to SEQ ID NO: 269270

SEQ ID NO: 598039 - RNA, 64 nt, hsa; identical to SEQ ID NO: 269271

SEQ ID NO: 598040 - RNA, 64 nt, hsa; identical to SEQ ID NO: 269272

SEQ ID NO: 598041 - RNA, 64 nt, hsa; identical to SEQ ID NO: 269273

SEQ ID NO: 598042 - RNA, 64 nt, hsa; identical to SEQ ID NO: 269274

SEQ ID NO: 598043 - RNA, 64 nt, hsa; identical to SEQ ID NO: 269275

SEQ ID NO: 598044 - RNA, 64 nt, hsa; identical to SEQ ID NO: 269276

SEQ ID NO: 598045 - RNA, 64 nt, hsa; identical to SEQ ID NO: 269277

SEQ ID NO: 598046 - RNA, 64 nt, hsa; identical to SEQ ID NO: 269278

SEQ ID NO: 598047 - RNA, 64 nt, hsa; identical to SEQ ID NO: 269279

SEQ ID NO: 598048 - RNA, 64 nt, hsa; identical to SEQ ID NO: 269280

SEQ ID NO: 598049 - RNA, 64 nt, hsa; identical to SEQ ID NO: 269281

SEQ ID NO: 598050 - RNA, 64 nt, hsa; identical to SEQ ID NO: 269282

SEQ ID NO: 598051 - RNA, 64 nt, hsa; identical to SEQ ID NO: 269283

SEQ ID NO: 598052 - RNA, 64 nt, hsa; identical to SEQ ID NO: 269284

SEQ ID NO: 598053 - RNA, 64 nt, hsa; identical to SEQ ID NO: 269285

SEQ ID NO: 598054 - RNA, 64 nt, hsa; identical to SEQ ID NO: 269286

SEQ ID NO: 598055 - RNA, 64 nt, hsa; identical to SEQ ID NO: 269287

SEQ ID NO: 598056 - RNA, 64 nt, hsa; identical to SEQ ID NO: 269288

SEQ ID NO: 598057 - RNA, 64 nt, hsa; identical to SEQ ID NO: 269289

SEQ ID NO: 598058 - RNA, 64 nt, hsa; identical to SEQ ID NO: 269290

SEQ ID NO: 598059 - RNA, 64 nt, hsa; identical to SEQ ID NO: 269291

SEQ ID NO: 598060 - RNA, 64 nt, hsa; identical to SEQ ID NO: 269292

SEQ ID NO: 598061 - RNA, 64 nt, hsa; identical to SEQ ID NO: 269293

SEQ ID NO: 598062 - RNA, 64 nt, hsa; identical to SEQ ID NO: 269294

SEQ ID NO: 598063 - RNA, 64 nt, hsa; identical to SEQ ID NO: 269295

SEQ ID NO: 598064 - RNA, 64 nt, hsa; identical to SEQ ID NO: 269296

SEQ ID NO: 598065 - RNA, 64 nt, hsa; identical to SEQ ID NO: 269297

SEQ ID NO: 598066 - RNA, 64 nt, hsa; identical to SEQ ID NO: 269298

SEQ ID NO: 598067 - RNA, 64 nt, hsa; identical to SEQ ID NO: 269299

SEQ ID NO: 598068 - RNA, 64 nt, hsa; identical to SEQ ID NO: 269300

SEQ ID NO: 598069 - RNA, 64 nt, hsa; identical to SEQ ID NO: 269301

SEQ ID NO: 598070 - RNA, 64 nt, hsa; identical to SEQ ID NO: 269302

SEQ ID NO: 598071 - RNA, 64 nt, hsa; identical to SEQ ID NO: 269303

SEQ ID NO: 598072 - RNA, 64 nt, hsa; identical to SEQ ID NO: 269304

SEQ ID NO: 598073 - RNA, 64 nt, hsa; identical to SEQ ID NO: 269305

SEQ ID NO: 598074 - RNA, 64 nt, hsa; identical to SEQ ID NO: 269306

SEQ ID NO: 598075 - RNA, 64 nt, hsa; identical to SEQ ID NO: 269307

SEQ ID NO: 598076 - RNA, 64 nt, hsa; identical to SEQ ID NO: 269308

SEQ ID NO: 598077 - RNA, 64 nt, hsa; identical to SEQ ID NO: 269309

SEQ ID NO: 598078 - RNA, 64 nt, hsa; identical to SEQ ID NO: 269310

SEQ ID NO: 598079 - RNA, 64 nt, hsa; identical to SEQ ID NO: 269311

SEQ ID NO: 598080 - RNA, 64 nt, hsa; identical to SEQ ID NO: 269312

SEQ ID NO: 598081 - RNA, 64 nt, hsa; identical to SEQ ID NO: 269313

SEQ ID NO: 598082 - RNA, 64 nt, hsa; identical to SEQ ID NO: 269314

SEQ ID NO: 598083 - RNA, 64 nt, hsa; identical to SEQ ID NO: 269315

SEQ ID NO: 598084 - RNA, 64 nt, hsa; identical to SEQ ID NO: 269316

SEQ ID NO: 598085 - RNA, 64 nt, hsa; identical to SEQ ID NO: 269317

SEQ ID NO: 598086 - RNA, 64 nt, hsa; identical to SEQ ID NO: 269318

SEQ ID NO: 598087 - RNA, 64 nt, hsa; identical to SEQ ID NO: 269319

SEQ ID NO: 598088 - RNA, 64 nt, hsa; identical to SEQ ID NO: 269320

SEQ ID NO: 598089 - RNA, 64 nt, hsa; identical to SEQ ID NO: 269321

SEQ ID NO: 598090 - RNA, 64 nt, hsa; identical to SEQ ID NO: 269322

SEQ ID NO: 598091 - RNA, 64 nt, hsa; identical to SEQ ID NO: 269323

SEQ ID NO: 598092 - RNA, 64 nt, hsa; identical to SEQ ID NO: 269324

SEQ ID NO: 598093 - RNA, 64 nt, hsa; identical to SEQ ID NO: 269325

SEQ ID NO: 598094 - RNA, 64 nt, hsa; identical to SEQ ID NO: 269326

SEQ ID NO: 598095 - RNA, 64 nt, hsa; identical to SEQ ID NO: 269327

SEQ ID NO: 598096 - RNA, 64 nt, hsa; identical to SEQ ID NO: 269328

SEQ ID NO: 598097 - RNA, 64 nt, hsa; identical to SEQ ID NO: 269329

SEQ ID NO: 598098 - RNA, 64 nt, hsa; identical to SEQ ID NO: 269330

SEQ ID NO: 598099 - RNA, 64 nt, hsa; identical to SEQ ID NO: 269331

SEQ ID NO: 598100 - RNA, 64 nt, hsa; identical to SEQ ID NO: 269332

SEQ ID NO: 598101 - RNA, 64 nt, hsa; identical to SEQ ID NO: 269333

SEQ ID NO: 598102 - RNA, 64 nt, hsa; identical to SEQ ID NO: 269334

SEQ ID NO: 598103 - RNA, 64 nt, hsa; identical to SEQ ID NO: 269335

SEQ ID NO: 598104 - RNA, 64 nt, hsa; identical to SEQ ID NO: 269336

SEQ ID NO: 598105 - RNA, 64 nt, hsa; identical to SEQ ID NO: 269337

SEQ ID NO: 598106 - RNA, 64 nt, hsa; identical to SEQ ID NO: 269338

SEQ ID NO: 598107 - RNA, 64 nt, hsa; identical to SEQ ID NO: 269339

SEQ ID NO: 598108 - RNA, 64 nt, hsa; identical to SEQ ID NO: 269340

SEQ ID NO: 598109 - RNA, 64 nt, hsa; identical to SEQ ID NO: 269341

SEQ ID NO: 598110 - RNA, 64 nt, hsa; identical to SEQ ID NO: 269342

SEQ ID NO: 598111 - RNA, 64 nt, hsa; identical to SEQ ID NO: 269343

SEQ ID NO: 598112 - RNA, 64 nt, hsa; identical to SEQ ID NO: 269344

SEQ ID NO: 598113 - RNA, 64 nt, hsa; identical to SEQ ID NO: 269345

SEQ ID NO: 598114 - RNA, 64 nt, hsa; identical to SEQ ID NO: 269346

SEQ ID NO: 598115 - RNA, 64 nt, hsa; identical to SEQ ID NO: 269347

SEQ ID NO: 598116 - RNA, 64 nt, hsa; identical to SEQ ID NO: 269348

SEQ ID NO: 598117 - RNA, 64 nt, hsa; identical to SEQ ID NO: 269349

SEQ ID NO: 598118 - RNA, 64 nt, hsa; identical to SEQ ID NO: 269350

SEQ ID NO: 598119 - RNA, 64 nt, hsa; identical to SEQ ID NO: 269351

SEQ ID NO: 598120 - RNA, 64 nt, hsa; identical to SEQ ID NO: 269352

SEQ ID NO: 598121 - RNA, 64 nt, hsa; identical to SEQ ID NO: 269353

SEQ ID NO: 598122 - RNA, 64 nt, hsa; identical to SEQ ID NO: 269354

SEQ ID NO: 598123 - RNA, 64 nt, hsa; identical to SEQ ID NO: 269355

SEQ ID NO: 598124 - RNA, 64 nt, hsa; identical to SEQ ID NO: 269356

SEQ ID NO: 598125 - RNA, 64 nt, hsa; identical to SEQ ID NO: 269357

SEQ ID NO: 598126 - RNA, 64 nt, hsa; identical to SEQ ID NO: 269358

SEQ ID NO: 598127 - RNA, 64 nt, hsa; identical to SEQ ID NO: 269359

SEQ ID NO: 598128 - RNA, 64 nt, hsa; identical to SEQ ID NO: 269360

SEQ ID NO: 598129 - RNA, 64 nt, hsa; identical to SEQ ID NO: 269361

SEQ ID NO: 598130 - RNA, 64 nt, hsa; identical to SEQ ID NO: 269362

SEQ ID NO: 598131 - RNA, 64 nt, hsa; identical to SEQ ID NO: 269363

SEQ ID NO: 598132 - RNA, 64 nt, hsa; identical to SEQ ID NO: 269364

SEQ ID NO: 598133 - RNA, 64 nt, hsa; identical to SEQ ID NO: 269365

SEQ ID NO: 598134 - RNA, 64 nt, hsa; identical to SEQ ID NO: 269366

SEQ ID NO: 598135 - RNA, 64 nt, hsa; identical to SEQ ID NO: 269367

SEQ ID NO: 598136 - RNA, 64 nt, hsa; identical to SEQ ID NO: 269368

SEQ ID NO: 598137 - RNA, 64 nt, hsa; identical to SEQ ID NO: 269369

SEQ ID NO: 598138 - RNA, 64 nt, hsa; identical to SEQ ID NO: 269370

SEQ ID NO: 598139 - RNA, 64 nt, hsa; identical to SEQ ID NO: 269371

SEQ ID NO: 598140 - RNA, 64 nt, hsa; identical to SEQ ID NO: 269372

SEQ ID NO: 598141 - RNA, 64 nt, hsa; identical to SEQ ID NO: 269373

SEQ ID NO: 598142 - RNA, 64 nt, hsa; identical to SEQ ID NO: 269374

SEQ ID NO: 598143 - RNA, 64 nt, hsa; identical to SEQ ID NO: 269375

SEQ ID NO: 598144 - RNA, 64 nt, hsa; identical to SEQ ID NO: 269376

SEQ ID NO: 598145 - RNA, 64 nt, hsa; identical to SEQ ID NO: 269377

SEQ ID NO: 598146 - RNA, 64 nt, hsa; identical to SEQ ID NO: 269378

SEQ ID NO: 598147 - RNA, 64 nt, hsa; identical to SEQ ID NO: 269379

SEQ ID NO: 598148 - RNA, 64 nt, hsa; identical to SEQ ID NO: 269380

SEQ ID NO: 598149 - RNA, 64 nt, hsa; identical to SEQ ID NO: 269381

SEQ ID NO: 598150 - RNA, 64 nt, hsa; identical to SEQ ID NO: 269382

SEQ ID NO: 598151 - RNA, 64 nt, hsa; identical to SEQ ID NO: 269383

SEQ ID NO: 598152 - RNA, 64 nt, hsa; identical to SEQ ID NO: 269384

SEQ ID NO: 598153 - RNA, 64 nt, hsa; identical to SEQ ID NO: 269385

SEQ ID NO: 598154 - RNA, 64 nt, hsa; identical to SEQ ID NO: 269386

SEQ ID NO: 598155 - RNA, 64 nt, hsa; identical to SEQ ID NO: 269387

SEQ ID NO: 598156 - RNA, 64 nt, hsa; identical to SEQ ID NO: 269388

SEQ ID NO: 598157 - RNA, 64 nt, hsa; identical to SEQ ID NO: 269389

SEQ ID NO: 598158 - RNA, 64 nt, hsa; identical to SEQ ID NO: 269390

SEQ ID NO: 598159 - RNA, 64 nt, hsa; identical to SEQ ID NO: 269391

SEQ ID NO: 598160 - RNA, 64 nt, hsa; identical to SEQ ID NO: 269392

SEQ ID NO: 598161 - RNA, 64 nt, hsa; identical to SEQ ID NO: 269393

SEQ ID NO: 598162 - RNA, 64 nt, hsa; identical to SEQ ID NO: 269394

SEQ ID NO: 598163 - RNA, 64 nt, hsa; identical to SEQ ID NO: 269395

SEQ ID NO: 598164 - RNA, 64 nt, hsa; identical to SEQ ID NO: 269396

SEQ ID NO: 598165 - RNA, 64 nt, hsa; identical to SEQ ID NO: 269397

SEQ ID NO: 598166 - RNA, 64 nt, hsa; identical to SEQ ID NO: 269398

SEQ ID NO: 598167 - RNA, 64 nt, hsa; identical to SEQ ID NO: 269399

SEQ ID NO: 598168 - RNA, 64 nt, hsa; identical to SEQ ID NO: 269400

SEQ ID NO: 598169 - RNA, 64 nt, hsa; identical to SEQ ID NO: 269401

SEQ ID NO: 598170 - RNA, 64 nt, hsa; identical to SEQ ID NO: 269402

SEQ ID NO: 598171 - RNA, 64 nt, hsa; identical to SEQ ID NO: 269403

SEQ ID NO: 598172 - RNA, 64 nt, hsa; identical to SEQ ID NO: 269404

SEQ ID NO: 598173 - RNA, 64 nt, hsa; identical to SEQ ID NO: 269405

SEQ ID NO: 598174 - RNA, 64 nt, hsa; identical to SEQ ID NO: 269406

SEQ ID NO: 598175 - RNA, 64 nt, hsa; identical to SEQ ID NO: 269407

SEQ ID NO: 598176 - RNA, 64 nt, hsa; identical to SEQ ID NO: 269408

SEQ ID NO: 598177 - RNA, 64 nt, hsa; identical to SEQ ID NO: 269409

SEQ ID NO: 598178 - RNA, 64 nt, hsa; identical to SEQ ID NO: 269410

SEQ ID NO: 598179 - RNA, 64 nt, hsa; identical to SEQ ID NO: 269411

SEQ ID NO: 598180 - RNA, 64 nt, hsa; identical to SEQ ID NO: 269412

SEQ ID NO: 598181 - RNA, 64 nt, hsa; identical to SEQ ID NO: 269413

SEQ ID NO: 598182 - RNA, 64 nt, hsa; identical to SEQ ID NO: 269414

SEQ ID NO: 598183 - RNA, 64 nt, hsa; identical to SEQ ID NO: 269415

SEQ ID NO: 598184 - RNA, 64 nt, hsa; identical to SEQ ID NO: 269416

SEQ ID NO: 598185 - RNA, 64 nt, hsa; identical to SEQ ID NO: 269417

SEQ ID NO: 598186 - RNA, 64 nt, hsa; identical to SEQ ID NO: 269418

SEQ ID NO: 598187 - RNA, 64 nt, hsa; identical to SEQ ID NO: 269419

SEQ ID NO: 598188 - RNA, 64 nt, hsa; identical to SEQ ID NO: 269420

SEQ ID NO: 598189 - RNA, 64 nt, hsa; identical to SEQ ID NO: 269421

SEQ ID NO: 598190 - RNA, 64 nt, hsa; identical to SEQ ID NO: 269422

SEQ ID NO: 598191 - RNA, 64 nt, hsa; identical to SEQ ID NO: 269423

SEQ ID NO: 598192 - RNA, 64 nt, hsa; identical to SEQ ID NO: 269424

SEQ ID NO: 598193 - RNA, 64 nt, hsa; identical to SEQ ID NO: 269425

SEQ ID NO: 598194 - RNA, 64 nt, hsa; identical to SEQ ID NO: 269426

SEQ ID NO: 598195 - RNA, 64 nt, hsa; identical to SEQ ID NO: 269427

SEQ ID NO: 598196 - RNA, 64 nt, hsa; identical to SEQ ID NO: 269428

SEQ ID NO: 598197 - RNA, 64 nt, hsa; identical to SEQ ID NO: 269429

SEQ ID NO: 598198 - RNA, 56 nt, hsa; identical to SEQ ID NO: 269430

SEQ ID NO: 598199 - RNA, 64 nt, hsa; identical to SEQ ID NO: 269431

SEQ ID NO: 598200 - RNA, 64 nt, hsa; identical to SEQ ID NO: 269432

SEQ ID NO: 598201 - RNA, 64 nt, hsa; identical to SEQ ID NO: 269433

SEQ ID NO: 598202 - RNA, 64 nt, hsa; identical to SEQ ID NO: 269434

SEQ ID NO: 598203 - RNA, 64 nt, hsa; identical to SEQ ID NO: 269435

SEQ ID NO: 598204 - RNA, 64 nt, hsa; identical to SEQ ID NO: 269436

SEQ ID NO: 598205 - RNA, 64 nt, hsa; identical to SEQ ID NO: 269437

SEQ ID NO: 598206 - RNA, 64 nt, hsa; identical to SEQ ID NO: 269438

SEQ ID NO: 598207 - RNA, 64 nt, hsa; identical to SEQ ID NO: 269439

SEQ ID NO: 598208 - RNA, 64 nt, hsa; identical to SEQ ID NO: 269440

SEQ ID NO: 598209 - RNA, 64 nt, hsa; identical to SEQ ID NO: 269441

SEQ ID NO: 598210 - RNA, 64 nt, hsa; identical to SEQ ID NO: 269442

SEQ ID NO: 598211 - RNA, 64 nt, hsa; identical to SEQ ID NO: 269443

SEQ ID NO: 598212 - RNA, 64 nt, hsa; identical to SEQ ID NO: 269444

SEQ ID NO: 598213 - RNA, 64 nt, hsa; identical to SEQ ID NO: 269445

SEQ ID NO: 598214 - RNA, 64 nt, hsa; identical to SEQ ID NO: 269446

SEQ ID NO: 598215 - RNA, 64 nt, hsa; identical to SEQ ID NO: 269447

SEQ ID NO: 598216 - RNA, 64 nt, hsa; identical to SEQ ID NO: 269448

SEQ ID NO: 598217 - RNA, 64 nt, hsa; identical to SEQ ID NO: 269449

SEQ ID NO: 598218 - RNA, 64 nt, hsa; identical to SEQ ID NO: 269450

SEQ ID NO: 598219 - RNA, 64 nt, hsa; identical to SEQ ID NO: 269451

SEQ ID NO: 598220 - RNA, 64 nt, hsa; identical to SEQ ID NO: 269452

SEQ ID NO: 598221 - RNA, 64 nt, hsa; identical to SEQ ID NO: 269453

SEQ ID NO: 598222 - RNA, 64 nt, hsa; identical to SEQ ID NO: 269454

SEQ ID NO: 598223 - RNA, 64 nt, hsa; identical to SEQ ID NO: 269455

SEQ ID NO: 598224 - RNA, 64 nt, hsa; identical to SEQ ID NO: 269456

SEQ ID NO: 598225 - RNA, 64 nt, hsa; identical to SEQ ID NO: 269457

SEQ ID NO: 598226 - RNA, 64 nt, hsa; identical to SEQ ID NO: 269458

SEQ ID NO: 598227 - RNA, 64 nt, hsa; identical to SEQ ID NO: 269459

SEQ ID NO: 598228 - RNA, 64 nt, hsa; identical to SEQ ID NO: 269460

SEQ ID NO: 598229 - RNA, 64 nt, hsa; identical to SEQ ID NO: 269461

SEQ ID NO: 598230 - RNA, 64 nt, hsa; identical to SEQ ID NO: 269462

SEQ ID NO: 598231 - RNA, 64 nt, hsa; identical to SEQ ID NO: 269463

SEQ ID NO: 598232 - RNA, 64 nt, hsa; identical to SEQ ID NO: 269464

SEQ ID NO: 598233 - RNA, 64 nt, hsa; identical to SEQ ID NO: 269465

SEQ ID NO: 598234 - RNA, 64 nt, hsa; identical to SEQ ID NO: 269466

SEQ ID NO: 598235 - RNA, 64 nt, hsa; identical to SEQ ID NO: 269467

SEQ ID NO: 598236 - RNA, 64 nt, hsa; identical to SEQ ID NO: 269468

SEQ ID NO: 598237 - RNA, 64 nt, hsa; identical to SEQ ID NO: 269469

SEQ ID NO: 598238 - RNA, 64 nt, hsa; identical to SEQ ID NO: 269470

SEQ ID NO: 598239 - RNA, 56 nt, hsa; identical to SEQ ID NO: 269471

SEQ ID NO: 598240 - RNA, 64 nt, hsa; identical to SEQ ID NO: 269472

SEQ ID NO: 598241 - RNA, 64 nt, hsa; identical to SEQ ID NO: 269473

SEQ ID NO: 598242 - RNA, 64 nt, hsa; identical to SEQ ID NO: 269474

SEQ ID NO: 598243 - RNA, 64 nt, hsa; identical to SEQ ID NO: 269475

SEQ ID NO: 598244 - RNA, 64 nt, hsa; identical to SEQ ID NO: 269476

SEQ ID NO: 598245 - RNA, 64 nt, hsa; identical to SEQ ID NO: 269477

SEQ ID NO: 598246 - RNA, 64 nt, hsa; identical to SEQ ID NO: 269478

SEQ ID NO: 598247 - RNA, 64 nt, hsa; identical to SEQ ID NO: 269479

SEQ ID NO: 598248 - RNA, 64 nt, hsa; identical to SEQ ID NO: 269480

SEQ ID NO: 598249 - RNA, 64 nt, hsa; identical to SEQ ID NO: 269481

SEQ ID NO: 598250 - RNA, 64 nt, hsa; identical to SEQ ID NO: 269482

SEQ ID NO: 598251 - RNA, 64 nt, hsa; identical to SEQ ID NO: 269483

SEQ ID NO: 598252 - RNA, 64 nt, hsa; identical to SEQ ID NO: 269484

SEQ ID NO: 598253 - RNA, 64 nt, hsa; identical to SEQ ID NO: 269485

SEQ ID NO: 598254 - RNA, 64 nt, hsa; identical to SEQ ID NO: 269486

SEQ ID NO: 598255 - RNA, 64 nt, hsa; identical to SEQ ID NO: 269487

SEQ ID NO: 598256 - RNA, 64 nt, hsa; identical to SEQ ID NO: 269488

SEQ ID NO: 598257 - RNA, 64 nt, hsa; identical to SEQ ID NO: 269489

SEQ ID NO: 598258 - RNA, 64 nt, hsa; identical to SEQ ID NO: 269490

SEQ ID NO: 598259 - RNA, 64 nt, hsa; identical to SEQ ID NO: 269491

SEQ ID NO: 598260 - RNA, 64 nt, hsa; identical to SEQ ID NO: 269492

SEQ ID NO: 598261 - RNA, 64 nt, hsa; identical to SEQ ID NO: 269493

SEQ ID NO: 598262 - RNA, 64 nt, hsa; identical to SEQ ID NO: 269494

SEQ ID NO: 598263 - RNA, 64 nt, hsa; identical to SEQ ID NO: 269495

SEQ ID NO: 598264 - RNA, 64 nt, hsa; identical to SEQ ID NO: 269496

SEQ ID NO: 598265 - RNA, 64 nt, hsa; identical to SEQ ID NO: 269497

SEQ ID NO: 598266 - RNA, 64 nt, hsa; identical to SEQ ID NO: 269498

SEQ ID NO: 598267 - RNA, 64 nt, hsa; identical to SEQ ID NO: 269499

SEQ ID NO: 598268 - RNA, 64 nt, hsa; identical to SEQ ID NO: 269500

SEQ ID NO: 598269 - RNA, 64 nt, hsa; identical to SEQ ID NO: 269501

SEQ ID NO: 598270 - RNA, 64 nt, hsa; identical to SEQ ID NO: 269502

SEQ ID NO: 598271 - RNA, 64 nt, hsa; identical to SEQ ID NO: 269503

SEQ ID NO: 598272 - RNA, 64 nt, hsa; identical to SEQ ID NO: 269504

SEQ ID NO: 598273 - RNA, 64 nt, hsa; identical to SEQ ID NO: 269505

SEQ ID NO: 598274 - RNA, 64 nt, hsa; identical to SEQ ID NO: 269506

SEQ ID NO: 598275 - RNA, 64 nt, hsa; identical to SEQ ID NO: 269507

SEQ ID NO: 598276 - RNA, 64 nt, hsa; identical to SEQ ID NO: 269476

SEQ ID NO: 598277 - RNA, 64 nt, hsa; identical to SEQ ID NO: 269509

SEQ ID NO: 598278 - RNA, 64 nt, hsa; identical to SEQ ID NO: 269510

SEQ ID NO: 598279 - RNA, 64 nt, hsa; identical to SEQ ID NO: 269511

SEQ ID NO: 598280 - RNA, 64 nt, hsa; identical to SEQ ID NO: 269512

SEQ ID NO: 598281 - RNA, 64 nt, hsa; identical to SEQ ID NO: 269513

SEQ ID NO: 598282 - RNA, 64 nt, hsa; identical to SEQ ID NO: 269514

SEQ ID NO: 598283 - RNA, 64 nt, hsa; identical to SEQ ID NO: 269515

SEQ ID NO: 598284 - RNA, 64 nt, hsa; identical to SEQ ID NO: 269516

SEQ ID NO: 598285 - RNA, 64 nt, hsa; identical to SEQ ID NO: 269517

SEQ ID NO: 598286 - RNA, 64 nt, hsa; identical to SEQ ID NO: 269518

SEQ ID NO: 598287 - RNA, 64 nt, hsa; identical to SEQ ID NO: 269519

SEQ ID NO: 598288 - RNA, 64 nt, hsa; identical to SEQ ID NO: 269520

SEQ ID NO: 598289 - RNA, 64 nt, hsa; identical to SEQ ID NO: 269521

SEQ ID NO: 598290 - RNA, 64 nt, hsa; identical to SEQ ID NO: 269522

SEQ ID NO: 598291 - RNA, 64 nt, hsa; identical to SEQ ID NO: 269523

SEQ ID NO: 598292 - RNA, 64 nt, hsa; identical to SEQ ID NO: 269524

SEQ ID NO: 598293 - RNA, 64 nt, hsa; identical to SEQ ID NO: 269525

SEQ ID NO: 598294 - RNA, 64 nt, hsa; identical to SEQ ID NO: 269526

SEQ ID NO: 598295 - RNA, 64 nt, hsa; identical to SEQ ID NO: 269527

SEQ ID NO: 598296 - RNA, 64 nt, hsa; identical to SEQ ID NO: 269528

SEQ ID NO: 598297 - RNA, 64 nt, hsa; identical to SEQ ID NO: 269529

SEQ ID NO: 598298 - RNA, 64 nt, hsa; identical to SEQ ID NO: 269530

SEQ ID NO: 598299 - RNA, 64 nt, hsa; identical to SEQ ID NO: 269531

SEQ ID NO: 598300 - RNA, 64 nt, hsa; identical to SEQ ID NO: 269532

SEQ ID NO: 598301 - RNA, 64 nt, hsa; identical to SEQ ID NO: 269533

SEQ ID NO: 598302 - RNA, 64 nt, hsa; identical to SEQ ID NO: 269534

SEQ ID NO: 598303 - RNA, 64 nt, hsa; identical to SEQ ID NO: 269535

SEQ ID NO: 598304 - RNA, 64 nt, hsa; identical to SEQ ID NO: 269536

SEQ ID NO: 598305 - RNA, 64 nt, hsa; identical to SEQ ID NO: 269537

SEQ ID NO: 598306 - RNA, 64 nt, hsa; identical to SEQ ID NO: 269538

SEQ ID NO: 598307 - RNA, 64 nt, hsa; identical to SEQ ID NO: 269539

SEQ ID NO: 598308 - RNA, 64 nt, hsa; identical to SEQ ID NO: 269540

SEQ ID NO: 598309 - RNA, 64 nt, hsa; identical to SEQ ID NO: 269541

SEQ ID NO: 598310 - RNA, 64 nt, hsa; identical to SEQ ID NO: 269542

SEQ ID NO: 598311 - RNA, 64 nt, hsa; identical to SEQ ID NO: 269543

SEQ ID NO: 598312 - RNA, 64 nt, hsa; identical to SEQ ID NO: 269544

SEQ ID NO: 598313 - RNA, 64 nt, hsa; identical to SEQ ID NO: 269545

SEQ ID NO: 598314 - RNA, 64 nt, hsa; identical to SEQ ID NO: 269546

SEQ ID NO: 598315 - RNA, 64 nt, hsa; identical to SEQ ID NO: 269547

SEQ ID NO: 598316 - RNA, 64 nt, hsa; identical to SEQ ID NO: 269548

SEQ ID NO: 598317 - RNA, 64 nt, hsa; identical to SEQ ID NO: 269549

SEQ ID NO: 598318 - RNA, 64 nt, hsa; identical to SEQ ID NO: 269550

SEQ ID NO: 598319 - RNA, 64 nt, hsa; identical to SEQ ID NO: 269551

SEQ ID NO: 598320 - RNA, 64 nt, hsa; identical to SEQ ID NO: 269552

SEQ ID NO: 598321 - RNA, 64 nt, hsa; identical to SEQ ID NO: 269553

SEQ ID NO: 598322 - RNA, 64 nt, hsa; identical to SEQ ID NO: 269554

SEQ ID NO: 598323 - RNA, 64 nt, hsa; identical to SEQ ID NO: 269555

SEQ ID NO: 598324 - RNA, 64 nt, hsa; identical to SEQ ID NO: 269556

SEQ ID NO: 598325 - RNA, 64 nt, hsa; identical to SEQ ID NO: 269557

SEQ ID NO: 598326 - RNA, 64 nt, hsa; identical to SEQ ID NO: 269558

SEQ ID NO: 598327 - RNA, 64 nt, hsa; identical to SEQ ID NO: 269559

SEQ ID NO: 598328 - RNA, 64 nt, hsa; identical to SEQ ID NO: 269560

SEQ ID NO: 598329 - RNA, 64 nt, hsa; identical to SEQ ID NO: 269561

SEQ ID NO: 598330 - RNA, 64 nt, hsa; identical to SEQ ID NO: 269562

SEQ ID NO: 598331 - RNA, 64 nt, hsa; identical to SEQ ID NO: 269563

SEQ ID NO: 598332 - RNA, 64 nt, hsa; identical to SEQ ID NO: 269564

SEQ ID NO: 598333 - RNA, 64 nt, hsa; identical to SEQ ID NO: 269565

SEQ ID NO: 598334 - RNA, 64 nt, hsa; identical to SEQ ID NO: 269566

SEQ ID NO: 598335 - RNA, 64 nt, hsa; identical to SEQ ID NO: 269567

SEQ ID NO: 598336 - RNA, 64 nt, hsa; identical to SEQ ID NO: 269568

SEQ ID NO: 598337 - RNA, 64 nt, hsa; identical to SEQ ID NO: 269569

SEQ ID NO: 598338 - RNA, 64 nt, hsa; identical to SEQ ID NO: 269570

SEQ ID NO: 598339 - RNA, 64 nt, hsa; identical to SEQ ID NO: 269571

SEQ ID NO: 598340 - RNA, 64 nt, hsa; identical to SEQ ID NO: 269572

SEQ ID NO: 598341 - RNA, 64 nt, hsa; identical to SEQ ID NO: 269573

SEQ ID NO: 598342 - RNA, 64 nt, hsa; identical to SEQ ID NO: 269574

SEQ ID NO: 598343 - RNA, 64 nt, hsa; identical to SEQ ID NO: 269575

SEQ ID NO: 598344 - RNA, 64 nt, hsa; identical to SEQ ID NO: 269576

SEQ ID NO: 598345 - RNA, 64 nt, hsa; identical to SEQ ID NO: 269577

SEQ ID NO: 598346 - RNA, 64 nt, hsa; identical to SEQ ID NO: 269578

SEQ ID NO: 598347 - RNA, 64 nt, hsa; identical to SEQ ID NO: 269579

SEQ ID NO: 598348 - RNA, 64 nt, hsa; identical to SEQ ID NO: 269580

SEQ ID NO: 598349 - RNA, 64 nt, hsa; identical to SEQ ID NO: 269581

SEQ ID NO: 598350 - RNA, 64 nt, hsa; identical to SEQ ID NO: 269582

SEQ ID NO: 598351 - RNA, 64 nt, hsa; identical to SEQ ID NO: 269583

SEQ ID NO: 598352 - RNA, 64 nt, hsa; identical to SEQ ID NO: 269584

SEQ ID NO: 598353 - RNA, 64 nt, hsa; identical to SEQ ID NO: 269585

SEQ ID NO: 598354 - RNA, 64 nt, hsa; identical to SEQ ID NO: 269586

SEQ ID NO: 598355 - RNA, 64 nt, hsa; identical to SEQ ID NO: 269587

SEQ ID NO: 598356 - RNA, 64 nt, hsa; identical to SEQ ID NO: 269588

SEQ ID NO: 598357 - RNA, 64 nt, hsa; identical to SEQ ID NO: 269589

SEQ ID NO: 598358 - RNA, 64 nt, hsa; identical to SEQ ID NO: 269590

SEQ ID NO: 598359 - RNA, 64 nt, hsa; identical to SEQ ID NO: 269591

SEQ ID NO: 598360 - RNA, 64 nt, hsa; identical to SEQ ID NO: 269592

SEQ ID NO: 598361 - RNA, 64 nt, hsa; identical to SEQ ID NO: 269593

SEQ ID NO: 598362 - RNA, 64 nt, hsa; identical to SEQ ID NO: 269594

SEQ ID NO: 598363 - RNA, 64 nt, hsa; identical to SEQ ID NO: 269595

SEQ ID NO: 598364 - RNA, 64 nt, hsa; identical to SEQ ID NO: 269596

SEQ ID NO: 598365 - RNA, 64 nt, hsa; identical to SEQ ID NO: 269597

SEQ ID NO: 598366 - RNA, 64 nt, hsa; identical to SEQ ID NO: 269598

SEQ ID NO: 598367 - RNA, 64 nt, hsa; identical to SEQ ID NO: 269599

SEQ ID NO: 598368 - RNA, 64 nt, hsa; identical to SEQ ID NO: 269600

SEQ ID NO: 598369 - RNA, 64 nt, hsa; identical to SEQ ID NO: 269601

SEQ ID NO: 598370 - RNA, 64 nt, hsa; identical to SEQ ID NO: 269602

SEQ ID NO: 598371 - RNA, 64 nt, hsa; identical to SEQ ID NO: 269603

SEQ ID NO: 598372 - RNA, 64 nt, hsa; identical to SEQ ID NO: 269604

SEQ ID NO: 598373 - RNA, 64 nt, hsa; identical to SEQ ID NO: 269605

SEQ ID NO: 598374 - RNA, 64 nt, hsa; identical to SEQ ID NO: 269606

SEQ ID NO: 598375 - RNA, 64 nt, hsa; identical to SEQ ID NO: 269607

SEQ ID NO: 598376 - RNA, 64 nt, hsa; identical to SEQ ID NO: 269608

SEQ ID NO: 598377 - RNA, 64 nt, hsa; identical to SEQ ID NO: 269609

SEQ ID NO: 598378 - RNA, 64 nt, hsa; identical to SEQ ID NO: 269610

SEQ ID NO: 598379 - RNA, 64 nt, hsa; identical to SEQ ID NO: 269611

SEQ ID NO: 598380 - RNA, 64 nt, hsa; identical to SEQ ID NO: 269612

SEQ ID NO: 598381 - RNA, 64 nt, hsa; identical to SEQ ID NO: 269613

SEQ ID NO: 598382 - RNA, 64 nt, hsa; identical to SEQ ID NO: 269614

SEQ ID NO: 598383 - RNA, 64 nt, hsa; identical to SEQ ID NO: 269615

SEQ ID NO: 598384 - RNA, 64 nt, hsa; identical to SEQ ID NO: 269616

SEQ ID NO: 598385 - RNA, 64 nt, hsa; identical to SEQ ID NO: 269617

SEQ ID NO: 598386 - RNA, 64 nt, hsa; identical to SEQ ID NO: 269618

SEQ ID NO: 598387 - RNA, 64 nt, hsa; identical to SEQ ID NO: 269619

SEQ ID NO: 598388 - RNA, 64 nt, hsa; identical to SEQ ID NO: 269620

SEQ ID NO: 598389 - RNA, 64 nt, hsa; identical to SEQ ID NO: 269621

SEQ ID NO: 598390 - RNA, 64 nt, hsa; identical to SEQ ID NO: 269622

SEQ ID NO: 598391 - RNA, 64 nt, hsa; identical to SEQ ID NO: 269623

SEQ ID NO: 598392 - RNA, 64 nt, hsa; identical to SEQ ID NO: 269624

SEQ ID NO: 598393 - RNA, 64 nt, hsa; identical to SEQ ID NO: 269625

SEQ ID NO: 598394 - RNA, 64 nt, hsa; identical to SEQ ID NO: 269626

SEQ ID NO: 598395 - RNA, 64 nt, hsa; identical to SEQ ID NO: 269627

SEQ ID NO: 598396 - RNA, 64 nt, hsa; identical to SEQ ID NO: 269628

SEQ ID NO: 598397 - RNA, 64 nt, hsa; identical to SEQ ID NO: 269629

SEQ ID NO: 598398 - RNA, 64 nt, hsa; identical to SEQ ID NO: 269630

SEQ ID NO: 598399 - RNA, 64 nt, hsa; identical to SEQ ID NO: 269631

SEQ ID NO: 598400 - RNA, 64 nt, hsa; identical to SEQ ID NO: 269632

SEQ ID NO: 598401 - RNA, 64 nt, hsa; identical to SEQ ID NO: 269633

SEQ ID NO: 598402 - RNA, 64 nt, hsa; identical to SEQ ID NO: 269634

SEQ ID NO: 598403 - RNA, 64 nt, hsa; identical to SEQ ID NO: 269635

SEQ ID NO: 598404 - RNA, 64 nt, hsa; identical to SEQ ID NO: 269636

SEQ ID NO: 598405 - RNA, 64 nt, hsa; identical to SEQ ID NO: 269637

SEQ ID NO: 598406 - RNA, 64 nt, hsa; identical to SEQ ID NO: 269638

SEQ ID NO: 598407 - RNA, 64 nt, hsa; identical to SEQ ID NO: 269639

SEQ ID NO: 598408 - RNA, 64 nt, hsa; identical to SEQ ID NO: 269640

SEQ ID NO: 598409 - RNA, 64 nt, hsa; identical to SEQ ID NO: 269641

SEQ ID NO: 598410 - RNA, 64 nt, hsa; identical to SEQ ID NO: 269642

SEQ ID NO: 598411 - RNA, 64 nt, hsa; identical to SEQ ID NO: 269643

SEQ ID NO: 598412 - RNA, 64 nt, hsa; identical to SEQ ID NO: 269644

SEQ ID NO: 598413 - RNA, 64 nt, hsa; identical to SEQ ID NO: 269645

SEQ ID NO: 598414 - RNA, 64 nt, hsa; identical to SEQ ID NO: 269646

SEQ ID NO: 598415 - RNA, 64 nt, hsa; identical to SEQ ID NO: 269647

SEQ ID NO: 598416 - RNA, 64 nt, hsa; identical to SEQ ID NO: 269648

SEQ ID NO: 598417 - RNA, 64 nt, hsa; identical to SEQ ID NO: 269649

SEQ ID NO: 598418 - RNA, 64 nt, hsa; identical to SEQ ID NO: 269650

SEQ ID NO: 598419 - RNA, 64 nt, hsa; identical to SEQ ID NO: 269651

SEQ ID NO: 598420 - RNA, 64 nt, hsa; identical to SEQ ID NO: 269652

SEQ ID NO: 598421 - RNA, 64 nt, hsa; identical to SEQ ID NO: 269653

SEQ ID NO: 598422 - RNA, 64 nt, hsa; identical to SEQ ID NO: 269654

SEQ ID NO: 598423 - RNA, 64 nt, hsa; identical to SEQ ID NO: 269655

SEQ ID NO: 598424 - RNA, 64 nt, hsa; identical to SEQ ID NO: 269656

SEQ ID NO: 598425 - RNA, 64 nt, hsa; identical to SEQ ID NO: 269657

SEQ ID NO: 598426 - RNA, 64 nt, hsa; identical to SEQ ID NO: 269658

SEQ ID NO: 598427 - RNA, 64 nt, hsa; identical to SEQ ID NO: 269659

SEQ ID NO: 598428 - RNA, 64 nt, hsa; identical to SEQ ID NO: 269660

SEQ ID NO: 598429 - RNA, 64 nt, hsa; identical to SEQ ID NO: 269661

SEQ ID NO: 598430 - RNA, 64 nt, hsa; identical to SEQ ID NO: 269662

SEQ ID NO: 598431 - RNA, 64 nt, hsa; identical to SEQ ID NO: 269663

SEQ ID NO: 598432 - RNA, 64 nt, hsa; identical to SEQ ID NO: 269664

SEQ ID NO: 598433 - RNA, 64 nt, hsa; identical to SEQ ID NO: 269665

SEQ ID NO: 598434 - RNA, 64 nt, hsa; identical to SEQ ID NO: 269666

SEQ ID NO: 598435 - RNA, 64 nt, hsa; identical to SEQ ID NO: 269667

SEQ ID NO: 598436 - RNA, 64 nt, hsa; identical to SEQ ID NO: 269668

SEQ ID NO: 598437 - RNA, 64 nt, hsa; identical to SEQ ID NO: 269669

SEQ ID NO: 598438 - RNA, 64 nt, hsa; identical to SEQ ID NO: 269670

SEQ ID NO: 598439 - RNA, 64 nt, hsa; identical to SEQ ID NO: 269671

SEQ ID NO: 598440 - RNA, 64 nt, hsa; identical to SEQ ID NO: 269672

SEQ ID NO: 598441 - RNA, 64 nt, hsa; identical to SEQ ID NO: 269673

SEQ ID NO: 598442 - RNA, 64 nt, hsa; identical to SEQ ID NO: 269674

SEQ ID NO: 598443 - RNA, 64 nt, hsa; identical to SEQ ID NO: 269675

SEQ ID NO: 598444 - RNA, 64 nt, hsa; identical to SEQ ID NO: 269676

SEQ ID NO: 598445 - RNA, 64 nt, hsa; identical to SEQ ID NO: 269677

SEQ ID NO: 598446 - RNA, 64 nt, hsa; identical to SEQ ID NO: 269678

SEQ ID NO: 598447 - RNA, 64 nt, hsa; identical to SEQ ID NO: 269679

SEQ ID NO: 598448 - RNA, 64 nt, hsa; identical to SEQ ID NO: 269680

SEQ ID NO: 598449 - RNA, 64 nt, hsa; identical to SEQ ID NO: 269681

SEQ ID NO: 598450 - RNA, 64 nt, hsa; identical to SEQ ID NO: 269682

SEQ ID NO: 598451 - RNA, 64 nt, hsa; identical to SEQ ID NO: 269683

SEQ ID NO: 598452 - RNA, 64 nt, hsa; identical to SEQ ID NO: 269684

SEQ ID NO: 598453 - RNA, 64 nt, hsa; identical to SEQ ID NO: 269685

SEQ ID NO: 598454 - RNA, 64 nt, hsa; identical to SEQ ID NO: 269686

SEQ ID NO: 598455 - RNA, 64 nt, hsa; identical to SEQ ID NO: 269687

SEQ ID NO: 598456 - RNA, 64 nt, hsa; identical to SEQ ID NO: 269688

SEQ ID NO: 598457 - RNA, 64 nt, hsa; identical to SEQ ID NO: 269689

SEQ ID NO: 598458 - RNA, 64 nt, hsa; identical to SEQ ID NO: 269690

SEQ ID NO: 598459 - RNA, 64 nt, hsa; identical to SEQ ID NO: 269691

SEQ ID NO: 598460 - RNA, 64 nt, hsa; identical to SEQ ID NO: 269692

SEQ ID NO: 598461 - RNA, 64 nt, hsa; identical to SEQ ID NO: 269693

SEQ ID NO: 598462 - RNA, 64 nt, hsa; identical to SEQ ID NO: 269694

SEQ ID NO: 598463 - RNA, 64 nt, hsa; identical to SEQ ID NO: 269695

SEQ ID NO: 598464 - RNA, 64 nt, hsa; identical to SEQ ID NO: 269696

SEQ ID NO: 598465 - RNA, 64 nt, hsa; identical to SEQ ID NO: 269697

SEQ ID NO: 598466 - RNA, 64 nt, hsa; identical to SEQ ID NO: 269698

SEQ ID NO: 598467 - RNA, 64 nt, hsa; identical to SEQ ID NO: 269699

SEQ ID NO: 598468 - RNA, 64 nt, hsa; identical to SEQ ID NO: 269700

SEQ ID NO: 598469 - RNA, 64 nt, hsa; identical to SEQ ID NO: 269701

SEQ ID NO: 598470 - RNA, 64 nt, hsa; identical to SEQ ID NO: 269702

SEQ ID NO: 598471 - RNA, 64 nt, hsa; identical to SEQ ID NO: 269703

SEQ ID NO: 598472 - RNA, 64 nt, hsa; identical to SEQ ID NO: 269704

SEQ ID NO: 598473 - RNA, 64 nt, hsa; identical to SEQ ID NO: 269705

SEQ ID NO: 598474 - RNA, 64 nt, hsa; identical to SEQ ID NO: 269706

SEQ ID NO: 598475 - RNA, 64 nt, hsa; identical to SEQ ID NO: 269707

SEQ ID NO: 598476 - RNA, 64 nt, hsa; identical to SEQ ID NO: 269708

SEQ ID NO: 598477 - RNA, 64 nt, hsa; identical to SEQ ID NO: 269709

SEQ ID NO: 598478 - RNA, 64 nt, hsa; identical to SEQ ID NO: 269710

SEQ ID NO: 598479 - RNA, 64 nt, hsa; identical to SEQ ID NO: 269711

SEQ ID NO: 598480 - RNA, 64 nt, hsa; identical to SEQ ID NO: 269712

SEQ ID NO: 598481 - RNA, 64 nt, hsa; identical to SEQ ID NO: 269713

SEQ ID NO: 598482 - RNA, 64 nt, hsa; identical to SEQ ID NO: 269714

SEQ ID NO: 598483 - RNA, 64 nt, hsa; identical to SEQ ID NO: 269715

SEQ ID NO: 598484 - RNA, 64 nt, hsa; identical to SEQ ID NO: 269716

SEQ ID NO: 598485 - RNA, 64 nt, hsa; identical to SEQ ID NO: 269717

SEQ ID NO: 598486 - RNA, 64 nt, hsa; identical to SEQ ID NO: 269718

SEQ ID NO: 598487 - RNA, 64 nt, hsa; identical to SEQ ID NO: 269719

SEQ ID NO: 598488 - RNA, 64 nt, hsa; identical to SEQ ID NO: 269720

SEQ ID NO: 598489 - RNA, 64 nt, hsa; identical to SEQ ID NO: 269721

SEQ ID NO: 598490 - RNA, 64 nt, hsa; identical to SEQ ID NO: 269722

SEQ ID NO: 598491 - RNA, 64 nt, hsa; identical to SEQ ID NO: 269723

SEQ ID NO: 598492 - RNA, 64 nt, hsa; identical to SEQ ID NO: 269724

SEQ ID NO: 598493 - RNA, 64 nt, hsa; identical to SEQ ID NO: 269725

SEQ ID NO: 598494 - RNA, 64 nt, hsa; identical to SEQ ID NO: 269726

SEQ ID NO: 598495 - RNA, 64 nt, hsa; identical to SEQ ID NO: 269727

SEQ ID NO: 598496 - RNA, 64 nt, hsa; identical to SEQ ID NO: 269728

SEQ ID NO: 598497 - RNA, 64 nt, hsa; identical to SEQ ID NO: 269729

SEQ ID NO: 598498 - RNA, 64 nt, hsa; identical to SEQ ID NO: 269730

SEQ ID NO: 598499 - RNA, 64 nt, hsa; identical to SEQ ID NO: 269731

SEQ ID NO: 598500 - RNA, 64 nt, hsa; identical to SEQ ID NO: 269732

SEQ ID NO: 598501 - RNA, 64 nt, hsa; identical to SEQ ID NO: 269733

SEQ ID NO: 598502 - RNA, 64 nt, hsa; identical to SEQ ID NO: 269734

SEQ ID NO: 598503 - RNA, 64 nt, hsa; identical to SEQ ID NO: 269735

SEQ ID NO: 598504 - RNA, 64 nt, hsa; identical to SEQ ID NO: 269736

SEQ ID NO: 598505 - RNA, 64 nt, hsa; identical to SEQ ID NO: 269737

SEQ ID NO: 598506 - RNA, 64 nt, hsa; identical to SEQ ID NO: 269738

SEQ ID NO: 598507 - RNA, 64 nt, hsa; identical to SEQ ID NO: 269739

SEQ ID NO: 598508 - RNA, 64 nt, hsa; identical to SEQ ID NO: 269740

SEQ ID NO: 598509 - RNA, 64 nt, hsa; identical to SEQ ID NO: 269741

SEQ ID NO: 598510 - RNA, 64 nt, hsa; identical to SEQ ID NO: 269742

SEQ ID NO: 598511 - RNA, 64 nt, hsa; identical to SEQ ID NO: 269743

SEQ ID NO: 598512 - RNA, 64 nt, hsa; identical to SEQ ID NO: 269744

SEQ ID NO: 598513 - RNA, 64 nt, hsa; identical to SEQ ID NO: 269745

SEQ ID NO: 598514 - RNA, 64 nt, hsa; identical to SEQ ID NO: 269746

SEQ ID NO: 598515 - RNA, 64 nt, hsa; identical to SEQ ID NO: 269747

SEQ ID NO: 598516 - RNA, 64 nt, hsa; identical to SEQ ID NO: 269748

SEQ ID NO: 598517 - RNA, 64 nt, hsa; identical to SEQ ID NO: 269749

SEQ ID NO: 598518 - RNA, 64 nt, hsa; identical to SEQ ID NO: 269750

SEQ ID NO: 598519 - RNA, 64 nt, hsa; identical to SEQ ID NO: 269751

SEQ ID NO: 598520 - RNA, 64 nt, hsa; identical to SEQ ID NO: 269752

SEQ ID NO: 598521 - RNA, 64 nt, hsa; identical to SEQ ID NO: 269753

SEQ ID NO: 598522 - RNA, 64 nt, hsa; identical to SEQ ID NO: 269754

SEQ ID NO: 598523 - RNA, 64 nt, hsa; identical to SEQ ID NO: 269755

SEQ ID NO: 598524 - RNA, 64 nt, hsa; identical to SEQ ID NO: 269756

SEQ ID NO: 598525 - RNA, 64 nt, hsa; identical to SEQ ID NO: 269757

SEQ ID NO: 598526 - RNA, 64 nt, hsa; identical to SEQ ID NO: 269758

SEQ ID NO: 598527 - RNA, 64 nt, hsa; identical to SEQ ID NO: 269759

SEQ ID NO: 598528 - RNA, 64 nt, hsa; identical to SEQ ID NO: 269760

SEQ ID NO: 598529 - RNA, 64 nt, hsa; identical to SEQ ID NO: 269761

SEQ ID NO: 598530 - RNA, 64 nt, hsa; identical to SEQ ID NO: 269762

SEQ ID NO: 598531 - RNA, 64 nt, hsa; identical to SEQ ID NO: 269763

SEQ ID NO: 598532 - RNA, 64 nt, hsa; identical to SEQ ID NO: 269764

SEQ ID NO: 598533 - RNA, 64 nt, hsa; identical to SEQ ID NO: 269765

SEQ ID NO: 598534 - RNA, 64 nt, hsa; identical to SEQ ID NO: 269766

SEQ ID NO: 598535 - RNA, 64 nt, hsa; identical to SEQ ID NO: 269767

SEQ ID NO: 598536 - RNA, 64 nt, hsa; identical to SEQ ID NO: 269768

SEQ ID NO: 598537 - RNA, 64 nt, hsa; identical to SEQ ID NO: 269769

SEQ ID NO: 598538 - RNA, 64 nt, hsa; identical to SEQ ID NO: 269770

SEQ ID NO: 598539 - RNA, 64 nt, hsa; identical to SEQ ID NO: 269771

SEQ ID NO: 598540 - RNA, 64 nt, hsa; identical to SEQ ID NO: 269772

SEQ ID NO: 598541 - RNA, 64 nt, hsa; identical to SEQ ID NO: 269773

SEQ ID NO: 598542 - RNA, 64 nt, hsa; identical to SEQ ID NO: 269774

SEQ ID NO: 598543 - RNA, 64 nt, hsa; identical to SEQ ID NO: 269775

SEQ ID NO: 598544 - RNA, 64 nt, hsa; identical to SEQ ID NO: 269776

SEQ ID NO: 598545 - RNA, 64 nt, hsa; identical to SEQ ID NO: 269777

SEQ ID NO: 598546 - RNA, 64 nt, hsa; identical to SEQ ID NO: 269778

SEQ ID NO: 598547 - RNA, 64 nt, hsa; identical to SEQ ID NO: 269779

SEQ ID NO: 598548 - RNA, 64 nt, hsa; identical to SEQ ID NO: 269780

SEQ ID NO: 598549 - RNA, 64 nt, hsa; identical to SEQ ID NO: 269781

SEQ ID NO: 598550 - RNA, 64 nt, hsa; identical to SEQ ID NO: 269782

SEQ ID NO: 598551 - RNA, 64 nt, hsa; identical to SEQ ID NO: 269783

SEQ ID NO: 598552 - RNA, 64 nt, hsa; identical to SEQ ID NO: 269784

SEQ ID NO: 598553 - RNA, 64 nt, hsa; identical to SEQ ID NO: 269785

SEQ ID NO: 598554 - RNA, 64 nt, hsa; identical to SEQ ID NO: 269786

SEQ ID NO: 598555 - RNA, 64 nt, hsa; identical to SEQ ID NO: 269787

SEQ ID NO: 598556 - RNA, 64 nt, hsa; identical to SEQ ID NO: 269788

SEQ ID NO: 598557 - RNA, 64 nt, hsa; identical to SEQ ID NO: 269789

SEQ ID NO: 598558 - RNA, 64 nt, hsa; identical to SEQ ID NO: 269790

SEQ ID NO: 598559 - RNA, 64 nt, hsa; identical to SEQ ID NO: 269791

SEQ ID NO: 598560 - RNA, 64 nt, hsa; identical to SEQ ID NO: 269792

SEQ ID NO: 598561 - RNA, 64 nt, hsa; identical to SEQ ID NO: 269793

SEQ ID NO: 598562 - RNA, 64 nt, hsa; identical to SEQ ID NO: 269794

SEQ ID NO: 598563 - RNA, 64 nt, hsa; identical to SEQ ID NO: 269795

SEQ ID NO: 598564 - RNA, 64 nt, hsa; identical to SEQ ID NO: 269796

SEQ ID NO: 598565 - RNA, 64 nt, hsa; identical to SEQ ID NO: 269797

SEQ ID NO: 598566 - RNA, 64 nt, hsa; identical to SEQ ID NO: 269798

SEQ ID NO: 598567 - RNA, 64 nt, hsa; identical to SEQ ID NO: 269799

SEQ ID NO: 598568 - RNA, 64 nt, hsa; identical to SEQ ID NO: 269800

SEQ ID NO: 598569 - RNA, 64 nt, hsa; identical to SEQ ID NO: 269801

SEQ ID NO: 598570 - RNA, 64 nt, hsa; identical to SEQ ID NO: 269802

SEQ ID NO: 598571 - RNA, 64 nt, hsa; identical to SEQ ID NO: 269803

SEQ ID NO: 598572 - RNA, 64 nt, hsa; identical to SEQ ID NO: 269804

SEQ ID NO: 598573 - RNA, 64 nt, hsa; identical to SEQ ID NO: 269805

SEQ ID NO: 598574 - RNA, 64 nt, hsa; identical to SEQ ID NO: 269806

SEQ ID NO: 598575 - RNA, 64 nt, hsa; identical to SEQ ID NO: 269807

SEQ ID NO: 598576 - RNA, 64 nt, hsa; identical to SEQ ID NO: 269808

SEQ ID NO: 598577 - RNA, 64 nt, hsa; identical to SEQ ID NO: 269809

SEQ ID NO: 598578 - RNA, 64 nt, hsa; identical to SEQ ID NO: 269810

SEQ ID NO: 598579 - RNA, 64 nt, hsa; identical to SEQ ID NO: 269811

SEQ ID NO: 598580 - RNA, 64 nt, hsa; identical to SEQ ID NO: 269812

SEQ ID NO: 598581 - RNA, 64 nt, hsa; identical to SEQ ID NO: 269813

SEQ ID NO: 598582 - RNA, 64 nt, hsa; identical to SEQ ID NO: 269814

SEQ ID NO: 598583 - RNA, 64 nt, hsa; identical to SEQ ID NO: 269815

SEQ ID NO: 598584 - RNA, 64 nt, hsa; identical to SEQ ID NO: 269816

SEQ ID NO: 598585 - RNA, 64 nt, hsa; identical to SEQ ID NO: 269817

SEQ ID NO: 598586 - RNA, 64 nt, hsa; identical to SEQ ID NO: 269818

SEQ ID NO: 598587 - RNA, 64 nt, hsa; identical to SEQ ID NO: 269819

SEQ ID NO: 598588 - RNA, 64 nt, hsa; identical to SEQ ID NO: 269820

SEQ ID NO: 598589 - RNA, 64 nt, hsa; identical to SEQ ID NO: 269821

SEQ ID NO: 598590 - RNA, 64 nt, hsa; identical to SEQ ID NO: 269822

SEQ ID NO: 598591 - RNA, 52 nt, hsa; identical to SEQ ID NO: 269823

SEQ ID NO: 598592 - RNA, 64 nt, hsa; identical to SEQ ID NO: 269824

SEQ ID NO: 598593 - RNA, 64 nt, hsa; identical to SEQ ID NO: 269825

SEQ ID NO: 598594 - RNA, 64 nt, hsa; identical to SEQ ID NO: 269826

SEQ ID NO: 598595 - RNA, 64 nt, hsa; identical to SEQ ID NO: 269827

SEQ ID NO: 598596 - RNA, 64 nt, hsa; identical to SEQ ID NO: 269828

SEQ ID NO: 598597 - RNA, 64 nt, hsa; identical to SEQ ID NO: 269829

SEQ ID NO: 598598 - RNA, 64 nt, hsa; identical to SEQ ID NO: 269830

SEQ ID NO: 598599 - RNA, 64 nt, hsa; identical to SEQ ID NO: 269831

SEQ ID NO: 598600 - RNA, 64 nt, hsa; identical to SEQ ID NO: 269832

SEQ ID NO: 598601 - RNA, 64 nt, hsa; identical to SEQ ID NO: 269833

SEQ ID NO: 598602 - RNA, 64 nt, hsa; identical to SEQ ID NO: 269834

SEQ ID NO: 598603 - RNA, 64 nt, hsa; identical to SEQ ID NO: 269835

SEQ ID NO: 598604 - RNA, 64 nt, hsa; identical to SEQ ID NO: 269836

SEQ ID NO: 598605 - RNA, 64 nt, hsa; identical to SEQ ID NO: 269837

SEQ ID NO: 598606 - RNA, 64 nt, hsa; identical to SEQ ID NO: 269838

SEQ ID NO: 598607 - RNA, 64 nt, hsa; identical to SEQ ID NO: 269839

SEQ ID NO: 598608 - RNA, 64 nt, hsa; identical to SEQ ID NO: 269840

SEQ ID NO: 598609 - RNA, 64 nt, hsa; identical to SEQ ID NO: 269841

SEQ ID NO: 598610 - RNA, 64 nt, hsa; identical to SEQ ID NO: 269842

SEQ ID NO: 598611 - RNA, 64 nt, hsa; identical to SEQ ID NO: 269843

SEQ ID NO: 598612 - RNA, 64 nt, hsa; identical to SEQ ID NO: 269844

SEQ ID NO: 598613 - RNA, 64 nt, hsa; identical to SEQ ID NO: 269845

SEQ ID NO: 598614 - RNA, 64 nt, hsa; identical to SEQ ID NO: 269846

SEQ ID NO: 598615 - RNA, 64 nt, hsa; identical to SEQ ID NO: 269847

SEQ ID NO: 598616 - RNA, 64 nt, hsa; identical to SEQ ID NO: 269848

SEQ ID NO: 598617 - RNA, 64 nt, hsa; identical to SEQ ID NO: 269849

SEQ ID NO: 598618 - RNA, 64 nt, hsa; identical to SEQ ID NO: 269850

SEQ ID NO: 598619 - RNA, 64 nt, hsa; identical to SEQ ID NO: 269851

SEQ ID NO: 598620 - RNA, 64 nt, hsa; identical to SEQ ID NO: 269852

SEQ ID NO: 598621 - RNA, 64 nt, hsa; identical to SEQ ID NO: 269853

SEQ ID NO: 598622 - RNA, 64 nt, hsa; identical to SEQ ID NO: 269854

SEQ ID NO: 598623 - RNA, 64 nt, hsa; identical to SEQ ID NO: 269855

SEQ ID NO: 598624 - RNA, 64 nt, hsa; identical to SEQ ID NO: 269856

SEQ ID NO: 598625 - RNA, 64 nt, hsa; identical to SEQ ID NO: 269857

SEQ ID NO: 598626 - RNA, 64 nt, hsa; identical to SEQ ID NO: 269858

SEQ ID NO: 598627 - RNA, 64 nt, hsa; identical to SEQ ID NO: 269859

SEQ ID NO: 598628 - RNA, 64 nt, hsa; identical to SEQ ID NO: 269860

SEQ ID NO: 598629 - RNA, 64 nt, hsa; identical to SEQ ID NO: 269861

SEQ ID NO: 598630 - RNA, 64 nt, hsa; identical to SEQ ID NO: 269862

SEQ ID NO: 598631 - RNA, 64 nt, hsa; identical to SEQ ID NO: 269863

SEQ ID NO: 598632 - RNA, 64 nt, hsa; identical to SEQ ID NO: 269864

SEQ ID NO: 598633 - RNA, 64 nt, hsa; identical to SEQ ID NO: 269865

SEQ ID NO: 598634 - RNA, 64 nt, hsa; identical to SEQ ID NO: 269866

SEQ ID NO: 598635 - RNA, 64 nt, hsa; identical to SEQ ID NO: 269867

SEQ ID NO: 598636 - RNA, 64 nt, hsa; identical to SEQ ID NO: 269868

SEQ ID NO: 598637 - RNA, 64 nt, hsa; identical to SEQ ID NO: 269869

SEQ ID NO: 598638 - RNA, 64 nt, hsa; identical to SEQ ID NO: 269870

SEQ ID NO: 598639 - RNA, 64 nt, hsa; identical to SEQ ID NO: 269871

SEQ ID NO: 598640 - RNA, 64 nt, hsa; identical to SEQ ID NO: 269872

SEQ ID NO: 598641 - RNA, 64 nt, hsa; identical to SEQ ID NO: 269873

SEQ ID NO: 598642 - RNA, 64 nt, hsa; identical to SEQ ID NO: 269874

SEQ ID NO: 598643 - RNA, 64 nt, hsa; identical to SEQ ID NO: 269875

SEQ ID NO: 598644 - RNA, 64 nt, hsa; identical to SEQ ID NO: 269876

SEQ ID NO: 598645 - RNA, 64 nt, hsa; identical to SEQ ID NO: 269877

SEQ ID NO: 598646 - RNA, 64 nt, hsa; identical to SEQ ID NO: 269878

SEQ ID NO: 598647 - RNA, 64 nt, hsa; identical to SEQ ID NO: 269879

SEQ ID NO: 598648 - RNA, 64 nt, hsa; identical to SEQ ID NO: 269880

SEQ ID NO: 598649 - RNA, 64 nt, hsa; identical to SEQ ID NO: 269881

SEQ ID NO: 598650 - RNA, 64 nt, hsa; identical to SEQ ID NO: 269882

SEQ ID NO: 598651 - RNA, 64 nt, hsa; identical to SEQ ID NO: 269883

SEQ ID NO: 598652 - RNA, 64 nt, hsa; identical to SEQ ID NO: 269884

SEQ ID NO: 598653 - RNA, 64 nt, hsa; identical to SEQ ID NO: 269885

SEQ ID NO: 598654 - RNA, 64 nt, hsa; identical to SEQ ID NO: 269886

SEQ ID NO: 598655 - RNA, 64 nt, hsa; identical to SEQ ID NO: 269887

SEQ ID NO: 598656 - RNA, 64 nt, hsa; identical to SEQ ID NO: 269888

SEQ ID NO: 598657 - RNA, 64 nt, hsa; identical to SEQ ID NO: 269889

SEQ ID NO: 598658 - RNA, 64 nt, hsa; identical to SEQ ID NO: 269890

SEQ ID NO: 598659 - RNA, 64 nt, hsa; identical to SEQ ID NO: 269891

SEQ ID NO: 598660 - RNA, 64 nt, hsa; identical to SEQ ID NO: 269892

SEQ ID NO: 598661 - RNA, 64 nt, hsa; identical to SEQ ID NO: 269893

SEQ ID NO: 598662 - RNA, 64 nt, hsa; identical to SEQ ID NO: 269894

SEQ ID NO: 598663 - RNA, 64 nt, hsa; identical to SEQ ID NO: 269895

SEQ ID NO: 598664 - RNA, 64 nt, hsa; identical to SEQ ID NO: 269896

SEQ ID NO: 598665 - RNA, 64 nt, hsa; identical to SEQ ID NO: 269897

SEQ ID NO: 598666 - RNA, 64 nt, hsa; identical to SEQ ID NO: 269898

SEQ ID NO: 598667 - RNA, 64 nt, hsa; identical to SEQ ID NO: 269899

SEQ ID NO: 598668 - RNA, 64 nt, hsa; identical to SEQ ID NO: 269900

SEQ ID NO: 598669 - RNA, 64 nt, hsa; identical to SEQ ID NO: 269901

SEQ ID NO: 598670 - RNA, 64 nt, hsa; identical to SEQ ID NO: 269902

SEQ ID NO: 598671 - RNA, 64 nt, hsa; identical to SEQ ID NO: 269903

SEQ ID NO: 598672 - RNA, 64 nt, hsa; identical to SEQ ID NO: 269904

SEQ ID NO: 598673 - RNA, 64 nt, hsa; identical to SEQ ID NO: 269905

SEQ ID NO: 598674 - RNA, 64 nt, hsa; identical to SEQ ID NO: 269906

SEQ ID NO: 598675 - RNA, 64 nt, hsa; identical to SEQ ID NO: 269907

SEQ ID NO: 598676 - RNA, 64 nt, hsa; identical to SEQ ID NO: 269908

SEQ ID NO: 598677 - RNA, 64 nt, hsa; identical to SEQ ID NO: 269909

SEQ ID NO: 598678 - RNA, 64 nt, hsa; identical to SEQ ID NO: 269910

SEQ ID NO: 598679 - RNA, 64 nt, hsa; identical to SEQ ID NO: 269911

SEQ ID NO: 598680 - RNA, 64 nt, hsa; identical to SEQ ID NO: 269912

SEQ ID NO: 598681 - RNA, 64 nt, hsa; identical to SEQ ID NO: 269913

SEQ ID NO: 598682 - RNA, 64 nt, hsa; identical to SEQ ID NO: 269914

SEQ ID NO: 598683 - RNA, 64 nt, hsa; identical to SEQ ID NO: 269915

SEQ ID NO: 598684 - RNA, 64 nt, hsa; identical to SEQ ID NO: 269916

SEQ ID NO: 598685 - RNA, 64 nt, hsa; identical to SEQ ID NO: 269917

SEQ ID NO: 598686 - RNA, 64 nt, hsa; identical to SEQ ID NO: 269918

SEQ ID NO: 598687 - RNA, 64 nt, hsa; identical to SEQ ID NO: 269919

SEQ ID NO: 598688 - RNA, 64 nt, hsa; identical to SEQ ID NO: 269920

SEQ ID NO: 598689 - RNA, 64 nt, hsa; identical to SEQ ID NO: 269921

SEQ ID NO: 598690 - RNA, 64 nt, hsa; identical to SEQ ID NO: 269922

SEQ ID NO: 598691 - RNA, 64 nt, hsa; identical to SEQ ID NO: 269923

SEQ ID NO: 598692 - RNA, 64 nt, hsa; identical to SEQ ID NO: 269924

SEQ ID NO: 598693 - RNA, 64 nt, hsa; identical to SEQ ID NO: 269925

SEQ ID NO: 598694 - RNA, 64 nt, hsa; identical to SEQ ID NO: 269926

SEQ ID NO: 598695 - RNA, 64 nt, hsa; identical to SEQ ID NO: 269927

SEQ ID NO: 598696 - RNA, 64 nt, hsa; identical to SEQ ID NO: 269928

SEQ ID NO: 598697 - RNA, 64 nt, hsa; identical to SEQ ID NO: 269929

SEQ ID NO: 598698 - RNA, 64 nt, hsa; identical to SEQ ID NO: 269930

SEQ ID NO: 598699 - RNA, 64 nt, hsa; identical to SEQ ID NO: 269931

SEQ ID NO: 598700 - RNA, 64 nt, hsa; identical to SEQ ID NO: 269932

SEQ ID NO: 598701 - RNA, 64 nt, hsa; identical to SEQ ID NO: 269933

SEQ ID NO: 598702 - RNA, 64 nt, hsa; identical to SEQ ID NO: 269934

SEQ ID NO: 598703 - RNA, 64 nt, hsa; identical to SEQ ID NO: 269935

SEQ ID NO: 598704 - RNA, 64 nt, hsa; identical to SEQ ID NO: 269936

SEQ ID NO: 598705 - RNA, 64 nt, hsa; identical to SEQ ID NO: 269937

SEQ ID NO: 598706 - RNA, 64 nt, hsa; identical to SEQ ID NO: 269938

SEQ ID NO: 598707 - RNA, 64 nt, hsa; identical to SEQ ID NO: 269939

SEQ ID NO: 598708 - RNA, 64 nt, hsa; identical to SEQ ID NO: 269940

SEQ ID NO: 598709 - RNA, 64 nt, hsa; identical to SEQ ID NO: 269941

SEQ ID NO: 598710 - RNA, 64 nt, hsa; identical to SEQ ID NO: 269942

SEQ ID NO: 598711 - RNA, 64 nt, hsa; identical to SEQ ID NO: 269943

SEQ ID NO: 598712 - RNA, 64 nt, hsa; identical to SEQ ID NO: 269944

SEQ ID NO: 598713 - RNA, 64 nt, hsa; identical to SEQ ID NO: 269945

SEQ ID NO: 598714 - RNA, 64 nt, hsa; identical to SEQ ID NO: 269946

SEQ ID NO: 598715 - RNA, 64 nt, hsa; identical to SEQ ID NO: 269947

SEQ ID NO: 598716 - RNA, 64 nt, hsa; identical to SEQ ID NO: 269948

SEQ ID NO: 598717 - RNA, 64 nt, hsa; identical to SEQ ID NO: 269949

SEQ ID NO: 598718 - RNA, 64 nt, hsa; identical to SEQ ID NO: 269950

SEQ ID NO: 598719 - RNA, 64 nt, hsa; identical to SEQ ID NO: 269951

SEQ ID NO: 598720 - RNA, 64 nt, hsa; identical to SEQ ID NO: 269952

SEQ ID NO: 598721 - RNA, 64 nt, hsa; identical to SEQ ID NO: 269953

SEQ ID NO: 598722 - RNA, 64 nt, hsa; identical to SEQ ID NO: 269954

SEQ ID NO: 598723 - RNA, 64 nt, hsa; identical to SEQ ID NO: 269955

SEQ ID NO: 598724 - RNA, 64 nt, hsa; identical to SEQ ID NO: 269956

SEQ ID NO: 598725 - RNA, 64 nt, hsa; identical to SEQ ID NO: 269957

SEQ ID NO: 598726 - RNA, 64 nt, hsa; identical to SEQ ID NO: 269958

SEQ ID NO: 598727 - RNA, 64 nt, hsa; identical to SEQ ID NO: 269959

SEQ ID NO: 598728 - RNA, 64 nt, hsa; identical to SEQ ID NO: 269960

SEQ ID NO: 598729 - RNA, 64 nt, hsa; identical to SEQ ID NO: 269961

SEQ ID NO: 598730 - RNA, 64 nt, hsa; identical to SEQ ID NO: 269962

SEQ ID NO: 598731 - RNA, 64 nt, hsa; identical to SEQ ID NO: 269963

SEQ ID NO: 598732 - RNA, 64 nt, hsa; identical to SEQ ID NO: 269964

SEQ ID NO: 598733 - RNA, 64 nt, hsa; identical to SEQ ID NO: 269965

SEQ ID NO: 598734 - RNA, 64 nt, hsa; identical to SEQ ID NO: 269966

SEQ ID NO: 598735 - RNA, 64 nt, hsa; identical to SEQ ID NO: 269967

SEQ ID NO: 598736 - RNA, 64 nt, hsa; identical to SEQ ID NO: 269968

SEQ ID NO: 598737 - RNA, 64 nt, hsa; identical to SEQ ID NO: 269969

SEQ ID NO: 598738 - RNA, 64 nt, hsa; identical to SEQ ID NO: 269970

SEQ ID NO: 598739 - RNA, 64 nt, hsa; identical to SEQ ID NO: 269971

SEQ ID NO: 598740 - RNA, 64 nt, hsa; identical to SEQ ID NO: 269972

SEQ ID NO: 598741 - RNA, 64 nt, hsa; identical to SEQ ID NO: 269973

SEQ ID NO: 598742 - RNA, 64 nt, hsa; identical to SEQ ID NO: 269974

SEQ ID NO: 598743 - RNA, 64 nt, hsa; identical to SEQ ID NO: 269975

SEQ ID NO: 598744 - RNA, 64 nt, hsa; identical to SEQ ID NO: 269976

SEQ ID NO: 598745 - RNA, 64 nt, hsa; identical to SEQ ID NO: 269977

SEQ ID NO: 598746 - RNA, 64 nt, hsa; identical to SEQ ID NO: 269978

SEQ ID NO: 598747 - RNA, 64 nt, hsa; identical to SEQ ID NO: 269979

SEQ ID NO: 598748 - RNA, 64 nt, hsa; identical to SEQ ID NO: 269980

SEQ ID NO: 598749 - RNA, 64 nt, hsa; identical to SEQ ID NO: 269981

SEQ ID NO: 598750 - RNA, 64 nt, hsa; identical to SEQ ID NO: 269982

SEQ ID NO: 598751 - RNA, 64 nt, hsa; identical to SEQ ID NO: 269983

SEQ ID NO: 598752 - RNA, 64 nt, hsa; identical to SEQ ID NO: 269984

SEQ ID NO: 598753 - RNA, 64 nt, hsa; identical to SEQ ID NO: 269985

SEQ ID NO: 598754 - RNA, 64 nt, hsa; identical to SEQ ID NO: 269986

SEQ ID NO: 598755 - RNA, 64 nt, hsa; identical to SEQ ID NO: 269987

SEQ ID NO: 598756 - RNA, 64 nt, hsa; identical to SEQ ID NO: 269988

SEQ ID NO: 598757 - RNA, 64 nt, hsa; identical to SEQ ID NO: 269989

SEQ ID NO: 598758 - RNA, 64 nt, hsa; identical to SEQ ID NO: 269990

SEQ ID NO: 598759 - RNA, 64 nt, hsa; identical to SEQ ID NO: 269991

SEQ ID NO: 598760 - RNA, 64 nt, hsa; identical to SEQ ID NO: 269992

SEQ ID NO: 598761 - RNA, 64 nt, hsa; identical to SEQ ID NO: 269993

SEQ ID NO: 598762 - RNA, 64 nt, hsa; identical to SEQ ID NO: 269994

SEQ ID NO: 598763 - RNA, 64 nt, hsa; identical to SEQ ID NO: 269995

SEQ ID NO: 598764 - RNA, 64 nt, hsa; identical to SEQ ID NO: 269996

SEQ ID NO: 598765 - RNA, 64 nt, hsa; identical to SEQ ID NO: 269997

SEQ ID NO: 598766 - RNA, 64 nt, hsa; identical to SEQ ID NO: 269998

SEQ ID NO: 598767 - RNA, 64 nt, hsa; identical to SEQ ID NO: 269999

SEQ ID NO: 598768 - RNA, 64 nt, hsa; identical to SEQ ID NO: 270000

SEQ ID NO: 598769 - RNA, 64 nt, hsa; identical to SEQ ID NO: 270001

SEQ ID NO: 598770 - RNA, 64 nt, hsa; identical to SEQ ID NO: 270002

SEQ ID NO: 598771 - RNA, 59 nt, hsa; identical to SEQ ID NO: 270003

SEQ ID NO: 598772 - RNA, 64 nt, hsa; identical to SEQ ID NO: 270004

SEQ ID NO: 598773 - RNA, 64 nt, hsa; identical to SEQ ID NO: 270005

SEQ ID NO: 598774 - RNA, 64 nt, hsa; identical to SEQ ID NO: 270006

SEQ ID NO: 598775 - RNA, 64 nt, hsa; identical to SEQ ID NO: 270007

SEQ ID NO: 598776 - RNA, 64 nt, hsa; identical to SEQ ID NO: 270008

SEQ ID NO: 598777 - RNA, 64 nt, hsa; identical to SEQ ID NO: 270009

SEQ ID NO: 598778 - RNA, 64 nt, hsa; identical to SEQ ID NO: 270010

SEQ ID NO: 598779 - RNA, 64 nt, hsa; identical to SEQ ID NO: 270011

SEQ ID NO: 598780 - RNA, 64 nt, hsa; identical to SEQ ID NO: 270012

SEQ ID NO: 598781 - RNA, 64 nt, hsa; identical to SEQ ID NO: 270013

SEQ ID NO: 598782 - RNA, 64 nt, hsa; identical to SEQ ID NO: 270014

SEQ ID NO: 598783 - RNA, 64 nt, hsa; identical to SEQ ID NO: 270015

SEQ ID NO: 598784 - RNA, 64 nt, hsa; identical to SEQ ID NO: 270016

SEQ ID NO: 598785 - RNA, 64 nt, hsa; identical to SEQ ID NO: 270017

SEQ ID NO: 598786 - RNA, 64 nt, hsa; identical to SEQ ID NO: 270018

SEQ ID NO: 598787 - RNA, 64 nt, hsa; identical to SEQ ID NO: 270019

SEQ ID NO: 598788 - RNA, 64 nt, hsa; identical to SEQ ID NO: 270020

SEQ ID NO: 598789 - RNA, 64 nt, hsa; identical to SEQ ID NO: 270021

SEQ ID NO: 598790 - RNA, 64 nt, hsa; identical to SEQ ID NO: 270022

SEQ ID NO: 598791 - RNA, 64 nt, hsa; identical to SEQ ID NO: 270023

SEQ ID NO: 598792 - RNA, 64 nt, hsa; identical to SEQ ID NO: 270024

SEQ ID NO: 598793 - RNA, 64 nt, hsa; identical to SEQ ID NO: 270025

SEQ ID NO: 598794 - RNA, 64 nt, hsa; identical to SEQ ID NO: 270026

SEQ ID NO: 598795 - RNA, 64 nt, hsa; identical to SEQ ID NO: 270027

SEQ ID NO: 598796 - RNA, 64 nt, hsa; identical to SEQ ID NO: 270028

SEQ ID NO: 598797 - RNA, 64 nt, hsa; identical to SEQ ID NO: 270029

SEQ ID NO: 598798 - RNA, 64 nt, hsa; identical to SEQ ID NO: 270030

SEQ ID NO: 598799 - RNA, 64 nt, hsa; identical to SEQ ID NO: 270031

SEQ ID NO: 598800 - RNA, 64 nt, hsa; identical to SEQ ID NO: 270032

SEQ ID NO: 598801 - RNA, 64 nt, hsa; identical to SEQ ID NO: 270033

SEQ ID NO: 598802 - RNA, 64 nt, hsa; identical to SEQ ID NO: 270034

SEQ ID NO: 598803 - RNA, 64 nt, hsa; identical to SEQ ID NO: 270035

SEQ ID NO: 598804 - RNA, 64 nt, hsa; identical to SEQ ID NO: 270036

SEQ ID NO: 598805 - RNA, 64 nt, hsa; identical to SEQ ID NO: 269952

SEQ ID NO: 598806 - RNA, 64 nt, hsa; identical to SEQ ID NO: 270038

SEQ ID NO: 598807 - RNA, 64 nt, hsa; identical to SEQ ID NO: 270039

SEQ ID NO: 598808 - RNA, 64 nt, hsa; identical to SEQ ID NO: 270040

SEQ ID NO: 598809 - RNA, 64 nt, hsa; identical to SEQ ID NO: 270041

SEQ ID NO: 598810 - RNA, 64 nt, hsa; identical to SEQ ID NO: 270042

SEQ ID NO: 598811 - RNA, 64 nt, hsa; identical to SEQ ID NO: 270043

SEQ ID NO: 598812 - RNA, 64 nt, hsa; identical to SEQ ID NO: 270044

SEQ ID NO: 598813 - RNA, 64 nt, hsa; identical to SEQ ID NO: 270045

SEQ ID NO: 598814 - RNA, 64 nt, hsa; identical to SEQ ID NO: 270042

SEQ ID NO: 598815 - RNA, 64 nt, hsa; identical to SEQ ID NO: 270043

SEQ ID NO: 598816 - RNA, 64 nt, hsa; identical to SEQ ID NO: 270044

SEQ ID NO: 598817 - RNA, 64 nt, hsa; identical to SEQ ID NO: 270045

SEQ ID NO: 598818 - RNA, 64 nt, hsa; identical to SEQ ID NO: 270050

SEQ ID NO: 598819 - RNA, 64 nt, hsa; identical to SEQ ID NO: 270051

SEQ ID NO: 598820 - RNA, 64 nt, hsa; identical to SEQ ID NO: 270052

SEQ ID NO: 598821 - RNA, 64 nt, hsa; identical to SEQ ID NO: 270053

SEQ ID NO: 598822 - RNA, 64 nt, hsa; identical to SEQ ID NO: 270054

SEQ ID NO: 598823 - RNA, 64 nt, hsa; identical to SEQ ID NO: 270055

SEQ ID NO: 598824 - RNA, 64 nt, hsa; identical to SEQ ID NO: 125569

SEQ ID NO: 598825 - RNA, 64 nt, hsa; identical to SEQ ID NO: 125570

SEQ ID NO: 598826 - RNA, 64 nt, hsa; identical to SEQ ID NO: 125571

SEQ ID NO: 598827 - RNA, 64 nt, hsa; identical to SEQ ID NO: 125572

SEQ ID NO: 598828 - RNA, 64 nt, hsa; identical to SEQ ID NO: 125573

SEQ ID NO: 598829 - RNA, 64 nt, hsa; identical to SEQ ID NO: 125574

SEQ ID NO: 598830 - RNA, 64 nt, hsa; identical to SEQ ID NO: 125575

SEQ ID NO: 598831 - RNA, 64 nt, hsa; identical to SEQ ID NO: 125576

SEQ ID NO: 598832 - RNA, 64 nt, hsa; identical to SEQ ID NO: 125577

SEQ ID NO: 598833 - RNA, 64 nt, hsa; identical to SEQ ID NO: 125578

SEQ ID NO: 598834 - RNA, 64 nt, hsa; identical to SEQ ID NO: 125579

SEQ ID NO: 598835 - RNA, 64 nt, hsa; identical to SEQ ID NO: 125580

SEQ ID NO: 598836 - RNA, 64 nt, hsa; identical to SEQ ID NO: 125581

SEQ ID NO: 598837 - RNA, 64 nt, hsa; identical to SEQ ID NO: 125582

SEQ ID NO: 598838 - RNA, 64 nt, hsa; identical to SEQ ID NO: 125583

SEQ ID NO: 598839 - RNA, 64 nt, hsa; identical to SEQ ID NO: 125584

SEQ ID NO: 598840 - RNA, 64 nt, hsa; identical to SEQ ID NO: 125585

SEQ ID NO: 598841 - RNA, 64 nt, hsa; identical to SEQ ID NO: 125586

SEQ ID NO: 598842 - RNA, 64 nt, hsa; identical to SEQ ID NO: 125587

SEQ ID NO: 598843 - RNA, 64 nt, hsa; identical to SEQ ID NO: 125588

SEQ ID NO: 598844 - RNA, 64 nt, hsa; identical to SEQ ID NO: 125589

SEQ ID NO: 598845 - RNA, 64 nt, hsa; identical to SEQ ID NO: 125590

SEQ ID NO: 598846 - RNA, 64 nt, hsa; identical to SEQ ID NO: 125591

SEQ ID NO: 598847 - RNA, 64 nt, hsa; identical to SEQ ID NO: 125592

SEQ ID NO: 598848 - RNA, 64 nt, hsa; identical to SEQ ID NO: 125593

SEQ ID NO: 598849 - RNA, 64 nt, hsa; identical to SEQ ID NO: 125594

SEQ ID NO: 598850 - RNA, 64 nt, hsa; identical to SEQ ID NO: 125595

SEQ ID NO: 598851 - RNA, 64 nt, hsa; identical to SEQ ID NO: 125596

SEQ ID NO: 598852 - RNA, 64 nt, hsa; identical to SEQ ID NO: 125597

SEQ ID NO: 598853 - RNA, 64 nt, hsa; identical to SEQ ID NO: 125598

SEQ ID NO: 598854 - RNA, 64 nt, hsa; identical to SEQ ID NO: 125599

SEQ ID NO: 598855 - RNA, 64 nt, hsa; identical to SEQ ID NO: 125600

SEQ ID NO: 598856 - RNA, 64 nt, hsa; identical to SEQ ID NO: 125601

SEQ ID NO: 598857 - RNA, 64 nt, hsa; identical to SEQ ID NO: 125602

SEQ ID NO: 598858 - RNA, 64 nt, hsa; identical to SEQ ID NO: 125603

SEQ ID NO: 598859 - RNA, 64 nt, hsa; identical to SEQ ID NO: 125604

SEQ ID NO: 598860 - RNA, 64 nt, hsa; identical to SEQ ID NO: 125605

SEQ ID NO: 598861 - RNA, 64 nt, hsa; identical to SEQ ID NO: 125606

SEQ ID NO: 598862 - RNA, 64 nt, hsa; identical to SEQ ID NO: 125607

SEQ ID NO: 598863 - RNA, 64 nt, hsa; identical to SEQ ID NO: 125608

SEQ ID NO: 598864 - RNA, 64 nt, hsa; identical to SEQ ID NO: 125609

SEQ ID NO: 598865 - RNA, 64 nt, hsa; identical to SEQ ID NO: 125610

SEQ ID NO: 598866 - RNA, 64 nt, hsa; identical to SEQ ID NO: 125611

SEQ ID NO: 598867 - RNA, 64 nt, hsa; identical to SEQ ID NO: 125612

SEQ ID NO: 598868 - RNA, 64 nt, hsa; identical to SEQ ID NO: 125613

SEQ ID NO: 598869 - RNA, 64 nt, hsa; identical to SEQ ID NO: 125614

SEQ ID NO: 598870 - RNA, 64 nt, hsa; identical to SEQ ID NO: 125615

SEQ ID NO: 598871 - RNA, 64 nt, hsa; identical to SEQ ID NO: 125616

SEQ ID NO: 598872 - RNA, 64 nt, hsa; identical to SEQ ID NO: 125617

SEQ ID NO: 598873 - RNA, 64 nt, hsa; identical to SEQ ID NO: 125618

SEQ ID NO: 598874 - RNA, 64 nt, hsa; identical to SEQ ID NO: 125619

SEQ ID NO: 598875 - RNA, 64 nt, hsa; identical to SEQ ID NO: 125620

SEQ ID NO: 598876 - RNA, 64 nt, hsa; identical to SEQ ID NO: 125621

SEQ ID NO: 598877 - RNA, 64 nt, hsa; identical to SEQ ID NO: 125622

SEQ ID NO: 598878 - RNA, 64 nt, hsa; identical to SEQ ID NO: 125623

SEQ ID NO: 598879 - RNA, 64 nt, hsa; identical to SEQ ID NO: 125624

SEQ ID NO: 598880 - RNA, 64 nt, hsa; identical to SEQ ID NO: 125625

SEQ ID NO: 598881 - RNA, 64 nt, hsa; identical to SEQ ID NO: 125626

SEQ ID NO: 598882 - RNA, 64 nt, hsa; identical to SEQ ID NO: 125627

SEQ ID NO: 598883 - RNA, 64 nt, hsa; identical to SEQ ID NO: 125628

SEQ ID NO: 598884 - RNA, 64 nt, hsa; identical to SEQ ID NO: 125629

SEQ ID NO: 598885 - RNA, 64 nt, hsa; identical to SEQ ID NO: 125630

SEQ ID NO: 598886 - RNA, 64 nt, hsa; identical to SEQ ID NO: 125631

SEQ ID NO: 598887 - RNA, 64 nt, hsa; identical to SEQ ID NO: 125632

SEQ ID NO: 598888 - RNA, 64 nt, hsa; identical to SEQ ID NO: 125633

SEQ ID NO: 598889 - RNA, 64 nt, hsa; identical to SEQ ID NO: 125634

SEQ ID NO: 598890 - RNA, 64 nt, hsa; identical to SEQ ID NO: 125635

SEQ ID NO: 598891 - RNA, 64 nt, hsa; identical to SEQ ID NO: 125636

SEQ ID NO: 598892 - RNA, 64 nt, hsa; identical to SEQ ID NO: 125637

SEQ ID NO: 598893 - RNA, 64 nt, hsa; identical to SEQ ID NO: 125638

SEQ ID NO: 598894 - RNA, 64 nt, hsa; identical to SEQ ID NO: 125639

SEQ ID NO: 598895 - RNA, 64 nt, hsa; identical to SEQ ID NO: 125640

SEQ ID NO: 598896 - RNA, 64 nt, hsa; identical to SEQ ID NO: 125641

SEQ ID NO: 598897 - RNA, 64 nt, hsa; identical to SEQ ID NO: 125642

SEQ ID NO: 598898 - RNA, 64 nt, hsa; identical to SEQ ID NO: 124007

SEQ ID NO: 598899 - RNA, 64 nt, hsa; identical to SEQ ID NO: 124008

SEQ ID NO: 598900 - RNA, 64 nt, hsa; identical to SEQ ID NO: 124009

SEQ ID NO: 598901 - RNA, 64 nt, hsa; identical to SEQ ID NO: 124010

SEQ ID NO: 598902 - RNA, 64 nt, hsa; identical to SEQ ID NO: 124011

SEQ ID NO: 598903 - RNA, 64 nt, hsa; identical to SEQ ID NO: 124012

SEQ ID NO: 598904 - RNA, 64 nt, hsa; identical to SEQ ID NO: 124013

SEQ ID NO: 598905 - RNA, 64 nt, hsa; identical to SEQ ID NO: 124014

SEQ ID NO: 598906 - RNA, 64 nt, hsa; identical to SEQ ID NO: 124015

SEQ ID NO: 598907 - RNA, 64 nt, hsa; identical to SEQ ID NO: 124016

SEQ ID NO: 598908 - RNA, 64 nt, hsa
gagcuccaagauauaagcccuccaagggaucagaagcuccaaguuccugucuucuguuuuauag

SEQ ID NO: 598909 - RNA, 64 nt, hsa
cucaggaagcuucuagagacuuuaugcccuccagagcuccaagauauaagcccuccaagggauc

SEQ ID NO: 598910 - RNA, 64 nt, hsa
ggcgccaucuaugguguggaugggaaacugcuccagcuccaagagguuuuucagcucuuugaca

SEQ ID NO: 598911 - RNA, 64 nt, hsa
cuggagggcaguggcacgaucucagcucacugcaagcuccaacucccggguucacgccauucuc

SEQ ID NO: 598912 - RNA, 64 nt, hsa
acaaggauagaugcuggcccagggcccagagcccagcuccaaggggaaucagaacucaaauggg

SEQ ID NO: 598913 - RNA, 64 nt, hsa
uuugggccagacaugccacaaggacuuccuguccagcuccaaccugcaaagaucuguccucagc

SEQ ID NO: 598914 - RNA, 64 nt, hsa
uucccacuccucugagcccggaggggacaccccaagcuccaagcuccaagcuccaggccaaagg

SEQ ID NO: 598915 - RNA, 64 nt, hsa
uccucugagcccggaggggacaccccaagcuccaagcuccaagcuccaggccaaaggcugaaag

SEQ ID NO: 598916 - RNA, 64 nt, hsa
cuuccguccaggcagccgugcugcagacagaccuagugccgagggauggacaggcgagguggca

SEQ ID NO: 598917 - RNA, 64 nt, hsa
uugaccucgugaucugcccgccucggccucccaaagugccgagauuacaggugugagccaccgc

SEQ ID NO: 598918 - RNA, 64 nt, hsa
guggacauuucaagccaacugagccuuuuccucaagugccgacaccucccucaucucucuuaua

SEQ ID NO: 598919 - RNA, 64 nt, hsa
ggugguuauggagaggguguccggucccugucccagugccgagaaggaagccucccacgacugc

SEQ ID NO: 598920 - RNA, 64 nt, hsa
caaggccagugcugugccaagcccgguaaggccaagugccgaggcccagccuucccugccacuc

SEQ ID NO: 598921 - RNA, 64 nt, hsa
cccaguuguccgugaagagaaagacaguauuugcagugccgaugauauagagugacuuggagag

SEQ ID NO: 598922 - RNA, 64 nt, hsa
ccucccuucuccuuccacucccuuaguacacuggagugccgagcccugccuuccacccagcguc

SEQ ID NO: 598923 - RNA, 64 nt, hsa
uuuggguugguuccaagucuuugcuauugugaauagugccgaaauaaacauacgugugcaugug

SEQ ID NO: 598924 - RNA, 64 nt, hsa
caauguauagccaaauuguacgugcuuaaaaaacagugccgagaguauguucaguucgcaguaa

SEQ ID NO: 598925 - RNA, 64 nt, hsa
uucccuccaacggggaaagccaacuccaucucuaagugccgaacucaucccuguuccucaaggc

SEQ ID NO: 598926 - RNA, 64 nt, hsa
aacagcaaagaaucauccaccccaaaauaucaguagugccgagauugagaaacccugauuuauc

SEQ ID NO: 598927 - RNA, 64 nt, hsa
cggucccugugguguugccaggcaagagacacgaagugccgagacacuccucgccucaccgcgu

SEQ ID NO: 598928 - RNA, 64 nt, hsa
gugcaggccacagcagcaugcccuugguguagucagugccgaaaggggucuguuccuucuugag

SEQ ID NO: 598929 - RNA, 64 nt, hsa
ucgugacuuuguguuauuuuccguguuguuugaaagugccgaacaguuuagaccagcucaccaa

SEQ ID NO: 598930 - RNA, 64 nt, hsa
guaccugagagcacagguguaacugugaugucauagugccgagacuacuuuccuuuaaccauug

SEQ ID NO: 598931 - RNA, 64 nt, hsa
ugaauguggaaaguagcaccacuugacggcuacaagugccgacuccugaauuuucccauggugu

SEQ ID NO: 598932 - RNA, 64 nt, hsa
cucuucacagaccucacggaugugaccggagaugagugccgaugaccacguuuuaaaggagaaa

SEQ ID NO: 598933 - RNA, 64 nt, hsa
uagaguucaucaagccuugaaaggcaggcuucacagugccgaguuggcgggaaaagcaaauucu

SEQ ID NO: 598934 - RNA, 64 nt, hsa
agucccaggggcagccacaccacugccauuacccagugccgaggacaugcaugacacuuccaaa

SEQ ID NO: 598935 - RNA, 64 nt, hsa
ugggccagcacuucucccagucuccccgagucacagugccgaucccacccacccaccguagggu

SEQ ID NO: 598936 - RNA, 64 nt, hsa
ccgcuuuuuaaaaaaacacuuggugauucuuucaagugccgaauguuauuagaaucaacauugc

SEQ ID NO: 598937 - RNA, 64 nt, hsa
cguggaccauguuuuaauaauccaaaauaauuccagugccgaacccugaauuuaacauauggua

SEQ ID NO: 598938 - RNA, 64 nt, hsa
cauuguacauaacaaaacagcccccaaacagcccagugccgacaccauuguuccuuucacacuu

SEQ ID NO: 598939 - RNA, 64 nt, hsa
gggauucugaaugaucaauauagcuuggugagacagugccgagauagauagccaugucugccuu

SEQ ID NO: 598940 - RNA, 64 nt, hsa
ccgucauauaacuagaggaaguggaaugcagauaagugccgaauucaaacccuucauuuuaugu

SEQ ID NO: 598941 - RNA, 64 nt, hsa
ccaagcccuacuuguaugugcggagucacacugcagugccgaacaguauuagcucccguuccca

SEQ ID NO: 598942 - RNA, 64 nt, hsa
ccuugccucagccucgggaagccccugggagggcagugccgagggucaccuuggugcacuuucu

SEQ ID NO: 598943 - RNA, 64 nt, hsa
uauuuguuaaaaaaaucaguuauuuuauuuauugagugccgacuguaguaaagcccugaaauag

SEQ ID NO: 598944 - RNA, 52 nt, hsa
ucccaggccugcucucuugaacagugccgaaaacuucacugugcucaucaag

SEQ ID NO: 598945 - RNA, 64 nt, hsa
auaucccauagcacucaauaaacucagcugcuagagugccgaugucaggagggcugugucgggu

SEQ ID NO: 598946 - RNA, 64 nt, hsa
acuguuuuuuuucuuccuccaauaaaagugguguagugccgaaagugcuaaaauauuuagugcg

SEQ ID NO: 598947 - RNA, 64 nt, hsa
uggaagccacugcuaccgucuacccagcaccaguagugccgaugugccacacugcccaguugag

SEQ ID NO: 598948 - RNA, 64 nt, hsa
caagaauaucuggucuccccuaauuuuuauucccagugccgauguucaaaauaaacuuucucca

SEQ ID NO: 598949 - RNA, 64 nt, hsa
cccgcagguggcauuuuaaaacuuggcuuuagccagugccgaagaggagcaggcacagcuacau

SEQ ID NO: 598950 - RNA, 64 nt, hsa
cccgggagcugugugucuccgccagagucacagcagugccgagguguccgcggcagaccacaca

SEQ ID NO: 598951 - RNA, 64 nt, hsa
cuccaccucccagccaccugccuuggccucccaaagugccgagauugcagccucugcccggccg

SEQ ID NO: 598952 - RNA, 64 nt, hsa
ugccccgcccuuuguuugcacuauuggacuuaggagugccgaggguggggagauggagcugccc

SEQ ID NO: 598953 - RNA, 64 nt, hsa
gagaggcuagaaguagcuuuucugucuuuuggccagugccgaguggaaugccugguuuggggga

SEQ ID NO: 598954 - RNA, 64 nt, hsa
uguccacuuacccuagguagccccccaccccaucagugccgaguccuugucccuaccuccagcu

SEQ ID NO: 598955 - RNA, 64 nt, hsa
ucccugucccccagcaucgggggccugcaaaucuagugccgaaugacuauguccagauugguga

SEQ ID NO: 598956 - RNA, 64 nt, hsa
cauuuuucuuuugauggguuuagucuugcccuggagugccgaugaugauucucccuccagagcc

SEQ ID NO: 598957 - RNA, 64 nt, hsa
aaaggagagcaaacugcucagcgcgucucagcucagugccgaggaggaggaagaaaaacaggcc

SEQ ID NO: 598958 - RNA, 64 nt, hsa
cuguucucugggccugagccuggggccacccccaagugccgacuuguuucucccagagccccag

SEQ ID NO: 598959 - RNA, 64 nt, hsa
gcaaggcagagaggacacaggagagccagcccugagugccgaccuuggguggcggggccugggu

SEQ ID NO: 598960 - RNA, 64 nt, hsa
gucuuuacacugcaugcagaaguuuaaacacugaagugccgaaguggcccgugccgccgcacag

SEQ ID NO: 598961 - RNA, 64 nt, hsa
cgaucaaaaccugcuaccuccccaagacuuuacuagugccgauaaacuuucucaaagagcaacc

SEQ ID NO: 598962 - RNA, 64 nt, hsa
cgaaagugucagagauucggcugccggaaaugcaagugccgaagguucccgacgugcaucuucc

SEQ ID NO: 598963 - RNA, 64 nt, hsa
cucagagaaacaauggcuaagauaccaaaaccacagugccgacagcucuccaauacucagguua

SEQ ID NO: 598964 - RNA, 64 nt, hsa
gcuguguuuccagguguucacccguggugcccacagugccgacccguggcugggucggagcucc

SEQ ID NO: 598965 - RNA, 64 nt, hsa
ggcauggccccagccaugaaggaacuuaaccgcuagugccgaggacacguuaaacgaacaggau

SEQ ID NO: 598966 - RNA, 64 nt, hsa
ugagguucaggagaccggccuguuccugaguuugagugccgaccaacccccaggauggcggaag

SEQ ID NO: 598967 - RNA, 64 nt, hsa; identical to SEQ ID NO: 73896

SEQ ID NO: 598968 - RNA, 64 nt, hsa; identical to SEQ ID NO: 73897

SEQ ID NO: 598969 - RNA, 64 nt, hsa; identical to SEQ ID NO: 73898

SEQ ID NO: 598970 - RNA, 64 nt, hsa; identical to SEQ ID NO: 73899

SEQ ID NO: 598971 - RNA, 64 nt, hsa; identical to SEQ ID NO: 73900

SEQ ID NO: 598972 - RNA, 64 nt, hsa; identical to SEQ ID NO: 73901

SEQ ID NO: 598973 - RNA, 64 nt, hsa; identical to SEQ ID NO: 73902

SEQ ID NO: 598974 - RNA, 64 nt, hsa; identical to SEQ ID NO: 73903

SEQ ID NO: 598975 - RNA, 64 nt, hsa; identical to SEQ ID NO: 73904

SEQ ID NO: 598976 - RNA, 64 nt, hsa; identical to SEQ ID NO: 73905

SEQ ID NO: 598977 - RNA, 64 nt, hsa; identical to SEQ ID NO: 73906

SEQ ID NO: 598978 - RNA, 64 nt, hsa; identical to SEQ ID NO: 73907

SEQ ID NO: 598979 - RNA, 64 nt, hsa; identical to SEQ ID NO: 73908

SEQ ID NO: 598980 - RNA, 64 nt, hsa; identical to SEQ ID NO: 73909

SEQ ID NO: 598981 - RNA, 64 nt, hsa; identical to SEQ ID NO: 73910

SEQ ID NO: 598982 - RNA, 64 nt, hsa; identical to SEQ ID NO: 73911

SEQ ID NO: 598983 - RNA, 64 nt, hsa; identical to SEQ ID NO: 73912

SEQ ID NO: 598984 - RNA, 64 nt, hsa
agcauaacuuaucauauggcccagccauuucacuacuagaaauugacgcaagugaacugaaaac

SEQ ID NO: 598985 - RNA, 64 nt, hsa
cuguuuauagcagcuucauucauaauuaccaaaaacuagaaauaacccagauauccuucaacag

SEQ ID NO: 598986 - RNA, 62 nt, hsa
auuacagauuauuuuugaacuagaaauaaacuaaacuagaaauaaaauaaguuucacuaguu

SEQ ID NO: 598987 - RNA, 64 nt, hsa
gacauuucuuacagcaauuacagauuauuuuugaacuagaaauaaacuaaacuagaaauaaaau

SEQ ID NO: 598988 - RNA, 64 nt, hsa
guuuaauucagcaacaacaaaaaauacauauaaaacuagaaagggacuuuuuuuccuuucuuuu

SEQ ID NO: 598989 - RNA, 64 nt, hsa
ucuuuccuauucauauaucuauauaguaaauuucacuagaaaaauucuuuuaaaauugacagaa

SEQ ID NO: 598990 - RNA, 64 nt, hsa
aaaaaguggcauaaaauauuacaaaacauccaacacuagaaagcaaugacuaacauuuaauuug

SEQ ID NO: 598991 - RNA, 64 nt, hsa
cagcaaauccccuugaugcuaccuuugaaauauaacuagaaaagaaugacuugccaccauaucc

SEQ ID NO: 598992 - RNA, 64 nt, hsa
auauagcccuuguuuggauuacugcugucugagcacuagaaauuucuaauggaaagaggccucu

SEQ ID NO: 598993 - RNA, 54 nt, hsa
ccugccuugucguucgguaaugagacuagaaagagauacacuguaaaggagggg

SEQ ID NO: 598994 - RNA, 64 nt, hsa
uuuaagcuaaagagugauuaucuuucacaguagaacuagaaacaaaacccuaacuugugaaguu

SEQ ID NO: 598995 - RNA, 64 nt, hsa
guggccaacuugcuaucuggugggugacuuggggacuagaaagaauaaagccuuuucuaaauuu

SEQ ID NO: 598996 - RNA, 64 nt, hsa
aagcauguggcauaaauuuggagaaaauaauaugacuagaaaaauuaguguuauauugggugug

SEQ ID NO: 598997 - RNA, 64 nt, hsa
aauagaaaaaggcuguggauucuuugaggacaucacuagaaaucauucuuugucucaaguucac

SEQ ID NO: 598998 - RNA, 64 nt, hsa
aagcuuauucucauauaauacuaaucuaaacaguacuagaaauuacagugccaagagccaccag

SEQ ID NO: 598999 - RNA, 64 nt, hsa
uacguuguuaguagaaggucaauuuaaaauagggacuagaaauuauuugaaguuuucuuuauua

SEQ ID NO: 599000 - RNA, 64 nt, hsa
guguuauuugauauuuuaauuuauuuuuugauugacuagaaaaaucauuuuaauuucacuaaaa

SEQ ID NO: 599001 - RNA, 64 nt, hsa
ggcacuuuuaacagauuguuuauagagugauuuuacuagaaagaauuuaauaaacucgaaguuu

SEQ ID NO: 599002 - RNA, 64 nt, hsa
ugaaaaguaagaacagcucaucuucaaaguuuuuacuagaaauucagccgaaaagaagagaaau

SEQ ID NO: 599003 - RNA, 64 nt, hsa
gauuuuuuuguucuuguuguacccuuguuuugaaacuagaaaucuguccuguggcaugcaaaag

SEQ ID NO: 599004 - RNA, 64 nt, hsa
gccaguauuucucuaguaagauuauguuucucuuacuagaaaacuauuuucuaaauauuaacac

SEQ ID NO: 599005 - RNA, 64 nt, hsa
auagucccguuaggguuuaaaaccauauugaucaacuagaaagaaaaauaugaaaagagaaaaa

SEQ ID NO: 599006 - RNA, 64 nt, hsa
cugaauugcaauuacagaugcauacaacuacuauacuagaaaaaauugucauuucugaugugcc

SEQ ID NO: 599007 - RNA, 64 nt, hsa
agcaaaaauaaaauaauuauaaauggucauauguacuagaaaggaaaugggcaagggucaaaga

SEQ ID NO: 599008 - RNA, 64 nt, hsa; identical to SEQ ID NO: 168067

SEQ ID NO: 599009 - RNA, 64 nt, hsa; identical to SEQ ID NO: 168068

SEQ ID NO: 599010 - RNA, 64 nt, hsa; identical to SEQ ID NO: 168069

SEQ ID NO: 599011 - RNA, 64 nt, hsa; identical to SEQ ID NO: 168070

SEQ ID NO: 599012 - RNA, 64 nt, hsa; identical to SEQ ID NO: 168071

SEQ ID NO: 599013 - RNA, 64 nt, hsa; identical to SEQ ID NO: 168072

SEQ ID NO: 599014 - RNA, 64 nt, hsa; identical to SEQ ID NO: 168073

SEQ ID NO: 599015 - RNA, 64 nt, hsa; identical to SEQ ID NO: 168074

SEQ ID NO: 599016 - RNA, 64 nt, hsa; identical to SEQ ID NO: 168075

SEQ ID NO: 599017 - RNA, 64 nt, hsa; identical to SEQ ID NO: 168076

SEQ ID NO: 599018 - RNA, 64 nt, hsa; identical to SEQ ID NO: 168077

SEQ ID NO: 599019 - RNA, 64 nt, hsa; identical to SEQ ID NO: 168078

SEQ ID NO: 599020 - RNA, 64 nt, hsa; identical to SEQ ID NO: 168079

SEQ ID NO: 599021 - RNA, 64 nt, hsa; identical to SEQ ID NO: 168080

SEQ ID NO: 599022 - RNA, 64 nt, hsa; identical to SEQ ID NO: 275005

SEQ ID NO: 599023 - RNA, 64 nt, hsa; identical to SEQ ID NO: 275006

SEQ ID NO: 599024 - RNA, 64 nt, hsa; identical to SEQ ID NO: 275007

SEQ ID NO: 599025 - RNA, 64 nt, hsa; identical to SEQ ID NO: 275008

SEQ ID NO: 599026 - RNA, 64 nt, hsa; identical to SEQ ID NO: 275009

SEQ ID NO: 599027 - RNA, 64 nt, hsa; identical to SEQ ID NO: 275010

SEQ ID NO: 599028 - RNA, 64 nt, hsa; identical to SEQ ID NO: 275011

SEQ ID NO: 599029 - RNA, 64 nt, hsa; identical to SEQ ID NO: 275012

SEQ ID NO: 599030 - RNA, 64 nt, hsa; identical to SEQ ID NO: 275013

SEQ ID NO: 599031 - RNA, 64 nt, hsa; identical to SEQ ID NO: 275014

SEQ ID NO: 599032 - RNA, 64 nt, hsa; identical to SEQ ID NO: 275015

SEQ ID NO: 599033 - RNA, 64 nt, hsa; identical to SEQ ID NO: 275016

SEQ ID NO: 599034 - RNA, 51 nt, hsa; identical to SEQ ID NO: 275017

SEQ ID NO: 599035 - RNA, 64 nt, hsa; identical to SEQ ID NO: 275018

SEQ ID NO: 599036 - RNA, 64 nt, hsa; identical to SEQ ID NO: 275019

SEQ ID NO: 599037 - RNA, 64 nt, hsa; identical to SEQ ID NO: 275020

SEQ ID NO: 599038 - RNA, 64 nt, hsa; identical to SEQ ID NO: 275021

SEQ ID NO: 599039 - RNA, 64 nt, hsa; identical to SEQ ID NO: 275022

SEQ ID NO: 599040 - RNA, 64 nt, hsa; identical to SEQ ID NO: 275023

SEQ ID NO: 599041 - RNA, 64 nt, hsa; identical to SEQ ID NO: 275024

SEQ ID NO: 599042 - RNA, 64 nt, hsa; identical to SEQ ID NO: 275025

SEQ ID NO: 599043 - RNA, 64 nt, hsa; identical to SEQ ID NO: 275026

SEQ ID NO: 599044 - RNA, 64 nt, hsa; identical to SEQ ID NO: 275027

SEQ ID NO: 599045 - RNA, 64 nt, hsa; identical to SEQ ID NO: 275028

SEQ ID NO: 599046 - RNA, 64 nt, hsa; identical to SEQ ID NO: 275029

SEQ ID NO: 599047 - RNA, 64 nt, hsa; identical to SEQ ID NO: 275030

SEQ ID NO: 599048 - RNA, 64 nt, hsa; identical to SEQ ID NO: 275031

SEQ ID NO: 599049 - RNA, 64 nt, hsa; identical to SEQ ID NO: 275032

SEQ ID NO: 599050 - RNA, 64 nt, hsa; identical to SEQ ID NO: 275033

SEQ ID NO: 599051 - RNA, 64 nt, hsa; identical to SEQ ID NO: 275034

SEQ ID NO: 599052 - RNA, 64 nt, hsa; identical to SEQ ID NO: 275035

SEQ ID NO: 599053 - RNA, 64 nt, hsa; identical to SEQ ID NO: 275036

SEQ ID NO: 599054 - RNA, 64 nt, hsa; identical to SEQ ID NO: 275037

SEQ ID NO: 599055 - RNA, 64 nt, hsa; identical to SEQ ID NO: 275038

SEQ ID NO: 599056 - RNA, 64 nt, hsa; identical to SEQ ID NO: 275038

SEQ ID NO: 599057 - RNA, 64 nt, hsa; identical to SEQ ID NO: 275040

SEQ ID NO: 599058 - RNA, 64 nt, hsa; identical to SEQ ID NO: 275041

SEQ ID NO: 599059 - RNA, 64 nt, hsa; identical to SEQ ID NO: 275042

SEQ ID NO: 599060 - RNA, 64 nt, hsa; identical to SEQ ID NO: 275043

SEQ ID NO: 599061 - RNA, 64 nt, hsa; identical to SEQ ID NO: 275044

SEQ ID NO: 599062 - RNA, 64 nt, hsa; identical to SEQ ID NO: 275045

SEQ ID NO: 599063 - RNA, 64 nt, hsa; identical to SEQ ID NO: 275046

SEQ ID NO: 599064 - RNA, 64 nt, hsa; identical to SEQ ID NO: 275047

SEQ ID NO: 599065 - RNA, 64 nt, hsa; identical to SEQ ID NO: 275048

SEQ ID NO: 599066 - RNA, 64 nt, hsa; identical to SEQ ID NO: 275049

SEQ ID NO: 599067 - RNA, 64 nt, hsa; identical to SEQ ID NO: 275050

SEQ ID NO: 599068 - RNA, 64 nt, hsa; identical to SEQ ID NO: 275051

SEQ ID NO: 599069 - RNA, 64 nt, hsa; identical to SEQ ID NO: 124017

SEQ ID NO: 599070 - RNA, 64 nt, hsa; identical to SEQ ID NO: 124018

SEQ ID NO: 599071 - RNA, 64 nt, hsa; identical to SEQ ID NO: 124019

SEQ ID NO: 599072 - RNA, 64 nt, hsa; identical to SEQ ID NO: 124020

SEQ ID NO: 599073 - RNA, 64 nt, hsa; identical to SEQ ID NO: 124021

SEQ ID NO: 599074 - RNA, 64 nt, hsa; identical to SEQ ID NO: 124022

SEQ ID NO: 599075 - RNA, 64 nt, hsa; identical to SEQ ID NO: 124023

SEQ ID NO: 599076 - RNA, 64 nt, hsa; identical to SEQ ID NO: 124024

SEQ ID NO: 599077 - RNA, 64 nt, hsa; identical to SEQ ID NO: 124025

SEQ ID NO: 599078 - RNA, 64 nt, hsa; identical to SEQ ID NO: 124026

SEQ ID NO: 599079 - RNA, 64 nt, hsa; identical to SEQ ID NO: 124027

SEQ ID NO: 599080 - RNA, 64 nt, hsa; identical to SEQ ID NO: 124028

SEQ ID NO: 599081 - RNA, 64 nt, hsa; identical to SEQ ID NO: 259212

SEQ ID NO: 599082 - RNA, 64 nt, hsa; identical to SEQ ID NO: 259213

SEQ ID NO: 599083 - RNA, 64 nt, hsa; identical to SEQ ID NO: 259214

SEQ ID NO: 599084 - RNA, 64 nt, hsa; identical to SEQ ID NO: 259215

SEQ ID NO: 599085 - RNA, 64 nt, hsa; identical to SEQ ID NO: 259216

SEQ ID NO: 599086 - RNA, 64 nt, hsa; identical to SEQ ID NO: 259217

SEQ ID NO: 599087 - RNA, 64 nt, hsa; identical to SEQ ID NO: 259218

SEQ ID NO: 599088 - RNA, 64 nt, hsa; identical to SEQ ID NO: 259219

SEQ ID NO: 599089 - RNA, 64 nt, hsa; identical to SEQ ID NO: 259220

SEQ ID NO: 599090 - RNA, 64 nt, hsa; identical to SEQ ID NO: 259221

SEQ ID NO: 599091 - RNA, 64 nt, hsa; identical to SEQ ID NO: 259222

SEQ ID NO: 599092 - RNA, 64 nt, hsa; identical to SEQ ID NO: 259223

SEQ ID NO: 599093 - RNA, 64 nt, hsa; identical to SEQ ID NO: 259224

SEQ ID NO: 599094 - RNA, 64 nt, hsa; identical to SEQ ID NO: 259225

SEQ ID NO: 599095 - RNA, 64 nt, hsa
uuuuuuguuaggcuguaaagaauuuaagcuguaaauuacauaaguuagaacaagcccaaauuua

SEQ ID NO: 599096 - RNA, 64 nt, hsa
guuucauuauucucauaauccuucugcaacugaaauuacauauugcaggagacauuuucauauc

SEQ ID NO: 599097 - RNA, 64 nt, hsa
aaaauuuugcagaauuccuccuuucuacccauaaauuacauauauuuuucuucuuuagucaugg

SEQ ID NO: 599098 - RNA, 64 nt, hsa
aucuuucccuguguacugguauuauuaaaaagacauuacauacgcaagucuuucucgacaauca

SEQ ID NO: 599099 - RNA, 64 nt, hsa
auagaacaucuuuuuuagugaaagaaugugccauauuacauauugcaaccuaauuuguuaaaac

SEQ ID NO: 599100 - RNA, 64 nt, hsa
auaaucagaauuuugccuuuuuucuucucaaauuauuacauauguauguauuauauauccacau

SEQ ID NO: 599101 - RNA, 64 nt, hsa
gucagcagccgcuauuaccguaucuuacaauuuaauuacauacacagugaauugaaaccauugu

SEQ ID NO: 599102 - RNA, 64 nt, hsa
cauuauucuaaacuauucauucagcaugccuauaauuacauaaauuguaugagacuuuuuguug

SEQ ID NO: 599103 - RNA, 64 nt, hsa
acuguguuuugugauuuucauuuuuggcccaauuauuacauaucagguuuuccugauuuauauu

SEQ ID NO: 599104 - RNA, 64 nt, hsa
caaagcaaugccuuagcguuaaccuucguaacuaauuacauaucgcugaguguucugucacccc

SEQ ID NO: 599105 - RNA, 64 nt, hsa
uuuaaauuaauacucuuauuuuuuauuuaauuuaauuacauaaauuaaaccuuaccaugaccaa

SEQ ID NO: 599106 - RNA, 64 nt, hsa
uuuauaacuauaguaaaaaauuaauauauauccuauuacauaaauguuauuucuuagguguucc

SEQ ID NO: 599107 - RNA, 64 nt, hsa
cuuuuagaaaagggaguuuaaaaaugguaucaaaauuacauauacuacagucaagauagaaagg

SEQ ID NO: 599108 - RNA, 64 nt, hsa
aaagggcaaauaaugaucgaaaaaauaauuauuuauuacauaauuuaguuguuucuagacuaua

SEQ ID NO: 599109 - RNA, 64 nt, hsa
guuaaaaccaugaacauuggcuaugaugaagauuauuacauaugaaaaaaaaacucacacaaca

SEQ ID NO: 599110 - RNA, 64 nt, hsa
ucccaaugagaaguucuauuuucauguucuuaauauuacauacaagaaaaugcaguuagguuau

SEQ ID NO: 599111 - RNA, 64 nt, hsa
cacacgcagccccuccccgccacagagacacaccauuacauacacagacacacacagaaagaca

SEQ ID NO: 599112 - RNA, 64 nt, hsa
cacacacacacccuccccgccacagagacacaccauuacauacacagacacgcaaucgcagaua

SEQ ID NO: 599113 - RNA, 64 nt, hsa
aucacacacacacccuccccgccacagagacaccauuacauacacagacacacacagaaagaca

SEQ ID NO: 599114 - RNA, 64 nt, hsa
aucacacacacccccuccccaccacagagacaccauuacauacacagacacacacagaaagaca

SEQ ID NO: 599115 - RNA, 64 nt, hsa
auccacaaaacuaacaggauaauugggcaaauaaauuacauauaaacacacacaaucuauauau

SEQ ID NO: 599116 - RNA, 64 nt, hsa
acacuucauauauaauuaaucacuauuuuguauaauuacauauugcugcuuguguguuuuuuuu

SEQ ID NO: 599117 - RNA, 64 nt, hsa
cucuaacuaaagucuccaaguuauguauuauaauauuacauaguaguaugcuuaggcuuuacua

SEQ ID NO: 599118 - RNA, 64 nt, hsa
aagacaucacacuagaaacauaugcaauguuuuuauuacauacuucuacuggacaucacagaau

SEQ ID NO: 599119 - RNA, 64 nt, hsa
gagucuuuaauuguaaugacuuuguuuuauccacauuacauauuuauguauuucacuguuaugu

SEQ ID NO: 599120 - RNA, 64 nt, hsa
ggauccuagcaugacuauacauugugacauggucauuacauauggauuagaccaacuggagaau

SEQ ID NO: 599121 - RNA, 64 nt, hsa
ugacuuuguuuuauccacaguuaagccuuuucucauuacauauuuauguauuucacugucaugu

SEQ ID NO: 599122 - RNA, 64 nt, hsa; identical to SEQ ID NO: 599120

SEQ ID NO: 599123 - RNA, 64 nt, hsa
auuaaacuagacuuacuauuuuagugaguuaaaaauuacauacuaaaaguuuauugguagguaa

SEQ ID NO: 599124 - RNA, 64 nt, hsa
caugugucccauggcaaugugaauccaauagucaauuacauaaugacuauagaaacacaacagu

SEQ ID NO: 599125 - RNA, 64 nt, hsa
agagcugugcccguuuaucuucauuguauuaauuauuacauaaagauuaacaaauacauugcaa

SEQ ID NO: 599126 - RNA, 64 nt, hsa
acuucauuuguguauuaguucauuuucuguuucuauuacauaguuuuuaaagucaaugaaagag

SEQ ID NO: 599127 - RNA, 64 nt, hsa
gucaggaaaagaaaagaaacuuaguucuaccuugauuacauauguuguuacaaauuaucauuau

SEQ ID NO: 599128 - RNA, 64 nt, hsa
aaaauggcaaaaugccauuauuuaaauggaacuuauuacauaccaauggcuuugcaagaagaug

SEQ ID NO: 599129 - RNA, 64 nt, hsa
uguuaaaguaaaugaaauuguuauuuuuccuagagucaaccaaagaucagcauggucccuguug

SEQ ID NO: 599130 - RNA, 64 nt, hsa
uugucuaggaaaugacaugaauucaauaucuaaugucaaccaauggggagagccacaacuccag

SEQ ID NO: 599131 - RNA, 64 nt, hsa
gggcuacuuaaugcacagugcauuauguacacaggucaaccaugguaacaauaguucuuagcuu

SEQ ID NO: 599132 - RNA, 64 nt, hsa
cugggaagugccacuugcuccuuagagucuguuugucaaccaggcagagucccuuucuuuucug

SEQ ID NO: 599133 - RNA, 64 nt, hsa
aagccagcucagccuuccaagcugcuuagccuuugucaaccaucaaaguggggaaagggucucu

SEQ ID NO: 599134 - RNA, 64 nt, hsa
cuggaugaaaugaaauuguucacuugagggauuagucaaccaucugggggagaaguugcucacu

SEQ ID NO: 599135 - RNA, 64 nt, hsa
gcuuuuuuccuucccgucuuagccucacccccuugucaaccagauugaguugcuauagcuugau

SEQ ID NO: 599136 - RNA, 64 nt, hsa
uuaacuccauauguguuccucuuguucuaaucuugucaaccagugcaagugaccgacaaaauuc

SEQ ID NO: 599137 - RNA, 64 nt, hsa
aaauaaucaugaaccaaucuggaugccucauuaugucaaccagguccagaugugcuauaaucug

SEQ ID NO: 599138 - RNA, 62 nt, hsa
uggggccauuuucauuuuagucuuuucuaagagucaaccacaggcauuuaagucagccaaag

SEQ ID NO: 599139 - RNA, 64 nt, hsa
auaagcuauccauguguuugugauaagagugcuugucaaccaugaccaucuuugagccuuccua

SEQ ID NO: 599140 - RNA, 64 nt, hsa
uauccuguaguaacauagacccaaaguuacuauagucaaccaagucuuucaaaggauaaaagau

SEQ ID NO: 599141 - RNA, 64 nt, hsa
uuauacuaaaugggcuccuucauggugacgccccgucaaccacaaucaagaacugaggccugag

SEQ ID NO: 599142 - RNA, 64 nt, hsa
agcaaaaacauaguaauuacacaauuucagugcagucaaccaaaauguugagucaauuggaaug

SEQ ID NO: 599143 - RNA, 64 nt, hsa
uguuugguauuuuugaggcauuguuaacaugaaagucaaccacuggcuuugugaaaaaugcuau

SEQ ID NO: 599144 - RNA, 64 nt, hsa
uucagggggucaaggugguaagcugugcagugaagucaaccaguggccauggcuuacauguuug

SEQ ID NO: 599145 - RNA, 64 nt, hsa
uugaucccaggucuucagcuaagcucaaccaauugucaaccagaaaauguuuaaauuuaccuac

SEQ ID NO: 599146 - RNA, 64 nt, hsa
ugaaaacauuuggauugguaggauuuuguaacacgucaaccauuugaugcuucugaaaaguacu

SEQ ID NO: 599147 - RNA, 64 nt, hsa
agagccauaaguagcccuuuggaggacugauggugucaaccaaaggcaugugauugauuaauga

SEQ ID NO: 599148 - RNA, 64 nt, hsa
auggggacuggggauucuggccaguguaauuucugucaaccacggacguuugccuucaugugua

SEQ ID NO: 599149 - RNA, 64 nt, hsa
uaaaaaaaaaaagaccuuugucaaggagagugcagucaaccaguaaauugcagauucucagaau

SEQ ID NO: 599150 - RNA, 64 nt, hsa
uccugaguaguaaucucacacuucauccuauagagucaaccaccacagauaggaauuccuuauu

SEQ ID NO: 599151 - RNA, 64 nt, hsa
aaaaaaaaaaaagaccuuugucaaggagagugcagucaaccaguaaacugcagauucucagaau

SEQ ID NO: 599152 - RNA, 64 nt, hsa
ugggaaacaagcaagaacuaaauaaucaaauguugucaaccaaaaguaauaguuggguauugga

SEQ ID NO: 599153 - RNA, 64 nt, hsa
cuucuguuguagaaagcaguacaguaucuuaagugucaaccaguuauauaccuaaucugguuuu

SEQ ID NO: 599154 - RNA, 64 nt, hsa
aucauguggacacaagcauaaguaaagaaaauuugucaaccaggcaaaaugugguucuuuaaca

SEQ ID NO: 599155 - RNA, 64 nt, hsa
caacaccagggaaugccaaaaaaacaaagggcaagucaaccaaggcauuuugagaacaugaaau

SEQ ID NO: 599156 - RNA, 64 nt, hsa
aaaaugcaauuuagguaaucuuacguggagacaggucaaccaaagagggagcuaggcaaagcug

SEQ ID NO: 599157 - RNA, 64 nt, hsa
uuaaguuuuauguuuuauuacaauuuuuaaaugugucaaccaacuuuauaguacauaaauuaua

SEQ ID NO: 599158 - RNA, 64 nt, hsa
uucauuuuuauggcuuuuuacaguuucucauucugucaaccauauugaagugaaguggcauagu

SEQ ID NO: 599159 - RNA, 64 nt, hsa
aaacaagccugaagauuaaacaguaaucauuuuugucaaccacuccaggaagagucauuacuac

SEQ ID NO: 599160 - RNA, 64 nt, hsa
ugaagucagaagaccuggguucuugaaccagccugucaaccaguuguaugacuuuaaacaaggc

SEQ ID NO: 599161 - RNA, 64 nt, hsa
ccagcgugaaggaggcuuccagguacuucacccugucaaccaccucugaauccccaccaggcgc

SEQ ID NO: 599162 - RNA, 64 nt, hsa
uuucaucagcauuacuugggaaaacguguugcaagucaaccagucacuaggauauuucuaccca

SEQ ID NO: 599163 - RNA, 64 nt, hsa
caaggaagacgccaucagggaagccacauccuuagucaaccaguugcaucgugcggggcaaaau

SEQ ID NO: 599164 - RNA, 64 nt, hsa
ggacgggguagcaccccccauuggggcuauaacggucaaccauuucugucucuucuuuuucccc

SEQ ID NO: 599165 - RNA, 64 nt, hsa
uuaacauuguuugguuaaaaaaggugaaguuccagucaaccacuuuuuaccccugaaauuucaa

SEQ ID NO: 599166 - RNA, 64 nt, hsa
ugauucccucuugcuauuggaaugugguccagacgucaaccaggaacauguaacuuggagaggg

SEQ ID NO: 599167 - RNA, 64 nt, hsa
gauagaauuucugaaagagaaagagaaguagauggucaaccagucacuaguugguuggcaugag

SEQ ID NO: 599168 - RNA, 64 nt, hsa
ggggaggcuggguuuagccugugggccauaguuugucaaccacugguguaaaaccuuaguuaua

SEQ ID NO: 599169 - RNA, 64 nt, hsa
agcgcauucaugccuuucuaaacgcauuucaaaugucaaccaggaaggcacaccacuguauuag

SEQ ID NO: 599170 - RNA, 64 nt, hsa
uguggaucuuguccaaauuuagugaaauguggaagucaaccagaccaaugauggaauuaaaugu

SEQ ID NO: 599171 - RNA, 64 nt, hsa
ugugcacguguguguggcuaaauuaagucauacugucaaccacacgugaucucgucugaaacag

SEQ ID NO: 599172 - RNA, 64 nt, hsa
ccccagagccacacaugggcaucuaugggagagugucaaccagacagagggucacaguguuuac

SEQ ID NO: 599173 - RNA, 64 nt, hsa
acugcacuaguguuuaauaccagcaagccacguggucaaccaccuuucugacuuuuuauuuuug

SEQ ID NO: 599174 - RNA, 64 nt, hsa
uuuaccuguucauaucuagugccccacagugugugucaaccaaagguggcaguggcuacaucug

SEQ ID NO: 599175 - RNA, 64 nt, hsa
cuggaaucauuuucuuucucucugccagggacaugucaaccaagaaaccugaaaauauggaugg

SEQ ID NO: 599176 - RNA, 64 nt, hsa
cuucucuuacagagucucccucccuuuauagaaugucaaccaaagagugcccuccuccccucuc

SEQ ID NO: 599177 - RNA, 64 nt, hsa
gaaacagugcucuggugacaugauaaauauaugugucaaccaccauuucagcuauuaaaaacuc

SEQ ID NO: 599178 - RNA, 64 nt, hsa
cagaugguuugccuugccuuuccacccccuaauugucaaccacaaaaaugagaaauuccucuuc

SEQ ID NO: 599179 - RNA, 64 nt, hsa
ccaagggucagguuguuguacacuuacaguacgugucaaccauaauggaacauccacaaaugca

SEQ ID NO: 599180 - RNA, 64 nt, hsa
aauggccaaaacauaguggaggugcugugugugagucaaccacuuguaccacuauaccacuggg

SEQ ID NO: 599181 - RNA, 64 nt, hsa
agacugaacuacuguguguguaaccguuucccccgucaaccaaaaucaguguuuauagagugaa

SEQ ID NO: 599182 - RNA, 64 nt, hsa
cacauaucaacacauuuauuuauacuaaauaacugucaaccauuuucuaacaaaaaguaagacu

SEQ ID NO: 599183 - RNA, 64 nt, hsa
gaaggcucugguggagaaccugugcaugaaggccgucaaccaguccauaggugagccuggcugc

SEQ ID NO: 599184 - RNA, 64 nt, hsa
aaaaggaaaaaaaaaaaagaacugcugugggauugucaaccagcuuaucugcaggauguuucag

SEQ ID NO: 599185 - RNA, 64 nt, hsa
gcuugccaagacucauugcuggagguagagaggugucaaccagagaacagcuccccuagacaug

SEQ ID NO: 599186 - RNA, 64 nt, hsa
uguauuugacauguaaaauauguacaguauuaacgucaaccaucucuuuaaaguuagccuauaa

SEQ ID NO: 599187 - RNA, 64 nt, hsa
aagaagaaaagagaagaagaaaaaaacgaaaacagucaaccaaccccaucgccaacuaagcgag

SEQ ID NO: 599188 - RNA, 64 nt, hsa
cauuaaggaccuugguagcugugcuucagcaaacgucaaccaugguagcaaauuggugaggcug

SEQ ID NO: 599189 - RNA, 64 nt, hsa
caaagcagaggcugugggcugucacagaugcugugucaaccagggcccuagggcuaagggccug

SEQ ID NO: 599190 - RNA, 64 nt, hsa
ugcaaugcaggcccuggaggacugugcgucacccgucaaccagagcgugccuccgggccagcuu

SEQ ID NO: 599191 - RNA, 64 nt, hsa
gagaaagccagagauuagcccucauuccgcaucugucaaccaggacagaaagcauggacaaggg

SEQ ID NO: 599192 - RNA, 64 nt, hsa
caaagagaaaaaaaguuugccagaaguuugucaagucaaccaauguagaaagcuuugcuuaugg

SEQ ID NO: 599193 - RNA, 64 nt, hsa
ccacucucugcuuggcaucaauagaugcauaagggucaaccacauuuuuccucaaguucccugg

SEQ ID NO: 599194 - RNA, 64 nt, hsa
gcacugccauuuggagacauuccauuucagauuugucaaccagcgauaggccacauuccaguaa

SEQ ID NO: 599195 - RNA, 64 nt, hsa
cacuaggcauaaacagguuuuaauuggcuccucagucaaccaugaccaauaucucuaucucagc

SEQ ID NO: 599196 - RNA, 64 nt, hsa
aaaaaacguauuaucuuuaauaaaauguuauuaugucaaccagugaggcugcccugaacaaaaa

SEQ ID NO: 599197 - RNA, 64 nt, hsa
agcaacacuuuuuuucuuccagguuauuaaaugggucaaccagagcaaaagguuauuaagaaua

SEQ ID NO: 599198 - RNA, 64 nt, hsa
cuaccuuauguaaauuaugauguugaaaaugacagucaaccagaguagaugaaguguccuuaug

SEQ ID NO: 599199 - RNA, 64 nt, hsa
uuccuuguacucuuaggauauuugagucacuugugucaaccacuaaaguauagagaaaagugua

SEQ ID NO: 599200 - RNA, 64 nt, hsa
uuggucauuauuucagugugcauaaguucuuaaugucaaccaucuuuaagguauugugcaucga

SEQ ID NO: 599201 - RNA, 64 nt, hsa
ccucccucucauucccauccuuccugguacugcagucaaccaaagauggcaugacuuaccugcg

SEQ ID NO: 599202 - RNA, 64 nt, hsa
acaaagcuucucucaagagcucucguaguggccugucaaccacuuucggagaaugagccagguc

SEQ ID NO: 599203 - RNA, 64 nt, hsa
ugauagugucccaguacaaaaaggcuguaagauagucaaccacaguagucaccuaugucugugc

SEQ ID NO: 599204 - RNA, 64 nt, hsa
agauuaauguacccugcguuuugucuucaccauugucaaccagcagucaaggaugagcaccagg

SEQ ID NO: 599205 - RNA, 64 nt, hsa
ucaaccaacauccaguccugagaagcccugaucagucaaccagcuguggcuuccugugccuaga

SEQ ID NO: 599206 - RNA, 64 nt, hsa
uacaccuggcacacuggggucugcacaaggcuuugucaaccaaagacagcuucccccuuuugau

SEQ ID NO: 599207 - RNA, 64 nt, hsa
augucacuuauaaggggagaaguguucuuaaaaagucaaccagaaaacuguuaugccuuuuauu

SEQ ID NO: 599208 - RNA, 64 nt, hsa
accaucuucaucucuagcaccuccccugccaagagucaaccacuaagcaaucccacccaagccu

SEQ ID NO: 599209 - RNA, 64 nt, hsa
gcugccugauggcaucaccguggaggucauuguggucaaccaggucaaugccgggcaccuguuc

SEQ ID NO: 599210 - RNA, 64 nt, hsa
acggugucacuuuccauggguucaguuaucugcggucaaccacggucugacaauauuaaaugga

SEQ ID NO: 599211 - RNA, 64 nt, hsa
aagguucugugcugucucauugaaaaccgagccagucaaccacaaggcuggcagggugugaucc

SEQ ID NO: 599212 - RNA, 64 nt, hsa
ugauguggucacucggcuagcaggcccuucuguggucaaccacaugaugccugcuaguuaugau

SEQ ID NO: 599213 - RNA, 64 nt, hsa
gaugcagagcagccaaggauauguugacccagaugucaaccaggcuauuuuuauacuuaaaaca

SEQ ID NO: 599214 - RNA, 64 nt, hsa
uauccuuuuuagugcuauuucucagguuuucucagucaaccagcuagaugcaugugaugcaugu

SEQ ID NO: 599215 - RNA, 64 nt, hsa
uuuuuuuuuuuucuuaacccguucagugcugccagucaaccaagggucugugagugucagcgug

SEQ ID NO: 599216 - RNA, 64 nt, hsa
cagucuuuguuguuagcacugaauuauugaaaaugucaaccagauucuagaaacugcggucauc

SEQ ID NO: 599217 - RNA, 64 nt, hsa
ucuuucuuucuuuuuuuugagauggucuuguucugucaaccaggcuagaaugcagcggugcaau

SEQ ID NO: 599218 - RNA, 64 nt, hsa
gcaggcuggaagcaccagggaauuaauucccccagucaaccaauggcauccagagagggcaugg

SEQ ID NO: 599219 - RNA, 64 nt, hsa
ucugcugucccauagggacugcgacugggaccaggucaaccacgccaggggggugucaccagcc

SEQ ID NO: 599220 - RNA, 64 nt, hsa
ugggaagaagaagcuccagccaguucugcugcaagucaaccagcaugcagggggccuuccucua

SEQ ID NO: 599221 - RNA, 64 nt, hsa
gcaggcuggaagcaccagggaauuaauucccccagucaaccaauggcacccagagagggcaugg

SEQ ID NO: 599222 - RNA, 64 nt, hsa
ugaaaagaaaacuuuccucccucaauagugaagugucaaccauccagaacacaagguaggaugu

SEQ ID NO: 599223 - RNA, 64 nt, hsa
cugaggaguugaaagaacaaggaagaaguaccaagucaaccaaguucucucuugucacugaaua

SEQ ID NO: 599224 - RNA, 64 nt, hsa
gugugugugugugugugugugugaccuugauccagucaaccacuucaaauuccuacacugucuc

SEQ ID NO: 599225 - RNA, 64 nt, hsa
acucaagacuguucuggaaugaggguccaggccugucaaccauggggcuucugaccugagcacc

SEQ ID NO: 599226 - RNA, 64 nt, hsa
aagcaagagaagucacagcagcaagacacgcacagucaaccauuuuccgagaaaaaaagaaaau

SEQ ID NO: 599227 - RNA, 64 nt, hsa
ggguggauucgggagcugggaguaaccaggcaaagucaaccagaugccuagcuccugcugagac

SEQ ID NO: 599228 - RNA, 64 nt, hsa
uuuaaaauauaaaauucuuuuauguuuuuaaaccgucaaccaagaagucaagaccacugucccc

SEQ ID NO: 599229 - RNA, 64 nt, hsa
cuuuaguaguuuaccauaagggaauuuccuuuaagucaaccaugauuucuccuugauuucuaca

SEQ ID NO: 599230 - RNA, 64 nt, hsa
ugcugcaguuuuaccccagcagucagcugucuuugucaaccauacguuuuuggagauugggucu

SEQ ID NO: 599231 - RNA, 64 nt, hsa
uugauucgaagggucuuaaagaauuuuuuuaaucgucaaccacuuuuaaacauaaagaauucac

SEQ ID NO: 599232 - RNA, 64 nt, hsa
cccagcgauucugcagagcggccaucggcagcaugucaaccauuugcauggcugggcuccaggg

SEQ ID NO: 599233 - RNA, 64 nt, hsa
ucucugccccucagguccuggcccuuggguccuugucaaccagaggucuagggaaccacaaccc

SEQ ID NO: 599234 - RNA, 64 nt, hsa
guucagccccagucacccucuuuuacacaugugggucaaccacugugugcucagagggucaguc

SEQ ID NO: 599235 - RNA, 64 nt, hsa
uguacccaguaaacccuaaauaaauacccucuuugucaaccagaaauccugcucccucucuuca

SEQ ID NO: 599236 - RNA, 64 nt, hsa
aaacugugucuaugcaaccuuccaagugcggagugucaaccaacuggacgggagagaguacugc

SEQ ID NO: 599237 - RNA, 64 nt, hsa
cuacguuccuugucuuuuuccaaaggccagaauugucaaccaauuucuuuaauugaacauugua

SEQ ID NO: 599238 - RNA, 64 nt, hsa
augcacagcuuggccuguuaaguuaaaugugggugucaaccaguggaaaagaucaaaggaccuu

SEQ ID NO: 599239 - RNA, 64 nt, hsa
uuuaaaauuaggcugaauguacuucaugugauuugucaaccauaguuuaucagagauuauggac

SEQ ID NO: 599240 - RNA, 64 nt, hsa
aagccucacagggaaucugauaauacauacuucugucaaccagaaccagagggguaguuuucuu

SEQ ID NO: 599241 - RNA, 64 nt, hsa
uucacaugcaguguacuccaaaaagcggguuugggucaaccauuucccaucucuuuuuaagaag

SEQ ID NO: 599242 - RNA, 64 nt, hsa
cuccuuagcccccccaaaaaauuacaauaauuuugucaaccaauacagaacaugagcccuuuuu

SEQ ID NO: 599243 - RNA, 64 nt, hsa
guuaucaaacagagcauggucuacaucccacugugucaaccagaagagccaaguguuaucucaa

SEQ ID NO: 599244 - RNA, 63 nt, hsa
uugccuuaguggcuugccugugccucuggguggauuacauaugauaguaaagcccaccuguuu

SEQ ID NO: 599245 - RNA, 63 nt, hsa
uaauacagcugugaagggcuaaaguuagaguugauuacauaaguaaguauuccccauauaauc

SEQ ID NO: 599246 - RNA, 63 nt, hsa
uaaaacauuaagaaaauuauggcuguugcugucauuacauaucuauuaaaugucaucaaauau

SEQ ID NO: 599247 - RNA, 63 nt, hsa
aaguaaguagcauaaaucaguauuuaaccuaaaauuacauauuugaaacagaagauauuaugu

SEQ ID NO: 599248 - RNA, 63 nt, hsa
cgaagaacuggagacccugucaaauaugacaggauuacauaagggacacugauauacugaaag

SEQ ID NO: 599249 - RNA, 63 nt, hsa
cuaaaugaaggauugcuaaauguuuuugguucaauuacauaaaaauuaauauucugggucuga

SEQ ID NO: 599250 - RNA, 63 nt, hsa
cccauauucaacauuuuguguacuguuuuucuaauuacauauauuacaaugaacaaccuuaug

SEQ ID NO: 599251 - RNA, 63 nt, hsa
aaacuuacaagucaagccuagccugauaauccuauuacauaguuugaaaaauaguauuuuauu

SEQ ID NO: 599252 - RNA, 63 nt, hsa
uccccagaggggcccuagugccucuguuccugaauuacauaagaauguaccaugccgggaagc

SEQ ID NO: 599253 - RNA, 63 nt, hsa
ugccuccagccugaguccuaggcucuaaaagauauuacauauuugaacuaauagaggaacucu

SEQ ID NO: 599254 - RNA, 63 nt, hsa
agaaccaaaaauaccuagauuuuuggagaacuuauuacauacauagaaacaugaauaugguuu

SEQ ID NO: 599255 - RNA, 63 nt, hsa
agguucacuuggaccuagugcugccuccuguuuauuacauagcauggcccuuaugucuugagu

SEQ ID NO: 599256 - RNA, 63 nt, hsa
uuugagaaaucuacaccaaagugguuuuuuaaaauuacauaacuaaaaauaaaccacacugug

SEQ ID NO: 599257 - RNA, 63 nt, hsa
ggauuuccugcuggaccacaagguucuguugauauuacauagaacggguauuccagacacuuc

SEQ ID NO: 599258 - RNA, 63 nt, hsa
ucuugaugucuuccuucaaauuaaugaccuuggauuacauaaggauuucuaugcauucauuau

SEQ ID NO: 599259 - RNA, 63 nt, hsa
uaauuaauauuaauauuaacaauauugauguuaauuacauagcauacuauuucaauaaauuau

SEQ ID NO: 599260 - RNA, 63 nt, hsa
uugaaauccaaagaaaauuauaguuuaaauucaauuacauaguccagugguccaacuauaauu

SEQ ID NO: 599261 - RNA, 63 nt, hsa
gggaggauggggaagcuuuuuauauaugcauacauuacauaccuauauauaaacuugugguau

SEQ ID NO: 599262 - RNA, 63 nt, hsa
uauagcugcaccaacaauaucccgccuccucuaauuacauaugauguucucuguucaaaagua

SEQ ID NO: 599263 - RNA, 63 nt, hsa
uuggacaguuucauuuuuuuggauuugggauagauuacauaggaguauggaguaugcuguaaa

SEQ ID NO: 599264 - RNA, 63 nt, hsa
aaauguauccuaaucuuauguauguuuaacuggauuacauagauuuuuaucuuuuguuaaaau

SEQ ID NO: 599265 - RNA, 63 nt, hsa
uuuuaaaaaaggaauuaacauccaauauucuguauuacauacuguacaccagauuuugauuuc

SEQ ID NO: 599266 - RNA, 63 nt, hsa
caguaaccccuaccucacaggguuguugugaggauuacauauaugcuaaagcauuuugcauau

SEQ ID NO: 599267 - RNA, 63 nt, hsa
ugaaauucccuguucuaguuccuaacaauucucauuacauacuaugccagauuacaaaauacu

SEQ ID NO: 599268 - RNA, 63 nt, hsa
auucucuguacuuaccacaguauuuugcacuugauuacauauccuucacucucuucucuucau

SEQ ID NO: 599269 - RNA, 63 nt, hsa
aagaucaacaagagcacuguacuccuggcaauuauuacauauguuagaacauggauuuugcac

SEQ ID NO: 599270 - RNA, 63 nt, hsa
caaaguauccaauauuuuaaagccacaaaguagauuacauaauuagcagagauuuuagucagu

SEQ ID NO: 599271 - RNA, 63 nt, hsa
ccuucuugcuuuuucauaucuguaaagaaaaaaauuacauaucaguuguccuuuaaugaaaau

SEQ ID NO: 599272 - RNA, 63 nt, hsa
ugauugugagugaaccuagaacagcacugaaguauuacauaaccuggaagacugagaagggua

SEQ ID NO: 599273 - RNA, 63 nt, hsa
uuguguugugugaauuuauuaacaaauaacauuauuacauauaggucauuguuaacaaacaaa

SEQ ID NO: 599274 - RNA, 63 nt, hsa
auuugcucauuccccuguauuucccacauauauauuacauauacccgcuaauaaauuuauguu

SEQ ID NO: 599275 - RNA, 63 nt, hsa
uguucauguuuugcuaaugcucguaucuccuugauuacauaauguuaguagcacugagacccc

SEQ ID NO: 599276 - RNA, 63 nt, hsa
uagaggaaaagcagauacuagaauucuaauuuaauuacauauacagccgucuuuguuuauagu

SEQ ID NO: 599277 - RNA, 63 nt, hsa
ugagccuuaaucauguaacaaaauauuuuguagauuacauauugauuuuucaaaaauuaaaaa

SEQ ID NO: 599278 - RNA, 63 nt, hsa
guugcauaguuaccagggaagauuaguccagugauuacauaagaguugggcaccauaaauucu

SEQ ID NO: 599279 - RNA, 63 nt, hsa
aauuacacaagaaaacaguauugcaaugacaccauuacauaaggaacauugaacuguuagagg

SEQ ID NO: 599280 - RNA, 63 nt, hsa
aaaaacugauaguuacuugcuuguuuuuuaaaaauuacauauuaaaaaugcccuuggcauaag

SEQ ID NO: 599281 - RNA, 63 nt, hsa
uagucacacaucauuugauaaguuggauguuccauuacauagaggaacacaaaauuccagggu

SEQ ID NO: 599282 - RNA, 63 nt, hsa
uuuuuacucuguuauugugguaauggacagaauauuacauacaaaaauauucugggagagcuu

SEQ ID NO: 599283 - RNA, 63 nt, hsa
uuuucuaauuuuaugccuuaaaauagguuucugauuacauaaaauuugaauagaacacucaag

SEQ ID NO: 599284 - RNA, 63 nt, hsa
uaagugccugggggaaggauacaauuuuuagaaauuacauauugggucaguuuuguuuuguuu

SEQ ID NO: 599285 - RNA, 63 nt, hsa
uuauuuuuucuguggucuuacugaucuuuguauauuacauacaugcuuugaaguuucuggaaa

SEQ ID NO: 599286 - RNA, 63 nt, hsa
aaagugaauuugauagcucagcauuuaagcaugauuacauauucagauagcucuuuuugcuuu

SEQ ID NO: 599287 - RNA, 63 nt, hsa
aaauauagguauuuuaguacaguacauacuugcauuacauagguacuucaagcaacacaauaa

SEQ ID NO: 599288 - RNA, 63 nt, hsa
cauugggaaauuuucaugcacgcuuauuauguuauuacauauguuuauauaaaauccaucucu

SEQ ID NO: 599289 - RNA, 63 nt, hsa
uuaaaaguaagucauuuauacaucuuagaaaaaauuacauaguuuuguuuuuacaauucugaa

SEQ ID NO: 599290 - RNA, 63 nt, hsa
aguguaucacagcuuucauuaggaaaacuuuucauuacauacuuguuuaaacucugucuucca

SEQ ID NO: 599291 - RNA, 63 nt, hsa
acccuuucaacaugaaagguuuguaguugagacauuacauauauuuuauuguuuauaauaaaa

SEQ ID NO: 599292 - RNA, 63 nt, hsa
aguguauauaaaaacgguuuauuuuucuucucuauuacauaucucuuuuuuucuuguuuuuau

SEQ ID NO: 599293 - RNA, 63 nt, hsa
cagccucaagugcaggcauuuuugaguggccugauuacauauuccucccacagcaaguccgua

SEQ ID NO: 599294 - RNA, 63 nt, hsa
uuucuguaaaugaaauugguagagaaccaugaaauuacauagaugcagaugcagaaagcagcc

SEQ ID NO: 599295 - RNA, 63 nt, hsa
accuucuuaaaauaugugcuuuagguagguguuauuacauaucuguagacaauugguauauga

SEQ ID NO: 599296 - RNA, 63 nt, hsa
uuguuuccaucacuguauuacuuguguaacaugauuacauaauucuuauccuaagagaaagcu

SEQ ID NO: 599297 - RNA, 63 nt, hsa
auacauuuaacuuguaaaauagacugugauauuauuacauaauguaauuaaaaauaugaauua

SEQ ID NO: 599298 - RNA, 63 nt, hsa
cagaagacagugaugcuguauuauuuuagauuuauuacauagauuuggaauucacuuuuuuca

SEQ ID NO: 599299 - RNA, 63 nt, hsa
ucuguaauaauagagcccuucuuuugaaucaaaauuacauauggacuuuggaagauugcuccu

SEQ ID NO: 599300 - RNA, 63 nt, hsa
uuguaccguugucuucaucacugggaaaugauuauuacauaguacagaagauucuuuguuuuu

SEQ ID NO: 599301 - RNA, 63 nt, hsa
auucuugguuuuuaaacuuuaccaugugucugaauuacauagugugcuuguaaaaagaagagu

SEQ ID NO: 599302 - RNA, 63 nt, hsa
agaaauuucucaucacagggauuuagacuuacuauuacauaaaggcuaacuaugagcuugcuc

SEQ ID NO: 599303 - RNA, 63 nt, hsa
uauuucacuagaaaaaauuuaauaucaaggacuauuacauacuucauuacuaggaaguucuuu

SEQ ID NO: 599304 - RNA, 63 nt, hsa
uuuuuguuaggcuguaaagaauuuaagcuguaaauuacauaaguuagaacaagcccaaauuua

SEQ ID NO: 599305 - RNA, 63 nt, hsa
uuucauuauucucauaauccuucugcaacugaaauuacauauugcaggagacauuuucauauc

SEQ ID NO: 599306 - RNA, 63 nt, hsa
acaaauuauauauauacauauccacacacauacauuacauauaucuguguauauaaauccaca

SEQ ID NO: 599307 - RNA, 63 nt, hsa
gcgugacuguaaacacaucguugaaguaaagcgauuacauauugaguaugucagcuuuucuca

SEQ ID NO: 599308 - RNA, 63 nt, hsa
gagcaauguuuucagucuuuuaggauuagaagaauuacauaaaaauuaauaaacauuuucaau

SEQ ID NO: 599309 - RNA, 63 nt, hsa
gucaggacagaaaagcuuccauaauugaacuagauuacauaauaguauuucuagaaaaagaga

SEQ ID NO: 599310 - RNA, 63 nt, hsa
uuuaauuauuagugguaguaauauauagaauguauuacauaacugucacugaagugguugggg

SEQ ID NO: 599311 - RNA, 63 nt, hsa
guuguuuggauauuucauauaaagauggcuauaauuacauauuucauucccaauuugugugug

SEQ ID NO: 599312 - RNA, 63 nt, hsa
uguucucucaguagaaaaaaaaauacuuauaaaauuacauauucugaaagaggauuccgaaag

SEQ ID NO: 599313 - RNA, 63 nt, hsa
aagaaagaccacgugugcauguugucaucuucaauuacauaacagaaaucaauaagauaugug

SEQ ID NO: 599314 - RNA, 63 nt, hsa
guuacccuaaguuuuuuacauuuuuaaacucuaauuacauaugugaauguuauuacucucagu

SEQ ID NO: 599315 - RNA, 63 nt, hsa
aucaggaaauagagaugauguggauauuuauauauuacauauauaaccaccagacuccauuuu

SEQ ID NO: 599316 - RNA, 63 nt, hsa
ugguauuuaaagguaauauuuuuaauaugauacauuacauauugugaauguauacuaaaaaaa

SEQ ID NO: 599317 - RNA, 63 nt, hsa
uaauaaauaaauauauuuuugacacaauuaaauauuacauagaguauguuuacaacaaauauc

SEQ ID NO: 599318 - RNA, 63 nt, hsa
uucuggagaaaaauacuuauagacaguuuaacuauuacauagauauauaagugaucucaguuu

SEQ ID NO: 599319 - RNA, 63 nt, hsa
aguuauuuccaaguuuguguauauauuauaaaaauuacauauauaaaacuaaggcuuuuauuu

SEQ ID NO: 599320 - RNA, 63 nt, hsa
ucuaucucucuguguccaggauagcugggaggcauuacauagucaugugcgaggucaaaacug

SEQ ID NO: 599321 - RNA, 63 nt, hsa
aaauuuugcagaauuccuccuuucuacccauaaauuacauauauuuuucuucuuuagucaugg

SEQ ID NO: 599322 - RNA, 63 nt, hsa
ucuuucccuguguacugguauuauuaaaaagacauuacauacgcaagucuuucucgacaauca

SEQ ID NO: 599323 - RNA, 63 nt, hsa
gaaauacauggauuuaacuuguuaaacauacaaauuacauagcugccauuugcauacauuuug

SEQ ID NO: 599324 - RNA, 63 nt, hsa
uagaugguauuaucacagauuuaaaaagguuguauuacauauuguuuaaacuuuguaaguaga

SEQ ID NO: 599325 - RNA, 63 nt, hsa
aagaugaggacagaagcaucucuacagaugaaaauuacauaaauaaaacauucuccaucaaca

SEQ ID NO: 599326 - RNA, 63 nt, hsa
auuuuuauguacuaaauauuuacacuaauaucaauuacauauuuugguaaacuagagagacau

SEQ ID NO: 599327 - RNA, 63 nt, hsa
cuuuuaaagguuuugaccauuuuguuaugaguaauuacauauauauuacauucacuauauuaa

SEQ ID NO: 599328 - RNA, 63 nt, hsa
uuuaccuggguuugagccuacagucuauuuaugauuacauaucaaaauugauuaaaacacuuc

SEQ ID NO: 599329 - RNA, 63 nt, hsa
aaagcuaacacaggaaaaggaacuguacuggcuauuacauaagaaacaauggacccaagagaa

SEQ ID NO: 599330 - RNA, 63 nt, hsa
auuuacuaccacuuguucuuuagccaaaagcugauuacauaugauauaaacagagaaauaccu

SEQ ID NO: 599331 - RNA, 63 nt, hsa
ccacucuguaauaguucaguagaauuaccauuaauuacauacagauuuuaccuauccacaaua

SEQ ID NO: 599332 - RNA, 63 nt, hsa
gacgggcacauuuuucaacgauuaagaaucaucauuacauaacuuggugaaacugaaaaagua

SEQ ID NO: 599333 - RNA, 63 nt, hsa
uugagaguauagcaugaauguuuuuagaggacuauuacauauuuuuuguauauuuguuuuaug

SEQ ID NO: 599334 - RNA, 63 nt, hsa
accucaucuuugaauuuagaauaaaaguggcacauuacauaucggaucuaagagauuaauacc

SEQ ID NO: 599335 - RNA, 63 nt, hsa
ucaacacaaaagguuuucccauuaauaugaaauauuacauauauauaagugccauauuuaaaa

SEQ ID NO: 599336 - RNA, 63 nt, hsa
uuuauucuuaaaaagcucauaaauaauuggcuuauuacauauaaacuucaaaaaaguggguua

SEQ ID NO: 599337 - RNA, 63 nt, hsa
auauuuaaaucaaacaucauucauagaaagcauauuacauacauguuuauacauaagcauuac

SEQ ID NO: 599338 - RNA, 63 nt, hsa
uuguggguauuuuuuugguagcacauguaugcuauuacauacaaauuuuuauuucuaaaauau

SEQ ID NO: 599339 - RNA, 63 nt, hsa
uagaacaucuuuuuuagugaaagaaugugccauauuacauauugcaaccuaauuuguuaaaac

SEQ ID NO: 599340 - RNA, 63 nt, hsa
uaaucagaauuuugccuuuuuucuucucaaauuauuacauauguauguauuauauauccacau

SEQ ID NO: 599341 - RNA, 63 nt, hsa
ucagcagccgcuauuaccguaucuuacaauuuaauuacauacacagugaauugaaaccauugu

SEQ ID NO: 599342 - RNA, 63 nt, hsa
auuauucuaaacuauucauucagcaugccuauaauuacauaaauuguaugagacuuuuuguug

SEQ ID NO: 599343 - RNA, 63 nt, hsa
uuccuuuuacauucuuuuuauaugcauucugacauuacauauuuuuuaagacuauggaaauaa

SEQ ID NO: 599344 - RNA, 63 nt, hsa
cauugaucuauccguaccaaaugauguugaauaauuacauaucuuucuugacuauacugauuu

SEQ ID NO: 599345 - RNA, 63 nt, hsa
cacuagcauguuuuucagaccaaauauuaucagauuacauauaauuuaaucaaauuaauuuau

SEQ ID NO: 599346 - RNA, 63 nt, hsa
auuaaucuguguaauaaacugguuacuacagucauuacauauaauuuugugugaauaggcuuu

SEQ ID NO: 599347 - RNA, 63 nt, hsa
ccagaaaaaagauuaaugguccugaguaggaauauuacauaauuuugauugcaucauuaguua

SEQ ID NO: 599348 - RNA, 63 nt, hsa
uuggagcacacccuaguaaccucuugagauuaaauuacauagucuuaauauuucuguuccucc

SEQ ID NO: 599349 - RNA, 63 nt, hsa
uugaauagaguaucaccuuuuucaacaagauuuauuacauaucauuuccuaagcaucugccuu

SEQ ID NO: 599350 - RNA, 63 nt, hsa
ucucuuuaaauuuaaaucuucauuuagaugguaauuacauauccuuauauuuacuuuaaaaaa

SEQ ID NO: 599351 - RNA, 63 nt, hsa
acaugagaaaucacucacuuugauuauguauagauuacauaggaagaacaaucacaucaguaa

SEQ ID NO: 599352 - RNA, 63 nt, hsa
auuuucauuugaaauguuuuucacaccuuuugcauuacauaauaauuuuguggaagcauuuug

SEQ ID NO: 599353 - RNA, 63 nt, hsa
uccacuuuuuuuaaucguaacaccuccauuuguauuacauaugguguauggguauugaugagg

SEQ ID NO: 599354 - RNA, 63 nt, hsa
cuguguuuugugauuuucauuuuuggcccaauuauuacauaucagguuuuccugauuuauauu

SEQ ID NO: 599355 - RNA, 63 nt, hsa
aaagcaaugccuuagcguuaaccuucguaacuaauuacauaucgcugaguguucugucacccc

SEQ ID NO: 599356 - RNA, 63 nt, hsa
cuuugugaauuaacacaguguuucaauucuguaauuacauauuugacucuuucaaagaaaucc

SEQ ID NO: 599357 - RNA, 63 nt, hsa
ugagggaagcaugaaccucagacuucuggcacuauuacauaguaagcacaugaaguaguuuga

SEQ ID NO: 599358 - RNA, 63 nt, hsa
uucuguguuagaaagguuuuauauauauauaaaauuacauauauauguagaaauauauguaau

SEQ ID NO: 599359 - RNA, 63 nt, hsa
ugaguaaugguuacuaggcuuaauaccugggugauuacauaaucuguacaaugaacccccaug

SEQ ID NO: 599360 - RNA, 63 nt, hsa
uuuuaauuuauuaccuuuacaacauuuauuuacauuacauacauacauuuacaacauuuauua

SEQ ID NO: 599361 - RNA, 63 nt, hsa
cggcgagagggcuugagucucaaggacucacugauuacauacccaaaggcucuuuucagagcc

SEQ ID NO: 599362 - RNA, 63 nt, hsa
cuuccuggggccaguauuaccuuguaugcaaauauuacauaugaugggugcauugucagaggg

SEQ ID NO: 599363 - RNA, 63 nt, hsa
uauucacugaauugucaguuuccuucauuugguauuacauauuuaauucuuaaauauugaggc

SEQ ID NO: 599364 - RNA, 63 nt, hsa
cugagccucaguuuucuccuuugcaaauuaauaauuacauaccuuuauagauuuugaaauuaa

SEQ ID NO: 599365 - RNA, 63 nt, hsa
gcaacauacaauugcaaaagaugaguuuaaaaaauuacauacaaacagcuuguauuauauuuu

SEQ ID NO: 599366 - RNA, 63 nt, hsa
uuaaauuaauacucuuauuuuuuauuuaauuuaauuacauaaauuaaaccuuaccaugaccaa

SEQ ID NO: 599367 - RNA, 63 nt, hsa
uuauaacuauaguaaaaaauuaauauauauccuauuacauaaauguuauuucuuagguguucc

SEQ ID NO: 599368 - RNA, 63 nt, hsa
cuuuugagcgcauggaacuccauaaacuaacaaauuacauaaacuaaagggggauuuucuuuc

SEQ ID NO: 599369 - RNA, 63 nt, hsa
gauaucaaccuauuuucacaucauaaaacaucuauuacauaaaauaaagguccaggcauagug

SEQ ID NO: 599370 - RNA, 63 nt, hsa
uaguaauagcuauuuuauugauauuauuacuuuauuacauaucuuuuauagggaaacauucug

SEQ ID NO: 599371 - RNA, 63 nt, hsa
gcuaaaauuguguugaugcuguuuacucaccuaauuacauaguuuuaaucauuuguacauaau

SEQ ID NO: 599372 - RNA, 63 nt, hsa
auaaaaauuauuuaacauuuauauuuuuacuugauuacauaugcacauguauguaaauguaaa

SEQ ID NO: 599373 - RNA, 63 nt, hsa
cuauucuacaucagacuugauuuuugucagcuaauuacauaauugguaagcuauaauugaaac

SEQ ID NO: 599374 - RNA, 63 nt, hsa
uaggaugagccucuccuagacuugaccuagaauauuacauauuccuccaguaaguaauacuga

SEQ ID NO: 599375 - RNA, 63 nt, hsa
uuuauuuccaucccauggauuaccuagagggaaauuacauacaucaaaaauccaguggaaaga

SEQ ID NO: 599376 - RNA, 63 nt, hsa
ugcacaaaaauauuauuauuagucuuaacuaaaauuacauauuuuauaaugcccugcaacucu

SEQ ID NO: 599377 - RNA, 63 nt, hsa
gaaaguguuaaaauuucugaaaauaaaugcuuaauuacauauacaggaauuaaauaguuugga

SEQ ID NO: 599378 - RNA, 63 nt, hsa
uaccugggggugccuugauuaaaaucgaacuuuauuacauacugauucuggaacaaaacaguu

SEQ ID NO: 599379 - RNA, 63 nt, hsa
agcacuaauaucauagugcugugaugauggacaauuacauaguaccgauaacagccaugcacu

SEQ ID NO: 599380 - RNA, 63 nt, hsa
cuagcauggcuaauugaucauugauuggaccucauuacauaagggggcuguggacgucuuugg

SEQ ID NO: 599381 - RNA, 63 nt, hsa
acaauuugauaugcuucaauuuuguaaaaucaaauuacauauauauaaaaaaaccuaucugua

SEQ ID NO: 599382 - RNA, 63 nt, hsa
uguauauuuuguuaccuuuuacagaauaaaagaauuacauaugaaaaacccucuaaaccaugg

SEQ ID NO: 599383 - RNA, 63 nt, hsa
ucauaaaauuauaugauuaaugaucacaguauaauuacauaagaauuuguuauauauguuucu

SEQ ID NO: 599384 - RNA, 63 nt, hsa
uuuuagaaaagggaguuuaaaaaugguaucaaaauuacauauacuacagucaagauagaaagg

SEQ ID NO: 599385 - RNA, 63 nt, hsa
aagggcaaauaaugaucgaaaaaauaauuauuuauuacauaauuuaguuguuucuagacuaua

SEQ ID NO: 599386 - RNA, 63 nt, hsa
uaauaucagaaugcaguccaaagagcaaaucauauuacauaauuacauuuuaauuaaauauag

SEQ ID NO: 599387 - RNA, 63 nt, hsa
gauguacauguguagggaaaguuaaaaguguugauuacauaaucaaagcuaccuguggugaug

SEQ ID NO: 599388 - RNA, 63 nt, hsa
ucuaccugccuuauacuacacuuaggaaaaaguauuacauaugguuuauuuugaaacuucaag

SEQ ID NO: 599389 - RNA, 63 nt, hsa
gggcuaacuaccucugauccucuuugaccuuccauuacauaccuaauccuagcugucuccuca

SEQ ID NO: 599390 - RNA, 63 nt, hsa
auaaaauauuuuguaauuaccuguagcuaauacauuacauagaaaaaaacuauguuaacagug

SEQ ID NO: 599391 - RNA, 63 nt, hsa
ucuccuuaauaauggugguguuuagcaaauuguauuacauaaauaaauauuuauuucauggau

SEQ ID NO: 599392 - RNA, 63 nt, hsa
gcaaauuugcuuaguaucuaauaaugaaguguuauuacauauagccggaauugaggaucucuu

SEQ ID NO: 599393 - RNA, 63 nt, hsa
auucuuaacugguuguaaauuagaaaagcugggauuacauauggugugcgguuacagucuaaa

SEQ ID NO: 599394 - RNA, 63 nt, hsa
uuaaaaccaugaacauuggcuaugaugaagauuauuacauaugaaaaaaaaacucacacaaca

SEQ ID NO: 599395 - RNA, 63 nt, hsa
cccaaugagaaguucuauuuucauguucuuaauauuacauacaagaaaaugcaguuagguuau

SEQ ID NO: 599396 - RNA, 63 nt, hsa
uuagucccuuccaaaaccauuuaguaggguucuauuacauaaacaguaggguuuuuccucucc

SEQ ID NO: 599397 - RNA, 63 nt, hsa
uguacuuuugaacaagagcuccuccugaucacuauuacauauuuuucuagaaaaucuaaaguu

SEQ ID NO: 599398 - RNA, 63 nt, hsa
ccuauuuagaguuggaaguugaacagcuguugcauuacauacuuuugcuuuuuuauugaaauu

SEQ ID NO: 599399 - RNA, 63 nt, hsa
uacugaauauaaugaaaauggcaauaaaauaauauuacauaaacuguaaaguuccuuugauca

SEQ ID NO: 599400 - RNA, 63 nt, hsa
guagauauguaaaaugaauauuuuagucuccuuauuacauauauguucauggugaacuuuauc

SEQ ID NO: 599401 - RNA, 63 nt, hsa
uggucauaguuuugugauguguaacaguguauaauuacauacugaauuauuucaugcauaguc

SEQ ID NO: 599402 - RNA, 63 nt, hsa
ugaaaagugagcucaaauuuuuuuuaguugaagauuacauauaaaguugugucugauuaauau

SEQ ID NO: 599403 - RNA, 63 nt, hsa
acugcucauguaucuugaucuaauuacuaaauaauuacauauuuauuuaccugauaaauaugu

SEQ ID NO: 599404 - RNA, 63 nt, hsa
uaccuaccaccugucuuugcuuaaagagccuugauuacauaaauauguaggaaaaaacauauu

SEQ ID NO: 599405 - RNA, 63 nt, hsa
accugcaagauguggcuugaauuuuaaccauuuauuacauaaucucuagugaucaugcaucua

SEQ ID NO: 599406 - RNA, 63 nt, hsa
auaauauauuuuuguugcuuuuauaaaucaugcauuacauaaagugugacaacuucaaaaugu

SEQ ID NO: 599407 - RNA, 63 nt, hsa
gaagaaaaaauggagcgauuuaggugaccaaauauuacauacauaaauagccacaugaaguuu

SEQ ID NO: 599408 - RNA, 63 nt, hsa
uccuccuuuugacuuauuugguauguuguauauauuacauaaaauaacuuuucaaauauaguu

SEQ ID NO: 599409 - RNA, 63 nt, hsa
cacauacauaguaaauuauaaucaaucaugggaauuacauaaggauaaugaggcccaacugaa

SEQ ID NO: 599410 - RNA, 63 nt, hsa
aguuaucuuuuuaacaucuuauuuuuuucauuaauuacauaucaacauuaauuuuguaucuug

SEQ ID NO: 599411 - RNA, 63 nt, hsa
gcuauauuuucuuagcaguuauuucuacaguuaauuacauagucaugauuguucuacguuuca

SEQ ID NO: 599412 - RNA, 63 nt, hsa
gcuccauaccacacaccuaaaccuguauuaugaauuacauauuacaaagucauaaaugugcca

SEQ ID NO: 599413 - RNA, 63 nt, hsa
auccaccuuacguagccgugugagcuccgguaaauuacauaacccaucaaauuucuuuaucua

SEQ ID NO: 599414 - RNA, 63 nt, hsa
ugcaggaccuggauaugaacugcacauauauacauuacauaaaugaaauucccaguauccaau

SEQ ID NO: 599415 - RNA, 63 nt, hsa
uaucuuugcuguuauugacagcgauauaauuuuauuacauaugauuagagggaugagacagac

SEQ ID NO: 599416 - RNA, 63 nt, hsa
caaccagccacuccagcuuugugucuucucucaauuacauagcaauuucuccuucccaccauc

SEQ ID NO: 599417 - RNA, 63 nt, hsa
auacacauauguuuuuuugguagauaagugcuaauuacauauauguaaugcuuuauuaaauuu

SEQ ID NO: 599418 - RNA, 63 nt, hsa
augcaaaugucaguacugaauuccugcuuguuaauuacauaauaugugaugcucuagaaaaua

SEQ ID NO: 599419 - RNA, 63 nt, hsa
uuuauucuucaguguucauauagcaccuggcccauuacauaucuaggcaacuaaaaacaaaca

SEQ ID NO: 599420 - RNA, 63 nt, hsa
gugaugucaggacauaaaugagguuaauguaauauuacauauugauagaggaauaggucaaua

SEQ ID NO: 599421 - RNA, 63 nt, hsa
accuguauuacugaauauaggaaagagauacccauuacauaguuacucaguaaacaaaagaga

SEQ ID NO: 599422 - RNA, 63 nt, hsa
aaaguuuuauauuucacauugcuguggacuauuauuacauauaucauuauuauauaaaucaug

SEQ ID NO: 599423 - RNA, 63 nt, hsa
uuucuuggauuacuuugacuauucuaauguuuaauuacauaugguaacccuaaggccugggga

SEQ ID NO: 599424 - RNA, 63 nt, hsa
caguacuucaaauggcacauagauaggcaggauauuacauagguaagcaggaauuuauacauu

SEQ ID NO: 599425 - RNA, 63 nt, hsa
cacaggacgaaugcauauucaacacacugccuuauuacauaacugaucuauuuauuaucgcau

SEQ ID NO: 599426 - RNA, 63 nt, hsa
ucaugggaaggcuaauauauuccaacguaaauuauuacauaugguuaaguaauugcauguuaa

SEQ ID NO: 599427 - RNA, 63 nt, hsa
ugucauaacuauuuuaaguguacaguucaguauauuacauauguucauaaguuguacaaccau

SEQ ID NO: 599428 - RNA, 63 nt, hsa
acacugugaaauauguugauuacaaacccauucauuacauaguauaaggaauucacaguauau

SEQ ID NO: 599429 - RNA, 63 nt, hsa
uguguguguguuuuuuuuuaaguucucaucauuauuacauagacugugauguaucuuuacugg

SEQ ID NO: 599430 - RNA, 63 nt, hsa
acacgcagccccuccccgccacagagacacaccauuacauacacagacacacacagaaagaca

SEQ ID NO: 599431 - RNA, 63 nt, hsa
acacacacacccuccccgccacagagacacaccauuacauacacagacacgcaaucgcagaua

SEQ ID NO: 599432 - RNA, 63 nt, hsa
ucacacacacacccuccccgccacagagacaccauuacauacacagacacacacagaaagaca

SEQ ID NO: 599433 - RNA, 63 nt, hsa
ucacacacacccccuccccaccacagagacaccauuacauacacagacacacacagaaagaca

SEQ ID NO: 599434 - RNA, 63 nt, hsa
auuauaaaaauucaaucauaaaagucaaaauauauuacauaauauaguuuaaugaaucauuac

SEQ ID NO: 599435 - RNA, 63 nt, hsa
auuuaauuguucagacuuguaagagguucuucaauuacauaggcagguuuuucuuaaaaauga

SEQ ID NO: 599436 - RNA, 63 nt, hsa
gugguuuuuaauuugaagaccccagagaauuccauuacauaaugauuuugcccuuguuauaaa

SEQ ID NO: 599437 - RNA, 63 nt, hsa
uacuaugaggauuuuucucacugacauaauuugauuacauacuaaauaagaggauauguuaau

SEQ ID NO: 599438 - RNA, 63 nt, hsa
agcuccguauuuacucaggagcagucaggguacauuacauaaaacaauggaggaugccucauu

SEQ ID NO: 599439 - RNA, 63 nt, hsa
uccacaaaacuaacaggauaauugggcaaauaaauuacauauaaacacacacaaucuauauau

SEQ ID NO: 599440 - RNA, 63 nt, hsa
cacuucauauauaauuaaucacuauuuuguauaauuacauauugcugcuuguguguuuuuuuu

SEQ ID NO: 599441 - RNA, 63 nt, hsa
uuuaugauucuguaauaaucaagggagaaacccauuacauaguggacaauuuuuuuucuuuuu

SEQ ID NO: 599442 - RNA, 63 nt, hsa
cuauuuugugaauucuaaaguuacauuuguaagauuacauaaucuauuaagcaauaaguuuau

SEQ ID NO: 599443 - RNA, 63 nt, hsa
cagccugggugacagagaaaagaaaaagaaaacauuacauaauuuggcuagagcauaauaauu

SEQ ID NO: 599444 - RNA, 63 nt, hsa
cauuagcagcugggaaggugucugagguccccaauuacauaucccaaagaguuucuuacuucu

SEQ ID NO: 599445 - RNA, 63 nt, hsa
uaaaguuuuuaguuacuuaaaauaugauuuuaaauuacauauuaauuuagaaaauuccugugu

SEQ ID NO: 599446 - RNA, 63 nt, hsa
uuguuacugaaagagacuacacuaucagguuucauuacauauucuccuuuauugugaagagua

SEQ ID NO: 599447 - RNA, 63 nt, hsa
uagcauuuacaguacagcuggagacccaugaugauuacauauaaaguucaguuagaaaagaug

SEQ ID NO: 599448 - RNA, 63 nt, hsa
ucuguauuauuuucacacucauauugcuuaaauauuacauauuagggauuguaagaaaacuuu

SEQ ID NO: 599449 - RNA, 63 nt, hsa
aauucuaccuagaaugcaaaauuggguauaugaauuacauagcauguuguugggauuuuuuuu

SEQ ID NO: 599450 - RNA, 63 nt, hsa
guuugugcuggagaaagguuuauuuggacuuugauuacauaaauauuaaaaucucugccuuac

SEQ ID NO: 599451 - RNA, 63 nt, hsa
cauugaagcuauuaagauguuuugauuauccuaauuacauaaugaccgauuugagauagaggc

SEQ ID NO: 599452 - RNA, 63 nt, hsa
auucauaaauuuuuguuauuuuauaaauaaaugauuacauaauuuuaguuauauggcaaugga

SEQ ID NO: 599453 - RNA, 63 nt, hsa
uuauuauucuguuauuuuagucuccauauguucauuacauacauaaucuuauuuaaucuucac

SEQ ID NO: 599454 - RNA, 63 nt, hsa
gguuauacauggcauaauuguuacuaaacuuguauuacauaucaaauaaaugauacaucuugg

SEQ ID NO: 599455 - RNA, 63 nt, hsa
aaacuuacugugcuggacucuuuaccuuauaauauuacauagagucuuguauugucuguguac

SEQ ID NO: 599456 - RNA, 63 nt, hsa
ggucaggauuuaggacucauagccugaaagcucauuacauacuccuuguaaccaucaguccaa

SEQ ID NO: 599457 - RNA, 63 nt, hsa
cguuugccuccacgagccugcuguuuccaggaaauuacauaacguucaguugggauggaaauc

SEQ ID NO: 599458 - RNA, 63 nt, hsa
augauuuacauaugaaccucaguucugaaauucauuacauaucugucucauucugccuuuuau

SEQ ID NO: 599459 - RNA, 63 nt, hsa
ggaaggugaugcaggggagaaaaugugaauuaaauuacauagauggguguuuuuaugucuucu

SEQ ID NO: 599460 - RNA, 63 nt, hsa
uauauuucacaagaaaucaguugcauauuauccauuacauauuuaguuuuaaaaggaggaguc

SEQ ID NO: 599461 - RNA, 63 nt, hsa
uguagaauugaauuuccagugaccuguaauuucauuacauauauuuuaaaaucuauuuauuuu

SEQ ID NO: 599462 - RNA, 63 nt, hsa
uguaauaguaagaacugucccauauguuaguaaauuacauauguacaaauugaaacuguaaau

SEQ ID NO: 599463 - RNA, 63 nt, hsa
acacuaguuagauguuuguucaccauggggaccauuacauaugaccauacaaugcacugaauu

SEQ ID NO: 599464 - RNA, 63 nt, hsa
uccuguaugcugagcugguaaaauacauuguaaauuacauauuaaauauuuuaucugcuuuua

SEQ ID NO: 599465 - RNA, 63 nt, hsa
ugaugauauguauuacugagaacguaaaauaucauuacauagugauagcuggacacacaagga

SEQ ID NO: 599466 - RNA, 63 nt, hsa
acuugaguuuuauuuaucuuauccucugguuuaauuacauaaauauuuauuuuuuaaguguaa

SEQ ID NO: 599467 - RNA, 63 nt, hsa
acuugaguuuuauuuauuuuauccucugguuuaauuacauaauuuuuuuuuuuuaacuuuaag

SEQ ID NO: 599468 - RNA, 63 nt, hsa
aauccuuguugaaguuuuuuuaaaaaaagcuaaauuacauagacuuaggcauuaacauguuug

SEQ ID NO: 599469 - RNA, 63 nt, hsa
uguauugaauacucaagaaaaugccacauuucaauuacauauuuaaaacuguaucuguaaggg

SEQ ID NO: 599470 - RNA, 63 nt, hsa
uaguggcaacagagucagugcuaaucuagccaaauuacauauguauaauauauuuauaaagga

SEQ ID NO: 599471 - RNA, 63 nt, hsa
ggugggaaguuguaucuuguauagccacugcauauuacauagccaggaguaccccuugaggcu

SEQ ID NO: 599472 - RNA, 63 nt, hsa
caauuugaucuuuuuuaugguuuaaauuaguuaauuacauacaaauugauuggcuuaucacaa

SEQ ID NO: 599473 - RNA, 63 nt, hsa
caugaaugugcaguuugagccauugcuauuuugauuacauagaauuuguauuucuuuuuuagc

SEQ ID NO: 599474 - RNA, 63 nt, hsa
gcacaucucuauaaaucauuaguuuucuauuuuauuacauaaaauucuuuuagaaaaugcaaa

SEQ ID NO: 599475 - RNA, 63 nt, hsa
augugugauuuuguguuuugaauuacugucagaauuacauacacaauuacaacaaacuuuuuu

SEQ ID NO: 599476 - RNA, 63 nt, hsa
aggacgaccagcugaggguguauuauaugcagaauuacauaaacgaagcucucaaagguaagg

SEQ ID NO: 599477 - RNA, 63 nt, hsa
acacauauacacauaacaaguguagaaguauauauuacauacauacacucacucugucuggua

SEQ ID NO: 599478 - RNA, 63 nt, hsa
uaaaaaaaagaauaacuuuuuuugccucuuuagauuacauagaagcauuguagucuugguaga

SEQ ID NO: 599479 - RNA, 63 nt, hsa
uuauacaaaacaagccagcaucugaucaaaaguauuacauaaaauauuuucuuaaacuauuga

SEQ ID NO: 599480 - RNA, 63 nt, hsa
acuaaaucugaaauggaauagaaaauagaauggauuacauacagaugguuuccuuguuagcag

SEQ ID NO: 599481 - RNA, 63 nt, hsa
uauaaguggauuuagaagcgauuuugguuuuguauuacauacgguaguccucugcgucaggga

SEQ ID NO: 599482 - RNA, 63 nt, hsa
uuagugauggcucacucacuuuucuauuuuggaauuacauaguuauguaaguaaaauuuuuaa

SEQ ID NO: 599483 - RNA, 63 nt, hsa
ucuaacuaaagucuccaaguuauguauuauaauauuacauaguaguaugcuuaggcuuuacua

SEQ ID NO: 599484 - RNA, 63 nt, hsa
agacaucacacuagaaacauaugcaauguuuuuauuacauacuucuacuggacaucacagaau

SEQ ID NO: 599485 - RNA, 63 nt, hsa
uuguaucuuaaaaaucuaugccuaaaaaguaucauuacauauaggaaaacaauaauuuuaacu

SEQ ID NO: 599486 - RNA, 63 nt, hsa
auuuuaaaucaauguguauucuuuacuggaaagauuacauacauuugagaauaagaaauuacu

SEQ ID NO: 599487 - RNA, 63 nt, hsa
aucuguaacagaaaagccaagacuuuaacuuucauuacauaucuaauaguugauaucaccagu

SEQ ID NO: 599488 - RNA, 63 nt, hsa
ugauccucugccucagccuccagaguaucugggauuacauaugucggcuaccgugucuggccg

SEQ ID NO: 599489 - RNA, 63 nt, hsa
caugggauacagcacccaucuacaaagaccucuauuacauaaacacugcuucuuacaggaaac

SEQ ID NO: 599490 - RNA, 63 nt, hsa
aggcagcaaauguugagaaagucuaucuguaguauuacauauacuaaguuacagaggaugcau

SEQ ID NO: 599491 - RNA, 63 nt, hsa
gacaugugccuuaaacagacuuuuuaguccaaaauuacauagcauugaagaauauauuucacu

SEQ ID NO: 599492 - RNA, 63 nt, hsa
agcggccuuuucuguguugauuucggcuuucauauuacauaagggaaaccuugagugguggug

SEQ ID NO: 599493 - RNA, 63 nt, hsa
uguuuauauuuaacuaaauguaagguacgaauuauuacauauuaaacuuuucuuccccuuccu

SEQ ID NO: 599494 - RNA, 63 nt, hsa
uauuauuuaauauccaacuggucuccaaucuccauuacauagggacuguacagagccugugaa

SEQ ID NO: 599495 - RNA, 63 nt, hsa
ugcucuuugucuauggaguuauacuuccaucaaauuacauagcaaugcugaauuaggcaaaac

SEQ ID NO: 599496 - RNA, 63 nt, hsa
augcuuugaaaauguaucauucaguguaaauuaauuacauacauauuuuucuauauauuuguu

SEQ ID NO: 599497 - RNA, 63 nt, hsa
aucaauacacuauguguccuuuuuagaauaaagauuacauaucaucauuccuuuggggaaaau

SEQ ID NO: 599498 - RNA, 63 nt, hsa
cuuuuuuuaacuggugcagugggaaaauaggacauuacauacugaauuggguccuugucauuu

SEQ ID NO: 599499 - RNA, 63 nt, hsa
aauuauauucauauguauugcauugcaauuauaauuacauaugcagauugauugauagucaug

SEQ ID NO: 599500 - RNA, 63 nt, hsa
uuccauugguggaauugaaauaauuaguuuuuaauuacauaagaugccuguuugcuauuuggu

SEQ ID NO: 599501 - RNA, 63 nt, hsa
uugaguaguuaggaagaagauggauaaaaaccuauuacauauuuguaauuuauuaaaaaccuu

SEQ ID NO: 599502 - RNA, 63 nt, hsa
cuggcucaucccucaggcccacccugacccuacauuacauagguuacgucagccuacuguggc

SEQ ID NO: 599503 - RNA, 63 nt, hsa
cccugugaugggcccuuaggccuggcugggcccauuacauaucccugugguggcucugguggc

SEQ ID NO: 599504 - RNA, 63 nt, hsa
ggcuuuauuaguguuuuuauauagaaaacaguuauuacauauguguuaagucauuucuuaaga

SEQ ID NO: 599505 - RNA, 63 nt, hsa
acgaggauggcuggacaaggacuuuuacuuuuuauuacauaaaaauauuaaaaaauaaauaaa

SEQ ID NO: 599506 - RNA, 63 nt, hsa
guggguaguaauucuucaucaugaaaaugauauauuacauauuuaguaucuucccuuugcagu

SEQ ID NO: 599507 - RNA, 63 nt, hsa
uauuuuugaauuuucugaacuuuuuucuaagagauuacauaggagacuaaagaaaucuaucug

SEQ ID NO: 599508 - RNA, 63 nt, hsa
agucuuuaauuguaaugacuuuguuuuauccacauuacauauuuauguauuucacuguuaugu

SEQ ID NO: 599509 - RNA, 63 nt, hsa
gauccuagcaugacuauacauugugacauggucauuacauauggauuagaccaacuggagaau

SEQ ID NO: 599510 - RNA, 63 nt, hsa
gacuuuguuuuauccacaguuaagccuuuucucauuacauauuuauguauuucacugucaugu

SEQ ID NO: 599511 - RNA, 63 nt, hsa; identical to SEQ ID NO: 599509

SEQ ID NO: 599512 - RNA, 63 nt, hsa
ugaaguuucacuggauuucauuaacuuuuaaauauuacauauauguguuuucucagauuagug

SEQ ID NO: 599513 - RNA, 62 nt, hsa
uucauuuugaugcuaugugacuugccuuuaauauuacauaauggaauggcuguucacuugau

SEQ ID NO: 599514 - RNA, 63 nt, hsa
ugaaauuauccaugguaaaaacuaguuauaaaaauuacauaauucaaagauaacauuguuauu

SEQ ID NO: 599515 - RNA, 63 nt, hsa
guuuuugguguuuuuuagggaugugcaaugugcauuacauaaugacagaaauacugagaaggu

SEQ ID NO: 599516 - RNA, 63 nt, hsa
uuuuucccauaccaacugcuucuacccuccccuauuacauacaucuuucaauguccaaaaagu

SEQ ID NO: 599517 - RNA, 63 nt, hsa
aauucggaaugaaaaauuauaauguaauuuuacauuacauaaguuccuuuuacaauuaaaaaa

SEQ ID NO: 599518 - RNA, 63 nt, hsa
gaugucccuauggaagcauauuguuauuauauaauuacauauuugcauauguaugacucccaa

SEQ ID NO: 599519 - RNA, 63 nt, hsa
cucccacuuugucuguacauacuggccucugugauuacauagaucagccauuaaaauaaaaca

SEQ ID NO: 599520 - RNA, 63 nt, hsa
gacucaaaaugacaguuucagagagucaaugucauuacauagaacacuucagacacaggaaaa

SEQ ID NO: 599521 - RNA, 63 nt, hsa
caugaaaauuaaaacacacaagugaaugaaguaauuacauaguccaagauuagaaauacaagu

SEQ ID NO: 599522 - RNA, 63 nt, hsa
uuugggagcguccagcauguuaauuagcguaucauuacauacugcuaucccuuuccauuucuu

SEQ ID NO: 599523 - RNA, 63 nt, hsa
uuucugacuguuaugcuugauuugaccuucaaaauuacauauuaacuguucuucaauaaauau

SEQ ID NO: 599524 - RNA, 63 nt, hsa
uuaaacuagacuuacuauuuuagugaguuaaaaauuacauacuaaaaguuuauugguagguaa

SEQ ID NO: 599525 - RNA, 63 nt, hsa
augugucccauggcaaugugaauccaauagucaauuacauaaugacuauagaaacacaacagu

SEQ ID NO: 599526 - RNA, 63 nt, hsa
uaggaacaucucuuugaauuguauuucuuguauauuacauacuuagagagagacucuuuuagc

SEQ ID NO: 599527 - RNA, 63 nt, hsa
uguguugcacauguccacaguauuggcgagauaauuacauaauucagauaccuuuaaucaucu

SEQ ID NO: 599528 - RNA, 63 nt, hsa
gcuguuuggaggacaggaaaauuuaucgggaaaauuacauaaucccucugauuccacuaucca

SEQ ID NO: 599529 - RNA, 63 nt, hsa
ugagaaugccagaucuguggcugucuucauucuauuacauagucaaacauagguuuaugugaa

SEQ ID NO: 599530 - RNA, 63 nt, hsa
uaguaggugauauucauucguauccagcucuuuauuacauagcucugaaguuaaaaugauuua

SEQ ID NO: 599531 - RNA, 63 nt, hsa
cugauuuuuaaauguuguugcuuggagauaaaaauuacauaagggacuuuuugccugcauucu

SEQ ID NO: 599532 - RNA, 63 nt, hsa
aaaaaugcccuagaaauauagauuuuaaucaccauuacauaaugacaaaccuuguuaaaugcu

SEQ ID NO: 599533 - RNA, 63 nt, hsa
gagcugugcccguuuaucuucauuguauuaauuauuacauaaagauuaacaaauacauugcaa

SEQ ID NO: 599534 - RNA, 63 nt, hsa
cuucauuuguguauuaguucauuuucuguuucuauuacauaguuuuuaaagucaaugaaagag

SEQ ID NO: 599535 - RNA, 63 nt, hsa
ucaggaaaagaaaagaaacuuaguucuaccuugauuacauauguuguuacaaauuaucauuau

SEQ ID NO: 599536 - RNA, 63 nt, hsa
aaauggcaaaaugccauuauuuaaauggaacuuauuacauaccaauggcuuugcaagaagaug

SEQ ID NO: 599537 - RNA, 63 nt, hsa
gaugaaugguagagcaaccugaaggauuuagaaauuacauauaaaucuuugcaguuaugcuau

SEQ ID NO: 599538 - RNA, 63 nt, hsa
uauuuugggagagagauacguucacauaauuuuauuacauauauuguuacaauuguucuauuu

SEQ ID NO: 599539 - RNA, 63 nt, hsa
aucaggguacauggcagccagucacagauuggaauuacauaugacaaaguaucaguguacuau

SEQ ID NO: 599540 - RNA, 63 nt, hsa
cuaaauccacacaugccaaguuucuuuuauaaaauuacauauuugcauguuaucuacccacau

SEQ ID NO: 599541 - RNA, 63 nt, hsa
cugguucaagagaccacauaauaucugccuuuuauuacauacaugaugggugcaugggauucu

SEQ ID NO: 599542 - RNA, 63 nt, hsa
auauuuguuguuaaaaugauugccauuaucaucauuacauacuguuagagaacucaaauggug

SEQ ID NO: 599543 - RNA, 63 nt, hsa
cauaaaguucagaagaguguaaauagaauuuauauuacauaaagucuuuauauuuuuccagag

SEQ ID NO: 599544 - RNA, 63 nt, hsa
cgugggauauucuuuaugcagaagucuuguuuuauuacauacagaagagcucccacugcagaa

SEQ ID NO: 599545 - RNA, 63 nt, hsa
caccuaccuccccugguuauugugaggcuggcgauuacauaaguauaagcagguccgcccagg

SEQ ID NO: 599546 - RNA, 63 nt, hsa
ggcauacagacaaauacauaaaccaaugaauauauuacauauucuguguuccaauaaaacuuu

SEQ ID NO: 599547 - RNA, 63 nt, hsa
ugucuuuaugauuucaugauuagacaauguggaauuacauaacaggcauugcacuaaaaguga

SEQ ID NO: 599548 - RNA, 63 nt, hsa
agguuuguacggaugugcuuugaaguuauguauauuacauauaacaggaaaaaauauuaaaau

SEQ ID NO: 599549 - RNA, 63 nt, hsa
aagucauuguuucuugcucaugguggcucauuuauuacauaguccccucaccccacuaaugga

SEQ ID NO: 599550 - RNA, 63 nt, hsa
ugcuugcuaucugucucauguuacagagcuuccauuacauauuaaacgugaaaucuaugacuc

SEQ ID NO: 599551 - RNA, 63 nt, hsa
gauuuuugacgugccuggcccugagcgaagcacauuacauauaucaucaaauuuaucucaacc

SEQ ID NO: 599552 - RNA, 63 nt, hsa
uaauaaauuaaauuuuauuguguaaaauguauuauuacauaaaauguguuuuugaaucaaugc

SEQ ID NO: 599553 - RNA, 63 nt, hsa
aauguaacuaggaagaaaaacccaauuuaagaaauuacauaaugcuuuccaaaggcaccuaca

SEQ ID NO: 599554 - RNA, 63 nt, hsa
cagcaggaagaaaacaauuuuuuaaaaauucucauuacauagacgcacaagaauaugucacau

SEQ ID NO: 599555 - RNA, 63 nt, hsa
uuauauauguuuauauauguucuucauaaaucuauuacauauauauagauaaaaugucagugu

SEQ ID NO: 599556 - RNA, 63 nt, hsa
cauugcuuaugacaugaucgcuuucuacacuguauuacauaaauaaauuaaauaaaauaaccc

SEQ ID NO: 599557 - RNA, 63 nt, hsa
uaaauguuuggaaacuuucuuuuacaaaagaauauuacauauuugagagaaaauauuucuauu

SEQ ID NO: 599558 - RNA, 63 nt, hsa
guuuuuuaucuccacacgcaguaugaagauaaaauuacauaguauuaccuagacauagacagu

SEQ ID NO: 599559 - RNA, 63 nt, hsa
aaaguaaauuguuuauuuuacaauaagaaagugauuacauauuuuuuuuuuuacaauggugga

SEQ ID NO: 599560 - RNA, 63 nt, hsa
uuuuguuguuuccuuuuuuacaguaaaggcugaauuacauaaacauugaguaaauguaugugc

SEQ ID NO: 599561 - RNA, 63 nt, hsa
ucccuaauaaucuggaauauucuacauggcuugauuacauagcaaacaagaccaagauuuagg

SEQ ID NO: 599562 - RNA, 63 nt, hsa
uguaaucacauaugugcauagauacacaaucguauuacauaaaacacccuugaaaauauauga

SEQ ID NO: 599563 - RNA, 63 nt, hsa
auaaguuuuauacauuuuguuucuuuaaaagguauuacauauucuuuugagcuggagcugcaa

SEQ ID NO: 599564 - RNA, 63 nt, hsa
ucauucgugaagccgaaacguuuuuaaacaugaauuacauaugaauuauuaagcauaugugcu

SEQ ID NO: 599565 - RNA, 63 nt, hsa
cauauuuuugaaagguaaaaaguacauuuguauauuacauauauggacauaacuugugaagga

SEQ ID NO: 599566 - RNA, 63 nt, hsa
agugauucucaaccucuuugaauuuuacuuauaauuacauacacacacacacugcuacuuaua

SEQ ID NO: 599567 - RNA, 63 nt, hsa
agucucugcauagauacaaaauauuauuaaauuauuacauaaauuuaauuuuauaaaauuuaa

SEQ ID NO: 599568 - RNA, 63 nt, hsa
aaagcaaauuuacuccaaagacuuguauuggaaauuacauaccuuuuuuuuuuuuuuuuaaag

SEQ ID NO: 599569 - RNA, 63 nt, hsa
cugccucgcucuuuguccccccauuaggauucuauuacauaugcaauuguagguucaaccugu

SEQ ID NO: 599570 - RNA, 63 nt, hsa
auaauacaacuauuucuguaaagaaaggacacuauuacauaugaaaauaucucuucuuuauau

SEQ ID NO: 599571 - RNA, 63 nt, hsa
uuucauagugguaugcaaacauaucauugaaauauuacauagauauaaagacuuagggaauaa

SEQ ID NO: 599572 - RNA, 63 nt, hsa
ggacauaugauucuuuccaagaugaacuugaagauuacauaaaagugcagaaagccagaggac

SEQ ID NO: 599573 - RNA, 63 nt, hsa
acauuuuuauaccuguuuaaauugcucacaguuauuacauacacaucagccaucaacuaaagu

SEQ ID NO: 599574 - RNA, 63 nt, hsa
gaccugaaacaacucuaggucugaguccuagagauuacauaaauaguguguagcccagaaaag

SEQ ID NO: 599575 - RNA, 63 nt, hsa
agagacugcagacuacugcuuugaaugaguugaauuacauaagcuaagaucacuauaggucca

SEQ ID NO: 599576 - RNA, 63 nt, hsa
acucuaaaucuuguauaugcaucuuuguugcuuauuacauauuuacacacacaaccacaaauu

SEQ ID NO: 599577 - RNA, 64 nt, hsa; identical to SEQ ID NO: 105625

SEQ ID NO: 599578 - RNA, 64 nt, hsa; identical to SEQ ID NO: 105626

SEQ ID NO: 599579 - RNA, 64 nt, hsa; identical to SEQ ID NO: 105627

SEQ ID NO: 599580 - RNA, 64 nt, hsa; identical to SEQ ID NO: 105628

SEQ ID NO: 599581 - RNA, 64 nt, hsa; identical to SEQ ID NO: 105629

SEQ ID NO: 599582 - RNA, 64 nt, hsa; identical to SEQ ID NO: 105630

SEQ ID NO: 599583 - RNA, 64 nt, hsa; identical to SEQ ID NO: 105631

SEQ ID NO: 599584 - RNA, 56 nt, hsa; identical to SEQ ID NO: 105632

SEQ ID NO: 599585 - RNA, 64 nt, hsa; identical to SEQ ID NO: 105633

SEQ ID NO: 599586 - RNA, 64 nt, hsa; identical to SEQ ID NO: 105634

SEQ ID NO: 599587 - RNA, 64 nt, hsa; identical to SEQ ID NO: 105635

SEQ ID NO: 599588 - RNA, 64 nt, hsa; identical to SEQ ID NO: 105636

SEQ ID NO: 599589 - RNA, 64 nt, hsa; identical to SEQ ID NO: 105637

SEQ ID NO: 599590 - RNA, 64 nt, hsa; identical to SEQ ID NO: 105638

SEQ ID NO: 599591 - RNA, 64 nt, hsa; identical to SEQ ID NO: 105639

SEQ ID NO: 599592 - RNA, 64 nt, hsa; identical to SEQ ID NO: 105640

SEQ ID NO: 599593 - RNA, 64 nt, hsa; identical to SEQ ID NO: 105641

SEQ ID NO: 599594 - RNA, 64 nt, hsa; identical to SEQ ID NO: 105642

SEQ ID NO: 599595 - RNA, 64 nt, hsa; identical to SEQ ID NO: 105643

SEQ ID NO: 599596 - RNA, 64 nt, hsa; identical to SEQ ID NO: 105644

SEQ ID NO: 599597 - RNA, 64 nt, hsa; identical to SEQ ID NO: 105645

SEQ ID NO: 599598 - RNA, 64 nt, hsa; identical to SEQ ID NO: 105646

SEQ ID NO: 599599 - RNA, 64 nt, hsa; identical to SEQ ID NO: 105647

SEQ ID NO: 599600 - RNA, 64 nt, hsa; identical to SEQ ID NO: 105648

SEQ ID NO: 599601 - RNA, 64 nt, hsa; identical to SEQ ID NO: 96929

SEQ ID NO: 599602 - RNA, 64 nt, hsa; identical to SEQ ID NO: 96930

SEQ ID NO: 599603 - RNA, 64 nt, hsa; identical to SEQ ID NO: 96931

SEQ ID NO: 599604 - RNA, 64 nt, hsa; identical to SEQ ID NO: 96932

SEQ ID NO: 599605 - RNA, 64 nt, hsa; identical to SEQ ID NO: 96933

SEQ ID NO: 599606 - RNA, 64 nt, hsa; identical to SEQ ID NO: 96934

SEQ ID NO: 599607 - RNA, 64 nt, hsa; identical to SEQ ID NO: 96935

SEQ ID NO: 599608 - RNA, 64 nt, hsa; identical to SEQ ID NO: 96936

SEQ ID NO: 599609 - RNA, 64 nt, hsa
cuccagaccccuguggcagaccgggggccagacacagauacauggggaacugcauaucggaggu

SEQ ID NO: 599610 - RNA, 64 nt, hsa
ggaugggaagaugguagcagauaaagacagcugacagauacauagauggaccaguagacaacug

SEQ ID NO: 599611 - RNA, 64 nt, hsa
ugcaaauuuuaaaaaggaacccuuuuccuccagacagauacagccccaaaccagggugcauggc

SEQ ID NO: 599612 - RNA, 56 nt, hsa
ugaguagacuugguguuugagugcuucagauacauuuuucagauacaaugugaaga

SEQ ID NO: 599613 - RNA, 64 nt, hsa
agacuugguguuugagugcuucagauacauuuuucagauacaaugugaagacauugaagauaug

SEQ ID NO: 599614 - RNA, 64 nt, hsa
gagggaaugguaguuaaggcuucuuuuuugcccccagauacauggugaugguuagcauauggug

SEQ ID NO: 599615 - RNA, 64 nt, hsa
ugggaagagcguagacagguguuacuuacagucccagauacacuaaaguuacaaacagaccacc

SEQ ID NO: 599616 - RNA, 64 nt, hsa
gccaaaaucaucacagaugcugcugugcugcagacagauacaugcuaguccagagagccgcccc

SEQ ID NO: 599617 - RNA, 64 nt, hsa
ggcgcucauuccaauauagucuuuauuucccauucagauacagguugagcaucccuaaucugaa

SEQ ID NO: 599618 - RNA, 64 nt, hsa
ugaaagcaccuacaauuagccuguuaguccuauucagauacaucaaauaucagugaaugcuuua

SEQ ID NO: 599619 - RNA, 64 nt, hsa
uucagaaauggacugaaaauggagagcuauguaacagauacacuacaguagaagaacuuacuuc

SEQ ID NO: 599620 - RNA, 64 nt, hsa
agaagccacccacguggggugugccaggcacccccagauacaaaugcagccacgcacagacgua

SEQ ID NO: 599621 - RNA, 64 nt, hsa
ugcuccuggaggcuggcuggcugucucucucacacagauacacgugcgcucccugggauccggg

SEQ ID NO: 599622 - RNA, 64 nt, hsa
auuaaaauguguccacgaaguagcuuugugaucgcagauacauucauagugaacucaucagaau

SEQ ID NO: 599623 - RNA, 64 nt, hsa
uugagauuccuguucauucuuggugugucucuaacagauacaguauguauacauuuguauaauu

SEQ ID NO: 599624 - RNA, 62 nt, hsa
aggguuugcuaacucugcuucaacauccaacaacacaaaacuauaugauuuuuaaaaucaug

SEQ ID NO: 599625 - RNA, 62 nt, hsa
gaucucugugccaaauacauuauaucaggauuacacaaaaaguaucacaaaggauggucuug

SEQ ID NO: 599626 - RNA, 62 nt, hsa
agaggcugagaugagcagugaacuaagaggccacacaaaagcagagguuugggaauuccaga

SEQ ID NO: 599627 - RNA, 62 nt, hsa
aauugacgcaagugaacugaaaacuuauguucacacaaaaacucgcacaugacuguuuauag

SEQ ID NO: 599628 - RNA, 62 nt, hsa
gcaggguaguaagcugacacuaaauauuuuuuacacaaaaauguauugaagcaacaaauauu

SEQ ID NO: 599629 - RNA, 62 nt, hsa
ggcuggcagagauuuauguaugacuugcacagacacaaaaauauacagacaaucaaaacauu

SEQ ID NO: 599630 - RNA, 62 nt, hsa
agcaaaguaauaaaaucacaaauguuuggaaaacacaaaaguaacuuguuuaucucagucug

SEQ ID NO: 599631 - RNA, 62 nt, hsa
ggccagcuuaaccuggucugaggugagacuaaacacaaaaacaguagauaaaucucucccua

SEQ ID NO: 599632 - RNA, 62 nt, hsa
uuucaaaaaugugaaauauaaggcacguuuucacacaaaauuucaaaacaaaaacaagaggg

SEQ ID NO: 599633 - RNA, 62 nt, hsa
aaggcacaacacaaaaaccaacacaaaacauaacacaaaaaagaagcuaccuaugauccugg

SEQ ID NO: 599634 - RNA, 62 nt, hsa
uacuacagcaucaaggcacaacacaaaaaccaacacaaaacauaacacaaaaaagaagcuac

SEQ ID NO: 599635 - RNA, 62 nt, hsa
aaagcaaaggaguacuacagcaucaaggcacaacacaaaaaccaacacaaaacauaacacaa

SEQ ID NO: 599636 - RNA, 62 nt, hsa
ccugcagggccccuguuccaaugaaaaacagaacacaaaagagcagagcaccuaagccuguc

SEQ ID NO: 599637 - RNA, 62 nt, hsa
caugcaaaggaauucuucaaguuuaaaucuggacacaaaaauaagauaaauguauggcauca

SEQ ID NO: 599638 - RNA, 62 nt, hsa
uuaguuguuucccuucacuuucagucuuccacacacaaaaaauaccucacagagcuucacca

SEQ ID NO: 599639 - RNA, 62 nt, hsa
aucaguuguuuuucucuucgcuucaggcccuuacacaaaagccaugaagagauguucaccua

SEQ ID NO: 599640 - RNA, 62 nt, hsa
aagaaguuggauggguggguacuauucugauuacacaaaacaaaugccacacaucacccuua

SEQ ID NO: 599641 - RNA, 62 nt, hsa
uucuuacaggcacaaaaugauggacccaaugcacacaaaacaacccuagaguguuguugaga

SEQ ID NO: 599642 - RNA, 62 nt, hsa
gagcuuccuuauguuucacacauuguauuugaacacaaaacauuaacaacuccacucauagu

SEQ ID NO: 599643 - RNA, 62 nt, hsa
gaaauuuauuauucuaauccaaaaguuaccccacacaaaaguuacugagcuuccuuauguuu

SEQ ID NO: 599644 - RNA, 62 nt, hsa
aggaauauucacuuuaccuagcagggaaaaauacacaaaaacugcagauacuucauauagcc

SEQ ID NO: 599645 - RNA, 62 nt, hsa
ucaaaaggcauuuccgcuuacaauuuguagaaacacaaaaugcguuuuccauacagcagugc

SEQ ID NO: 599646 - RNA, 62 nt, hsa
aaugaaguaguauauaugaaaaugcuuuuuaaacacaaaagcuuuauacaaaauauuguuga

SEQ ID NO: 599647 - RNA, 62 nt, hsa
uuugcaaaugggaaggauuucuuuaaagcaagacacaaaagcauacacaggaaaaaaugaug

SEQ ID NO: 599648 - RNA, 62 nt, hsa
gucauuuuguugucacagcacuacagugaaauacacaaaaaaugaaauucauauaaugacuu

SEQ ID NO: 599649 - RNA, 62 nt, hsa
agaguuuguuuuucuauaugugaaggauuacaacacaaaaaguuauccugccauucgagugc

SEQ ID NO: 599650 - RNA, 62 nt, hsa
aaaaggaaaaaaaauccaccaaaccaugauaaacacaaaaugcagcuuccugaugcuuagag

SEQ ID NO: 599651 - RNA, 62 nt, hsa
accuuaucuuaauggaaaacgguuaacuccaaacacaaaagacucuacuggaaaguguaggu

SEQ ID NO: 599652 - RNA, 62 nt, hsa
accaauauggagaaacccugucucuacuaagaacacaaaauuagcugggcaugguggugcau

SEQ ID NO: 599653 - RNA, 62 nt, hsa
aagauaucuaugaaauauggugguuuuuuaaaacacaaaaauuauagaauaugggaucccgu

SEQ ID NO: 599654 - RNA, 62 nt, hsa
caaugcauccaaaaaaucuuuuuaaacagauuacacaaaaauuauuuccagaaaggcuacca

SEQ ID NO: 599655 - RNA, 62 nt, hsa
aagucaaacaggauuccauccccugugaaauaacacaaaauuucacucucuaaaagcaacag

SEQ ID NO: 599656 - RNA, 62 nt, hsa
auuuacuaauccuaucugccaaaauggcuuagacacaaaaacaccucagcagaaaugaauau

SEQ ID NO: 599657 - RNA, 62 nt, hsa
gugaguuaaauauaacucacaucccacucaagacacaaaacauuuucuuaauccuaguacau

SEQ ID NO: 599658 - RNA, 62 nt, hsa
auagaagaaauauauuuauaaagcuuagugaaacacaaaauuagaauguucaugucaggcac

SEQ ID NO: 599659 - RNA, 62 nt, hsa
aaaaugcagcagcauaggagugaacaacagcaacacaaaacgggcauugguuucuuaggagu

SEQ ID NO: 599660 - RNA, 62 nt, hsa
uuacauacacagacacacacagaaagacacagacacaaaaucacacacacacccuccccgcc

SEQ ID NO: 599661 - RNA, 62 nt, hsa
auacacagacacacacagaaagacacacacagacacaaaaucacacacacacccuccccgcc

SEQ ID NO: 599662 - RNA, 62 nt, hsa
auacagccauuccaaaugggagaaauuggccaacacaaaaggguaacagggcccaugcaagu

SEQ ID NO: 599663 - RNA, 62 nt, hsa
caaguuaguauuguuagagauuucauuuuacaacacaaaaauaagccugugucaaagauuuu

SEQ ID NO: 599664 - RNA, 62 nt, hsa
agucaagccgagcaaccuguauaagcagcccaacacaaaacgaguguggauuuaucuaaaug

SEQ ID NO: 599665 - RNA, 62 nt, hsa
gacagaauuuuggcugaucuagauaccaugagacacaaaaugagacaguuaaaaggucagua

SEQ ID NO: 599666 - RNA, 62 nt, hsa
acacuuuuuggcugucaccuugugccauauacacacaaaauuuuguggaaggcaguuuuaac

SEQ ID NO: 599667 - RNA, 62 nt, hsa
uuuaguuguaugagucucuuucuaugaacugaacacaaaacucaggaauugguggcuuaauu

SEQ ID NO: 599668 - RNA, 62 nt, hsa
ucgccaaagaaaccacgcccacaccaaugccaacacaaaacuguguuuacugaaagccgaaa

SEQ ID NO: 599669 - RNA, 62 nt, hsa
uucuuguuuugucucaaaacuuaaaaaaacaaacacaaaaagaugagucccaccccccacua

SEQ ID NO: 599670 - RNA, 62 nt, hsa
acaaauaaaugaauaaagcugcugugacacacacacaaaaggaauuuaauaguauaauauau

SEQ ID NO: 599671 - RNA, 62 nt, hsa
gaaaagcaagagacaaagcaagacaaauauucacacaaaaaugaaguguguccucuggaggg

SEQ ID NO: 599672 - RNA, 62 nt, hsa
cccaagacugggaggggacuucuuuuucuaaaacacaaaacucagcccagccaggcccccuc

SEQ ID NO: 599673 - RNA, 62 nt, hsa
uuacuggggauucuugaacuugaaaaaaaaaaacacaaaaaaagacaaaaaaaaaaaaagaa

SEQ ID NO: 599674 - RNA, 62 nt, hsa
acugagcuugaacuucauauaucagucaugugacacaaaauaucauucuucuuuuuauuugu

SEQ ID NO: 599675 - RNA, 62 nt, hsa
gucaguguaagaauuaaagaaagaggaaagaaacacaaaaaguggcuugaugguuaagacag

SEQ ID NO: 599676 - RNA, 62 nt, hsa
auauacaacuauauauacacaaauauauauauacacaaaacugucauuuaccuguauuugca

SEQ ID NO: 599677 - RNA, 62 nt, hsa
uaaauaacaaugacacacacacaacaaaacaaacacaaaaccacugaucugugauugcucuc

SEQ ID NO: 599678 - RNA, 64 nt, hsa; identical to SEQ ID NO: 276332

SEQ ID NO: 599679 - RNA, 64 nt, hsa; identical to SEQ ID NO: 276333

SEQ ID NO: 599680 - RNA, 64 nt, hsa; identical to SEQ ID NO: 276334

SEQ ID NO: 599681 - RNA, 64 nt, hsa; identical to SEQ ID NO: 276335

SEQ ID NO: 599682 - RNA, 64 nt, hsa; identical to SEQ ID NO: 276336

SEQ ID NO: 599683 - RNA, 64 nt, hsa; identical to SEQ ID NO: 276337

SEQ ID NO: 599684 - RNA, 64 nt, hsa; identical to SEQ ID NO: 276338

SEQ ID NO: 599685 - RNA, 64 nt, hsa; identical to SEQ ID NO: 276339

SEQ ID NO: 599686 - RNA, 64 nt, hsa; identical to SEQ ID NO: 276340

SEQ ID NO: 599687 - RNA, 64 nt, hsa; identical to SEQ ID NO: 276341

SEQ ID NO: 599688 - RNA, 64 nt, hsa; identical to SEQ ID NO: 276342

SEQ ID NO: 599689 - RNA, 64 nt, hsa; identical to SEQ ID NO: 276343

SEQ ID NO: 599690 - RNA, 64 nt, hsa; identical to SEQ ID NO: 276344

SEQ ID NO: 599691 - RNA, 64 nt, hsa; identical to SEQ ID NO: 276345

SEQ ID NO: 599692 - RNA, 64 nt, hsa; identical to SEQ ID NO: 276346

SEQ ID NO: 599693 - RNA, 64 nt, hsa; identical to SEQ ID NO: 276347

SEQ ID NO: 599694 - RNA, 64 nt, hsa; identical to SEQ ID NO: 276348

SEQ ID NO: 599695 - RNA, 64 nt, hsa; identical to SEQ ID NO: 276349

SEQ ID NO: 599696 - RNA, 64 nt, hsa; identical to SEQ ID NO: 276350

SEQ ID NO: 599697 - RNA, 64 nt, hsa; identical to SEQ ID NO: 276351

SEQ ID NO: 599698 - RNA, 64 nt, hsa; identical to SEQ ID NO: 276352

SEQ ID NO: 599699 - RNA, 64 nt, hsa; identical to SEQ ID NO: 276353

SEQ ID NO: 599700 - RNA, 64 nt, hsa; identical to SEQ ID NO: 276354

SEQ ID NO: 599701 - RNA, 64 nt, hsa; identical to SEQ ID NO: 276355

SEQ ID NO: 599702 - RNA, 64 nt, hsa; identical to SEQ ID NO: 276356

SEQ ID NO: 599703 - RNA, 64 nt, hsa; identical to SEQ ID NO: 276357

SEQ ID NO: 599704 - RNA, 64 nt, hsa; identical to SEQ ID NO: 276358

SEQ ID NO: 599705 - RNA, 64 nt, hsa; identical to SEQ ID NO: 276359

SEQ ID NO: 599706 - RNA, 64 nt, hsa
acacucugcuaguuuugaauaaguaaccaucaaaguuacuaaaacauggccaggcgcaguggcu

SEQ ID NO: 599707 - RNA, 64 nt, hsa
agcgagaaccugucucaaaaaaaacaaaaacaaaguuacuaaaaugucaccuucacagaacagg

SEQ ID NO: 599708 - RNA, 64 nt, hsa
acuuauguacuugauacugaaugcauaaauaaauguuacuaaauguagaauguucucccucucu

SEQ ID NO: 599709 - RNA, 64 nt, hsa
uuguaugggauuggugggcugauuuacauguaugguuacuaaaaaguaccagcauguuaacuuu

SEQ ID NO: 599710 - RNA, 59 nt, hsa
uguggguugucucuucaugaagaaccagcggaacucaaaacugcuguucaagaaaccuc

SEQ ID NO: 599711 - RNA, 64 nt, hsa
auuccugacaguuaaauucagaaacgugccaaauggaacucaaggugccccuucagaauuaaaa

SEQ ID NO: 599712 - RNA, 64 nt, hsa
gaagaguuacuucuacggaauaguuuuugcucauggaacucaaacagaugaagcaccacuguua

SEQ ID NO: 599713 - RNA, 64 nt, hsa
aagacaguaaaaauaaugaucaauaaauacugagggaacucagaggccagcgccggugcggguc

SEQ ID NO: 599714 - RNA, 64 nt, hsa
auaacgagaccgcccuagagaaaaagauucugaaggaacucacuuccaacuauaucccuucuua

SEQ ID NO: 599715 - RNA, 64 nt, hsa
ccaccucguuuaaccacgaggagaguuugggccuggaacucauucaugaggaaucugaugcucc

SEQ ID NO: 599716 - RNA, 64 nt, hsa
uuguuuaguucugggaaauuguuauagcuuaaauggaacucaccaacauuauucauaguuuaag

SEQ ID NO: 599717 - RNA, 64 nt, hsa
ugaggcacuuaaagcuuauaaaagaacugcggcuggaacucaucuggugcuccccaugagagug

SEQ ID NO: 599718 - RNA, 64 nt, hsa
ucugacugcacugucuccaucuuaugcaaagccaggaacucacucacugucuuaagugagccag

SEQ ID NO: 599719 - RNA, 64 nt, hsa
uguucucugggaaguggacugugguuuuuccagaggaacucaguuaagaaaucgagaguggauu

SEQ ID NO: 599720 - RNA, 59 nt, hsa
caacaaauagaggccuggccuccaggugccggauccagacaccugaccuagaaugccug

SEQ ID NO: 599721 - RNA, 59 nt, hsa
accacgugagugagaugagccaacagcaccggauccacagaauguuucuucucugccuu

SEQ ID NO: 599722 - RNA, 59 nt, hsa
aaggugaaggaucuguccgacagucaagacggauccacaguaaucuuucggucuccuua

SEQ ID NO: 599723 - RNA, 59 nt, hsa
ucacugaugcacugauggcccugaagaagcggauccagucacauaggaaaggaggcugu

SEQ ID NO: 599724 - RNA, 59 nt, hsa
aacaugccagccacugugauagaggcuggcggauccaagcaaauggccaaugagaucau

SEQ ID NO: 599725 - RNA, 59 nt, hsa
uuuuuaaugaaaaaaaaaaacaaaaaaaacggauccaagaagaaaagagaauuuauuuc

SEQ ID NO: 599726 - RNA, 59 nt, hsa
uacacacacgugcauguaucugagcugcucggauccagaggucauuuuuguuacagugu

SEQ ID NO: 599727 - RNA, 59 nt, hsa
uuuuuuacuucuuuccuuuuucuuaaguucggauccaaguuugucuucuuauccaucac

SEQ ID NO: 599728 - RNA, 59 nt, hsa
agaagggcuacugcuccuggaagaguggacggauccauaauaaagacgucccaaauggu

SEQ ID NO: 599729 - RNA, 59 nt, hsa
auuaccggcccagcaaagucugcaucuggcggauccaggugucugagggcuuccacgug

SEQ ID NO: 599730 - RNA, 59 nt, hsa
gaaaaggcaguuagcucaaggacuugugacggauccacuuugguguucaaggaccugcu

SEQ ID NO: 599731 - RNA, 59 nt, hsa
uuguuuccuuagcuugguaugagacagaucggauccaguuucccaugcaccaacccacu

SEQ ID NO: 599732 - RNA, 59 nt, hsa
uaaagcccccuccucacaucccucuauugcggauccacaguggccuuacucuuaacuug

SEQ ID NO: 599733 - RNA, 59 nt, hsa
uaauaaauguacuuccuggaagugucuuucggauccacuauaugccucagcacauggaa

SEQ ID NO: 599734 - RNA, 59 nt, hsa
cucugagcagcagcaggcaacuucgagaacggauccagaaaugcagucagaaggacccu

SEQ ID NO: 599735 - RNA, 59 nt, hsa
gugcauuuggagggagugaguggcccuuucggauccagggaggcugguccuauggccuc

SEQ ID NO: 599736 - RNA, 59 nt, hsa
uccacaaacacuccguggcugagaggcagcggauccaggcagcgaugcugagccaccuc

SEQ ID NO: 599737 - RNA, 59 nt, hsa
cagggaagggaugggggcagcagcugcuucggauccacacuguaucugugucaucccca

SEQ ID NO: 599738 - RNA, 59 nt, hsa
uucaagaaagcaccaaagaccagggagcucggauccauacucggggggccucagcccuu

SEQ ID NO: 599739 - RNA, 59 nt, hsa
uuuccaguuuauaaaaaggaaaagcugaucggauccauguuucucucugcgagucuccu

SEQ ID NO: 599740 - RNA, 59 nt, hsa
caggagugccucucacagcuauaugacuacggauccauuagugaggagcgacacacaca

SEQ ID NO: 599741 - RNA, 59 nt, hsa
cugucaggugggaagaggaguacacggugcggauccagcugcaagaccguguaaaugag

SEQ ID NO: 599742 - RNA, 59 nt, hsa
gguugguugagguggaagcccuccuuccacggauccauguagcaggacugaauuguccc

SEQ ID NO: 599743 - RNA, 59 nt, hsa
ggcagggccauagggagggagauucgcuacggauccaggccauuccugggugagcccuu

SEQ ID NO: 599744 - RNA, 59 nt, hsa
uccucccguaggccagugugucucugaaacggauccagcaauuccugagccaagaggaa

SEQ ID NO: 599745 - RNA, 59 nt, hsa
aggcugaacuucacacagguagucugccacggauccagagcacggcacucagaggcgag

SEQ ID NO: 599746 - RNA, 59 nt, hsa
ugcuucuguuauuucugucauugugaagacggauccagacacagaagaacaaagaccca

SEQ ID NO: 599747 - RNA, 59 nt, hsa
cacccaccucggagaggcguccccaccaucggauccaggcuugcuagggguccugaacc

SEQ ID NO: 599748 - RNA, 59 nt, hsa
ggucccugggaaagaggguacuaggggcccggauccaggauucugggaggcuucaguua

SEQ ID NO: 599749 - RNA, 59 nt, hsa
gcccuggccucugcagcagccgcagucuccggauccaaagccaaagccgaaugagaacg

SEQ ID NO: 599750 - RNA, 59 nt, hsa
gcaguucuguuggagaaacgcuugguuuccggauccagagccacagaaagaaauguagg

SEQ ID NO: 599751 - RNA, 59 nt, hsa
agcgccuacuucugguggcucuagguccccggauccaccacccuucccccacugacucu

SEQ ID NO: 599752 - RNA, 59 nt, hsa
ugugagcucuggcucagacagcagcaagccggauccaccaacaccgcagcgccuuauga

SEQ ID NO: 599753 - RNA, 59 nt, hsa
uggggaacuuggcauucaacauuaaaaagcggauccaaagacccaggaaugacagguga

SEQ ID NO: 599754 - RNA, 64 nt, hsa; identical to SEQ ID NO: 296855

SEQ ID NO: 599755 - RNA, 64 nt, hsa; identical to SEQ ID NO: 296856

SEQ ID NO: 599756 - RNA, 64 nt, hsa; identical to SEQ ID NO: 296857

SEQ ID NO: 599757 - RNA, 64 nt, hsa; identical to SEQ ID NO: 296858

SEQ ID NO: 599758 - RNA, 64 nt, hsa; identical to SEQ ID NO: 296859

SEQ ID NO: 599759 - RNA, 64 nt, hsa; identical to SEQ ID NO: 296860

SEQ ID NO: 599760 - RNA, 64 nt, hsa; identical to SEQ ID NO: 296861

SEQ ID NO: 599761 - RNA, 64 nt, hsa; identical to SEQ ID NO: 296862

SEQ ID NO: 599762 - RNA, 64 nt, hsa; identical to SEQ ID NO: 296863

SEQ ID NO: 599763 - RNA, 64 nt, hsa; identical to SEQ ID NO: 296864

SEQ ID NO: 599764 - RNA, 64 nt, hsa; identical to SEQ ID NO: 296865

SEQ ID NO: 599765 - RNA, 64 nt, hsa; identical to SEQ ID NO: 296866

SEQ ID NO: 599766 - RNA, 64 nt, hsa; identical to SEQ ID NO: 296867

SEQ ID NO: 599767 - RNA, 64 nt, hsa; identical to SEQ ID NO: 296868

SEQ ID NO: 599768 - RNA, 64 nt, hsa; identical to SEQ ID NO: 296869

SEQ ID NO: 599769 - RNA, 64 nt, hsa; identical to SEQ ID NO: 296870

SEQ ID NO: 599770 - RNA, 64 nt, hsa; identical to SEQ ID NO: 296871

SEQ ID NO: 599771 - RNA, 64 nt, hsa; identical to SEQ ID NO: 296872

SEQ ID NO: 599772 - RNA, 64 nt, hsa; identical to SEQ ID NO: 296873

SEQ ID NO: 599773 - RNA, 64 nt, hsa; identical to SEQ ID NO: 296874

SEQ ID NO: 599774 - RNA, 64 nt, hsa; identical to SEQ ID NO: 296875

SEQ ID NO: 599775 - RNA, 64 nt, hsa; identical to SEQ ID NO: 296876

SEQ ID NO: 599776 - RNA, 64 nt, hsa; identical to SEQ ID NO: 296877

SEQ ID NO: 599777 - RNA, 64 nt, hsa; identical to SEQ ID NO: 296878

SEQ ID NO: 599778 - RNA, 64 nt, hsa; identical to SEQ ID NO: 296879

SEQ ID NO: 599779 - RNA, 64 nt, hsa; identical to SEQ ID NO: 296880

SEQ ID NO: 599780 - RNA, 64 nt, hsa; identical to SEQ ID NO: 296881

SEQ ID NO: 599781 - RNA, 64 nt, hsa; identical to SEQ ID NO: 296882

SEQ ID NO: 599782 - RNA, 64 nt, hsa; identical to SEQ ID NO: 296883

SEQ ID NO: 599783 - RNA, 64 nt, hsa; identical to SEQ ID NO: 296884

SEQ ID NO: 599784 - RNA, 64 nt, hsa; identical to SEQ ID NO: 296885

SEQ ID NO: 599785 - RNA, 64 nt, hsa; identical to SEQ ID NO: 296886

SEQ ID NO: 599786 - RNA, 64 nt, hsa; identical to SEQ ID NO: 296887

SEQ ID NO: 599787 - RNA, 64 nt, hsa; identical to SEQ ID NO: 296888

SEQ ID NO: 599788 - RNA, 64 nt, hsa; identical to SEQ ID NO: 296889

SEQ ID NO: 599789 - RNA, 64 nt, hsa; identical to SEQ ID NO: 296890

SEQ ID NO: 599790 - RNA, 64 nt, hsa; identical to SEQ ID NO: 296891

SEQ ID NO: 599791 - RNA, 64 nt, hsa; identical to SEQ ID NO: 296892

SEQ ID NO: 599792 - RNA, 64 nt, hsa; identical to SEQ ID NO: 296893

SEQ ID NO: 599793 - RNA, 64 nt, hsa; identical to SEQ ID NO: 296894

SEQ ID NO: 599794 - RNA, 64 nt, hsa; identical to SEQ ID NO: 296895

SEQ ID NO: 599795 - RNA, 64 nt, hsa; identical to SEQ ID NO: 296896

SEQ ID NO: 599796 - RNA, 64 nt, hsa; identical to SEQ ID NO: 296897

SEQ ID NO: 599797 - RNA, 64 nt, hsa; identical to SEQ ID NO: 296898

SEQ ID NO: 599798 - RNA, 64 nt, hsa; identical to SEQ ID NO: 296899

SEQ ID NO: 599799 - RNA, 64 nt, hsa; identical to SEQ ID NO: 296900

SEQ ID NO: 599800 - RNA, 64 nt, hsa; identical to SEQ ID NO: 296901

SEQ ID NO: 599801 - RNA, 59 nt, hsa; identical to SEQ ID NO: 296902

SEQ ID NO: 599802 - RNA, 64 nt, hsa; identical to SEQ ID NO: 296903

SEQ ID NO: 599803 - RNA, 64 nt, hsa; identical to SEQ ID NO: 296904

SEQ ID NO: 599804 - RNA, 64 nt, hsa; identical to SEQ ID NO: 296905

SEQ ID NO: 599805 - RNA, 64 nt, hsa; identical to SEQ ID NO: 296906

SEQ ID NO: 599806 - RNA, 64 nt, hsa; identical to SEQ ID NO: 296907

SEQ ID NO: 599807 - RNA, 64 nt, hsa; identical to SEQ ID NO: 296908

SEQ ID NO: 599808 - RNA, 64 nt, hsa; identical to SEQ ID NO: 296909

SEQ ID NO: 599809 - RNA, 64 nt, hsa; identical to SEQ ID NO: 296910

SEQ ID NO: 599810 - RNA, 64 nt, hsa; identical to SEQ ID NO: 296911

SEQ ID NO: 599811 - RNA, 64 nt, hsa; identical to SEQ ID NO: 296912

SEQ ID NO: 599812 - RNA, 64 nt, hsa; identical to SEQ ID NO: 296913

SEQ ID NO: 599813 - RNA, 64 nt, hsa; identical to SEQ ID NO: 296914

SEQ ID NO: 599814 - RNA, 64 nt, hsa; identical to SEQ ID NO: 296915

SEQ ID NO: 599815 - RNA, 64 nt, hsa; identical to SEQ ID NO: 296916

SEQ ID NO: 599816 - RNA, 64 nt, hsa; identical to SEQ ID NO: 296917

SEQ ID NO: 599817 - RNA, 64 nt, hsa; identical to SEQ ID NO: 296918

SEQ ID NO: 599818 - RNA, 64 nt, hsa; identical to SEQ ID NO: 296919

SEQ ID NO: 599819 - RNA, 64 nt, hsa; identical to SEQ ID NO: 296920

SEQ ID NO: 599820 - RNA, 64 nt, hsa; identical to SEQ ID NO: 296921

SEQ ID NO: 599821 - RNA, 64 nt, hsa; identical to SEQ ID NO: 296922

SEQ ID NO: 599822 - RNA, 64 nt, hsa; identical to SEQ ID NO: 296923

SEQ ID NO: 599823 - RNA, 64 nt, hsa; identical to SEQ ID NO: 38140

SEQ ID NO: 599824 - RNA, 64 nt, hsa; identical to SEQ ID NO: 38141

SEQ ID NO: 599825 - RNA, 64 nt, hsa; identical to SEQ ID NO: 38142

SEQ ID NO: 599826 - RNA, 64 nt, hsa; identical to SEQ ID NO: 38143

SEQ ID NO: 599827 - RNA, 64 nt, hsa; identical to SEQ ID NO: 38144

SEQ ID NO: 599828 - RNA, 64 nt, hsa; identical to SEQ ID NO: 38145

SEQ ID NO: 599829 - RNA, 64 nt, hsa; identical to SEQ ID NO: 38146

SEQ ID NO: 599830 - RNA, 64 nt, hsa; identical to SEQ ID NO: 38147

SEQ ID NO: 599831 - RNA, 64 nt, hsa; identical to SEQ ID NO: 38148

SEQ ID NO: 599832 - RNA, 64 nt, hsa; identical to SEQ ID NO: 38149

SEQ ID NO: 599833 - RNA, 64 nt, hsa; identical to SEQ ID NO: 38150

SEQ ID NO: 599834 - RNA, 64 nt, hsa; identical to SEQ ID NO: 38151

SEQ ID NO: 599835 - RNA, 64 nt, hsa; identical to SEQ ID NO: 38152

SEQ ID NO: 599836 - RNA, 64 nt, hsa; identical to SEQ ID NO: 38153

SEQ ID NO: 599837 - RNA, 64 nt, hsa; identical to SEQ ID NO: 38154

SEQ ID NO: 599838 - RNA, 64 nt, hsa; identical to SEQ ID NO: 38155

SEQ ID NO: 599839 - RNA, 64 nt, hsa; identical to SEQ ID NO: 38156

SEQ ID NO: 599840 - RNA, 64 nt, hsa; identical to SEQ ID NO: 38157

SEQ ID NO: 599841 - RNA, 64 nt, hsa; identical to SEQ ID NO: 38158

SEQ ID NO: 599842 - RNA, 64 nt, hsa; identical to SEQ ID NO: 38159

SEQ ID NO: 599843 - RNA, 64 nt, hsa; identical to SEQ ID NO: 38160

SEQ ID NO: 599844 - RNA, 64 nt, hsa; identical to SEQ ID NO: 38161

SEQ ID NO: 599845 - RNA, 64 nt, hsa; identical to SEQ ID NO: 73762

SEQ ID NO: 599846 - RNA, 64 nt, hsa; identical to SEQ ID NO: 73763

SEQ ID NO: 599847 - RNA, 64 nt, hsa; identical to SEQ ID NO: 73764

SEQ ID NO: 599848 - RNA, 64 nt, hsa; identical to SEQ ID NO: 73765

SEQ ID NO: 599849 - RNA, 64 nt, hsa; identical to SEQ ID NO: 73766

SEQ ID NO: 599850 - RNA, 64 nt, hsa; identical to SEQ ID NO: 73767

SEQ ID NO: 599851 - RNA, 64 nt, hsa; identical to SEQ ID NO: 73768

SEQ ID NO: 599852 - RNA, 64 nt, hsa; identical to SEQ ID NO: 73769

SEQ ID NO: 599853 - RNA, 64 nt, hsa; identical to SEQ ID NO: 73770

SEQ ID NO: 599854 - RNA, 64 nt, hsa; identical to SEQ ID NO: 73771

SEQ ID NO: 599855 - RNA, 64 nt, hsa
gugauauuauaucuguuuguaugagaaacccaguaaccaauaaaaugaccgcauauuccugacu

SEQ ID NO: 599856 - RNA, 64 nt, hsa
uuuuguugagaggugguuuagggauuuuggcccuaaccaauacauugaauguaugaugacuauu

SEQ ID NO: 599857 - RNA, 64 nt, hsa
aaaauuuuauugaaaguccacagucauauucacaaaccaauacugucauugcuaaucugaacua

SEQ ID NO: 599858 - RNA, 64 nt, hsa
aaugacaauuguacugcuauauuaucccagucaaaaccaauacuuucuuuucuuuauuuuacaa

SEQ ID NO: 599859 - RNA, 64 nt, hsa
caucccgaaaugucaccugcagauuucucgugggaaccaauauguacauguuugcaauuaugcu

SEQ ID NO: 599860 - RNA, 64 nt, hsa
ugggaagacgauuucagcugacagaguuaauggcaaccaauaaugguggccuguagcugcuaag

SEQ ID NO: 599861 - RNA, 64 nt, hsa
ugaaaauuuuaaacuuggggaagauuaagaaaagaaccaauagugacaaaaaucagugcuucca

SEQ ID NO: 599862 - RNA, 64 nt, hsa
uuuugacaccuuuccuauagaugauauaggaaugaaccaauacgcuuuuauuacccuuucuaac

SEQ ID NO: 599863 - RNA, 64 nt, hsa
ucuugguccuaguagaggaugcaguguacuguuaaaccaauaucaucacaucucgagucuuauc

SEQ ID NO: 599864 - RNA, 50 nt, hsa
acuaugaagacuacuacuagaaccaauagucucaaaguaaaaacaaccac

SEQ ID NO: 599865 - RNA, 64 nt, hsa
ugaaaauuguaaacuuggggaagauuaagaaaagaaccaauagugacaaaaaucagugcuucca

SEQ ID NO: 599866 - RNA, 64 nt, hsa
aaguuuugacaccuuuccuauagauauaggaaugaaccaauacgcuuuuauuacccuuucuaac

SEQ ID NO: 599867 - RNA, 64 nt, hsa
caguguuucugucagucuuuccugcucagccaggggggaugauaccggggacucuccagagcca

SEQ ID NO: 599868 - RNA, 64 nt, hsa
gucaacggauguguagcuuuucagaaacuuaauuggggaugaauagaaaaccuguaagcuuuga

SEQ ID NO: 599869 - RNA, 64 nt, hsa
cagcccaccagcaggagcuuggaguuuggggaguggggaugaguccgucaagcacaacuguucu

SEQ ID NO: 599870 - RNA, 64 nt, hsa
gagaggagggcuguaacgccuucagucagucucuggggaugaaacucuuaaaugcuuuguauau

SEQ ID NO: 599871 - RNA, 64 nt, hsa
aauuuugagacuuguuucggugugucugugugauggggaugaggcugggguugggaucugaugu

SEQ ID NO: 599872 - RNA, 64 nt, hsa
guuuuaguugagugcucuggucucacuaugaaguggggaugacuguggcuucauaacucuaccu

SEQ ID NO: 599873 - RNA, 64 nt, hsa
cuuaagaaauccuuucuucucccuaaggggaugaggggaugaucuuuuguggugucuugaucaa

SEQ ID NO: 599874 - RNA, 64 nt, hsa
cagaaacucuuaagaaauccuuucuucucccuaaggggaugaggggaugaucuuuugugguguc

SEQ ID NO: 599875 - RNA, 64 nt, hsa
cuuaaccaguuuaauuuuuuuuuuccucauuguuggggaugaugagaagaaaugauuugggaaa

SEQ ID NO: 599876 - RNA, 64 nt, hsa
acugaaaccaaggucuuuucaaauguggcuaaauggggaugaggagacacggguaggacuuucu

SEQ ID NO: 599877 - RNA, 64 nt, hsa
ccccagcucggccuugggagguggucguguccagggggaugauggagagcuguccaaccaagag

SEQ ID NO: 599878 - RNA, 64 nt, hsa
gguguuaaugguggccuggguugugucuuccccuggggaugaggguuggguguccauggugccc

SEQ ID NO: 599879 - RNA, 64 nt, hsa
gguguccaagaugcccugggcuguguccuucccuggggaugaggguuggauguccaagaugccc

SEQ ID NO: 599880 - RNA, 64 nt, hsa
gguguccaagauacccugggcuguguccuccccuggggaugaggguuggguguccauggugccc

SEQ ID NO: 599881 - RNA, 64 nt, hsa
gguguccauggugcccugggcuguguccuccccuggggaugacgguuggguguccauggugccc

SEQ ID NO: 599882 - RNA, 64 nt, hsa
uggguguccauggugcccugggcuguguuuccuuggggaugaggguugggugcuauggcauccu

SEQ ID NO: 599883 - RNA, 64 nt, hsa
ggaaccaggggcaagcuggggcugagcuggagguggggaugagagcagguguggggacagcaau

SEQ ID NO: 599884 - RNA, 64 nt, hsa
cuuccucgagcgcgggguggggcuucgggaccccggggaugagccgggccaggucccgccccuc

SEQ ID NO: 599885 - RNA, 64 nt, hsa
gaagcuggcagugcucaccccaggcuucccugacggggaugacucagcacuaccccucaacaga

SEQ ID NO: 599886 - RNA, 64 nt, hsa
ugacucagcagggaugauucagcagagauaacucggggaugacucugauuguccuucagcaggg

SEQ ID NO: 599887 - RNA, 64 nt, hsa
caggagguauugaaggacaggagagaugucagguggggaugaagaagaggggcaggucggggga

SEQ ID NO: 599888 - RNA, 64 nt, hsa
gguguucaggagcggggagcacugaugaggugcuggggaugacaggaaggaaggaacacugggc

SEQ ID NO: 599889 - RNA, 64 nt, hsa
uuagucagaggccccacccccaggaagcauggauggggaugaaggcacaggcgucuccaaccuc

SEQ ID NO: 599890 - RNA, 64 nt, hsa
cuuucaagagguaacagcacugggauccaagcagggggaugaaaaacucagcagagaaauucga

SEQ ID NO: 599891 - RNA, 60 nt, hsa
ccaguaucaucagugaagaauuguauuucaagauucaaacaauaaccagcaauuaaacuu

SEQ ID NO: 599892 - RNA, 60 nt, hsa
agauuuguuuauguguucagauuuuaauagagauucaaaaaugacucauuuuuaccaaua

SEQ ID NO: 599893 - RNA, 60 nt, hsa
aguguucauucauccuauauuuuuauucucagauucaaagaaagagcaacuacuuuggac

SEQ ID NO: 599894 - RNA, 60 nt, hsa
ugcuuuauaacacuaagacauccuuucuaaagauucaaguggacuugacuaagcugaggg

SEQ ID NO: 599895 - RNA, 60 nt, hsa
ggcagaggggauucaaaugugugagaggcuagauucaaagacccucaguguucuauguua

SEQ ID NO: 599896 - RNA, 60 nt, hsa
uaaaguaauaagggucaaagacuacaucagagauucaaauagguuuuuaaagaaaagcua

SEQ ID NO: 599897 - RNA, 64 nt, hsa; identical to SEQ ID NO: 95478

SEQ ID NO: 599898 - RNA, 64 nt, hsa; identical to SEQ ID NO: 95479

SEQ ID NO: 599899 - RNA, 64 nt, hsa; identical to SEQ ID NO: 95480

SEQ ID NO: 599900 - RNA, 64 nt, hsa; identical to SEQ ID NO: 95481

SEQ ID NO: 599901 - RNA, 64 nt, hsa; identical to SEQ ID NO: 95482

SEQ ID NO: 599902 - RNA, 64 nt, hsa; identical to SEQ ID NO: 95483

SEQ ID NO: 599903 - RNA, 64 nt, hsa; identical to SEQ ID NO: 95484

SEQ ID NO: 599904 - RNA, 64 nt, hsa; identical to SEQ ID NO: 95485

SEQ ID NO: 599905 - RNA, 64 nt, hsa; identical to SEQ ID NO: 95486

SEQ ID NO: 599906 - RNA, 64 nt, hsa; identical to SEQ ID NO: 95487

SEQ ID NO: 599907 - RNA, 64 nt, hsa; identical to SEQ ID NO: 95488

SEQ ID NO: 599908 - RNA, 64 nt, hsa; identical to SEQ ID NO: 95489

SEQ ID NO: 599909 - RNA, 64 nt, hsa; identical to SEQ ID NO: 95490

SEQ ID NO: 599910 - RNA, 64 nt, hsa; identical to SEQ ID NO: 95491

SEQ ID NO: 599911 - RNA, 64 nt, hsa; identical to SEQ ID NO: 95492

SEQ ID NO: 599912 - RNA, 64 nt, hsa; identical to SEQ ID NO: 95493

SEQ ID NO: 599913 - RNA, 64 nt, hsa; identical to SEQ ID NO: 95494

SEQ ID NO: 599914 - RNA, 64 nt, hsa; identical to SEQ ID NO: 95495

SEQ ID NO: 599915 - RNA, 64 nt, hsa; identical to SEQ ID NO: 95496

SEQ ID NO: 599916 - RNA, 64 nt, hsa; identical to SEQ ID NO: 95497

SEQ ID NO: 599917 - RNA, 64 nt, hsa; identical to SEQ ID NO: 95498

SEQ ID NO: 599918 - RNA, 64 nt, hsa; identical to SEQ ID NO: 95499

SEQ ID NO: 599919 - RNA, 64 nt, hsa; identical to SEQ ID NO: 95500

SEQ ID NO: 599920 - RNA, 64 nt, hsa; identical to SEQ ID NO: 95501

SEQ ID NO: 599921 - RNA, 64 nt, hsa; identical to SEQ ID NO: 95502

SEQ ID NO: 599922 - RNA, 64 nt, hsa; identical to SEQ ID NO: 95503

SEQ ID NO: 599923 - RNA, 64 nt, hsa; identical to SEQ ID NO: 95504

SEQ ID NO: 599924 - RNA, 64 nt, hsa; identical to SEQ ID NO: 95505

SEQ ID NO: 599925 - RNA, 64 nt, hsa; identical to SEQ ID NO: 95506

SEQ ID NO: 599926 - RNA, 64 nt, hsa; identical to SEQ ID NO: 95507

SEQ ID NO: 599927 - RNA, 64 nt, hsa; identical to SEQ ID NO: 95508

SEQ ID NO: 599928 - RNA, 64 nt, hsa; identical to SEQ ID NO: 95509

SEQ ID NO: 599929 - RNA, 64 nt, hsa; identical to SEQ ID NO: 95510

SEQ ID NO: 599930 - RNA, 64 nt, hsa; identical to SEQ ID NO: 95511

SEQ ID NO: 599931 - RNA, 64 nt, hsa; identical to SEQ ID NO: 95512

SEQ ID NO: 599932 - RNA, 64 nt, hsa; identical to SEQ ID NO: 95513

SEQ ID NO: 599933 - RNA, 64 nt, hsa; identical to SEQ ID NO: 95514

SEQ ID NO: 599934 - RNA, 64 nt, hsa; identical to SEQ ID NO: 95515

SEQ ID NO: 599935 - RNA, 64 nt, hsa; identical to SEQ ID NO: 95516

SEQ ID NO: 599936 - RNA, 64 nt, hsa; identical to SEQ ID NO: 95517

SEQ ID NO: 599937 - RNA, 64 nt, hsa; identical to SEQ ID NO: 95518

SEQ ID NO: 599938 - RNA, 64 nt, hsa; identical to SEQ ID NO: 95519

SEQ ID NO: 599939 - RNA, 64 nt, hsa; identical to SEQ ID NO: 95520

SEQ ID NO: 599940 - RNA, 64 nt, hsa; identical to SEQ ID NO: 95521

SEQ ID NO: 599941 - RNA, 64 nt, hsa; identical to SEQ ID NO: 95522

SEQ ID NO: 599942 - RNA, 64 nt, hsa; identical to SEQ ID NO: 95523

SEQ ID NO: 599943 - RNA, 64 nt, hsa; identical to SEQ ID NO: 95524

SEQ ID NO: 599944 - RNA, 64 nt, hsa; identical to SEQ ID NO: 95525

SEQ ID NO: 599945 - RNA, 64 nt, hsa; identical to SEQ ID NO: 115857

SEQ ID NO: 599946 - RNA, 64 nt, hsa; identical to SEQ ID NO: 115858

SEQ ID NO: 599947 - RNA, 64 nt, hsa; identical to SEQ ID NO: 115859

SEQ ID NO: 599948 - RNA, 64 nt, hsa; identical to SEQ ID NO: 115860

SEQ ID NO: 599949 - RNA, 64 nt, hsa; identical to SEQ ID NO: 527879

SEQ ID NO: 599950 - RNA, 64 nt, hsa; identical to SEQ ID NO: 527880

SEQ ID NO: 599951 - RNA, 64 nt, hsa; identical to SEQ ID NO: 527881

SEQ ID NO: 599952 - RNA, 64 nt, hsa; identical to SEQ ID NO: 527882

SEQ ID NO: 599953 - RNA, 64 nt, hsa; identical to SEQ ID NO: 527883

SEQ ID NO: 599954 - RNA, 64 nt, hsa; identical to SEQ ID NO: 527884

SEQ ID NO: 599955 - RNA, 64 nt, hsa; identical to SEQ ID NO: 527885

SEQ ID NO: 599956 - RNA, 64 nt, hsa; identical to SEQ ID NO: 527886

SEQ ID NO: 599957 - RNA, 64 nt, hsa; identical to SEQ ID NO: 527887

SEQ ID NO: 599958 - RNA, 64 nt, hsa; identical to SEQ ID NO: 527888

SEQ ID NO: 599959 - RNA, 64 nt, hsa; identical to SEQ ID NO: 527889

SEQ ID NO: 599960 - RNA, 64 nt, hsa; identical to SEQ ID NO: 527890

SEQ ID NO: 599961 - RNA, 64 nt, hsa; identical to SEQ ID NO: 527891

SEQ ID NO: 599962 - RNA, 64 nt, hsa; identical to SEQ ID NO: 527892

SEQ ID NO: 599963 - RNA, 64 nt, hsa; identical to SEQ ID NO: 527893

SEQ ID NO: 599964 - RNA, 64 nt, hsa; identical to SEQ ID NO: 119338

SEQ ID NO: 599965 - RNA, 64 nt, hsa; identical to SEQ ID NO: 119339

SEQ ID NO: 599966 - RNA, 64 nt, hsa; identical to SEQ ID NO: 119340

SEQ ID NO: 599967 - RNA, 64 nt, hsa; identical to SEQ ID NO: 119341

SEQ ID NO: 599968 - RNA, 64 nt, hsa; identical to SEQ ID NO: 119342

SEQ ID NO: 599969 - RNA, 64 nt, hsa; identical to SEQ ID NO: 119343

SEQ ID NO: 599970 - RNA, 64 nt, hsa; identical to SEQ ID NO: 119344

SEQ ID NO: 599971 - RNA, 64 nt, hsa; identical to SEQ ID NO: 119345

SEQ ID NO: 599972 - RNA, 64 nt, hsa; identical to SEQ ID NO: 119346

SEQ ID NO: 599973 - RNA, 64 nt, hsa; identical to SEQ ID NO: 119347

SEQ ID NO: 599974 - RNA, 64 nt, hsa; identical to SEQ ID NO: 119348

SEQ ID NO: 599975 - RNA, 64 nt, hsa; identical to SEQ ID NO: 119349

SEQ ID NO: 599976 - RNA, 64 nt, hsa; identical to SEQ ID NO: 119350

SEQ ID NO: 599977 - RNA, 64 nt, hsa; identical to SEQ ID NO: 119351

SEQ ID NO: 599978 - RNA, 64 nt, hsa; identical to SEQ ID NO: 119352

SEQ ID NO: 599979 - RNA, 64 nt, hsa; identical to SEQ ID NO: 119353

SEQ ID NO: 599980 - RNA, 64 nt, hsa; identical to SEQ ID NO: 119354

SEQ ID NO: 599981 - RNA, 64 nt, hsa; identical to SEQ ID NO: 119355

SEQ ID NO: 599982 - RNA, 64 nt, hsa; identical to SEQ ID NO: 119356

SEQ ID NO: 599983 - RNA, 64 nt, hsa; identical to SEQ ID NO: 119357

SEQ ID NO: 599984 - RNA, 64 nt, hsa; identical to SEQ ID NO: 119358

SEQ ID NO: 599985 - RNA, 64 nt, hsa; identical to SEQ ID NO: 119359

SEQ ID NO: 599986 - RNA, 64 nt, hsa; identical to SEQ ID NO: 119360

SEQ ID NO: 599987 - RNA, 64 nt, hsa; identical to SEQ ID NO: 119361

SEQ ID NO: 599988 - RNA, 64 nt, hsa; identical to SEQ ID NO: 95478

SEQ ID NO: 599989 - RNA, 64 nt, hsa; identical to SEQ ID NO: 95479

SEQ ID NO: 599990 - RNA, 64 nt, hsa; identical to SEQ ID NO: 95480

SEQ ID NO: 599991 - RNA, 64 nt, hsa; identical to SEQ ID NO: 95481

SEQ ID NO: 599992 - RNA, 64 nt, hsa; identical to SEQ ID NO: 95482

SEQ ID NO: 599993 - RNA, 64 nt, hsa; identical to SEQ ID NO: 95483

SEQ ID NO: 599994 - RNA, 64 nt, hsa; identical to SEQ ID NO: 95484

SEQ ID NO: 599995 - RNA, 64 nt, hsa; identical to SEQ ID NO: 95485

SEQ ID NO: 599996 - RNA, 64 nt, hsa; identical to SEQ ID NO: 95486

SEQ ID NO: 599997 - RNA, 64 nt, hsa; identical to SEQ ID NO: 95487

SEQ ID NO: 599998 - RNA, 64 nt, hsa; identical to SEQ ID NO: 95488

SEQ ID NO: 599999 - RNA, 64 nt, hsa; identical to SEQ ID NO: 95489

SEQ ID NO: 600000 - RNA, 64 nt, hsa; identical to SEQ ID NO: 95490

SEQ ID NO: 600001 - RNA, 64 nt, hsa; identical to SEQ ID NO: 95491

SEQ ID NO: 600002 - RNA, 64 nt, hsa; identical to SEQ ID NO: 95492

SEQ ID NO: 600003 - RNA, 64 nt, hsa; identical to SEQ ID NO: 95493

SEQ ID NO: 600004 - RNA, 64 nt, hsa; identical to SEQ ID NO: 95494

SEQ ID NO: 600005 - RNA, 64 nt, hsa; identical to SEQ ID NO: 95495

SEQ ID NO: 600006 - RNA, 64 nt, hsa; identical to SEQ ID NO: 95496

SEQ ID NO: 600007 - RNA, 64 nt, hsa; identical to SEQ ID NO: 95497

SEQ ID NO: 600008 - RNA, 64 nt, hsa; identical to SEQ ID NO: 95498

SEQ ID NO: 600009 - RNA, 64 nt, hsa; identical to SEQ ID NO: 95499

SEQ ID NO: 600010 - RNA, 64 nt, hsa; identical to SEQ ID NO: 95500

SEQ ID NO: 600011 - RNA, 64 nt, hsa; identical to SEQ ID NO: 95501

SEQ ID NO: 600012 - RNA, 64 nt, hsa; identical to SEQ ID NO: 95502

SEQ ID NO: 600013 - RNA, 64 nt, hsa; identical to SEQ ID NO: 95503

SEQ ID NO: 600014 - RNA, 64 nt, hsa; identical to SEQ ID NO: 95504

SEQ ID NO: 600015 - RNA, 64 nt, hsa; identical to SEQ ID NO: 95505

SEQ ID NO: 600016 - RNA, 64 nt, hsa; identical to SEQ ID NO: 95506

SEQ ID NO: 600017 - RNA, 64 nt, hsa; identical to SEQ ID NO: 95507

SEQ ID NO: 600018 - RNA, 64 nt, hsa; identical to SEQ ID NO: 95508

SEQ ID NO: 600019 - RNA, 64 nt, hsa; identical to SEQ ID NO: 95509

SEQ ID NO: 600020 - RNA, 64 nt, hsa; identical to SEQ ID NO: 95510

SEQ ID NO: 600021 - RNA, 64 nt, hsa; identical to SEQ ID NO: 95511

SEQ ID NO: 600022 - RNA, 64 nt, hsa; identical to SEQ ID NO: 95512

SEQ ID NO: 600023 - RNA, 64 nt, hsa; identical to SEQ ID NO: 95513

SEQ ID NO: 600024 - RNA, 64 nt, hsa; identical to SEQ ID NO: 95514

SEQ ID NO: 600025 - RNA, 64 nt, hsa; identical to SEQ ID NO: 95515

SEQ ID NO: 600026 - RNA, 64 nt, hsa; identical to SEQ ID NO: 95516

SEQ ID NO: 600027 - RNA, 64 nt, hsa; identical to SEQ ID NO: 95517

SEQ ID NO: 600028 - RNA, 64 nt, hsa; identical to SEQ ID NO: 95518

SEQ ID NO: 600029 - RNA, 64 nt, hsa; identical to SEQ ID NO: 95519

SEQ ID NO: 600030 - RNA, 64 nt, hsa; identical to SEQ ID NO: 95520

SEQ ID NO: 600031 - RNA, 64 nt, hsa; identical to SEQ ID NO: 95521

SEQ ID NO: 600032 - RNA, 64 nt, hsa; identical to SEQ ID NO: 95522

SEQ ID NO: 600033 - RNA, 64 nt, hsa; identical to SEQ ID NO: 95523

SEQ ID NO: 600034 - RNA, 64 nt, hsa; identical to SEQ ID NO: 95524

SEQ ID NO: 600035 - RNA, 64 nt, hsa; identical to SEQ ID NO: 95525

SEQ ID NO: 600036 - RNA, 64 nt, hsa; identical to SEQ ID NO: 91216

SEQ ID NO: 600037 - RNA, 64 nt, hsa; identical to SEQ ID NO: 91217

SEQ ID NO: 600038 - RNA, 64 nt, hsa; identical to SEQ ID NO: 91218

SEQ ID NO: 600039 - RNA, 64 nt, hsa; identical to SEQ ID NO: 91219

SEQ ID NO: 600040 - RNA, 64 nt, hsa; identical to SEQ ID NO: 91220

SEQ ID NO: 600041 - RNA, 64 nt, hsa; identical to SEQ ID NO: 91221

SEQ ID NO: 600042 - RNA, 64 nt, hsa; identical to SEQ ID NO: 91222

SEQ ID NO: 600043 - RNA, 64 nt, hsa; identical to SEQ ID NO: 91223

SEQ ID NO: 600044 - RNA, 64 nt, hsa; identical to SEQ ID NO: 91224

SEQ ID NO: 600045 - RNA, 55 nt, hsa; identical to SEQ ID NO: 91225

SEQ ID NO: 600046 - RNA, 64 nt, hsa; identical to SEQ ID NO: 91226

SEQ ID NO: 600047 - RNA, 64 nt, hsa; identical to SEQ ID NO: 91227

SEQ ID NO: 600048 - RNA, 64 nt, hsa; identical to SEQ ID NO: 91228

SEQ ID NO: 600049 - RNA, 64 nt, hsa; identical to SEQ ID NO: 91229

SEQ ID NO: 600050 - RNA, 64 nt, hsa; identical to SEQ ID NO: 91230

SEQ ID NO: 600051 - RNA, 64 nt, hsa; identical to SEQ ID NO: 91231

SEQ ID NO: 600052 - RNA, 64 nt, hsa; identical to SEQ ID NO: 91232

SEQ ID NO: 600053 - RNA, 64 nt, hsa; identical to SEQ ID NO: 91233

SEQ ID NO: 600054 - RNA, 64 nt, hsa; identical to SEQ ID NO: 91234

SEQ ID NO: 600055 - RNA, 64 nt, hsa; identical to SEQ ID NO: 91235

SEQ ID NO: 600056 - RNA, 64 nt, hsa; identical to SEQ ID NO: 91236

SEQ ID NO: 600057 - RNA, 64 nt, hsa; identical to SEQ ID NO: 91237

SEQ ID NO: 600058 - RNA, 64 nt, hsa; identical to SEQ ID NO: 91238

SEQ ID NO: 600059 - RNA, 55 nt, hsa; identical to SEQ ID NO: 91239

SEQ ID NO: 600060 - RNA, 64 nt, hsa; identical to SEQ ID NO: 91240

SEQ ID NO: 600061 - RNA, 64 nt, hsa; identical to SEQ ID NO: 91241

SEQ ID NO: 600062 - RNA, 64 nt, hsa; identical to SEQ ID NO: 91242

SEQ ID NO: 600063 - RNA, 64 nt, hsa; identical to SEQ ID NO: 91243

SEQ ID NO: 600064 - RNA, 64 nt, hsa; identical to SEQ ID NO: 91244

SEQ ID NO: 600065 - RNA, 64 nt, hsa; identical to SEQ ID NO: 91245

SEQ ID NO: 600066 - RNA, 64 nt, hsa; identical to SEQ ID NO: 91246

SEQ ID NO: 600067 - RNA, 64 nt, hsa; identical to SEQ ID NO: 91247

SEQ ID NO: 600068 - RNA, 64 nt, hsa; identical to SEQ ID NO: 91248

SEQ ID NO: 600069 - RNA, 64 nt, hsa; identical to SEQ ID NO: 91249

SEQ ID NO: 600070 - RNA, 64 nt, hsa; identical to SEQ ID NO: 91250

SEQ ID NO: 600071 - RNA, 64 nt, hsa; identical to SEQ ID NO: 91251

SEQ ID NO: 600072 - RNA, 64 nt, hsa; identical to SEQ ID NO: 91252

SEQ ID NO: 600073 - RNA, 64 nt, hsa; identical to SEQ ID NO: 91253

SEQ ID NO: 600074 - RNA, 64 nt, hsa; identical to SEQ ID NO: 91254

SEQ ID NO: 600075 - RNA, 64 nt, hsa; identical to SEQ ID NO: 91255

SEQ ID NO: 600076 - RNA, 64 nt, hsa; identical to SEQ ID NO: 91256

SEQ ID NO: 600077 - RNA, 64 nt, hsa; identical to SEQ ID NO: 91257

SEQ ID NO: 600078 - RNA, 64 nt, hsa; identical to SEQ ID NO: 91258

SEQ ID NO: 600079 - RNA, 64 nt, hsa; identical to SEQ ID NO: 91259

SEQ ID NO: 600080 - RNA, 64 nt, hsa; identical to SEQ ID NO: 91260

SEQ ID NO: 600081 - RNA, 64 nt, hsa; identical to SEQ ID NO: 91261

SEQ ID NO: 600082 - RNA, 64 nt, hsa
gcugaguuuuucacguguaagaugagaauggcugauggcugagagcccaccaaccuuccccacc

SEQ ID NO: 600083 - RNA, 64 nt, hsa
ucucucagcugaguuuuucacguguaagaugagaauggcugauggcugagagcccaccaaccuu

SEQ ID NO: 600084 - RNA, 64 nt, hsa
uuuguguguguggcgcuuuagggugcuggacuguauggcugagggcugguuggguuccucuauu

SEQ ID NO: 600085 - RNA, 64 nt, hsa
ugaaaggguugccuuggcagcagaggcuccucugauggcugacaucagucacugcgucugggcc

SEQ ID NO: 600086 - RNA, 64 nt, hsa
uguuuuccauuacauuuagauucauagaaucugaauggcugauuaaauggccaucugauggcug

SEQ ID NO: 600087 - RNA, 64 nt, hsa
auagaaucugaauggcugauuaaauggccaucugauggcugaaagaggggcguauuuuucacuc

SEQ ID NO: 600088 - RNA, 64 nt, hsa
cuuggucauuuuuuuuauauugccuuauuucccuauggcugagccuuguugugacacaucaagc

SEQ ID NO: 600089 - RNA, 64 nt, hsa
aggggaggguuggagacaaaagcuguaaauuacuauggcugauuuauuucuacuauauacauau

SEQ ID NO: 600090 - RNA, 64 nt, hsa
ucuccaugguuuuuccuacacaugaaugcgagaaauggcugauaagcacaguaauuuaagauug

SEQ ID NO: 600091 - RNA, 64 nt, hsa
aucuggguuucuagaccucacugaacacacuggaauggcugaguuuaacuuauuuaggcauuca

SEQ ID NO: 600092 - RNA, 64 nt, hsa
gaaggugcuggaagccgaggugcuggcacugaagauggcugaggagucagagaggaggugaggg

SEQ ID NO: 600093 - RNA, 64 nt, hsa
ugcacccagccccuucuugcccuuucuuuucuccauggcugaugcugcuguggccagccagggc

SEQ ID NO: 600094 - RNA, 64 nt, hsa
uuuuguuguauaaggcuguggaaguuguacuccaauggcugaagccauguuguuaauauggcug

SEQ ID NO: 600095 - RNA, 64 nt, hsa
guuguacuccaauggcugaagccauguuguuaauauggcugaugggagcaucccugcagcugaa

SEQ ID NO: 600096 - RNA, 64 nt, hsa; identical to SEQ ID NO: 50645

SEQ ID NO: 600097 - RNA, 64 nt, hsa; identical to SEQ ID NO: 50646

SEQ ID NO: 600098 - RNA, 64 nt, hsa; identical to SEQ ID NO: 50647

SEQ ID NO: 600099 - RNA, 64 nt, hsa; identical to SEQ ID NO: 50648

SEQ ID NO: 600100 - RNA, 64 nt, hsa; identical to SEQ ID NO: 50649

SEQ ID NO: 600101 - RNA, 64 nt, hsa; identical to SEQ ID NO: 50650

SEQ ID NO: 600102 - RNA, 64 nt, hsa; identical to SEQ ID NO: 50651

SEQ ID NO: 600103 - RNA, 64 nt, hsa; identical to SEQ ID NO: 50652

SEQ ID NO: 600104 - RNA, 64 nt, hsa; identical to SEQ ID NO: 50653

SEQ ID NO: 600105 - RNA, 64 nt, hsa; identical to SEQ ID NO: 50654

SEQ ID NO: 600106 - RNA, 64 nt, hsa; identical to SEQ ID NO: 50653

SEQ ID NO: 600107 - RNA, 64 nt, hsa; identical to SEQ ID NO: 50656

SEQ ID NO: 600108 - RNA, 64 nt, hsa; identical to SEQ ID NO: 50657

SEQ ID NO: 600109 - RNA, 64 nt, hsa; identical to SEQ ID NO: 50658

SEQ ID NO: 600110 - RNA, 64 nt, hsa; identical to SEQ ID NO: 50659

SEQ ID NO: 600111 - RNA, 64 nt, hsa; identical to SEQ ID NO: 50660

SEQ ID NO: 600112 - RNA, 64 nt, hsa; identical to SEQ ID NO: 50661

SEQ ID NO: 600113 - RNA, 64 nt, hsa; identical to SEQ ID NO: 50662

SEQ ID NO: 600114 - RNA, 64 nt, hsa; identical to SEQ ID NO: 50663

SEQ ID NO: 600115 - RNA, 64 nt, hsa; identical to SEQ ID NO: 50664

SEQ ID NO: 600116 - RNA, 64 nt, hsa; identical to SEQ ID NO: 50665

SEQ ID NO: 600117 - RNA, 64 nt, hsa; identical to SEQ ID NO: 50666

SEQ ID NO: 600118 - RNA, 64 nt, hsa; identical to SEQ ID NO: 50667

SEQ ID NO: 600119 - RNA, 64 nt, hsa; identical to SEQ ID NO: 50668

SEQ ID NO: 600120 - RNA, 64 nt, hsa; identical to SEQ ID NO: 50669

SEQ ID NO: 600121 - RNA, 64 nt, hsa; identical to SEQ ID NO: 50670

SEQ ID NO: 600122 - RNA, 64 nt, hsa; identical to SEQ ID NO: 50671

SEQ ID NO: 600123 - RNA, 64 nt, hsa; identical to SEQ ID NO: 50672

SEQ ID NO: 600124 - RNA, 53 nt, hsa; identical to SEQ ID NO: 50673

SEQ ID NO: 600125 - RNA, 64 nt, hsa; identical to SEQ ID NO: 50674

SEQ ID NO: 600126 - RNA, 64 nt, hsa; identical to SEQ ID NO: 50675

SEQ ID NO: 600127 - RNA, 64 nt, hsa; identical to SEQ ID NO: 50676

SEQ ID NO: 600128 - RNA, 64 nt, hsa; identical to SEQ ID NO: 50677

SEQ ID NO: 600129 - RNA, 64 nt, hsa; identical to SEQ ID NO: 50678

SEQ ID NO: 600130 - RNA, 64 nt, hsa; identical to SEQ ID NO: 50679

SEQ ID NO: 600131 - RNA, 64 nt, hsa; identical to SEQ ID NO: 393047

SEQ ID NO: 600132 - RNA, 64 nt, hsa; identical to SEQ ID NO: 393048

SEQ ID NO: 600133 - RNA, 64 nt, hsa; identical to SEQ ID NO: 393049

SEQ ID NO: 600134 - RNA, 64 nt, hsa; identical to SEQ ID NO: 393050

SEQ ID NO: 600135 - RNA, 64 nt, hsa; identical to SEQ ID NO: 393051

SEQ ID NO: 600136 - RNA, 64 nt, hsa; identical to SEQ ID NO: 393052

SEQ ID NO: 600137 - RNA, 64 nt, hsa; identical to SEQ ID NO: 393053

SEQ ID NO: 600138 - RNA, 64 nt, hsa; identical to SEQ ID NO: 393054

SEQ ID NO: 600139 - RNA, 64 nt, hsa; identical to SEQ ID NO: 393055

SEQ ID NO: 600140 - RNA, 64 nt, hsa; identical to SEQ ID NO: 393056

SEQ ID NO: 600141 - RNA, 64 nt, hsa; identical to SEQ ID NO: 393057

SEQ ID NO: 600142 - RNA, 64 nt, hsa; identical to SEQ ID NO: 393058

SEQ ID NO: 600143 - RNA, 64 nt, hsa; identical to SEQ ID NO: 393059

SEQ ID NO: 600144 - RNA, 64 nt, hsa; identical to SEQ ID NO: 393060

SEQ ID NO: 600145 - RNA, 64 nt, hsa; identical to SEQ ID NO: 393061

SEQ ID NO: 600146 - RNA, 64 nt, hsa; identical to SEQ ID NO: 393062

SEQ ID NO: 600147 - RNA, 64 nt, hsa; identical to SEQ ID NO: 393063

SEQ ID NO: 600148 - RNA, 64 nt, hsa; identical to SEQ ID NO: 393064

SEQ ID NO: 600149 - RNA, 64 nt, hsa; identical to SEQ ID NO: 393065

SEQ ID NO: 600150 - RNA, 64 nt, hsa; identical to SEQ ID NO: 393066

SEQ ID NO: 600151 - RNA, 64 nt, hsa; identical to SEQ ID NO: 393067

SEQ ID NO: 600152 - RNA, 64 nt, hsa; identical to SEQ ID NO: 393068

SEQ ID NO: 600153 - RNA, 64 nt, hsa; identical to SEQ ID NO: 393069

SEQ ID NO: 600154 - RNA, 64 nt, hsa; identical to SEQ ID NO: 393070

SEQ ID NO: 600155 - RNA, 64 nt, hsa; identical to SEQ ID NO: 393071

SEQ ID NO: 600156 - RNA, 64 nt, hsa; identical to SEQ ID NO: 393072

SEQ ID NO: 600157 - RNA, 64 nt, hsa; identical to SEQ ID NO: 393073

SEQ ID NO: 600158 - RNA, 64 nt, hsa; identical to SEQ ID NO: 393074

SEQ ID NO: 600159 - RNA, 64 nt, hsa; identical to SEQ ID NO: 393075

SEQ ID NO: 600160 - RNA, 64 nt, hsa; identical to SEQ ID NO: 393076

SEQ ID NO: 600161 - RNA, 64 nt, hsa; identical to SEQ ID NO: 393077

SEQ ID NO: 600162 - RNA, 64 nt, hsa; identical to SEQ ID NO: 393078

SEQ ID NO: 600163 - RNA, 64 nt, hsa; identical to SEQ ID NO: 393079

SEQ ID NO: 600164 - RNA, 64 nt, hsa; identical to SEQ ID NO: 393080

SEQ ID NO: 600165 - RNA, 64 nt, hsa; identical to SEQ ID NO: 393081

SEQ ID NO: 600166 - RNA, 64 nt, hsa; identical to SEQ ID NO: 393082

SEQ ID NO: 600167 - RNA, 64 nt, hsa; identical to SEQ ID NO: 393083

SEQ ID NO: 600168 - RNA, 64 nt, hsa; identical to SEQ ID NO: 393084

SEQ ID NO: 600169 - RNA, 64 nt, hsa; identical to SEQ ID NO: 393085

SEQ ID NO: 600170 - RNA, 64 nt, hsa; identical to SEQ ID NO: 393086

SEQ ID NO: 600171 - RNA, 64 nt, hsa; identical to SEQ ID NO: 393087

SEQ ID NO: 600172 - RNA, 64 nt, hsa; identical to SEQ ID NO: 393088

SEQ ID NO: 600173 - RNA, 64 nt, hsa; identical to SEQ ID NO: 393089

SEQ ID NO: 600174 - RNA, 64 nt, hsa; identical to SEQ ID NO: 393090

SEQ ID NO: 600175 - RNA, 64 nt, hsa; identical to SEQ ID NO: 393091

SEQ ID NO: 600176 - RNA, 64 nt, hsa; identical to SEQ ID NO: 393092

SEQ ID NO: 600177 - RNA, 64 nt, hsa; identical to SEQ ID NO: 393093

SEQ ID NO: 600178 - RNA, 64 nt, hsa; identical to SEQ ID NO: 393094

SEQ ID NO: 600179 - RNA, 64 nt, hsa; identical to SEQ ID NO: 393095

SEQ ID NO: 600180 - RNA, 64 nt, hsa; identical to SEQ ID NO: 393096

SEQ ID NO: 600181 - RNA, 64 nt, hsa; identical to SEQ ID NO: 393097

SEQ ID NO: 600182 - RNA, 64 nt, hsa; identical to SEQ ID NO: 393098

SEQ ID NO: 600183 - RNA, 64 nt, hsa; identical to SEQ ID NO: 393099

SEQ ID NO: 600184 - RNA, 64 nt, hsa; identical to SEQ ID NO: 393100

SEQ ID NO: 600185 - RNA, 64 nt, hsa; identical to SEQ ID NO: 393101

SEQ ID NO: 600186 - RNA, 64 nt, hsa; identical to SEQ ID NO: 393102

SEQ ID NO: 600187 - RNA, 64 nt, hsa; identical to SEQ ID NO: 393103

SEQ ID NO: 600188 - RNA, 64 nt, hsa; identical to SEQ ID NO: 393104

SEQ ID NO: 600189 - RNA, 64 nt, hsa; identical to SEQ ID NO: 393105

SEQ ID NO: 600190 - RNA, 64 nt, hsa; identical to SEQ ID NO: 393106

SEQ ID NO: 600191 - RNA, 64 nt, hsa; identical to SEQ ID NO: 393107

SEQ ID NO: 600192 - RNA, 64 nt, hsa; identical to SEQ ID NO: 393108

SEQ ID NO: 600193 - RNA, 64 nt, hsa; identical to SEQ ID NO: 393109

SEQ ID NO: 600194 - RNA, 64 nt, hsa; identical to SEQ ID NO: 393110

SEQ ID NO: 600195 - RNA, 64 nt, hsa; identical to SEQ ID NO: 393111

SEQ ID NO: 600196 - RNA, 64 nt, hsa; identical to SEQ ID NO: 393112

SEQ ID NO: 600197 - RNA, 64 nt, hsa; identical to SEQ ID NO: 393113

SEQ ID NO: 600198 - RNA, 64 nt, hsa; identical to SEQ ID NO: 393114

SEQ ID NO: 600199 - RNA, 64 nt, hsa; identical to SEQ ID NO: 393115

SEQ ID NO: 600200 - RNA, 64 nt, hsa; identical to SEQ ID NO: 393116

SEQ ID NO: 600201 - RNA, 64 nt, hsa; identical to SEQ ID NO: 393117

SEQ ID NO: 600202 - RNA, 64 nt, hsa; identical to SEQ ID NO: 393118

SEQ ID NO: 600203 - RNA, 64 nt, hsa; identical to SEQ ID NO: 393119

SEQ ID NO: 600204 - RNA, 64 nt, hsa; identical to SEQ ID NO: 393120

SEQ ID NO: 600205 - RNA, 64 nt, hsa; identical to SEQ ID NO: 393121

SEQ ID NO: 600206 - RNA, 64 nt, hsa; identical to SEQ ID NO: 393122

SEQ ID NO: 600207 - RNA, 64 nt, hsa; identical to SEQ ID NO: 393123

SEQ ID NO: 600208 - RNA, 64 nt, hsa; identical to SEQ ID NO: 393124

SEQ ID NO: 600209 - RNA, 64 nt, hsa; identical to SEQ ID NO: 393125

SEQ ID NO: 600210 - RNA, 64 nt, hsa; identical to SEQ ID NO: 393126

SEQ ID NO: 600211 - RNA, 64 nt, hsa; identical to SEQ ID NO: 393127

SEQ ID NO: 600212 - RNA, 64 nt, hsa; identical to SEQ ID NO: 393128

SEQ ID NO: 600213 - RNA, 64 nt, hsa; identical to SEQ ID NO: 393129

SEQ ID NO: 600214 - RNA, 64 nt, hsa; identical to SEQ ID NO: 393130

SEQ ID NO: 600215 - RNA, 64 nt, hsa; identical to SEQ ID NO: 393131

SEQ ID NO: 600216 - RNA, 64 nt, hsa; identical to SEQ ID NO: 393132

SEQ ID NO: 600217 - RNA, 64 nt, hsa; identical to SEQ ID NO: 393133

SEQ ID NO: 600218 - RNA, 64 nt, hsa; identical to SEQ ID NO: 393134

SEQ ID NO: 600219 - RNA, 64 nt, hsa; identical to SEQ ID NO: 393135

SEQ ID NO: 600220 - RNA, 64 nt, hsa; identical to SEQ ID NO: 393136

SEQ ID NO: 600221 - RNA, 64 nt, hsa; identical to SEQ ID NO: 393137

SEQ ID NO: 600222 - RNA, 64 nt, hsa; identical to SEQ ID NO: 393138

SEQ ID NO: 600223 - RNA, 64 nt, hsa; identical to SEQ ID NO: 393139

SEQ ID NO: 600224 - RNA, 64 nt, hsa; identical to SEQ ID NO: 393140

SEQ ID NO: 600225 - RNA, 64 nt, hsa; identical to SEQ ID NO: 393141

SEQ ID NO: 600226 - RNA, 64 nt, hsa; identical to SEQ ID NO: 393142

SEQ ID NO: 600227 - RNA, 64 nt, hsa; identical to SEQ ID NO: 393143

SEQ ID NO: 600228 - RNA, 64 nt, hsa; identical to SEQ ID NO: 393144

SEQ ID NO: 600229 - RNA, 64 nt, hsa; identical to SEQ ID NO: 393145

SEQ ID NO: 600230 - RNA, 64 nt, hsa; identical to SEQ ID NO: 393146

SEQ ID NO: 600231 - RNA, 64 nt, hsa; identical to SEQ ID NO: 393147

SEQ ID NO: 600232 - RNA, 64 nt, hsa; identical to SEQ ID NO: 393148

SEQ ID NO: 600233 - RNA, 64 nt, hsa; identical to SEQ ID NO: 393149

SEQ ID NO: 600234 - RNA, 64 nt, hsa; identical to SEQ ID NO: 393150

SEQ ID NO: 600235 - RNA, 64 nt, hsa; identical to SEQ ID NO: 393151

SEQ ID NO: 600236 - RNA, 64 nt, hsa; identical to SEQ ID NO: 393152

SEQ ID NO: 600237 - RNA, 64 nt, hsa; identical to SEQ ID NO: 393153

SEQ ID NO: 600238 - RNA, 64 nt, hsa; identical to SEQ ID NO: 393154

SEQ ID NO: 600239 - RNA, 64 nt, hsa; identical to SEQ ID NO: 393155

SEQ ID NO: 600240 - RNA, 64 nt, hsa; identical to SEQ ID NO: 393156

SEQ ID NO: 600241 - RNA, 64 nt, hsa; identical to SEQ ID NO: 393157

SEQ ID NO: 600242 - RNA, 64 nt, hsa; identical to SEQ ID NO: 393158

SEQ ID NO: 600243 - RNA, 64 nt, hsa; identical to SEQ ID NO: 393159

SEQ ID NO: 600244 - RNA, 64 nt, hsa; identical to SEQ ID NO: 393160

SEQ ID NO: 600245 - RNA, 64 nt, hsa; identical to SEQ ID NO: 393161

SEQ ID NO: 600246 - RNA, 64 nt, hsa; identical to SEQ ID NO: 393162

SEQ ID NO: 600247 - RNA, 64 nt, hsa; identical to SEQ ID NO: 393163

SEQ ID NO: 600248 - RNA, 64 nt, hsa; identical to SEQ ID NO: 393164

SEQ ID NO: 600249 - RNA, 64 nt, hsa; identical to SEQ ID NO: 393165

SEQ ID NO: 600250 - RNA, 64 nt, hsa; identical to SEQ ID NO: 393166

SEQ ID NO: 600251 - RNA, 64 nt, hsa; identical to SEQ ID NO: 393167

SEQ ID NO: 600252 - RNA, 64 nt, hsa; identical to SEQ ID NO: 393168

SEQ ID NO: 600253 - RNA, 64 nt, hsa; identical to SEQ ID NO: 393169

SEQ ID NO: 600254 - RNA, 64 nt, hsa; identical to SEQ ID NO: 393170

SEQ ID NO: 600255 - RNA, 64 nt, hsa; identical to SEQ ID NO: 393171

SEQ ID NO: 600256 - RNA, 64 nt, hsa; identical to SEQ ID NO: 393172

SEQ ID NO: 600257 - RNA, 64 nt, hsa; identical to SEQ ID NO: 393173

SEQ ID NO: 600258 - RNA, 64 nt, hsa; identical to SEQ ID NO: 393174

SEQ ID NO: 600259 - RNA, 64 nt, hsa; identical to SEQ ID NO: 393175

SEQ ID NO: 600260 - RNA, 64 nt, hsa; identical to SEQ ID NO: 393176

SEQ ID NO: 600261 - RNA, 64 nt, hsa; identical to SEQ ID NO: 492885

SEQ ID NO: 600262 - RNA, 64 nt, hsa; identical to SEQ ID NO: 492886

SEQ ID NO: 600263 - RNA, 64 nt, hsa; identical to SEQ ID NO: 492887

SEQ ID NO: 600264 - RNA, 64 nt, hsa; identical to SEQ ID NO: 492888

SEQ ID NO: 600265 - RNA, 64 nt, hsa; identical to SEQ ID NO: 492889

SEQ ID NO: 600266 - RNA, 64 nt, hsa; identical to SEQ ID NO: 492890

SEQ ID NO: 600267 - RNA, 64 nt, hsa; identical to SEQ ID NO: 492891

SEQ ID NO: 600268 - RNA, 64 nt, hsa; identical to SEQ ID NO: 492892

SEQ ID NO: 600269 - RNA, 64 nt, hsa; identical to SEQ ID NO: 492893

SEQ ID NO: 600270 - RNA, 64 nt, hsa; identical to SEQ ID NO: 492894

SEQ ID NO: 600271 - RNA, 64 nt, hsa; identical to SEQ ID NO: 492895

SEQ ID NO: 600272 - RNA, 64 nt, hsa; identical to SEQ ID NO: 492896

SEQ ID NO: 600273 - RNA, 64 nt, hsa; identical to SEQ ID NO: 492897

SEQ ID NO: 600274 - RNA, 64 nt, hsa; identical to SEQ ID NO: 47001

SEQ ID NO: 600275 - RNA, 64 nt, hsa; identical to SEQ ID NO: 47002

SEQ ID NO: 600276 - RNA, 64 nt, hsa; identical to SEQ ID NO: 47003

SEQ ID NO: 600277 - RNA, 64 nt, hsa; identical to SEQ ID NO: 47004

SEQ ID NO: 600278 - RNA, 64 nt, hsa; identical to SEQ ID NO: 47005

SEQ ID NO: 600279 - RNA, 64 nt, hsa; identical to SEQ ID NO: 47006

SEQ ID NO: 600280 - RNA, 58 nt, hsa; identical to SEQ ID NO: 47007

SEQ ID NO: 600281 - RNA, 64 nt, hsa; identical to SEQ ID NO: 47008

SEQ ID NO: 600282 - RNA, 64 nt, hsa; identical to SEQ ID NO: 47009

SEQ ID NO: 600283 - RNA, 64 nt, hsa; identical to SEQ ID NO: 47010

SEQ ID NO: 600284 - RNA, 64 nt, hsa; identical to SEQ ID NO: 47011

SEQ ID NO: 600285 - RNA, 64 nt, hsa; identical to SEQ ID NO: 47012

SEQ ID NO: 600286 - RNA, 64 nt, hsa; identical to SEQ ID NO: 47013

SEQ ID NO: 600287 - RNA, 64 nt, hsa; identical to SEQ ID NO: 47014

SEQ ID NO: 600288 - RNA, 64 nt, hsa; identical to SEQ ID NO: 47015

SEQ ID NO: 600289 - RNA, 64 nt, hsa
uugauuauucaccaaaaguguuccccagucuuugacucuuuaaauuccaauacugauuccaaaa

SEQ ID NO: 600290 - RNA, 64 nt, hsa
aaguuuaaguuuacuuggauugauaauuagguuuacucuuuaucugaauaagaaccaauuccau

SEQ ID NO: 600291 - RNA, 64 nt, hsa
ugugccuuacaccuugaguuguguacacuuguaaacucuuuaugaucaacuguucccccuuuug

SEQ ID NO: 600292 - RNA, 64 nt, hsa
uuuuaaugaaauaacgugaccguuaacgcaaguaacucuuuauuuauuguucacccuuuuuuuc

SEQ ID NO: 600293 - RNA, 64 nt, hsa
ggauuacaggugugagccaccaugccugggcuaaacucuuuaagucucuaguaaaugcagcuag

SEQ ID NO: 600294 - RNA, 64 nt, hsa
uuucuagcagugccaucuccaaaauguguuuuaaacucuuuauuuuuuuaauuauuauuaguau

SEQ ID NO: 600295 - RNA, 64 nt, hsa
aggagggggcuggcugccuuuaugucccaggaugacucuuuaugggugggauuacauugcaccc

SEQ ID NO: 600296 - RNA, 64 nt, hsa
ucuuucccucuuuuucacuuugagcuuugggaaaacucuuuaucuuaugaggcuguauuccuca

SEQ ID NO: 600297 - RNA, 64 nt, hsa
gauggcauugggagaaauuuuagagagcuuucaaacucuuuauucucauguuccacauggucua

SEQ ID NO: 600298 - RNA, 64 nt, hsa
gugcuuccuauauuaccaucccucaugcauauuaacucuuuagaauuuuagguuaagugauguc

SEQ ID NO: 600299 - RNA, 64 nt, hsa
ggguuuuuuuuuuuaaauaaaggaaaauuuguagacucuuuauaauagaacuuguggaaguuaa

SEQ ID NO: 600300 - RNA, 64 nt, hsa
guucuguuuaaugaccucuuuaaagguacuguguacucuuuaauagggauaucauguaccaggu

SEQ ID NO: 600301 - RNA, 64 nt, hsa
agacgaaugauagggccugguuuacauucauuuaacucuuuaugaccuucacucagcuguggau

SEQ ID NO: 600302 - RNA, 64 nt, hsa
cuuaaaucuguauacagaauaucauugauauaauacucuuuaggcaggagcacucuugccuucc

SEQ ID NO: 600303 - RNA, 64 nt, hsa
aaagcaguguguguuucuuauuuuuauauuuuuaacucuuuauucuuggauguauaaagugaac

SEQ ID NO: 600304 - RNA, 64 nt, hsa; identical to SEQ ID NO: 98813

SEQ ID NO: 600305 - RNA, 64 nt, hsa; identical to SEQ ID NO: 98814

SEQ ID NO: 600306 - RNA, 64 nt, hsa; identical to SEQ ID NO: 98815

SEQ ID NO: 600307 - RNA, 64 nt, hsa; identical to SEQ ID NO: 98816

SEQ ID NO: 600308 - RNA, 64 nt, hsa; identical to SEQ ID NO: 98817

SEQ ID NO: 600309 - RNA, 64 nt, hsa; identical to SEQ ID NO: 98818

SEQ ID NO: 600310 - RNA, 64 nt, hsa; identical to SEQ ID NO: 98819

SEQ ID NO: 600311 - RNA, 64 nt, hsa; identical to SEQ ID NO: 98820

SEQ ID NO: 600312 - RNA, 64 nt, hsa; identical to SEQ ID NO: 98821

SEQ ID NO: 600313 - RNA, 64 nt, hsa; identical to SEQ ID NO: 98822

SEQ ID NO: 600314 - RNA, 64 nt, hsa; identical to SEQ ID NO: 98823

SEQ ID NO: 600315 - RNA, 64 nt, hsa; identical to SEQ ID NO: 98824

SEQ ID NO: 600316 - RNA, 64 nt, hsa; identical to SEQ ID NO: 98825

SEQ ID NO: 600317 - RNA, 64 nt, hsa; identical to SEQ ID NO: 98826

SEQ ID NO: 600318 - RNA, 64 nt, hsa; identical to SEQ ID NO: 98827

SEQ ID NO: 600319 - RNA, 64 nt, hsa; identical to SEQ ID NO: 98828

SEQ ID NO: 600320 - RNA, 64 nt, hsa; identical to SEQ ID NO: 98829

SEQ ID NO: 600321 - RNA, 64 nt, hsa; identical to SEQ ID NO: 98830

SEQ ID NO: 600322 - RNA, 64 nt, hsa; identical to SEQ ID NO: 98831

SEQ ID NO: 600323 - RNA, 64 nt, hsa; identical to SEQ ID NO: 98832

SEQ ID NO: 600324 - RNA, 64 nt, hsa; identical to SEQ ID NO: 98833

SEQ ID NO: 600325 - RNA, 64 nt, hsa; identical to SEQ ID NO: 98834

SEQ ID NO: 600326 - RNA, 64 nt, hsa; identical to SEQ ID NO: 98835

SEQ ID NO: 600327 - RNA, 64 nt, hsa; identical to SEQ ID NO: 98836

SEQ ID NO: 600328 - RNA, 64 nt, hsa; identical to SEQ ID NO: 98837

SEQ ID NO: 600329 - RNA, 64 nt, hsa; identical to SEQ ID NO: 98838

SEQ ID NO: 600330 - RNA, 64 nt, hsa; identical to SEQ ID NO: 98839

SEQ ID NO: 600331 - RNA, 64 nt, hsa; identical to SEQ ID NO: 98840

SEQ ID NO: 600332 - RNA, 64 nt, hsa; identical to SEQ ID NO: 98841

SEQ ID NO: 600333 - RNA, 64 nt, hsa; identical to SEQ ID NO: 98842

SEQ ID NO: 600334 - RNA, 64 nt, hsa; identical to SEQ ID NO: 98843

SEQ ID NO: 600335 - RNA, 64 nt, hsa; identical to SEQ ID NO: 98844

SEQ ID NO: 600336 - RNA, 64 nt, hsa; identical to SEQ ID NO: 98845

SEQ ID NO: 600337 - RNA, 64 nt, hsa; identical to SEQ ID NO: 98846

SEQ ID NO: 600338 - RNA, 64 nt, hsa; identical to SEQ ID NO: 98847

SEQ ID NO: 600339 - RNA, 64 nt, hsa; identical to SEQ ID NO: 98848

SEQ ID NO: 600340 - RNA, 64 nt, hsa; identical to SEQ ID NO: 98849

SEQ ID NO: 600341 - RNA, 64 nt, hsa; identical to SEQ ID NO: 98850

SEQ ID NO: 600342 - RNA, 64 nt, hsa; identical to SEQ ID NO: 98851

SEQ ID NO: 600343 - RNA, 64 nt, hsa; identical to SEQ ID NO: 98852

SEQ ID NO: 600344 - RNA, 64 nt, hsa; identical to SEQ ID NO: 98853

SEQ ID NO: 600345 - RNA, 64 nt, hsa; identical to SEQ ID NO: 98854

SEQ ID NO: 600346 - RNA, 64 nt, hsa; identical to SEQ ID NO: 98855

SEQ ID NO: 600347 - RNA, 64 nt, hsa; identical to SEQ ID NO: 98856

SEQ ID NO: 600348 - RNA, 64 nt, hsa; identical to SEQ ID NO: 98857

SEQ ID NO: 600349 - RNA, 64 nt, hsa; identical to SEQ ID NO: 98858

SEQ ID NO: 600350 - RNA, 64 nt, hsa; identical to SEQ ID NO: 98859

SEQ ID NO: 600351 - RNA, 64 nt, hsa; identical to SEQ ID NO: 98860

SEQ ID NO: 600352 - RNA, 64 nt, hsa; identical to SEQ ID NO: 98861

SEQ ID NO: 600353 - RNA, 64 nt, hsa; identical to SEQ ID NO: 98862

SEQ ID NO: 600354 - RNA, 64 nt, hsa; identical to SEQ ID NO: 98863

SEQ ID NO: 600355 - RNA, 64 nt, hsa; identical to SEQ ID NO: 98864

SEQ ID NO: 600356 - RNA, 64 nt, hsa; identical to SEQ ID NO: 98865

SEQ ID NO: 600357 - RNA, 64 nt, hsa; identical to SEQ ID NO: 98866

SEQ ID NO: 600358 - RNA, 64 nt, hsa; identical to SEQ ID NO: 98867

SEQ ID NO: 600359 - RNA, 64 nt, hsa; identical to SEQ ID NO: 98868

SEQ ID NO: 600360 - RNA, 64 nt, hsa; identical to SEQ ID NO: 98869

SEQ ID NO: 600361 - RNA, 64 nt, hsa; identical to SEQ ID NO: 98870

SEQ ID NO: 600362 - RNA, 64 nt, hsa; identical to SEQ ID NO: 98871

SEQ ID NO: 600363 - RNA, 64 nt, hsa; identical to SEQ ID NO: 98872

SEQ ID NO: 600364 - RNA, 64 nt, hsa; identical to SEQ ID NO: 98873

SEQ ID NO: 600365 - RNA, 64 nt, hsa; identical to SEQ ID NO: 98874

SEQ ID NO: 600366 - RNA, 64 nt, hsa; identical to SEQ ID NO: 98875

SEQ ID NO: 600367 - RNA, 64 nt, hsa; identical to SEQ ID NO: 98876

SEQ ID NO: 600368 - RNA, 64 nt, hsa; identical to SEQ ID NO: 98877

SEQ ID NO: 600369 - RNA, 64 nt, hsa; identical to SEQ ID NO: 98878

SEQ ID NO: 600370 - RNA, 64 nt, hsa; identical to SEQ ID NO: 98879

SEQ ID NO: 600371 - RNA, 64 nt, hsa; identical to SEQ ID NO: 98880

SEQ ID NO: 600372 - RNA, 64 nt, hsa; identical to SEQ ID NO: 98881

SEQ ID NO: 600373 - RNA, 64 nt, hsa; identical to SEQ ID NO: 98882

SEQ ID NO: 600374 - RNA, 64 nt, hsa; identical to SEQ ID NO: 98883

SEQ ID NO: 600375 - RNA, 64 nt, hsa; identical to SEQ ID NO: 98884

SEQ ID NO: 600376 - RNA, 64 nt, hsa; identical to SEQ ID NO: 98885

SEQ ID NO: 600377 - RNA, 64 nt, hsa; identical to SEQ ID NO: 98886

SEQ ID NO: 600378 - RNA, 64 nt, hsa; identical to SEQ ID NO: 98887

SEQ ID NO: 600379 - RNA, 64 nt, hsa; identical to SEQ ID NO: 98888

SEQ ID NO: 600380 - RNA, 64 nt, hsa; identical to SEQ ID NO: 98889

SEQ ID NO: 600381 - RNA, 64 nt, hsa; identical to SEQ ID NO: 98890

SEQ ID NO: 600382 - RNA, 64 nt, hsa; identical to SEQ ID NO: 98891

SEQ ID NO: 600383 - RNA, 64 nt, hsa; identical to SEQ ID NO: 98892

SEQ ID NO: 600384 - RNA, 64 nt, hsa; identical to SEQ ID NO: 98893

SEQ ID NO: 600385 - RNA, 64 nt, hsa; identical to SEQ ID NO: 98894

SEQ ID NO: 600386 - RNA, 64 nt, hsa; identical to SEQ ID NO: 98895

SEQ ID NO: 600387 - RNA, 64 nt, hsa; identical to SEQ ID NO: 98896

SEQ ID NO: 600388 - RNA, 64 nt, hsa; identical to SEQ ID NO: 98897

SEQ ID NO: 600389 - RNA, 64 nt, hsa; identical to SEQ ID NO: 98898

SEQ ID NO: 600390 - RNA, 64 nt, hsa; identical to SEQ ID NO: 98899

SEQ ID NO: 600391 - RNA, 64 nt, hsa; identical to SEQ ID NO: 98900

SEQ ID NO: 600392 - RNA, 64 nt, hsa; identical to SEQ ID NO: 98901

SEQ ID NO: 600393 - RNA, 64 nt, hsa; identical to SEQ ID NO: 98902

SEQ ID NO: 600394 - RNA, 64 nt, hsa; identical to SEQ ID NO: 98903

SEQ ID NO: 600395 - RNA, 64 nt, hsa; identical to SEQ ID NO: 98904

SEQ ID NO: 600396 - RNA, 64 nt, hsa; identical to SEQ ID NO: 98905

SEQ ID NO: 600397 - RNA, 64 nt, hsa; identical to SEQ ID NO: 98906

SEQ ID NO: 600398 - RNA, 64 nt, hsa; identical to SEQ ID NO: 98907

SEQ ID NO: 600399 - RNA, 64 nt, hsa; identical to SEQ ID NO: 98908

SEQ ID NO: 600400 - RNA, 64 nt, hsa; identical to SEQ ID NO: 98909

SEQ ID NO: 600401 - RNA, 64 nt, hsa; identical to SEQ ID NO: 98910

SEQ ID NO: 600402 - RNA, 64 nt, hsa; identical to SEQ ID NO: 98911

SEQ ID NO: 600403 - RNA, 64 nt, hsa; identical to SEQ ID NO: 98912

SEQ ID NO: 600404 - RNA, 64 nt, hsa; identical to SEQ ID NO: 562343

SEQ ID NO: 600405 - RNA, 64 nt, hsa; identical to SEQ ID NO: 562344

SEQ ID NO: 600406 - RNA, 64 nt, hsa; identical to SEQ ID NO: 562345

SEQ ID NO: 600407 - RNA, 64 nt, hsa; identical to SEQ ID NO: 562346

SEQ ID NO: 600408 - RNA, 64 nt, hsa; identical to SEQ ID NO: 562347

SEQ ID NO: 600409 - RNA, 64 nt, hsa; identical to SEQ ID NO: 562348

SEQ ID NO: 600410 - RNA, 64 nt, hsa; identical to SEQ ID NO: 562348

SEQ ID NO: 600411 - RNA, 64 nt, hsa; identical to SEQ ID NO: 562350

SEQ ID NO: 600412 - RNA, 64 nt, hsa; identical to SEQ ID NO: 562351

SEQ ID NO: 600413 - RNA, 64 nt, hsa; identical to SEQ ID NO: 137985

SEQ ID NO: 600414 - RNA, 64 nt, hsa; identical to SEQ ID NO: 137986

SEQ ID NO: 600415 - RNA, 64 nt, hsa; identical to SEQ ID NO: 137987

SEQ ID NO: 600416 - RNA, 64 nt, hsa; identical to SEQ ID NO: 137988

SEQ ID NO: 600417 - RNA, 64 nt, hsa; identical to SEQ ID NO: 137989

SEQ ID NO: 600418 - RNA, 64 nt, hsa; identical to SEQ ID NO: 137990

SEQ ID NO: 600419 - RNA, 64 nt, hsa; identical to SEQ ID NO: 137991

SEQ ID NO: 600420 - RNA, 64 nt, hsa; identical to SEQ ID NO: 137992

SEQ ID NO: 600421 - RNA, 64 nt, hsa; identical to SEQ ID NO: 137993

SEQ ID NO: 600422 - RNA, 64 nt, hsa; identical to SEQ ID NO: 137994

SEQ ID NO: 600423 - RNA, 64 nt, hsa; identical to SEQ ID NO: 137995

SEQ ID NO: 600424 - RNA, 64 nt, hsa; identical to SEQ ID NO: 137996

SEQ ID NO: 600425 - RNA, 64 nt, hsa; identical to SEQ ID NO: 137997

SEQ ID NO: 600426 - RNA, 64 nt, hsa; identical to SEQ ID NO: 137998

SEQ ID NO: 600427 - RNA, 64 nt, hsa; identical to SEQ ID NO: 137999

SEQ ID NO: 600428 - RNA, 64 nt, hsa; identical to SEQ ID NO: 138000

SEQ ID NO: 600429 - RNA, 64 nt, hsa; identical to SEQ ID NO: 138001

SEQ ID NO: 600430 - RNA, 64 nt, hsa; identical to SEQ ID NO: 138002

SEQ ID NO: 600431 - RNA, 64 nt, hsa; identical to SEQ ID NO: 138003

SEQ ID NO: 600432 - RNA, 64 nt, hsa; identical to SEQ ID NO: 138004

SEQ ID NO: 600433 - RNA, 64 nt, hsa; identical to SEQ ID NO: 138005

SEQ ID NO: 600434 - RNA, 64 nt, hsa; identical to SEQ ID NO: 138006

SEQ ID NO: 600435 - RNA, 64 nt, hsa; identical to SEQ ID NO: 138007

SEQ ID NO: 600436 - RNA, 64 nt, hsa; identical to SEQ ID NO: 138008

SEQ ID NO: 600437 - RNA, 64 nt, hsa; identical to SEQ ID NO: 138009

SEQ ID NO: 600438 - RNA, 64 nt, hsa; identical to SEQ ID NO: 138010

SEQ ID NO: 600439 - RNA, 64 nt, hsa; identical to SEQ ID NO: 426993

SEQ ID NO: 600440 - RNA, 64 nt, hsa; identical to SEQ ID NO: 426994

SEQ ID NO: 600441 - RNA, 64 nt, hsa; identical to SEQ ID NO: 426995

SEQ ID NO: 600442 - RNA, 64 nt, hsa; identical to SEQ ID NO: 426996

SEQ ID NO: 600443 - RNA, 64 nt, hsa; identical to SEQ ID NO: 426997

SEQ ID NO: 600444 - RNA, 64 nt, hsa; identical to SEQ ID NO: 426998

SEQ ID NO: 600445 - RNA, 64 nt, hsa; identical to SEQ ID NO: 463735

SEQ ID NO: 600446 - RNA, 64 nt, hsa; identical to SEQ ID NO: 463736

SEQ ID NO: 600447 - RNA, 64 nt, hsa; identical to SEQ ID NO: 463737

SEQ ID NO: 600448 - RNA, 64 nt, hsa; identical to SEQ ID NO: 463738

SEQ ID NO: 600449 - RNA, 64 nt, hsa; identical to SEQ ID NO: 463739

SEQ ID NO: 600450 - RNA, 64 nt, hsa; identical to SEQ ID NO: 463740

SEQ ID NO: 600451 - RNA, 64 nt, hsa
uggccugcaaaccuucaacucccaucuuuccccaagaagucagagaugcuguuacuugaaugau

SEQ ID NO: 600452 - RNA, 64 nt, hsa
accugugguuuuaacaaaccaauacacauauugaagaagucauuuuaauucagugaaacgaaga

SEQ ID NO: 600453 - RNA, 64 nt, hsa
ucccccucuucaagcuaggaacuggcaaugcuguagaagucagccguaggaauucaaaauggcu

SEQ ID NO: 600454 - RNA, 64 nt, hsa
uguucaacauuuacuucuauuugauaucugcucaagaagucauagaagucuugggaaacuauuc

SEQ ID NO: 600455 - RNA, 64 nt, hsa
aaaccuugauucagugcucaguggucuccuaguaagaagucaccgacgguagcgucauaugaga

SEQ ID NO: 600456 - RNA, 64 nt, hsa
ugugucuagcaguuacguccugcuuaaagggacuagaagucaaaguuccuugucucacuauuug

SEQ ID NO: 600457 - RNA, 64 nt, hsa
aaaaaugaaccguaguuuuuguuuuuuuaaauacagaagucauguuguuucugcacuuuauaau

SEQ ID NO: 600458 - RNA, 64 nt, hsa
ccuaagccaaaggaaggaaagccaugaagaaugcagaagucaaacccucaugacaaaguaggca

SEQ ID NO: 600459 - RNA, 64 nt, hsa
agccccagggaggucaauaaugucuuuuaaagccagaagucacauuuuaccaauaugcauuuau

SEQ ID NO: 600460 - RNA, 64 nt, hsa
ucugggaaucccagaaugucaagccaaaggucuaagaagucaucuccuucaaauacuuuaauaa

SEQ ID NO: 600461 - RNA, 64 nt, hsa
accuuucagaagucauacuuuuguuuugcaacauagaagucacacaggagaaaaauccuguaag

SEQ ID NO: 600462 - RNA, 64 nt, hsa
ucaugcaaauuguaaaacaggaaggaaaccuuucagaagucauacuuuuguuuugcaacauaga

SEQ ID NO: 600463 - RNA, 64 nt, hsa
uaggcuuuucuaaauauuagauaauauagauggcagaagucaugcaaauuguaaaacaggaagg

SEQ ID NO: 600464 - RNA, 64 nt, hsa
ggacaucacuuacuauccauuucuucauguuaaaagaagucaucucaaacucuuaguuuuuuuu

SEQ ID NO: 600465 - RNA, 64 nt, hsa
gaaaagaugagcaaagaugguaaaaagaagaaaaagaagucaaagacaaaguguguaauuaugu

SEQ ID NO: 600466 - RNA, 64 nt, hsa
cccacugggaguuaggaaguauaaguaagccaagagaagucagccccugcccagaagaucugaa

SEQ ID NO: 600467 - RNA, 64 nt, hsa
cagaagaucugaaacuaauaguaggaguuuccccagaagucauuuucagccuuaauucucauca

SEQ ID NO: 600468 - RNA, 64 nt, hsa
agccagauucugcauuugcgauguuacuagcagcagaagucagauuguagagguccuggcggcu

SEQ ID NO: 600469 - RNA, 64 nt, hsa
uguagauaaugaaacucccagaaaaauuacaggcagaagucacagaaaauggagaaaacuucuc

SEQ ID NO: 600470 - RNA, 64 nt, hsa
cuucucucgaaucucaucccucacucuucaugugagaagucacacaggggagaaacccuaugaa

SEQ ID NO: 600471 - RNA, 64 nt, hsa
cuuuucucagugcucauuacuuauuauacauaugagaagucauacuggugagaaacccuuugaa

SEQ ID NO: 600472 - RNA, 64 nt, hsa
uucagacuugauaagaucucagaguccacaggaaagaagucacuguugcaauaaaagcacccgu

SEQ ID NO: 600473 - RNA, 64 nt, hsa
ccuucugcuguguuaauucuggucaguuucacacagaagucacgagggccucugcccaggaccu

SEQ ID NO: 600474 - RNA, 64 nt, hsa
ugugguccaggaaagugagccucaugguuuucagagaagucauuguucuguuuacauuuucaua

SEQ ID NO: 600475 - RNA, 64 nt, hsa
cucaagguacaaaugagagauuugcuauaccgugagaagucaacaacuuagccaccacuucccc

SEQ ID NO: 600476 - RNA, 64 nt, hsa; identical to SEQ ID NO: 75353

SEQ ID NO: 600477 - RNA, 64 nt, hsa; identical to SEQ ID NO: 75354

SEQ ID NO: 600478 - RNA, 64 nt, hsa; identical to SEQ ID NO: 75355

SEQ ID NO: 600479 - RNA, 64 nt, hsa; identical to SEQ ID NO: 75356

SEQ ID NO: 600480 - RNA, 64 nt, hsa; identical to SEQ ID NO: 75357

SEQ ID NO: 600481 - RNA, 64 nt, hsa; identical to SEQ ID NO: 75358

SEQ ID NO: 600482 - RNA, 64 nt, hsa; identical to SEQ ID NO: 75359

SEQ ID NO: 600483 - RNA, 64 nt, hsa; identical to SEQ ID NO: 75360

SEQ ID NO: 600484 - RNA, 64 nt, hsa; identical to SEQ ID NO: 75361

SEQ ID NO: 600485 - RNA, 64 nt, hsa; identical to SEQ ID NO: 75362

SEQ ID NO: 600486 - RNA, 64 nt, hsa; identical to SEQ ID NO: 426082

SEQ ID NO: 600487 - RNA, 64 nt, hsa; identical to SEQ ID NO: 426083

SEQ ID NO: 600488 - RNA, 64 nt, hsa; identical to SEQ ID NO: 426084

SEQ ID NO: 600489 - RNA, 64 nt, hsa; identical to SEQ ID NO: 426085

SEQ ID NO: 600490 - RNA, 64 nt, hsa; identical to SEQ ID NO: 426086

SEQ ID NO: 600491 - RNA, 64 nt, hsa; identical to SEQ ID NO: 426087

SEQ ID NO: 600492 - RNA, 64 nt, hsa; identical to SEQ ID NO: 426088

SEQ ID NO: 600493 - RNA, 64 nt, hsa; identical to SEQ ID NO: 426089

SEQ ID NO: 600494 - RNA, 64 nt, hsa; identical to SEQ ID NO: 426090

SEQ ID NO: 600495 - RNA, 64 nt, hsa; identical to SEQ ID NO: 426091

SEQ ID NO: 600496 - RNA, 64 nt, hsa; identical to SEQ ID NO: 426092

SEQ ID NO: 600497 - RNA, 64 nt, hsa; identical to SEQ ID NO: 426093

SEQ ID NO: 600498 - RNA, 64 nt, hsa; identical to SEQ ID NO: 426094

SEQ ID NO: 600499 - RNA, 64 nt, hsa; identical to SEQ ID NO: 426095

SEQ ID NO: 600500 - RNA, 64 nt, hsa; identical to SEQ ID NO: 426096

SEQ ID NO: 600501 - RNA, 64 nt, hsa; identical to SEQ ID NO: 426097

SEQ ID NO: 600502 - RNA, 64 nt, hsa; identical to SEQ ID NO: 426098

SEQ ID NO: 600503 - RNA, 64 nt, hsa; identical to SEQ ID NO: 426099

SEQ ID NO: 600504 - RNA, 59 nt, hsa; identical to SEQ ID NO: 426100

SEQ ID NO: 600505 - RNA, 64 nt, hsa; identical to SEQ ID NO: 426101

SEQ ID NO: 600506 - RNA, 64 nt, hsa; identical to SEQ ID NO: 426102

SEQ ID NO: 600507 - RNA, 64 nt, hsa; identical to SEQ ID NO: 426103

SEQ ID NO: 600508 - RNA, 64 nt, hsa; identical to SEQ ID NO: 426104

SEQ ID NO: 600509 - RNA, 64 nt, hsa; identical to SEQ ID NO: 426105

SEQ ID NO: 600510 - RNA, 64 nt, hsa; identical to SEQ ID NO: 426106

SEQ ID NO: 600511 - RNA, 64 nt, hsa; identical to SEQ ID NO: 426107

SEQ ID NO: 600512 - RNA, 64 nt, hsa; identical to SEQ ID NO: 426108

SEQ ID NO: 600513 - RNA, 64 nt, hsa; identical to SEQ ID NO: 426109

SEQ ID NO: 600514 - RNA, 64 nt, hsa; identical to SEQ ID NO: 426110

SEQ ID NO: 600515 - RNA, 64 nt, hsa; identical to SEQ ID NO: 426111

SEQ ID NO: 600516 - RNA, 64 nt, hsa; identical to SEQ ID NO: 426112

SEQ ID NO: 600517 - RNA, 64 nt, hsa; identical to SEQ ID NO: 426113

SEQ ID NO: 600518 - RNA, 64 nt, hsa; identical to SEQ ID NO: 426114

SEQ ID NO: 600519 - RNA, 64 nt, hsa; identical to SEQ ID NO: 426115

SEQ ID NO: 600520 - RNA, 64 nt, hsa; identical to SEQ ID NO: 426116

SEQ ID NO: 600521 - RNA, 64 nt, hsa; identical to SEQ ID NO: 426117

SEQ ID NO: 600522 - RNA, 64 nt, hsa; identical to SEQ ID NO: 426118

SEQ ID NO: 600523 - RNA, 64 nt, hsa; identical to SEQ ID NO: 426119

SEQ ID NO: 600524 - RNA, 64 nt, hsa; identical to SEQ ID NO: 426120

SEQ ID NO: 600525 - RNA, 64 nt, hsa; identical to SEQ ID NO: 426121

SEQ ID NO: 600526 - RNA, 64 nt, hsa; identical to SEQ ID NO: 426122

SEQ ID NO: 600527 - RNA, 64 nt, hsa; identical to SEQ ID NO: 426123

SEQ ID NO: 600528 - RNA, 64 nt, hsa; identical to SEQ ID NO: 426124

SEQ ID NO: 600529 - RNA, 64 nt, hsa; identical to SEQ ID NO: 332827

SEQ ID NO: 600530 - RNA, 64 nt, hsa; identical to SEQ ID NO: 332828

SEQ ID NO: 600531 - RNA, 64 nt, hsa; identical to SEQ ID NO: 332829

SEQ ID NO: 600532 - RNA, 64 nt, hsa; identical to SEQ ID NO: 332830

SEQ ID NO: 600533 - RNA, 64 nt, hsa; identical to SEQ ID NO: 332831

SEQ ID NO: 600534 - RNA, 64 nt, hsa; identical to SEQ ID NO: 332832

SEQ ID NO: 600535 - RNA, 64 nt, hsa
ccuauagucccagcuacucaggaagcugagacaagaggaucaauugagcccaggaguucaaagc

SEQ ID NO: 600536 - RNA, 64 nt, hsa
acuguaaucccaguuauaggggaggcugaagcaggaggaucacuugaggccaggaguuugagac

SEQ ID NO: 600537 - RNA, 64 nt, hsa
ugcauagucccagcuacccaggaggcugaggugggaggaucacuugagcccaggaauuugaagc

SEQ ID NO: 600538 - RNA, 64 nt, hsa
gcuguaauaacaacaccuucagaggcugaggugagaggaucaguugaggccaggaguuuaagac

SEQ ID NO: 600539 - RNA, 64 nt, hsa
gccuauagucccacuacuuguggggcuaaggcaggaggaucacuugagccccggaggucgaggc

SEQ ID NO: 600540 - RNA, 64 nt, hsa
ccuguaauccuugcauuuuggaaggcugaggcaggaggaucacuuuaggccugguguguucaag

SEQ ID NO: 600541 - RNA, 64 nt, hsa
ugguguuuccccccucuuucugguuuuacaucaugaggaucaguuagcugcugacaagaaaagu

SEQ ID NO: 600542 - RNA, 64 nt, hsa
aggcaaauucacaaauacggaauccaugaauaacgaggaucaacuguacuuaacuauauuuuaa

SEQ ID NO: 600543 - RNA, 64 nt, hsa
ccuauaaucccaauauuuugggaggccgaggagagaggaucacuuaagcccaggagucugagac

SEQ ID NO: 600544 - RNA, 64 nt, hsa
ccuguagucccagcuacaugggaggcugaggugggaggaucacuugagcccaggaaguccagaa

SEQ ID NO: 600545 - RNA, 64 nt, hsa
ugugcagucccagcuacucaggaggcugaggcaggaggaucacagugaccuauaaugagccguu

SEQ ID NO: 600546 - RNA, 63 nt, hsa
cuguaaucccagcauuuuaggaggccaaggcaggaggaucacuuggagccaggaguuugagac

SEQ ID NO: 600547 - RNA, 64 nt, hsa
caccuguagucccggccacucggggcugaggcaggaggaucacuggaaccugggagguugccac

SEQ ID NO: 600548 - RNA, 64 nt, hsa
ccuauaaucccaggacuuugggaggccaaggcaggaggaucacuugaguccagaaauucaagac

SEQ ID NO: 600549 - RNA, 64 nt, hsa
cuuugaugcauggcuauaaucccagccgaggugggaggaucacuugaguccagguucaagacua

SEQ ID NO: 600550 - RNA, 64 nt, hsa
ccugcagucccagcuacuugggaggcugaguugggaggaucacuugagccugggagguugaggc

SEQ ID NO: 600551 - RNA, 64 nt, hsa
cuguagucuuugggucuuugggaggccagggugggaggaucacuugagcucaggaguuugagac

SEQ ID NO: 600552 - RNA, 64 nt, hsa
uagucccagcuacucgggaggcugagugaggcaggaggaucacuugagaccaggagguuguggc

SEQ ID NO: 600553 - RNA, 64 nt, hsa
cuugcaaucccagugcuuugggagacugaggcaggaggaucacuuaaggccaggaguucgagac

SEQ ID NO: 600554 - RNA, 64 nt, hsa
ccuguaauccgagugcuuugggaggcugaggcaggaggaucacucgagcucaagaauucaagac

SEQ ID NO: 600555 - RNA, 64 nt, hsa
ccuguaguccaagcuacuugggaggcugaagugggaggaucauuugugcccagguugaggcuau

SEQ ID NO: 600556 - RNA, 64 nt, hsa
ccuguaaucccugcacuuugggaggccaaggugggaggaucaguugagccccagaguucaagac

SEQ ID NO: 600557 - RNA, 64 nt, hsa
ccuguaggccuagcugcucaggaggcugaagcaggaggaucacuugagccugaguucaacacug

SEQ ID NO: 600558 - RNA, 64 nt, hsa
ccuauaaucccagcacuuugggaagccgggguaggaggaucaccagaggccagcagguccacac

SEQ ID NO: 600559 - RNA, 64 nt, hsa
acagagacacacacacauacuacuuuaagggggugaggaucauuaauucagauaauuuuuaagu

SEQ ID NO: 600560 - RNA, 64 nt, hsa
acauauguauauacacauaucauuuuaagaagcugaggaucacuaauucagauaauguauaagu

SEQ ID NO: 600561 - RNA, 64 nt, hsa; identical to SEQ ID NO: 286385

SEQ ID NO: 600562 - RNA, 64 nt, hsa; identical to SEQ ID NO: 286386

SEQ ID NO: 600563 - RNA, 64 nt, hsa; identical to SEQ ID NO: 286387

SEQ ID NO: 600564 - RNA, 63 nt, hsa; identical to SEQ ID NO: 286388

SEQ ID NO: 600565 - RNA, 64 nt, hsa; identical to SEQ ID NO: 286389

SEQ ID NO: 600566 - RNA, 64 nt, hsa; identical to SEQ ID NO: 286390

SEQ ID NO: 600567 - RNA, 64 nt, hsa; identical to SEQ ID NO: 286391

SEQ ID NO: 600568 - RNA, 64 nt, hsa; identical to SEQ ID NO: 286392

SEQ ID NO: 600569 - RNA, 64 nt, hsa; identical to SEQ ID NO: 286393

SEQ ID NO: 600570 - RNA, 64 nt, hsa; identical to SEQ ID NO: 286394

SEQ ID NO: 600571 - RNA, 64 nt, hsa; identical to SEQ ID NO: 286395

SEQ ID NO: 600572 - RNA, 64 nt, hsa; identical to SEQ ID NO: 286396

SEQ ID NO: 600573 - RNA, 64 nt, hsa; identical to SEQ ID NO: 286397

SEQ ID NO: 600574 - RNA, 64 nt, hsa; identical to SEQ ID NO: 286398

SEQ ID NO: 600575 - RNA, 64 nt, hsa; identical to SEQ ID NO: 286399

SEQ ID NO: 600576 - RNA, 64 nt, hsa; identical to SEQ ID NO: 286400

SEQ ID NO: 600577 - RNA, 64 nt, hsa; identical to SEQ ID NO: 286401

SEQ ID NO: 600578 - RNA, 64 nt, hsa; identical to SEQ ID NO: 286402

SEQ ID NO: 600579 - RNA, 64 nt, hsa; identical to SEQ ID NO: 286403

SEQ ID NO: 600580 - RNA, 64 nt, hsa; identical to SEQ ID NO: 286404

SEQ ID NO: 600581 - RNA, 64 nt, hsa; identical to SEQ ID NO: 286405

SEQ ID NO: 600582 - RNA, 64 nt, hsa; identical to SEQ ID NO: 286406

SEQ ID NO: 600583 - RNA, 64 nt, hsa; identical to SEQ ID NO: 286407

SEQ ID NO: 600584 - RNA, 64 nt, hsa; identical to SEQ ID NO: 286408

SEQ ID NO: 600585 - RNA, 64 nt, hsa; identical to SEQ ID NO: 286409

SEQ ID NO: 600586 - RNA, 64 nt, hsa; identical to SEQ ID NO: 286410

SEQ ID NO: 600587 - RNA, 64 nt, hsa; identical to SEQ ID NO: 286411

SEQ ID NO: 600588 - RNA, 64 nt, hsa; identical to SEQ ID NO: 286412

SEQ ID NO: 600589 - RNA, 64 nt, hsa; identical to SEQ ID NO: 286413

SEQ ID NO: 600590 - RNA, 64 nt, hsa; identical to SEQ ID NO: 286414

SEQ ID NO: 600591 - RNA, 64 nt, hsa; identical to SEQ ID NO: 286415

SEQ ID NO: 600592 - RNA, 64 nt, hsa; identical to SEQ ID NO: 286416

SEQ ID NO: 600593 - RNA, 64 nt, hsa; identical to SEQ ID NO: 286417

SEQ ID NO: 600594 - RNA, 64 nt, hsa; identical to SEQ ID NO: 286418

SEQ ID NO: 600595 - RNA, 64 nt, hsa; identical to SEQ ID NO: 286419

SEQ ID NO: 600596 - RNA, 64 nt, hsa; identical to SEQ ID NO: 286420

SEQ ID NO: 600597 - RNA, 64 nt, hsa; identical to SEQ ID NO: 286421

SEQ ID NO: 600598 - RNA, 64 nt, hsa; identical to SEQ ID NO: 286422

SEQ ID NO: 600599 - RNA, 64 nt, hsa; identical to SEQ ID NO: 286423

SEQ ID NO: 600600 - RNA, 64 nt, hsa; identical to SEQ ID NO: 286424

SEQ ID NO: 600601 - RNA, 64 nt, hsa; identical to SEQ ID NO: 286425

SEQ ID NO: 600602 - RNA, 64 nt, hsa; identical to SEQ ID NO: 286426

SEQ ID NO: 600603 - RNA, 62 nt, hsa; identical to SEQ ID NO: 286427

SEQ ID NO: 600604 - RNA, 64 nt, hsa; identical to SEQ ID NO: 286428

SEQ ID NO: 600605 - RNA, 64 nt, hsa; identical to SEQ ID NO: 286429

SEQ ID NO: 600606 - RNA, 64 nt, hsa; identical to SEQ ID NO: 286430

SEQ ID NO: 600607 - RNA, 64 nt, hsa; identical to SEQ ID NO: 286431

SEQ ID NO: 600608 - RNA, 64 nt, hsa; identical to SEQ ID NO: 286432

SEQ ID NO: 600609 - RNA, 64 nt, hsa; identical to SEQ ID NO: 286433

SEQ ID NO: 600610 - RNA, 64 nt, hsa; identical to SEQ ID NO: 286434

SEQ ID NO: 600611 - RNA, 64 nt, hsa; identical to SEQ ID NO: 286435

SEQ ID NO: 600612 - RNA, 64 nt, hsa; identical to SEQ ID NO: 286436

SEQ ID NO: 600613 - RNA, 64 nt, hsa; identical to SEQ ID NO: 286437

SEQ ID NO: 600614 - RNA, 64 nt, hsa; identical to SEQ ID NO: 286438

SEQ ID NO: 600615 - RNA, 64 nt, hsa; identical to SEQ ID NO: 286439

SEQ ID NO: 600616 - RNA, 51 nt, hsa; identical to SEQ ID NO: 286440

SEQ ID NO: 600617 - RNA, 64 nt, hsa; identical to SEQ ID NO: 286441

SEQ ID NO: 600618 - RNA, 64 nt, hsa; identical to SEQ ID NO: 286442

SEQ ID NO: 600619 - RNA, 64 nt, hsa; identical to SEQ ID NO: 286443

SEQ ID NO: 600620 - RNA, 64 nt, hsa; identical to SEQ ID NO: 286444

SEQ ID NO: 600621 - RNA, 64 nt, hsa; identical to SEQ ID NO: 286445

SEQ ID NO: 600622 - RNA, 64 nt, hsa; identical to SEQ ID NO: 286446

SEQ ID NO: 600623 - RNA, 64 nt, hsa; identical to SEQ ID NO: 286447

SEQ ID NO: 600624 - RNA, 64 nt, hsa; identical to SEQ ID NO: 286448

SEQ ID NO: 600625 - RNA, 64 nt, hsa; identical to SEQ ID NO: 286449

SEQ ID NO: 600626 - RNA, 64 nt, hsa; identical to SEQ ID NO: 286450

SEQ ID NO: 600627 - RNA, 64 nt, hsa; identical to SEQ ID NO: 286451

SEQ ID NO: 600628 - RNA, 64 nt, hsa; identical to SEQ ID NO: 286452

SEQ ID NO: 600629 - RNA, 64 nt, hsa; identical to SEQ ID NO: 286453

SEQ ID NO: 600630 - RNA, 64 nt, hsa; identical to SEQ ID NO: 286454

SEQ ID NO: 600631 - RNA, 64 nt, hsa; identical to SEQ ID NO: 286455

SEQ ID NO: 600632 - RNA, 64 nt, hsa; identical to SEQ ID NO: 286456

SEQ ID NO: 600633 - RNA, 64 nt, hsa; identical to SEQ ID NO: 286457

SEQ ID NO: 600634 - RNA, 64 nt, hsa; identical to SEQ ID NO: 286458

SEQ ID NO: 600635 - RNA, 64 nt, hsa; identical to SEQ ID NO: 286459

SEQ ID NO: 600636 - RNA, 64 nt, hsa; identical to SEQ ID NO: 286460

SEQ ID NO: 600637 - RNA, 64 nt, hsa; identical to SEQ ID NO: 286461

SEQ ID NO: 600638 - RNA, 64 nt, hsa; identical to SEQ ID NO: 286462

SEQ ID NO: 600639 - RNA, 64 nt, hsa; identical to SEQ ID NO: 286463

SEQ ID NO: 600640 - RNA, 64 nt, hsa; identical to SEQ ID NO: 286464

SEQ ID NO: 600641 - RNA, 64 nt, hsa; identical to SEQ ID NO: 286465

SEQ ID NO: 600642 - RNA, 64 nt, hsa; identical to SEQ ID NO: 286466

SEQ ID NO: 600643 - RNA, 64 nt, hsa; identical to SEQ ID NO: 286467

SEQ ID NO: 600644 - RNA, 64 nt, hsa; identical to SEQ ID NO: 286468

SEQ ID NO: 600645 - RNA, 64 nt, hsa; identical to SEQ ID NO: 286469

SEQ ID NO: 600646 - RNA, 64 nt, hsa; identical to SEQ ID NO: 286470

SEQ ID NO: 600647 - RNA, 64 nt, hsa; identical to SEQ ID NO: 286471

SEQ ID NO: 600648 - RNA, 64 nt, hsa; identical to SEQ ID NO: 286472

SEQ ID NO: 600649 - RNA, 64 nt, hsa; identical to SEQ ID NO: 286473

SEQ ID NO: 600650 - RNA, 64 nt, hsa; identical to SEQ ID NO: 286474

SEQ ID NO: 600651 - RNA, 64 nt, hsa; identical to SEQ ID NO: 286475

SEQ ID NO: 600652 - RNA, 64 nt, hsa; identical to SEQ ID NO: 286476

SEQ ID NO: 600653 - RNA, 64 nt, hsa; identical to SEQ ID NO: 286477

SEQ ID NO: 600654 - RNA, 64 nt, hsa; identical to SEQ ID NO: 286478

SEQ ID NO: 600655 - RNA, 64 nt, hsa; identical to SEQ ID NO: 286479

SEQ ID NO: 600656 - RNA, 64 nt, hsa; identical to SEQ ID NO: 286480

SEQ ID NO: 600657 - RNA, 64 nt, hsa; identical to SEQ ID NO: 286481

SEQ ID NO: 600658 - RNA, 64 nt, hsa; identical to SEQ ID NO: 286482

SEQ ID NO: 600659 - RNA, 64 nt, hsa; identical to SEQ ID NO: 286483

SEQ ID NO: 600660 - RNA, 64 nt, hsa; identical to SEQ ID NO: 286484

SEQ ID NO: 600661 - RNA, 64 nt, hsa; identical to SEQ ID NO: 286485

SEQ ID NO: 600662 - RNA, 64 nt, hsa; identical to SEQ ID NO: 286486

SEQ ID NO: 600663 - RNA, 64 nt, hsa; identical to SEQ ID NO: 286487

SEQ ID NO: 600664 - RNA, 64 nt, hsa; identical to SEQ ID NO: 286488

SEQ ID NO: 600665 - RNA, 64 nt, hsa; identical to SEQ ID NO: 286489

SEQ ID NO: 600666 - RNA, 64 nt, hsa; identical to SEQ ID NO: 286490

SEQ ID NO: 600667 - RNA, 64 nt, hsa; identical to SEQ ID NO: 286491

SEQ ID NO: 600668 - RNA, 64 nt, hsa; identical to SEQ ID NO: 286492

SEQ ID NO: 600669 - RNA, 64 nt, hsa; identical to SEQ ID NO: 286493

SEQ ID NO: 600670 - RNA, 64 nt, hsa; identical to SEQ ID NO: 286494

SEQ ID NO: 600671 - RNA, 64 nt, hsa; identical to SEQ ID NO: 286495

SEQ ID NO: 600672 - RNA, 64 nt, hsa; identical to SEQ ID NO: 286496

SEQ ID NO: 600673 - RNA, 64 nt, hsa; identical to SEQ ID NO: 286497

SEQ ID NO: 600674 - RNA, 64 nt, hsa; identical to SEQ ID NO: 286498

SEQ ID NO: 600675 - RNA, 64 nt, hsa; identical to SEQ ID NO: 286499

SEQ ID NO: 600676 - RNA, 64 nt, hsa; identical to SEQ ID NO: 286500

SEQ ID NO: 600677 - RNA, 64 nt, hsa; identical to SEQ ID NO: 286501

SEQ ID NO: 600678 - RNA, 64 nt, hsa; identical to SEQ ID NO: 286502

SEQ ID NO: 600679 - RNA, 64 nt, hsa; identical to SEQ ID NO: 286503

SEQ ID NO: 600680 - RNA, 64 nt, hsa; identical to SEQ ID NO: 286504

SEQ ID NO: 600681 - RNA, 64 nt, hsa; identical to SEQ ID NO: 286505

SEQ ID NO: 600682 - RNA, 64 nt, hsa; identical to SEQ ID NO: 286506

SEQ ID NO: 600683 - RNA, 64 nt, hsa; identical to SEQ ID NO: 286507

SEQ ID NO: 600684 - RNA, 64 nt, hsa; identical to SEQ ID NO: 286508

SEQ ID NO: 600685 - RNA, 64 nt, hsa; identical to SEQ ID NO: 286509

SEQ ID NO: 600686 - RNA, 64 nt, hsa; identical to SEQ ID NO: 286510

SEQ ID NO: 600687 - RNA, 64 nt, hsa; identical to SEQ ID NO: 286511

SEQ ID NO: 600688 - RNA, 64 nt, hsa; identical to SEQ ID NO: 286512

SEQ ID NO: 600689 - RNA, 64 nt, hsa; identical to SEQ ID NO: 286513

SEQ ID NO: 600690 - RNA, 64 nt, hsa; identical to SEQ ID NO: 286514

SEQ ID NO: 600691 - RNA, 64 nt, hsa; identical to SEQ ID NO: 286515

SEQ ID NO: 600692 - RNA, 64 nt, hsa; identical to SEQ ID NO: 286516

SEQ ID NO: 600693 - RNA, 64 nt, hsa; identical to SEQ ID NO: 286517

SEQ ID NO: 600694 - RNA, 64 nt, hsa; identical to SEQ ID NO: 286518

SEQ ID NO: 600695 - RNA, 64 nt, hsa; identical to SEQ ID NO: 286519

SEQ ID NO: 600696 - RNA, 64 nt, hsa; identical to SEQ ID NO: 286520

SEQ ID NO: 600697 - RNA, 64 nt, hsa; identical to SEQ ID NO: 286521

SEQ ID NO: 600698 - RNA, 64 nt, hsa; identical to SEQ ID NO: 286522

SEQ ID NO: 600699 - RNA, 64 nt, hsa; identical to SEQ ID NO: 286523

SEQ ID NO: 600700 - RNA, 64 nt, hsa; identical to SEQ ID NO: 286524

SEQ ID NO: 600701 - RNA, 64 nt, hsa; identical to SEQ ID NO: 286525

SEQ ID NO: 600702 - RNA, 64 nt, hsa; identical to SEQ ID NO: 286526

SEQ ID NO: 600703 - RNA, 64 nt, hsa; identical to SEQ ID NO: 286527

SEQ ID NO: 600704 - RNA, 64 nt, hsa; identical to SEQ ID NO: 286528

SEQ ID NO: 600705 - RNA, 64 nt, hsa; identical to SEQ ID NO: 286529

SEQ ID NO: 600706 - RNA, 64 nt, hsa; identical to SEQ ID NO: 286530

SEQ ID NO: 600707 - RNA, 64 nt, hsa; identical to SEQ ID NO: 286531

SEQ ID NO: 600708 - RNA, 64 nt, hsa; identical to SEQ ID NO: 286532

SEQ ID NO: 600709 - RNA, 64 nt, hsa; identical to SEQ ID NO: 286533

SEQ ID NO: 600710 - RNA, 64 nt, hsa; identical to SEQ ID NO: 286534

SEQ ID NO: 600711 - RNA, 64 nt, hsa; identical to SEQ ID NO: 286535

SEQ ID NO: 600712 - RNA, 64 nt, hsa; identical to SEQ ID NO: 286536

SEQ ID NO: 600713 - RNA, 64 nt, hsa; identical to SEQ ID NO: 286537

SEQ ID NO: 600714 - RNA, 64 nt, hsa; identical to SEQ ID NO: 286538

SEQ ID NO: 600715 - RNA, 64 nt, hsa; identical to SEQ ID NO: 286539

SEQ ID NO: 600716 - RNA, 64 nt, hsa; identical to SEQ ID NO: 286540

SEQ ID NO: 600717 - RNA, 64 nt, hsa; identical to SEQ ID NO: 286541

SEQ ID NO: 600718 - RNA, 64 nt, hsa; identical to SEQ ID NO: 286542

SEQ ID NO: 600719 - RNA, 64 nt, hsa; identical to SEQ ID NO: 286543

SEQ ID NO: 600720 - RNA, 63 nt, hsa; identical to SEQ ID NO: 286544

SEQ ID NO: 600721 - RNA, 64 nt, hsa; identical to SEQ ID NO: 286545

SEQ ID NO: 600722 - RNA, 64 nt, hsa; identical to SEQ ID NO: 286546

SEQ ID NO: 600723 - RNA, 64 nt, hsa; identical to SEQ ID NO: 286547

SEQ ID NO: 600724 - RNA, 64 nt, hsa; identical to SEQ ID NO: 286548

SEQ ID NO: 600725 - RNA, 64 nt, hsa; identical to SEQ ID NO: 286549

SEQ ID NO: 600726 - RNA, 64 nt, hsa; identical to SEQ ID NO: 286550

SEQ ID NO: 600727 - RNA, 64 nt, hsa; identical to SEQ ID NO: 286551

SEQ ID NO: 600728 - RNA, 64 nt, hsa; identical to SEQ ID NO: 286552

SEQ ID NO: 600729 - RNA, 64 nt, hsa; identical to SEQ ID NO: 286553

SEQ ID NO: 600730 - RNA, 64 nt, hsa; identical to SEQ ID NO: 286554

SEQ ID NO: 600731 - RNA, 64 nt, hsa; identical to SEQ ID NO: 286554

SEQ ID NO: 600732 - RNA, 64 nt, hsa; identical to SEQ ID NO: 286556

SEQ ID NO: 600733 - RNA, 64 nt, hsa; identical to SEQ ID NO: 286557

SEQ ID NO: 600734 - RNA, 64 nt, hsa; identical to SEQ ID NO: 286558

SEQ ID NO: 600735 - RNA, 64 nt, hsa; identical to SEQ ID NO: 286559

SEQ ID NO: 600736 - RNA, 64 nt, hsa; identical to SEQ ID NO: 286560

SEQ ID NO: 600737 - RNA, 64 nt, hsa; identical to SEQ ID NO: 286561

SEQ ID NO: 600738 - RNA, 64 nt, hsa; identical to SEQ ID NO: 286562

SEQ ID NO: 600739 - RNA, 64 nt, hsa; identical to SEQ ID NO: 286563

SEQ ID NO: 600740 - RNA, 64 nt, hsa; identical to SEQ ID NO: 286564

SEQ ID NO: 600741 - RNA, 64 nt, hsa; identical to SEQ ID NO: 286565

SEQ ID NO: 600742 - RNA, 64 nt, hsa; identical to SEQ ID NO: 286566

SEQ ID NO: 600743 - RNA, 64 nt, hsa; identical to SEQ ID NO: 286567

SEQ ID NO: 600744 - RNA, 64 nt, hsa; identical to SEQ ID NO: 286568

SEQ ID NO: 600745 - RNA, 64 nt, hsa; identical to SEQ ID NO: 286569

SEQ ID NO: 600746 - RNA, 64 nt, hsa; identical to SEQ ID NO: 286570

SEQ ID NO: 600747 - RNA, 64 nt, hsa; identical to SEQ ID NO: 286571

SEQ ID NO: 600748 - RNA, 64 nt, hsa; identical to SEQ ID NO: 286572

SEQ ID NO: 600749 - RNA, 64 nt, hsa; identical to SEQ ID NO: 286573

SEQ ID NO: 600750 - RNA, 64 nt, hsa; identical to SEQ ID NO: 286574

SEQ ID NO: 600751 - RNA, 64 nt, hsa; identical to SEQ ID NO: 286575

SEQ ID NO: 600752 - RNA, 64 nt, hsa; identical to SEQ ID NO: 286576

SEQ ID NO: 600753 - RNA, 64 nt, hsa; identical to SEQ ID NO: 286577

SEQ ID NO: 600754 - RNA, 64 nt, hsa; identical to SEQ ID NO: 286578

SEQ ID NO: 600755 - RNA, 64 nt, hsa; identical to SEQ ID NO: 286579

SEQ ID NO: 600756 - RNA, 64 nt, hsa; identical to SEQ ID NO: 286580

SEQ ID NO: 600757 - RNA, 64 nt, hsa; identical to SEQ ID NO: 286581

SEQ ID NO: 600758 - RNA, 64 nt, hsa; identical to SEQ ID NO: 286582

SEQ ID NO: 600759 - RNA, 64 nt, hsa; identical to SEQ ID NO: 286583

SEQ ID NO: 600760 - RNA, 64 nt, hsa; identical to SEQ ID NO: 286584

SEQ ID NO: 600761 - RNA, 64 nt, hsa; identical to SEQ ID NO: 286585

SEQ ID NO: 600762 - RNA, 64 nt, hsa; identical to SEQ ID NO: 286586

SEQ ID NO: 600763 - RNA, 64 nt, hsa; identical to SEQ ID NO: 286587

SEQ ID NO: 600764 - RNA, 64 nt, hsa
guacacucucagauguggauggugacucugcuaguaauuuaaacuuggcauuucauggaggaug

SEQ ID NO: 600765 - RNA, 64 nt, hsa
uuucuggagguucaacacuacguaccgcacuuuauaauuuaacuggaauugagaugaaggccag

SEQ ID NO: 600766 - RNA, 64 nt, hsa
ccugaugauuggauuuaagcuauugaaaauuggauaauuuaaacuuaaugauuuuuauaauuuu

SEQ ID NO: 600767 - RNA, 64 nt, hsa
uaaaagcugguucccaaaugcauagcuggcauuuuaauuuaaauucaaaucuacauagagaaca

SEQ ID NO: 600768 - RNA, 64 nt, hsa
auuuguguguaauugccauuaaauuuucaaaauguaauuuaaaaggauuaaauacucauuuaau

SEQ ID NO: 600769 - RNA, 64 nt, hsa
aaauguaauuuaaaaggauuaaauacucauuuaauaauuuaaaauaauuauuguauaauaucua

SEQ ID NO: 600770 - RNA, 64 nt, hsa
ugaacuaaaauagaaagaaaauguugcugucauguaauuuaaacaauguaaauauuuuauggaa

SEQ ID NO: 600771 - RNA, 64 nt, hsa
uguuuaugauuauuacuggauuugucauuuuugauaauuuaaauauugcugcugcuuuguagau

SEQ ID NO: 600772 - RNA, 64 nt, hsa
caaauguuuuuauuaaauguuucauugacccaaguaauuuaaaaguaauauguuaccuaugucu

SEQ ID NO: 600773 - RNA, 64 nt, hsa
gcugaucuguaaaugacuuuaaaagcuauuuuaguaauuuaaauaaauuuacuuucuugguuua

SEQ ID NO: 600774 - RNA, 64 nt, hsa
guuuggagugauaauuuuuaguggaagcaauuuguaauuuaaguugguaguuauauuauauaua

SEQ ID NO: 600775 - RNA, 64 nt, hsa
aacaagaauuaaaaaugaauaagcuaucaauauauaauuuaaguacaaguuuaggcugggcgug

SEQ ID NO: 600776 - RNA, 64 nt, hsa
cuagcauuuaaauuuaaauuuuauuaaaauuaaauaauuuaaaucuagcauuuaaauuuaaaua

SEQ ID NO: 600777 - RNA, 64 nt, hsa
auuaaauaauuuaaaucuagcauuuaaauuuaaauaauuuaagucuagcauuuacuuuuaaaua

SEQ ID NO: 600778 - RNA, 64 nt, hsa
ccacaccuggcaauucccugcuuuuuugacaacauaauuuaaaugaauuugauuuaaauguuuc

SEQ ID NO: 600779 - RNA, 64 nt, hsa
cacauauuaguuagugcuaauauucuacugaauauaauuuaagcaaugggcuaagguccaagaa

SEQ ID NO: 600780 - RNA, 64 nt, hsa
uaauuuaaaugggaaagaacuauacccugacacauaauuuaaauuauauaaaugcuagaaauau

SEQ ID NO: 600781 - RNA, 64 nt, hsa
acucuuaggcuuuuuuacuacuaaagauuccacauaauuuaaaugggaaagaacuauacccuga

SEQ ID NO: 600782 - RNA, 64 nt, hsa
gguugguucuuuggguucuguuuguuuauuuguuuaauuuaaugauuuguaaagugauguuccu

SEQ ID NO: 600783 - RNA, 64 nt, hsa
uacaguauauauauguauauauauuuuaauuuuuuaauuuaagcaaagacuaaaaucaaccauu

SEQ ID NO: 600784 - RNA, 64 nt, hsa
acuagaagacucuaaauuggcuucuacagaucaauaauuuaaauguaacuaguugggauuuuau

SEQ ID NO: 600785 - RNA, 64 nt, hsa
cuugaaaucaaaacuaucagauuuuauuuuuguauaauuuaaggaagguaaaguuaggggacua

SEQ ID NO: 600786 - RNA, 64 nt, hsa
auuaauguucucuguucuguuuccauguuaaauuuaauuuaaccuggauagccacauuaaugaa

SEQ ID NO: 600787 - RNA, 64 nt, hsa
agagguuacacaauauuuuacaguuucuuaaacauaauuuaaugcaucaccuuccacuugcuaa

SEQ ID NO: 600788 - RNA, 64 nt, hsa
auuuaagaggauucacacucaacagguuuuaggauaauuuaaauaucaaaaauugauuguuaua

SEQ ID NO: 600789 - RNA, 64 nt, hsa
ucauacaaauuuauaaacauuucuuuauaaauuguaauuuaauagauuaucucagaaaaaccuc

SEQ ID NO: 600790 - RNA, 64 nt, hsa
cccuguucaaaguacuaaaacuagauaacuuaaauaauuuaagccaauaaauaauauuauauug

SEQ ID NO: 600791 - RNA, 64 nt, hsa
auacuuuugauaugauuguaacauauuucuugaguaauuuaaaugcuuuguuuucccacacaua

SEQ ID NO: 600792 - RNA, 64 nt, hsa
aaaacuguuggaauggauuuuucuuuaacugccguaauuuaacuuucuggguugccuuuauuuu

SEQ ID NO: 600793 - RNA, 64 nt, hsa
ccccuaucuguauucccaaaaauuacuuuggggcuaauuuaacaagaacuuuaaauuguguuuu

SEQ ID NO: 600794 - RNA, 64 nt, hsa
uauuauaacuuauuguucauauucauuucuaaguuaauuuaaguaaucauuuauuaagacagaa

SEQ ID NO: 600795 - RNA, 64 nt, hsa
cagaauuuguguguuuucgauuuaagcuaaaagauaauuuaagaacauuuauuuccccuuuuca

SEQ ID NO: 600796 - RNA, 64 nt, hsa
cuauaucaauguguccuuaguuuucuuagccuguuaauuuaaaaauccagacuugggggucauu

SEQ ID NO: 600797 - RNA, 64 nt, hsa
aacuucaugcagaauuucacagacaucuaugcauuaauuuaaauucuuggugcaaaugugugcu

SEQ ID NO: 600798 - RNA, 64 nt, hsa
auaagaauaaauuuggacccgguuucugauuauuuaauuuaaaagaucacuuacaggaucaugu

SEQ ID NO: 600799 - RNA, 64 nt, hsa
gacuguuguaauggaguaaagaagagggccagcuuaauuuaaaaauaaagugaguuuaccaaaa

SEQ ID NO: 600800 - RNA, 64 nt, hsa
guauguaacgauguuguauugauuuuuaagaaaguaauuuaauuuguaaaacuucugcucguuu

SEQ ID NO: 600801 - RNA, 64 nt, hsa
gauacuuugaagugcagcucauguuuuuaacuuuuaauuuaaaaacacaaaaaaaauuuuagcu

SEQ ID NO: 600802 - RNA, 64 nt, hsa
agaauuauaucuaauuuauacaaaauaauuuaacuaauuuaaaccagcagaaaagugcuuagaa

SEQ ID NO: 600803 - RNA, 64 nt, hsa
cagaaaaguagaauuauaucuaauuuauacaaaauaauuuaacuaauuuaaaccagcagaaaag

SEQ ID NO: 600804 - RNA, 64 nt, hsa
uuuucccguguauuuuuaaauaacuggugaucuauaauuuaauaaaauuuuucguugguguaau

SEQ ID NO: 600805 - RNA, 64 nt, hsa
auuaauuucuuucaagcaacuaaaaaauauaugguaauuuaaaggugucugcuuauuugguuga

SEQ ID NO: 600806 - RNA, 64 nt, hsa
aaucaagcaauauggaagcaaccagcaaauuaacuaauuuaaguacauuuuuaaaaaaagagcu

SEQ ID NO: 600807 - RNA, 64 nt, hsa
uccuagcaaguaagaauggccaacucaacuuucauaauuuaaaaaucuccauuaaaguuauaac

SEQ ID NO: 600808 - RNA, 64 nt, hsa
aguuaucccauuuagggugguuggagggccuuuuuaauuuaauugaccccccgagguggucuuu

SEQ ID NO: 600809 - RNA, 64 nt, hsa
uggaugcuguuaauuucuuuaauagccaugacuauaauuuaagccuaugagaagauagacuguu

SEQ ID NO: 600810 - RNA, 64 nt, hsa
gcguuguucuuuaaguguacaucguaauuugaccuaauuuaaaaauaauauauuuucgaaguag

SEQ ID NO: 600811 - RNA, 64 nt, hsa
acuuuuauaaauaaauaauuccaaaauaauuucuuaauuuaaaaugauagcacuucucuugcac

SEQ ID NO: 600812 - RNA, 64 nt, hsa
aguuuuuaauuauuauuaauauaaaggaucaaauuaauuuaaauaugauucugaagucuacaga

SEQ ID NO: 600813 - RNA, 64 nt, hsa
uuggucuggugagauguuucauauuugugacaguuaauuuaaaaauuaugaguuaaugcugccu

SEQ ID NO: 600814 - RNA, 64 nt, hsa
guacauugauggccaucacaaugcagcuuugguuuaauuuaauucaggccugcugcugaguuau

SEQ ID NO: 600815 - RNA, 64 nt, hsa
uguuuuuaguaguuucccaacuuuaagacuuaucuaauuuaacugagaaagaaagccuuuuuca

SEQ ID NO: 600816 - RNA, 64 nt, hsa
auaaagcauuacucuuuuucaauaaauuguuuuuuaauuuaaaaaaaggauuauuggcuuguuu

SEQ ID NO: 600817 - RNA, 64 nt, hsa
ccagugagauagaauacauguaagugugguuuuguaauuuaaaaagugcuauacuaagggaaag

SEQ ID NO: 600818 - RNA, 64 nt, hsa
acauuuaaugccaucuagcuagcaauugcgaccuuaauuuaacuuuccagucuuagcugaggcu

SEQ ID NO: 600819 - RNA, 64 nt, hsa
aaaugaagaucuuuauauuucaauaaaugauauauaauuuaaaguuauacuaagguuucagcau

SEQ ID NO: 600820 - RNA, 64 nt, hsa
ggaaaacuccugacugguauuacuggguuugguauaauuuaauuuaaaauucucauuuauagag

SEQ ID NO: 600821 - RNA, 64 nt, hsa
acuccugacugguauuacuggguuugguauaauuuaauuuaaaauucucauuuauagaguauuu

SEQ ID NO: 600822 - RNA, 64 nt, hsa
caggucaaaauaaaaguugaacuugaguuacauuuaauuuaaauauaaaugcauuuugagaaau

SEQ ID NO: 600823 - RNA, 64 nt, hsa
aaaagggaggaguauuuuuaguuugacaauuuaauaauuuaaaaacaagacaucuccagguagg

SEQ ID NO: 600824 - RNA, 64 nt, hsa
cauuuaaauuacuugaaucucauuauuuugacaauaauuuaauucuuuuauuguucaaucuguu

SEQ ID NO: 600825 - RNA, 64 nt, hsa
uguucaauucuuaugucgcucaaaaaauaaaauuuaauuuaaaaaguaucugauuuuuaaagua

SEQ ID NO: 600826 - RNA, 64 nt, hsa
auuaguuuuggggggaauaauugugcaaagaggauaauuuaauuuacgugcuucuguuauucag

SEQ ID NO: 600827 - RNA, 64 nt, hsa
aauccgcccacucccacugaccuaguagaauuuguaauuuaauacuuaccuucuauuucugaaa

SEQ ID NO: 600828 - RNA, 64 nt, hsa
uuuugagccuucaagauacaguuccugaauauucuaauuuaaauuguuauaauuggauuaccua

SEQ ID NO: 600829 - RNA, 64 nt, hsa
acuauaacauuuacauuguguuagguauuuuaaguaauuuaaagguuacaguauacaggcgguu

SEQ ID NO: 600830 - RNA, 64 nt, hsa
gguuggggcauaugggagcuuaauauaucauaucuaauuuaaaauaauuucacugaaauaaacu

SEQ ID NO: 600831 - RNA, 64 nt, hsa
guaguguaugguaagucauaucagauaucagaccuaauuuaaauuucauuuuagcuuuacaagu

SEQ ID NO: 600832 - RNA, 64 nt, hsa
gcccugacaucugucaagcuuuggggccacaaaauaauuuaauauaacccuaagcaaaaugcag

SEQ ID NO: 600833 - RNA, 64 nt, hsa
aagcacauuuuaaaggucaacuuucaauuacugguaauuuaauuucccacuuuuaauuccaagc

SEQ ID NO: 600834 - RNA, 64 nt, hsa
gauauuaaauaagucccaggcagauuuacauauuuaauuuaaaacauuggcuuuauuucauuuu

SEQ ID NO: 600835 - RNA, 64 nt, hsa
uaauuugaccaguguuaagaauuuucuaauuuaauaauuuaauagugaucucaauaccacaccc

SEQ ID NO: 600836 - RNA, 64 nt, hsa
cacucgucuaauuugaccaguguuaagaauuuucuaauuuaauaauuuaauagugaucucaaua

SEQ ID NO: 600837 - RNA, 64 nt, hsa
aucagacuuuguaacagguagaaauauuacagaauaauuuaagacacuacaaugggggcaaaug

SEQ ID NO: 600838 - RNA, 64 nt, hsa
uuagaaaaugucagacuuuuguuuuugggguuuauaauuuaaaccagcuaugcuauuuuuucau

SEQ ID NO: 600839 - RNA, 64 nt, hsa
guagaguaacaccuuuauacgugugcuugccuccuaauuuaaaauacuguauucgcauguagau

SEQ ID NO: 600840 - RNA, 64 nt, hsa
ugggauuauacuuccuuucuguaccaauuucuuuuaauuuaaagaacuauaagucaguuauauu

SEQ ID NO: 600841 - RNA, 64 nt, hsa
gucuuuaaugucuucagacaaaaaagccuuacauuaauuuaauguuugcacucugaggugcaac

SEQ ID NO: 600842 - RNA, 64 nt, hsa
auuaauaauuacauaccuuuauagauuuugaaauuaauuuaaauauuaguauuugguacaugaa

SEQ ID NO: 600843 - RNA, 64 nt, hsa
agcugugaacagaguugugucugaggaaugugccuaauuuaaggcaggguuuguuccaaugcau

SEQ ID NO: 600844 - RNA, 64 nt, hsa
uauuaauagguuguuuaucuuuuugccuguuugcuaauuuaaaaauauuuauuuuaucauuuua

SEQ ID NO: 600845 - RNA, 64 nt, hsa
gcaacaaagggcagcaagaaaugcuggguccaccuaauuuaacacaaaaugaaguugagauucg

SEQ ID NO: 600846 - RNA, 64 nt, hsa
gauaauguacaugcuucaugucaugucuuuaaaauaauuuaaucaacuuuauugucuuaguauu

SEQ ID NO: 600847 - RNA, 64 nt, hsa
aaauggcuuuaaauuaauacucuuauuuuuuauuuaauuuaauuacauaaauuaaaccuuacca

SEQ ID NO: 600848 - RNA, 64 nt, hsa
ccugugagauguuugauauuaugaacaggaaacauaauuuaauguaugaauagaugugaauuug

SEQ ID NO: 600849 - RNA, 64 nt, hsa
uggucugcauuuuucuuuuugauuacaaaauuuauaauuuaauaaauacuagaguuuaucaaaa

SEQ ID NO: 600850 - RNA, 64 nt, hsa
uggauuuuuaaauacauuuuuaaaauuucagauguaauuuaacaucacauuuguuuuucaggua

SEQ ID NO: 600851 - RNA, 64 nt, hsa
auuuuacaucuuauuuuugccuuuauuucauaaguaauuuaaaaaucacuggauugcuuuauua

SEQ ID NO: 600852 - RNA, 64 nt, hsa
auuugagggagauuuuauauaccuuuaaaaacuguaauuuaauugggaugccagguuuauagca

SEQ ID NO: 600853 - RNA, 64 nt, hsa
uuaucagugaauaggugguguacuuuacuugguauaauuuaaaguugcacaguaaguacuguuu

SEQ ID NO: 600854 - RNA, 64 nt, hsa
auugaacauguuguauaaauacaccagguguuuuuaauuuaauaagguggcaugcagauacauu

SEQ ID NO: 600855 - RNA, 64 nt, hsa
uaugaugaaauuuugauuucucugaaucucagaguaauuuaagaugggcaaauccaaugaguug

SEQ ID NO: 600856 - RNA, 64 nt, hsa
cuugggacuccacaacaacaacaacaacaaaauuuaauuuaauuuaaaaauagccccagucguc

SEQ ID NO: 600857 - RNA, 64 nt, hsa
gacuccacaacaacaacaacaacaaaauuuaauuuaauuuaaaaauagccccagucgucaucac

SEQ ID NO: 600858 - RNA, 64 nt, hsa
aaauauauuuuugcaagugaaguaaauauaaaaauaauuuaauccaaaauuaagucuauauaaa

SEQ ID NO: 600859 - RNA, 64 nt, hsa
cugaguauagaaucagaaugcugaguauagaaaauaauuuaaaacuaaaguugguagguaaaua

SEQ ID NO: 600860 - RNA, 64 nt, hsa
gggaaaugauuaccuuuccaguaaaaaguauagauaauuuaauuaacuuagugacaccaccaag

SEQ ID NO: 600861 - RNA, 64 nt, hsa
auauuuucuguucacaguauaugaaaauauggaguaauuuaaacaguaaauaaacauucugugg

SEQ ID NO: 600862 - RNA, 64 nt, hsa
gaggccaggucucaguccgcgcuaaacaaugcaauaauuuaaaaucauaaagggccaguguaua

SEQ ID NO: 600863 - RNA, 64 nt, hsa
cuuuuuaaaaaggaaaguauaaaaacaaaaguuguaauuuaaaagucugaauaaccaucugcug

SEQ ID NO: 600864 - RNA, 64 nt, hsa
uaagucuucaaauuuuuuaaagguuuuuuuuuuuuaauuuaauuuuuccuuuuggggguaaagu

SEQ ID NO: 600865 - RNA, 64 nt, hsa
ucuguagauucaugcaaguggagcugucugucucuaauuuaacuuauugcuagauaauaggguu

SEQ ID NO: 600866 - RNA, 64 nt, hsa
gggcaaaaugugucagaugcccuaguuaaucauguaauuuaauucugguauugugagugguuag

SEQ ID NO: 600867 - RNA, 64 nt, hsa
uagcgagcucaaagcaauuaagugggaacauuuuuaauuuaaaaaaaauuuccaaauauuugug

SEQ ID NO: 600868 - RNA, 64 nt, hsa
gaguuaaucuguuguaauuguaguauuguuuuuguaauuuaacaauaaauaagccugcuacaug

SEQ ID NO: 600869 - RNA, 59 nt, hsa
cuagagcuguagccacguaguuuucuacuuaauuuaaagaaaagaauuccuuaccuaua

SEQ ID NO: 600870 - RNA, 64 nt, hsa
aguuauucaaagaauguuaucuuucuugcaagaguaauuuaagcacaugggaaagauucuagac

SEQ ID NO: 600871 - RNA, 64 nt, hsa
cucuagugaucaugcaucuaguuaucauaagaaauaauuuaaaagguuuuguugcugaaagcag

SEQ ID NO: 600872 - RNA, 64 nt, hsa
uuuggcucggugcauuuuucauuuauuuaauuaguaauuuaaguaaaguguuugguaaaucauu

SEQ ID NO: 600873 - RNA, 64 nt, hsa
aagcuugucuggucaacauuccaguguggaaaaauaauuuaaacaaucuuauucucuuaauucu

SEQ ID NO: 600874 - RNA, 64 nt, hsa
cacuuuugaaacucagacuucaguguauacccaauaauuuaaaauuaugugaaauguuuuaaau

SEQ ID NO: 600875 - RNA, 64 nt, hsa
agcguugcaacgaaauccuauauccaguuuccuguaauuuaauugaagaaaaauacauccaaau

SEQ ID NO: 600876 - RNA, 64 nt, hsa
aaggaaaaccugucugagaaaaugccugacaguuuaauuuaaaacuaugguguaagucuuugac

SEQ ID NO: 600877 - RNA, 64 nt, hsa
agguggacuuagccauaggaaaauauuacuaauguaauuuaacaaauugcugcauguauuccau

SEQ ID NO: 600878 - RNA, 64 nt, hsa
auaguaagacccuaucucuaccccccuaauaaauuaauuuaaaaagccccccaaucugugguau

SEQ ID NO: 600879 - RNA, 64 nt, hsa
aaaacaaaaugaacacuugaccaaaaaaccacauuaauuuaaauggagccuuucauuauuuuca

SEQ ID NO: 600880 - RNA, 64 nt, hsa
gcauuaaaauuucuuuuggggagagacugucuaguaauuuaaaauguguuaaauaugaaccaua

SEQ ID NO: 600881 - RNA, 64 nt, hsa
aguuuagaauuucuuggaccacauuaugcuauuguaauuuaacaccauuucuacgucgggaaau

SEQ ID NO: 600882 - RNA, 64 nt, hsa
gagccucuucugcauagaaaaagaauugcaauuuuaauuuaaaaacauuuauagaaaauucauu

SEQ ID NO: 600883 - RNA, 64 nt, hsa
agaacuuuuuuggaacuucuaauuuugggucauuuaauuuaagaaugagagucaugauguuuug

SEQ ID NO: 600884 - RNA, 64 nt, hsa
aaggugccuaugccauuguuaaauuuucuuuaaguaauuuaacaacagauuugcuaauuuaaaa

SEQ ID NO: 600885 - RNA, 64 nt, hsa
aaauuuucuuuaaguaauuuaacaacagauuugcuaauuuaaaaaaaaaugaaaaaaaaaaucu

SEQ ID NO: 600886 - RNA, 64 nt, hsa
uuucuuuuuucuuuuuuuuaauaaaaucuaccaguaauuuaaaugugagcuuuuuaugucuguc

SEQ ID NO: 600887 - RNA, 64 nt, hsa
auguugagaccaaaguaguauagaaguauggacuuaauuuaauuguaaaauuauuagagguauu

SEQ ID NO: 600888 - RNA, 64 nt, hsa
gcaaugaauaauuuuccugcuucacuguuauuuuuaauuuaaccuggcaaauuaagugagacuu

SEQ ID NO: 600889 - RNA, 64 nt, hsa
gugaacagaaaaaacaguguuccugcauuuaccauaauuuaaucagucaauuugcagauagcua

SEQ ID NO: 600890 - RNA, 64 nt, hsa
agugaguagccuauaugugcauuuacugaauuguuaauuuaaggauauauauuaauagaguaug

SEQ ID NO: 600891 - RNA, 64 nt, hsa
acaaaauauauuuuaccaaaaauuauacugaauauaauuuaaccuuggggaauccagaauacuu

SEQ ID NO: 600892 - RNA, 64 nt, hsa
uucucuauuauauauuucccauauuucaggugaauaauuuaauuuaaaugacaaaacccuaucu

SEQ ID NO: 600893 - RNA, 64 nt, hsa
uauuauauauuucccauauuucaggugaauaauuuaauuuaaaugacaaaacccuaucuaguca

SEQ ID NO: 600894 - RNA, 64 nt, hsa
accuuuaaaaauuuucucauuaagacaauguuuuuaauuuaauuugccucauuacaucuaauag

SEQ ID NO: 600895 - RNA, 64 nt, hsa
auuuuuuauauuuccuuacaauuuugguggccauuaauuuaacuuuaggcuuuugggcauaugc

SEQ ID NO: 600896 - RNA, 64 nt, hsa
augguuuggguagacuuuuuuuuuauaucaaguauaauuuaaaacaucagauuaaauaauuaca

SEQ ID NO: 600897 - RNA, 64 nt, hsa
cauuaacauuaauuuuauuuuuucagacauacuguaauuuaaaaauuaaugugagcguuuguuu

SEQ ID NO: 600898 - RNA, 64 nt, hsa
cagggcagacauacauaugauagcuugugcugauuaauuuaaccccauuuguaaacagaugaaa

SEQ ID NO: 600899 - RNA, 64 nt, hsa
cauucauauguaucugucuacaaaugucuggggauaauuuaaauuugaaaccuaaguuauauau

SEQ ID NO: 600900 - RNA, 64 nt, hsa
aggacuaauuuaaacacauaucaaugugaaggacuaauuuaaauuacuaucauuuaugauugca

SEQ ID NO: 600901 - RNA, 64 nt, hsa
cagaacaaaaggcagaaaaggcauaccuaaggacuaauuuaaacacauaucaaugugaaggacu

SEQ ID NO: 600902 - RNA, 64 nt, hsa
cauuauuuuucuuaauaucuauuuacuaaguauguaauuuaauauacauuaauuauuuuuugaa

SEQ ID NO: 600903 - RNA, 64 nt, hsa
aaccaaaaacacaacagucauuaucugugaaccauaauuuaaaaaucuuucuagaauaacaaca

SEQ ID NO: 600904 - RNA, 64 nt, hsa
gaagaaaaugacaauaucuguuggauauuugauauaauuuaaugguguuauaaaaccuuuaaga

SEQ ID NO: 600905 - RNA, 64 nt, hsa
uacuguguaacaguaacucuuuuuugcuuuucaguaauuuaauauguucacuuaacaaaauacg

SEQ ID NO: 600906 - RNA, 64 nt, hsa
uuaaaaauuaauaacuuuuaguaauuacuuuuauuaauuuaaaauagaacgcuugagaggcacu

SEQ ID NO: 600907 - RNA, 64 nt, hsa
uagguuuuuuaaaauuaauauuaauaacuuuuauuaauuuaaaauagaaugcuuaaaauaaaau

SEQ ID NO: 600908 - RNA, 64 nt, hsa
agauacuuuugagacaacaccuucagaaaacacauaauuuaaucuuugccauccuuagauagag

SEQ ID NO: 600909 - RNA, 64 nt, hsa
ugugcagucaguagagcugaacuuagcuaugaauuaauuuaaauuaauucuaaagugacucugg

SEQ ID NO: 600910 - RNA, 64 nt, hsa
auguugaaccucacacuuuuauguggugacaguguaauuuaauuaaaagguguaaauguuuuca

SEQ ID NO: 600911 - RNA, 64 nt, hsa
ucccuacguguugugggagggacccagugggcaguaauuuaaucaugguggugguuacccucau

SEQ ID NO: 600912 - RNA, 64 nt, hsa
uuucuaaauacuagccuucugguucacagugaaauaauuuaauuaucaaucaguagauugauuc

SEQ ID NO: 600913 - RNA, 64 nt, hsa
uuaaaaaacuaucaaaguagguuaaauuaaaaucuaauuuaaauuagguuaauuuauauuacau

SEQ ID NO: 600914 - RNA, 64 nt, hsa
gauaggacagugacaaaauucguaagugaauacuuaauuuaaaaguguuaacauuaaugcucaa

SEQ ID NO: 600915 - RNA, 64 nt, hsa
ucaaaaaaacuauuaugaaagucaauaaaauagauaauuuaacaaaaguacaggauuagaacau

SEQ ID NO: 600916 - RNA, 64 nt, hsa
uuauauguucaccaaugggaggucaauauuuaucuaauuuaaaagguaugcuaaccacuguggu

SEQ ID NO: 600917 - RNA, 64 nt, hsa
uuucacauaaaauugagacaguguauauuuaaucuaauuuaaauuuuaaagagauacugguauu

SEQ ID NO: 600918 - RNA, 64 nt, hsa
gcuuuagaguaaggaugagaaacuugaguguuuuuaauuuaaagauaaaagccuguguuuuaca

SEQ ID NO: 600919 - RNA, 64 nt, hsa
gggaaggcgauguggugaccccacccccacccguuaauuuaaagcuguuucuaaacaguugagu

SEQ ID NO: 600920 - RNA, 64 nt, hsa
uaaucugacaaagucaugaagcucaguuuggcuguaauuuaauuccccuucccuuauuuuuauu

SEQ ID NO: 600921 - RNA, 64 nt, hsa
uuauuauaacauccacaaagagauuauuuuuaaauaauuuaaagcauaauauuucuuaaaaagu

SEQ ID NO: 600922 - RNA, 64 nt, hsa
uugaaaaaaaauuucaaaaagaaaaaaauauauauaauuuaaaacuacuuagucuuauucuucu

SEQ ID NO: 600923 - RNA, 64 nt, hsa
cuguuauugaucccuucuccugcccuuucccagguaauuuaaauuggucaugguagauuuuuuu

SEQ ID NO: 600924 - RNA, 64 nt, hsa
uuaaugguaggucaaguaauaaaaagagaugaaauaauuuaaauucuuaaaugaaucaguuuuu

SEQ ID NO: 600925 - RNA, 64 nt, hsa
aucagcuauuuuuaaacauuauuuacucggauucuaauuuaaugugacauugacuauaagaagg

SEQ ID NO: 600926 - RNA, 64 nt, hsa
cauccccaacaugggucuauuuugugcuuaaaaauaauuuaaaaaucauacaauauuagguugg

SEQ ID NO: 600927 - RNA, 64 nt, hsa
uuauaaugucuucuauauguaguaucuaaaagcauaauuuaauagcauugucuuaaaauacgug

SEQ ID NO: 600928 - RNA, 64 nt, hsa
gguguuaauuacuaaaauuuucuuucuaaaaguauaauuuaauagaauuaucuuaaaauacaug

SEQ ID NO: 600929 - RNA, 64 nt, hsa
cccuccgaagagaaaauuuuuauacuaaaaucuauaauuuaauucaagagaaugcuuuuauuuc

SEQ ID NO: 600930 - RNA, 64 nt, hsa
cagagaugacuaauuuaaauuuagaaccagauuuuaauuuaaauuaauauuuccauuaauaacc

SEQ ID NO: 600931 - RNA, 64 nt, hsa
ugacuucuuuuucucuucauuagccagagaugacuaauuuaaauuuagaaccagauuuuaauuu

SEQ ID NO: 600932 - RNA, 64 nt, hsa
uuuuauugucaguagaaaaaaguuaaacuccuacuaauuuaaacuaagacaguuuaaaaaggaa

SEQ ID NO: 600933 - RNA, 64 nt, hsa
aaaaaggaagccugaaaaagacucauacuacaaauaauuuaauugauggcauauaagaauaugc

SEQ ID NO: 600934 - RNA, 64 nt, hsa
gaaaugcuaugauucacauguaacauuuaaacauuaauuuaaaaagggaaccuuggagaauucu

SEQ ID NO: 600935 - RNA, 64 nt, hsa
uaggugauuauccaaacaaguaaauuugaguguauaauuuaauuuuuaaccuguuaaauaaacc

SEQ ID NO: 600936 - RNA, 64 nt, hsa
uaaaaggaaaaaaaacuuagccuagaauuagaauuaauuuaauugaauucaucuaaagaugucu

SEQ ID NO: 600937 - RNA, 64 nt, hsa
gcagccugggaucucccuacuccauuuuuuccuuuaauuuaaguggccacauguauaugucuuc

SEQ ID NO: 600938 - RNA, 64 nt, hsa
uuucaaaagcaauauaacguuuguauaugcuguuuaauuuaaguuaauguuaaguaaucauuuc

SEQ ID NO: 600939 - RNA, 64 nt, hsa
ugagucaguggaacacugaaauacagcgguuguguaauuuaagaguggcaacaguuucauuuga

SEQ ID NO: 600940 - RNA, 64 nt, hsa
gaggcaggcacacguccuccagcccaagacugccuaauuuaacagggauuucugcauucuggaa

SEQ ID NO: 600941 - RNA, 64 nt, hsa
gcugggacuacaggcaugcaccaccaagcuuggcuaauuuaaaaaaaaaauuauauagauaggg

SEQ ID NO: 600942 - RNA, 64 nt, hsa
caugagauuuaguaacuuauaaaaugagguuuaguaauuuaauuuaaauggauaggaccaauaa

SEQ ID NO: 600943 - RNA, 64 nt, hsa
gauuuaguaacuuauaaaaugagguuuaguaauuuaauuuaaauggauaggaccaauaaguuaa

SEQ ID NO: 600944 - RNA, 64 nt, hsa
gaaaacuaccuggugaugcaaucuuuuuuuuuuuuaauuuaauuuaauuuuaaaauaaaugcug

SEQ ID NO: 600945 - RNA, 64 nt, hsa
cuaccuggugaugcaaucuuuuuuuuuuuuaauuuaauuuaauuuuaaaauaaaugcugcauug

SEQ ID NO: 600946 - RNA, 64 nt, hsa
uuaauccuauuuaaauguucuuucaaaucucuaauaauuuaaacuuuccucagugcuccaugau

SEQ ID NO: 600947 - RNA, 64 nt, hsa
aacaacucaggaauauaacauauaagggagauguuaauuuaaaaauuuccacuacacuuauuau

SEQ ID NO: 600948 - RNA, 64 nt, hsa
aagaaaaauaaaacaccuuguacuuuauuuucuauaauuuaaauauaugcuaagucuuauauau

SEQ ID NO: 600949 - RNA, 64 nt, hsa
aaauccacagaccaaccuggaguugaaaaucuuauaauuuaaaauaugcucuaaacauguuuau

SEQ ID NO: 600950 - RNA, 64 nt, hsa
gcucuuaugggcuucuaauuuuaauauaaauaaauaauuuaaauuuuauugguguuauuggaag

SEQ ID NO: 600951 - RNA, 64 nt, hsa
uguauauuguaacaaccuaaaacgcagagaaguuuaauuuaauacuguuuuuuuucuugaagga

SEQ ID NO: 600952 - RNA, 64 nt, hsa
acaggcuaccuggaaacugcccauggcggggucauaauuuaaaugucccaaugucauauagagg

SEQ ID NO: 600953 - RNA, 64 nt, hsa
ucauaauuuaaaugucccaaugucauauagagguuaauuuaaucaaaaugagcuaaaacaugga

SEQ ID NO: 600954 - RNA, 64 nt, hsa
ucaaaaugagcuaaaacauggaacaaucacugaauaauuuaaaaagaguuuaccuggcagagug

SEQ ID NO: 600955 - RNA, 64 nt, hsa
accaauuaauauuuuugaaagagcucuuuuagguuaauuuaaguacagcaauuucucauguaau

SEQ ID NO: 600956 - RNA, 64 nt, hsa
acgguuuaaacaggaaggauugugcagcaggcuuuaauuuaauguagauucauacugcucuguu

SEQ ID NO: 600957 - RNA, 62 nt, hsa
auucuauugacuuucuuaaaaauauuuuuucuguaccuaacuugagcauaaggguuauuuga

SEQ ID NO: 600958 - RNA, 62 nt, hsa
ccaaugcuucuuauaagacuaaaugauuagaaguaccuaauaguuugaacagauauguuuuu

SEQ ID NO: 600959 - RNA, 62 nt, hsa
auaaguggucaugaaauuuuaauguuaaguuuguaccuaauagaaauaugucuaucacaaau

SEQ ID NO: 600960 - RNA, 62 nt, hsa
ugaaaugccacaaaaccccuuaaaguggucaaguaccuaagguaguggcuaaggcaugcuug

SEQ ID NO: 600961 - RNA, 64 nt, hsa; identical to SEQ ID NO: 390817

SEQ ID NO: 600962 - RNA, 64 nt, hsa; identical to SEQ ID NO: 390818

SEQ ID NO: 600963 - RNA, 64 nt, hsa
agaagaucuggccaugcuggggcucacauucucaccuagcaacaacuggcuggagcugggcacc

SEQ ID NO: 600964 - RNA, 64 nt, hsa
uggaaauucaucuugaaucccauuguccuauaguccuagcaauaagagaaauuuccucaaguuu

SEQ ID NO: 600965 - RNA, 64 nt, hsa
gugauccuuggaauuauccuagcaacaacauuguccuagcaaccauaucccaagagccauuuau

SEQ ID NO: 600966 - RNA, 64 nt, hsa
guguaauuguuuugcuugugauccuuggaauuauccuagcaacaacauuguccuagcaaccaua

SEQ ID NO: 600967 - RNA, 64 nt, hsa
augugugaucuuugugucuccuuuuugccaagcacauucugauuuucuuguuggaacacagguc

SEQ ID NO: 600968 - RNA, 64 nt, hsa
caggaauaagaacuccauuucaaacaguucuggccauucugagccugcuuuugugauugcucau

SEQ ID NO: 600969 - RNA, 64 nt, hsa
accccccacccaccgcaagcuuugagugggacaccauucugaauuuuuuuucugaauuuuuuuu

SEQ ID NO: 600970 - RNA, 64 nt, hsa
uuccuucuuccccaauaugccugcgccaucuucacauucugaaguugaaacccaugaucacccc

SEQ ID NO: 600971 - RNA, 64 nt, hsa
aaaugcugaaaggcagcguuuuuuagacucuaaacauucugauuuugaagguggguguuggaac

SEQ ID NO: 600972 - RNA, 64 nt, hsa
aucacagcaaggcuuuugugccuugcacuccaugcauucugauaacggcagcuuuccuaaaaag

SEQ ID NO: 600973 - RNA, 64 nt, hsa
aaaagaaggaaagaugguuaaacauuuucccacucauucugaauuaauuaauuuggagcacaaa

SEQ ID NO: 600974 - RNA, 64 nt, hsa
auggcaugcuuaaauuuuaacuaaauuuuaaagccauucugauuauugaguuccaguugaaguu

SEQ ID NO: 600975 - RNA, 64 nt, hsa
agaaagguugugcucgcuacacugcuggugugugcauucugagaccucuuguauucaaucugug

SEQ ID NO: 600976 - RNA, 64 nt, hsa
auaaguagagaaaaucaucaauaaauauuuauuacauucugacaggguguguggcauuguguuc

SEQ ID NO: 600977 - RNA, 64 nt, hsa
uuaaaaaugaucuguaguuuuuuuggugcuauaacauucugacacauaucauucugugauuaaa

SEQ ID NO: 600978 - RNA, 64 nt, hsa
gugcccccuagggucuauaauuccuuaaaauuuucauucugaaucugaaggagagagucuuuua

SEQ ID NO: 600979 - RNA, 64 nt, hsa
caaauaacaaagcaaaccaauauaauuauauggucauucugaccccagcucuuauacaaauuau

SEQ ID NO: 600980 - RNA, 64 nt, hsa
ucugccuccuguuuauugagaacuaugcauugaacauucugaaucauucuaagccucuggagag

SEQ ID NO: 600981 - RNA, 64 nt, hsa
uauaucggauuuaccuuaagcuucucuagugaggcauucugagcaguggugaucacaugccaga

SEQ ID NO: 600982 - RNA, 64 nt, hsa
uuugauacaacuccccgaucuagauuuauuccuacauucugaauggggagcagguaagagcaga

SEQ ID NO: 600983 - RNA, 64 nt, hsa
ggguucaaaugccaaauagugauuagaagacgaccauucugaucugugugugaucuggucacua

SEQ ID NO: 600984 - RNA, 64 nt, hsa
aacucuuuguauaugcaaauugcaagauuuaaaccauucugaugcaaggauaaaccuuuacuuu

SEQ ID NO: 600985 - RNA, 64 nt, hsa
caccuuugcauagcuggguugcagcugcgaaccucauucugacugugaacuaagcaagcuuuga

SEQ ID NO: 600986 - RNA, 64 nt, hsa
guacacgucugugcccugaaggaacacuggccuccauucugacaucugggcuggggccucagga

SEQ ID NO: 600987 - RNA, 64 nt, hsa
ggagcagaccccugagaucugggcauaggcaccgcauucugaucuggacaaagucgggacagca

SEQ ID NO: 600988 - RNA, 64 nt, hsa
gaaaucaaaacaccgcaccagccagcagaauggacauucugacaucgccagccgacgcccugaa

SEQ ID NO: 600989 - RNA, 64 nt, hsa
ggggaucauuuugauguugaauguucccccaaagcauucugacaaguuugguccacuuggcucu

SEQ ID NO: 600990 - RNA, 64 nt, hsa
cugguuuuguaggcaggcuguaccugcaaauaggcauucugagcaaggauccuaaauuucccuu

SEQ ID NO: 600991 - RNA, 64 nt, hsa; identical to SEQ ID NO: 124927

SEQ ID NO: 600992 - RNA, 64 nt, hsa; identical to SEQ ID NO: 124928

SEQ ID NO: 600993 - RNA, 64 nt, hsa; identical to SEQ ID NO: 124929

SEQ ID NO: 600994 - RNA, 64 nt, hsa; identical to SEQ ID NO: 124930

SEQ ID NO: 600995 - RNA, 64 nt, hsa; identical to SEQ ID NO: 124931

SEQ ID NO: 600996 - RNA, 64 nt, hsa; identical to SEQ ID NO: 124932

SEQ ID NO: 600997 - RNA, 64 nt, hsa; identical to SEQ ID NO: 124933

SEQ ID NO: 600998 - RNA, 64 nt, hsa; identical to SEQ ID NO: 124934

SEQ ID NO: 600999 - RNA, 64 nt, hsa; identical to SEQ ID NO: 124935

SEQ ID NO: 601000 - RNA, 64 nt, hsa; identical to SEQ ID NO: 124936

SEQ ID NO: 601001 - RNA, 64 nt, hsa; identical to SEQ ID NO: 124937

SEQ ID NO: 601002 - RNA, 64 nt, hsa; identical to SEQ ID NO: 124938

SEQ ID NO: 601003 - RNA, 64 nt, hsa; identical to SEQ ID NO: 124939

SEQ ID NO: 601004 - RNA, 64 nt, hsa; identical to SEQ ID NO: 124940

SEQ ID NO: 601005 - RNA, 64 nt, hsa; identical to SEQ ID NO: 124941

SEQ ID NO: 601006 - RNA, 64 nt, hsa; identical to SEQ ID NO: 124942

SEQ ID NO: 601007 - RNA, 64 nt, hsa; identical to SEQ ID NO: 124943

SEQ ID NO: 601008 - RNA, 64 nt, hsa; identical to SEQ ID NO: 124944

SEQ ID NO: 601009 - RNA, 64 nt, hsa; identical to SEQ ID NO: 124945

SEQ ID NO: 601010 - RNA, 64 nt, hsa; identical to SEQ ID NO: 124946

SEQ ID NO: 601011 - RNA, 64 nt, hsa; identical to SEQ ID NO: 124947

SEQ ID NO: 601012 - RNA, 64 nt, hsa; identical to SEQ ID NO: 124948

SEQ ID NO: 601013 - RNA, 64 nt, hsa; identical to SEQ ID NO: 124949

SEQ ID NO: 601014 - RNA, 64 nt, hsa; identical to SEQ ID NO: 124950

SEQ ID NO: 601015 - RNA, 64 nt, hsa; identical to SEQ ID NO: 124951

SEQ ID NO: 601016 - RNA, 64 nt, hsa; identical to SEQ ID NO: 124952

SEQ ID NO: 601017 - RNA, 64 nt, hsa; identical to SEQ ID NO: 124953

SEQ ID NO: 601018 - RNA, 64 nt, hsa; identical to SEQ ID NO: 124954

SEQ ID NO: 601019 - RNA, 64 nt, hsa; identical to SEQ ID NO: 124955

SEQ ID NO: 601020 - RNA, 64 nt, hsa; identical to SEQ ID NO: 124956

SEQ ID NO: 601021 - RNA, 64 nt, hsa; identical to SEQ ID NO: 124957

SEQ ID NO: 601022 - RNA, 64 nt, hsa; identical to SEQ ID NO: 124958

SEQ ID NO: 601023 - RNA, 64 nt, hsa; identical to SEQ ID NO: 124959

SEQ ID NO: 601024 - RNA, 64 nt, hsa; identical to SEQ ID NO: 124960

SEQ ID NO: 601025 - RNA, 64 nt, hsa; identical to SEQ ID NO: 124961

SEQ ID NO: 601026 - RNA, 64 nt, hsa; identical to SEQ ID NO: 124962

SEQ ID NO: 601027 - RNA, 64 nt, hsa; identical to SEQ ID NO: 124963

SEQ ID NO: 601028 - RNA, 64 nt, hsa; identical to SEQ ID NO: 124964

SEQ ID NO: 601029 - RNA, 64 nt, hsa; identical to SEQ ID NO: 124965

SEQ ID NO: 601030 - RNA, 64 nt, hsa; identical to SEQ ID NO: 124966

SEQ ID NO: 601031 - RNA, 64 nt, hsa; identical to SEQ ID NO: 124967

SEQ ID NO: 601032 - RNA, 63 nt, hsa; identical to SEQ ID NO: 124968

SEQ ID NO: 601033 - RNA, 64 nt, hsa; identical to SEQ ID NO: 124969

SEQ ID NO: 601034 - RNA, 64 nt, hsa; identical to SEQ ID NO: 124970

SEQ ID NO: 601035 - RNA, 64 nt, hsa; identical to SEQ ID NO: 124971

SEQ ID NO: 601036 - RNA, 64 nt, hsa; identical to SEQ ID NO: 124972

SEQ ID NO: 601037 - RNA, 64 nt, hsa; identical to SEQ ID NO: 124973

SEQ ID NO: 601038 - RNA, 64 nt, hsa; identical to SEQ ID NO: 124974

SEQ ID NO: 601039 - RNA, 64 nt, hsa; identical to SEQ ID NO: 124975

SEQ ID NO: 601040 - RNA, 64 nt, hsa; identical to SEQ ID NO: 124976

SEQ ID NO: 601041 - RNA, 64 nt, hsa; identical to SEQ ID NO: 124977

SEQ ID NO: 601042 - RNA, 64 nt, hsa; identical to SEQ ID NO: 124977

SEQ ID NO: 601043 - RNA, 64 nt, hsa; identical to SEQ ID NO: 124979

SEQ ID NO: 601044 - RNA, 64 nt, hsa; identical to SEQ ID NO: 124980

SEQ ID NO: 601045 - RNA, 64 nt, hsa; identical to SEQ ID NO: 124981

SEQ ID NO: 601046 - RNA, 64 nt, hsa; identical to SEQ ID NO: 124982

SEQ ID NO: 601047 - RNA, 64 nt, hsa; identical to SEQ ID NO: 124983

SEQ ID NO: 601048 - RNA, 64 nt, hsa; identical to SEQ ID NO: 124984

SEQ ID NO: 601049 - RNA, 64 nt, hsa; identical to SEQ ID NO: 124985

SEQ ID NO: 601050 - RNA, 64 nt, hsa; identical to SEQ ID NO: 124986

SEQ ID NO: 601051 - RNA, 64 nt, hsa; identical to SEQ ID NO: 124987

SEQ ID NO: 601052 - RNA, 64 nt, hsa; identical to SEQ ID NO: 124988

SEQ ID NO: 601053 - RNA, 64 nt, hsa; identical to SEQ ID NO: 124989

SEQ ID NO: 601054 - RNA, 64 nt, hsa; identical to SEQ ID NO: 124990

SEQ ID NO: 601055 - RNA, 64 nt, hsa; identical to SEQ ID NO: 124991

SEQ ID NO: 601056 - RNA, 64 nt, hsa; identical to SEQ ID NO: 124992

SEQ ID NO: 601057 - RNA, 64 nt, hsa; identical to SEQ ID NO: 124993

SEQ ID NO: 601058 - RNA, 64 nt, hsa; identical to SEQ ID NO: 124994

SEQ ID NO: 601059 - RNA, 64 nt, hsa; identical to SEQ ID NO: 124995

SEQ ID NO: 601060 - RNA, 64 nt, hsa; identical to SEQ ID NO: 124996

SEQ ID NO: 601061 - RNA, 64 nt, hsa; identical to SEQ ID NO: 124997

SEQ ID NO: 601062 - RNA, 64 nt, hsa; identical to SEQ ID NO: 124998

SEQ ID NO: 601063 - RNA, 64 nt, hsa; identical to SEQ ID NO: 124999

SEQ ID NO: 601064 - RNA, 64 nt, hsa; identical to SEQ ID NO: 125000

SEQ ID NO: 601065 - RNA, 64 nt, hsa; identical to SEQ ID NO: 125001

SEQ ID NO: 601066 - RNA, 64 nt, hsa; identical to SEQ ID NO: 125002

SEQ ID NO: 601067 - RNA, 64 nt, hsa; identical to SEQ ID NO: 103765

SEQ ID NO: 601068 - RNA, 64 nt, hsa; identical to SEQ ID NO: 103766

SEQ ID NO: 601069 - RNA, 53 nt, hsa; identical to SEQ ID NO: 103767

SEQ ID NO: 601070 - RNA, 64 nt, hsa; identical to SEQ ID NO: 103768

SEQ ID NO: 601071 - RNA, 64 nt, hsa; identical to SEQ ID NO: 103769

SEQ ID NO: 601072 - RNA, 64 nt, hsa; identical to SEQ ID NO: 103770

SEQ ID NO: 601073 - RNA, 53 nt, hsa; identical to SEQ ID NO: 103771

SEQ ID NO: 601074 - RNA, 64 nt, hsa; identical to SEQ ID NO: 103772

SEQ ID NO: 601075 - RNA, 64 nt, hsa; identical to SEQ ID NO: 103773

SEQ ID NO: 601076 - RNA, 64 nt, hsa; identical to SEQ ID NO: 103774

SEQ ID NO: 601077 - RNA, 64 nt, hsa; identical to SEQ ID NO: 103775

SEQ ID NO: 601078 - RNA, 64 nt, hsa; identical to SEQ ID NO: 103776

SEQ ID NO: 601079 - RNA, 64 nt, hsa
uagcuccauagggaagccugugucuccugcccccagggcgcacccucagugcaggcaccucugu

SEQ ID NO: 601080 - RNA, 64 nt, hsa
ggugcaaucuuggcucacugcaaccuccgccuccagggcgcagccuccugaguagcugggagga

SEQ ID NO: 601081 - RNA, 64 nt, hsa
cccacccuugcccaccccacccccacccccaccaagggcgcaagaguagcgguccaagccugca

SEQ ID NO: 601082 - RNA, 64 nt, hsa
ggcacugagcugccgccuggugaagggggcgcccagggcgcauggggccuccuuggccuccucu

SEQ ID NO: 601083 - RNA, 64 nt, hsa
aggggcagaaguuuugaaugcacuuaaccggaggagggcgcagggugggggguaucaaagaagg

SEQ ID NO: 601084 - RNA, 64 nt, hsa
uuuuccagauggcuucagaaguaggcucgugggcagggcgcagaccugaucuuuauaggguuga

SEQ ID NO: 601085 - RNA, 64 nt, hsa
ggacgugaugcaaaauaaccgaugcccuacaaaaagggcgcaucuuuaagaguuuuaaugccag

SEQ ID NO: 601086 - RNA, 64 nt, hsa
gaacucagcagaaaguggcaagaagagggcgauuagggcgcagaacuuuggaagcugcuacuua

SEQ ID NO: 601087 - RNA, 64 nt, hsa
gguugaugcauauuuccccguuuaaguagccguuagggcgcaguaucggcagcuugacacccac

SEQ ID NO: 601088 - RNA, 64 nt, hsa
gggaguuauuuugauacugcgaugaguaaggguaagggcgcauggaauggggcuaaggugggag

SEQ ID NO: 601089 - RNA, 64 nt, hsa
gcuuucccagagacccggggauggauuggccuccagggcgcaggggagggugcggcagggcagg

SEQ ID NO: 601090 - RNA, 64 nt, hsa
uggugcucuaggcugugcugagcccacucucccgagggcgcauccaagcgggggccacuugaga

SEQ ID NO: 601091 - RNA, 64 nt, hsa
cucacggaauguaaguguugagguuucugcaaagagggcgcaggcccugcagugacgguucaga

SEQ ID NO: 601092 - RNA, 64 nt, hsa
gaaucacaucaaugcgaacgucacagcgccuucgagggcgcagauuuuaacugccacguauuuu

SEQ ID NO: 601093 - RNA, 64 nt, hsa
ggaacguucacucacaggguacgcucauggagagagggcgcagagcaaaccaugucacgccauc

SEQ ID NO: 601094 - RNA, 64 nt, hsa
cucagaggaacacccagcgcugcggucuggucucagggcgcaaacacaucccugcacccggugg

SEQ ID NO: 601095 - RNA, 64 nt, hsa
cugucccgcgugcggguccccuccuggccggcagagggcgcaggagcccaggagauggccucag

SEQ ID NO: 601096 - RNA, 64 nt, hsa
cccggagccaguaacccggcgccuccuccuccccagggcgcagcgcuggcugcuccccggauac

SEQ ID NO: 601097 - RNA, 64 nt, hsa
cgucccagguacccggugggaaaguggcagugcgagggcgcagccauuggugguugcagggccc

SEQ ID NO: 601098 - RNA, 64 nt, hsa
gaaccaugccccauauaacgcuugggugcgugggagggcgcacaucagggcagaggccaaguuc

SEQ ID NO: 601099 - RNA, 64 nt, hsa
gcugcuggaauauuucuggcuuuagaaguacaggagggcgcagauggcuaacugaguaacauuc

SEQ ID NO: 601100 - RNA, 64 nt, hsa
cugcccgguucccagcugcugcggaggcaggcugagggcgcaggggcugccgagugcugugcac

SEQ ID NO: 601101 - RNA, 64 nt, hsa
cgcugugggaggccggucggcagccacucccuccagggcgcaccugcaggucugccauccacgg

SEQ ID NO: 601102 - RNA, 64 nt, hsa
ugaaggacagaguccuggguggggcagcggcugcagggcgcaccagagaacccagccagagggg

SEQ ID NO: 601103 - RNA, 64 nt, hsa
cgucuccgccagaggccaccccggcccggccuccagggcgcagaggcgccccccuccauccucc

SEQ ID NO: 601104 - RNA, 64 nt, hsa
gggcucggcguggccccuuccgcccgccuuucugagggcgcagguucgacgcccuuucccggga

SEQ ID NO: 601105 - RNA, 64 nt, hsa
aagaacuucccaugguagaauggggugggggaggagggcgcacgggcugagcggauaggggcgg

SEQ ID NO: 601106 - RNA, 64 nt, hsa
gagagggaaccugcucacggcccugcagcagagcagggcgcaaacccaggacaucugugccagg

SEQ ID NO: 601107 - RNA, 64 nt, hsa
gacccgguaggggcagucugggcagcaggaaggaagggcgcagcguccccuccuucagaggagg

SEQ ID NO: 601108 - RNA, 64 nt, hsa
cguaacugguucccugaccaggucaccgacgaugagggcgcaccugcuguccuggagcuuccga

SEQ ID NO: 601109 - RNA, 64 nt, hsa
cacaaacugauuucucacggcgugucaccccaccagggcgcaagccucacuauuacuugaacuu

SEQ ID NO: 601110 - RNA, 62 nt, hsa
guggcucagaugaggaaugagccgagaugcggagggcgcagaugucccacugcacagcugga

SEQ ID NO: 601111 - RNA, 64 nt, hsa
auccuaugaccaggcuuuuagaggaccuucccuaagggcgcagcuucggagcaggaucugucca

SEQ ID NO: 601112 - RNA, 64 nt, hsa
acaggacugaagcacugaaaggguccugccguuaagggcgcaggauuguauagaauauauaaua

SEQ ID NO: 601113 - RNA, 64 nt, hsa
acacccaaaccagucuaucagggaggcugaagcaagggcgcagugugauauuuuaggaauacag

SEQ ID NO: 601114 - RNA, 64 nt, hsa
cacuucagugcagugugguguagguguuacgcgaagggcgcacagugucuagaaauacuugauc

SEQ ID NO: 601115 - RNA, 64 nt, hsa
guagccacggagccgggacccagaggggcagcgcagggcgcagagcacacccgcugggccagca

SEQ ID NO: 601116 - RNA, 64 nt, hsa
gaacacggggagcagaggccaaagcacuaaggggagggcgcauacccgagacgauuguaugaag

SEQ ID NO: 601117 - RNA, 64 nt, hsa
caggccugggcccagcuccgggcuggcuuuuugcagggcgcagguggaggggacaggucugccg

SEQ ID NO: 601118 - RNA, 64 nt, hsa
gagaaguccccuuccaucccagagggugggcuucagggcgcacagcaugagaggcucugugccc

SEQ ID NO: 601119 - RNA, 64 nt, hsa
auuugcugagcgccuccuaguugccaggcacuggagggcgcaucaaagaagaguccuacccagg

SEQ ID NO: 601120 - RNA, 64 nt, hsa
uggcgguguccugcggaccccagagcccccgggaagggcgcaagucaaagagcacuggaggcac

SEQ ID NO: 601121 - RNA, 64 nt, hsa
ggaguuggaacccugggcgucgagacaggaaggcagggcgcagugguugaaacaucaggacacu

SEQ ID NO: 601122 - RNA, 64 nt, hsa
ggaagagggagggucagugccaagucucaggaggagggcgcauguguguaucacccucagcugg

SEQ ID NO: 601123 - RNA, 64 nt, hsa
gggagaacauugaguccuguuuuccauuggcuucagggcgcauccauguggauauaggaaaagc

SEQ ID NO: 601124 - RNA, 57 nt, hsa
aguacgaugccccgcuuuaagggguaaagggcgcaaagggcaugggucgggagaggg

SEQ ID NO: 601125 - RNA, 64 nt, hsa
cgccccuccacaggacccuggaccagggcggugcagggcgcagcccugaggaggcagguggagg

SEQ ID NO: 601126 - RNA, 64 nt, hsa
ccuggggacacaucugcccacagcugcacaggccagggcgcaggcacaucuguugguucucagg

SEQ ID NO: 601127 - RNA, 64 nt, hsa
ggaggaagggggcagagagaguuaugaccccgagagggcgcacagaccaagcgugagcuccacg

SEQ ID NO: 601128 - RNA, 64 nt, hsa
cggagcccagagcgcgcgucgaaccgucggcccgagggcgcagaccugaggcgaggccaccccc

SEQ ID NO: 601129 - RNA, 64 nt, hsa
cucuuaguccaguagcugcauggugagugagcguagggcgcacccuggaaggcugccaagccca

SEQ ID NO: 601130 - RNA, 64 nt, hsa
ugaaugucaggaauguaggaaggccuuuaggcagagggcgcaucuuacucaacaucaaagaauu

SEQ ID NO: 601131 - RNA, 64 nt, hsa
ccaguggacucgcgagagggugccgcgggcgagaagggcgcaggaaccgaggacuccaggggcu

SEQ ID NO: 601132 - RNA, 64 nt, hsa
gaaaaaauaccaaauguaagagaaccuccaagucagggcgcaguggcucaccccuguaaucuca

SEQ ID NO: 601133 - RNA, 64 nt, hsa
cuguagacuggucuggccugcuggccugggcgucagggcgcaucaauaaaguacuuggaccagu

SEQ ID NO: 601134 - RNA, 64 nt, hsa
uuggccucaugaagucucagguccguguucccgcagggcgcacaugcuuggagaguccucagca

SEQ ID NO: 601135 - RNA, 64 nt, hsa
gcuggcccaggcccugcagcggcagccuuuccacagggcgcagcggcggccuuucgaggcccuu

SEQ ID NO: 601136 - RNA, 64 nt, hsa
agguggggccggggacuggccacugaauuaugccagggcgcacuuuccacuggaguucacuuuc

SEQ ID NO: 601137 - RNA, 64 nt, hsa
cuuugagcucagaaaauaucccuccuguugggagagggcgcaggccgugacgucuggguggccc

SEQ ID NO: 601138 - RNA, 64 nt, hsa
gucugcgggcugggaacucucguccucgguccccagggcgcagcuguuggggcugcgggggagu

SEQ ID NO: 601139 - RNA, 64 nt, hsa; identical to SEQ ID NO: 430360

SEQ ID NO: 601140 - RNA, 64 nt, hsa; identical to SEQ ID NO: 430361

SEQ ID NO: 601141 - RNA, 64 nt, hsa; identical to SEQ ID NO: 430362

SEQ ID NO: 601142 - RNA, 64 nt, hsa; identical to SEQ ID NO: 430363

SEQ ID NO: 601143 - RNA, 64 nt, hsa; identical to SEQ ID NO: 430364

SEQ ID NO: 601144 - RNA, 64 nt, hsa; identical to SEQ ID NO: 430365

SEQ ID NO: 601145 - RNA, 64 nt, hsa; identical to SEQ ID NO: 430366

SEQ ID NO: 601146 - RNA, 64 nt, hsa; identical to SEQ ID NO: 430367

SEQ ID NO: 601147 - RNA, 64 nt, hsa; identical to SEQ ID NO: 430368

SEQ ID NO: 601148 - RNA, 64 nt, hsa; identical to SEQ ID NO: 430369

SEQ ID NO: 601149 - RNA, 64 nt, hsa; identical to SEQ ID NO: 430370

SEQ ID NO: 601150 - RNA, 64 nt, hsa; identical to SEQ ID NO: 430371

SEQ ID NO: 601151 - RNA, 64 nt, hsa; identical to SEQ ID NO: 430372

SEQ ID NO: 601152 - RNA, 64 nt, hsa; identical to SEQ ID NO: 279869

SEQ ID NO: 601153 - RNA, 64 nt, hsa; identical to SEQ ID NO: 279870

SEQ ID NO: 601154 - RNA, 64 nt, hsa; identical to SEQ ID NO: 279871

SEQ ID NO: 601155 - RNA, 64 nt, hsa; identical to SEQ ID NO: 279871

SEQ ID NO: 601156 - RNA, 64 nt, hsa; identical to SEQ ID NO: 279873

SEQ ID NO: 601157 - RNA, 64 nt, hsa; identical to SEQ ID NO: 279874

SEQ ID NO: 601158 - RNA, 64 nt, hsa; identical to SEQ ID NO: 279875

SEQ ID NO: 601159 - RNA, 64 nt, hsa; identical to SEQ ID NO: 279876

SEQ ID NO: 601160 - RNA, 64 nt, hsa; identical to SEQ ID NO: 279877

SEQ ID NO: 601161 - RNA, 64 nt, hsa; identical to SEQ ID NO: 279878

SEQ ID NO: 601162 - RNA, 64 nt, hsa; identical to SEQ ID NO: 279879

SEQ ID NO: 601163 - RNA, 64 nt, hsa; identical to SEQ ID NO: 279880

SEQ ID NO: 601164 - RNA, 64 nt, hsa; identical to SEQ ID NO: 279881

SEQ ID NO: 601165 - RNA, 64 nt, hsa; identical to SEQ ID NO: 279882

SEQ ID NO: 601166 - RNA, 64 nt, hsa; identical to SEQ ID NO: 279883

SEQ ID NO: 601167 - RNA, 64 nt, hsa; identical to SEQ ID NO: 279884

SEQ ID NO: 601168 - RNA, 64 nt, hsa; identical to SEQ ID NO: 279885

SEQ ID NO: 601169 - RNA, 64 nt, hsa; identical to SEQ ID NO: 279886

SEQ ID NO: 601170 - RNA, 64 nt, hsa; identical to SEQ ID NO: 279887

SEQ ID NO: 601171 - RNA, 64 nt, hsa; identical to SEQ ID NO: 279888

SEQ ID NO: 601172 - RNA, 64 nt, hsa; identical to SEQ ID NO: 279889

SEQ ID NO: 601173 - RNA, 64 nt, hsa; identical to SEQ ID NO: 279890

SEQ ID NO: 601174 - RNA, 64 nt, hsa; identical to SEQ ID NO: 279891

SEQ ID NO: 601175 - RNA, 64 nt, hsa; identical to SEQ ID NO: 279892

SEQ ID NO: 601176 - RNA, 64 nt, hsa; identical to SEQ ID NO: 279893

SEQ ID NO: 601177 - RNA, 64 nt, hsa; identical to SEQ ID NO: 279894

SEQ ID NO: 601178 - RNA, 64 nt, hsa; identical to SEQ ID NO: 279895

SEQ ID NO: 601179 - RNA, 64 nt, hsa; identical to SEQ ID NO: 279896

SEQ ID NO: 601180 - RNA, 64 nt, hsa; identical to SEQ ID NO: 279897

SEQ ID NO: 601181 - RNA, 64 nt, hsa; identical to SEQ ID NO: 279898

SEQ ID NO: 601182 - RNA, 64 nt, hsa; identical to SEQ ID NO: 279898

SEQ ID NO: 601183 - RNA, 64 nt, hsa
uucauauauggcucuauucuuagaaauauaauuugaaugugaucuuucaauagucugaauauuu

SEQ ID NO: 601184 - RNA, 64 nt, hsa
ccagaguuggggcauugaggaagagauauuucuggaaugugagacuuguuaugccucugucucu

SEQ ID NO: 601185 - RNA, 64 nt, hsa
aauccauacuagagagaagcccuacaaauguaaagaaugugaaaagucuuucagucagagcuca

SEQ ID NO: 601186 - RNA, 64 nt, hsa
gcaucagauaauucacaccagagagaaacccucugaaugugacgaaugaagaaaagguauuagu

SEQ ID NO: 601187 - RNA, 64 nt, hsa
aauucacaugggaauaaaauuccauugcugcaaugaaugugaaaaagccaucagucaaagaaac

SEQ ID NO: 601188 - RNA, 64 nt, hsa
uuaaacacuugcaaccuaccuguugagcaucacagaaugugauaaggaaaucaacuugcuuauc

SEQ ID NO: 601189 - RNA, 64 nt, hsa
agacucuuuaugcuugcaaaaacuacaaccaauggaaugugauguucauggguauaguucaugu

SEQ ID NO: 601190 - RNA, 64 nt, hsa
gcauaagauaauucauacuggagagaaacccuaugaaugugaugaaugugggaaagccuuuaac

SEQ ID NO: 601191 - RNA, 64 nt, hsa
aguuuauauggaacacaaacccuacaaauauaaagaaugugacaaagcuuuuuaaggaaguucu

SEQ ID NO: 601192 - RNA, 64 nt, hsa
aauucauaccauagagaaauccuacaaauaugaagaaugugacaaagcuuuuaaccacuucuca

SEQ ID NO: 601193 - RNA, 64 nt, hsa
aauucauacaggagagaaacccuacaaaugugaagaaugugacaaagccuuuaaccaguccuca

SEQ ID NO: 601194 - RNA, 64 nt, hsa
aaaucauaugaaugagaaauccuagaaaugugaagaaugugacaaagccuuuaaauggcuguca

SEQ ID NO: 601195 - RNA, 64 nt, hsa
aauucauacuggagagaaacccuacaaaugcgaagaaugugauaaagacuucaacuguuccuca

SEQ ID NO: 601196 - RNA, 64 nt, hsa
aauucaugcuggagagaaacacuacaaacgugaagaaugugacaaaggcuucaaccgguccuca

SEQ ID NO: 601197 - RNA, 64 nt, hsa
aauucauaguggagagaaaccuuacaagcacaaugaaugugacaugguuuuuaaucaacaauca

SEQ ID NO: 601198 - RNA, 64 nt, hsa
acuucauacuggagagaaaccuuacaaaugggaggaaugugacaaaaguuuucaguuguaaauc

SEQ ID NO: 601199 - RNA, 64 nt, hsa
guauucuugagaaaaagauaaaggguuauaauuugaaugugaacugauccagaaauaagugcug

SEQ ID NO: 601200 - RNA, 64 nt, hsa
gggaauauauuuauauuuuucuaugaaaaguuaugaaugugacuaaaucaugacuguuauuuuu

SEQ ID NO: 601201 - RNA, 64 nt, hsa; identical to SEQ ID NO: 411023

SEQ ID NO: 601202 - RNA, 64 nt, hsa; identical to SEQ ID NO: 411024

SEQ ID NO: 601203 - RNA, 64 nt, hsa; identical to SEQ ID NO: 411025

SEQ ID NO: 601204 - RNA, 64 nt, hsa; identical to SEQ ID NO: 411026

SEQ ID NO: 601205 - RNA, 64 nt, hsa; identical to SEQ ID NO: 411027

SEQ ID NO: 601206 - RNA, 64 nt, hsa; identical to SEQ ID NO: 411028

SEQ ID NO: 601207 - RNA, 64 nt, hsa; identical to SEQ ID NO: 411029

SEQ ID NO: 601208 - RNA, 64 nt, hsa; identical to SEQ ID NO: 411030

SEQ ID NO: 601209 - RNA, 64 nt, hsa; identical to SEQ ID NO: 411031

SEQ ID NO: 601210 - RNA, 64 nt, hsa; identical to SEQ ID NO: 411032

SEQ ID NO: 601211 - RNA, 64 nt, hsa; identical to SEQ ID NO: 411033

SEQ ID NO: 601212 - RNA, 64 nt, hsa; identical to SEQ ID NO: 411034

SEQ ID NO: 601213 - RNA, 64 nt, hsa; identical to SEQ ID NO: 411035

SEQ ID NO: 601214 - RNA, 64 nt, hsa; identical to SEQ ID NO: 411036

SEQ ID NO: 601215 - RNA, 64 nt, hsa
ucucuguuuaccugccuaggaaaacauuuuauggcagucuuaugugcaaagaucguaaaaggac

SEQ ID NO: 601216 - RNA, 64 nt, hsa
ccaguguuaguagcugcucccuguauuaugugaacagucuuauucuauguacacagauguaauu

SEQ ID NO: 601217 - RNA, 64 nt, hsa
uuuaguuacagugcccauuuugaaauugccuauacagucuuagugaccauuuaaaccggacgaa

SEQ ID NO: 601218 - RNA, 64 nt, hsa
ucagccagguuuugccacuacccuauaauuagugcagucuuauguuauaaaagaaagaaguuaa

SEQ ID NO: 601219 - RNA, 64 nt, hsa
auuauauaauuuucuaauuugaaaucaugacaagcagucuuagaacaaaguuaaaauuaaaaag

SEQ ID NO: 601220 - RNA, 64 nt, hsa
uacaggcgugagccacugcaccuggccucuguugcagucuuaucuucauuuuccuuuguuuaua

SEQ ID NO: 601221 - RNA, 64 nt, hsa
uguguaguguuuuacaauuuuugaagcucuuucacagucuuauuugaccuucacagucauucug

SEQ ID NO: 601222 - RNA, 64 nt, hsa
uguaagauagcacacaaguagaaauauuuaaaagcagucuuauucacagauugcaguaauucug

SEQ ID NO: 601223 - RNA, 64 nt, hsa
uggguuaccgucucaugugaaccuggagauucaccagucuuaacuuuugggucauuguguuuuc

SEQ ID NO: 601224 - RNA, 64 nt, hsa
cuacagagaacauacagcagccuucuuuggaccacagucuuauccgaggggucugugguuguau

SEQ ID NO: 601225 - RNA, 64 nt, hsa
caacaauuuaguugaaugacucccuuccaucuaucagucuuacuccaaauauaugaaauuacua

SEQ ID NO: 601226 - RNA, 64 nt, hsa
gaagugaaggcuuuugagguuuauaaaaugguagcagucuuaguccuugcccugccucaguuua

SEQ ID NO: 601227 - RNA, 64 nt, hsa
guaguguagucaggugcucaauggagaauauaaacauauacagaaaaauauauauuuuaaguuu

SEQ ID NO: 601228 - RNA, 64 nt, hsa
gauagucacagugauaccaguucagacacuaccccauauacaccuggaacauugaggauggaaa

SEQ ID NO: 601229 - RNA, 64 nt, hsa
aauaaacagacaaaaacaaguaaauauauauggucauauacauauuguauauauauucauauac

SEQ ID NO: 601230 - RNA, 64 nt, hsa
auauauauggucauauacauauuguauauauauucauauacaaacauguauguauacaugaccu

SEQ ID NO: 601231 - RNA, 64 nt, hsa
uuggagauaucuuccaucaagcaguacucgugcccauauacaaucucuuaguggcuaggagaaa

SEQ ID NO: 601232 - RNA, 64 nt, hsa
gagagaaaacaaaccuaaguuuacuuuacuuguacauauacacuacaauggauaguauauuugc

SEQ ID NO: 601233 - RNA, 64 nt, hsa
caugauuuucuagauacacagucuaugcauuauucauauacauuuauuuuagccuaaagugguu

SEQ ID NO: 601234 - RNA, 64 nt, hsa
uugaauauucuugaacaccaccacugaagaguuucauauacaccaaauaaugucucaucucuau

SEQ ID NO: 601235 - RNA, 64 nt, hsa
uauacacaucuauguauggauauguguguauacacauauacacaucucuguccaaaauuuccuc

SEQ ID NO: 601236 - RNA, 64 nt, hsa
ucuguacauauacaugugaguguacauauauacacauauacacaucuauguauggauaugugug

SEQ ID NO: 601237 - RNA, 64 nt, hsa
uauguguguggauauagaugcacacauaucuguacauauacaugugaguguacauauauacaca

SEQ ID NO: 601238 - RNA, 64 nt, hsa
uaugcaugcauguguauaaagaugcacaugcguacauauacauaacauacacacaauauguauu

SEQ ID NO: 601239 - RNA, 64 nt, hsa
guagaaagguugaacugguuuuucagcuauaaugcauauacaacuauaguguguacguauacca

SEQ ID NO: 601240 - RNA, 64 nt, hsa
aaugcauauacaacuauaguguguacguauaccacauauacauauacuuguaugaagauaugug

SEQ ID NO: 601241 - RNA, 64 nt, hsa
cagauuaauuuauauauauauauauacacacacacauauacaguauaaauacucauuugauucu

SEQ ID NO: 601242 - RNA, 64 nt, hsa
agucauauucauagacacagaaucaagcuuuuaacauauacauccaccucuauauguuaaauaa

SEQ ID NO: 601243 - RNA, 64 nt, hsa
uguacauauacauguauauacacacagacacaugcauauacaugaauauaccuugagcaugaau

SEQ ID NO: 601244 - RNA, 64 nt, hsa
uaaaugcauguguauauauaugcaaauauauguacauauacauguauauacacacagacacaug

SEQ ID NO: 601245 - RNA, 64 nt, hsa
gacucaagacuaaacaugaaauucauuuaugcuucauauacaccuuauauacauagccuaaagg

SEQ ID NO: 601246 - RNA, 64 nt, hsa
gaaguguuuugaauuucagauuuuggaauauuugcauauacaugcgauaucuuggggaugagac

SEQ ID NO: 601247 - RNA, 64 nt, hsa; identical to SEQ ID NO: 380943

SEQ ID NO: 601248 - RNA, 64 nt, hsa; identical to SEQ ID NO: 380944

SEQ ID NO: 601249 - RNA, 64 nt, hsa; identical to SEQ ID NO: 380945

SEQ ID NO: 601250 - RNA, 64 nt, hsa; identical to SEQ ID NO: 380946

SEQ ID NO: 601251 - RNA, 64 nt, hsa; identical to SEQ ID NO: 380947

SEQ ID NO: 601252 - RNA, 64 nt, hsa; identical to SEQ ID NO: 380948

SEQ ID NO: 601253 - RNA, 64 nt, hsa; identical to SEQ ID NO: 380949

SEQ ID NO: 601254 - RNA, 64 nt, hsa; identical to SEQ ID NO: 380950

SEQ ID NO: 601255 - RNA, 64 nt, hsa; identical to SEQ ID NO: 380951

SEQ ID NO: 601256 - RNA, 64 nt, hsa; identical to SEQ ID NO: 380952

SEQ ID NO: 601257 - RNA, 64 nt, hsa; identical to SEQ ID NO: 380953

SEQ ID NO: 601258 - RNA, 64 nt, hsa; identical to SEQ ID NO: 380954

SEQ ID NO: 601259 - RNA, 64 nt, hsa; identical to SEQ ID NO: 380955

SEQ ID NO: 601260 - RNA, 64 nt, hsa; identical to SEQ ID NO: 380956

SEQ ID NO: 601261 - RNA, 64 nt, hsa; identical to SEQ ID NO: 380957

SEQ ID NO: 601262 - RNA, 64 nt, hsa; identical to SEQ ID NO: 380958

SEQ ID NO: 601263 - RNA, 64 nt, hsa; identical to SEQ ID NO: 380959

SEQ ID NO: 601264 - RNA, 64 nt, hsa; identical to SEQ ID NO: 380960

SEQ ID NO: 601265 - RNA, 64 nt, hsa; identical to SEQ ID NO: 380961

SEQ ID NO: 601266 - RNA, 64 nt, hsa; identical to SEQ ID NO: 380962

SEQ ID NO: 601267 - RNA, 64 nt, hsa; identical to SEQ ID NO: 380963

SEQ ID NO: 601268 - RNA, 64 nt, hsa; identical to SEQ ID NO: 380964

SEQ ID NO: 601269 - RNA, 64 nt, hsa; identical to SEQ ID NO: 380965

SEQ ID NO: 601270 - RNA, 64 nt, hsa; identical to SEQ ID NO: 380966

SEQ ID NO: 601271 - RNA, 64 nt, hsa; identical to SEQ ID NO: 380967

SEQ ID NO: 601272 - RNA, 64 nt, hsa; identical to SEQ ID NO: 380968

SEQ ID NO: 601273 - RNA, 64 nt, hsa; identical to SEQ ID NO: 380969

SEQ ID NO: 601274 - RNA, 64 nt, hsa; identical to SEQ ID NO: 380970

SEQ ID NO: 601275 - RNA, 64 nt, hsa; identical to SEQ ID NO: 380971

SEQ ID NO: 601276 - RNA, 64 nt, hsa; identical to SEQ ID NO: 484813

SEQ ID NO: 601277 - RNA, 64 nt, hsa; identical to SEQ ID NO: 484814

SEQ ID NO: 601278 - RNA, 64 nt, hsa; identical to SEQ ID NO: 484815

SEQ ID NO: 601279 - RNA, 64 nt, hsa; identical to SEQ ID NO: 484816

SEQ ID NO: 601280 - RNA, 64 nt, hsa; identical to SEQ ID NO: 484817

SEQ ID NO: 601281 - RNA, 64 nt, hsa; identical to SEQ ID NO: 484818

SEQ ID NO: 601282 - RNA, 64 nt, hsa; identical to SEQ ID NO: 484819

SEQ ID NO: 601283 - RNA, 64 nt, hsa; identical to SEQ ID NO: 484820

SEQ ID NO: 601284 - RNA, 64 nt, hsa; identical to SEQ ID NO: 484821

SEQ ID NO: 601285 - RNA, 64 nt, hsa; identical to SEQ ID NO: 484822

SEQ ID NO: 601286 - RNA, 64 nt, hsa; identical to SEQ ID NO: 484823

SEQ ID NO: 601287 - RNA, 64 nt, hsa; identical to SEQ ID NO: 484824

SEQ ID NO: 601288 - RNA, 64 nt, hsa; identical to SEQ ID NO: 484825

SEQ ID NO: 601289 - RNA, 64 nt, hsa; identical to SEQ ID NO: 484826

SEQ ID NO: 601290 - RNA, 64 nt, hsa
ccuuugcgcuuucgcaguccaguguuugccgcgguucccgcacggucaggccccaggacuggcu

SEQ ID NO: 601291 - RNA, 64 nt, hsa
caugccauugcaccuucuuuagucuugauugcccuucccgcauuuauugguguauuaaaaugac

SEQ ID NO: 601292 - RNA, 64 nt, hsa
aagggaaguuauuuuuaaaaagguacucugcauguucccgcaguaauguucugcacaacaguau

SEQ ID NO: 601293 - RNA, 64 nt, hsa
aggcacaagacguucuccucugcccgugaggagcuucccgcagccgccuggcccagccugggca

SEQ ID NO: 601294 - RNA, 64 nt, hsa
agcuacaccacagaugccagugguucaugccuucuucccgcaacuuuaggaaaauuuauuuauu

SEQ ID NO: 601295 - RNA, 64 nt, hsa
auauugcuucccugcuauuucccuccuugggcucuucccgcaaaucaacacuuucugcacuuau

SEQ ID NO: 601296 - RNA, 64 nt, hsa
caugggacaugaggggcagcuagacuucacccccuucccgcagaccugccuccagagcaaggag

SEQ ID NO: 601297 - RNA, 64 nt, hsa
auacuggcuucauuacacuuguacagccgaguucuucccgcauuacugcuguuuaauagaacgu

SEQ ID NO: 601298 - RNA, 64 nt, hsa
aggcauuaaauagaagaaucccugcuguuuaaauuucccgcauauuccaauucacuuuuaaaaa

SEQ ID NO: 601299 - RNA, 64 nt, hsa
ccccugcagguccucugcgauggcauugucucgguucccgcagugcugcaguguggaagggagu

SEQ ID NO: 601300 - RNA, 64 nt, hsa
aggcuguuggaguuucuguuuagggcauuaaaaauucccgcaaacuauaaagagcaauguuuuc

SEQ ID NO: 601301 - RNA, 64 nt, hsa
ccucagguugcugguugcugugugguuugguguguucccgcaaacccccuuugugcuguggggc

SEQ ID NO: 601302 - RNA, 64 nt, hsa
caagcuucacauaaagccuggcaagccaaggauguucccgcauucaccugcuuuugcaguaaua

SEQ ID NO: 601303 - RNA, 64 nt, hsa
uaaguguucgggggacaucagcaugugugguucuuucccgcacugauccccuccauuuuuuguu

SEQ ID NO: 601304 - RNA, 64 nt, hsa
cugguuccuacaguauccacuccauccucaaggcuucccgcagggccuuggggcacugccuugc

SEQ ID NO: 601305 - RNA, 64 nt, hsa
cucugcccagggaguccuugcgucccaugaggucuucccgcaaggccucucagacccagaugug

SEQ ID NO: 601306 - RNA, 64 nt, hsa
ccccagugugaaguuucuggcauagaguccuggcuucccgcagacgacuuucacacucugccau

SEQ ID NO: 601307 - RNA, 64 nt, hsa
aucaggggagcgcuccacuggauaagcauuuuauuucccgcauggcauaauguuuuugcacuaa

SEQ ID NO: 601308 - RNA, 64 nt, hsa
acugaccccaccugaaauucuuggccaguccucuuucccgcagcugcagagaggaggaagacua

SEQ ID NO: 601309 - RNA, 64 nt, hsa
cuguuguuuagcuuaccuuucugcuaggauuggcuucccgcagagggcagggcccauccuaagc

SEQ ID NO: 601310 - RNA, 64 nt, hsa
cuccccaggugccccccucaccuugaugggugcguucccgcagaccaaagagagugugacuccc

SEQ ID NO: 601311 - RNA, 64 nt, hsa
ccgaagguuuggccgccgcgggacaccuguuuccuucccgcagugucugcguccgcacagcaua

SEQ ID NO: 601312 - RNA, 64 nt, hsa
caggcaaaguccucagccagugcuuuagagcaacuucccgcaaaucagaaacucacugugauuc

SEQ ID NO: 601313 - RNA, 64 nt, hsa
cgcaagccccccagccucccacccuggucccaguuucccgcaaagugccucugggggacccccc

SEQ ID NO: 601314 - RNA, 64 nt, hsa
cacuauucucugccuuuuuuuuccuauuuauuucuucccgcacaaauuccacauagaggccuuc

SEQ ID NO: 601315 - RNA, 64 nt, hsa
uaugagaaaugaauguaacacuguggacauugacuucccgcauaaggcagggugacccccugaa

SEQ ID NO: 601316 - RNA, 64 nt, hsa
gcagaugaaugugucauguggcacaccuugucccuucccgcagcauuuccugguuccccccaga

SEQ ID NO: 601317 - RNA, 64 nt, hsa
cagccuuacccaccgcucuacgugucccgggcacuucccgcagccuucccgucccuuucucauc

SEQ ID NO: 601318 - RNA, 64 nt, hsa
ggaggggcuuggagcagagacggcagccccauccuucccgcagcaccagccugagccacagugg

SEQ ID NO: 601319 - RNA, 56 nt, hsa
gcaacagccccugugcgugauccuccuucccgcagccaccagcgugagcucucuga

SEQ ID NO: 601320 - RNA, 64 nt, hsa
gcucuuccgccaacccagcagcuacuuugugcaguucccgcaggccaugcagcgcugccgugac

SEQ ID NO: 601321 - RNA, 64 nt, hsa
ccaggggggcugcagcccucagcccccgccaggauucccgcaggcuccuggacuggaagcuccc

SEQ ID NO: 601322 - RNA, 64 nt, hsa
gaaaaccuuugugaauuacuucguuucuccaggauucccgcaguguugaggaauuccuuacucu

SEQ ID NO: 601323 - RNA, 64 nt, hsa
gaauauuaaauuauguuucgaaguccaguugucauucccgcauucagauuucauuugcuguugc

SEQ ID NO: 601324 - RNA, 64 nt, hsa
cccaaucuuccuucuuuugcuucucgcccaccucuucccgcacccagcaugcagcucugccucc

SEQ ID NO: 601325 - RNA, 64 nt, hsa
acugaguuggguuccuaaucuguuucuggccugauucccgcaugaguauuagggugaucuuaaa

SEQ ID NO: 601326 - RNA, 64 nt, hsa
cagcagucuguucuuggcugggucaacucugcuuuucccgcaaccugggguugucgggggagcg

SEQ ID NO: 601327 - RNA, 64 nt, hsa
acaggccagaguugggcucuagcuccuggugcuguucccgcauucacccacuggccuuucccac

SEQ ID NO: 601328 - RNA, 64 nt, hsa
aguuuacuucuaaucaugucccucucaauuuuauuucccgcaguccaggaguguuauguuuugc

SEQ ID NO: 601329 - RNA, 64 nt, hsa
agcgugcccucagccaagugcuuuggcccggugcuucccgcagcugcacagagaccuuggccac

SEQ ID NO: 601330 - RNA, 64 nt, hsa
ggagccaggcuggcccaguccugggccucggcccuucccgcaccgccgccagcgcccgcagaca

SEQ ID NO: 601331 - RNA, 64 nt, hsa
augcagguaaggugaaccagcugcacggaccagguucccgcaaaacauugccagcuagugaggc

SEQ ID NO: 601332 - RNA, 64 nt, hsa
aagccuuuugguuaccgccucaugaagaauaugcuucccgcauuguccuagucccaguuguauu

SEQ ID NO: 601333 - RNA, 64 nt, hsa
aguucucugagccgcggacaugcccucgcauugcuucccgcagagugcagagacaggaagcugg

SEQ ID NO: 601334 - RNA, 64 nt, hsa
gccagaggcuaaaaccccaggaccccugcuguccuucccgcagcuucuucuuggagucucaggg

SEQ ID NO: 601335 - RNA, 64 nt, hsa
uggacaaggaggcuguuucugcacaucagcucauuucccgcaccccauuucuugcuugauugcu

SEQ ID NO: 601336 - RNA, 64 nt, hsa
gccucagccagagcugccagagaaaggaaaccucuucccgcagccuggcuccuguguucccucu

SEQ ID NO: 601337 - RNA, 64 nt, hsa
uagccuuccucugcucugggaccagugguuuauuuucccgcaaacgcugagugacucggggccg

SEQ ID NO: 601338 - RNA, 64 nt, hsa
ggcagcccuccccgccccucuccuucaaggaggguucccgcagcuggggggugugcggaggcgc

SEQ ID NO: 601339 - RNA, 58 nt, hsa
aguuugugaagaaaaggugaagagcgaguucccgcaggcaaauuggaugggcgucugg

SEQ ID NO: 601340 - RNA, 64 nt, hsa
gccgugggaccgcgugagaauugaagcggugggguucccgcacccugggcuggcuggugguuuu

SEQ ID NO: 601341 - RNA, 64 nt, hsa
uaaguguucgggggacgucaacaugugugguuguuucccgcacugauccccuccauuuuuugug

SEQ ID NO: 601342 - RNA, 64 nt, hsa
ccugccgucaguucuuccuuucuccguggcuggcuucccgcacuagggaacggguuguaaaugg

SEQ ID NO: 601343 - RNA, 64 nt, hsa
uuucucuuccccuuccuguuucagacccccccauuucccgcacaugguguggggggcuggggga

SEQ ID NO: 601344 - RNA, 64 nt, hsa
uggcguguuccuugcucccuggguccgacauguguucccgcaccugcauggacugccccgguuc

SEQ ID NO: 601345 - RNA, 64 nt, hsa
cuuaaaggaaugcagugcucaaaaccuacccaaauucccgcaggauucuaccaaacccuucccc

SEQ ID NO: 601346 - RNA, 64 nt, hsa
gcaucgucuucccuuccgcagguggaggggccgcuucccgcaggcaucugagcucugugccggg

SEQ ID NO: 601347 - RNA, 64 nt, hsa
aaggacuuccacuucaacacuuccacuucaacaguucccgcacggccugaacgcuucuuaggcc

SEQ ID NO: 601348 - RNA, 64 nt, hsa
ccccagagcccaggcucggccugcccccaccccauucccgcagugggagcaaacugcaugccca

SEQ ID NO: 601349 - RNA, 64 nt, hsa
uucaagccugugcaaugcauuagggaugccuccuuucccgcaggggauggacgaucucccaccu

SEQ ID NO: 601350 - RNA, 64 nt, hsa
guuucucggaccguugacuuuauuugggggaguuuucccgcaguucaguuccugacugugcaag

SEQ ID NO: 601351 - RNA, 64 nt, hsa
gcacagggacacagccagagcccacggagggcccuucccgcaaagcagaagccgccagggcagg

SEQ ID NO: 601352 - RNA, 64 nt, hsa
gagaggacuuaaaagcagaaggaaaccgagaugcuucccgcagccguggacgauucuccaggac

SEQ ID NO: 601353 - RNA, 64 nt, hsa
caaaggugagagaucaccuucccuauccuccaccuucccgcagggaagacgaagccaggugcca

SEQ ID NO: 601354 - RNA, 64 nt, hsa
uuuggacauggccuauguaccuaacguggccuucuucccgcaccacccuugccugcgcuggccc

SEQ ID NO: 601355 - RNA, 64 nt, hsa
gagucccauuagcugugagaugccugugagagccuucccgcacccgucagaagcucagagccuu

SEQ ID NO: 601356 - RNA, 62 nt, hsa
ucagcaaacucuccaagugacccggagggacuuucccgcacccguauuuauacagcugcuuc

SEQ ID NO: 601357 - RNA, 64 nt, hsa
cccauagacagccugggggcaaguuagcacuuuauucccgcagcaguuccugaaugggguggcc

SEQ ID NO: 601358 - RNA, 64 nt, hsa
gcagggcuuggccucaugaagucucagguccguguucccgcagggcgcacaugcuuggagaguc

SEQ ID NO: 601359 - RNA, 64 nt, hsa
caguuucugaggucagacgagugucugcgaugucuucccgcacucuauucccccagccucuuuc

SEQ ID NO: 601360 - RNA, 64 nt, hsa
acauggauagacggagcuguggugcagagaacuuuucccgcaacaggugcaggacugccaggga

SEQ ID NO: 601361 - RNA, 64 nt, hsa
uaagagagcaguuuuugggcuuuauauucucaauuucccgcacagugccuagcacauagcaagg

SEQ ID NO: 601362 - RNA, 64 nt, hsa
uaucuuuacugucauucugaccauagccucuuuguucccgcauucgaacuuuugguucuuacuu

SEQ ID NO: 601363 - RNA, 64 nt, hsa
cccugcucacuccagucacauagagaauugguguuucccgcaguggggaugcagcuguuggaca

SEQ ID NO: 601364 - RNA, 64 nt, hsa
acggcucccacguccaggcuuaagguggaugcacuucccgcaccuccagucuucuguguagcag

SEQ ID NO: 601365 - RNA, 64 nt, hsa
agaaggagcagaauaaauguuuuacaacuccugauucccgcaugguuuuuauaauauucauaca

SEQ ID NO: 601366 - RNA, 64 nt, hsa
agauuccugaccauccucagaaucucaugccauuuucccgcagagcugagggauguggucagca

SEQ ID NO: 601367 - RNA, 64 nt, hsa; identical to SEQ ID NO: 282773

SEQ ID NO: 601368 - RNA, 64 nt, hsa; identical to SEQ ID NO: 282774

SEQ ID NO: 601369 - RNA, 64 nt, hsa; identical to SEQ ID NO: 282775

SEQ ID NO: 601370 - RNA, 64 nt, hsa; identical to SEQ ID NO: 282776

SEQ ID NO: 601371 - RNA, 64 nt, hsa; identical to SEQ ID NO: 282777

SEQ ID NO: 601372 - RNA, 64 nt, hsa; identical to SEQ ID NO: 282778

SEQ ID NO: 601373 - RNA, 64 nt, hsa; identical to SEQ ID NO: 282779

SEQ ID NO: 601374 - RNA, 64 nt, hsa; identical to SEQ ID NO: 282780

SEQ ID NO: 601375 - RNA, 64 nt, hsa; identical to SEQ ID NO: 282781

SEQ ID NO: 601376 - RNA, 64 nt, hsa; identical to SEQ ID NO: 282782

SEQ ID NO: 601377 - RNA, 64 nt, hsa; identical to SEQ ID NO: 282783

SEQ ID NO: 601378 - RNA, 54 nt, hsa; identical to SEQ ID NO: 282784

SEQ ID NO: 601379 - RNA, 64 nt, hsa; identical to SEQ ID NO: 282785

SEQ ID NO: 601380 - RNA, 64 nt, hsa; identical to SEQ ID NO: 282786

SEQ ID NO: 601381 - RNA, 64 nt, hsa; identical to SEQ ID NO: 282787

SEQ ID NO: 601382 - RNA, 64 nt, hsa; identical to SEQ ID NO: 282788

SEQ ID NO: 601383 - RNA, 64 nt, hsa; identical to SEQ ID NO: 282789

SEQ ID NO: 601384 - RNA, 64 nt, hsa; identical to SEQ ID NO: 282790

SEQ ID NO: 601385 - RNA, 64 nt, hsa; identical to SEQ ID NO: 282791

SEQ ID NO: 601386 - RNA, 64 nt, hsa; identical to SEQ ID NO: 282792

SEQ ID NO: 601387 - RNA, 64 nt, hsa; identical to SEQ ID NO: 282793

SEQ ID NO: 601388 - RNA, 64 nt, hsa; identical to SEQ ID NO: 282794

SEQ ID NO: 601389 - RNA, 64 nt, hsa; identical to SEQ ID NO: 282795

SEQ ID NO: 601390 - RNA, 64 nt, hsa; identical to SEQ ID NO: 282796

SEQ ID NO: 601391 - RNA, 64 nt, hsa; identical to SEQ ID NO: 282797

SEQ ID NO: 601392 - RNA, 64 nt, hsa; identical to SEQ ID NO: 282798

SEQ ID NO: 601393 - RNA, 64 nt, hsa; identical to SEQ ID NO: 282799

SEQ ID NO: 601394 - RNA, 64 nt, hsa; identical to SEQ ID NO: 282800

SEQ ID NO: 601395 - RNA, 64 nt, hsa; identical to SEQ ID NO: 282801

SEQ ID NO: 601396 - RNA, 64 nt, hsa; identical to SEQ ID NO: 282802

SEQ ID NO: 601397 - RNA, 64 nt, hsa; identical to SEQ ID NO: 282803

SEQ ID NO: 601398 - RNA, 64 nt, hsa; identical to SEQ ID NO: 282804

SEQ ID NO: 601399 - RNA, 64 nt, hsa; identical to SEQ ID NO: 282805

SEQ ID NO: 601400 - RNA, 64 nt, hsa; identical to SEQ ID NO: 282806

SEQ ID NO: 601401 - RNA, 64 nt, hsa; identical to SEQ ID NO: 282807

SEQ ID NO: 601402 - RNA, 64 nt, hsa; identical to SEQ ID NO: 282808

SEQ ID NO: 601403 - RNA, 64 nt, hsa; identical to SEQ ID NO: 282809

SEQ ID NO: 601404 - RNA, 64 nt, hsa; identical to SEQ ID NO: 282810

SEQ ID NO: 601405 - RNA, 64 nt, hsa; identical to SEQ ID NO: 282811

SEQ ID NO: 601406 - RNA, 64 nt, hsa; identical to SEQ ID NO: 282812

SEQ ID NO: 601407 - RNA, 64 nt, hsa; identical to SEQ ID NO: 282813

SEQ ID NO: 601408 - RNA, 64 nt, hsa; identical to SEQ ID NO: 282814

SEQ ID NO: 601409 - RNA, 64 nt, hsa; identical to SEQ ID NO: 282815

SEQ ID NO: 601410 - RNA, 64 nt, hsa; identical to SEQ ID NO: 282816

SEQ ID NO: 601411 - RNA, 64 nt, hsa; identical to SEQ ID NO: 282817

SEQ ID NO: 601412 - RNA, 64 nt, hsa; identical to SEQ ID NO: 282818

SEQ ID NO: 601413 - RNA, 64 nt, hsa; identical to SEQ ID NO: 282819

SEQ ID NO: 601414 - RNA, 64 nt, hsa; identical to SEQ ID NO: 282820

SEQ ID NO: 601415 - RNA, 64 nt, hsa; identical to SEQ ID NO: 282821

SEQ ID NO: 601416 - RNA, 64 nt, hsa; identical to SEQ ID NO: 282822

SEQ ID NO: 601417 - RNA, 64 nt, hsa; identical to SEQ ID NO: 282823

SEQ ID NO: 601418 - RNA, 64 nt, hsa; identical to SEQ ID NO: 282824

SEQ ID NO: 601419 - RNA, 64 nt, hsa; identical to SEQ ID NO: 282825

SEQ ID NO: 601420 - RNA, 64 nt, hsa; identical to SEQ ID NO: 282826

SEQ ID NO: 601421 - RNA, 64 nt, hsa; identical to SEQ ID NO: 282827

SEQ ID NO: 601422 - RNA, 64 nt, hsa; identical to SEQ ID NO: 282828

SEQ ID NO: 601423 - RNA, 64 nt, hsa; identical to SEQ ID NO: 282829

SEQ ID NO: 601424 - RNA, 64 nt, hsa; identical to SEQ ID NO: 282830

SEQ ID NO: 601425 - RNA, 64 nt, hsa; identical to SEQ ID NO: 282831

SEQ ID NO: 601426 - RNA, 64 nt, hsa; identical to SEQ ID NO: 282832

SEQ ID NO: 601427 - RNA, 64 nt, hsa; identical to SEQ ID NO: 282833

SEQ ID NO: 601428 - RNA, 53 nt, hsa; identical to SEQ ID NO: 282834

SEQ ID NO: 601429 - RNA, 64 nt, hsa; identical to SEQ ID NO: 282835

SEQ ID NO: 601430 - RNA, 64 nt, hsa; identical to SEQ ID NO: 282836

SEQ ID NO: 601431 - RNA, 64 nt, hsa; identical to SEQ ID NO: 282837

SEQ ID NO: 601432 - RNA, 64 nt, hsa; identical to SEQ ID NO: 282838

SEQ ID NO: 601433 - RNA, 64 nt, hsa; identical to SEQ ID NO: 282839

SEQ ID NO: 601434 - RNA, 64 nt, hsa; identical to SEQ ID NO: 282840

SEQ ID NO: 601435 - RNA, 64 nt, hsa; identical to SEQ ID NO: 282841

SEQ ID NO: 601436 - RNA, 64 nt, hsa; identical to SEQ ID NO: 282842

SEQ ID NO: 601437 - RNA, 64 nt, hsa; identical to SEQ ID NO: 282843

SEQ ID NO: 601438 - RNA, 64 nt, hsa; identical to SEQ ID NO: 282844

SEQ ID NO: 601439 - RNA, 64 nt, hsa; identical to SEQ ID NO: 282845

SEQ ID NO: 601440 - RNA, 64 nt, hsa; identical to SEQ ID NO: 282846

SEQ ID NO: 601441 - RNA, 53 nt, hsa; identical to SEQ ID NO: 282847

SEQ ID NO: 601442 - RNA, 64 nt, hsa; identical to SEQ ID NO: 282848

SEQ ID NO: 601443 - RNA, 64 nt, hsa; identical to SEQ ID NO: 282849

SEQ ID NO: 601444 - RNA, 64 nt, hsa; identical to SEQ ID NO: 282850

SEQ ID NO: 601445 - RNA, 64 nt, hsa; identical to SEQ ID NO: 282851

SEQ ID NO: 601446 - RNA, 64 nt, hsa; identical to SEQ ID NO: 282852

SEQ ID NO: 601447 - RNA, 64 nt, hsa; identical to SEQ ID NO: 282853

SEQ ID NO: 601448 - RNA, 64 nt, hsa; identical to SEQ ID NO: 282854

SEQ ID NO: 601449 - RNA, 64 nt, hsa; identical to SEQ ID NO: 282855

SEQ ID NO: 601450 - RNA, 64 nt, hsa; identical to SEQ ID NO: 282856

SEQ ID NO: 601451 - RNA, 64 nt, hsa; identical to SEQ ID NO: 282857

SEQ ID NO: 601452 - RNA, 64 nt, hsa; identical to SEQ ID NO: 282858

SEQ ID NO: 601453 - RNA, 64 nt, hsa; identical to SEQ ID NO: 282859

SEQ ID NO: 601454 - RNA, 64 nt, hsa; identical to SEQ ID NO: 282860

SEQ ID NO: 601455 - RNA, 64 nt, hsa; identical to SEQ ID NO: 282861

SEQ ID NO: 601456 - RNA, 64 nt, hsa; identical to SEQ ID NO: 282862

SEQ ID NO: 601457 - RNA, 64 nt, hsa; identical to SEQ ID NO: 282863

SEQ ID NO: 601458 - RNA, 64 nt, hsa; identical to SEQ ID NO: 282864

SEQ ID NO: 601459 - RNA, 64 nt, hsa; identical to SEQ ID NO: 282865

SEQ ID NO: 601460 - RNA, 64 nt, hsa; identical to SEQ ID NO: 282866

SEQ ID NO: 601461 - RNA, 64 nt, hsa; identical to SEQ ID NO: 282867

SEQ ID NO: 601462 - RNA, 64 nt, hsa; identical to SEQ ID NO: 282868

SEQ ID NO: 601463 - RNA, 64 nt, hsa; identical to SEQ ID NO: 282869

SEQ ID NO: 601464 - RNA, 64 nt, hsa; identical to SEQ ID NO: 282870

SEQ ID NO: 601465 - RNA, 64 nt, hsa; identical to SEQ ID NO: 282871

SEQ ID NO: 601466 - RNA, 64 nt, hsa; identical to SEQ ID NO: 282872

SEQ ID NO: 601467 - RNA, 64 nt, hsa; identical to SEQ ID NO: 282873

SEQ ID NO: 601468 - RNA, 64 nt, hsa; identical to SEQ ID NO: 282874

SEQ ID NO: 601469 - RNA, 64 nt, hsa; identical to SEQ ID NO: 282875

SEQ ID NO: 601470 - RNA, 64 nt, hsa; identical to SEQ ID NO: 282876

SEQ ID NO: 601471 - RNA, 64 nt, hsa; identical to SEQ ID NO: 282877

SEQ ID NO: 601472 - RNA, 64 nt, hsa; identical to SEQ ID NO: 282878

SEQ ID NO: 601473 - RNA, 64 nt, hsa; identical to SEQ ID NO: 282879

SEQ ID NO: 601474 - RNA, 64 nt, hsa; identical to SEQ ID NO: 282880

SEQ ID NO: 601475 - RNA, 64 nt, hsa; identical to SEQ ID NO: 282881

SEQ ID NO: 601476 - RNA, 64 nt, hsa; identical to SEQ ID NO: 282882

SEQ ID NO: 601477 - RNA, 64 nt, hsa; identical to SEQ ID NO: 282883

SEQ ID NO: 601478 - RNA, 64 nt, hsa; identical to SEQ ID NO: 282884

SEQ ID NO: 601479 - RNA, 64 nt, hsa; identical to SEQ ID NO: 282885

SEQ ID NO: 601480 - RNA, 64 nt, hsa; identical to SEQ ID NO: 282886

SEQ ID NO: 601481 - RNA, 64 nt, hsa; identical to SEQ ID NO: 282887

SEQ ID NO: 601482 - RNA, 64 nt, hsa; identical to SEQ ID NO: 282888

SEQ ID NO: 601483 - RNA, 64 nt, hsa; identical to SEQ ID NO: 282889

SEQ ID NO: 601484 - RNA, 64 nt, hsa; identical to SEQ ID NO: 282890

SEQ ID NO: 601485 - RNA, 64 nt, hsa; identical to SEQ ID NO: 282891

SEQ ID NO: 601486 - RNA, 64 nt, hsa; identical to SEQ ID NO: 282892

SEQ ID NO: 601487 - RNA, 64 nt, hsa; identical to SEQ ID NO: 282893

SEQ ID NO: 601488 - RNA, 64 nt, hsa; identical to SEQ ID NO: 282894

SEQ ID NO: 601489 - RNA, 64 nt, hsa; identical to SEQ ID NO: 282895

SEQ ID NO: 601490 - RNA, 64 nt, hsa; identical to SEQ ID NO: 282896

SEQ ID NO: 601491 - RNA, 64 nt, hsa; identical to SEQ ID NO: 282897

SEQ ID NO: 601492 - RNA, 64 nt, hsa; identical to SEQ ID NO: 282898

SEQ ID NO: 601493 - RNA, 64 nt, hsa; identical to SEQ ID NO: 282899

SEQ ID NO: 601494 - RNA, 64 nt, hsa; identical to SEQ ID NO: 282900

SEQ ID NO: 601495 - RNA, 64 nt, hsa; identical to SEQ ID NO: 282901

SEQ ID NO: 601496 - RNA, 64 nt, hsa; identical to SEQ ID NO: 282902

SEQ ID NO: 601497 - RNA, 64 nt, hsa; identical to SEQ ID NO: 282903

SEQ ID NO: 601498 - RNA, 64 nt, hsa; identical to SEQ ID NO: 282904

SEQ ID NO: 601499 - RNA, 64 nt, hsa; identical to SEQ ID NO: 282905

SEQ ID NO: 601500 - RNA, 64 nt, hsa; identical to SEQ ID NO: 282906

SEQ ID NO: 601501 - RNA, 64 nt, hsa; identical to SEQ ID NO: 282907

SEQ ID NO: 601502 - RNA, 64 nt, hsa; identical to SEQ ID NO: 282908

SEQ ID NO: 601503 - RNA, 64 nt, hsa; identical to SEQ ID NO: 282909

SEQ ID NO: 601504 - RNA, 64 nt, hsa; identical to SEQ ID NO: 282910

SEQ ID NO: 601505 - RNA, 64 nt, hsa; identical to SEQ ID NO: 282911

SEQ ID NO: 601506 - RNA, 64 nt, hsa; identical to SEQ ID NO: 147168

SEQ ID NO: 601507 - RNA, 64 nt, hsa; identical to SEQ ID NO: 147169

SEQ ID NO: 601508 - RNA, 64 nt, hsa; identical to SEQ ID NO: 147170

SEQ ID NO: 601509 - RNA, 64 nt, hsa; identical to SEQ ID NO: 147171

SEQ ID NO: 601510 - RNA, 64 nt, hsa; identical to SEQ ID NO: 147172

SEQ ID NO: 601511 - RNA, 64 nt, hsa; identical to SEQ ID NO: 147173

SEQ ID NO: 601512 - RNA, 64 nt, hsa; identical to SEQ ID NO: 147174

SEQ ID NO: 601513 - RNA, 64 nt, hsa; identical to SEQ ID NO: 147175

SEQ ID NO: 601514 - RNA, 64 nt, hsa; identical to SEQ ID NO: 147176

SEQ ID NO: 601515 - RNA, 64 nt, hsa; identical to SEQ ID NO: 147177

SEQ ID NO: 601516 - RNA, 64 nt, hsa; identical to SEQ ID NO: 147178

SEQ ID NO: 601517 - RNA, 64 nt, hsa; identical to SEQ ID NO: 147179

SEQ ID NO: 601518 - RNA, 64 nt, hsa; identical to SEQ ID NO: 155629

SEQ ID NO: 601519 - RNA, 64 nt, hsa; identical to SEQ ID NO: 155630

SEQ ID NO: 601520 - RNA, 64 nt, hsa; identical to SEQ ID NO: 155631

SEQ ID NO: 601521 - RNA, 64 nt, hsa; identical to SEQ ID NO: 155632

SEQ ID NO: 601522 - RNA, 64 nt, hsa; identical to SEQ ID NO: 155633

SEQ ID NO: 601523 - RNA, 64 nt, hsa; identical to SEQ ID NO: 155634

SEQ ID NO: 601524 - RNA, 64 nt, hsa; identical to SEQ ID NO: 155635

SEQ ID NO: 601525 - RNA, 64 nt, hsa; identical to SEQ ID NO: 155636

SEQ ID NO: 601526 - RNA, 64 nt, hsa; identical to SEQ ID NO: 155637

SEQ ID NO: 601527 - RNA, 64 nt, hsa; identical to SEQ ID NO: 155638

SEQ ID NO: 601528 - RNA, 64 nt, hsa; identical to SEQ ID NO: 155639

SEQ ID NO: 601529 - RNA, 64 nt, hsa; identical to SEQ ID NO: 155640

SEQ ID NO: 601530 - RNA, 64 nt, hsa; identical to SEQ ID NO: 155641

SEQ ID NO: 601531 - RNA, 64 nt, hsa; identical to SEQ ID NO: 155642

SEQ ID NO: 601532 - RNA, 64 nt, hsa; identical to SEQ ID NO: 155643

SEQ ID NO: 601533 - RNA, 64 nt, hsa; identical to SEQ ID NO: 155644

SEQ ID NO: 601534 - RNA, 64 nt, hsa; identical to SEQ ID NO: 155645

SEQ ID NO: 601535 - RNA, 64 nt, hsa; identical to SEQ ID NO: 155646

SEQ ID NO: 601536 - RNA, 64 nt, hsa; identical to SEQ ID NO: 155647

SEQ ID NO: 601537 - RNA, 64 nt, hsa; identical to SEQ ID NO: 155648

SEQ ID NO: 601538 - RNA, 64 nt, hsa; identical to SEQ ID NO: 155649

SEQ ID NO: 601539 - RNA, 64 nt, hsa; identical to SEQ ID NO: 155650

SEQ ID NO: 601540 - RNA, 64 nt, hsa; identical to SEQ ID NO: 155651

SEQ ID NO: 601541 - RNA, 64 nt, hsa; identical to SEQ ID NO: 155652

SEQ ID NO: 601542 - RNA, 64 nt, hsa; identical to SEQ ID NO: 155653

SEQ ID NO: 601543 - RNA, 64 nt, hsa; identical to SEQ ID NO: 155654

SEQ ID NO: 601544 - RNA, 64 nt, hsa; identical to SEQ ID NO: 155655

SEQ ID NO: 601545 - RNA, 64 nt, hsa; identical to SEQ ID NO: 155656

SEQ ID NO: 601546 - RNA, 64 nt, hsa; identical to SEQ ID NO: 155657

SEQ ID NO: 601547 - RNA, 64 nt, hsa; identical to SEQ ID NO: 155658

SEQ ID NO: 601548 - RNA, 64 nt, hsa; identical to SEQ ID NO: 155659

SEQ ID NO: 601549 - RNA, 64 nt, hsa; identical to SEQ ID NO: 155660

SEQ ID NO: 601550 - RNA, 64 nt, hsa; identical to SEQ ID NO: 155661

SEQ ID NO: 601551 - RNA, 64 nt, hsa; identical to SEQ ID NO: 155662

SEQ ID NO: 601552 - RNA, 64 nt, hsa; identical to SEQ ID NO: 155663

SEQ ID NO: 601553 - RNA, 64 nt, hsa; identical to SEQ ID NO: 155664

SEQ ID NO: 601554 - RNA, 64 nt, hsa; identical to SEQ ID NO: 155665

SEQ ID NO: 601555 - RNA, 64 nt, hsa; identical to SEQ ID NO: 155666

SEQ ID NO: 601556 - RNA, 64 nt, hsa; identical to SEQ ID NO: 155667

SEQ ID NO: 601557 - RNA, 64 nt, hsa; identical to SEQ ID NO: 155668

SEQ ID NO: 601558 - RNA, 64 nt, hsa; identical to SEQ ID NO: 155669

SEQ ID NO: 601559 - RNA, 64 nt, hsa; identical to SEQ ID NO: 155670

SEQ ID NO: 601560 - RNA, 64 nt, hsa; identical to SEQ ID NO: 155671

SEQ ID NO: 601561 - RNA, 64 nt, hsa; identical to SEQ ID NO: 155672

SEQ ID NO: 601562 - RNA, 64 nt, hsa; identical to SEQ ID NO: 155673

SEQ ID NO: 601563 - RNA, 64 nt, hsa; identical to SEQ ID NO: 155674

SEQ ID NO: 601564 - RNA, 64 nt, hsa; identical to SEQ ID NO: 155675

SEQ ID NO: 601565 - RNA, 64 nt, hsa; identical to SEQ ID NO: 155676

SEQ ID NO: 601566 - RNA, 64 nt, hsa; identical to SEQ ID NO: 155677

SEQ ID NO: 601567 - RNA, 64 nt, hsa; identical to SEQ ID NO: 155678

SEQ ID NO: 601568 - RNA, 64 nt, hsa; identical to SEQ ID NO: 155679

SEQ ID NO: 601569 - RNA, 64 nt, hsa; identical to SEQ ID NO: 155680

SEQ ID NO: 601570 - RNA, 64 nt, hsa; identical to SEQ ID NO: 155681

SEQ ID NO: 601571 - RNA, 64 nt, hsa; identical to SEQ ID NO: 155682

SEQ ID NO: 601572 - RNA, 64 nt, hsa; identical to SEQ ID NO: 155683

SEQ ID NO: 601573 - RNA, 64 nt, hsa; identical to SEQ ID NO: 155684

SEQ ID NO: 601574 - RNA, 64 nt, hsa; identical to SEQ ID NO: 155685

SEQ ID NO: 601575 - RNA, 64 nt, hsa; identical to SEQ ID NO: 155686

SEQ ID NO: 601576 - RNA, 64 nt, hsa; identical to SEQ ID NO: 155687

SEQ ID NO: 601577 - RNA, 64 nt, hsa; identical to SEQ ID NO: 155688

SEQ ID NO: 601578 - RNA, 64 nt, hsa; identical to SEQ ID NO: 155689

SEQ ID NO: 601579 - RNA, 64 nt, hsa; identical to SEQ ID NO: 155690

SEQ ID NO: 601580 - RNA, 64 nt, hsa; identical to SEQ ID NO: 155691

SEQ ID NO: 601581 - RNA, 64 nt, hsa; identical to SEQ ID NO: 155692

SEQ ID NO: 601582 - RNA, 64 nt, hsa; identical to SEQ ID NO: 155693

SEQ ID NO: 601583 - RNA, 64 nt, hsa; identical to SEQ ID NO: 155694

SEQ ID NO: 601584 - RNA, 64 nt, hsa; identical to SEQ ID NO: 155695

SEQ ID NO: 601585 - RNA, 64 nt, hsa; identical to SEQ ID NO: 155696

SEQ ID NO: 601586 - RNA, 64 nt, hsa; identical to SEQ ID NO: 155697

SEQ ID NO: 601587 - RNA, 64 nt, hsa; identical to SEQ ID NO: 155698

SEQ ID NO: 601588 - RNA, 64 nt, hsa; identical to SEQ ID NO: 155699

SEQ ID NO: 601589 - RNA, 64 nt, hsa; identical to SEQ ID NO: 155700

SEQ ID NO: 601590 - RNA, 64 nt, hsa; identical to SEQ ID NO: 155701

SEQ ID NO: 601591 - RNA, 64 nt, hsa; identical to SEQ ID NO: 155702

SEQ ID NO: 601592 - RNA, 64 nt, hsa; identical to SEQ ID NO: 155703

SEQ ID NO: 601593 - RNA, 64 nt, hsa; identical to SEQ ID NO: 155704

SEQ ID NO: 601594 - RNA, 64 nt, hsa; identical to SEQ ID NO: 155705

SEQ ID NO: 601595 - RNA, 64 nt, hsa; identical to SEQ ID NO: 155706

SEQ ID NO: 601596 - RNA, 64 nt, hsa; identical to SEQ ID NO: 155707

SEQ ID NO: 601597 - RNA, 64 nt, hsa; identical to SEQ ID NO: 155708

SEQ ID NO: 601598 - RNA, 64 nt, hsa; identical to SEQ ID NO: 155709

SEQ ID NO: 601599 - RNA, 64 nt, hsa; identical to SEQ ID NO: 155710

SEQ ID NO: 601600 - RNA, 64 nt, hsa; identical to SEQ ID NO: 155711

SEQ ID NO: 601601 - RNA, 64 nt, hsa; identical to SEQ ID NO: 155712

SEQ ID NO: 601602 - RNA, 64 nt, hsa; identical to SEQ ID NO: 155713

SEQ ID NO: 601603 - RNA, 64 nt, hsa; identical to SEQ ID NO: 155714

SEQ ID NO: 601604 - RNA, 64 nt, hsa; identical to SEQ ID NO: 155715

SEQ ID NO: 601605 - RNA, 64 nt, hsa; identical to SEQ ID NO: 155716

SEQ ID NO: 601606 - RNA, 64 nt, hsa; identical to SEQ ID NO: 155717

SEQ ID NO: 601607 - RNA, 64 nt, hsa; identical to SEQ ID NO: 155718

SEQ ID NO: 601608 - RNA, 64 nt, hsa; identical to SEQ ID NO: 155719

SEQ ID NO: 601609 - RNA, 64 nt, hsa; identical to SEQ ID NO: 155720

SEQ ID NO: 601610 - RNA, 64 nt, hsa; identical to SEQ ID NO: 155721

SEQ ID NO: 601611 - RNA, 64 nt, hsa; identical to SEQ ID NO: 155722

SEQ ID NO: 601612 - RNA, 64 nt, hsa; identical to SEQ ID NO: 155723

SEQ ID NO: 601613 - RNA, 64 nt, hsa; identical to SEQ ID NO: 155724

SEQ ID NO: 601614 - RNA, 64 nt, hsa; identical to SEQ ID NO: 155725

SEQ ID NO: 601615 - RNA, 64 nt, hsa; identical to SEQ ID NO: 155726

SEQ ID NO: 601616 - RNA, 64 nt, hsa; identical to SEQ ID NO: 155727

SEQ ID NO: 601617 - RNA, 64 nt, hsa; identical to SEQ ID NO: 155728

SEQ ID NO: 601618 - RNA, 64 nt, hsa; identical to SEQ ID NO: 155729

SEQ ID NO: 601619 - RNA, 58 nt, hsa; identical to SEQ ID NO: 155730

SEQ ID NO: 601620 - RNA, 64 nt, hsa; identical to SEQ ID NO: 155731

SEQ ID NO: 601621 - RNA, 64 nt, hsa; identical to SEQ ID NO: 155732

SEQ ID NO: 601622 - RNA, 64 nt, hsa; identical to SEQ ID NO: 155733

SEQ ID NO: 601623 - RNA, 64 nt, hsa; identical to SEQ ID NO: 155734

SEQ ID NO: 601624 - RNA, 64 nt, hsa; identical to SEQ ID NO: 155735

SEQ ID NO: 601625 - RNA, 64 nt, hsa; identical to SEQ ID NO: 155736

SEQ ID NO: 601626 - RNA, 64 nt, hsa; identical to SEQ ID NO: 155737

SEQ ID NO: 601627 - RNA, 64 nt, hsa; identical to SEQ ID NO: 155738

SEQ ID NO: 601628 - RNA, 64 nt, hsa; identical to SEQ ID NO: 155739

SEQ ID NO: 601629 - RNA, 64 nt, hsa; identical to SEQ ID NO: 155740

SEQ ID NO: 601630 - RNA, 64 nt, hsa; identical to SEQ ID NO: 155741

SEQ ID NO: 601631 - RNA, 64 nt, hsa; identical to SEQ ID NO: 155742

SEQ ID NO: 601632 - RNA, 64 nt, hsa; identical to SEQ ID NO: 155743

SEQ ID NO: 601633 - RNA, 64 nt, hsa; identical to SEQ ID NO: 155744

SEQ ID NO: 601634 - RNA, 64 nt, hsa; identical to SEQ ID NO: 155745

SEQ ID NO: 601635 - RNA, 64 nt, hsa; identical to SEQ ID NO: 155746

SEQ ID NO: 601636 - RNA, 64 nt, hsa; identical to SEQ ID NO: 155747

SEQ ID NO: 601637 - RNA, 64 nt, hsa; identical to SEQ ID NO: 155748

SEQ ID NO: 601638 - RNA, 64 nt, hsa; identical to SEQ ID NO: 155749

SEQ ID NO: 601639 - RNA, 64 nt, hsa; identical to SEQ ID NO: 155750

SEQ ID NO: 601640 - RNA, 64 nt, hsa; identical to SEQ ID NO: 155751

SEQ ID NO: 601641 - RNA, 64 nt, hsa; identical to SEQ ID NO: 155752

SEQ ID NO: 601642 - RNA, 64 nt, hsa; identical to SEQ ID NO: 155753

SEQ ID NO: 601643 - RNA, 63 nt, hsa; identical to SEQ ID NO: 155754

SEQ ID NO: 601644 - RNA, 64 nt, hsa; identical to SEQ ID NO: 155755

SEQ ID NO: 601645 - RNA, 64 nt, hsa; identical to SEQ ID NO: 155756

SEQ ID NO: 601646 - RNA, 64 nt, hsa; identical to SEQ ID NO: 155757

SEQ ID NO: 601647 - RNA, 64 nt, hsa; identical to SEQ ID NO: 155758

SEQ ID NO: 601648 - RNA, 64 nt, hsa; identical to SEQ ID NO: 155759

SEQ ID NO: 601649 - RNA, 64 nt, hsa; identical to SEQ ID NO: 155760

SEQ ID NO: 601650 - RNA, 64 nt, hsa; identical to SEQ ID NO: 155761

SEQ ID NO: 601651 - RNA, 64 nt, hsa; identical to SEQ ID NO: 155762

SEQ ID NO: 601652 - RNA, 64 nt, hsa; identical to SEQ ID NO: 155763

SEQ ID NO: 601653 - RNA, 64 nt, hsa; identical to SEQ ID NO: 155764

SEQ ID NO: 601654 - RNA, 64 nt, hsa; identical to SEQ ID NO: 155765

SEQ ID NO: 601655 - RNA, 64 nt, hsa; identical to SEQ ID NO: 155766

SEQ ID NO: 601656 - RNA, 64 nt, hsa; identical to SEQ ID NO: 155767

SEQ ID NO: 601657 - RNA, 64 nt, hsa; identical to SEQ ID NO: 155768

SEQ ID NO: 601658 - RNA, 64 nt, hsa; identical to SEQ ID NO: 155769

SEQ ID NO: 601659 - RNA, 64 nt, hsa; identical to SEQ ID NO: 155770

SEQ ID NO: 601660 - RNA, 64 nt, hsa; identical to SEQ ID NO: 155771

SEQ ID NO: 601661 - RNA, 64 nt, hsa; identical to SEQ ID NO: 155772

SEQ ID NO: 601662 - RNA, 64 nt, hsa; identical to SEQ ID NO: 155773

SEQ ID NO: 601663 - RNA, 64 nt, hsa; identical to SEQ ID NO: 155774

SEQ ID NO: 601664 - RNA, 64 nt, hsa; identical to SEQ ID NO: 155775

SEQ ID NO: 601665 - RNA, 64 nt, hsa; identical to SEQ ID NO: 155776

SEQ ID NO: 601666 - RNA, 64 nt, hsa; identical to SEQ ID NO: 155777

SEQ ID NO: 601667 - RNA, 64 nt, hsa; identical to SEQ ID NO: 155778

SEQ ID NO: 601668 - RNA, 64 nt, hsa; identical to SEQ ID NO: 155779

SEQ ID NO: 601669 - RNA, 64 nt, hsa; identical to SEQ ID NO: 155780

SEQ ID NO: 601670 - RNA, 64 nt, hsa; identical to SEQ ID NO: 155781

SEQ ID NO: 601671 - RNA, 64 nt, hsa; identical to SEQ ID NO: 155782

SEQ ID NO: 601672 - RNA, 64 nt, hsa; identical to SEQ ID NO: 155783

SEQ ID NO: 601673 - RNA, 64 nt, hsa; identical to SEQ ID NO: 155784

SEQ ID NO: 601674 - RNA, 64 nt, hsa; identical to SEQ ID NO: 155785

SEQ ID NO: 601675 - RNA, 64 nt, hsa; identical to SEQ ID NO: 155786

SEQ ID NO: 601676 - RNA, 53 nt, hsa; identical to SEQ ID NO: 155787

SEQ ID NO: 601677 - RNA, 64 nt, hsa; identical to SEQ ID NO: 155788

SEQ ID NO: 601678 - RNA, 64 nt, hsa; identical to SEQ ID NO: 155789

SEQ ID NO: 601679 - RNA, 64 nt, hsa; identical to SEQ ID NO: 155790

SEQ ID NO: 601680 - RNA, 64 nt, hsa; identical to SEQ ID NO: 155791

SEQ ID NO: 601681 - RNA, 64 nt, hsa; identical to SEQ ID NO: 155792

SEQ ID NO: 601682 - RNA, 64 nt, hsa; identical to SEQ ID NO: 155793

SEQ ID NO: 601683 - RNA, 64 nt, hsa; identical to SEQ ID NO: 155794

SEQ ID NO: 601684 - RNA, 64 nt, hsa; identical to SEQ ID NO: 155795

SEQ ID NO: 601685 - RNA, 64 nt, hsa; identical to SEQ ID NO: 155796

SEQ ID NO: 601686 - RNA, 64 nt, hsa; identical to SEQ ID NO: 155797

SEQ ID NO: 601687 - RNA, 64 nt, hsa; identical to SEQ ID NO: 155798

SEQ ID NO: 601688 - RNA, 64 nt, hsa; identical to SEQ ID NO: 155799

SEQ ID NO: 601689 - RNA, 64 nt, hsa; identical to SEQ ID NO: 155800

SEQ ID NO: 601690 - RNA, 64 nt, hsa; identical to SEQ ID NO: 155801

SEQ ID NO: 601691 - RNA, 64 nt, hsa; identical to SEQ ID NO: 155802

SEQ ID NO: 601692 - RNA, 64 nt, hsa; identical to SEQ ID NO: 155803

SEQ ID NO: 601693 - RNA, 64 nt, hsa; identical to SEQ ID NO: 155804

SEQ ID NO: 601694 - RNA, 64 nt, hsa; identical to SEQ ID NO: 155805

SEQ ID NO: 601695 - RNA, 64 nt, hsa; identical to SEQ ID NO: 155806

SEQ ID NO: 601696 - RNA, 64 nt, hsa; identical to SEQ ID NO: 155807

SEQ ID NO: 601697 - RNA, 64 nt, hsa; identical to SEQ ID NO: 155808

SEQ ID NO: 601698 - RNA, 64 nt, hsa; identical to SEQ ID NO: 147168

SEQ ID NO: 601699 - RNA, 64 nt, hsa; identical to SEQ ID NO: 147169

SEQ ID NO: 601700 - RNA, 64 nt, hsa; identical to SEQ ID NO: 147170

SEQ ID NO: 601701 - RNA, 64 nt, hsa; identical to SEQ ID NO: 147171

SEQ ID NO: 601702 - RNA, 64 nt, hsa; identical to SEQ ID NO: 147172

SEQ ID NO: 601703 - RNA, 64 nt, hsa; identical to SEQ ID NO: 147173

SEQ ID NO: 601704 - RNA, 64 nt, hsa; identical to SEQ ID NO: 147174

SEQ ID NO: 601705 - RNA, 64 nt, hsa; identical to SEQ ID NO: 147175

SEQ ID NO: 601706 - RNA, 64 nt, hsa; identical to SEQ ID NO: 147176

SEQ ID NO: 601707 - RNA, 64 nt, hsa; identical to SEQ ID NO: 147177

SEQ ID NO: 601708 - RNA, 64 nt, hsa; identical to SEQ ID NO: 147178

SEQ ID NO: 601709 - RNA, 64 nt, hsa; identical to SEQ ID NO: 147179

SEQ ID NO: 601710 - RNA, 64 nt, hsa; identical to SEQ ID NO: 155629

SEQ ID NO: 601711 - RNA, 64 nt, hsa; identical to SEQ ID NO: 155630

SEQ ID NO: 601712 - RNA, 64 nt, hsa; identical to SEQ ID NO: 155631

SEQ ID NO: 601713 - RNA, 64 nt, hsa; identical to SEQ ID NO: 155632

SEQ ID NO: 601714 - RNA, 64 nt, hsa; identical to SEQ ID NO: 155633

SEQ ID NO: 601715 - RNA, 64 nt, hsa; identical to SEQ ID NO: 155634

SEQ ID NO: 601716 - RNA, 64 nt, hsa; identical to SEQ ID NO: 155635

SEQ ID NO: 601717 - RNA, 64 nt, hsa; identical to SEQ ID NO: 155636

SEQ ID NO: 601718 - RNA, 64 nt, hsa; identical to SEQ ID NO: 155637

SEQ ID NO: 601719 - RNA, 64 nt, hsa; identical to SEQ ID NO: 155638

SEQ ID NO: 601720 - RNA, 64 nt, hsa; identical to SEQ ID NO: 155639

SEQ ID NO: 601721 - RNA, 64 nt, hsa; identical to SEQ ID NO: 155640

SEQ ID NO: 601722 - RNA, 64 nt, hsa; identical to SEQ ID NO: 155641

SEQ ID NO: 601723 - RNA, 64 nt, hsa; identical to SEQ ID NO: 155642

SEQ ID NO: 601724 - RNA, 64 nt, hsa; identical to SEQ ID NO: 155643

SEQ ID NO: 601725 - RNA, 64 nt, hsa; identical to SEQ ID NO: 155644

SEQ ID NO: 601726 - RNA, 64 nt, hsa; identical to SEQ ID NO: 155645

SEQ ID NO: 601727 - RNA, 64 nt, hsa; identical to SEQ ID NO: 155646

SEQ ID NO: 601728 - RNA, 64 nt, hsa; identical to SEQ ID NO: 155647

SEQ ID NO: 601729 - RNA, 64 nt, hsa; identical to SEQ ID NO: 155648

SEQ ID NO: 601730 - RNA, 64 nt, hsa; identical to SEQ ID NO: 155649

SEQ ID NO: 601731 - RNA, 64 nt, hsa; identical to SEQ ID NO: 155650

SEQ ID NO: 601732 - RNA, 64 nt, hsa; identical to SEQ ID NO: 155651

SEQ ID NO: 601733 - RNA, 64 nt, hsa; identical to SEQ ID NO: 155652

SEQ ID NO: 601734 - RNA, 64 nt, hsa; identical to SEQ ID NO: 155653

SEQ ID NO: 601735 - RNA, 64 nt, hsa; identical to SEQ ID NO: 155654

SEQ ID NO: 601736 - RNA, 64 nt, hsa; identical to SEQ ID NO: 155655

SEQ ID NO: 601737 - RNA, 64 nt, hsa; identical to SEQ ID NO: 155656

SEQ ID NO: 601738 - RNA, 64 nt, hsa; identical to SEQ ID NO: 155657

SEQ ID NO: 601739 - RNA, 64 nt, hsa; identical to SEQ ID NO: 155658

SEQ ID NO: 601740 - RNA, 64 nt, hsa; identical to SEQ ID NO: 155659

SEQ ID NO: 601741 - RNA, 64 nt, hsa; identical to SEQ ID NO: 155660

SEQ ID NO: 601742 - RNA, 64 nt, hsa; identical to SEQ ID NO: 155661

SEQ ID NO: 601743 - RNA, 64 nt, hsa; identical to SEQ ID NO: 155662

SEQ ID NO: 601744 - RNA, 64 nt, hsa; identical to SEQ ID NO: 155663

SEQ ID NO: 601745 - RNA, 64 nt, hsa; identical to SEQ ID NO: 155664

SEQ ID NO: 601746 - RNA, 64 nt, hsa; identical to SEQ ID NO: 155665

SEQ ID NO: 601747 - RNA, 64 nt, hsa; identical to SEQ ID NO: 155666

SEQ ID NO: 601748 - RNA, 64 nt, hsa; identical to SEQ ID NO: 155667

SEQ ID NO: 601749 - RNA, 64 nt, hsa; identical to SEQ ID NO: 155668

SEQ ID NO: 601750 - RNA, 64 nt, hsa; identical to SEQ ID NO: 155669

SEQ ID NO: 601751 - RNA, 64 nt, hsa; identical to SEQ ID NO: 155670

SEQ ID NO: 601752 - RNA, 64 nt, hsa; identical to SEQ ID NO: 155671

SEQ ID NO: 601753 - RNA, 64 nt, hsa; identical to SEQ ID NO: 155672

SEQ ID NO: 601754 - RNA, 64 nt, hsa; identical to SEQ ID NO: 155673

SEQ ID NO: 601755 - RNA, 64 nt, hsa; identical to SEQ ID NO: 155674

SEQ ID NO: 601756 - RNA, 64 nt, hsa; identical to SEQ ID NO: 155675

SEQ ID NO: 601757 - RNA, 64 nt, hsa; identical to SEQ ID NO: 155676

SEQ ID NO: 601758 - RNA, 64 nt, hsa; identical to SEQ ID NO: 155677

SEQ ID NO: 601759 - RNA, 64 nt, hsa; identical to SEQ ID NO: 155678

SEQ ID NO: 601760 - RNA, 64 nt, hsa; identical to SEQ ID NO: 155679

SEQ ID NO: 601761 - RNA, 64 nt, hsa; identical to SEQ ID NO: 155680

SEQ ID NO: 601762 - RNA, 64 nt, hsa; identical to SEQ ID NO: 155681

SEQ ID NO: 601763 - RNA, 64 nt, hsa; identical to SEQ ID NO: 155682

SEQ ID NO: 601764 - RNA, 64 nt, hsa; identical to SEQ ID NO: 155683

SEQ ID NO: 601765 - RNA, 64 nt, hsa; identical to SEQ ID NO: 155684

SEQ ID NO: 601766 - RNA, 64 nt, hsa; identical to SEQ ID NO: 155685

SEQ ID NO: 601767 - RNA, 64 nt, hsa; identical to SEQ ID NO: 155686

SEQ ID NO: 601768 - RNA, 64 nt, hsa; identical to SEQ ID NO: 155687

SEQ ID NO: 601769 - RNA, 64 nt, hsa; identical to SEQ ID NO: 155688

SEQ ID NO: 601770 - RNA, 64 nt, hsa; identical to SEQ ID NO: 155689

SEQ ID NO: 601771 - RNA, 64 nt, hsa; identical to SEQ ID NO: 155690

SEQ ID NO: 601772 - RNA, 64 nt, hsa; identical to SEQ ID NO: 155691

SEQ ID NO: 601773 - RNA, 64 nt, hsa; identical to SEQ ID NO: 155692

SEQ ID NO: 601774 - RNA, 64 nt, hsa; identical to SEQ ID NO: 155693

SEQ ID NO: 601775 - RNA, 64 nt, hsa; identical to SEQ ID NO: 155694

SEQ ID NO: 601776 - RNA, 64 nt, hsa; identical to SEQ ID NO: 155695

SEQ ID NO: 601777 - RNA, 64 nt, hsa; identical to SEQ ID NO: 155696

SEQ ID NO: 601778 - RNA, 64 nt, hsa; identical to SEQ ID NO: 155697

SEQ ID NO: 601779 - RNA, 64 nt, hsa; identical to SEQ ID NO: 155698

SEQ ID NO: 601780 - RNA, 64 nt, hsa; identical to SEQ ID NO: 155699

SEQ ID NO: 601781 - RNA, 64 nt, hsa; identical to SEQ ID NO: 155700

SEQ ID NO: 601782 - RNA, 64 nt, hsa; identical to SEQ ID NO: 155701

SEQ ID NO: 601783 - RNA, 64 nt, hsa; identical to SEQ ID NO: 155702

SEQ ID NO: 601784 - RNA, 64 nt, hsa; identical to SEQ ID NO: 155703

SEQ ID NO: 601785 - RNA, 64 nt, hsa; identical to SEQ ID NO: 155704

SEQ ID NO: 601786 - RNA, 64 nt, hsa; identical to SEQ ID NO: 155705

SEQ ID NO: 601787 - RNA, 64 nt, hsa; identical to SEQ ID NO: 155706

SEQ ID NO: 601788 - RNA, 64 nt, hsa; identical to SEQ ID NO: 155707

SEQ ID NO: 601789 - RNA, 64 nt, hsa; identical to SEQ ID NO: 155708

SEQ ID NO: 601790 - RNA, 64 nt, hsa; identical to SEQ ID NO: 155709

SEQ ID NO: 601791 - RNA, 64 nt, hsa; identical to SEQ ID NO: 155710

SEQ ID NO: 601792 - RNA, 64 nt, hsa; identical to SEQ ID NO: 155711

SEQ ID NO: 601793 - RNA, 64 nt, hsa; identical to SEQ ID NO: 155712

SEQ ID NO: 601794 - RNA, 64 nt, hsa; identical to SEQ ID NO: 155713

SEQ ID NO: 601795 - RNA, 64 nt, hsa; identical to SEQ ID NO: 155714

SEQ ID NO: 601796 - RNA, 64 nt, hsa; identical to SEQ ID NO: 155715

SEQ ID NO: 601797 - RNA, 64 nt, hsa; identical to SEQ ID NO: 155716

SEQ ID NO: 601798 - RNA, 64 nt, hsa; identical to SEQ ID NO: 155717

SEQ ID NO: 601799 - RNA, 64 nt, hsa; identical to SEQ ID NO: 155718

SEQ ID NO: 601800 - RNA, 64 nt, hsa; identical to SEQ ID NO: 155719

SEQ ID NO: 601801 - RNA, 64 nt, hsa; identical to SEQ ID NO: 155720

SEQ ID NO: 601802 - RNA, 64 nt, hsa; identical to SEQ ID NO: 155721

SEQ ID NO: 601803 - RNA, 64 nt, hsa; identical to SEQ ID NO: 155722

SEQ ID NO: 601804 - RNA, 64 nt, hsa; identical to SEQ ID NO: 155723

SEQ ID NO: 601805 - RNA, 64 nt, hsa; identical to SEQ ID NO: 155724

SEQ ID NO: 601806 - RNA, 64 nt, hsa; identical to SEQ ID NO: 155725

SEQ ID NO: 601807 - RNA, 64 nt, hsa; identical to SEQ ID NO: 155726

SEQ ID NO: 601808 - RNA, 64 nt, hsa; identical to SEQ ID NO: 155727

SEQ ID NO: 601809 - RNA, 64 nt, hsa; identical to SEQ ID NO: 155728

SEQ ID NO: 601810 - RNA, 64 nt, hsa; identical to SEQ ID NO: 155729

SEQ ID NO: 601811 - RNA, 58 nt, hsa; identical to SEQ ID NO: 155730

SEQ ID NO: 601812 - RNA, 64 nt, hsa; identical to SEQ ID NO: 155731

SEQ ID NO: 601813 - RNA, 64 nt, hsa; identical to SEQ ID NO: 155732

SEQ ID NO: 601814 - RNA, 64 nt, hsa; identical to SEQ ID NO: 155733

SEQ ID NO: 601815 - RNA, 64 nt, hsa; identical to SEQ ID NO: 155734

SEQ ID NO: 601816 - RNA, 64 nt, hsa; identical to SEQ ID NO: 155735

SEQ ID NO: 601817 - RNA, 64 nt, hsa; identical to SEQ ID NO: 155736

SEQ ID NO: 601818 - RNA, 64 nt, hsa; identical to SEQ ID NO: 155737

SEQ ID NO: 601819 - RNA, 64 nt, hsa; identical to SEQ ID NO: 155738

SEQ ID NO: 601820 - RNA, 64 nt, hsa; identical to SEQ ID NO: 155739

SEQ ID NO: 601821 - RNA, 64 nt, hsa; identical to SEQ ID NO: 155740

SEQ ID NO: 601822 - RNA, 64 nt, hsa; identical to SEQ ID NO: 155741

SEQ ID NO: 601823 - RNA, 64 nt, hsa; identical to SEQ ID NO: 155742

SEQ ID NO: 601824 - RNA, 64 nt, hsa; identical to SEQ ID NO: 155743

SEQ ID NO: 601825 - RNA, 64 nt, hsa; identical to SEQ ID NO: 155744

SEQ ID NO: 601826 - RNA, 64 nt, hsa; identical to SEQ ID NO: 155745

SEQ ID NO: 601827 - RNA, 64 nt, hsa; identical to SEQ ID NO: 155746

SEQ ID NO: 601828 - RNA, 64 nt, hsa; identical to SEQ ID NO: 155747

SEQ ID NO: 601829 - RNA, 64 nt, hsa; identical to SEQ ID NO: 155748

SEQ ID NO: 601830 - RNA, 64 nt, hsa; identical to SEQ ID NO: 155749

SEQ ID NO: 601831 - RNA, 64 nt, hsa; identical to SEQ ID NO: 155750

SEQ ID NO: 601832 - RNA, 64 nt, hsa; identical to SEQ ID NO: 155751

SEQ ID NO: 601833 - RNA, 64 nt, hsa; identical to SEQ ID NO: 155752

SEQ ID NO: 601834 - RNA, 64 nt, hsa; identical to SEQ ID NO: 155753

SEQ ID NO: 601835 - RNA, 63 nt, hsa; identical to SEQ ID NO: 155754

SEQ ID NO: 601836 - RNA, 64 nt, hsa; identical to SEQ ID NO: 155755

SEQ ID NO: 601837 - RNA, 64 nt, hsa; identical to SEQ ID NO: 155756

SEQ ID NO: 601838 - RNA, 64 nt, hsa; identical to SEQ ID NO: 155757

SEQ ID NO: 601839 - RNA, 64 nt, hsa; identical to SEQ ID NO: 155758

SEQ ID NO: 601840 - RNA, 64 nt, hsa; identical to SEQ ID NO: 155759

SEQ ID NO: 601841 - RNA, 64 nt, hsa; identical to SEQ ID NO: 155760

SEQ ID NO: 601842 - RNA, 64 nt, hsa; identical to SEQ ID NO: 155761

SEQ ID NO: 601843 - RNA, 64 nt, hsa; identical to SEQ ID NO: 155762

SEQ ID NO: 601844 - RNA, 64 nt, hsa; identical to SEQ ID NO: 155763

SEQ ID NO: 601845 - RNA, 64 nt, hsa; identical to SEQ ID NO: 155764

SEQ ID NO: 601846 - RNA, 64 nt, hsa; identical to SEQ ID NO: 155765

SEQ ID NO: 601847 - RNA, 64 nt, hsa; identical to SEQ ID NO: 155766

SEQ ID NO: 601848 - RNA, 64 nt, hsa; identical to SEQ ID NO: 155767

SEQ ID NO: 601849 - RNA, 64 nt, hsa; identical to SEQ ID NO: 155768

SEQ ID NO: 601850 - RNA, 64 nt, hsa; identical to SEQ ID NO: 155769

SEQ ID NO: 601851 - RNA, 64 nt, hsa; identical to SEQ ID NO: 155770

SEQ ID NO: 601852 - RNA, 64 nt, hsa; identical to SEQ ID NO: 155771

SEQ ID NO: 601853 - RNA, 64 nt, hsa; identical to SEQ ID NO: 155772

SEQ ID NO: 601854 - RNA, 64 nt, hsa; identical to SEQ ID NO: 155773

SEQ ID NO: 601855 - RNA, 64 nt, hsa; identical to SEQ ID NO: 155774

SEQ ID NO: 601856 - RNA, 64 nt, hsa; identical to SEQ ID NO: 155775

SEQ ID NO: 601857 - RNA, 64 nt, hsa; identical to SEQ ID NO: 155776

SEQ ID NO: 601858 - RNA, 64 nt, hsa; identical to SEQ ID NO: 155777

SEQ ID NO: 601859 - RNA, 64 nt, hsa; identical to SEQ ID NO: 155778

SEQ ID NO: 601860 - RNA, 64 nt, hsa; identical to SEQ ID NO: 155779

SEQ ID NO: 601861 - RNA, 64 nt, hsa; identical to SEQ ID NO: 155780

SEQ ID NO: 601862 - RNA, 64 nt, hsa; identical to SEQ ID NO: 155781

SEQ ID NO: 601863 - RNA, 64 nt, hsa; identical to SEQ ID NO: 155782

SEQ ID NO: 601864 - RNA, 64 nt, hsa; identical to SEQ ID NO: 155783

SEQ ID NO: 601865 - RNA, 64 nt, hsa; identical to SEQ ID NO: 155784

SEQ ID NO: 601866 - RNA, 64 nt, hsa; identical to SEQ ID NO: 155785

SEQ ID NO: 601867 - RNA, 64 nt, hsa; identical to SEQ ID NO: 155786

SEQ ID NO: 601868 - RNA, 53 nt, hsa; identical to SEQ ID NO: 155787

SEQ ID NO: 601869 - RNA, 64 nt, hsa; identical to SEQ ID NO: 155788

SEQ ID NO: 601870 - RNA, 64 nt, hsa; identical to SEQ ID NO: 155789

SEQ ID NO: 601871 - RNA, 64 nt, hsa; identical to SEQ ID NO: 155790

SEQ ID NO: 601872 - RNA, 64 nt, hsa; identical to SEQ ID NO: 155791

SEQ ID NO: 601873 - RNA, 64 nt, hsa; identical to SEQ ID NO: 155792

SEQ ID NO: 601874 - RNA, 64 nt, hsa; identical to SEQ ID NO: 155793

SEQ ID NO: 601875 - RNA, 64 nt, hsa; identical to SEQ ID NO: 155794

SEQ ID NO: 601876 - RNA, 64 nt, hsa; identical to SEQ ID NO: 155795

SEQ ID NO: 601877 - RNA, 64 nt, hsa; identical to SEQ ID NO: 155796

SEQ ID NO: 601878 - RNA, 64 nt, hsa; identical to SEQ ID NO: 155797

SEQ ID NO: 601879 - RNA, 64 nt, hsa; identical to SEQ ID NO: 155798

SEQ ID NO: 601880 - RNA, 64 nt, hsa; identical to SEQ ID NO: 155799

SEQ ID NO: 601881 - RNA, 64 nt, hsa; identical to SEQ ID NO: 155800

SEQ ID NO: 601882 - RNA, 64 nt, hsa; identical to SEQ ID NO: 155801

SEQ ID NO: 601883 - RNA, 64 nt, hsa; identical to SEQ ID NO: 155802

SEQ ID NO: 601884 - RNA, 64 nt, hsa; identical to SEQ ID NO: 155803

SEQ ID NO: 601885 - RNA, 64 nt, hsa; identical to SEQ ID NO: 155804

SEQ ID NO: 601886 - RNA, 64 nt, hsa; identical to SEQ ID NO: 155805

SEQ ID NO: 601887 - RNA, 64 nt, hsa; identical to SEQ ID NO: 155806

SEQ ID NO: 601888 - RNA, 64 nt, hsa; identical to SEQ ID NO: 155807

SEQ ID NO: 601889 - RNA, 64 nt, hsa; identical to SEQ ID NO: 155808

SEQ ID NO: 601890 - RNA, 64 nt, hsa; identical to SEQ ID NO: 556943

SEQ ID NO: 601891 - RNA, 64 nt, hsa; identical to SEQ ID NO: 556944

SEQ ID NO: 601892 - RNA, 64 nt, hsa; identical to SEQ ID NO: 556945

SEQ ID NO: 601893 - RNA, 64 nt, hsa; identical to SEQ ID NO: 556946

SEQ ID NO: 601894 - RNA, 64 nt, hsa; identical to SEQ ID NO: 556947

SEQ ID NO: 601895 - RNA, 64 nt, hsa; identical to SEQ ID NO: 556948

SEQ ID NO: 601896 - RNA, 64 nt, hsa; identical to SEQ ID NO: 556949

SEQ ID NO: 601897 - RNA, 64 nt, hsa; identical to SEQ ID NO: 556950

SEQ ID NO: 601898 - RNA, 64 nt, hsa; identical to SEQ ID NO: 556951

SEQ ID NO: 601899 - RNA, 64 nt, hsa; identical to SEQ ID NO: 556952

SEQ ID NO: 601900 - RNA, 64 nt, hsa; identical to SEQ ID NO: 556953

SEQ ID NO: 601901 - RNA, 64 nt, hsa; identical to SEQ ID NO: 556954

SEQ ID NO: 601902 - RNA, 64 nt, hsa; identical to SEQ ID NO: 556955

SEQ ID NO: 601903 - RNA, 64 nt, hsa; identical to SEQ ID NO: 556956

SEQ ID NO: 601904 - RNA, 64 nt, hsa; identical to SEQ ID NO: 556957

SEQ ID NO: 601905 - RNA, 64 nt, hsa; identical to SEQ ID NO: 556958

SEQ ID NO: 601906 - RNA, 64 nt, hsa; identical to SEQ ID NO: 556959

SEQ ID NO: 601907 - RNA, 58 nt, hsa; identical to SEQ ID NO: 556960

SEQ ID NO: 601908 - RNA, 64 nt, hsa; identical to SEQ ID NO: 556961

SEQ ID NO: 601909 - RNA, 64 nt, hsa; identical to SEQ ID NO: 556962

SEQ ID NO: 601910 - RNA, 64 nt, hsa; identical to SEQ ID NO: 556963

SEQ ID NO: 601911 - RNA, 64 nt, hsa; identical to SEQ ID NO: 556964

SEQ ID NO: 601912 - RNA, 64 nt, hsa; identical to SEQ ID NO: 556965

SEQ ID NO: 601913 - RNA, 64 nt, hsa; identical to SEQ ID NO: 556966

SEQ ID NO: 601914 - RNA, 64 nt, hsa; identical to SEQ ID NO: 556967

SEQ ID NO: 601915 - RNA, 64 nt, hsa; identical to SEQ ID NO: 556968

SEQ ID NO: 601916 - RNA, 64 nt, hsa; identical to SEQ ID NO: 556969

SEQ ID NO: 601917 - RNA, 64 nt, hsa; identical to SEQ ID NO: 556970

SEQ ID NO: 601918 - RNA, 64 nt, hsa; identical to SEQ ID NO: 556971

SEQ ID NO: 601919 - RNA, 64 nt, hsa; identical to SEQ ID NO: 556972

SEQ ID NO: 601920 - RNA, 64 nt, hsa; identical to SEQ ID NO: 556973

SEQ ID NO: 601921 - RNA, 64 nt, hsa; identical to SEQ ID NO: 556974

SEQ ID NO: 601922 - RNA, 64 nt, hsa; identical to SEQ ID NO: 556975

SEQ ID NO: 601923 - RNA, 64 nt, hsa; identical to SEQ ID NO: 556976

SEQ ID NO: 601924 - RNA, 64 nt, hsa; identical to SEQ ID NO: 556977

SEQ ID NO: 601925 - RNA, 64 nt, hsa; identical to SEQ ID NO: 556978

SEQ ID NO: 601926 - RNA, 64 nt, hsa; identical to SEQ ID NO: 556979

SEQ ID NO: 601927 - RNA, 64 nt, hsa; identical to SEQ ID NO: 556980

SEQ ID NO: 601928 - RNA, 64 nt, hsa; identical to SEQ ID NO: 556981

SEQ ID NO: 601929 - RNA, 64 nt, hsa; identical to SEQ ID NO: 556982

SEQ ID NO: 601930 - RNA, 64 nt, hsa; identical to SEQ ID NO: 556983

SEQ ID NO: 601931 - RNA, 64 nt, hsa; identical to SEQ ID NO: 556984

SEQ ID NO: 601932 - RNA, 64 nt, hsa; identical to SEQ ID NO: 556985

SEQ ID NO: 601933 - RNA, 64 nt, hsa; identical to SEQ ID NO: 556986

SEQ ID NO: 601934 - RNA, 64 nt, hsa; identical to SEQ ID NO: 556987

SEQ ID NO: 601935 - RNA, 64 nt, hsa; identical to SEQ ID NO: 556988

SEQ ID NO: 601936 - RNA, 64 nt, hsa; identical to SEQ ID NO: 556989

SEQ ID NO: 601937 - RNA, 64 nt, hsa; identical to SEQ ID NO: 556990

SEQ ID NO: 601938 - RNA, 64 nt, hsa; identical to SEQ ID NO: 556991

SEQ ID NO: 601939 - RNA, 64 nt, hsa; identical to SEQ ID NO: 556992

SEQ ID NO: 601940 - RNA, 64 nt, hsa; identical to SEQ ID NO: 556993

SEQ ID NO: 601941 - RNA, 64 nt, hsa; identical to SEQ ID NO: 556994

SEQ ID NO: 601942 - RNA, 64 nt, hsa; identical to SEQ ID NO: 556995

SEQ ID NO: 601943 - RNA, 64 nt, hsa; identical to SEQ ID NO: 556996

SEQ ID NO: 601944 - RNA, 64 nt, hsa; identical to SEQ ID NO: 556997

SEQ ID NO: 601945 - RNA, 64 nt, hsa; identical to SEQ ID NO: 556998

SEQ ID NO: 601946 - RNA, 64 nt, hsa; identical to SEQ ID NO: 556999

SEQ ID NO: 601947 - RNA, 64 nt, hsa; identical to SEQ ID NO: 557000

SEQ ID NO: 601948 - RNA, 64 nt, hsa; identical to SEQ ID NO: 557001

SEQ ID NO: 601949 - RNA, 64 nt, hsa; identical to SEQ ID NO: 557002

SEQ ID NO: 601950 - RNA, 64 nt, hsa; identical to SEQ ID NO: 557003

SEQ ID NO: 601951 - RNA, 64 nt, hsa; identical to SEQ ID NO: 557004

SEQ ID NO: 601952 - RNA, 64 nt, hsa; identical to SEQ ID NO: 557005

SEQ ID NO: 601953 - RNA, 64 nt, hsa; identical to SEQ ID NO: 557006

SEQ ID NO: 601954 - RNA, 64 nt, hsa; identical to SEQ ID NO: 557007

SEQ ID NO: 601955 - RNA, 64 nt, hsa; identical to SEQ ID NO: 557008

SEQ ID NO: 601956 - RNA, 64 nt, hsa; identical to SEQ ID NO: 557009

SEQ ID NO: 601957 - RNA, 64 nt, hsa; identical to SEQ ID NO: 557010

SEQ ID NO: 601958 - RNA, 64 nt, hsa; identical to SEQ ID NO: 557011

SEQ ID NO: 601959 - RNA, 64 nt, hsa; identical to SEQ ID NO: 557012

SEQ ID NO: 601960 - RNA, 64 nt, hsa; identical to SEQ ID NO: 557013

SEQ ID NO: 601961 - RNA, 64 nt, hsa; identical to SEQ ID NO: 557014

SEQ ID NO: 601962 - RNA, 64 nt, hsa; identical to SEQ ID NO: 557015

SEQ ID NO: 601963 - RNA, 64 nt, hsa; identical to SEQ ID NO: 557016

SEQ ID NO: 601964 - RNA, 64 nt, hsa; identical to SEQ ID NO: 557017

SEQ ID NO: 601965 - RNA, 64 nt, hsa; identical to SEQ ID NO: 557018

SEQ ID NO: 601966 - RNA, 64 nt, hsa; identical to SEQ ID NO: 557019

SEQ ID NO: 601967 - RNA, 64 nt, hsa; identical to SEQ ID NO: 557020

SEQ ID NO: 601968 - RNA, 64 nt, hsa; identical to SEQ ID NO: 557021

SEQ ID NO: 601969 - RNA, 64 nt, hsa; identical to SEQ ID NO: 557022

SEQ ID NO: 601970 - RNA, 64 nt, hsa; identical to SEQ ID NO: 557023

SEQ ID NO: 601971 - RNA, 64 nt, hsa; identical to SEQ ID NO: 557024

SEQ ID NO: 601972 - RNA, 64 nt, hsa; identical to SEQ ID NO: 557025

SEQ ID NO: 601973 - RNA, 64 nt, hsa; identical to SEQ ID NO: 99218

SEQ ID NO: 601974 - RNA, 64 nt, hsa; identical to SEQ ID NO: 99219

SEQ ID NO: 601975 - RNA, 64 nt, hsa; identical to SEQ ID NO: 99220

SEQ ID NO: 601976 - RNA, 64 nt, hsa; identical to SEQ ID NO: 99221

SEQ ID NO: 601977 - RNA, 64 nt, hsa; identical to SEQ ID NO: 99222

SEQ ID NO: 601978 - RNA, 64 nt, hsa; identical to SEQ ID NO: 99223

SEQ ID NO: 601979 - RNA, 64 nt, hsa; identical to SEQ ID NO: 99224

SEQ ID NO: 601980 - RNA, 64 nt, hsa; identical to SEQ ID NO: 99225

SEQ ID NO: 601981 - RNA, 64 nt, hsa; identical to SEQ ID NO: 99226

SEQ ID NO: 601982 - RNA, 64 nt, hsa; identical to SEQ ID NO: 99227

SEQ ID NO: 601983 - RNA, 64 nt, hsa; identical to SEQ ID NO: 99228

SEQ ID NO: 601984 - RNA, 64 nt, hsa; identical to SEQ ID NO: 99229

SEQ ID NO: 601985 - RNA, 64 nt, hsa; identical to SEQ ID NO: 99230

SEQ ID NO: 601986 - RNA, 64 nt, hsa; identical to SEQ ID NO: 99231

SEQ ID NO: 601987 - RNA, 64 nt, hsa; identical to SEQ ID NO: 99232

SEQ ID NO: 601988 - RNA, 64 nt, hsa; identical to SEQ ID NO: 99233

SEQ ID NO: 601989 - RNA, 64 nt, hsa; identical to SEQ ID NO: 99234

SEQ ID NO: 601990 - RNA, 64 nt, hsa; identical to SEQ ID NO: 99235

SEQ ID NO: 601991 - RNA, 64 nt, hsa; identical to SEQ ID NO: 99236

SEQ ID NO: 601992 - RNA, 64 nt, hsa; identical to SEQ ID NO: 99237

SEQ ID NO: 601993 - RNA, 64 nt, hsa; identical to SEQ ID NO: 99238

SEQ ID NO: 601994 - RNA, 64 nt, hsa; identical to SEQ ID NO: 99239

SEQ ID NO: 601995 - RNA, 64 nt, hsa; identical to SEQ ID NO: 99240

SEQ ID NO: 601996 - RNA, 64 nt, hsa; identical to SEQ ID NO: 99241

SEQ ID NO: 601997 - RNA, 64 nt, hsa; identical to SEQ ID NO: 144505

SEQ ID NO: 601998 - RNA, 64 nt, hsa; identical to SEQ ID NO: 144505

SEQ ID NO: 601999 - RNA, 64 nt, hsa; identical to SEQ ID NO: 144507

SEQ ID NO: 602000 - RNA, 64 nt, hsa; identical to SEQ ID NO: 144508

SEQ ID NO: 602001 - RNA, 64 nt, hsa
caguggccauugagcugggagcauucuucccucuaccgcuuaagccacugauggcugcgagcuu

SEQ ID NO: 602002 - RNA, 64 nt, hsa
ugcugcuuuacuaacugacguguuggaccaccccaccgcuuaauggggcacgcacggugcauca

SEQ ID NO: 602003 - RNA, 64 nt, hsa
cagcaucccccucuauuuccaaugcuccucuccaaccgcuuaguuucugaauuucuuuuaaauu

SEQ ID NO: 602004 - RNA, 64 nt, hsa
aaacugcgaacuccuuaaagcucuaucuagccaaaccgcuuacgaccuuguauauauuuaauuu

SEQ ID NO: 602005 - RNA, 64 nt, hsa
gauagcaucuucuuuggcacaagacuaguggcuuaccgcuuaccuuagaguuuuguuuuuuuuu

SEQ ID NO: 602006 - RNA, 64 nt, hsa
uacgagcacauccagaaagaagacaugaggcugcaccgcuuaccuggccacuggcacuccaggg

SEQ ID NO: 602007 - RNA, 64 nt, hsa
uaaucccagcuacuugggaggcugaggcaggagaaccgcuuaaaccugggagguggagguugca

SEQ ID NO: 602008 - RNA, 64 nt, hsa
ugucaccuucuuaacuagaauaguuguugaagguaccgcuuaagccauuuuuuucuuaacaucg

SEQ ID NO: 602009 - RNA, 64 nt, hsa
auagcuaauagcucuuauuuuucuuauguuuuuaaccgcuuaggucuauuuggauguaagggug

SEQ ID NO: 602010 - RNA, 54 nt, hsa
uuuacggcuucggcggcuaaugcuaccgcuuaaacgacucagcaucucgacuuc

SEQ ID NO: 602011 - RNA, 64 nt, hsa
auugucuaggucacaguaaucccuaggauuuuucaccgcuuauucuuuuugucuuuuuaacaaa

SEQ ID NO: 602012 - RNA, 64 nt, hsa
cuaauuagugccuggggaugaccuaugcaaucacaccgcuuaugaccauccuagagagggcccu

SEQ ID NO: 602013 - RNA, 64 nt, hsa
ucugucccagaaaagcggcccugcaaguuugaggaccgcuuauuccacuuuaaggacagccuuc

SEQ ID NO: 602014 - RNA, 64 nt, hsa
aucagggccaacugagagugagggagucucacccaccgcuuaccccagcccuccccugggagca

SEQ ID NO: 602015 - RNA, 64 nt, hsa
ugcugcuccaguaacuacaguggcauuaggacuuaccgcuuagaugacaauagugcucuuuaca

SEQ ID NO: 602016 - RNA, 64 nt, hsa
uccucccagcacuuugcagggcugagguggaaggaccgcuuaagcccagguguucaaggcugcu

SEQ ID NO: 602017 - RNA, 64 nt, hsa
uuuguauuucuggaagaauguaguaaucuucuagaccgcuuaaaaccaaugcucccaagcugaa

SEQ ID NO: 602018 - RNA, 64 nt, hsa
cauccaggaauacagucugcagugcagcaacagaaccgcuuaccaagaacugugcuuacauacc

SEQ ID NO: 602019 - RNA, 64 nt, hsa
uaugcauguguuuuuuccccauuguauauaaaguaccgcuuaaaauugauauaaauuacugagg

SEQ ID NO: 602020 - RNA, 64 nt, hsa
uuguucacacucagaacccaggacagccacagccaccgcuuaggggaagccacugcagaugccc

SEQ ID NO: 602021 - RNA, 64 nt, hsa
auuugcgggucuaaucuaauauuagaauauauuaaccgcuuaaggcauugaagccauaugggau

SEQ ID NO: 602022 - RNA, 64 nt, hsa
ccucgccauaaggcacuuaucccugguuccuagcaccgcuuauccccucagaauccacaacuug

SEQ ID NO: 602023 - RNA, 64 nt, hsa
agcccaguggcaccuggaaugccagugaaacagaaccgcuuacucccuuguuaagggggcugaa

SEQ ID NO: 602024 - RNA, 64 nt, hsa
gggcgaggaacaccuggcccacccagggcggaaaaccgcuuaaagggguuccugaaccacaaac

SEQ ID NO: 602025 - RNA, 64 nt, hsa
aaggaggccagaggcugcaaggagcggggucgugaccgcuuacaccccuucuccacagcccggc

SEQ ID NO: 602026 - RNA, 64 nt, hsa
acuuuuccucaagaggaaaucuggauuuccaccuaccgcuuaccugaaaugcaggaucaccuac

SEQ ID NO: 602027 - RNA, 64 nt, hsa
gcacagcccagugugggauuacagcuuugggaugaccgcuuacaaaguucuguuugguuaguau

SEQ ID NO: 602028 - RNA, 64 nt, hsa; identical to SEQ ID NO: 45231

SEQ ID NO: 602029 - RNA, 64 nt, hsa; identical to SEQ ID NO: 45232

SEQ ID NO: 602030 - RNA, 64 nt, hsa; identical to SEQ ID NO: 45233

SEQ ID NO: 602031 - RNA, 64 nt, hsa; identical to SEQ ID NO: 45234

SEQ ID NO: 602032 - RNA, 64 nt, hsa; identical to SEQ ID NO: 45235

SEQ ID NO: 602033 - RNA, 64 nt, hsa; identical to SEQ ID NO: 45236

SEQ ID NO: 602034 - RNA, 64 nt, hsa; identical to SEQ ID NO: 45237

SEQ ID NO: 602035 - RNA, 64 nt, hsa; identical to SEQ ID NO: 45238

SEQ ID NO: 602036 - RNA, 64 nt, hsa; identical to SEQ ID NO: 45239

SEQ ID NO: 602037 - RNA, 64 nt, hsa; identical to SEQ ID NO: 45240

SEQ ID NO: 602038 - RNA, 64 nt, hsa; identical to SEQ ID NO: 45241

SEQ ID NO: 602039 - RNA, 64 nt, hsa; identical to SEQ ID NO: 45242

SEQ ID NO: 602040 - RNA, 64 nt, hsa; identical to SEQ ID NO: 45243

SEQ ID NO: 602041 - RNA, 64 nt, hsa; identical to SEQ ID NO: 45244

SEQ ID NO: 602042 - RNA, 64 nt, hsa; identical to SEQ ID NO: 45245

SEQ ID NO: 602043 - RNA, 64 nt, hsa; identical to SEQ ID NO: 45246

SEQ ID NO: 602044 - RNA, 64 nt, hsa; identical to SEQ ID NO: 45247

SEQ ID NO: 602045 - RNA, 64 nt, hsa; identical to SEQ ID NO: 45248

SEQ ID NO: 602046 - RNA, 64 nt, hsa; identical to SEQ ID NO: 45249

SEQ ID NO: 602047 - RNA, 64 nt, hsa; identical to SEQ ID NO: 45250

SEQ ID NO: 602048 - RNA, 64 nt, hsa; identical to SEQ ID NO: 45251

SEQ ID NO: 602049 - RNA, 64 nt, hsa; identical to SEQ ID NO: 45252

SEQ ID NO: 602050 - RNA, 64 nt, hsa; identical to SEQ ID NO: 45253

SEQ ID NO: 602051 - RNA, 64 nt, hsa; identical to SEQ ID NO: 45254

SEQ ID NO: 602052 - RNA, 64 nt, hsa; identical to SEQ ID NO: 45255

SEQ ID NO: 602053 - RNA, 64 nt, hsa; identical to SEQ ID NO: 45256

SEQ ID NO: 602054 - RNA, 64 nt, hsa; identical to SEQ ID NO: 45257

SEQ ID NO: 602055 - RNA, 64 nt, hsa; identical to SEQ ID NO: 45258

SEQ ID NO: 602056 - RNA, 64 nt, hsa; identical to SEQ ID NO: 45259

SEQ ID NO: 602057 - RNA, 64 nt, hsa; identical to SEQ ID NO: 45260

SEQ ID NO: 602058 - RNA, 64 nt, hsa; identical to SEQ ID NO: 45261

SEQ ID NO: 602059 - RNA, 64 nt, hsa; identical to SEQ ID NO: 45262

SEQ ID NO: 602060 - RNA, 64 nt, hsa; identical to SEQ ID NO: 45263

SEQ ID NO: 602061 - RNA, 64 nt, hsa; identical to SEQ ID NO: 45264

SEQ ID NO: 602062 - RNA, 64 nt, hsa; identical to SEQ ID NO: 45265

SEQ ID NO: 602063 - RNA, 64 nt, hsa; identical to SEQ ID NO: 45266

SEQ ID NO: 602064 - RNA, 64 nt, hsa; identical to SEQ ID NO: 45267

SEQ ID NO: 602065 - RNA, 64 nt, hsa; identical to SEQ ID NO: 45268

SEQ ID NO: 602066 - RNA, 64 nt, hsa; identical to SEQ ID NO: 45269

SEQ ID NO: 602067 - RNA, 64 nt, hsa; identical to SEQ ID NO: 45270

SEQ ID NO: 602068 - RNA, 64 nt, hsa; identical to SEQ ID NO: 45271

SEQ ID NO: 602069 - RNA, 64 nt, hsa; identical to SEQ ID NO: 45272

SEQ ID NO: 602070 - RNA, 64 nt, hsa; identical to SEQ ID NO: 45273

SEQ ID NO: 602071 - RNA, 64 nt, hsa; identical to SEQ ID NO: 45274

SEQ ID NO: 602072 - RNA, 64 nt, hsa; identical to SEQ ID NO: 45275

SEQ ID NO: 602073 - RNA, 64 nt, hsa; identical to SEQ ID NO: 45276

SEQ ID NO: 602074 - RNA, 64 nt, hsa; identical to SEQ ID NO: 45277

SEQ ID NO: 602075 - RNA, 64 nt, hsa; identical to SEQ ID NO: 45278

SEQ ID NO: 602076 - RNA, 64 nt, hsa; identical to SEQ ID NO: 45279

SEQ ID NO: 602077 - RNA, 64 nt, hsa; identical to SEQ ID NO: 45280

SEQ ID NO: 602078 - RNA, 64 nt, hsa; identical to SEQ ID NO: 468621

SEQ ID NO: 602079 - RNA, 64 nt, hsa; identical to SEQ ID NO: 468622

SEQ ID NO: 602080 - RNA, 64 nt, hsa; identical to SEQ ID NO: 468623

SEQ ID NO: 602081 - RNA, 64 nt, hsa; identical to SEQ ID NO: 468624

SEQ ID NO: 602082 - RNA, 64 nt, hsa; identical to SEQ ID NO: 468625

SEQ ID NO: 602083 - RNA, 64 nt, hsa; identical to SEQ ID NO: 468626

SEQ ID NO: 602084 - RNA, 64 nt, hsa; identical to SEQ ID NO: 468627

SEQ ID NO: 602085 - RNA, 64 nt, hsa; identical to SEQ ID NO: 468628

SEQ ID NO: 602086 - RNA, 64 nt, hsa; identical to SEQ ID NO: 468629

SEQ ID NO: 602087 - RNA, 64 nt, hsa; identical to SEQ ID NO: 468630

SEQ ID NO: 602088 - RNA, 64 nt, hsa; identical to SEQ ID NO: 468631

SEQ ID NO: 602089 - RNA, 64 nt, hsa; identical to SEQ ID NO: 468632

SEQ ID NO: 602090 - RNA, 64 nt, hsa; identical to SEQ ID NO: 468633

SEQ ID NO: 602091 - RNA, 64 nt, hsa; identical to SEQ ID NO: 468634

SEQ ID NO: 602092 - RNA, 64 nt, hsa; identical to SEQ ID NO: 468635

SEQ ID NO: 602093 - RNA, 64 nt, hsa; identical to SEQ ID NO: 468636

SEQ ID NO: 602094 - RNA, 64 nt, hsa; identical to SEQ ID NO: 468637

SEQ ID NO: 602095 - RNA, 64 nt, hsa; identical to SEQ ID NO: 468638

SEQ ID NO: 602096 - RNA, 64 nt, hsa; identical to SEQ ID NO: 468639

SEQ ID NO: 602097 - RNA, 64 nt, hsa; identical to SEQ ID NO: 468640

SEQ ID NO: 602098 - RNA, 64 nt, hsa; identical to SEQ ID NO: 468641

SEQ ID NO: 602099 - RNA, 64 nt, hsa; identical to SEQ ID NO: 468642

SEQ ID NO: 602100 - RNA, 64 nt, hsa; identical to SEQ ID NO: 468643

SEQ ID NO: 602101 - RNA, 64 nt, hsa; identical to SEQ ID NO: 468644

SEQ ID NO: 602102 - RNA, 64 nt, hsa; identical to SEQ ID NO: 468645

SEQ ID NO: 602103 - RNA, 64 nt, hsa; identical to SEQ ID NO: 468646

SEQ ID NO: 602104 - RNA, 64 nt, hsa; identical to SEQ ID NO: 468647

SEQ ID NO: 602105 - RNA, 64 nt, hsa; identical to SEQ ID NO: 468648

SEQ ID NO: 602106 - RNA, 64 nt, hsa; identical to SEQ ID NO: 468649

SEQ ID NO: 602107 - RNA, 64 nt, hsa; identical to SEQ ID NO: 468650

SEQ ID NO: 602108 - RNA, 64 nt, hsa; identical to SEQ ID NO: 468651

SEQ ID NO: 602109 - RNA, 64 nt, hsa; identical to SEQ ID NO: 468652

SEQ ID NO: 602110 - RNA, 64 nt, hsa; identical to SEQ ID NO: 468653

SEQ ID NO: 602111 - RNA, 64 nt, hsa; identical to SEQ ID NO: 468654

SEQ ID NO: 602112 - RNA, 64 nt, hsa; identical to SEQ ID NO: 468655

SEQ ID NO: 602113 - RNA, 64 nt, hsa; identical to SEQ ID NO: 468656

SEQ ID NO: 602114 - RNA, 64 nt, hsa; identical to SEQ ID NO: 468657

SEQ ID NO: 602115 - RNA, 64 nt, hsa; identical to SEQ ID NO: 468658

SEQ ID NO: 602116 - RNA, 64 nt, hsa; identical to SEQ ID NO: 468659

SEQ ID NO: 602117 - RNA, 64 nt, hsa; identical to SEQ ID NO: 468660

SEQ ID NO: 602118 - RNA, 64 nt, hsa; identical to SEQ ID NO: 468661

SEQ ID NO: 602119 - RNA, 64 nt, hsa; identical to SEQ ID NO: 468662

SEQ ID NO: 602120 - RNA, 64 nt, hsa; identical to SEQ ID NO: 468663

SEQ ID NO: 602121 - RNA, 64 nt, hsa; identical to SEQ ID NO: 468664

SEQ ID NO: 602122 - RNA, 64 nt, hsa; identical to SEQ ID NO: 468665

SEQ ID NO: 602123 - RNA, 64 nt, hsa; identical to SEQ ID NO: 468666

SEQ ID NO: 602124 - RNA, 64 nt, hsa; identical to SEQ ID NO: 468667

SEQ ID NO: 602125 - RNA, 64 nt, hsa; identical to SEQ ID NO: 468668

SEQ ID NO: 602126 - RNA, 64 nt, hsa; identical to SEQ ID NO: 468669

SEQ ID NO: 602127 - RNA, 64 nt, hsa; identical to SEQ ID NO: 468670

SEQ ID NO: 602128 - RNA, 64 nt, hsa; identical to SEQ ID NO: 468671

SEQ ID NO: 602129 - RNA, 64 nt, hsa; identical to SEQ ID NO: 468672

SEQ ID NO: 602130 - RNA, 64 nt, hsa; identical to SEQ ID NO: 468673

SEQ ID NO: 602131 - RNA, 64 nt, hsa; identical to SEQ ID NO: 468674

SEQ ID NO: 602132 - RNA, 64 nt, hsa; identical to SEQ ID NO: 468675

SEQ ID NO: 602133 - RNA, 64 nt, hsa; identical to SEQ ID NO: 468676

SEQ ID NO: 602134 - RNA, 64 nt, hsa; identical to SEQ ID NO: 468677

SEQ ID NO: 602135 - RNA, 64 nt, hsa; identical to SEQ ID NO: 468678

SEQ ID NO: 602136 - RNA, 64 nt, hsa; identical to SEQ ID NO: 468679

SEQ ID NO: 602137 - RNA, 64 nt, hsa; identical to SEQ ID NO: 468680

SEQ ID NO: 602138 - RNA, 64 nt, hsa; identical to SEQ ID NO: 468681

SEQ ID NO: 602139 - RNA, 64 nt, hsa; identical to SEQ ID NO: 468682

SEQ ID NO: 602140 - RNA, 64 nt, hsa; identical to SEQ ID NO: 468683

SEQ ID NO: 602141 - RNA, 64 nt, hsa; identical to SEQ ID NO: 468684

SEQ ID NO: 602142 - RNA, 64 nt, hsa; identical to SEQ ID NO: 468685

SEQ ID NO: 602143 - RNA, 64 nt, hsa; identical to SEQ ID NO: 468686

SEQ ID NO: 602144 - RNA, 64 nt, hsa; identical to SEQ ID NO: 468687

SEQ ID NO: 602145 - RNA, 64 nt, hsa; identical to SEQ ID NO: 468688

SEQ ID NO: 602146 - RNA, 64 nt, hsa; identical to SEQ ID NO: 468689

SEQ ID NO: 602147 - RNA, 64 nt, hsa; identical to SEQ ID NO: 468690

SEQ ID NO: 602148 - RNA, 64 nt, hsa; identical to SEQ ID NO: 468691

SEQ ID NO: 602149 - RNA, 64 nt, hsa
caacuuucuuuuguacauuuugauacuuucuaccuaauggcagcucuuccaaaauagcugcuuu

SEQ ID NO: 602150 - RNA, 64 nt, hsa
auugaccacaugaaucgaaaacacucaucacaauuaauggcacuaucauuaaugagacaugagu

SEQ ID NO: 602151 - RNA, 64 nt, hsa
gagauagauagauauacuaucucacuagcuugacuaauggcaacaaaguuccagcuuguguagu

SEQ ID NO: 602152 - RNA, 64 nt, hsa
ccauugacuuaaagguaucauuugaaaaauaccauaauggcauuugagacugaauuucuaaaaa

SEQ ID NO: 602153 - RNA, 64 nt, hsa
caucugccacaggucuauuuugaagcuuuucuucuaauggcaauguuuguccuuaccaggauuu

SEQ ID NO: 602154 - RNA, 64 nt, hsa
gcuuucaacagguuuuaaaccuggcauuaaaauguaauggcaaaaccaauauuuucuauauugu

SEQ ID NO: 602155 - RNA, 64 nt, hsa
uagagaauaagcuugccaauuuaaggccugucuguaauggcaucugaauguuccagcagccuaa

SEQ ID NO: 602156 - RNA, 64 nt, hsa
ggauaauggcacuaggcagcauuuguauaguaacuaauggcaaaaauucauggcuagugaugua

SEQ ID NO: 602157 - RNA, 64 nt, hsa
gaauuguggacguaaaaugguugugcuauuuggauaauggcacuaggcagcauuuguauaguaa

SEQ ID NO: 602158 - RNA, 64 nt, hsa
cuccagaaaauauccaucuucuuuuuguggcugcuaauggcagaagugccugugcuagaguucc

SEQ ID NO: 602159 - RNA, 64 nt, hsa
agacgggaugcuaagcagugcaccugcagugguuuaauggcagauaagcuccgucugcaguucc

SEQ ID NO: 602160 - RNA, 64 nt, hsa; identical to SEQ ID NO: 584690

SEQ ID NO: 602161 - RNA, 64 nt, hsa; identical to SEQ ID NO: 584691

SEQ ID NO: 602162 - RNA, 64 nt, hsa; identical to SEQ ID NO: 412166

SEQ ID NO: 602163 - RNA, 64 nt, hsa; identical to SEQ ID NO: 412167

SEQ ID NO: 602164 - RNA, 64 nt, hsa; identical to SEQ ID NO: 412168

SEQ ID NO: 602165 - RNA, 64 nt, hsa; identical to SEQ ID NO: 412169

SEQ ID NO: 602166 - RNA, 64 nt, hsa; identical to SEQ ID NO: 412170

SEQ ID NO: 602167 - RNA, 64 nt, hsa; identical to SEQ ID NO: 412171

SEQ ID NO: 602168 - RNA, 64 nt, hsa; identical to SEQ ID NO: 412172

SEQ ID NO: 602169 - RNA, 64 nt, hsa; identical to SEQ ID NO: 412173

SEQ ID NO: 602170 - RNA, 64 nt, hsa; identical to SEQ ID NO: 412174

SEQ ID NO: 602171 - RNA, 64 nt, hsa; identical to SEQ ID NO: 412175

SEQ ID NO: 602172 - RNA, 64 nt, hsa; identical to SEQ ID NO: 412176

SEQ ID NO: 602173 - RNA, 64 nt, hsa; identical to SEQ ID NO: 412177

SEQ ID NO: 602174 - RNA, 64 nt, hsa; identical to SEQ ID NO: 412178

SEQ ID NO: 602175 - RNA, 64 nt, hsa; identical to SEQ ID NO: 412179

SEQ ID NO: 602176 - RNA, 64 nt, hsa; identical to SEQ ID NO: 412180

SEQ ID NO: 602177 - RNA, 64 nt, hsa; identical to SEQ ID NO: 412181

SEQ ID NO: 602178 - RNA, 64 nt, hsa; identical to SEQ ID NO: 412182

SEQ ID NO: 602179 - RNA, 64 nt, hsa; identical to SEQ ID NO: 412183

SEQ ID NO: 602180 - RNA, 64 nt, hsa; identical to SEQ ID NO: 412184

SEQ ID NO: 602181 - RNA, 64 nt, hsa; identical to SEQ ID NO: 412185

SEQ ID NO: 602182 - RNA, 64 nt, hsa; identical to SEQ ID NO: 412186

SEQ ID NO: 602183 - RNA, 64 nt, hsa; identical to SEQ ID NO: 412187

SEQ ID NO: 602184 - RNA, 64 nt, hsa; identical to SEQ ID NO: 412188

SEQ ID NO: 602185 - RNA, 64 nt, hsa; identical to SEQ ID NO: 412189

SEQ ID NO: 602186 - RNA, 64 nt, hsa; identical to SEQ ID NO: 412190

SEQ ID NO: 602187 - RNA, 64 nt, hsa; identical to SEQ ID NO: 412191

SEQ ID NO: 602188 - RNA, 64 nt, hsa; identical to SEQ ID NO: 173459

SEQ ID NO: 602189 - RNA, 64 nt, hsa; identical to SEQ ID NO: 173460

SEQ ID NO: 602190 - RNA, 64 nt, hsa; identical to SEQ ID NO: 173461

SEQ ID NO: 602191 - RNA, 64 nt, hsa; identical to SEQ ID NO: 173462

SEQ ID NO: 602192 - RNA, 64 nt, hsa; identical to SEQ ID NO: 173463

SEQ ID NO: 602193 - RNA, 64 nt, hsa; identical to SEQ ID NO: 173464

SEQ ID NO: 602194 - RNA, 64 nt, hsa; identical to SEQ ID NO: 173465

SEQ ID NO: 602195 - RNA, 64 nt, hsa; identical to SEQ ID NO: 173466

SEQ ID NO: 602196 - RNA, 64 nt, hsa
uccuugagcuguugugagcuuugaaguagguggcuugagcuagagauaaaacagaaucuucugg

SEQ ID NO: 602197 - RNA, 64 nt, hsa
agggguuagccuggacuaaaggcauccuugucuuuugagcuauucaccucaguagaaaaggauc

SEQ ID NO: 602198 - RNA, 64 nt, hsa
uuagaguucuuuaauucuuggcacaacgugacuguugagcuaacaccaaauaguguguuggcaa

SEQ ID NO: 602199 - RNA, 64 nt, hsa
cuggcaggauuuuaaaacucaaucagucuuuccuuugagcuagugacuugaaaagaaagagaga

SEQ ID NO: 602200 - RNA, 64 nt, hsa
auuuaaacauauuuaaacaaaaacaaaaaaaaugaaugcacaaacuugcugcugcuuagaucac

SEQ ID NO: 602201 - RNA, 64 nt, hsa
aaaaauaaauaaauuuaagaaaaccauuuuaaauaaugcacaguugcagccuggaaaaacuuaa

SEQ ID NO: 602202 - RNA, 64 nt, hsa
aaucuauccuuuaaacucuuccacuagacguuguaaugcacacuuauuuuuuucccaaggagua

SEQ ID NO: 602203 - RNA, 64 nt, hsa
gaccuuuguaguagaauuuacaacuuauaauuacaaugcacaauuuauaauuacaauauguauu

SEQ ID NO: 602204 - RNA, 64 nt, hsa
gcagagugcucacuuugaauugcuaauagaaaauaaugcacaguguccucaggauaugcuaaac

SEQ ID NO: 602205 - RNA, 64 nt, hsa
uaugugcacauacacacauuacacacacacacagaaugcacauuucacacacauauacuuauua

SEQ ID NO: 602206 - RNA, 64 nt, hsa
uucucaagaguauggauugacauauuguguuaugaaugcacaucucucagauguguugaagcau

SEQ ID NO: 602207 - RNA, 64 nt, hsa
auucacugacccaaaacucuuuauggcauuuuacaaugcacacagccucaugcaaguuuagaca

SEQ ID NO: 602208 - RNA, 64 nt, hsa
auacuucuaaauagugguaaaaaugcacaugguuaaugcacauguuacuuuuaaaucauuagga

SEQ ID NO: 602209 - RNA, 64 nt, hsa
cagugcaucagaaauacuucuaaauagugguaaaaaugcacaugguuaaugcacauguuacuuu

SEQ ID NO: 602210 - RNA, 64 nt, hsa
ugugcauuuuauauaaagaugcauuuuauauaaaaaugcacaccuuuaaucucuauauggcagc

SEQ ID NO: 602211 - RNA, 64 nt, hsa
cucuauauggcagcauauacauauauauauauaaaaugcacacuuuuaaucucuauauggcagc

SEQ ID NO: 602212 - RNA, 64 nt, hsa
auuuugugagauagaauucaauuaaagcgauuugaaugcacaguaaguggauaaucugaguaca

SEQ ID NO: 602213 - RNA, 64 nt, hsa
acccaaguaagauuguuuuuagucuugcuugaggaaugcacacuccauuuaaaaaauugugcgc

SEQ ID NO: 602214 - RNA, 64 nt, hsa
acagaaaugcacaggggacacuuacggacacagaaaugcacaggggaggccgagcauaaccagg

SEQ ID NO: 602215 - RNA, 64 nt, hsa
ucuacaggguuuauaguagucuuguggacacagaaaugcacaggggacacuuacggacacagaa

SEQ ID NO: 602216 - RNA, 64 nt, hsa
ugaaaaacccuuugugaaaguaacuuuucaaguaaaugcacaacuuuagaauuucuacaaauaa

SEQ ID NO: 602217 - RNA, 64 nt, hsa
guguagaaguagaguuaccuaaaccuuuaucgccaaugcacagcuuggccuguuaaguuaaaug

SEQ ID NO: 602218 - RNA, 64 nt, hsa
uguuuuuagcagagacaugcaacaacaacacacacgcacacacgcacacacacacacguacaca

SEQ ID NO: 602219 - RNA, 64 nt, hsa
gcagagacaugcaacaacaacacacacgcacacacgcacacacacacacguacacacacauaca

SEQ ID NO: 602220 - RNA, 64 nt, hsa
ucuucagcaccacacacacgcacacacacacacacgcacacaugcgugugcacccgcgcacgca

SEQ ID NO: 602221 - RNA, 64 nt, hsa
ccaagcaaccuccacuucuucagcaccacacacacgcacacacacacacacgcacacaugcgug

SEQ ID NO: 602222 - RNA, 64 nt, hsa
augcgcgcacacgugcucccugaaggcacacguacgcacacacgcacaugcacagauaugccgc

SEQ ID NO: 602223 - RNA, 64 nt, hsa
ggacacacacacacacacggauaugcugucuggacgcacacacgugcagauaugguauccggac

SEQ ID NO: 602224 - RNA, 64 nt, hsa
acacacacgugugcacagauaugcugucuggacacgcacacacaugcagauaugcugccuggac

SEQ ID NO: 602225 - RNA, 64 nt, hsa
acacgugcagauaugcuguccggauacacacgcacgcacacaugcagauaugcugccugggcac

SEQ ID NO: 602226 - RNA, 64 nt, hsa
aguugugugugcaaugcacacccagacacacgcacgcacacacacgcgcgcgcacacacaugcu

SEQ ID NO: 602227 - RNA, 64 nt, hsa
cacacccagacacacgcacgcacacacacgcgcgcgcacacacaugcuuuuuucuguuccccuc

SEQ ID NO: 602228 - RNA, 64 nt, hsa
uacacaggcauacaugcaugcacacacacaugcacgcacacacacaugcacacauacacgugca

SEQ ID NO: 602229 - RNA, 64 nt, hsa
caugcacacauauaugcacaggcacacacauguacgcacacacacaugcacugcacacauaucc

SEQ ID NO: 602230 - RNA, 64 nt, hsa
gauauacacauggaugcacgcacaugccaaugcacgcacacaucagugcacacggaugcacaga

SEQ ID NO: 602231 - RNA, 64 nt, hsa
cacggaugcacagagauaugcacacaccgaugugcgcacacacagauaugcacacacauggaug

SEQ ID NO: 602232 - RNA, 64 nt, hsa
ugcacacacauggaugagcacacacacaccaaugcgcacacacaccgauguacacacacagaug

SEQ ID NO: 602233 - RNA, 64 nt, hsa
cugucucgcucagaacaugcuccgcaaaguucuccgcacacacuucuuccccaucaagcccauu

SEQ ID NO: 602234 - RNA, 64 nt, hsa
ucuacgacccgaccucucuauguaagcacacaugcgcacacacacuugcauucaugaaucugau

SEQ ID NO: 602235 - RNA, 64 nt, hsa
acaccgccacauggcuuccuccugcgcgcaugugcgcacacacacacacacacgcacacacaca

SEQ ID NO: 602236 - RNA, 64 nt, hsa
cuccugcgcgcaugugcgcacacacacacacacacgcacacacacacacacacacucacugcgg

SEQ ID NO: 602237 - RNA, 64 nt, hsa
ugugugugugugugugugcgcgcgcgcgcgcacgcgcacacacucacgcacacacaagcagaga

SEQ ID NO: 602238 - RNA, 64 nt, hsa
ugugugcgcgcgcgcgcgcacgcgcacacacucacgcacacacaagcagagaaggcgcugaucu

SEQ ID NO: 602239 - RNA, 64 nt, hsa
cgcacacgcacacucggacucacacgaagucacacgcacacaugcacgcacacacacauauggg

SEQ ID NO: 602240 - RNA, 64 nt, hsa
cucggacucacacgaagucacacgcacacaugcacgcacacacacauauggggaccugcacacc

SEQ ID NO: 602241 - RNA, 64 nt, hsa
aucccccaugcucuugcgugugcuugcacgugcacgcacacacacacccagugcucucuccacc

SEQ ID NO: 602242 - RNA, 64 nt, hsa
gugugugugcgcgcgcgcgugcucgcugugcgcacgcacacaucuccucgucugggugugcgca

SEQ ID NO: 602243 - RNA, 64 nt, hsa; identical to SEQ ID NO: 360996

SEQ ID NO: 602244 - RNA, 64 nt, hsa; identical to SEQ ID NO: 360997

SEQ ID NO: 602245 - RNA, 64 nt, hsa; identical to SEQ ID NO: 360998

SEQ ID NO: 602246 - RNA, 64 nt, hsa; identical to SEQ ID NO: 360999

SEQ ID NO: 602247 - RNA, 64 nt, hsa; identical to SEQ ID NO: 361000

SEQ ID NO: 602248 - RNA, 64 nt, hsa; identical to SEQ ID NO: 361001

SEQ ID NO: 602249 - RNA, 64 nt, hsa; identical to SEQ ID NO: 361002

SEQ ID NO: 602250 - RNA, 64 nt, hsa; identical to SEQ ID NO: 361003

SEQ ID NO: 602251 - RNA, 64 nt, hsa; identical to SEQ ID NO: 361004

SEQ ID NO: 602252 - RNA, 64 nt, hsa; identical to SEQ ID NO: 361005

SEQ ID NO: 602253 - RNA, 64 nt, hsa; identical to SEQ ID NO: 361006

SEQ ID NO: 602254 - RNA, 64 nt, hsa; identical to SEQ ID NO: 361007

SEQ ID NO: 602255 - RNA, 64 nt, hsa; identical to SEQ ID NO: 361008

SEQ ID NO: 602256 - RNA, 64 nt, hsa; identical to SEQ ID NO: 361009

SEQ ID NO: 602257 - RNA, 64 nt, hsa; identical to SEQ ID NO: 361010

SEQ ID NO: 602258 - RNA, 64 nt, hsa; identical to SEQ ID NO: 361011

SEQ ID NO: 602259 - RNA, 64 nt, hsa; identical to SEQ ID NO: 361012

SEQ ID NO: 602260 - RNA, 64 nt, hsa; identical to SEQ ID NO: 361013

SEQ ID NO: 602261 - RNA, 64 nt, hsa; identical to SEQ ID NO: 376668

SEQ ID NO: 602262 - RNA, 64 nt, hsa; identical to SEQ ID NO: 376669

SEQ ID NO: 602263 - RNA, 64 nt, hsa; identical to SEQ ID NO: 376670

SEQ ID NO: 602264 - RNA, 64 nt, hsa; identical to SEQ ID NO: 376671

SEQ ID NO: 602265 - RNA, 64 nt, hsa; identical to SEQ ID NO: 376672

SEQ ID NO: 602266 - RNA, 64 nt, hsa; identical to SEQ ID NO: 376673

SEQ ID NO: 602267 - RNA, 64 nt, hsa; identical to SEQ ID NO: 107696

SEQ ID NO: 602268 - RNA, 64 nt, hsa; identical to SEQ ID NO: 107697

SEQ ID NO: 602269 - RNA, 64 nt, hsa; identical to SEQ ID NO: 107698

SEQ ID NO: 602270 - RNA, 64 nt, hsa; identical to SEQ ID NO: 107699

SEQ ID NO: 602271 - RNA, 64 nt, hsa; identical to SEQ ID NO: 107700

SEQ ID NO: 602272 - RNA, 64 nt, hsa; identical to SEQ ID NO: 107701

SEQ ID NO: 602273 - RNA, 64 nt, hsa; identical to SEQ ID NO: 107702

SEQ ID NO: 602274 - RNA, 64 nt, hsa; identical to SEQ ID NO: 107703

SEQ ID NO: 602275 - RNA, 64 nt, hsa
acccugcuccaucggcacuggcgcccugcuccaucggcacuaaugcuccacucggcgccccacu

SEQ ID NO: 602276 - RNA, 64 nt, hsa
cacucggcgccccacuccaucggccccgcuccaucggcacuaaugccccacucggcgccccacu

SEQ ID NO: 602277 - RNA, 64 nt, hsa
cuccacuccauuggcacuaacgccccaacuccagcggcacuaaugacccgcuccuuugacauug

SEQ ID NO: 602278 - RNA, 64 nt, hsa
gucccacuccauugucacuaacguccggcuccaucggcacuaccaccccgcuccaucaucacua

SEQ ID NO: 602279 - RNA, 64 nt, hsa
caccccgcuccaucaucacuauguccagcuccgucggcacuaccacccugcuccaucaucacua

SEQ ID NO: 602280 - RNA, 64 nt, hsa
guccagcuccaacggcacuggugccccauuccaucggcacuaacgccccgcuccaccggcacca

SEQ ID NO: 602281 - RNA, 64 nt, hsa
gcccagcuccaccgguacuggcucccugcuccaucggcacuaacgcccugcuucauuggcacuu

SEQ ID NO: 602282 - RNA, 64 nt, hsa
gccucuccuuuucacuucuugccuucuguggauuuugucugauacuaauccaggcacacugcug

SEQ ID NO: 602283 - RNA, 64 nt, hsa
gcuuugacuggccguaaguucucucagcuuuuguuugucugaaaauaaauuuaguucgccuuua

SEQ ID NO: 602284 - RNA, 64 nt, hsa
ucuuuuccaaauuagggccacagaacagcaacauuugucugacaguaguauaaagaauaaugau

SEQ ID NO: 602285 - RNA, 64 nt, hsa
uugaaacagaugugaaaaacagaaaaagaaaaaauugucugaaauguuuauuuugcaaaacagu

SEQ ID NO: 602286 - RNA, 64 nt, hsa
aaucaccauagaucauggcugaaauaguuuguaauugucugagucugugcacguacuuuuagau

SEQ ID NO: 602287 - RNA, 64 nt, hsa
uuucaggagucaaauguagccauaaacuguauccuugucugacacuuuagcuaaaaauuuccag

SEQ ID NO: 602288 - RNA, 64 nt, hsa
gcaaagagcugugauaaaccaugcuuuuuugagcuugucugacuccuaauuaauaacauguuuu

SEQ ID NO: 602289 - RNA, 64 nt, hsa
uuugucuuuuagcuaaaggaaaagcauuggcgauuugucugauucugguuuugaguuacucuuu

SEQ ID NO: 602290 - RNA, 64 nt, hsa
auguuuuucuggcugggagcuccugguuacccccuugucugacugcuugguggcaggcacccug

SEQ ID NO: 602291 - RNA, 64 nt, hsa
uauugcuuuugugaaacaaagaaaauuuaccaccuugucugauacauagauuggaaggcgcucu

SEQ ID NO: 602292 - RNA, 64 nt, hsa
auuccucucauuaaggaaauauuuuuccccacaauugucugauguaugaguccucucagaagca

SEQ ID NO: 602293 - RNA, 64 nt, hsa; identical to SEQ ID NO: 65415

SEQ ID NO: 602294 - RNA, 64 nt, hsa; identical to SEQ ID NO: 65416

SEQ ID NO: 602295 - RNA, 64 nt, hsa; identical to SEQ ID NO: 65417

SEQ ID NO: 602296 - RNA, 64 nt, hsa; identical to SEQ ID NO: 65418

SEQ ID NO: 602297 - RNA, 64 nt, hsa; identical to SEQ ID NO: 61352

SEQ ID NO: 602298 - RNA, 64 nt, hsa; identical to SEQ ID NO: 61353

SEQ ID NO: 602299 - RNA, 64 nt, hsa; identical to SEQ ID NO: 65421

SEQ ID NO: 602300 - RNA, 64 nt, hsa; identical to SEQ ID NO: 65422

SEQ ID NO: 602301 - RNA, 64 nt, hsa; identical to SEQ ID NO: 65423

SEQ ID NO: 602302 - RNA, 64 nt, hsa; identical to SEQ ID NO: 65424

SEQ ID NO: 602303 - RNA, 64 nt, hsa; identical to SEQ ID NO: 65425

SEQ ID NO: 602304 - RNA, 64 nt, hsa; identical to SEQ ID NO: 65426

SEQ ID NO: 602305 - RNA, 64 nt, hsa; identical to SEQ ID NO: 61354

SEQ ID NO: 602306 - RNA, 64 nt, hsa; identical to SEQ ID NO: 61355

SEQ ID NO: 602307 - RNA, 64 nt, hsa; identical to SEQ ID NO: 65429

SEQ ID NO: 602308 - RNA, 64 nt, hsa; identical to SEQ ID NO: 65430

SEQ ID NO: 602309 - RNA, 64 nt, hsa; identical to SEQ ID NO: 65431

SEQ ID NO: 602310 - RNA, 64 nt, hsa; identical to SEQ ID NO: 65432

SEQ ID NO: 602311 - RNA, 64 nt, hsa; identical to SEQ ID NO: 65433

SEQ ID NO: 602312 - RNA, 64 nt, hsa; identical to SEQ ID NO: 65434

SEQ ID NO: 602313 - RNA, 64 nt, hsa; identical to SEQ ID NO: 65435

SEQ ID NO: 602314 - RNA, 64 nt, hsa; identical to SEQ ID NO: 65436

SEQ ID NO: 602315 - RNA, 64 nt, hsa; identical to SEQ ID NO: 65437

SEQ ID NO: 602316 - RNA, 64 nt, hsa; identical to SEQ ID NO: 65438

SEQ ID NO: 602317 - RNA, 64 nt, hsa; identical to SEQ ID NO: 65439

SEQ ID NO: 602318 - RNA, 64 nt, hsa; identical to SEQ ID NO: 65440

SEQ ID NO: 602319 - RNA, 64 nt, hsa; identical to SEQ ID NO: 61356

SEQ ID NO: 602320 - RNA, 64 nt, hsa; identical to SEQ ID NO: 61357

SEQ ID NO: 602321 - RNA, 64 nt, hsa; identical to SEQ ID NO: 65443

SEQ ID NO: 602322 - RNA, 64 nt, hsa; identical to SEQ ID NO: 65444

SEQ ID NO: 602323 - RNA, 64 nt, hsa; identical to SEQ ID NO: 65445

SEQ ID NO: 602324 - RNA, 64 nt, hsa; identical to SEQ ID NO: 65446

SEQ ID NO: 602325 - RNA, 64 nt, hsa; identical to SEQ ID NO: 65447

SEQ ID NO: 602326 - RNA, 64 nt, hsa; identical to SEQ ID NO: 65448

SEQ ID NO: 602327 - RNA, 64 nt, hsa; identical to SEQ ID NO: 65449

SEQ ID NO: 602328 - RNA, 64 nt, hsa; identical to SEQ ID NO: 65450

SEQ ID NO: 602329 - RNA, 64 nt, hsa; identical to SEQ ID NO: 65451

SEQ ID NO: 602330 - RNA, 64 nt, hsa; identical to SEQ ID NO: 65452

SEQ ID NO: 602331 - RNA, 64 nt, hsa; identical to SEQ ID NO: 65453

SEQ ID NO: 602332 - RNA, 64 nt, hsa; identical to SEQ ID NO: 65454

SEQ ID NO: 602333 - RNA, 64 nt, hsa; identical to SEQ ID NO: 65455

SEQ ID NO: 602334 - RNA, 64 nt, hsa; identical to SEQ ID NO: 65456

SEQ ID NO: 602335 - RNA, 64 nt, hsa; identical to SEQ ID NO: 65457

SEQ ID NO: 602336 - RNA, 64 nt, hsa; identical to SEQ ID NO: 65458

SEQ ID NO: 602337 - RNA, 64 nt, hsa; identical to SEQ ID NO: 65459

SEQ ID NO: 602338 - RNA, 64 nt, hsa; identical to SEQ ID NO: 65460

SEQ ID NO: 602339 - RNA, 64 nt, hsa; identical to SEQ ID NO: 65461

SEQ ID NO: 602340 - RNA, 64 nt, hsa; identical to SEQ ID NO: 65462

SEQ ID NO: 602341 - RNA, 64 nt, hsa; identical to SEQ ID NO: 65463

SEQ ID NO: 602342 - RNA, 64 nt, hsa; identical to SEQ ID NO: 65464

SEQ ID NO: 602343 - RNA, 64 nt, hsa; identical to SEQ ID NO: 61358

SEQ ID NO: 602344 - RNA, 64 nt, hsa; identical to SEQ ID NO: 61359

SEQ ID NO: 602345 - RNA, 64 nt, hsa; identical to SEQ ID NO: 65467

SEQ ID NO: 602346 - RNA, 64 nt, hsa; identical to SEQ ID NO: 65468

SEQ ID NO: 602347 - RNA, 64 nt, hsa; identical to SEQ ID NO: 65469

SEQ ID NO: 602348 - RNA, 64 nt, hsa; identical to SEQ ID NO: 65470

SEQ ID NO: 602349 - RNA, 64 nt, hsa; identical to SEQ ID NO: 65471

SEQ ID NO: 602350 - RNA, 64 nt, hsa; identical to SEQ ID NO: 65472

SEQ ID NO: 602351 - RNA, 64 nt, hsa; identical to SEQ ID NO: 65473

SEQ ID NO: 602352 - RNA, 64 nt, hsa; identical to SEQ ID NO: 65474

SEQ ID NO: 602353 - RNA, 64 nt, hsa; identical to SEQ ID NO: 65475

SEQ ID NO: 602354 - RNA, 64 nt, hsa; identical to SEQ ID NO: 65476

SEQ ID NO: 602355 - RNA, 64 nt, hsa; identical to SEQ ID NO: 65477

SEQ ID NO: 602356 - RNA, 64 nt, hsa; identical to SEQ ID NO: 65478

SEQ ID NO: 602357 - RNA, 64 nt, hsa; identical to SEQ ID NO: 65479

SEQ ID NO: 602358 - RNA, 64 nt, hsa; identical to SEQ ID NO: 65480

SEQ ID NO: 602359 - RNA, 64 nt, hsa; identical to SEQ ID NO: 65481

SEQ ID NO: 602360 - RNA, 64 nt, hsa; identical to SEQ ID NO: 65482

SEQ ID NO: 602361 - RNA, 64 nt, hsa; identical to SEQ ID NO: 65483

SEQ ID NO: 602362 - RNA, 64 nt, hsa; identical to SEQ ID NO: 65484

SEQ ID NO: 602363 - RNA, 64 nt, hsa; identical to SEQ ID NO: 65485

SEQ ID NO: 602364 - RNA, 64 nt, hsa; identical to SEQ ID NO: 65486

SEQ ID NO: 602365 - RNA, 64 nt, hsa; identical to SEQ ID NO: 65487

SEQ ID NO: 602366 - RNA, 64 nt, hsa; identical to SEQ ID NO: 65488

SEQ ID NO: 602367 - RNA, 64 nt, hsa; identical to SEQ ID NO: 65489

SEQ ID NO: 602368 - RNA, 64 nt, hsa; identical to SEQ ID NO: 65490

SEQ ID NO: 602369 - RNA, 64 nt, hsa; identical to SEQ ID NO: 65491

SEQ ID NO: 602370 - RNA, 64 nt, hsa; identical to SEQ ID NO: 65492

SEQ ID NO: 602371 - RNA, 64 nt, hsa; identical to SEQ ID NO: 65493

SEQ ID NO: 602372 - RNA, 64 nt, hsa; identical to SEQ ID NO: 65494

SEQ ID NO: 602373 - RNA, 64 nt, hsa; identical to SEQ ID NO: 65495

SEQ ID NO: 602374 - RNA, 64 nt, hsa; identical to SEQ ID NO: 65496

SEQ ID NO: 602375 - RNA, 64 nt, hsa; identical to SEQ ID NO: 65497

SEQ ID NO: 602376 - RNA, 64 nt, hsa; identical to SEQ ID NO: 65498

SEQ ID NO: 602377 - RNA, 64 nt, hsa; identical to SEQ ID NO: 65499

SEQ ID NO: 602378 - RNA, 64 nt, hsa; identical to SEQ ID NO: 65500

SEQ ID NO: 602379 - RNA, 64 nt, hsa; identical to SEQ ID NO: 65501

SEQ ID NO: 602380 - RNA, 64 nt, hsa; identical to SEQ ID NO: 65502

SEQ ID NO: 602381 - RNA, 64 nt, hsa; identical to SEQ ID NO: 65503

SEQ ID NO: 602382 - RNA, 64 nt, hsa; identical to SEQ ID NO: 65504

SEQ ID NO: 602383 - RNA, 64 nt, hsa; identical to SEQ ID NO: 65505

SEQ ID NO: 602384 - RNA, 64 nt, hsa; identical to SEQ ID NO: 65506

SEQ ID NO: 602385 - RNA, 64 nt, hsa; identical to SEQ ID NO: 65507

SEQ ID NO: 602386 - RNA, 64 nt, hsa; identical to SEQ ID NO: 65508

SEQ ID NO: 602387 - RNA, 64 nt, hsa; identical to SEQ ID NO: 61360

SEQ ID NO: 602388 - RNA, 64 nt, hsa; identical to SEQ ID NO: 61361

SEQ ID NO: 602389 - RNA, 64 nt, hsa; identical to SEQ ID NO: 65511

SEQ ID NO: 602390 - RNA, 64 nt, hsa; identical to SEQ ID NO: 65512

SEQ ID NO: 602391 - RNA, 64 nt, hsa; identical to SEQ ID NO: 65513

SEQ ID NO: 602392 - RNA, 64 nt, hsa; identical to SEQ ID NO: 65514

SEQ ID NO: 602393 - RNA, 64 nt, hsa; identical to SEQ ID NO: 65515

SEQ ID NO: 602394 - RNA, 64 nt, hsa; identical to SEQ ID NO: 65516

SEQ ID NO: 602395 - RNA, 64 nt, hsa; identical to SEQ ID NO: 65517

SEQ ID NO: 602396 - RNA, 64 nt, hsa; identical to SEQ ID NO: 65518

SEQ ID NO: 602397 - RNA, 64 nt, hsa; identical to SEQ ID NO: 65519

SEQ ID NO: 602398 - RNA, 64 nt, hsa; identical to SEQ ID NO: 65520

SEQ ID NO: 602399 - RNA, 64 nt, hsa; identical to SEQ ID NO: 65521

SEQ ID NO: 602400 - RNA, 64 nt, hsa; identical to SEQ ID NO: 65522

SEQ ID NO: 602401 - RNA, 64 nt, hsa; identical to SEQ ID NO: 65523

SEQ ID NO: 602402 - RNA, 64 nt, hsa; identical to SEQ ID NO: 65524

SEQ ID NO: 602403 - RNA, 64 nt, hsa; identical to SEQ ID NO: 65525

SEQ ID NO: 602404 - RNA, 64 nt, hsa; identical to SEQ ID NO: 65526

SEQ ID NO: 602405 - RNA, 64 nt, hsa; identical to SEQ ID NO: 65527

SEQ ID NO: 602406 - RNA, 64 nt, hsa; identical to SEQ ID NO: 65528

SEQ ID NO: 602407 - RNA, 64 nt, hsa; identical to SEQ ID NO: 61362

SEQ ID NO: 602408 - RNA, 64 nt, hsa; identical to SEQ ID NO: 61363

SEQ ID NO: 602409 - RNA, 64 nt, hsa; identical to SEQ ID NO: 61364

SEQ ID NO: 602410 - RNA, 64 nt, hsa; identical to SEQ ID NO: 61365

SEQ ID NO: 602411 - RNA, 64 nt, hsa; identical to SEQ ID NO: 65533

SEQ ID NO: 602412 - RNA, 64 nt, hsa; identical to SEQ ID NO: 65534

SEQ ID NO: 602413 - RNA, 64 nt, hsa; identical to SEQ ID NO: 65535

SEQ ID NO: 602414 - RNA, 64 nt, hsa; identical to SEQ ID NO: 65536

SEQ ID NO: 602415 - RNA, 64 nt, hsa; identical to SEQ ID NO: 65537

SEQ ID NO: 602416 - RNA, 64 nt, hsa; identical to SEQ ID NO: 65538

SEQ ID NO: 602417 - RNA, 64 nt, hsa; identical to SEQ ID NO: 65539

SEQ ID NO: 602418 - RNA, 64 nt, hsa; identical to SEQ ID NO: 65540

SEQ ID NO: 602419 - RNA, 64 nt, hsa; identical to SEQ ID NO: 65541

SEQ ID NO: 602420 - RNA, 64 nt, hsa; identical to SEQ ID NO: 65542

SEQ ID NO: 602421 - RNA, 64 nt, hsa; identical to SEQ ID NO: 65543

SEQ ID NO: 602422 - RNA, 64 nt, hsa; identical to SEQ ID NO: 65544

SEQ ID NO: 602423 - RNA, 64 nt, hsa; identical to SEQ ID NO: 65545

SEQ ID NO: 602424 - RNA, 64 nt, hsa; identical to SEQ ID NO: 65546

SEQ ID NO: 602425 - RNA, 64 nt, hsa; identical to SEQ ID NO: 65547

SEQ ID NO: 602426 - RNA, 64 nt, hsa; identical to SEQ ID NO: 61366

SEQ ID NO: 602427 - RNA, 64 nt, hsa; identical to SEQ ID NO: 61367

SEQ ID NO: 602428 - RNA, 64 nt, hsa; identical to SEQ ID NO: 65550

SEQ ID NO: 602429 - RNA, 64 nt, hsa; identical to SEQ ID NO: 65551

SEQ ID NO: 602430 - RNA, 64 nt, hsa; identical to SEQ ID NO: 61368

SEQ ID NO: 602431 - RNA, 56 nt, hsa; identical to SEQ ID NO: 61369

SEQ ID NO: 602432 - RNA, 64 nt, hsa; identical to SEQ ID NO: 65554

SEQ ID NO: 602433 - RNA, 64 nt, hsa; identical to SEQ ID NO: 65555

SEQ ID NO: 602434 - RNA, 64 nt, hsa; identical to SEQ ID NO: 65556

SEQ ID NO: 602435 - RNA, 64 nt, hsa; identical to SEQ ID NO: 65557

SEQ ID NO: 602436 - RNA, 64 nt, hsa; identical to SEQ ID NO: 65558

SEQ ID NO: 602437 - RNA, 64 nt, hsa; identical to SEQ ID NO: 65559

SEQ ID NO: 602438 - RNA, 64 nt, hsa; identical to SEQ ID NO: 65560

SEQ ID NO: 602439 - RNA, 64 nt, hsa; identical to SEQ ID NO: 65561

SEQ ID NO: 602440 - RNA, 64 nt, hsa; identical to SEQ ID NO: 65562

SEQ ID NO: 602441 - RNA, 64 nt, hsa; identical to SEQ ID NO: 65563

SEQ ID NO: 602442 - RNA, 64 nt, hsa; identical to SEQ ID NO: 65564

SEQ ID NO: 602443 - RNA, 64 nt, hsa; identical to SEQ ID NO: 65565

SEQ ID NO: 602444 - RNA, 64 nt, hsa; identical to SEQ ID NO: 65566

SEQ ID NO: 602445 - RNA, 64 nt, hsa; identical to SEQ ID NO: 65567

SEQ ID NO: 602446 - RNA, 64 nt, hsa; identical to SEQ ID NO: 65568

SEQ ID NO: 602447 - RNA, 64 nt, hsa; identical to SEQ ID NO: 65569

SEQ ID NO: 602448 - RNA, 64 nt, hsa; identical to SEQ ID NO: 65570

SEQ ID NO: 602449 - RNA, 64 nt, hsa; identical to SEQ ID NO: 65571

SEQ ID NO: 602450 - RNA, 64 nt, hsa; identical to SEQ ID NO: 65572

SEQ ID NO: 602451 - RNA, 64 nt, hsa; identical to SEQ ID NO: 65573

SEQ ID NO: 602452 - RNA, 64 nt, hsa; identical to SEQ ID NO: 61370

SEQ ID NO: 602453 - RNA, 64 nt, hsa; identical to SEQ ID NO: 61371

SEQ ID NO: 602454 - RNA, 64 nt, hsa; identical to SEQ ID NO: 65576

SEQ ID NO: 602455 - RNA, 64 nt, hsa; identical to SEQ ID NO: 65577

SEQ ID NO: 602456 - RNA, 64 nt, hsa; identical to SEQ ID NO: 65578

SEQ ID NO: 602457 - RNA, 64 nt, hsa; identical to SEQ ID NO: 65579

SEQ ID NO: 602458 - RNA, 64 nt, hsa; identical to SEQ ID NO: 65580

SEQ ID NO: 602459 - RNA, 64 nt, hsa; identical to SEQ ID NO: 65581

SEQ ID NO: 602460 - RNA, 64 nt, hsa; identical to SEQ ID NO: 65582

SEQ ID NO: 602461 - RNA, 64 nt, hsa; identical to SEQ ID NO: 65583

SEQ ID NO: 602462 - RNA, 64 nt, hsa; identical to SEQ ID NO: 65584

SEQ ID NO: 602463 - RNA, 64 nt, hsa; identical to SEQ ID NO: 65585

SEQ ID NO: 602464 - RNA, 64 nt, hsa; identical to SEQ ID NO: 65586

SEQ ID NO: 602465 - RNA, 64 nt, hsa; identical to SEQ ID NO: 65587

SEQ ID NO: 602466 - RNA, 64 nt, hsa; identical to SEQ ID NO: 65588

SEQ ID NO: 602467 - RNA, 64 nt, hsa; identical to SEQ ID NO: 65589

SEQ ID NO: 602468 - RNA, 64 nt, hsa; identical to SEQ ID NO: 65590

SEQ ID NO: 602469 - RNA, 64 nt, hsa; identical to SEQ ID NO: 65591

SEQ ID NO: 602470 - RNA, 64 nt, hsa; identical to SEQ ID NO: 65592

SEQ ID NO: 602471 - RNA, 64 nt, hsa; identical to SEQ ID NO: 65593

SEQ ID NO: 602472 - RNA, 64 nt, hsa; identical to SEQ ID NO: 65594

SEQ ID NO: 602473 - RNA, 64 nt, hsa; identical to SEQ ID NO: 65595

SEQ ID NO: 602474 - RNA, 64 nt, hsa; identical to SEQ ID NO: 65596

SEQ ID NO: 602475 - RNA, 64 nt, hsa; identical to SEQ ID NO: 65597

SEQ ID NO: 602476 - RNA, 64 nt, hsa; identical to SEQ ID NO: 65598

SEQ ID NO: 602477 - RNA, 64 nt, hsa; identical to SEQ ID NO: 65599

SEQ ID NO: 602478 - RNA, 64 nt, hsa; identical to SEQ ID NO: 65600

SEQ ID NO: 602479 - RNA, 64 nt, hsa; identical to SEQ ID NO: 65601

SEQ ID NO: 602480 - RNA, 64 nt, hsa; identical to SEQ ID NO: 65602

SEQ ID NO: 602481 - RNA, 64 nt, hsa; identical to SEQ ID NO: 65603

SEQ ID NO: 602482 - RNA, 64 nt, hsa; identical to SEQ ID NO: 65604

SEQ ID NO: 602483 - RNA, 64 nt, hsa; identical to SEQ ID NO: 65605

SEQ ID NO: 602484 - RNA, 64 nt, hsa; identical to SEQ ID NO: 65606

SEQ ID NO: 602485 - RNA, 64 nt, hsa; identical to SEQ ID NO: 65607

SEQ ID NO: 602486 - RNA, 64 nt, hsa; identical to SEQ ID NO: 65608

SEQ ID NO: 602487 - RNA, 64 nt, hsa; identical to SEQ ID NO: 65609

SEQ ID NO: 602488 - RNA, 64 nt, hsa; identical to SEQ ID NO: 65610

SEQ ID NO: 602489 - RNA, 64 nt, hsa; identical to SEQ ID NO: 65611

SEQ ID NO: 602490 - RNA, 64 nt, hsa; identical to SEQ ID NO: 61372

SEQ ID NO: 602491 - RNA, 64 nt, hsa; identical to SEQ ID NO: 61373

SEQ ID NO: 602492 - RNA, 64 nt, hsa; identical to SEQ ID NO: 65614

SEQ ID NO: 602493 - RNA, 64 nt, hsa; identical to SEQ ID NO: 65615

SEQ ID NO: 602494 - RNA, 64 nt, hsa; identical to SEQ ID NO: 65616

SEQ ID NO: 602495 - RNA, 64 nt, hsa; identical to SEQ ID NO: 61374

SEQ ID NO: 602496 - RNA, 64 nt, hsa; identical to SEQ ID NO: 61375

SEQ ID NO: 602497 - RNA, 64 nt, hsa; identical to SEQ ID NO: 65619

SEQ ID NO: 602498 - RNA, 64 nt, hsa; identical to SEQ ID NO: 65620

SEQ ID NO: 602499 - RNA, 64 nt, hsa; identical to SEQ ID NO: 65621

SEQ ID NO: 602500 - RNA, 64 nt, hsa; identical to SEQ ID NO: 65622

SEQ ID NO: 602501 - RNA, 64 nt, hsa; identical to SEQ ID NO: 65623

SEQ ID NO: 602502 - RNA, 64 nt, hsa; identical to SEQ ID NO: 65624

SEQ ID NO: 602503 - RNA, 64 nt, hsa; identical to SEQ ID NO: 65625

SEQ ID NO: 602504 - RNA, 64 nt, hsa; identical to SEQ ID NO: 65626

SEQ ID NO: 602505 - RNA, 64 nt, hsa; identical to SEQ ID NO: 65627

SEQ ID NO: 602506 - RNA, 64 nt, hsa; identical to SEQ ID NO: 65628

SEQ ID NO: 602507 - RNA, 64 nt, hsa; identical to SEQ ID NO: 65629

SEQ ID NO: 602508 - RNA, 64 nt, hsa; identical to SEQ ID NO: 65630

SEQ ID NO: 602509 - RNA, 64 nt, hsa; identical to SEQ ID NO: 65631

SEQ ID NO: 602510 - RNA, 64 nt, hsa; identical to SEQ ID NO: 65632

SEQ ID NO: 602511 - RNA, 64 nt, hsa; identical to SEQ ID NO: 65633

SEQ ID NO: 602512 - RNA, 64 nt, hsa; identical to SEQ ID NO: 65634

SEQ ID NO: 602513 - RNA, 64 nt, hsa; identical to SEQ ID NO: 65635

SEQ ID NO: 602514 - RNA, 64 nt, hsa; identical to SEQ ID NO: 65636

SEQ ID NO: 602515 - RNA, 64 nt, hsa; identical to SEQ ID NO: 65637

SEQ ID NO: 602516 - RNA, 64 nt, hsa; identical to SEQ ID NO: 65638

SEQ ID NO: 602517 - RNA, 64 nt, hsa; identical to SEQ ID NO: 65639

SEQ ID NO: 602518 - RNA, 64 nt, hsa; identical to SEQ ID NO: 65640

SEQ ID NO: 602519 - RNA, 64 nt, hsa; identical to SEQ ID NO: 65641

SEQ ID NO: 602520 - RNA, 64 nt, hsa; identical to SEQ ID NO: 65642

SEQ ID NO: 602521 - RNA, 64 nt, hsa; identical to SEQ ID NO: 65643

SEQ ID NO: 602522 - RNA, 64 nt, hsa; identical to SEQ ID NO: 65644

SEQ ID NO: 602523 - RNA, 60 nt, hsa; identical to SEQ ID NO: 65087

SEQ ID NO: 602524 - RNA, 64 nt, hsa; identical to SEQ ID NO: 65646

SEQ ID NO: 602525 - RNA, 64 nt, hsa; identical to SEQ ID NO: 65647

SEQ ID NO: 602526 - RNA, 64 nt, hsa; identical to SEQ ID NO: 65648

SEQ ID NO: 602527 - RNA, 64 nt, hsa; identical to SEQ ID NO: 65649

SEQ ID NO: 602528 - RNA, 64 nt, hsa; identical to SEQ ID NO: 65650

SEQ ID NO: 602529 - RNA, 64 nt, hsa; identical to SEQ ID NO: 65651

SEQ ID NO: 602530 - RNA, 51 nt, hsa; identical to SEQ ID NO: 65094

SEQ ID NO: 602531 - RNA, 64 nt, hsa; identical to SEQ ID NO: 65653

SEQ ID NO: 602532 - RNA, 64 nt, hsa; identical to SEQ ID NO: 65654

SEQ ID NO: 602533 - RNA, 64 nt, hsa; identical to SEQ ID NO: 65655

SEQ ID NO: 602534 - RNA, 64 nt, hsa; identical to SEQ ID NO: 65656

SEQ ID NO: 602535 - RNA, 64 nt, hsa; identical to SEQ ID NO: 65657

SEQ ID NO: 602536 - RNA, 64 nt, hsa; identical to SEQ ID NO: 65658

SEQ ID NO: 602537 - RNA, 64 nt, hsa; identical to SEQ ID NO: 65659

SEQ ID NO: 602538 - RNA, 64 nt, hsa; identical to SEQ ID NO: 65660

SEQ ID NO: 602539 - RNA, 64 nt, hsa; identical to SEQ ID NO: 65661

SEQ ID NO: 602540 - RNA, 64 nt, hsa; identical to SEQ ID NO: 65662

SEQ ID NO: 602541 - RNA, 64 nt, hsa; identical to SEQ ID NO: 65663

SEQ ID NO: 602542 - RNA, 64 nt, hsa; identical to SEQ ID NO: 65664

SEQ ID NO: 602543 - RNA, 64 nt, hsa; identical to SEQ ID NO: 65665

SEQ ID NO: 602544 - RNA, 64 nt, hsa; identical to SEQ ID NO: 65666

SEQ ID NO: 602545 - RNA, 64 nt, hsa; identical to SEQ ID NO: 65667

SEQ ID NO: 602546 - RNA, 64 nt, hsa; identical to SEQ ID NO: 65668

SEQ ID NO: 602547 - RNA, 64 nt, hsa; identical to SEQ ID NO: 65669

SEQ ID NO: 602548 - RNA, 64 nt, hsa; identical to SEQ ID NO: 65670

SEQ ID NO: 602549 - RNA, 64 nt, hsa; identical to SEQ ID NO: 65671

SEQ ID NO: 602550 - RNA, 64 nt, hsa; identical to SEQ ID NO: 65672

SEQ ID NO: 602551 - RNA, 64 nt, hsa; identical to SEQ ID NO: 65673

SEQ ID NO: 602552 - RNA, 64 nt, hsa; identical to SEQ ID NO: 65674

SEQ ID NO: 602553 - RNA, 64 nt, hsa; identical to SEQ ID NO: 65675

SEQ ID NO: 602554 - RNA, 64 nt, hsa; identical to SEQ ID NO: 65676

SEQ ID NO: 602555 - RNA, 64 nt, hsa; identical to SEQ ID NO: 65677

SEQ ID NO: 602556 - RNA, 64 nt, hsa; identical to SEQ ID NO: 65678

SEQ ID NO: 602557 - RNA, 64 nt, hsa; identical to SEQ ID NO: 65679

SEQ ID NO: 602558 - RNA, 64 nt, hsa; identical to SEQ ID NO: 65680

SEQ ID NO: 602559 - RNA, 64 nt, hsa; identical to SEQ ID NO: 65681

SEQ ID NO: 602560 - RNA, 64 nt, hsa; identical to SEQ ID NO: 65682

SEQ ID NO: 602561 - RNA, 64 nt, hsa; identical to SEQ ID NO: 65683

SEQ ID NO: 602562 - RNA, 64 nt, hsa; identical to SEQ ID NO: 65684

SEQ ID NO: 602563 - RNA, 64 nt, hsa; identical to SEQ ID NO: 65685

SEQ ID NO: 602564 - RNA, 64 nt, hsa; identical to SEQ ID NO: 65686

SEQ ID NO: 602565 - RNA, 64 nt, hsa; identical to SEQ ID NO: 65687

SEQ ID NO: 602566 - RNA, 64 nt, hsa; identical to SEQ ID NO: 65688

SEQ ID NO: 602567 - RNA, 64 nt, hsa; identical to SEQ ID NO: 65689

SEQ ID NO: 602568 - RNA, 64 nt, hsa; identical to SEQ ID NO: 65690

SEQ ID NO: 602569 - RNA, 64 nt, hsa; identical to SEQ ID NO: 65691

SEQ ID NO: 602570 - RNA, 64 nt, hsa; identical to SEQ ID NO: 65692

SEQ ID NO: 602571 - RNA, 64 nt, hsa; identical to SEQ ID NO: 65693

SEQ ID NO: 602572 - RNA, 64 nt, hsa; identical to SEQ ID NO: 197374

SEQ ID NO: 602573 - RNA, 64 nt, hsa; identical to SEQ ID NO: 197375

SEQ ID NO: 602574 - RNA, 63 nt, hsa; identical to SEQ ID NO: 197376

SEQ ID NO: 602575 - RNA, 64 nt, hsa; identical to SEQ ID NO: 197377

SEQ ID NO: 602576 - RNA, 64 nt, hsa; identical to SEQ ID NO: 197378

SEQ ID NO: 602577 - RNA, 64 nt, hsa; identical to SEQ ID NO: 197379

SEQ ID NO: 602578 - RNA, 64 nt, hsa; identical to SEQ ID NO: 197380

SEQ ID NO: 602579 - RNA, 64 nt, hsa; identical to SEQ ID NO: 197381

SEQ ID NO: 602580 - RNA, 64 nt, hsa; identical to SEQ ID NO: 197382

SEQ ID NO: 602581 - RNA, 64 nt, hsa; identical to SEQ ID NO: 197383

SEQ ID NO: 602582 - RNA, 64 nt, hsa; identical to SEQ ID NO: 197384

SEQ ID NO: 602583 - RNA, 64 nt, hsa; identical to SEQ ID NO: 197385

SEQ ID NO: 602584 - RNA, 64 nt, hsa; identical to SEQ ID NO: 197386

SEQ ID NO: 602585 - RNA, 64 nt, hsa; identical to SEQ ID NO: 197387

SEQ ID NO: 602586 - RNA, 64 nt, hsa; identical to SEQ ID NO: 197388

SEQ ID NO: 602587 - RNA, 64 nt, hsa; identical to SEQ ID NO: 197389

SEQ ID NO: 602588 - RNA, 64 nt, hsa; identical to SEQ ID NO: 197390

SEQ ID NO: 602589 - RNA, 64 nt, hsa; identical to SEQ ID NO: 197391

SEQ ID NO: 602590 - RNA, 64 nt, hsa; identical to SEQ ID NO: 197392

SEQ ID NO: 602591 - RNA, 64 nt, hsa; identical to SEQ ID NO: 197393

SEQ ID NO: 602592 - RNA, 64 nt, hsa; identical to SEQ ID NO: 197394

SEQ ID NO: 602593 - RNA, 64 nt, hsa; identical to SEQ ID NO: 197395

SEQ ID NO: 602594 - RNA, 64 nt, hsa; identical to SEQ ID NO: 197396

SEQ ID NO: 602595 - RNA, 64 nt, hsa; identical to SEQ ID NO: 197397

SEQ ID NO: 602596 - RNA, 64 nt, hsa; identical to SEQ ID NO: 197398

SEQ ID NO: 602597 - RNA, 64 nt, hsa; identical to SEQ ID NO: 197399

SEQ ID NO: 602598 - RNA, 64 nt, hsa; identical to SEQ ID NO: 197400

SEQ ID NO: 602599 - RNA, 64 nt, hsa; identical to SEQ ID NO: 197401

SEQ ID NO: 602600 - RNA, 64 nt, hsa; identical to SEQ ID NO: 197402

SEQ ID NO: 602601 - RNA, 64 nt, hsa; identical to SEQ ID NO: 197403

SEQ ID NO: 602602 - RNA, 64 nt, hsa; identical to SEQ ID NO: 197404

SEQ ID NO: 602603 - RNA, 64 nt, hsa; identical to SEQ ID NO: 197405

SEQ ID NO: 602604 - RNA, 64 nt, hsa; identical to SEQ ID NO: 197406

SEQ ID NO: 602605 - RNA, 64 nt, hsa; identical to SEQ ID NO: 197407

SEQ ID NO: 602606 - RNA, 64 nt, hsa; identical to SEQ ID NO: 197408

SEQ ID NO: 602607 - RNA, 64 nt, hsa; identical to SEQ ID NO: 197409

SEQ ID NO: 602608 - RNA, 64 nt, hsa; identical to SEQ ID NO: 197410

SEQ ID NO: 602609 - RNA, 64 nt, hsa; identical to SEQ ID NO: 197411

SEQ ID NO: 602610 - RNA, 64 nt, hsa; identical to SEQ ID NO: 197412

SEQ ID NO: 602611 - RNA, 64 nt, hsa; identical to SEQ ID NO: 197413

SEQ ID NO: 602612 - RNA, 64 nt, hsa; identical to SEQ ID NO: 197414

SEQ ID NO: 602613 - RNA, 64 nt, hsa; identical to SEQ ID NO: 197415

SEQ ID NO: 602614 - RNA, 64 nt, hsa; identical to SEQ ID NO: 197416

SEQ ID NO: 602615 - RNA, 64 nt, hsa; identical to SEQ ID NO: 197417

SEQ ID NO: 602616 - RNA, 64 nt, hsa; identical to SEQ ID NO: 197418

SEQ ID NO: 602617 - RNA, 64 nt, hsa; identical to SEQ ID NO: 197419

SEQ ID NO: 602618 - RNA, 64 nt, hsa; identical to SEQ ID NO: 197420

SEQ ID NO: 602619 - RNA, 64 nt, hsa; identical to SEQ ID NO: 197421

SEQ ID NO: 602620 - RNA, 64 nt, hsa; identical to SEQ ID NO: 197422

SEQ ID NO: 602621 - RNA, 64 nt, hsa; identical to SEQ ID NO: 197423

SEQ ID NO: 602622 - RNA, 64 nt, hsa; identical to SEQ ID NO: 197424

SEQ ID NO: 602623 - RNA, 64 nt, hsa; identical to SEQ ID NO: 197425

SEQ ID NO: 602624 - RNA, 64 nt, hsa; identical to SEQ ID NO: 197426

SEQ ID NO: 602625 - RNA, 64 nt, hsa; identical to SEQ ID NO: 197427

SEQ ID NO: 602626 - RNA, 64 nt, hsa; identical to SEQ ID NO: 197428

SEQ ID NO: 602627 - RNA, 64 nt, hsa; identical to SEQ ID NO: 197429

SEQ ID NO: 602628 - RNA, 64 nt, hsa; identical to SEQ ID NO: 197430

SEQ ID NO: 602629 - RNA, 64 nt, hsa; identical to SEQ ID NO: 197431

SEQ ID NO: 602630 - RNA, 64 nt, hsa; identical to SEQ ID NO: 197431

SEQ ID NO: 602631 - RNA, 64 nt, hsa; identical to SEQ ID NO: 197433

SEQ ID NO: 602632 - RNA, 64 nt, hsa; identical to SEQ ID NO: 197434

SEQ ID NO: 602633 - RNA, 64 nt, hsa; identical to SEQ ID NO: 197435

SEQ ID NO: 602634 - RNA, 64 nt, hsa; identical to SEQ ID NO: 197436

SEQ ID NO: 602635 - RNA, 64 nt, hsa; identical to SEQ ID NO: 197437

SEQ ID NO: 602636 - RNA, 64 nt, hsa; identical to SEQ ID NO: 197438

SEQ ID NO: 602637 - RNA, 64 nt, hsa; identical to SEQ ID NO: 197439

SEQ ID NO: 602638 - RNA, 64 nt, hsa; identical to SEQ ID NO: 197440

SEQ ID NO: 602639 - RNA, 64 nt, hsa; identical to SEQ ID NO: 197441

SEQ ID NO: 602640 - RNA, 64 nt, hsa; identical to SEQ ID NO: 197442

SEQ ID NO: 602641 - RNA, 64 nt, hsa; identical to SEQ ID NO: 197443

SEQ ID NO: 602642 - RNA, 64 nt, hsa; identical to SEQ ID NO: 197444

SEQ ID NO: 602643 - RNA, 64 nt, hsa; identical to SEQ ID NO: 197445

SEQ ID NO: 602644 - RNA, 64 nt, hsa; identical to SEQ ID NO: 197446

SEQ ID NO: 602645 - RNA, 64 nt, hsa; identical to SEQ ID NO: 197447

SEQ ID NO: 602646 - RNA, 64 nt, hsa; identical to SEQ ID NO: 197448

SEQ ID NO: 602647 - RNA, 64 nt, hsa; identical to SEQ ID NO: 197449

SEQ ID NO: 602648 - RNA, 64 nt, hsa; identical to SEQ ID NO: 197450

SEQ ID NO: 602649 - RNA, 64 nt, hsa; identical to SEQ ID NO: 197451

SEQ ID NO: 602650 - RNA, 64 nt, hsa; identical to SEQ ID NO: 197452

SEQ ID NO: 602651 - RNA, 64 nt, hsa; identical to SEQ ID NO: 197453

SEQ ID NO: 602652 - RNA, 64 nt, hsa; identical to SEQ ID NO: 197454

SEQ ID NO: 602653 - RNA, 64 nt, hsa; identical to SEQ ID NO: 197455

SEQ ID NO: 602654 - RNA, 53 nt, hsa; identical to SEQ ID NO: 197456

SEQ ID NO: 602655 - RNA, 64 nt, hsa; identical to SEQ ID NO: 197457

SEQ ID NO: 602656 - RNA, 64 nt, hsa; identical to SEQ ID NO: 197458

SEQ ID NO: 602657 - RNA, 64 nt, hsa; identical to SEQ ID NO: 197459

SEQ ID NO: 602658 - RNA, 64 nt, hsa; identical to SEQ ID NO: 197460

SEQ ID NO: 602659 - RNA, 64 nt, hsa; identical to SEQ ID NO: 197461

SEQ ID NO: 602660 - RNA, 64 nt, hsa; identical to SEQ ID NO: 197462

SEQ ID NO: 602661 - RNA, 64 nt, hsa; identical to SEQ ID NO: 197463

SEQ ID NO: 602662 - RNA, 64 nt, hsa; identical to SEQ ID NO: 197464

SEQ ID NO: 602663 - RNA, 64 nt, hsa; identical to SEQ ID NO: 197465

SEQ ID NO: 602664 - RNA, 64 nt, hsa; identical to SEQ ID NO: 197466

SEQ ID NO: 602665 - RNA, 64 nt, hsa; identical to SEQ ID NO: 197467

SEQ ID NO: 602666 - RNA, 64 nt, hsa; identical to SEQ ID NO: 197468

SEQ ID NO: 602667 - RNA, 64 nt, hsa; identical to SEQ ID NO: 197469

SEQ ID NO: 602668 - RNA, 64 nt, hsa; identical to SEQ ID NO: 197470

SEQ ID NO: 602669 - RNA, 64 nt, hsa; identical to SEQ ID NO: 197471

SEQ ID NO: 602670 - RNA, 64 nt, hsa; identical to SEQ ID NO: 197472

SEQ ID NO: 602671 - RNA, 64 nt, hsa; identical to SEQ ID NO: 197473

SEQ ID NO: 602672 - RNA, 64 nt, hsa; identical to SEQ ID NO: 197474

SEQ ID NO: 602673 - RNA, 64 nt, hsa; identical to SEQ ID NO: 197475

SEQ ID NO: 602674 - RNA, 64 nt, hsa; identical to SEQ ID NO: 197476

SEQ ID NO: 602675 - RNA, 64 nt, hsa; identical to SEQ ID NO: 197477

SEQ ID NO: 602676 - RNA, 64 nt, hsa; identical to SEQ ID NO: 197478

SEQ ID NO: 602677 - RNA, 64 nt, hsa; identical to SEQ ID NO: 197479

SEQ ID NO: 602678 - RNA, 64 nt, hsa; identical to SEQ ID NO: 197480

SEQ ID NO: 602679 - RNA, 64 nt, hsa; identical to SEQ ID NO: 197481

SEQ ID NO: 602680 - RNA, 64 nt, hsa; identical to SEQ ID NO: 197482

SEQ ID NO: 602681 - RNA, 64 nt, hsa; identical to SEQ ID NO: 197483

SEQ ID NO: 602682 - RNA, 64 nt, hsa; identical to SEQ ID NO: 197484

SEQ ID NO: 602683 - RNA, 64 nt, hsa; identical to SEQ ID NO: 197485

SEQ ID NO: 602684 - RNA, 64 nt, hsa; identical to SEQ ID NO: 197486

SEQ ID NO: 602685 - RNA, 64 nt, hsa; identical to SEQ ID NO: 197487

SEQ ID NO: 602686 - RNA, 64 nt, hsa; identical to SEQ ID NO: 197488

SEQ ID NO: 602687 - RNA, 64 nt, hsa; identical to SEQ ID NO: 197489

SEQ ID NO: 602688 - RNA, 64 nt, hsa; identical to SEQ ID NO: 197490

SEQ ID NO: 602689 - RNA, 64 nt, hsa; identical to SEQ ID NO: 197491

SEQ ID NO: 602690 - RNA, 64 nt, hsa; identical to SEQ ID NO: 197492

SEQ ID NO: 602691 - RNA, 64 nt, hsa; identical to SEQ ID NO: 197493

SEQ ID NO: 602692 - RNA, 64 nt, hsa; identical to SEQ ID NO: 197494

SEQ ID NO: 602693 - RNA, 64 nt, hsa; identical to SEQ ID NO: 197495

SEQ ID NO: 602694 - RNA, 64 nt, hsa; identical to SEQ ID NO: 197496

SEQ ID NO: 602695 - RNA, 64 nt, hsa; identical to SEQ ID NO: 197497

SEQ ID NO: 602696 - RNA, 64 nt, hsa; identical to SEQ ID NO: 197498

SEQ ID NO: 602697 - RNA, 64 nt, hsa; identical to SEQ ID NO: 197499

SEQ ID NO: 602698 - RNA, 64 nt, hsa; identical to SEQ ID NO: 197500

SEQ ID NO: 602699 - RNA, 64 nt, hsa; identical to SEQ ID NO: 197501

SEQ ID NO: 602700 - RNA, 64 nt, hsa; identical to SEQ ID NO: 197502

SEQ ID NO: 602701 - RNA, 64 nt, hsa; identical to SEQ ID NO: 197503

SEQ ID NO: 602702 - RNA, 64 nt, hsa; identical to SEQ ID NO: 197504

SEQ ID NO: 602703 - RNA, 64 nt, hsa; identical to SEQ ID NO: 197505

SEQ ID NO: 602704 - RNA, 64 nt, hsa; identical to SEQ ID NO: 197506

SEQ ID NO: 602705 - RNA, 64 nt, hsa; identical to SEQ ID NO: 197507

SEQ ID NO: 602706 - RNA, 64 nt, hsa; identical to SEQ ID NO: 197508

SEQ ID NO: 602707 - RNA, 64 nt, hsa; identical to SEQ ID NO: 197509

SEQ ID NO: 602708 - RNA, 64 nt, hsa; identical to SEQ ID NO: 197510

SEQ ID NO: 602709 - RNA, 64 nt, hsa; identical to SEQ ID NO: 197511

SEQ ID NO: 602710 - RNA, 64 nt, hsa; identical to SEQ ID NO: 197512

SEQ ID NO: 602711 - RNA, 64 nt, hsa; identical to SEQ ID NO: 197513

SEQ ID NO: 602712 - RNA, 64 nt, hsa; identical to SEQ ID NO: 197514

SEQ ID NO: 602713 - RNA, 64 nt, hsa; identical to SEQ ID NO: 197515

SEQ ID NO: 602714 - RNA, 64 nt, hsa; identical to SEQ ID NO: 197516

SEQ ID NO: 602715 - RNA, 64 nt, hsa; identical to SEQ ID NO: 197517

SEQ ID NO: 602716 - RNA, 64 nt, hsa; identical to SEQ ID NO: 197518

SEQ ID NO: 602717 - RNA, 64 nt, hsa; identical to SEQ ID NO: 197519

SEQ ID NO: 602718 - RNA, 64 nt, hsa; identical to SEQ ID NO: 197520

SEQ ID NO: 602719 - RNA, 64 nt, hsa; identical to SEQ ID NO: 197521

SEQ ID NO: 602720 - RNA, 64 nt, hsa; identical to SEQ ID NO: 197522

SEQ ID NO: 602721 - RNA, 64 nt, hsa; identical to SEQ ID NO: 197523

SEQ ID NO: 602722 - RNA, 64 nt, hsa; identical to SEQ ID NO: 197524

SEQ ID NO: 602723 - RNA, 64 nt, hsa; identical to SEQ ID NO: 197525

SEQ ID NO: 602724 - RNA, 64 nt, hsa; identical to SEQ ID NO: 197526

SEQ ID NO: 602725 - RNA, 64 nt, hsa; identical to SEQ ID NO: 197527

SEQ ID NO: 602726 - RNA, 64 nt, hsa; identical to SEQ ID NO: 197528

SEQ ID NO: 602727 - RNA, 64 nt, hsa; identical to SEQ ID NO: 197529

SEQ ID NO: 602728 - RNA, 64 nt, hsa; identical to SEQ ID NO: 197530

SEQ ID NO: 602729 - RNA, 64 nt, hsa; identical to SEQ ID NO: 197531

SEQ ID NO: 602730 - RNA, 64 nt, hsa; identical to SEQ ID NO: 197532

SEQ ID NO: 602731 - RNA, 64 nt, hsa; identical to SEQ ID NO: 197533

SEQ ID NO: 602732 - RNA, 64 nt, hsa; identical to SEQ ID NO: 197534

SEQ ID NO: 602733 - RNA, 64 nt, hsa; identical to SEQ ID NO: 197535

SEQ ID NO: 602734 - RNA, 64 nt, hsa; identical to SEQ ID NO: 197536

SEQ ID NO: 602735 - RNA, 64 nt, hsa; identical to SEQ ID NO: 197537

SEQ ID NO: 602736 - RNA, 64 nt, hsa; identical to SEQ ID NO: 197538

SEQ ID NO: 602737 - RNA, 64 nt, hsa; identical to SEQ ID NO: 197539

SEQ ID NO: 602738 - RNA, 64 nt, hsa; identical to SEQ ID NO: 197540

SEQ ID NO: 602739 - RNA, 64 nt, hsa; identical to SEQ ID NO: 197541

SEQ ID NO: 602740 - RNA, 64 nt, hsa; identical to SEQ ID NO: 197542

SEQ ID NO: 602741 - RNA, 64 nt, hsa; identical to SEQ ID NO: 197543

SEQ ID NO: 602742 - RNA, 64 nt, hsa; identical to SEQ ID NO: 197544

SEQ ID NO: 602743 - RNA, 64 nt, hsa; identical to SEQ ID NO: 197545

SEQ ID NO: 602744 - RNA, 64 nt, hsa; identical to SEQ ID NO: 197546

SEQ ID NO: 602745 - RNA, 64 nt, hsa; identical to SEQ ID NO: 197547

SEQ ID NO: 602746 - RNA, 64 nt, hsa; identical to SEQ ID NO: 197548

SEQ ID NO: 602747 - RNA, 64 nt, hsa; identical to SEQ ID NO: 197549

SEQ ID NO: 602748 - RNA, 64 nt, hsa; identical to SEQ ID NO: 197550

SEQ ID NO: 602749 - RNA, 64 nt, hsa; identical to SEQ ID NO: 197551

SEQ ID NO: 602750 - RNA, 64 nt, hsa; identical to SEQ ID NO: 197552

SEQ ID NO: 602751 - RNA, 64 nt, hsa; identical to SEQ ID NO: 197553

SEQ ID NO: 602752 - RNA, 52 nt, hsa; identical to SEQ ID NO: 197554

SEQ ID NO: 602753 - RNA, 64 nt, hsa; identical to SEQ ID NO: 197555

SEQ ID NO: 602754 - RNA, 64 nt, hsa; identical to SEQ ID NO: 197556

SEQ ID NO: 602755 - RNA, 64 nt, hsa; identical to SEQ ID NO: 197557

SEQ ID NO: 602756 - RNA, 64 nt, hsa; identical to SEQ ID NO: 197558

SEQ ID NO: 602757 - RNA, 64 nt, hsa; identical to SEQ ID NO: 197559

SEQ ID NO: 602758 - RNA, 64 nt, hsa; identical to SEQ ID NO: 197560

SEQ ID NO: 602759 - RNA, 64 nt, hsa; identical to SEQ ID NO: 197561

SEQ ID NO: 602760 - RNA, 64 nt, hsa; identical to SEQ ID NO: 197562

SEQ ID NO: 602761 - RNA, 64 nt, hsa; identical to SEQ ID NO: 197563

SEQ ID NO: 602762 - RNA, 64 nt, hsa; identical to SEQ ID NO: 197564

SEQ ID NO: 602763 - RNA, 64 nt, hsa; identical to SEQ ID NO: 197565

SEQ ID NO: 602764 - RNA, 64 nt, hsa; identical to SEQ ID NO: 197566

SEQ ID NO: 602765 - RNA, 64 nt, hsa; identical to SEQ ID NO: 197567

SEQ ID NO: 602766 - RNA, 64 nt, hsa; identical to SEQ ID NO: 197568

SEQ ID NO: 602767 - RNA, 64 nt, hsa; identical to SEQ ID NO: 197569

SEQ ID NO: 602768 - RNA, 64 nt, hsa; identical to SEQ ID NO: 197570

SEQ ID NO: 602769 - RNA, 64 nt, hsa; identical to SEQ ID NO: 197571

SEQ ID NO: 602770 - RNA, 64 nt, hsa; identical to SEQ ID NO: 197572

SEQ ID NO: 602771 - RNA, 64 nt, hsa; identical to SEQ ID NO: 197573

SEQ ID NO: 602772 - RNA, 64 nt, hsa; identical to SEQ ID NO: 197574

SEQ ID NO: 602773 - RNA, 64 nt, hsa; identical to SEQ ID NO: 197575

SEQ ID NO: 602774 - RNA, 64 nt, hsa; identical to SEQ ID NO: 197576

SEQ ID NO: 602775 - RNA, 64 nt, hsa; identical to SEQ ID NO: 197577

SEQ ID NO: 602776 - RNA, 64 nt, hsa; identical to SEQ ID NO: 197578

SEQ ID NO: 602777 - RNA, 64 nt, hsa; identical to SEQ ID NO: 197579

SEQ ID NO: 602778 - RNA, 64 nt, hsa; identical to SEQ ID NO: 197580

SEQ ID NO: 602779 - RNA, 64 nt, hsa; identical to SEQ ID NO: 197581

SEQ ID NO: 602780 - RNA, 64 nt, hsa; identical to SEQ ID NO: 197582

SEQ ID NO: 602781 - RNA, 64 nt, hsa; identical to SEQ ID NO: 197583

SEQ ID NO: 602782 - RNA, 64 nt, hsa; identical to SEQ ID NO: 197584

SEQ ID NO: 602783 - RNA, 64 nt, hsa; identical to SEQ ID NO: 197585

SEQ ID NO: 602784 - RNA, 64 nt, hsa; identical to SEQ ID NO: 197574

SEQ ID NO: 602785 - RNA, 64 nt, hsa; identical to SEQ ID NO: 197587

SEQ ID NO: 602786 - RNA, 64 nt, hsa; identical to SEQ ID NO: 197588

SEQ ID NO: 602787 - RNA, 64 nt, hsa; identical to SEQ ID NO: 197589

SEQ ID NO: 602788 - RNA, 64 nt, hsa; identical to SEQ ID NO: 197590

SEQ ID NO: 602789 - RNA, 64 nt, hsa; identical to SEQ ID NO: 197591

SEQ ID NO: 602790 - RNA, 64 nt, hsa; identical to SEQ ID NO: 197592

SEQ ID NO: 602791 - RNA, 64 nt, hsa; identical to SEQ ID NO: 197593

SEQ ID NO: 602792 - RNA, 64 nt, hsa; identical to SEQ ID NO: 197593

SEQ ID NO: 602793 - RNA, 64 nt, hsa; identical to SEQ ID NO: 197595

SEQ ID NO: 602794 - RNA, 64 nt, hsa; identical to SEQ ID NO: 197596

SEQ ID NO: 602795 - RNA, 64 nt, hsa; identical to SEQ ID NO: 197597

SEQ ID NO: 602796 - RNA, 64 nt, hsa; identical to SEQ ID NO: 197598

SEQ ID NO: 602797 - RNA, 64 nt, hsa; identical to SEQ ID NO: 197599

SEQ ID NO: 602798 - RNA, 64 nt, hsa; identical to SEQ ID NO: 197600

SEQ ID NO: 602799 - RNA, 64 nt, hsa; identical to SEQ ID NO: 197601

SEQ ID NO: 602800 - RNA, 64 nt, hsa; identical to SEQ ID NO: 197602

SEQ ID NO: 602801 - RNA, 64 nt, hsa; identical to SEQ ID NO: 197603

SEQ ID NO: 602802 - RNA, 64 nt, hsa; identical to SEQ ID NO: 197604

SEQ ID NO: 602803 - RNA, 64 nt, hsa; identical to SEQ ID NO: 197605

SEQ ID NO: 602804 - RNA, 64 nt, hsa; identical to SEQ ID NO: 197606

SEQ ID NO: 602805 - RNA, 64 nt, hsa; identical to SEQ ID NO: 197607

SEQ ID NO: 602806 - RNA, 64 nt, hsa; identical to SEQ ID NO: 197608

SEQ ID NO: 602807 - RNA, 64 nt, hsa; identical to SEQ ID NO: 197609

SEQ ID NO: 602808 - RNA, 64 nt, hsa; identical to SEQ ID NO: 197610

SEQ ID NO: 602809 - RNA, 64 nt, hsa; identical to SEQ ID NO: 197611

SEQ ID NO: 602810 - RNA, 64 nt, hsa; identical to SEQ ID NO: 64824

SEQ ID NO: 602811 - RNA, 64 nt, hsa; identical to SEQ ID NO: 64825

SEQ ID NO: 602812 - RNA, 64 nt, hsa; identical to SEQ ID NO: 64826

SEQ ID NO: 602813 - RNA, 64 nt, hsa; identical to SEQ ID NO: 64827

SEQ ID NO: 602814 - RNA, 64 nt, hsa; identical to SEQ ID NO: 197616

SEQ ID NO: 602815 - RNA, 64 nt, hsa; identical to SEQ ID NO: 197617

SEQ ID NO: 602816 - RNA, 64 nt, hsa; identical to SEQ ID NO: 64828

SEQ ID NO: 602817 - RNA, 64 nt, hsa; identical to SEQ ID NO: 64829

SEQ ID NO: 602818 - RNA, 64 nt, hsa; identical to SEQ ID NO: 64830

SEQ ID NO: 602819 - RNA, 64 nt, hsa; identical to SEQ ID NO: 197621

SEQ ID NO: 602820 - RNA, 64 nt, hsa; identical to SEQ ID NO: 197622

SEQ ID NO: 602821 - RNA, 64 nt, hsa; identical to SEQ ID NO: 197623

SEQ ID NO: 602822 - RNA, 64 nt, hsa; identical to SEQ ID NO: 197624

SEQ ID NO: 602823 - RNA, 64 nt, hsa; identical to SEQ ID NO: 197625

SEQ ID NO: 602824 - RNA, 64 nt, hsa; identical to SEQ ID NO: 197626

SEQ ID NO: 602825 - RNA, 64 nt, hsa; identical to SEQ ID NO: 197627

SEQ ID NO: 602826 - RNA, 64 nt, hsa; identical to SEQ ID NO: 197628

SEQ ID NO: 602827 - RNA, 64 nt, hsa; identical to SEQ ID NO: 197629

SEQ ID NO: 602828 - RNA, 64 nt, hsa; identical to SEQ ID NO: 197630

SEQ ID NO: 602829 - RNA, 64 nt, hsa; identical to SEQ ID NO: 197631

SEQ ID NO: 602830 - RNA, 64 nt, hsa; identical to SEQ ID NO: 197632

SEQ ID NO: 602831 - RNA, 64 nt, hsa; identical to SEQ ID NO: 197633

SEQ ID NO: 602832 - RNA, 64 nt, hsa; identical to SEQ ID NO: 197634

SEQ ID NO: 602833 - RNA, 64 nt, hsa; identical to SEQ ID NO: 197635

SEQ ID NO: 602834 - RNA, 64 nt, hsa; identical to SEQ ID NO: 197636

SEQ ID NO: 602835 - RNA, 64 nt, hsa; identical to SEQ ID NO: 197637

SEQ ID NO: 602836 - RNA, 64 nt, hsa; identical to SEQ ID NO: 197638

SEQ ID NO: 602837 - RNA, 64 nt, hsa; identical to SEQ ID NO: 197639

SEQ ID NO: 602838 - RNA, 64 nt, hsa; identical to SEQ ID NO: 197640

SEQ ID NO: 602839 - RNA, 64 nt, hsa; identical to SEQ ID NO: 197641

SEQ ID NO: 602840 - RNA, 64 nt, hsa; identical to SEQ ID NO: 197642

SEQ ID NO: 602841 - RNA, 64 nt, hsa; identical to SEQ ID NO: 197643

SEQ ID NO: 602842 - RNA, 64 nt, hsa; identical to SEQ ID NO: 197644

SEQ ID NO: 602843 - RNA, 64 nt, hsa; identical to SEQ ID NO: 197645

SEQ ID NO: 602844 - RNA, 64 nt, hsa; identical to SEQ ID NO: 197646

SEQ ID NO: 602845 - RNA, 64 nt, hsa; identical to SEQ ID NO: 197647

SEQ ID NO: 602846 - RNA, 64 nt, hsa; identical to SEQ ID NO: 197648

SEQ ID NO: 602847 - RNA, 64 nt, hsa; identical to SEQ ID NO: 197649

SEQ ID NO: 602848 - RNA, 64 nt, hsa; identical to SEQ ID NO: 197650

SEQ ID NO: 602849 - RNA, 64 nt, hsa; identical to SEQ ID NO: 197651

SEQ ID NO: 602850 - RNA, 64 nt, hsa; identical to SEQ ID NO: 197652

SEQ ID NO: 602851 - RNA, 64 nt, hsa; identical to SEQ ID NO: 197653

SEQ ID NO: 602852 - RNA, 64 nt, hsa; identical to SEQ ID NO: 197654

SEQ ID NO: 602853 - RNA, 64 nt, hsa; identical to SEQ ID NO: 197655

SEQ ID NO: 602854 - RNA, 64 nt, hsa; identical to SEQ ID NO: 64831

SEQ ID NO: 602855 - RNA, 64 nt, hsa; identical to SEQ ID NO: 64832

SEQ ID NO: 602856 - RNA, 64 nt, hsa; identical to SEQ ID NO: 197658

SEQ ID NO: 602857 - RNA, 64 nt, hsa; identical to SEQ ID NO: 197659

SEQ ID NO: 602858 - RNA, 64 nt, hsa; identical to SEQ ID NO: 197660

SEQ ID NO: 602859 - RNA, 64 nt, hsa; identical to SEQ ID NO: 197661

SEQ ID NO: 602860 - RNA, 64 nt, hsa; identical to SEQ ID NO: 197662

SEQ ID NO: 602861 - RNA, 64 nt, hsa; identical to SEQ ID NO: 197663

SEQ ID NO: 602862 - RNA, 64 nt, hsa; identical to SEQ ID NO: 197664

SEQ ID NO: 602863 - RNA, 64 nt, hsa; identical to SEQ ID NO: 197665

SEQ ID NO: 602864 - RNA, 64 nt, hsa; identical to SEQ ID NO: 197666

SEQ ID NO: 602865 - RNA, 64 nt, hsa; identical to SEQ ID NO: 197667

SEQ ID NO: 602866 - RNA, 64 nt, hsa; identical to SEQ ID NO: 197668

SEQ ID NO: 602867 - RNA, 64 nt, hsa; identical to SEQ ID NO: 197669

SEQ ID NO: 602868 - RNA, 64 nt, hsa; identical to SEQ ID NO: 197670

SEQ ID NO: 602869 - RNA, 54 nt, hsa; identical to SEQ ID NO: 197671

SEQ ID NO: 602870 - RNA, 64 nt, hsa; identical to SEQ ID NO: 197672

SEQ ID NO: 602871 - RNA, 64 nt, hsa; identical to SEQ ID NO: 197673

SEQ ID NO: 602872 - RNA, 64 nt, hsa; identical to SEQ ID NO: 197674

SEQ ID NO: 602873 - RNA, 64 nt, hsa; identical to SEQ ID NO: 197675

SEQ ID NO: 602874 - RNA, 64 nt, hsa; identical to SEQ ID NO: 197676

SEQ ID NO: 602875 - RNA, 64 nt, hsa; identical to SEQ ID NO: 197677

SEQ ID NO: 602876 - RNA, 64 nt, hsa; identical to SEQ ID NO: 197678

SEQ ID NO: 602877 - RNA, 64 nt, hsa; identical to SEQ ID NO: 197679

SEQ ID NO: 602878 - RNA, 64 nt, hsa; identical to SEQ ID NO: 197680

SEQ ID NO: 602879 - RNA, 64 nt, hsa; identical to SEQ ID NO: 197681

SEQ ID NO: 602880 - RNA, 64 nt, hsa; identical to SEQ ID NO: 197682

SEQ ID NO: 602881 - RNA, 64 nt, hsa; identical to SEQ ID NO: 197683

SEQ ID NO: 602882 - RNA, 64 nt, hsa; identical to SEQ ID NO: 64833

SEQ ID NO: 602883 - RNA, 64 nt, hsa; identical to SEQ ID NO: 64834

SEQ ID NO: 602884 - RNA, 64 nt, hsa; identical to SEQ ID NO: 197686

SEQ ID NO: 602885 - RNA, 59 nt, hsa; identical to SEQ ID NO: 197687

SEQ ID NO: 602886 - RNA, 64 nt, hsa; identical to SEQ ID NO: 197688

SEQ ID NO: 602887 - RNA, 64 nt, hsa; identical to SEQ ID NO: 197689

SEQ ID NO: 602888 - RNA, 64 nt, hsa; identical to SEQ ID NO: 197690

SEQ ID NO: 602889 - RNA, 64 nt, hsa; identical to SEQ ID NO: 197691

SEQ ID NO: 602890 - RNA, 64 nt, hsa; identical to SEQ ID NO: 197692

SEQ ID NO: 602891 - RNA, 57 nt, hsa; identical to SEQ ID NO: 197693

SEQ ID NO: 602892 - RNA, 64 nt, hsa; identical to SEQ ID NO: 197694

SEQ ID NO: 602893 - RNA, 64 nt, hsa; identical to SEQ ID NO: 197695

SEQ ID NO: 602894 - RNA, 64 nt, hsa; identical to SEQ ID NO: 197696

SEQ ID NO: 602895 - RNA, 64 nt, hsa; identical to SEQ ID NO: 197697

SEQ ID NO: 602896 - RNA, 64 nt, hsa; identical to SEQ ID NO: 197698

SEQ ID NO: 602897 - RNA, 64 nt, hsa; identical to SEQ ID NO: 197699

SEQ ID NO: 602898 - RNA, 64 nt, hsa; identical to SEQ ID NO: 197700

SEQ ID NO: 602899 - RNA, 64 nt, hsa; identical to SEQ ID NO: 197701

SEQ ID NO: 602900 - RNA, 64 nt, hsa; identical to SEQ ID NO: 197702

SEQ ID NO: 602901 - RNA, 64 nt, hsa; identical to SEQ ID NO: 197703

SEQ ID NO: 602902 - RNA, 64 nt, hsa; identical to SEQ ID NO: 197704

SEQ ID NO: 602903 - RNA, 64 nt, hsa; identical to SEQ ID NO: 197705

SEQ ID NO: 602904 - RNA, 64 nt, hsa; identical to SEQ ID NO: 197706

SEQ ID NO: 602905 - RNA, 64 nt, hsa; identical to SEQ ID NO: 197707

SEQ ID NO: 602906 - RNA, 64 nt, hsa; identical to SEQ ID NO: 197708

SEQ ID NO: 602907 - RNA, 64 nt, hsa; identical to SEQ ID NO: 197709

SEQ ID NO: 602908 - RNA, 64 nt, hsa; identical to SEQ ID NO: 197710

SEQ ID NO: 602909 - RNA, 64 nt, hsa; identical to SEQ ID NO: 197711

SEQ ID NO: 602910 - RNA, 64 nt, hsa; identical to SEQ ID NO: 197712

SEQ ID NO: 602911 - RNA, 64 nt, hsa; identical to SEQ ID NO: 197713

SEQ ID NO: 602912 - RNA, 64 nt, hsa; identical to SEQ ID NO: 197714

SEQ ID NO: 602913 - RNA, 64 nt, hsa; identical to SEQ ID NO: 197715

SEQ ID NO: 602914 - RNA, 64 nt, hsa; identical to SEQ ID NO: 197716

SEQ ID NO: 602915 - RNA, 64 nt, hsa; identical to SEQ ID NO: 197717

SEQ ID NO: 602916 - RNA, 64 nt, hsa; identical to SEQ ID NO: 197718

SEQ ID NO: 602917 - RNA, 64 nt, hsa; identical to SEQ ID NO: 197719

SEQ ID NO: 602918 - RNA, 64 nt, hsa; identical to SEQ ID NO: 197720

SEQ ID NO: 602919 - RNA, 64 nt, hsa; identical to SEQ ID NO: 197721

SEQ ID NO: 602920 - RNA, 64 nt, hsa; identical to SEQ ID NO: 197722

SEQ ID NO: 602921 - RNA, 64 nt, hsa; identical to SEQ ID NO: 197723

SEQ ID NO: 602922 - RNA, 64 nt, hsa; identical to SEQ ID NO: 197724

SEQ ID NO: 602923 - RNA, 64 nt, hsa; identical to SEQ ID NO: 197725

SEQ ID NO: 602924 - RNA, 64 nt, hsa; identical to SEQ ID NO: 197726

SEQ ID NO: 602925 - RNA, 64 nt, hsa; identical to SEQ ID NO: 197727

SEQ ID NO: 602926 - RNA, 64 nt, hsa; identical to SEQ ID NO: 197728

SEQ ID NO: 602927 - RNA, 50 nt, hsa; identical to SEQ ID NO: 197729

SEQ ID NO: 602928 - RNA, 64 nt, hsa; identical to SEQ ID NO: 197730

SEQ ID NO: 602929 - RNA, 64 nt, hsa; identical to SEQ ID NO: 197731

SEQ ID NO: 602930 - RNA, 64 nt, hsa; identical to SEQ ID NO: 197732

SEQ ID NO: 602931 - RNA, 64 nt, hsa; identical to SEQ ID NO: 197733

SEQ ID NO: 602932 - RNA, 64 nt, hsa; identical to SEQ ID NO: 197734

SEQ ID NO: 602933 - RNA, 64 nt, hsa; identical to SEQ ID NO: 197735

SEQ ID NO: 602934 - RNA, 64 nt, hsa; identical to SEQ ID NO: 197736

SEQ ID NO: 602935 - RNA, 64 nt, hsa; identical to SEQ ID NO: 197737

SEQ ID NO: 602936 - RNA, 64 nt, hsa; identical to SEQ ID NO: 197738

SEQ ID NO: 602937 - RNA, 64 nt, hsa; identical to SEQ ID NO: 197739

SEQ ID NO: 602938 - RNA, 64 nt, hsa; identical to SEQ ID NO: 197740

SEQ ID NO: 602939 - RNA, 64 nt, hsa; identical to SEQ ID NO: 197741

SEQ ID NO: 602940 - RNA, 64 nt, hsa; identical to SEQ ID NO: 197742

SEQ ID NO: 602941 - RNA, 64 nt, hsa; identical to SEQ ID NO: 197743

SEQ ID NO: 602942 - RNA, 64 nt, hsa; identical to SEQ ID NO: 197744

SEQ ID NO: 602943 - RNA, 64 nt, hsa; identical to SEQ ID NO: 197745

SEQ ID NO: 602944 - RNA, 64 nt, hsa; identical to SEQ ID NO: 197746

SEQ ID NO: 602945 - RNA, 64 nt, hsa; identical to SEQ ID NO: 197747

SEQ ID NO: 602946 - RNA, 64 nt, hsa; identical to SEQ ID NO: 197748

SEQ ID NO: 602947 - RNA, 64 nt, hsa; identical to SEQ ID NO: 197749

SEQ ID NO: 602948 - RNA, 64 nt, hsa; identical to SEQ ID NO: 197750

SEQ ID NO: 602949 - RNA, 57 nt, hsa; identical to SEQ ID NO: 197751

SEQ ID NO: 602950 - RNA, 64 nt, hsa; identical to SEQ ID NO: 197752

SEQ ID NO: 602951 - RNA, 64 nt, hsa; identical to SEQ ID NO: 197753

SEQ ID NO: 602952 - RNA, 64 nt, hsa; identical to SEQ ID NO: 197754

SEQ ID NO: 602953 - RNA, 64 nt, hsa; identical to SEQ ID NO: 197755

SEQ ID NO: 602954 - RNA, 64 nt, hsa; identical to SEQ ID NO: 197756

SEQ ID NO: 602955 - RNA, 64 nt, hsa; identical to SEQ ID NO: 197757

SEQ ID NO: 602956 - RNA, 64 nt, hsa; identical to SEQ ID NO: 64835

SEQ ID NO: 602957 - RNA, 64 nt, hsa; identical to SEQ ID NO: 64836

SEQ ID NO: 602958 - RNA, 64 nt, hsa; identical to SEQ ID NO: 197760

SEQ ID NO: 602959 - RNA, 64 nt, hsa; identical to SEQ ID NO: 197761

SEQ ID NO: 602960 - RNA, 64 nt, hsa; identical to SEQ ID NO: 197762

SEQ ID NO: 602961 - RNA, 64 nt, hsa; identical to SEQ ID NO: 197763

SEQ ID NO: 602962 - RNA, 64 nt, hsa; identical to SEQ ID NO: 197764

SEQ ID NO: 602963 - RNA, 64 nt, hsa; identical to SEQ ID NO: 197765

SEQ ID NO: 602964 - RNA, 64 nt, hsa; identical to SEQ ID NO: 197766

SEQ ID NO: 602965 - RNA, 64 nt, hsa; identical to SEQ ID NO: 197767

SEQ ID NO: 602966 - RNA, 64 nt, hsa; identical to SEQ ID NO: 197768

SEQ ID NO: 602967 - RNA, 64 nt, hsa; identical to SEQ ID NO: 197769

SEQ ID NO: 602968 - RNA, 64 nt, hsa; identical to SEQ ID NO: 197770

SEQ ID NO: 602969 - RNA, 64 nt, hsa; identical to SEQ ID NO: 197771

SEQ ID NO: 602970 - RNA, 64 nt, hsa; identical to SEQ ID NO: 197772

SEQ ID NO: 602971 - RNA, 64 nt, hsa; identical to SEQ ID NO: 197773

SEQ ID NO: 602972 - RNA, 64 nt, hsa; identical to SEQ ID NO: 197774

SEQ ID NO: 602973 - RNA, 64 nt, hsa; identical to SEQ ID NO: 197775

SEQ ID NO: 602974 - RNA, 64 nt, hsa; identical to SEQ ID NO: 197776

SEQ ID NO: 602975 - RNA, 64 nt, hsa; identical to SEQ ID NO: 197777

SEQ ID NO: 602976 - RNA, 64 nt, hsa; identical to SEQ ID NO: 197778

SEQ ID NO: 602977 - RNA, 64 nt, hsa; identical to SEQ ID NO: 197779

SEQ ID NO: 602978 - RNA, 64 nt, hsa; identical to SEQ ID NO: 197780

SEQ ID NO: 602979 - RNA, 64 nt, hsa; identical to SEQ ID NO: 197781

SEQ ID NO: 602980 - RNA, 64 nt, hsa; identical to SEQ ID NO: 197782

SEQ ID NO: 602981 - RNA, 64 nt, hsa; identical to SEQ ID NO: 197783

SEQ ID NO: 602982 - RNA, 64 nt, hsa; identical to SEQ ID NO: 197784

SEQ ID NO: 602983 - RNA, 64 nt, hsa; identical to SEQ ID NO: 197785

SEQ ID NO: 602984 - RNA, 64 nt, hsa; identical to SEQ ID NO: 197786

SEQ ID NO: 602985 - RNA, 64 nt, hsa; identical to SEQ ID NO: 197787

SEQ ID NO: 602986 - RNA, 64 nt, hsa; identical to SEQ ID NO: 197788

SEQ ID NO: 602987 - RNA, 64 nt, hsa; identical to SEQ ID NO: 197789

SEQ ID NO: 602988 - RNA, 64 nt, hsa; identical to SEQ ID NO: 197790

SEQ ID NO: 602989 - RNA, 64 nt, hsa; identical to SEQ ID NO: 197791

SEQ ID NO: 602990 - RNA, 64 nt, hsa; identical to SEQ ID NO: 197792

SEQ ID NO: 602991 - RNA, 64 nt, hsa; identical to SEQ ID NO: 197793

SEQ ID NO: 602992 - RNA, 64 nt, hsa; identical to SEQ ID NO: 197794

SEQ ID NO: 602993 - RNA, 64 nt, hsa; identical to SEQ ID NO: 197795

SEQ ID NO: 602994 - RNA, 64 nt, hsa; identical to SEQ ID NO: 197796

SEQ ID NO: 602995 - RNA, 64 nt, hsa; identical to SEQ ID NO: 64837

SEQ ID NO: 602996 - RNA, 64 nt, hsa; identical to SEQ ID NO: 64838

SEQ ID NO: 602997 - RNA, 64 nt, hsa; identical to SEQ ID NO: 64839

SEQ ID NO: 602998 - RNA, 64 nt, hsa; identical to SEQ ID NO: 64840

SEQ ID NO: 602999 - RNA, 64 nt, hsa; identical to SEQ ID NO: 197801

SEQ ID NO: 603000 - RNA, 64 nt, hsa; identical to SEQ ID NO: 64841

SEQ ID NO: 603001 - RNA, 64 nt, hsa; identical to SEQ ID NO: 64842

SEQ ID NO: 603002 - RNA, 64 nt, hsa; identical to SEQ ID NO: 197804

SEQ ID NO: 603003 - RNA, 64 nt, hsa; identical to SEQ ID NO: 197805

SEQ ID NO: 603004 - RNA, 64 nt, hsa; identical to SEQ ID NO: 197806

SEQ ID NO: 603005 - RNA, 64 nt, hsa; identical to SEQ ID NO: 197807

SEQ ID NO: 603006 - RNA, 64 nt, hsa; identical to SEQ ID NO: 197808

SEQ ID NO: 603007 - RNA, 64 nt, hsa; identical to SEQ ID NO: 197809

SEQ ID NO: 603008 - RNA, 64 nt, hsa; identical to SEQ ID NO: 197810

SEQ ID NO: 603009 - RNA, 64 nt, hsa; identical to SEQ ID NO: 197811

SEQ ID NO: 603010 - RNA, 64 nt, hsa; identical to SEQ ID NO: 197812

SEQ ID NO: 603011 - RNA, 64 nt, hsa; identical to SEQ ID NO: 197813

SEQ ID NO: 603012 - RNA, 64 nt, hsa; identical to SEQ ID NO: 197814

SEQ ID NO: 603013 - RNA, 64 nt, hsa; identical to SEQ ID NO: 197815

SEQ ID NO: 603014 - RNA, 64 nt, hsa; identical to SEQ ID NO: 197816

SEQ ID NO: 603015 - RNA, 64 nt, hsa; identical to SEQ ID NO: 197817

SEQ ID NO: 603016 - RNA, 64 nt, hsa; identical to SEQ ID NO: 197818

SEQ ID NO: 603017 - RNA, 64 nt, hsa; identical to SEQ ID NO: 197819

SEQ ID NO: 603018 - RNA, 64 nt, hsa; identical to SEQ ID NO: 197820

SEQ ID NO: 603019 - RNA, 64 nt, hsa; identical to SEQ ID NO: 197821

SEQ ID NO: 603020 - RNA, 64 nt, hsa; identical to SEQ ID NO: 197822

SEQ ID NO: 603021 - RNA, 64 nt, hsa; identical to SEQ ID NO: 197823

SEQ ID NO: 603022 - RNA, 64 nt, hsa; identical to SEQ ID NO: 197824

SEQ ID NO: 603023 - RNA, 64 nt, hsa; identical to SEQ ID NO: 197825

SEQ ID NO: 603024 - RNA, 64 nt, hsa; identical to SEQ ID NO: 197826

SEQ ID NO: 603025 - RNA, 64 nt, hsa; identical to SEQ ID NO: 197827

SEQ ID NO: 603026 - RNA, 64 nt, hsa; identical to SEQ ID NO: 197828

SEQ ID NO: 603027 - RNA, 64 nt, hsa; identical to SEQ ID NO: 64843

SEQ ID NO: 603028 - RNA, 64 nt, hsa; identical to SEQ ID NO: 64844

SEQ ID NO: 603029 - RNA, 64 nt, hsa; identical to SEQ ID NO: 197831

SEQ ID NO: 603030 - RNA, 64 nt, hsa; identical to SEQ ID NO: 197832

SEQ ID NO: 603031 - RNA, 64 nt, hsa; identical to SEQ ID NO: 197833

SEQ ID NO: 603032 - RNA, 64 nt, hsa; identical to SEQ ID NO: 197834

SEQ ID NO: 603033 - RNA, 64 nt, hsa; identical to SEQ ID NO: 197835

SEQ ID NO: 603034 - RNA, 64 nt, hsa; identical to SEQ ID NO: 64845

SEQ ID NO: 603035 - RNA, 64 nt, hsa; identical to SEQ ID NO: 64846

SEQ ID NO: 603036 - RNA, 64 nt, hsa; identical to SEQ ID NO: 197838

SEQ ID NO: 603037 - RNA, 64 nt, hsa; identical to SEQ ID NO: 197839

SEQ ID NO: 603038 - RNA, 64 nt, hsa; identical to SEQ ID NO: 197840

SEQ ID NO: 603039 - RNA, 64 nt, hsa; identical to SEQ ID NO: 197841

SEQ ID NO: 603040 - RNA, 64 nt, hsa; identical to SEQ ID NO: 197842

SEQ ID NO: 603041 - RNA, 64 nt, hsa; identical to SEQ ID NO: 197843

SEQ ID NO: 603042 - RNA, 64 nt, hsa; identical to SEQ ID NO: 197844

SEQ ID NO: 603043 - RNA, 64 nt, hsa; identical to SEQ ID NO: 197845

SEQ ID NO: 603044 - RNA, 64 nt, hsa; identical to SEQ ID NO: 197846

SEQ ID NO: 603045 - RNA, 64 nt, hsa; identical to SEQ ID NO: 197847

SEQ ID NO: 603046 - RNA, 64 nt, hsa; identical to SEQ ID NO: 197848

SEQ ID NO: 603047 - RNA, 64 nt, hsa; identical to SEQ ID NO: 197849

SEQ ID NO: 603048 - RNA, 64 nt, hsa; identical to SEQ ID NO: 197850

SEQ ID NO: 603049 - RNA, 54 nt, hsa; identical to SEQ ID NO: 197851

SEQ ID NO: 603050 - RNA, 64 nt, hsa; identical to SEQ ID NO: 197852

SEQ ID NO: 603051 - RNA, 64 nt, hsa; identical to SEQ ID NO: 197853

SEQ ID NO: 603052 - RNA, 62 nt, hsa; identical to SEQ ID NO: 197854

SEQ ID NO: 603053 - RNA, 64 nt, hsa; identical to SEQ ID NO: 197855

SEQ ID NO: 603054 - RNA, 64 nt, hsa; identical to SEQ ID NO: 197856

SEQ ID NO: 603055 - RNA, 64 nt, hsa; identical to SEQ ID NO: 197857

SEQ ID NO: 603056 - RNA, 64 nt, hsa; identical to SEQ ID NO: 197858

SEQ ID NO: 603057 - RNA, 64 nt, hsa; identical to SEQ ID NO: 197859

SEQ ID NO: 603058 - RNA, 64 nt, hsa; identical to SEQ ID NO: 197860

SEQ ID NO: 603059 - RNA, 64 nt, hsa; identical to SEQ ID NO: 197861

SEQ ID NO: 603060 - RNA, 64 nt, hsa; identical to SEQ ID NO: 197862

SEQ ID NO: 603061 - RNA, 64 nt, hsa; identical to SEQ ID NO: 197863

SEQ ID NO: 603062 - RNA, 64 nt, hsa; identical to SEQ ID NO: 197864

SEQ ID NO: 603063 - RNA, 64 nt, hsa; identical to SEQ ID NO: 197865

SEQ ID NO: 603064 - RNA, 64 nt, hsa; identical to SEQ ID NO: 197866

SEQ ID NO: 603065 - RNA, 64 nt, hsa; identical to SEQ ID NO: 197867

SEQ ID NO: 603066 - RNA, 64 nt, hsa; identical to SEQ ID NO: 64847

SEQ ID NO: 603067 - RNA, 64 nt, hsa; identical to SEQ ID NO: 64848

SEQ ID NO: 603068 - RNA, 64 nt, hsa; identical to SEQ ID NO: 197870

SEQ ID NO: 603069 - RNA, 64 nt, hsa; identical to SEQ ID NO: 197871

SEQ ID NO: 603070 - RNA, 64 nt, hsa; identical to SEQ ID NO: 197872

SEQ ID NO: 603071 - RNA, 64 nt, hsa; identical to SEQ ID NO: 197873

SEQ ID NO: 603072 - RNA, 64 nt, hsa; identical to SEQ ID NO: 197874

SEQ ID NO: 603073 - RNA, 64 nt, hsa; identical to SEQ ID NO: 197875

SEQ ID NO: 603074 - RNA, 64 nt, hsa; identical to SEQ ID NO: 197876

SEQ ID NO: 603075 - RNA, 64 nt, hsa; identical to SEQ ID NO: 197877

SEQ ID NO: 603076 - RNA, 64 nt, hsa; identical to SEQ ID NO: 197878

SEQ ID NO: 603077 - RNA, 64 nt, hsa; identical to SEQ ID NO: 197879

SEQ ID NO: 603078 - RNA, 64 nt, hsa; identical to SEQ ID NO: 197880

SEQ ID NO: 603079 - RNA, 64 nt, hsa; identical to SEQ ID NO: 197881

SEQ ID NO: 603080 - RNA, 64 nt, hsa; identical to SEQ ID NO: 197882

SEQ ID NO: 603081 - RNA, 64 nt, hsa; identical to SEQ ID NO: 197883

SEQ ID NO: 603082 - RNA, 64 nt, hsa; identical to SEQ ID NO: 197884

SEQ ID NO: 603083 - RNA, 64 nt, hsa; identical to SEQ ID NO: 197885

SEQ ID NO: 603084 - RNA, 64 nt, hsa; identical to SEQ ID NO: 64849

SEQ ID NO: 603085 - RNA, 64 nt, hsa; identical to SEQ ID NO: 64850

SEQ ID NO: 603086 - RNA, 64 nt, hsa; identical to SEQ ID NO: 197888

SEQ ID NO: 603087 - RNA, 64 nt, hsa; identical to SEQ ID NO: 197889

SEQ ID NO: 603088 - RNA, 64 nt, hsa; identical to SEQ ID NO: 197890

SEQ ID NO: 603089 - RNA, 64 nt, hsa; identical to SEQ ID NO: 197891

SEQ ID NO: 603090 - RNA, 64 nt, hsa; identical to SEQ ID NO: 197892

SEQ ID NO: 603091 - RNA, 64 nt, hsa; identical to SEQ ID NO: 197893

SEQ ID NO: 603092 - RNA, 64 nt, hsa; identical to SEQ ID NO: 197894

SEQ ID NO: 603093 - RNA, 64 nt, hsa; identical to SEQ ID NO: 197895

SEQ ID NO: 603094 - RNA, 64 nt, hsa; identical to SEQ ID NO: 197896

SEQ ID NO: 603095 - RNA, 64 nt, hsa; identical to SEQ ID NO: 197897

SEQ ID NO: 603096 - RNA, 64 nt, hsa; identical to SEQ ID NO: 197898

SEQ ID NO: 603097 - RNA, 64 nt, hsa; identical to SEQ ID NO: 197899

SEQ ID NO: 603098 - RNA, 64 nt, hsa; identical to SEQ ID NO: 197900

SEQ ID NO: 603099 - RNA, 64 nt, hsa; identical to SEQ ID NO: 197901

SEQ ID NO: 603100 - RNA, 64 nt, hsa; identical to SEQ ID NO: 197902

SEQ ID NO: 603101 - RNA, 64 nt, hsa; identical to SEQ ID NO: 197903

SEQ ID NO: 603102 - RNA, 64 nt, hsa; identical to SEQ ID NO: 64851

SEQ ID NO: 603103 - RNA, 64 nt, hsa; identical to SEQ ID NO: 64852

SEQ ID NO: 603104 - RNA, 64 nt, hsa; identical to SEQ ID NO: 197906

SEQ ID NO: 603105 - RNA, 64 nt, hsa; identical to SEQ ID NO: 197907

SEQ ID NO: 603106 - RNA, 64 nt, hsa; identical to SEQ ID NO: 197908

SEQ ID NO: 603107 - RNA, 64 nt, hsa; identical to SEQ ID NO: 197909

SEQ ID NO: 603108 - RNA, 64 nt, hsa; identical to SEQ ID NO: 197910

SEQ ID NO: 603109 - RNA, 64 nt, hsa; identical to SEQ ID NO: 197911

SEQ ID NO: 603110 - RNA, 64 nt, hsa; identical to SEQ ID NO: 197912

SEQ ID NO: 603111 - RNA, 64 nt, hsa; identical to SEQ ID NO: 197913

SEQ ID NO: 603112 - RNA, 64 nt, hsa; identical to SEQ ID NO: 197914

SEQ ID NO: 603113 - RNA, 64 nt, hsa; identical to SEQ ID NO: 197915

SEQ ID NO: 603114 - RNA, 64 nt, hsa; identical to SEQ ID NO: 197916

SEQ ID NO: 603115 - RNA, 64 nt, hsa; identical to SEQ ID NO: 197917

SEQ ID NO: 603116 - RNA, 64 nt, hsa; identical to SEQ ID NO: 197918

SEQ ID NO: 603117 - RNA, 64 nt, hsa; identical to SEQ ID NO: 197919

SEQ ID NO: 603118 - RNA, 64 nt, hsa; identical to SEQ ID NO: 197920

SEQ ID NO: 603119 - RNA, 64 nt, hsa; identical to SEQ ID NO: 197921

SEQ ID NO: 603120 - RNA, 64 nt, hsa; identical to SEQ ID NO: 197922

SEQ ID NO: 603121 - RNA, 64 nt, hsa; identical to SEQ ID NO: 197923

SEQ ID NO: 603122 - RNA, 64 nt, hsa; identical to SEQ ID NO: 197924

SEQ ID NO: 603123 - RNA, 50 nt, hsa; identical to SEQ ID NO: 197925

SEQ ID NO: 603124 - RNA, 64 nt, hsa; identical to SEQ ID NO: 197926

SEQ ID NO: 603125 - RNA, 64 nt, hsa; identical to SEQ ID NO: 197927

SEQ ID NO: 603126 - RNA, 64 nt, hsa; identical to SEQ ID NO: 197928

SEQ ID NO: 603127 - RNA, 64 nt, hsa; identical to SEQ ID NO: 197929

SEQ ID NO: 603128 - RNA, 64 nt, hsa; identical to SEQ ID NO: 197930

SEQ ID NO: 603129 - RNA, 64 nt, hsa; identical to SEQ ID NO: 197931

SEQ ID NO: 603130 - RNA, 63 nt, hsa; identical to SEQ ID NO: 197932

SEQ ID NO: 603131 - RNA, 64 nt, hsa; identical to SEQ ID NO: 197933

SEQ ID NO: 603132 - RNA, 64 nt, hsa; identical to SEQ ID NO: 197934

SEQ ID NO: 603133 - RNA, 64 nt, hsa; identical to SEQ ID NO: 197935

SEQ ID NO: 603134 - RNA, 64 nt, hsa; identical to SEQ ID NO: 197936

SEQ ID NO: 603135 - RNA, 64 nt, hsa; identical to SEQ ID NO: 197937

SEQ ID NO: 603136 - RNA, 64 nt, hsa; identical to SEQ ID NO: 197938

SEQ ID NO: 603137 - RNA, 64 nt, hsa; identical to SEQ ID NO: 197939

SEQ ID NO: 603138 - RNA, 64 nt, hsa; identical to SEQ ID NO: 197940

SEQ ID NO: 603139 - RNA, 64 nt, hsa; identical to SEQ ID NO: 197941

SEQ ID NO: 603140 - RNA, 64 nt, hsa; identical to SEQ ID NO: 197942

SEQ ID NO: 603141 - RNA, 64 nt, hsa; identical to SEQ ID NO: 197943

SEQ ID NO: 603142 - RNA, 64 nt, hsa; identical to SEQ ID NO: 197944

SEQ ID NO: 603143 - RNA, 64 nt, hsa; identical to SEQ ID NO: 197945

SEQ ID NO: 603144 - RNA, 64 nt, hsa; identical to SEQ ID NO: 197946

SEQ ID NO: 603145 - RNA, 64 nt, hsa; identical to SEQ ID NO: 197947

SEQ ID NO: 603146 - RNA, 63 nt, hsa; identical to SEQ ID NO: 197948

SEQ ID NO: 603147 - RNA, 64 nt, hsa; identical to SEQ ID NO: 197949

SEQ ID NO: 603148 - RNA, 64 nt, hsa; identical to SEQ ID NO: 64853

SEQ ID NO: 603149 - RNA, 64 nt, hsa; identical to SEQ ID NO: 64854

SEQ ID NO: 603150 - RNA, 64 nt, hsa; identical to SEQ ID NO: 197952

SEQ ID NO: 603151 - RNA, 64 nt, hsa; identical to SEQ ID NO: 197953

SEQ ID NO: 603152 - RNA, 64 nt, hsa; identical to SEQ ID NO: 197954

SEQ ID NO: 603153 - RNA, 64 nt, hsa; identical to SEQ ID NO: 197955

SEQ ID NO: 603154 - RNA, 64 nt, hsa; identical to SEQ ID NO: 197956

SEQ ID NO: 603155 - RNA, 64 nt, hsa; identical to SEQ ID NO: 197957

SEQ ID NO: 603156 - RNA, 64 nt, hsa; identical to SEQ ID NO: 197958

SEQ ID NO: 603157 - RNA, 64 nt, hsa; identical to SEQ ID NO: 197959

SEQ ID NO: 603158 - RNA, 64 nt, hsa; identical to SEQ ID NO: 197960

SEQ ID NO: 603159 - RNA, 64 nt, hsa; identical to SEQ ID NO: 197961

SEQ ID NO: 603160 - RNA, 64 nt, hsa; identical to SEQ ID NO: 197962

SEQ ID NO: 603161 - RNA, 64 nt, hsa; identical to SEQ ID NO: 197963

SEQ ID NO: 603162 - RNA, 64 nt, hsa; identical to SEQ ID NO: 197964

SEQ ID NO: 603163 - RNA, 64 nt, hsa; identical to SEQ ID NO: 197965

SEQ ID NO: 603164 - RNA, 64 nt, hsa; identical to SEQ ID NO: 197966

SEQ ID NO: 603165 - RNA, 64 nt, hsa; identical to SEQ ID NO: 197967

SEQ ID NO: 603166 - RNA, 64 nt, hsa; identical to SEQ ID NO: 197968

SEQ ID NO: 603167 - RNA, 64 nt, hsa; identical to SEQ ID NO: 197969

SEQ ID NO: 603168 - RNA, 64 nt, hsa; identical to SEQ ID NO: 197970

SEQ ID NO: 603169 - RNA, 64 nt, hsa; identical to SEQ ID NO: 197971

SEQ ID NO: 603170 - RNA, 64 nt, hsa; identical to SEQ ID NO: 197972

SEQ ID NO: 603171 - RNA, 64 nt, hsa; identical to SEQ ID NO: 197973

SEQ ID NO: 603172 - RNA, 64 nt, hsa; identical to SEQ ID NO: 197974

SEQ ID NO: 603173 - RNA, 64 nt, hsa; identical to SEQ ID NO: 197975

SEQ ID NO: 603174 - RNA, 64 nt, hsa; identical to SEQ ID NO: 197976

SEQ ID NO: 603175 - RNA, 64 nt, hsa; identical to SEQ ID NO: 197977

SEQ ID NO: 603176 - RNA, 64 nt, hsa; identical to SEQ ID NO: 197978

SEQ ID NO: 603177 - RNA, 64 nt, hsa; identical to SEQ ID NO: 197979

SEQ ID NO: 603178 - RNA, 64 nt, hsa; identical to SEQ ID NO: 197980

SEQ ID NO: 603179 - RNA, 64 nt, hsa; identical to SEQ ID NO: 197981

SEQ ID NO: 603180 - RNA, 50 nt, hsa; identical to SEQ ID NO: 197982

SEQ ID NO: 603181 - RNA, 64 nt, hsa; identical to SEQ ID NO: 197983

SEQ ID NO: 603182 - RNA, 64 nt, hsa; identical to SEQ ID NO: 197984

SEQ ID NO: 603183 - RNA, 64 nt, hsa; identical to SEQ ID NO: 197985

SEQ ID NO: 603184 - RNA, 64 nt, hsa; identical to SEQ ID NO: 197986

SEQ ID NO: 603185 - RNA, 64 nt, hsa; identical to SEQ ID NO: 197987

SEQ ID NO: 603186 - RNA, 64 nt, hsa; identical to SEQ ID NO: 197988

SEQ ID NO: 603187 - RNA, 64 nt, hsa; identical to SEQ ID NO: 197989

SEQ ID NO: 603188 - RNA, 64 nt, hsa; identical to SEQ ID NO: 197990

SEQ ID NO: 603189 - RNA, 64 nt, hsa; identical to SEQ ID NO: 197991

SEQ ID NO: 603190 - RNA, 64 nt, hsa; identical to SEQ ID NO: 197992

SEQ ID NO: 603191 - RNA, 64 nt, hsa; identical to SEQ ID NO: 197993

SEQ ID NO: 603192 - RNA, 64 nt, hsa; identical to SEQ ID NO: 197994

SEQ ID NO: 603193 - RNA, 64 nt, hsa; identical to SEQ ID NO: 197995

SEQ ID NO: 603194 - RNA, 64 nt, hsa; identical to SEQ ID NO: 197996

SEQ ID NO: 603195 - RNA, 64 nt, hsa; identical to SEQ ID NO: 197997

SEQ ID NO: 603196 - RNA, 64 nt, hsa; identical to SEQ ID NO: 197998

SEQ ID NO: 603197 - RNA, 64 nt, hsa; identical to SEQ ID NO: 197999

SEQ ID NO: 603198 - RNA, 64 nt, hsa; identical to SEQ ID NO: 198000

SEQ ID NO: 603199 - RNA, 64 nt, hsa; identical to SEQ ID NO: 198001

SEQ ID NO: 603200 - RNA, 64 nt, hsa; identical to SEQ ID NO: 198002

SEQ ID NO: 603201 - RNA, 64 nt, hsa; identical to SEQ ID NO: 198003

SEQ ID NO: 603202 - RNA, 64 nt, hsa; identical to SEQ ID NO: 198004

SEQ ID NO: 603203 - RNA, 64 nt, hsa; identical to SEQ ID NO: 198005

SEQ ID NO: 603204 - RNA, 64 nt, hsa; identical to SEQ ID NO: 198006

SEQ ID NO: 603205 - RNA, 64 nt, hsa; identical to SEQ ID NO: 198007

SEQ ID NO: 603206 - RNA, 64 nt, hsa; identical to SEQ ID NO: 198008

SEQ ID NO: 603207 - RNA, 64 nt, hsa; identical to SEQ ID NO: 198009

SEQ ID NO: 603208 - RNA, 64 nt, hsa; identical to SEQ ID NO: 198010

SEQ ID NO: 603209 - RNA, 64 nt, hsa; identical to SEQ ID NO: 198011

SEQ ID NO: 603210 - RNA, 64 nt, hsa; identical to SEQ ID NO: 198012

SEQ ID NO: 603211 - RNA, 64 nt, hsa; identical to SEQ ID NO: 198013

SEQ ID NO: 603212 - RNA, 64 nt, hsa; identical to SEQ ID NO: 198014

SEQ ID NO: 603213 - RNA, 64 nt, hsa; identical to SEQ ID NO: 198015

SEQ ID NO: 603214 - RNA, 64 nt, hsa; identical to SEQ ID NO: 198016

SEQ ID NO: 603215 - RNA, 64 nt, hsa; identical to SEQ ID NO: 198017

SEQ ID NO: 603216 - RNA, 64 nt, hsa; identical to SEQ ID NO: 198018

SEQ ID NO: 603217 - RNA, 64 nt, hsa; identical to SEQ ID NO: 198019

SEQ ID NO: 603218 - RNA, 64 nt, hsa; identical to SEQ ID NO: 198020

SEQ ID NO: 603219 - RNA, 64 nt, hsa; identical to SEQ ID NO: 198021

SEQ ID NO: 603220 - RNA, 64 nt, hsa; identical to SEQ ID NO: 198022

SEQ ID NO: 603221 - RNA, 64 nt, hsa; identical to SEQ ID NO: 198023

SEQ ID NO: 603222 - RNA, 64 nt, hsa; identical to SEQ ID NO: 198024

SEQ ID NO: 603223 - RNA, 64 nt, hsa; identical to SEQ ID NO: 198025

SEQ ID NO: 603224 - RNA, 64 nt, hsa; identical to SEQ ID NO: 198026

SEQ ID NO: 603225 - RNA, 64 nt, hsa; identical to SEQ ID NO: 198027

SEQ ID NO: 603226 - RNA, 64 nt, hsa; identical to SEQ ID NO: 198028

SEQ ID NO: 603227 - RNA, 64 nt, hsa; identical to SEQ ID NO: 198029

SEQ ID NO: 603228 - RNA, 64 nt, hsa; identical to SEQ ID NO: 64855

SEQ ID NO: 603229 - RNA, 64 nt, hsa; identical to SEQ ID NO: 64856

SEQ ID NO: 603230 - RNA, 64 nt, hsa; identical to SEQ ID NO: 198032

SEQ ID NO: 603231 - RNA, 64 nt, hsa; identical to SEQ ID NO: 198033

SEQ ID NO: 603232 - RNA, 64 nt, hsa; identical to SEQ ID NO: 198034

SEQ ID NO: 603233 - RNA, 64 nt, hsa; identical to SEQ ID NO: 198035

SEQ ID NO: 603234 - RNA, 64 nt, hsa; identical to SEQ ID NO: 198036

SEQ ID NO: 603235 - RNA, 64 nt, hsa; identical to SEQ ID NO: 198037

SEQ ID NO: 603236 - RNA, 64 nt, hsa; identical to SEQ ID NO: 198038

SEQ ID NO: 603237 - RNA, 64 nt, hsa; identical to SEQ ID NO: 198039

SEQ ID NO: 603238 - RNA, 64 nt, hsa; identical to SEQ ID NO: 198040

SEQ ID NO: 603239 - RNA, 64 nt, hsa; identical to SEQ ID NO: 198041

SEQ ID NO: 603240 - RNA, 64 nt, hsa; identical to SEQ ID NO: 198042

SEQ ID NO: 603241 - RNA, 64 nt, hsa; identical to SEQ ID NO: 198043

SEQ ID NO: 603242 - RNA, 64 nt, hsa; identical to SEQ ID NO: 198044

SEQ ID NO: 603243 - RNA, 64 nt, hsa; identical to SEQ ID NO: 198045

SEQ ID NO: 603244 - RNA, 64 nt, hsa; identical to SEQ ID NO: 198046

SEQ ID NO: 603245 - RNA, 64 nt, hsa; identical to SEQ ID NO: 198047

SEQ ID NO: 603246 - RNA, 64 nt, hsa; identical to SEQ ID NO: 198048

SEQ ID NO: 603247 - RNA, 64 nt, hsa; identical to SEQ ID NO: 198049

SEQ ID NO: 603248 - RNA, 64 nt, hsa; identical to SEQ ID NO: 198050

SEQ ID NO: 603249 - RNA, 64 nt, hsa; identical to SEQ ID NO: 198051

SEQ ID NO: 603250 - RNA, 64 nt, hsa; identical to SEQ ID NO: 198052

SEQ ID NO: 603251 - RNA, 64 nt, hsa; identical to SEQ ID NO: 198046

SEQ ID NO: 603252 - RNA, 64 nt, hsa; identical to SEQ ID NO: 198054

SEQ ID NO: 603253 - RNA, 65 nt, hsa; identical to SEQ ID NO: 198055

SEQ ID NO: 603254 - RNA, 65 nt, hsa; identical to SEQ ID NO: 198056

SEQ ID NO: 603255 - RNA, 65 nt, hsa; identical to SEQ ID NO: 198057

SEQ ID NO: 603256 - RNA, 65 nt, hsa; identical to SEQ ID NO: 198058

SEQ ID NO: 603257 - RNA, 65 nt, hsa; identical to SEQ ID NO: 198059

SEQ ID NO: 603258 - RNA, 65 nt, hsa; identical to SEQ ID NO: 198060

SEQ ID NO: 603259 - RNA, 50 nt, hsa; identical to SEQ ID NO: 198061

SEQ ID NO: 603260 - RNA, 65 nt, hsa; identical to SEQ ID NO: 198062

SEQ ID NO: 603261 - RNA, 65 nt, hsa; identical to SEQ ID NO: 198063

SEQ ID NO: 603262 - RNA, 65 nt, hsa; identical to SEQ ID NO: 198064

SEQ ID NO: 603263 - RNA, 65 nt, hsa; identical to SEQ ID NO: 198065

SEQ ID NO: 603264 - RNA, 65 nt, hsa; identical to SEQ ID NO: 198066

SEQ ID NO: 603265 - RNA, 65 nt, hsa; identical to SEQ ID NO: 198067

SEQ ID NO: 603266 - RNA, 65 nt, hsa; identical to SEQ ID NO: 198068

SEQ ID NO: 603267 - RNA, 65 nt, hsa; identical to SEQ ID NO: 198069

SEQ ID NO: 603268 - RNA, 65 nt, hsa; identical to SEQ ID NO: 198070

SEQ ID NO: 603269 - RNA, 65 nt, hsa; identical to SEQ ID NO: 198071

SEQ ID NO: 603270 - RNA, 65 nt, hsa; identical to SEQ ID NO: 198072

SEQ ID NO: 603271 - RNA, 65 nt, hsa; identical to SEQ ID NO: 198073

SEQ ID NO: 603272 - RNA, 65 nt, hsa; identical to SEQ ID NO: 198074

SEQ ID NO: 603273 - RNA, 65 nt, hsa; identical to SEQ ID NO: 198075

SEQ ID NO: 603274 - RNA, 65 nt, hsa; identical to SEQ ID NO: 198076

SEQ ID NO: 603275 - RNA, 65 nt, hsa; identical to SEQ ID NO: 198077

SEQ ID NO: 603276 - RNA, 65 nt, hsa; identical to SEQ ID NO: 198078

SEQ ID NO: 603277 - RNA, 65 nt, hsa; identical to SEQ ID NO: 198079

SEQ ID NO: 603278 - RNA, 65 nt, hsa; identical to SEQ ID NO: 198080

SEQ ID NO: 603279 - RNA, 65 nt, hsa; identical to SEQ ID NO: 198081

SEQ ID NO: 603280 - RNA, 65 nt, hsa; identical to SEQ ID NO: 198082

SEQ ID NO: 603281 - RNA, 65 nt, hsa; identical to SEQ ID NO: 198083

SEQ ID NO: 603282 - RNA, 65 nt, hsa; identical to SEQ ID NO: 198084

SEQ ID NO: 603283 - RNA, 65 nt, hsa; identical to SEQ ID NO: 198085

SEQ ID NO: 603284 - RNA, 65 nt, hsa; identical to SEQ ID NO: 198086

SEQ ID NO: 603285 - RNA, 65 nt, hsa; identical to SEQ ID NO: 198087

SEQ ID NO: 603286 - RNA, 65 nt, hsa; identical to SEQ ID NO: 198088

SEQ ID NO: 603287 - RNA, 65 nt, hsa; identical to SEQ ID NO: 198089

SEQ ID NO: 603288 - RNA, 65 nt, hsa; identical to SEQ ID NO: 198090

SEQ ID NO: 603289 - RNA, 65 nt, hsa; identical to SEQ ID NO: 198091

SEQ ID NO: 603290 - RNA, 65 nt, hsa; identical to SEQ ID NO: 198092

SEQ ID NO: 603291 - RNA, 65 nt, hsa; identical to SEQ ID NO: 198093

SEQ ID NO: 603292 - RNA, 65 nt, hsa; identical to SEQ ID NO: 198094

SEQ ID NO: 603293 - RNA, 65 nt, hsa; identical to SEQ ID NO: 198095

SEQ ID NO: 603294 - RNA, 65 nt, hsa; identical to SEQ ID NO: 198096

SEQ ID NO: 603295 - RNA, 65 nt, hsa; identical to SEQ ID NO: 198097

SEQ ID NO: 603296 - RNA, 65 nt, hsa; identical to SEQ ID NO: 198098

SEQ ID NO: 603297 - RNA, 65 nt, hsa; identical to SEQ ID NO: 198099

SEQ ID NO: 603298 - RNA, 65 nt, hsa; identical to SEQ ID NO: 198100

SEQ ID NO: 603299 - RNA, 65 nt, hsa; identical to SEQ ID NO: 198101

SEQ ID NO: 603300 - RNA, 65 nt, hsa; identical to SEQ ID NO: 198102

SEQ ID NO: 603301 - RNA, 65 nt, hsa; identical to SEQ ID NO: 198103

SEQ ID NO: 603302 - RNA, 65 nt, hsa; identical to SEQ ID NO: 198104

SEQ ID NO: 603303 - RNA, 65 nt, hsa; identical to SEQ ID NO: 198105

SEQ ID NO: 603304 - RNA, 65 nt, hsa; identical to SEQ ID NO: 198106

SEQ ID NO: 603305 - RNA, 65 nt, hsa; identical to SEQ ID NO: 198107

SEQ ID NO: 603306 - RNA, 65 nt, hsa; identical to SEQ ID NO: 198108

SEQ ID NO: 603307 - RNA, 65 nt, hsa; identical to SEQ ID NO: 198109

SEQ ID NO: 603308 - RNA, 65 nt, hsa; identical to SEQ ID NO: 198110

SEQ ID NO: 603309 - RNA, 65 nt, hsa; identical to SEQ ID NO: 198111

SEQ ID NO: 603310 - RNA, 65 nt, hsa; identical to SEQ ID NO: 198112

SEQ ID NO: 603311 - RNA, 65 nt, hsa; identical to SEQ ID NO: 198113

SEQ ID NO: 603312 - RNA, 65 nt, hsa; identical to SEQ ID NO: 198114

SEQ ID NO: 603313 - RNA, 64 nt, hsa; identical to SEQ ID NO: 198115

SEQ ID NO: 603314 - RNA, 65 nt, hsa; identical to SEQ ID NO: 198116

SEQ ID NO: 603315 - RNA, 65 nt, hsa; identical to SEQ ID NO: 198117

SEQ ID NO: 603316 - RNA, 65 nt, hsa; identical to SEQ ID NO: 198118

SEQ ID NO: 603317 - RNA, 65 nt, hsa; identical to SEQ ID NO: 198119

SEQ ID NO: 603318 - RNA, 65 nt, hsa; identical to SEQ ID NO: 198120

SEQ ID NO: 603319 - RNA, 65 nt, hsa; identical to SEQ ID NO: 198121

SEQ ID NO: 603320 - RNA, 65 nt, hsa; identical to SEQ ID NO: 198122

SEQ ID NO: 603321 - RNA, 65 nt, hsa; identical to SEQ ID NO: 198123

SEQ ID NO: 603322 - RNA, 65 nt, hsa; identical to SEQ ID NO: 198124

SEQ ID NO: 603323 - RNA, 65 nt, hsa; identical to SEQ ID NO: 198125

SEQ ID NO: 603324 - RNA, 65 nt, hsa; identical to SEQ ID NO: 198126

SEQ ID NO: 603325 - RNA, 65 nt, hsa; identical to SEQ ID NO: 198127

SEQ ID NO: 603326 - RNA, 65 nt, hsa; identical to SEQ ID NO: 198128

SEQ ID NO: 603327 - RNA, 65 nt, hsa; identical to SEQ ID NO: 198129

SEQ ID NO: 603328 - RNA, 65 nt, hsa; identical to SEQ ID NO: 198130

SEQ ID NO: 603329 - RNA, 65 nt, hsa; identical to SEQ ID NO: 198131

SEQ ID NO: 603330 - RNA, 65 nt, hsa; identical to SEQ ID NO: 198132

SEQ ID NO: 603331 - RNA, 65 nt, hsa; identical to SEQ ID NO: 198133

SEQ ID NO: 603332 - RNA, 65 nt, hsa; identical to SEQ ID NO: 198134

SEQ ID NO: 603333 - RNA, 65 nt, hsa; identical to SEQ ID NO: 198135

SEQ ID NO: 603334 - RNA, 65 nt, hsa; identical to SEQ ID NO: 198136

SEQ ID NO: 603335 - RNA, 65 nt, hsa; identical to SEQ ID NO: 198137

SEQ ID NO: 603336 - RNA, 65 nt, hsa; identical to SEQ ID NO: 198138

SEQ ID NO: 603337 - RNA, 65 nt, hsa; identical to SEQ ID NO: 198139

SEQ ID NO: 603338 - RNA, 65 nt, hsa; identical to SEQ ID NO: 198140

SEQ ID NO: 603339 - RNA, 65 nt, hsa; identical to SEQ ID NO: 198141

SEQ ID NO: 603340 - RNA, 65 nt, hsa; identical to SEQ ID NO: 198142

SEQ ID NO: 603341 - RNA, 65 nt, hsa; identical to SEQ ID NO: 198143

SEQ ID NO: 603342 - RNA, 65 nt, hsa; identical to SEQ ID NO: 198144

SEQ ID NO: 603343 - RNA, 65 nt, hsa; identical to SEQ ID NO: 198145

SEQ ID NO: 603344 - RNA, 65 nt, hsa; identical to SEQ ID NO: 198146

SEQ ID NO: 603345 - RNA, 65 nt, hsa; identical to SEQ ID NO: 198147

SEQ ID NO: 603346 - RNA, 65 nt, hsa; identical to SEQ ID NO: 198148

SEQ ID NO: 603347 - RNA, 65 nt, hsa; identical to SEQ ID NO: 198149

SEQ ID NO: 603348 - RNA, 65 nt, hsa; identical to SEQ ID NO: 198150

SEQ ID NO: 603349 - RNA, 65 nt, hsa; identical to SEQ ID NO: 198151

SEQ ID NO: 603350 - RNA, 65 nt, hsa; identical to SEQ ID NO: 198152

SEQ ID NO: 603351 - RNA, 65 nt, hsa; identical to SEQ ID NO: 198153

SEQ ID NO: 603352 - RNA, 65 nt, hsa; identical to SEQ ID NO: 198154

SEQ ID NO: 603353 - RNA, 65 nt, hsa; identical to SEQ ID NO: 198155

SEQ ID NO: 603354 - RNA, 65 nt, hsa; identical to SEQ ID NO: 198156

SEQ ID NO: 603355 - RNA, 65 nt, hsa; identical to SEQ ID NO: 198157

SEQ ID NO: 603356 - RNA, 65 nt, hsa; identical to SEQ ID NO: 198158

SEQ ID NO: 603357 - RNA, 65 nt, hsa; identical to SEQ ID NO: 198159

SEQ ID NO: 603358 - RNA, 65 nt, hsa; identical to SEQ ID NO: 198160

SEQ ID NO: 603359 - RNA, 65 nt, hsa; identical to SEQ ID NO: 198161

SEQ ID NO: 603360 - RNA, 65 nt, hsa; identical to SEQ ID NO: 198162

SEQ ID NO: 603361 - RNA, 65 nt, hsa; identical to SEQ ID NO: 198163

SEQ ID NO: 603362 - RNA, 65 nt, hsa; identical to SEQ ID NO: 198164

SEQ ID NO: 603363 - RNA, 65 nt, hsa; identical to SEQ ID NO: 198165

SEQ ID NO: 603364 - RNA, 65 nt, hsa; identical to SEQ ID NO: 198166

SEQ ID NO: 603365 - RNA, 65 nt, hsa; identical to SEQ ID NO: 198167

SEQ ID NO: 603366 - RNA, 65 nt, hsa; identical to SEQ ID NO: 198168

SEQ ID NO: 603367 - RNA, 65 nt, hsa; identical to SEQ ID NO: 198169

SEQ ID NO: 603368 - RNA, 65 nt, hsa; identical to SEQ ID NO: 198170

SEQ ID NO: 603369 - RNA, 65 nt, hsa; identical to SEQ ID NO: 198171

SEQ ID NO: 603370 - RNA, 65 nt, hsa; identical to SEQ ID NO: 198172

SEQ ID NO: 603371 - RNA, 65 nt, hsa; identical to SEQ ID NO: 198173

SEQ ID NO: 603372 - RNA, 65 nt, hsa; identical to SEQ ID NO: 198174

SEQ ID NO: 603373 - RNA, 65 nt, hsa; identical to SEQ ID NO: 198175

SEQ ID NO: 603374 - RNA, 65 nt, hsa; identical to SEQ ID NO: 198176

SEQ ID NO: 603375 - RNA, 65 nt, hsa; identical to SEQ ID NO: 198177

SEQ ID NO: 603376 - RNA, 65 nt, hsa; identical to SEQ ID NO: 198178

SEQ ID NO: 603377 - RNA, 65 nt, hsa; identical to SEQ ID NO: 198179

SEQ ID NO: 603378 - RNA, 65 nt, hsa; identical to SEQ ID NO: 198180

SEQ ID NO: 603379 - RNA, 65 nt, hsa; identical to SEQ ID NO: 198181

SEQ ID NO: 603380 - RNA, 65 nt, hsa; identical to SEQ ID NO: 198182

SEQ ID NO: 603381 - RNA, 65 nt, hsa; identical to SEQ ID NO: 198183

SEQ ID NO: 603382 - RNA, 65 nt, hsa; identical to SEQ ID NO: 198184

SEQ ID NO: 603383 - RNA, 65 nt, hsa; identical to SEQ ID NO: 198185

SEQ ID NO: 603384 - RNA, 65 nt, hsa; identical to SEQ ID NO: 198186

SEQ ID NO: 603385 - RNA, 65 nt, hsa; identical to SEQ ID NO: 198187

SEQ ID NO: 603386 - RNA, 65 nt, hsa; identical to SEQ ID NO: 198188

SEQ ID NO: 603387 - RNA, 65 nt, hsa; identical to SEQ ID NO: 198189

SEQ ID NO: 603388 - RNA, 65 nt, hsa; identical to SEQ ID NO: 198190

SEQ ID NO: 603389 - RNA, 65 nt, hsa; identical to SEQ ID NO: 198191

SEQ ID NO: 603390 - RNA, 65 nt, hsa; identical to SEQ ID NO: 198192

SEQ ID NO: 603391 - RNA, 65 nt, hsa; identical to SEQ ID NO: 198193

SEQ ID NO: 603392 - RNA, 65 nt, hsa; identical to SEQ ID NO: 198194

SEQ ID NO: 603393 - RNA, 65 nt, hsa; identical to SEQ ID NO: 198195

SEQ ID NO: 603394 - RNA, 65 nt, hsa; identical to SEQ ID NO: 198196

SEQ ID NO: 603395 - RNA, 65 nt, hsa; identical to SEQ ID NO: 198197

SEQ ID NO: 603396 - RNA, 65 nt, hsa; identical to SEQ ID NO: 198198

SEQ ID NO: 603397 - RNA, 65 nt, hsa; identical to SEQ ID NO: 198199

SEQ ID NO: 603398 - RNA, 65 nt, hsa; identical to SEQ ID NO: 198200

SEQ ID NO: 603399 - RNA, 65 nt, hsa; identical to SEQ ID NO: 198201

SEQ ID NO: 603400 - RNA, 65 nt, hsa; identical to SEQ ID NO: 198202

SEQ ID NO: 603401 - RNA, 65 nt, hsa; identical to SEQ ID NO: 198203

SEQ ID NO: 603402 - RNA, 65 nt, hsa; identical to SEQ ID NO: 198204

SEQ ID NO: 603403 - RNA, 65 nt, hsa; identical to SEQ ID NO: 198205

SEQ ID NO: 603404 - RNA, 65 nt, hsa; identical to SEQ ID NO: 198206

SEQ ID NO: 603405 - RNA, 65 nt, hsa; identical to SEQ ID NO: 198207

SEQ ID NO: 603406 - RNA, 65 nt, hsa; identical to SEQ ID NO: 198208

SEQ ID NO: 603407 - RNA, 65 nt, hsa; identical to SEQ ID NO: 198209

SEQ ID NO: 603408 - RNA, 65 nt, hsa; identical to SEQ ID NO: 198210

SEQ ID NO: 603409 - RNA, 65 nt, hsa; identical to SEQ ID NO: 198211

SEQ ID NO: 603410 - RNA, 65 nt, hsa; identical to SEQ ID NO: 198212

SEQ ID NO: 603411 - RNA, 65 nt, hsa; identical to SEQ ID NO: 198213

SEQ ID NO: 603412 - RNA, 64 nt, hsa
uaaaguuuuugccacuguaaauaaaaacaguauccguagcuaucaggaucauugcgcacucaua

SEQ ID NO: 603413 - RNA, 64 nt, hsa
caggugugagcuggcaaauccgagaccuguuuugcguagcuaauuaccagcaaugacaaacucc

SEQ ID NO: 603414 - RNA, 64 nt, hsa
ccacuugcggaaccugacucaggcugcuggcaagcguagcuauguguuggcccuggggcggccc

SEQ ID NO: 603415 - RNA, 64 nt, hsa
uugguucacuggacauuuccacgugagcggccuccguagcuaaccucccugcccucugaggagc

SEQ ID NO: 603416 - RNA, 64 nt, hsa
gcuuccauuuaauggggugcaccuguccaauaggcguagcuauccggacagagcacguuugcag

SEQ ID NO: 603417 - RNA, 64 nt, hsa
cagagcccacauuuccacaccagaacuggaacuacguagcuaguaagcauuugaguuugcaaac

SEQ ID NO: 603418 - RNA, 64 nt, hsa
uuuugccuuuuuaccuggaauuuuugcuuacagccguagcuaugaauauauauagggugguccc

SEQ ID NO: 603419 - RNA, 64 nt, hsa
cuauuuaauggaaguuaguguaagcugauaaaaacguagcuaccguacacacacaucaaucacu

SEQ ID NO: 603420 - RNA, 64 nt, hsa
uucuuuuugguuugccuuuuauguaaauuuuuuacguagcuauuuuuauacacuguaagcuuug

SEQ ID NO: 603421 - RNA, 64 nt, hsa
uuaaucuccucuuuuaucuuggacugacauuuagcguagcuaagugaaaaggucauagcugaga

SEQ ID NO: 603422 - RNA, 64 nt, hsa
auaauuauuuucccccuugcucucuauauuaauacguagcuauaaagcaacaguugguuuucuu

SEQ ID NO: 603423 - RNA, 64 nt, hsa
cucucacucuuccuucagguuacuaacaaaauuucguagcuaaagaaugccauggccgggugca

SEQ ID NO: 603424 - RNA, 64 nt, hsa
gcuauguuaauguccuaauguguagcuagcagaucguagcuaguuuguauugucuugucaauug

SEQ ID NO: 603425 - RNA, 64 nt, hsa
cuguucuuuguuucauaauuggauucaucaaucccguagcuacccauauugcacugagcuugcc

SEQ ID NO: 603426 - RNA, 64 nt, hsa
aaauuagcugcguguaguagcauaugccuuucaacguagcuacucaggaggcugaggugggagg

SEQ ID NO: 603427 - RNA, 64 nt, hsa
aaauuagcugggugugguggcgcaaaccuguagucguagcuacuugggaggcugaggcagggga

SEQ ID NO: 603428 - RNA, 64 nt, hsa
augugugucagaagggagaucacggugugaguuucguagcuauuuaagugauacauaccucuag

SEQ ID NO: 603429 - RNA, 64 nt, hsa
cauuccuaaaaugcuucacuguacguaguuaagucguagcuauaacuucaaauuuuuuaaaaga

SEQ ID NO: 603430 - RNA, 64 nt, hsa
guuccccacuccguacuguauuuugccauucugccguagcuagauguucugugggguuuguuaa

SEQ ID NO: 603431 - RNA, 64 nt, hsa
gcauuuucauguuuugaaucugauuaguggaucacguagcuacuuucccugucgcguccaauuc

SEQ ID NO: 603432 - RNA, 64 nt, hsa
aauuguaugaaggccuuaaaaaagcuacauuaagcguagcuaaaauuauuuauuggacuaaaaa

SEQ ID NO: 603433 - RNA, 64 nt, hsa
ggcuucuauuugggauucacaucaguauuaguaucguagcuacaccaaguucaggcuucucuuu

SEQ ID NO: 603434 - RNA, 64 nt, hsa
acaaaaaacaacacuuugguguggugguaugguacguagcuauuuuccuaagcaugucugucaa

SEQ ID NO: 603435 - RNA, 64 nt, hsa
auuguauccacucaccauugacgauggcauugagcguagcuagcuuauuuccaucacuacgugu

SEQ ID NO: 603436 - RNA, 64 nt, hsa
uuuuaaggggucuucaaguaaguaaaacauacaucguagcuagaagaaaaauguaccuuaaauu

SEQ ID NO: 603437 - RNA, 64 nt, hsa
ucacuagaaggcugaguuugacauguugauauuacguagcuauaguuugcaguuucugggaagc

SEQ ID NO: 603438 - RNA, 64 nt, hsa
gagauagguauuuuuuguaggcuguuucacugaacucaguuaaugaaaacuguauuaacauaau

SEQ ID NO: 603439 - RNA, 64 nt, hsa
cauuccauaggaaaacacacauaugcacacaaaacucaguuaucuguggggaaagugguaguaa

SEQ ID NO: 603440 - RNA, 64 nt, hsa
aaauugguaaacuagaaguaacuuguccacaacccucaguuaugauacuuaugugcguguuuuu

SEQ ID NO: 603441 - RNA, 64 nt, hsa
acguacuugcaguuuaugaagcugccccccaccccucaguuaauugcagucuaaugucaagagg

SEQ ID NO: 603442 - RNA, 58 nt, hsa
ucgagggaccgagcugcugagggaggaccucaguuaaccaauuaccuuuucccggauu

SEQ ID NO: 603443 - RNA, 64 nt, hsa; identical to SEQ ID NO: 572336

SEQ ID NO: 603444 - RNA, 64 nt, hsa; identical to SEQ ID NO: 572337

SEQ ID NO: 603445 - RNA, 64 nt, hsa; identical to SEQ ID NO: 76900

SEQ ID NO: 603446 - RNA, 64 nt, hsa; identical to SEQ ID NO: 76901

SEQ ID NO: 603447 - RNA, 64 nt, hsa; identical to SEQ ID NO: 76902

SEQ ID NO: 603448 - RNA, 64 nt, hsa; identical to SEQ ID NO: 76903

SEQ ID NO: 603449 - RNA, 64 nt, hsa; identical to SEQ ID NO: 76904

SEQ ID NO: 603450 - RNA, 64 nt, hsa; identical to SEQ ID NO: 76905

SEQ ID NO: 603451 - RNA, 64 nt, hsa; identical to SEQ ID NO: 76906

SEQ ID NO: 603452 - RNA, 64 nt, hsa; identical to SEQ ID NO: 76907

SEQ ID NO: 603453 - RNA, 64 nt, hsa; identical to SEQ ID NO: 570140

SEQ ID NO: 603454 - RNA, 64 nt, hsa; identical to SEQ ID NO: 570141

SEQ ID NO: 603455 - RNA, 64 nt, hsa; identical to SEQ ID NO: 570142

SEQ ID NO: 603456 - RNA, 64 nt, hsa; identical to SEQ ID NO: 570143

SEQ ID NO: 603457 - RNA, 64 nt, hsa; identical to SEQ ID NO: 570144

SEQ ID NO: 603458 - RNA, 64 nt, hsa; identical to SEQ ID NO: 570145

SEQ ID NO: 603459 - RNA, 64 nt, hsa; identical to SEQ ID NO: 570146

SEQ ID NO: 603460 - RNA, 64 nt, hsa; identical to SEQ ID NO: 570147

SEQ ID NO: 603461 - RNA, 64 nt, hsa; identical to SEQ ID NO: 570148

SEQ ID NO: 603462 - RNA, 64 nt, hsa; identical to SEQ ID NO: 570149

SEQ ID NO: 603463 - RNA, 64 nt, hsa; identical to SEQ ID NO: 570150

SEQ ID NO: 603464 - RNA, 64 nt, hsa; identical to SEQ ID NO: 570151

SEQ ID NO: 603465 - RNA, 64 nt, hsa
uaggacuguguggccaaccaagugcuugugagaucacugacacugcaaaaacaaagcaaacugc

SEQ ID NO: 603466 - RNA, 64 nt, hsa
gaguucguucaguaacgcagcgggaaucaaucugcacugacaccgcggcaggaacugaagcugc

SEQ ID NO: 603467 - RNA, 64 nt, hsa
cagggaaaccuaaacugaggucagcacuugggcccacugacagugacugacugggggagaaggu

SEQ ID NO: 603468 - RNA, 64 nt, hsa
uuauagauagggaaacugaggcuuugggaggacucacugacauaccuaccuucaagaugaguuc

SEQ ID NO: 603469 - RNA, 64 nt, hsa
ccuuccucagcacagggaacccggaagcccguugcacugacagaggcucacacccucuggguuu

SEQ ID NO: 603470 - RNA, 64 nt, hsa
cugaaacacugaaucuccuuuuguaacugguguucacugacaccuugauggcucuugauggcuc

SEQ ID NO: 603471 - RNA, 64 nt, hsa
uaggaacuuaguacuuuggagcuuuugccucucacacugacaacauaacaggaugugauugccu

SEQ ID NO: 603472 - RNA, 64 nt, hsa
aggagucaguuuugucuuaaaugcugacuacagccacugacaugguuggcuggaauuucuuucu

SEQ ID NO: 603473 - RNA, 64 nt, hsa
aucagcagcuugacgcguggucacaggacgauuucacugacacugcgaacucucaggacuaccg

SEQ ID NO: 603474 - RNA, 64 nt, hsa
auguagauugccuuuggcaauucuucuucucaagcacugacacucauuaccgucugugauugcc

SEQ ID NO: 603475 - RNA, 64 nt, hsa
gccaucugccgccaaauacauccacuccccaugccacugacauccuaugggucagccaggcuug

SEQ ID NO: 603476 - RNA, 64 nt, hsa
cuauuccugcaccuaggcuaggauaacuuuagagcacugacauaaaacgcaaaaacaggaauca

SEQ ID NO: 603477 - RNA, 64 nt, hsa; identical to SEQ ID NO: 438442

SEQ ID NO: 603478 - RNA, 64 nt, hsa; identical to SEQ ID NO: 438443

SEQ ID NO: 603479 - RNA, 64 nt, hsa; identical to SEQ ID NO: 438444

SEQ ID NO: 603480 - RNA, 64 nt, hsa; identical to SEQ ID NO: 438445

SEQ ID NO: 603481 - RNA, 64 nt, hsa; identical to SEQ ID NO: 438446

SEQ ID NO: 603482 - RNA, 64 nt, hsa; identical to SEQ ID NO: 438447

SEQ ID NO: 603483 - RNA, 64 nt, hsa; identical to SEQ ID NO: 438448

SEQ ID NO: 603484 - RNA, 64 nt, hsa; identical to SEQ ID NO: 438449

SEQ ID NO: 603485 - RNA, 64 nt, hsa; identical to SEQ ID NO: 302252

SEQ ID NO: 603486 - RNA, 64 nt, hsa; identical to SEQ ID NO: 302253

SEQ ID NO: 603487 - RNA, 64 nt, hsa; identical to SEQ ID NO: 302254

SEQ ID NO: 603488 - RNA, 64 nt, hsa; identical to SEQ ID NO: 302255

SEQ ID NO: 603489 - RNA, 64 nt, hsa; identical to SEQ ID NO: 302256

SEQ ID NO: 603490 - RNA, 64 nt, hsa; identical to SEQ ID NO: 302257

SEQ ID NO: 603491 - RNA, 64 nt, hsa; identical to SEQ ID NO: 302258

SEQ ID NO: 603492 - RNA, 64 nt, hsa; identical to SEQ ID NO: 302259

SEQ ID NO: 603493 - RNA, 64 nt, hsa; identical to SEQ ID NO: 302260

SEQ ID NO: 603494 - RNA, 64 nt, hsa; identical to SEQ ID NO: 302261

SEQ ID NO: 603495 - RNA, 64 nt, hsa; identical to SEQ ID NO: 302262

SEQ ID NO: 603496 - RNA, 64 nt, hsa; identical to SEQ ID NO: 302263

SEQ ID NO: 603497 - RNA, 64 nt, hsa; identical to SEQ ID NO: 302264

SEQ ID NO: 603498 - RNA, 64 nt, hsa; identical to SEQ ID NO: 302265

SEQ ID NO: 603499 - RNA, 64 nt, hsa; identical to SEQ ID NO: 302266

SEQ ID NO: 603500 - RNA, 64 nt, hsa; identical to SEQ ID NO: 302267

SEQ ID NO: 603501 - RNA, 64 nt, hsa; identical to SEQ ID NO: 302268

SEQ ID NO: 603502 - RNA, 64 nt, hsa; identical to SEQ ID NO: 302269

SEQ ID NO: 603503 - RNA, 64 nt, hsa; identical to SEQ ID NO: 302270

SEQ ID NO: 603504 - RNA, 64 nt, hsa; identical to SEQ ID NO: 302271

SEQ ID NO: 603505 - RNA, 64 nt, hsa; identical to SEQ ID NO: 302272

SEQ ID NO: 603506 - RNA, 64 nt, hsa; identical to SEQ ID NO: 302273

SEQ ID NO: 603507 - RNA, 64 nt, hsa
uuuauaagucuuagcauuauuuccuuugugaaguacuauguaacagaugauuguuugcuagauu

SEQ ID NO: 603508 - RNA, 64 nt, hsa
guaaguccuccugauaagugcuuucuuguuuaucacuauguaaaucugaaauauuuuguacuuc

SEQ ID NO: 603509 - RNA, 64 nt, hsa
cccaccuauuuguguuguccauucacuauacguaacuauguaacucuuuggaguugcauagcag

SEQ ID NO: 603510 - RNA, 64 nt, hsa
ugaugucaaaucacauuacuggguaauuuuuaagacuauguacccacaccauacauacauacau

SEQ ID NO: 603511 - RNA, 64 nt, hsa
aaaaaaaauaggugacagggaacagguuaagaaaacuauguaaauguaggaaagaugggaggaa

SEQ ID NO: 603512 - RNA, 64 nt, hsa
caagagcacauccauaaaaugaaaaccuguuacaacuauguacagaaggguuugacguuuuauu

SEQ ID NO: 603513 - RNA, 64 nt, hsa
uaagcaucgauagguaaguugauggauaaaaguuacuauguaagccuauuuuuuugaguccuua

SEQ ID NO: 603514 - RNA, 64 nt, hsa
auaaauagcaucuuaugcuaauuagcccugcuaaacuauguacagaggaaacuguucaaguauu

SEQ ID NO: 603515 - RNA, 64 nt, hsa
uguauuaugaaaagcuaaauuauacaucauuguaacuauguagaaaguguagacuaauguauaa

SEQ ID NO: 603516 - RNA, 64 nt, hsa
acgaugagauugccuaccauuuuauaggauauuuacuauguauuuauacguuaagaccucuaug

SEQ ID NO: 603517 - RNA, 64 nt, hsa
uacuaugccgcauucauuuaaagcuauuuuguuuacuauguauaaaagucuacaaucuaauuaa

SEQ ID NO: 603518 - RNA, 64 nt, hsa
aaucucuccagcuaauucaggucauuuugugaauacuauguaucaagcccugaaaauaugguaa

SEQ ID NO: 603519 - RNA, 64 nt, hsa
uuaugcgaaccuaugucuaaauucacuguuuguuacuauguauguuuuuuuccaaugcuucuua

SEQ ID NO: 603520 - RNA, 64 nt, hsa
acauccacauaucuaacaguaucaauguuauauaacuauguaauaauuguugauuuuuaauuau

SEQ ID NO: 603521 - RNA, 64 nt, hsa
uagaaagacugaaaccaagacuauuuaacugugaacuauguagcagauguuuuaaacuuuuuau

SEQ ID NO: 603522 - RNA, 64 nt, hsa
uauauauuuuuuuccauuuaaaacuaauuuauaaacuauguacuccugggaagauuugaaaucu

SEQ ID NO: 603523 - RNA, 64 nt, hsa
uuucuuuauuuucuucagcauuuaaucacuguauacuauguaauuccugaaggggaagaacuaa

SEQ ID NO: 603524 - RNA, 64 nt, hsa
aauaaaauguuuaaaaucaaaaccaaaauuauagacuauguagaaaugaaugacagugagaugc

SEQ ID NO: 603525 - RNA, 64 nt, hsa
ucuuuagaucacuuauaccuaucacaauguaaauacuauguaaauaguuguuauacuguauuuu

SEQ ID NO: 603526 - RNA, 64 nt, hsa
ggaucccccagucccaucccgccguuuucggcugucuuccuaaccguccugucuucucuuggcg

SEQ ID NO: 603527 - RNA, 64 nt, hsa
aaugagugauacugugacaaaaccauccuugcauucuuccuagaagaguuccucugcuccuucc

SEQ ID NO: 603528 - RNA, 64 nt, hsa
acaguuaaacuaauauguuuauaagcuugaguuuucuuccuaccauaucacucucauauaucag

SEQ ID NO: 603529 - RNA, 64 nt, hsa
uuuuauucuucuuuagucucauuccucuccuucuucuuccuagcccuucuuacaaacaaguuug

SEQ ID NO: 603530 - RNA, 64 nt, hsa
ggguucagcuggucaucuugucaugugaagaccaucuuccuacagagucuaggcuggccgucgu

SEQ ID NO: 603531 - RNA, 64 nt, hsa
uguuuggugaccagagcuguauauauugauauucucuuccuauugacuugcugccucaacagau

SEQ ID NO: 603532 - RNA, 64 nt, hsa
gacuggguaauuuaaaaagaaaagaaauuuauuuucuuccuaguucuggaggcugggaaggcga

SEQ ID NO: 603533 - RNA, 64 nt, hsa
aaaggcuugaaauaccuagaugaaguuuagauuuucuuccuauuguaaacuuuugagucugguu

SEQ ID NO: 603534 - RNA, 64 nt, hsa
cacuuucauauugagaggaauaugggcuugauccucuuccuaucuaaaugggugggccauuuga

SEQ ID NO: 603535 - RNA, 64 nt, hsa
cuccuguggauuuaggaaugugugcuaauagcaaucuuccuaauuuucauguuuauauggaacu

SEQ ID NO: 603536 - RNA, 64 nt, hsa
uugaguuuaagccaaauacaugcauagaaaagggucuuccuauuaauggaagaagguaauuuuu

SEQ ID NO: 603537 - RNA, 64 nt, hsa
ugcuguuucauacagcacuuagaugaauuauugaucuuccuaauaucaggcgccuacuuaaccu

SEQ ID NO: 603538 - RNA, 64 nt, hsa
aagaagccuagauugcaggccucaccauggauggucuuccuaguugccuggggaaacccuggaa

SEQ ID NO: 603539 - RNA, 64 nt, hsa
uuguagauuuugaaaaaacagauauuuuuaugagucuuccuauucauaaaaauaguaugucucc

SEQ ID NO: 603540 - RNA, 64 nt, hsa
uggaccaucgagggcaaccuccagaguuggcugcucuuccuacuccugagucuacacccgugcu

SEQ ID NO: 603541 - RNA, 64 nt, hsa
ucuccagacagagcagcuacaccaguaauggcacucuuccuaggacgggacuaaagaggacgcc

SEQ ID NO: 603542 - RNA, 64 nt, hsa
gcaccugaaagcccucggcucgguccuuagaccaucuuccuacauuaccuggaagggagcugcc

SEQ ID NO: 603543 - RNA, 64 nt, hsa
ugcuguaauuucugacaacauccaaaaaauaaaaucuuccuaaauuauguuaagaggaaaaucu

SEQ ID NO: 603544 - RNA, 64 nt, hsa
uaauaacaaauagcauuuggcaagucuauaggauucuuccuaucuggaaauucuauuuuguuag

SEQ ID NO: 603545 - RNA, 64 nt, hsa
ugugacaccgaccgaagccuuuguucuggaucuuucuuccuauugaagguggcugcugguggcu

SEQ ID NO: 603546 - RNA, 64 nt, hsa
acuuagcagcucacagagcacagagauccugccuucuuccuacuaucaggcugaccuaaugggg

SEQ ID NO: 603547 - RNA, 64 nt, hsa
ccuagagcguaaguauggauguuguggcccugugucuuccuagugugacccagccaggagcgga

SEQ ID NO: 603548 - RNA, 64 nt, hsa; identical to SEQ ID NO: 115857

SEQ ID NO: 603549 - RNA, 64 nt, hsa; identical to SEQ ID NO: 115858

SEQ ID NO: 603550 - RNA, 64 nt, hsa; identical to SEQ ID NO: 115859

SEQ ID NO: 603551 - RNA, 64 nt, hsa; identical to SEQ ID NO: 115860

SEQ ID NO: 603552 - RNA, 64 nt, hsa; identical to SEQ ID NO: 58780

SEQ ID NO: 603553 - RNA, 64 nt, hsa; identical to SEQ ID NO: 58781

SEQ ID NO: 603554 - RNA, 64 nt, hsa; identical to SEQ ID NO: 58782

SEQ ID NO: 603555 - RNA, 54 nt, hsa; identical to SEQ ID NO: 58783

SEQ ID NO: 603556 - RNA, 64 nt, hsa; identical to SEQ ID NO: 58784

SEQ ID NO: 603557 - RNA, 64 nt, hsa; identical to SEQ ID NO: 58785

SEQ ID NO: 603558 - RNA, 64 nt, hsa; identical to SEQ ID NO: 58786

SEQ ID NO: 603559 - RNA, 64 nt, hsa; identical to SEQ ID NO: 58787

SEQ ID NO: 603560 - RNA, 64 nt, hsa; identical to SEQ ID NO: 58788

SEQ ID NO: 603561 - RNA, 64 nt, hsa; identical to SEQ ID NO: 58788

SEQ ID NO: 603562 - RNA, 64 nt, hsa; identical to SEQ ID NO: 58790

SEQ ID NO: 603563 - RNA, 64 nt, hsa; identical to SEQ ID NO: 58791

SEQ ID NO: 603564 - RNA, 64 nt, hsa; identical to SEQ ID NO: 58792

SEQ ID NO: 603565 - RNA, 64 nt, hsa; identical to SEQ ID NO: 58793

SEQ ID NO: 603566 - RNA, 64 nt, hsa; identical to SEQ ID NO: 58794

SEQ ID NO: 603567 - RNA, 64 nt, hsa; identical to SEQ ID NO: 58795

SEQ ID NO: 603568 - RNA, 64 nt, hsa; identical to SEQ ID NO: 58796

SEQ ID NO: 603569 - RNA, 64 nt, hsa; identical to SEQ ID NO: 496488

SEQ ID NO: 603570 - RNA, 64 nt, hsa; identical to SEQ ID NO: 496489

SEQ ID NO: 603571 - RNA, 64 nt, hsa; identical to SEQ ID NO: 496490

SEQ ID NO: 603572 - RNA, 64 nt, hsa; identical to SEQ ID NO: 496491

SEQ ID NO: 603573 - RNA, 64 nt, hsa; identical to SEQ ID NO: 496492

SEQ ID NO: 603574 - RNA, 64 nt, hsa; identical to SEQ ID NO: 496493

SEQ ID NO: 603575 - RNA, 64 nt, hsa; identical to SEQ ID NO: 496494

SEQ ID NO: 603576 - RNA, 64 nt, hsa; identical to SEQ ID NO: 496495

SEQ ID NO: 603577 - RNA, 64 nt, hsa
cccuccaaacuguuccagccucugccuguuacccaguuccaaagucacuuccacauuuugggua

SEQ ID NO: 603578 - RNA, 64 nt, hsa
auuuggggcaaagccauucaacaagucuguaggaaguuccaaacuuucccacauuuuccuguuu

SEQ ID NO: 603579 - RNA, 64 nt, hsa
uauagcuagugucugaacgacacuccuuaaaguaaguuccaaauguaaaacacuccuuaaguuc

SEQ ID NO: 603580 - RNA, 64 nt, hsa
cuuaaaguaaguuccaaauguaaaacacuccuuaaguuccaaauguuuuccgcuaauagucugu

SEQ ID NO: 603581 - RNA, 64 nt, hsa
auuuugggcaaagccauucagcaaguaucuaggaaguuccaaacuuucccacauuuuccugucu

SEQ ID NO: 603582 - RNA, 64 nt, hsa
cccuucaaacuguuccaaccucugccuguuacccaguuccaaacuugcuuucauauuuuuggcu

SEQ ID NO: 603583 - RNA, 64 nt, hsa
ggugaaguuuuaaaaaaaaaguuguggaaaggaaaguuccaaagaggugguuucugaggaaguc

SEQ ID NO: 603584 - RNA, 64 nt, hsa
uuguugaaaucuuuuuuccuucuuccucuugaaaaguuccaaaauauaguuuauuguaucuuuc

SEQ ID NO: 603585 - RNA, 64 nt, hsa
gaagugaucaaaugccagugucauuuuguacuuaaguuccaaaguaggaacauuuuauacuuuu

SEQ ID NO: 603586 - RNA, 64 nt, hsa
gaggcacagcacaugagcccuggacaggucccaaaguuccaagcaguccuuuccgugaaagcag

SEQ ID NO: 603587 - RNA, 64 nt, hsa
ccuuuuguguagagcuuuuaauaucauuugaggaaguuccaaauuuguagccaguuccaaacaa

SEQ ID NO: 603588 - RNA, 64 nt, hsa
uaauaucauuugaggaaguuccaaauuuguagccaguuccaaacaaauuuaaauauugaguuga

SEQ ID NO: 603589 - RNA, 64 nt, hsa
ugcaccacugcucucuagccugggcaaaaaaacuaguuccaaaaaagacacuuguacacgcaug

SEQ ID NO: 603590 - RNA, 64 nt, hsa
uaaaauauaaaaagaaagagaaagaaaagaaaauaguuccaauuuaucaugccaaauuguuuga

SEQ ID NO: 603591 - RNA, 64 nt, hsa
auuaaaaaaaaaaaccuuucagggucuuucaugaaguuccaauaguugagugaguuaaaagguu

SEQ ID NO: 603592 - RNA, 64 nt, hsa
guccaaaauuucauucaaauaucaucgguucaaaaguuccaaagcuuaucauuuagaucaucua

SEQ ID NO: 603593 - RNA, 64 nt, hsa
cuccauggaaacagccccuagaaucugaaaggccgggauaaaccuaaucacuguucccaaacau

SEQ ID NO: 603594 - RNA, 64 nt, hsa
uuuccucccuucucuagcccuggauguccacuuagggauaaaaagaauaugguuuugguuccca

SEQ ID NO: 603595 - RNA, 64 nt, hsa
gguuagugcaucuuucaggggucacucugccauggggauaaaauagcuguuucacaaacaguuu

SEQ ID NO: 603596 - RNA, 64 nt, hsa
augauggggaaaggguggggggaauuaaaagggagggauaaauauauauauauaaaucuauuuu

SEQ ID NO: 603597 - RNA, 64 nt, hsa
ugggcgcgcugggagugugguuguguuucugaaggggauaaaagagggcacgguggugccaaga

SEQ ID NO: 603598 - RNA, 64 nt, hsa
cuaacuucugauuuagauacuucucccugagguggggauaaaagaaaaaaaaaaacaacuucuu

SEQ ID NO: 603599 - RNA, 64 nt, hsa; identical to SEQ ID NO: 210736

SEQ ID NO: 603600 - RNA, 64 nt, hsa; identical to SEQ ID NO: 210737

SEQ ID NO: 603601 - RNA, 64 nt, hsa; identical to SEQ ID NO: 210738

SEQ ID NO: 603602 - RNA, 64 nt, hsa; identical to SEQ ID NO: 210739

SEQ ID NO: 603603 - RNA, 64 nt, hsa; identical to SEQ ID NO: 210740

SEQ ID NO: 603604 - RNA, 64 nt, hsa; identical to SEQ ID NO: 210741

SEQ ID NO: 603605 - RNA, 64 nt, hsa; identical to SEQ ID NO: 210742

SEQ ID NO: 603606 - RNA, 64 nt, hsa; identical to SEQ ID NO: 210743

SEQ ID NO: 603607 - RNA, 64 nt, hsa; identical to SEQ ID NO: 210744

SEQ ID NO: 603608 - RNA, 64 nt, hsa; identical to SEQ ID NO: 210745

SEQ ID NO: 603609 - RNA, 64 nt, hsa; identical to SEQ ID NO: 210746

SEQ ID NO: 603610 - RNA, 64 nt, hsa; identical to SEQ ID NO: 210747

SEQ ID NO: 603611 - RNA, 64 nt, hsa; identical to SEQ ID NO: 210748

SEQ ID NO: 603612 - RNA, 64 nt, hsa; identical to SEQ ID NO: 210749

SEQ ID NO: 603613 - RNA, 64 nt, hsa; identical to SEQ ID NO: 210750

SEQ ID NO: 603614 - RNA, 64 nt, hsa; identical to SEQ ID NO: 210751

SEQ ID NO: 603615 - RNA, 64 nt, hsa; identical to SEQ ID NO: 210752

SEQ ID NO: 603616 - RNA, 64 nt, hsa; identical to SEQ ID NO: 210753

SEQ ID NO: 603617 - RNA, 64 nt, hsa; identical to SEQ ID NO: 210754

SEQ ID NO: 603618 - RNA, 64 nt, hsa; identical to SEQ ID NO: 210755

SEQ ID NO: 603619 - RNA, 64 nt, hsa; identical to SEQ ID NO: 210756

SEQ ID NO: 603620 - RNA, 64 nt, hsa; identical to SEQ ID NO: 210757

SEQ ID NO: 603621 - RNA, 64 nt, hsa; identical to SEQ ID NO: 210758

SEQ ID NO: 603622 - RNA, 64 nt, hsa; identical to SEQ ID NO: 210759

SEQ ID NO: 603623 - RNA, 64 nt, hsa; identical to SEQ ID NO: 210760

SEQ ID NO: 603624 - RNA, 64 nt, hsa; identical to SEQ ID NO: 210761

SEQ ID NO: 603625 - RNA, 64 nt, hsa; identical to SEQ ID NO: 210762

SEQ ID NO: 603626 - RNA, 64 nt, hsa; identical to SEQ ID NO: 210763

SEQ ID NO: 603627 - RNA, 64 nt, hsa; identical to SEQ ID NO: 210764

SEQ ID NO: 603628 - RNA, 64 nt, hsa; identical to SEQ ID NO: 210765

SEQ ID NO: 603629 - RNA, 64 nt, hsa; identical to SEQ ID NO: 210766

SEQ ID NO: 603630 - RNA, 64 nt, hsa; identical to SEQ ID NO: 210767

SEQ ID NO: 603631 - RNA, 64 nt, hsa; identical to SEQ ID NO: 210728

SEQ ID NO: 603632 - RNA, 64 nt, hsa; identical to SEQ ID NO: 210729

SEQ ID NO: 603633 - RNA, 64 nt, hsa; identical to SEQ ID NO: 210730

SEQ ID NO: 603634 - RNA, 64 nt, hsa; identical to SEQ ID NO: 210731

SEQ ID NO: 603635 - RNA, 64 nt, hsa; identical to SEQ ID NO: 210732

SEQ ID NO: 603636 - RNA, 64 nt, hsa; identical to SEQ ID NO: 210733

SEQ ID NO: 603637 - RNA, 64 nt, hsa; identical to SEQ ID NO: 210734

SEQ ID NO: 603638 - RNA, 64 nt, hsa; identical to SEQ ID NO: 210735

SEQ ID NO: 603639 - RNA, 60 nt, hsa
aaaauaauaaaaggcagcuaauggaaaggagagacaaaagcaugguuaauauauauacuu

SEQ ID NO: 603640 - RNA, 60 nt, hsa
ucagugcuauccaguuauaaauggaaucuugagacaaaaccuuaacaaagaaauaacagu

SEQ ID NO: 603641 - RNA, 60 nt, hsa
uguauauaagagcacguuguaaacuugaaagagacaaaggcacaaauguggcuguugauu

SEQ ID NO: 603642 - RNA, 60 nt, hsa
gacuaggacuccagugcccuccucucccaagagacaaaggccauugcauugaaggaggug

SEQ ID NO: 603643 - RNA, 60 nt, hsa
gacucuuuaaaaaaagaaauuaaaagaguugagacaaacguuuccuacauucuuuuccau

SEQ ID NO: 603644 - RNA, 60 nt, hsa
accguuccgacagggaccagugaaagaaaagagacaaaguuagaacgugcuggggagcgg

SEQ ID NO: 603645 - RNA, 64 nt, hsa
cuaauuuuguauuuuuggucgagacgggguuuugccauguuagucaggcuggucuugaacuccu

SEQ ID NO: 603646 - RNA, 64 nt, hsa
aucauucucugcuucccugggaggaauuuuuucaccauguuauugaaggggaugguucauuaag

SEQ ID NO: 603647 - RNA, 64 nt, hsa
cuuucuguaacagccucaaauaaagguguaccuuccauguuauauuauuuuuguuuuuauaaga

SEQ ID NO: 603648 - RNA, 64 nt, hsa
guuuuaaugaaagcaugcaacagggaucucacacccauguuacuugccauuuaguuauuauacc

SEQ ID NO: 603649 - RNA, 64 nt, hsa
gcagaccuaacaaauauuugaggucagaacccuaccauguuaaaacaaacaaaaacuuaccaug

SEQ ID NO: 603650 - RNA, 64 nt, hsa
agaacccuaccauguuaaaacaaacaaaaacuuaccauguuaauaaaaguauucauuugcuuga

SEQ ID NO: 603651 - RNA, 64 nt, hsa
aauguucuguauuuuuaauagggacgggguuuugccauguuagcuaggcuggucucaaacucac

SEQ ID NO: 603652 - RNA, 64 nt, hsa
uaauuuuuguauuuuuaguagagaugggguuucgccauguuagccagacuggucucgaacuccu

SEQ ID NO: 603653 - RNA, 63 nt, hsa; identical to SEQ ID NO: 266651

SEQ ID NO: 603654 - RNA, 63 nt, hsa; identical to SEQ ID NO: 266652

SEQ ID NO: 603655 - RNA, 63 nt, hsa; identical to SEQ ID NO: 266653

SEQ ID NO: 603656 - RNA, 63 nt, hsa; identical to SEQ ID NO: 266654

SEQ ID NO: 603657 - RNA, 63 nt, hsa; identical to SEQ ID NO: 266655

SEQ ID NO: 603658 - RNA, 63 nt, hsa; identical to SEQ ID NO: 266656

SEQ ID NO: 603659 - RNA, 63 nt, hsa; identical to SEQ ID NO: 266657

SEQ ID NO: 603660 - RNA, 63 nt, hsa; identical to SEQ ID NO: 266658

SEQ ID NO: 603661 - RNA, 63 nt, hsa; identical to SEQ ID NO: 266659

SEQ ID NO: 603662 - RNA, 63 nt, hsa; identical to SEQ ID NO: 266660

SEQ ID NO: 603663 - RNA, 63 nt, hsa; identical to SEQ ID NO: 266661

SEQ ID NO: 603664 - RNA, 63 nt, hsa; identical to SEQ ID NO: 266662

SEQ ID NO: 603665 - RNA, 63 nt, hsa; identical to SEQ ID NO: 266663

SEQ ID NO: 603666 - RNA, 60 nt, hsa; identical to SEQ ID NO: 266664

SEQ ID NO: 603667 - RNA, 63 nt, hsa; identical to SEQ ID NO: 266665

SEQ ID NO: 603668 - RNA, 63 nt, hsa; identical to SEQ ID NO: 266666

SEQ ID NO: 603669 - RNA, 63 nt, hsa; identical to SEQ ID NO: 266667

SEQ ID NO: 603670 - RNA, 63 nt, hsa; identical to SEQ ID NO: 266668

SEQ ID NO: 603671 - RNA, 63 nt, hsa; identical to SEQ ID NO: 266669

SEQ ID NO: 603672 - RNA, 63 nt, hsa; identical to SEQ ID NO: 266670

SEQ ID NO: 603673 - RNA, 63 nt, hsa; identical to SEQ ID NO: 266671

SEQ ID NO: 603674 - RNA, 63 nt, hsa; identical to SEQ ID NO: 266672

SEQ ID NO: 603675 - RNA, 63 nt, hsa; identical to SEQ ID NO: 266673

SEQ ID NO: 603676 - RNA, 63 nt, hsa; identical to SEQ ID NO: 266674

SEQ ID NO: 603677 - RNA, 63 nt, hsa; identical to SEQ ID NO: 266675

SEQ ID NO: 603678 - RNA, 63 nt, hsa; identical to SEQ ID NO: 266676

SEQ ID NO: 603679 - RNA, 63 nt, hsa; identical to SEQ ID NO: 266677

SEQ ID NO: 603680 - RNA, 63 nt, hsa; identical to SEQ ID NO: 266678

SEQ ID NO: 603681 - RNA, 63 nt, hsa; identical to SEQ ID NO: 266679

SEQ ID NO: 603682 - RNA, 63 nt, hsa; identical to SEQ ID NO: 266680

SEQ ID NO: 603683 - RNA, 63 nt, hsa; identical to SEQ ID NO: 266681

SEQ ID NO: 603684 - RNA, 63 nt, hsa; identical to SEQ ID NO: 266682

SEQ ID NO: 603685 - RNA, 63 nt, hsa; identical to SEQ ID NO: 266683

SEQ ID NO: 603686 - RNA, 63 nt, hsa; identical to SEQ ID NO: 266684

SEQ ID NO: 603687 - RNA, 63 nt, hsa; identical to SEQ ID NO: 266685

SEQ ID NO: 603688 - RNA, 63 nt, hsa; identical to SEQ ID NO: 266686

SEQ ID NO: 603689 - RNA, 63 nt, hsa; identical to SEQ ID NO: 266687

SEQ ID NO: 603690 - RNA, 63 nt, hsa; identical to SEQ ID NO: 266688

SEQ ID NO: 603691 - RNA, 63 nt, hsa; identical to SEQ ID NO: 266689

SEQ ID NO: 603692 - RNA, 63 nt, hsa; identical to SEQ ID NO: 266690

SEQ ID NO: 603693 - RNA, 63 nt, hsa; identical to SEQ ID NO: 266691

SEQ ID NO: 603694 - RNA, 63 nt, hsa; identical to SEQ ID NO: 266692

SEQ ID NO: 603695 - RNA, 63 nt, hsa; identical to SEQ ID NO: 266693

SEQ ID NO: 603696 - RNA, 64 nt, hsa; identical to SEQ ID NO: 293103

SEQ ID NO: 603697 - RNA, 64 nt, hsa; identical to SEQ ID NO: 293104

SEQ ID NO: 603698 - RNA, 64 nt, hsa; identical to SEQ ID NO: 293105

SEQ ID NO: 603699 - RNA, 64 nt, hsa; identical to SEQ ID NO: 293106

SEQ ID NO: 603700 - RNA, 64 nt, hsa; identical to SEQ ID NO: 293107

SEQ ID NO: 603701 - RNA, 64 nt, hsa; identical to SEQ ID NO: 293108

SEQ ID NO: 603702 - RNA, 64 nt, hsa; identical to SEQ ID NO: 293109

SEQ ID NO: 603703 - RNA, 64 nt, hsa; identical to SEQ ID NO: 293110

SEQ ID NO: 603704 - RNA, 64 nt, hsa; identical to SEQ ID NO: 293111

SEQ ID NO: 603705 - RNA, 64 nt, hsa; identical to SEQ ID NO: 293112

SEQ ID NO: 603706 - RNA, 64 nt, hsa; identical to SEQ ID NO: 293113

SEQ ID NO: 603707 - RNA, 64 nt, hsa; identical to SEQ ID NO: 293114

SEQ ID NO: 603708 - RNA, 64 nt, hsa; identical to SEQ ID NO: 293115

SEQ ID NO: 603709 - RNA, 64 nt, hsa; identical to SEQ ID NO: 293116

SEQ ID NO: 603710 - RNA, 64 nt, hsa; identical to SEQ ID NO: 293117

SEQ ID NO: 603711 - RNA, 64 nt, hsa; identical to SEQ ID NO: 293118

SEQ ID NO: 603712 - RNA, 64 nt, hsa; identical to SEQ ID NO: 293119

SEQ ID NO: 603713 - RNA, 64 nt, hsa; identical to SEQ ID NO: 293120

SEQ ID NO: 603714 - RNA, 64 nt, hsa; identical to SEQ ID NO: 293121

SEQ ID NO: 603715 - RNA, 64 nt, hsa; identical to SEQ ID NO: 293122

SEQ ID NO: 603716 - RNA, 64 nt, hsa; identical to SEQ ID NO: 293123

SEQ ID NO: 603717 - RNA, 64 nt, hsa; identical to SEQ ID NO: 293124

SEQ ID NO: 603718 - RNA, 64 nt, hsa; identical to SEQ ID NO: 293125

SEQ ID NO: 603719 - RNA, 64 nt, hsa; identical to SEQ ID NO: 293126

SEQ ID NO: 603720 - RNA, 64 nt, hsa; identical to SEQ ID NO: 293127

SEQ ID NO: 603721 - RNA, 64 nt, hsa; identical to SEQ ID NO: 293128

SEQ ID NO: 603722 - RNA, 64 nt, hsa; identical to SEQ ID NO: 293129

SEQ ID NO: 603723 - RNA, 64 nt, hsa; identical to SEQ ID NO: 293130

SEQ ID NO: 603724 - RNA, 64 nt, hsa; identical to SEQ ID NO: 293131

SEQ ID NO: 603725 - RNA, 64 nt, hsa; identical to SEQ ID NO: 293132

SEQ ID NO: 603726 - RNA, 64 nt, hsa; identical to SEQ ID NO: 293133

SEQ ID NO: 603727 - RNA, 64 nt, hsa; identical to SEQ ID NO: 293134

SEQ ID NO: 603728 - RNA, 64 nt, hsa; identical to SEQ ID NO: 293135

SEQ ID NO: 603729 - RNA, 64 nt, hsa; identical to SEQ ID NO: 293136

SEQ ID NO: 603730 - RNA, 64 nt, hsa; identical to SEQ ID NO: 293137

SEQ ID NO: 603731 - RNA, 64 nt, hsa; identical to SEQ ID NO: 293138

SEQ ID NO: 603732 - RNA, 64 nt, hsa; identical to SEQ ID NO: 293139

SEQ ID NO: 603733 - RNA, 64 nt, hsa; identical to SEQ ID NO: 293140

SEQ ID NO: 603734 - RNA, 64 nt, hsa; identical to SEQ ID NO: 293141

SEQ ID NO: 603735 - RNA, 64 nt, hsa; identical to SEQ ID NO: 293142

SEQ ID NO: 603736 - RNA, 64 nt, hsa
cugcccuccucucaggugcuggaggagcugaaggcuucgccacaggaccuggaguuaucagggg

SEQ ID NO: 603737 - RNA, 64 nt, hsa
cccuccacggcccaggucuccucacucaaagucccuucgccaaccuuucaaugcccagcccuga

SEQ ID NO: 603738 - RNA, 64 nt, hsa
cucugcugaguugugagggcccagaucacagaucccaugugagaaagagagaguuucagcguca

SEQ ID NO: 603739 - RNA, 64 nt, hsa
cucugucccaggaucuccacagaccucggccucuccaugugagggggacacaguggugcucugc

SEQ ID NO: 603740 - RNA, 64 nt, hsa
uccucucagggaccaggggccuccugcuuuucagaggcccgagugcauuuaucccaaaacgagg

SEQ ID NO: 603741 - RNA, 64 nt, hsa
agggagcuguacggaggcuggaagcugcaggguuaggcccgagagagcuuuugacaagccuggc

SEQ ID NO: 603742 - RNA, 64 nt, hsa
gaacauggcuaacaaucuucaaauacccaaauugugauagcauaaauaaaguauuuauuuuaug

SEQ ID NO: 603743 - RNA, 64 nt, hsa
uuccuuucuuaaaccuaccagcaaacuaggauugugauagcaaugaaugguaugaugaagaaag

SEQ ID NO: 603744 - RNA, 64 nt, hsa
gauugagguuaacaucauccaugauaagcccuuuugauagcauguauccuugauagcaucacau

SEQ ID NO: 603745 - RNA, 64 nt, hsa
auccaugauaagcccuuuugauagcauguauccuugauagcaucacaucauacagaaugugaua

SEQ ID NO: 603746 - RNA, 64 nt, hsa; identical to SEQ ID NO: 452530

SEQ ID NO: 603747 - RNA, 64 nt, hsa; identical to SEQ ID NO: 452531

SEQ ID NO: 603748 - RNA, 64 nt, hsa; identical to SEQ ID NO: 452532

SEQ ID NO: 603749 - RNA, 64 nt, hsa; identical to SEQ ID NO: 452533

SEQ ID NO: 603750 - RNA, 64 nt, hsa
ucacacauagguuuguucuuacuauagaucuuaccaaucucagcauacuuuuauuucucuugag

SEQ ID NO: 603751 - RNA, 64 nt, hsa
auauacuaugcaugaauuucuuuuuccuucuuuacaaucucacacauagguuuguucuuacuau

SEQ ID NO: 603752 - RNA, 64 nt, hsa
uuaaacauguaaauuaauuguuugucugauuagccaaucucaccacccaaauggggagguauac

SEQ ID NO: 603753 - RNA, 64 nt, hsa
aauacugugccagaaucccaaauuauaaaugugacaaucucauuggaacaugucacaaaaaguu

SEQ ID NO: 603754 - RNA, 64 nt, hsa
aaacuuauuuaaaugggagagagaaggggagaaccaaucucaacuucuaccuuguguaagcugc

SEQ ID NO: 603755 - RNA, 64 nt, hsa
ucacucuuguuguccagucuggagugcaauggcacaaucucagcucacagcaaccucugccucc

SEQ ID NO: 603756 - RNA, 64 nt, hsa
cagagaucacaccacugcacuccagccuggguggcagagcaacacuuugucucagaaaaaaaaa

SEQ ID NO: 603757 - RNA, 64 nt, hsa
cugagaucgugcuauugcacuccagccugggcgacagagcaagacgccaucucaaaaacaaaaa

SEQ ID NO: 603758 - RNA, 64 nt, hsa
gcugaaguauacauaugcuauuucucuuaaaccucagagcaaccauaugagcauuguaauuaau

SEQ ID NO: 603759 - RNA, 64 nt, hsa
cugagaucgcgccacugcacugcagccuaggcgacagagcaagacugccucaaaaaaaaaacau

SEQ ID NO: 603760 - RNA, 64 nt, hsa
ccaagaucacaucacugcacuucaaccugggugacagagcaagacccugucucaaaaacaaaaa

SEQ ID NO: 603761 - RNA, 64 nt, hsa
ccgagaucgugccacugcacuccagccugagcaacagagcaagacucuaucucaaaaauaaaau

SEQ ID NO: 603762 - RNA, 64 nt, hsa
auguuaugcagagacacucugccucugguggcugcagagcaauacccaagccucauuuggaagg

SEQ ID NO: 603763 - RNA, 64 nt, hsa
uucacuguuagaaagaaacuaacaaaagagaacccagagcaaucuagaaucuuugagugcuugg

SEQ ID NO: 603764 - RNA, 64 nt, hsa
uucacucacaggguacgcucauggagagagggcgcagagcaaaccaugucacgccauccaauga

SEQ ID NO: 603765 - RNA, 64 nt, hsa
uuuaaauuccccuaaauagcgccccauuugggaacagagcaagaguguugaacugaagaccaaa

SEQ ID NO: 603766 - RNA, 64 nt, hsa
ccaggaucacaccauugcuguccagccugggugacagagcaagacugcguuucaaaaaaaaaaa

SEQ ID NO: 603767 - RNA, 64 nt, hsa
ccgaaauggcgccacuguacuccaaccugggcgacagagcaagacuccaucucauaaauuaaaa

SEQ ID NO: 603768 - RNA, 64 nt, hsa
cugagauccugccacugcacuccagucugggugacagagcaagacuccaucucaaaaaauaaau

SEQ ID NO: 603769 - RNA, 64 nt, hsa
cugagauuaagccaccgcacuccagccugggcgacagagcaagauuccguucccaagaaaaaaa

SEQ ID NO: 603770 - RNA, 64 nt, hsa
ggaaacagacuucgcauuucaaucagagaggccacagagcaaggucuaaacuucuggcuucuag

SEQ ID NO: 603771 - RNA, 64 nt, hsa
gagcugagauugcaccacugcaccagccuggcaacagagcaagacuccgucucacaaaaaugaa

SEQ ID NO: 603772 - RNA, 64 nt, hsa
caggaauugugccacugcacuccaaccugagugacagagcaacacucugucuuaaaagaaaaaa

SEQ ID NO: 603773 - RNA, 64 nt, hsa
gaggauugcuugagcccaggaguucgagaccagccagagcaacauagugagaccacaucucuac

SEQ ID NO: 603774 - RNA, 64 nt, hsa
ccaugauugcaccacugcaccccagccugggugacagagcaagacccugucucaaaaaaaauaa

SEQ ID NO: 603775 - RNA, 64 nt, hsa
uaagauguagacuuggaacaaagcuguugggacccagagcaaugaauuuuugaacugaagcuac

SEQ ID NO: 603776 - RNA, 64 nt, hsa
cagguuauucuuagagacuacacauuuggaauagcagagcaaaauauggauaaugaaaguguug

SEQ ID NO: 603777 - RNA, 64 nt, hsa
caggaucaaggguacaguaacacgaaugagcauacagagcaacaccuguugagccagggaguag

SEQ ID NO: 603778 - RNA, 64 nt, hsa
ccugcuguuugcuuucugaaagaauuucagaaaucagagcaaaugugucuuuaggcagauucag

SEQ ID NO: 603779 - RNA, 64 nt, hsa
gcuguuuucugaaggugagaagccauuuuuagcucagagcaacccuuaagagaacuuuuggcag

SEQ ID NO: 603780 - RNA, 64 nt, hsa
cauccuguaugcauuaacguacuuuccccugaaacagagcaacccagucaacaccacagaaccu

SEQ ID NO: 603781 - RNA, 64 nt, hsa
cugagaucacgccauugcacuccagccugggcgacagagcaagacucugucucaagaagaaaaa

SEQ ID NO: 603782 - RNA, 64 nt, hsa
uugagaucgcgccacugcacuccagccuggguaacagagcaagagucugucaaaaaaaaaaaaa

SEQ ID NO: 603783 - RNA, 64 nt, hsa
gaagccaaacagauccagaaugugugaaauucuacagagcaaauuaccugauuucuucaacuaa

SEQ ID NO: 603784 - RNA, 64 nt, hsa
ccaagauuguaccacuguauuccagcccgggugacagagcaagacugugucucaaaaaaaaaaa

SEQ ID NO: 603785 - RNA, 64 nt, hsa
ccaagauggcaccauugcacccuagccugggcaacagagcaagacaccgucuuaaaaccaaaag

SEQ ID NO: 603786 - RNA, 64 nt, hsa
auguuugagauucuuuuuuaguacuaagcaaaauucucaucacagaauguagcccaggccaauu

SEQ ID NO: 603787 - RNA, 64 nt, hsa
auuuguguaggaaguauauacauuucccuauuacucucaucagcugaagaauauguacuauugu

SEQ ID NO: 603788 - RNA, 64 nt, hsa
uaucaaauuauaguaacugagccugugugaaguaucucaucauuuucgaaaggaacaccuugug

SEQ ID NO: 603789 - RNA, 64 nt, hsa
agugacagauguguuugcaaggcugggauggcucucucaucauacucuuguuucuuagaaauaa

SEQ ID NO: 603790 - RNA, 64 nt, hsa
uuuuguuuuguuuuguucagauuaacugcuuauagccuuagaaagccuuuuacaaaauuaaaaa

SEQ ID NO: 603791 - RNA, 64 nt, hsa
uugauuuuacugauuguacuguacaucuauuaaagccuuagauuauuacauuacggguuggaac

SEQ ID NO: 603792 - RNA, 64 nt, hsa
ucucucauugacucacaggggucugcugcgaguugccuuagagcgcaagggccaggcccuggag

SEQ ID NO: 603793 - RNA, 64 nt, hsa
ugggcugugaccccaugaaacacugcaaauagaagccuuagaugcuauaguuccuucugcugcu

SEQ ID NO: 603794 - RNA, 64 nt, hsa
ggcuuaaaacuugagaauauauauuuggaauacagccuuagaacgguuucuguacacacccacg

SEQ ID NO: 603795 - RNA, 64 nt, hsa
cuuuccagccagugucucugacgucgggguuagugccuuagaggguacuggggucuggucuucc

SEQ ID NO: 603796 - RNA, 64 nt, hsa
ccuuucuagccuuagacaaaugaucaccauguuagccuuagacgaagaagcuggcuaguccuuu

SEQ ID NO: 603797 - RNA, 64 nt, hsa
ucuccucaguuuacaucuuguugguaccuuucuagccuuagacaaaugaucaccauguuagccu

SEQ ID NO: 603798 - RNA, 64 nt, hsa
uuuuuuaacaccaagauccuaaguaauuccaaaugccuuagauaucaaugaaagcuacacacca

SEQ ID NO: 603799 - RNA, 64 nt, hsa
caucagagugaaaugaaggcuauuugccaucccugccuuagacagaggagugaaagaauuaagu

SEQ ID NO: 603800 - RNA, 64 nt, hsa
auugccaaucaggacaaggccuugaaggaacgcagccuuagacaucaggugaggaugauggagg

SEQ ID NO: 603801 - RNA, 64 nt, hsa
ucuacccagacaggcccugcuuuucuaggauguggccuuagagcaagaacagacccaacagcca

SEQ ID NO: 603802 - RNA, 64 nt, hsa
cgcccacgugcuagcuccgugggcccaccgugcggccuuagagguuucccuccuuccuuuccac

SEQ ID NO: 603803 - RNA, 64 nt, hsa
guagcauuucccugcagaugguacagauguuccugccuuagagucaucucuaguuccccaccuc

SEQ ID NO: 603804 - RNA, 64 nt, hsa
uucuugugaccggggcaggaugugucuucugcuggaccggcaccuuuuguuugucccauuggug

SEQ ID NO: 603805 - RNA, 64 nt, hsa
gagagggcaggacaagccuugucccgaugccuuugaccggcagcucuguguauugguggauaga

SEQ ID NO: 603806 - RNA, 64 nt, hsa
gccugccgcuggggccgccgcacccugcaccuuggaccggcauccguagccauggacagagguc

SEQ ID NO: 603807 - RNA, 64 nt, hsa
ugugcugagagaccaugugcccgagcaucugguugaccggcaugaaguacaucagccugucuua

SEQ ID NO: 603808 - RNA, 64 nt, hsa
gggguguugaccucgccucaccuuucacagaccagaccggcacaggcuuugagcucauuauaac

SEQ ID NO: 603809 - RNA, 64 nt, hsa
aguuuccuacaccuggagguugcauggacuguacgaccggcaugacuuuauauuguauacagau

SEQ ID NO: 603810 - RNA, 64 nt, hsa
cugugaugcccgcaauucucaaaggaggacuaaggaccggcacuguggagcacccuggcuuugc

SEQ ID NO: 603811 - RNA, 58 nt, hsa
cguaccaguauguggucugaaggaccccgaccggcauggccacucagacacaagucca

SEQ ID NO: 603812 - RNA, 64 nt, hsa
cagugccaagcaugcgauauucagagucuccccagaccggcagucaucauggcaguuucagcgu

SEQ ID NO: 603813 - RNA, 64 nt, hsa
ggcaggcgggauguguuggccacagggagaggcggaccggcacccggugggaccuccuaggacu

SEQ ID NO: 603814 - RNA, 61 nt, hsa
cgggagaagaacuguccuaagggccuguagugaccggcagggcuggggugagaccccuccc

SEQ ID NO: 603815 - RNA, 64 nt, hsa
agaggcuccuggauuauagccugcacaaggagaggaccggcagcaaucgauuugccaagguugg

SEQ ID NO: 603816 - RNA, 64 nt, hsa
gggccugagugaccuccuucugcaaaguggcagggaccggcagagcucuacaggccugcagccc

SEQ ID NO: 603817 - RNA, 64 nt, hsa
uccccgcagcagcgccuccucccggcgcccgagagaccggcacgccacggccccucccccaagg

SEQ ID NO: 603818 - RNA, 64 nt, hsa
cuugucuguccacggggguggcuuuugcaaagaugaccggcauagggcaugccagcuccuugag

SEQ ID NO: 603819 - RNA, 64 nt, hsa
ucgggccgcugcccccaugcucgcgcugggcagggaccggcagcccuggaaggggcacuugaua

SEQ ID NO: 603820 - RNA, 64 nt, hsa
cuuucccaugguccucacuggccucagucucccugaccggcagugugaggggauguagcuauag

SEQ ID NO: 603821 - RNA, 64 nt, hsa
cuuguguuguucccugcuguccuccguauuacgugaccggcaaauaaaucucauagcaguuaau

SEQ ID NO: 603822 - RNA, 64 nt, hsa
cgucagcagggacuucguggccagcggggcggaggaccggcacggcuacaucugggaccgccac

SEQ ID NO: 603823 - RNA, 64 nt, hsa
uaauuuuuaugcaugcuuuaaaaguauauaucgggaccggcagaaauggaaguauccauacauu

SEQ ID NO: 603824 - RNA, 64 nt, hsa
gcacgguggucggccuggugugaggccccccggggaccggcaguguguccagggaggggauggc

SEQ ID NO: 603825 - RNA, 60 nt, hsa
ucauccuggagaucgagugaucuugccccagaccggcagccuggccauccccaagccuuc

SEQ ID NO: 603826 - RNA, 64 nt, hsa
acuccgucccugcccaccugcgacgggaucccccgaccggcacgggccacgccgagcucccggc

SEQ ID NO: 603827 - RNA, 64 nt, hsa
cguaucauaccaccuguuccuguggagagggaaugaccggcacugaagguaccuuacaacuggc

SEQ ID NO: 603828 - RNA, 64 nt, hsa
cagaggcaguucuuuguucaagcguuccucuggggaccggcagcagaggcaccguguucucuca

SEQ ID NO: 603829 - RNA, 64 nt, hsa
ccuagaggaccagcuguccaggggaggugguauugaccggcacucaguggguggagaggaagca

SEQ ID NO: 603830 - RNA, 64 nt, hsa
guucucgcagauguuaccuaaaacugcugaacuugaccggcagaauguucugccguuuucugcu

SEQ ID NO: 603831 - RNA, 64 nt, hsa
gggugagcagagugggaggccggagacugcccuugaccggcaaaugcccugcaacgguggcucc

SEQ ID NO: 603832 - RNA, 64 nt, hsa
aaugaagagaaugccgauacucagacugcagcuggaccggcaagcuggcuguguacaggaaaau

SEQ ID NO: 603833 - RNA, 64 nt, hsa
gugcuggggccaguggggcuggggaccggcgggggaccggcagagcccaccugggggccccacc

SEQ ID NO: 603834 - RNA, 64 nt, hsa
uccuggugcaggcaggcgggucacagggacccuggaccggcacaagaaacugcuuucuucucga

SEQ ID NO: 603835 - RNA, 64 nt, hsa
gagugcaccgaggagggaaggauggcuaagcugggaccggcaguccucacagggugccugugag

SEQ ID NO: 603836 - RNA, 64 nt, hsa
ucaggucaggugcacauugcagggauaagcccaggaccggcagagagugguugccuuuccauuu

SEQ ID NO: 603837 - RNA, 64 nt, hsa
uccuucaagcucaaacaccaccucccuuauucaggaccggcacuucuuaauguuuguggcuuuc

SEQ ID NO: 603838 - RNA, 64 nt, hsa
ugcacggccgcaagucuccuggaaaggcuggagugaccggcaugccgggauugggagauuagga

SEQ ID NO: 603839 - RNA, 64 nt, hsa
ccugcggcuccgugcccgcugggaaagugcccuggaccggcagcuggcgcaccaggcccagcag

SEQ ID NO: 603840 - RNA, 64 nt, hsa
auucuagaccagccaauuggugggacagcgugaugaccggcaggguucaacagaccagggcauc

SEQ ID NO: 603841 - RNA, 64 nt, hsa
ggauagcggguggugagggaaggggcacgugcuagaccggcacgcccucgccgcgugcugcgcu

SEQ ID NO: 603842 - RNA, 64 nt, hsa; identical to SEQ ID NO: 287400

SEQ ID NO: 603843 - RNA, 64 nt, hsa; identical to SEQ ID NO: 287401

SEQ ID NO: 603844 - RNA, 64 nt, hsa; identical to SEQ ID NO: 287402

SEQ ID NO: 603845 - RNA, 64 nt, hsa; identical to SEQ ID NO: 287403

SEQ ID NO: 603846 - RNA, 64 nt, hsa; identical to SEQ ID NO: 287404

SEQ ID NO: 603847 - RNA, 64 nt, hsa; identical to SEQ ID NO: 287405

SEQ ID NO: 603848 - RNA, 64 nt, hsa; identical to SEQ ID NO: 287406

SEQ ID NO: 603849 - RNA, 64 nt, hsa; identical to SEQ ID NO: 287407

SEQ ID NO: 603850 - RNA, 64 nt, hsa; identical to SEQ ID NO: 71724

SEQ ID NO: 603851 - RNA, 64 nt, hsa; identical to SEQ ID NO: 71725

SEQ ID NO: 603852 - RNA, 64 nt, hsa; identical to SEQ ID NO: 71726

SEQ ID NO: 603853 - RNA, 64 nt, hsa; identical to SEQ ID NO: 71727

SEQ ID NO: 603854 - RNA, 64 nt, hsa; identical to SEQ ID NO: 71728

SEQ ID NO: 603855 - RNA, 64 nt, hsa; identical to SEQ ID NO: 71729

SEQ ID NO: 603856 - RNA, 64 nt, hsa; identical to SEQ ID NO: 71730

SEQ ID NO: 603857 - RNA, 64 nt, hsa; identical to SEQ ID NO: 71731

SEQ ID NO: 603858 - RNA, 64 nt, hsa; identical to SEQ ID NO: 71732

SEQ ID NO: 603859 - RNA, 64 nt, hsa; identical to SEQ ID NO: 71733

SEQ ID NO: 603860 - RNA, 64 nt, hsa; identical to SEQ ID NO: 71734

SEQ ID NO: 603861 - RNA, 64 nt, hsa; identical to SEQ ID NO: 71735

SEQ ID NO: 603862 - RNA, 64 nt, hsa; identical to SEQ ID NO: 71736

SEQ ID NO: 603863 - RNA, 64 nt, hsa; identical to SEQ ID NO: 71737

SEQ ID NO: 603864 - RNA, 64 nt, hsa; identical to SEQ ID NO: 71738

SEQ ID NO: 603865 - RNA, 64 nt, hsa; identical to SEQ ID NO: 71739

SEQ ID NO: 603866 - RNA, 64 nt, hsa; identical to SEQ ID NO: 71739

SEQ ID NO: 603867 - RNA, 64 nt, hsa; identical to SEQ ID NO: 71738

SEQ ID NO: 603868 - RNA, 64 nt, hsa; identical to SEQ ID NO: 71742

SEQ ID NO: 603869 - RNA, 64 nt, hsa; identical to SEQ ID NO: 71743

SEQ ID NO: 603870 - RNA, 64 nt, hsa; identical to SEQ ID NO: 71744

SEQ ID NO: 603871 - RNA, 64 nt, hsa; identical to SEQ ID NO: 71745

SEQ ID NO: 603872 - RNA, 64 nt, hsa; identical to SEQ ID NO: 71746

SEQ ID NO: 603873 - RNA, 64 nt, hsa; identical to SEQ ID NO: 71747

SEQ ID NO: 603874 - RNA, 64 nt, hsa; identical to SEQ ID NO: 71748

SEQ ID NO: 603875 - RNA, 64 nt, hsa; identical to SEQ ID NO: 71749

SEQ ID NO: 603876 - RNA, 64 nt, hsa; identical to SEQ ID NO: 71750

SEQ ID NO: 603877 - RNA, 64 nt, hsa; identical to SEQ ID NO: 71751

SEQ ID NO: 603878 - RNA, 64 nt, hsa; identical to SEQ ID NO: 71752

SEQ ID NO: 603879 - RNA, 64 nt, hsa; identical to SEQ ID NO: 71753

SEQ ID NO: 603880 - RNA, 64 nt, hsa
gguuucaccaacugaaaugucucccuuugaaaguagcaaacaugauuuguauguuaacuuaacu

SEQ ID NO: 603881 - RNA, 64 nt, hsa
uaaaauagugucucagcuaaauggaaaacuguuaagcaaacauccauaguaaaacaaauaaucu

SEQ ID NO: 603882 - RNA, 64 nt, hsa
aaaaauuacagaauggaaaauaauauuuugggcaagcaaacaaauucacugagaauuccaaaag

SEQ ID NO: 603883 - RNA, 64 nt, hsa
auguuuuaaaaagauacacucuaucacauauuuaagcaaacaucacauuuggagaagaggaaau

SEQ ID NO: 603884 - RNA, 64 nt, hsa
cauacugggcgugugcaucugaauccugcuggagagcaaacacgaacuucuguucccugcaaaa

SEQ ID NO: 603885 - RNA, 64 nt, hsa
guauuuuguucuggcauuagaagaaaaacaagcaagcaaacaaaaacacagccuccgaugccaa

SEQ ID NO: 603886 - RNA, 64 nt, hsa
aaaguggccguaugggaauuuaguucauucauccagcaaacauugaguaccaauuauuugcuag

SEQ ID NO: 603887 - RNA, 64 nt, hsa
caauuguuucuuuccuuuucuccuuugugagcaaagcaaacaaguacuguccaaggacagccuu

SEQ ID NO: 603888 - RNA, 64 nt, hsa
cugucuagacuaaaaauauccuugaaagaauaguagcaaacaguaugcaguacuccuguguucu

SEQ ID NO: 603889 - RNA, 64 nt, hsa
agugcagggucaguuaaugcuacaguuacuguauagcaaacaguauccuuuuuucuccuucccc

SEQ ID NO: 603890 - RNA, 64 nt, hsa
aacuuuuaaagggauccuuucaaaaggaucacuuagcaaacacauguugacuuuuaacugaugu

SEQ ID NO: 603891 - RNA, 64 nt, hsa
uagagaagucaggugauagaugauauuaaaaauuagcaaacaaaagugacuugcucagggucau

SEQ ID NO: 603892 - RNA, 64 nt, hsa
gaacuuccaguauaguggggacaaucaguuaauaagcaaacaaacacauuucuauuuauaaaug

SEQ ID NO: 603893 - RNA, 64 nt, hsa
ugugcauuugcuaugcuuuaccugucuggcaucuagcaaacauucuucacauguuugcuguuau

SEQ ID NO: 603894 - RNA, 64 nt, hsa
gcaacagaggccaaagaaacgaagcaagacaaacagcaaacaggcauuuuggucaggucauuug

SEQ ID NO: 603895 - RNA, 64 nt, hsa
aauacuuuucaggccuuuuuaaaaaauucauuacagcaaacagcuggggaaggacaugcagucc

SEQ ID NO: 603896 - RNA, 64 nt, hsa
uuuaaucaauaaaguaugucuguugaagcaagcaagcaaacaaauccauaacaaccacaacaag

SEQ ID NO: 603897 - RNA, 64 nt, hsa
ccacuuagacauaauccauuccacucauuauuccagcaaacacuuacugacaaaucggguccug

SEQ ID NO: 603898 - RNA, 64 nt, hsa
cauacugggcgugugcaucugaaucccgcuggagagcaaacacgaacuucuguucgcugcaaaa

SEQ ID NO: 603899 - RNA, 64 nt, hsa
guauuuuguucuggcauuaaaagaaaaacaagcaagcaaacaaaaacacagccuccgaugccaa

SEQ ID NO: 603900 - RNA, 64 nt, hsa
auaaauaagagaccaaaaguaggcuaucacccaaagcaaacauccuuaacugacccuaacgugu

SEQ ID NO: 603901 - RNA, 64 nt, hsa
cacacgaccaagucagcgagagcuagcccugguaagcaaacauagcccauuacagguucagaac

SEQ ID NO: 603902 - RNA, 64 nt, hsa
ucuagcuacuuaaugguucuguucuuuuauaugcagcaaacacaccguccauuucugaagaggc

SEQ ID NO: 603903 - RNA, 64 nt, hsa
gaccacccgagcuaaucauggaaugucuguucccagcaaacacgauaaagaaagauugugcacu

SEQ ID NO: 603904 - RNA, 64 nt, hsa
gggaaagucagcaaaagaaagaaugcauuucgaaagcaaacagaagaaaaaaguauauucucac

SEQ ID NO: 603905 - RNA, 64 nt, hsa
ucuuaaaccaguuuuuacuugucaguuuucucucagcaaacagucuuacuauuauguggaauuu

SEQ ID NO: 603906 - RNA, 64 nt, hsa
gccaaguagcuuugggcauaggcugcccaaucugagcaaacaccagugaggcucuauugagcca

SEQ ID NO: 603907 - RNA, 64 nt, hsa
uaaaagauaaacaguuuagcccaucucuccagagagcaaacauaggaauaugacucaggagccu

SEQ ID NO: 603908 - RNA, 64 nt, hsa
guugaagagguaaaaaauaaauaaauacauaaaaagcaaacaagcggggacaccugcagucuua

SEQ ID NO: 603909 - RNA, 64 nt, hsa
ccacauuuucauggaaugguacugugggagacugagcaaacacucuuuuggcaacuuaguagaa

SEQ ID NO: 603910 - RNA, 64 nt, hsa
aacucugauaagaaaaguguucaauuuguauuuaagcaaacagugaacgacguuugcaaucaac

SEQ ID NO: 603911 - RNA, 64 nt, hsa
acucuguggaguuuguucagugguacgguguccaagcaaacagcagaaugcaacuuucuaaaca

SEQ ID NO: 603912 - RNA, 64 nt, hsa
caaacagcagaaugcaacuuucuaaacagccccaagcaaacagcagaauucaacuuuuuaaaca

SEQ ID NO: 603913 - RNA, 64 nt, hsa
auaaucuggaauauucuacauggcuugauuacauagcaaacaagaccaagauuuagggcugucu

SEQ ID NO: 603914 - RNA, 64 nt, hsa
guuuuuggcuaaguagaggacauggacuaguuguagcaaacagaacaugcuguuugcucuugcc

SEQ ID NO: 603915 - RNA, 64 nt, hsa
uuucacuuuguagggugggggauuacugagagucaggcuagaccuguguuuagagaagcaguuu

SEQ ID NO: 603916 - RNA, 64 nt, hsa
agggaggccuccaucuggaaaugggaggaugaagaggcuagaaucaucuuuccuagugauccug

SEQ ID NO: 603917 - RNA, 64 nt, hsa
augagaguccugggugugaggaacaccucccaccaggcuagaggcaacugcccaggaaggacug

SEQ ID NO: 603918 - RNA, 64 nt, hsa
uguuguuuuuaagauggaguuucccucuguugccaggcuagagugcaguggcaugaucucggcu

SEQ ID NO: 603919 - RNA, 64 nt, hsa
auuuugccacguacuaacguucugcacaaaagacaggcuagacucuugucuagauuguuuaaaa

SEQ ID NO: 603920 - RNA, 64 nt, hsa
uacaaucuaaccagccaucauaucauauccuaucaggcuagauaucucaauaguagacugaaua

SEQ ID NO: 603921 - RNA, 64 nt, hsa
uauuuuuuugagacagauucucacucugucucccaggcuagagugcaguggugcaaucucagcu

SEQ ID NO: 603922 - RNA, 64 nt, hsa
uuuuuguuugagauggagucucacucugucaccuaggcuagagugcaguggugugaucucggcu

SEQ ID NO: 603923 - RNA, 64 nt, hsa
gucucuacuuuguauucuugugaggcacaaauauaggcuagaauccaggccccacaaauauagg

SEQ ID NO: 603924 - RNA, 64 nt, hsa
caaauauaggcuagaauccaggccccacaaauauaggcuagaauccggaauguuuucuugauuu

SEQ ID NO: 603925 - RNA, 64 nt, hsa
uggagaacuagaaccuggagggcuagaacuggagaggcuagaaccaagaagggcuagaaccugg

SEQ ID NO: 603926 - RNA, 64 nt, hsa
uguagagcuagaacauggagagcuagaacccggcaggcuagaaccuggcaagcuagaaccugga

SEQ ID NO: 603927 - RNA, 62 nt, hsa
gcuugauauguucaacuggagacacuauuuaucugugcaaauccuugauacugcucaucauu

SEQ ID NO: 603928 - RNA, 62 nt, hsa
gagauguuucacgaaguuuguucaucagacuccugugcaacuuucccaauguggccuaaaaa

SEQ ID NO: 603929 - RNA, 62 nt, hsa
cgaaaacugcuguuuguggcaggaaccccuggcugugcaaauaaauggggcugaggccccug

SEQ ID NO: 603930 - RNA, 62 nt, hsa
accuucuuugugucugugaugaaaggaacagucugugcaauggguuuuacuuaaacuucacu

SEQ ID NO: 603931 - RNA, 62 nt, hsa
ccagccucuaggcuagcggcugcauucguggucugugcaaacacuucgugguucuauauauc

SEQ ID NO: 603932 - RNA, 62 nt, hsa
cuugccuguguaauuuuaaaaaauuaauagagcugugcaaacccuguuauuuuuguaaaaaa

SEQ ID NO: 603933 - RNA, 62 nt, hsa
ugcuuuagcuauuaauggggcauugugaggaacugugcaaagacauuuuuguuacaaaccug

SEQ ID NO: 603934 - RNA, 62 nt, hsa
uugacucaaaguagaucguuauuuugaucaaacugugcaaacaguaguaccacguguagcau

SEQ ID NO: 603935 - RNA, 62 nt, hsa
uuuacuuuugucagaaucaaggcuucggccaccugugcaauauuuucccauggaaugcagca

SEQ ID NO: 603936 - RNA, 62 nt, hsa
cuucucaguagaaaggaacagaaaacaaacaucugugcaaaacccuauaaaagugauauucc

SEQ ID NO: 603937 - RNA, 62 nt, hsa
acuauauggacucuucauuucauauugauuuacugugcaauuuacuuuuggacauugagaac

SEQ ID NO: 603938 - RNA, 62 nt, hsa
agcaagcuaaauggcaucccagcugcuccuuucugugcaaccaauuaaagaacaaugagugu

SEQ ID NO: 603939 - RNA, 62 nt, hsa
cgcuucccuucacauuagaaaacaagaucagccugugcaacauggugaaaccucaucucuac

SEQ ID NO: 603940 - RNA, 62 nt, hsa
cccagcucucaggguugacucuguuccauccucugugcaaaauccucccgugcuucccuuug

SEQ ID NO: 603941 - RNA, 62 nt, hsa
gugguuuuuauggaccacauuaucagagagcacugugcaagccaaaugguucaauaaugaau

SEQ ID NO: 603942 - RNA, 62 nt, hsa
gguuaggacaucgcugcuugauccuuacaauacugugcaacugcaaugcaacguggcccugc

SEQ ID NO: 603943 - RNA, 64 nt, hsa; identical to SEQ ID NO: 106478

SEQ ID NO: 603944 - RNA, 64 nt, hsa; identical to SEQ ID NO: 106479

SEQ ID NO: 603945 - RNA, 64 nt, hsa; identical to SEQ ID NO: 106480

SEQ ID NO: 603946 - RNA, 64 nt, hsa; identical to SEQ ID NO: 106481

SEQ ID NO: 603947 - RNA, 64 nt, hsa; identical to SEQ ID NO: 106482

SEQ ID NO: 603948 - RNA, 64 nt, hsa; identical to SEQ ID NO: 106483

SEQ ID NO: 603949 - RNA, 64 nt, hsa; identical to SEQ ID NO: 106484

SEQ ID NO: 603950 - RNA, 64 nt, hsa; identical to SEQ ID NO: 106485

SEQ ID NO: 603951 - RNA, 64 nt, hsa; identical to SEQ ID NO: 106486

SEQ ID NO: 603952 - RNA, 64 nt, hsa; identical to SEQ ID NO: 106487

SEQ ID NO: 603953 - RNA, 64 nt, hsa; identical to SEQ ID NO: 106488

SEQ ID NO: 603954 - RNA, 64 nt, hsa; identical to SEQ ID NO: 106489

SEQ ID NO: 603955 - RNA, 64 nt, hsa; identical to SEQ ID NO: 106490

SEQ ID NO: 603956 - RNA, 64 nt, hsa; identical to SEQ ID NO: 106491

SEQ ID NO: 603957 - RNA, 64 nt, hsa; identical to SEQ ID NO: 106492

SEQ ID NO: 603958 - RNA, 64 nt, hsa; identical to SEQ ID NO: 106493

SEQ ID NO: 603959 - RNA, 64 nt, hsa; identical to SEQ ID NO: 106494

SEQ ID NO: 603960 - RNA, 64 nt, hsa; identical to SEQ ID NO: 311847

SEQ ID NO: 603961 - RNA, 64 nt, hsa; identical to SEQ ID NO: 311848

SEQ ID NO: 603962 - RNA, 64 nt, hsa; identical to SEQ ID NO: 311849

SEQ ID NO: 603963 - RNA, 64 nt, hsa; identical to SEQ ID NO: 311850

SEQ ID NO: 603964 - RNA, 64 nt, hsa; identical to SEQ ID NO: 311851

SEQ ID NO: 603965 - RNA, 64 nt, hsa; identical to SEQ ID NO: 311852

SEQ ID NO: 603966 - RNA, 64 nt, hsa; identical to SEQ ID NO: 311853

SEQ ID NO: 603967 - RNA, 64 nt, hsa; identical to SEQ ID NO: 311854

SEQ ID NO: 603968 - RNA, 64 nt, hsa; identical to SEQ ID NO: 311855

SEQ ID NO: 603969 - RNA, 64 nt, hsa; identical to SEQ ID NO: 311856

SEQ ID NO: 603970 - RNA, 64 nt, hsa; identical to SEQ ID NO: 311857

SEQ ID NO: 603971 - RNA, 64 nt, hsa; identical to SEQ ID NO: 311858

SEQ ID NO: 603972 - RNA, 64 nt, hsa; identical to SEQ ID NO: 311859

SEQ ID NO: 603973 - RNA, 64 nt, hsa; identical to SEQ ID NO: 311860

SEQ ID NO: 603974 - RNA, 64 nt, hsa; identical to SEQ ID NO: 311861

SEQ ID NO: 603975 - RNA, 64 nt, hsa; identical to SEQ ID NO: 311862

SEQ ID NO: 603976 - RNA, 64 nt, hsa; identical to SEQ ID NO: 311863

SEQ ID NO: 603977 - RNA, 64 nt, hsa; identical to SEQ ID NO: 311864

SEQ ID NO: 603978 - RNA, 64 nt, hsa; identical to SEQ ID NO: 311865

SEQ ID NO: 603979 - RNA, 64 nt, hsa; identical to SEQ ID NO: 311866

SEQ ID NO: 603980 - RNA, 64 nt, hsa; identical to SEQ ID NO: 311867

SEQ ID NO: 603981 - RNA, 64 nt, hsa; identical to SEQ ID NO: 311868

SEQ ID NO: 603982 - RNA, 64 nt, hsa; identical to SEQ ID NO: 311869

SEQ ID NO: 603983 - RNA, 64 nt, hsa; identical to SEQ ID NO: 311870

SEQ ID NO: 603984 - RNA, 64 nt, hsa; identical to SEQ ID NO: 311871

SEQ ID NO: 603985 - RNA, 64 nt, hsa; identical to SEQ ID NO: 311872

SEQ ID NO: 603986 - RNA, 64 nt, hsa; identical to SEQ ID NO: 311873

SEQ ID NO: 603987 - RNA, 64 nt, hsa; identical to SEQ ID NO: 311874

SEQ ID NO: 603988 - RNA, 64 nt, hsa; identical to SEQ ID NO: 311875

SEQ ID NO: 603989 - RNA, 64 nt, hsa
gguccagaucuugcgcucagcacacucuagggaauaauuccacuccagagauggggcugcuuca

SEQ ID NO: 603990 - RNA, 64 nt, hsa
uucuguuugcacuguuuguuuguaugauguuagcuaauuccacuguguauauaaauuguauuuu

SEQ ID NO: 603991 - RNA, 64 nt, hsa
aguguucuuggcacauguauauuacuaaaguagauaauuccaaugagaaauacuaccagauuau

SEQ ID NO: 603992 - RNA, 64 nt, hsa
acagagauuauuaauaugguagaacccuguuauguaauuccaaaacuuaagaaccauauuuaca

SEQ ID NO: 603993 - RNA, 64 nt, hsa
ugccacauacauagaucuucaugaugugugaguguaauuccauguggauaucaguuaccaaaca

SEQ ID NO: 603994 - RNA, 64 nt, hsa
uacuuaaaauaucucuaaaauagguaaauguauuuaauuccauauugaugaagauguuuauugg

SEQ ID NO: 603995 - RNA, 64 nt, hsa
uagccaccuaaacauuuuaauuccagauauuauuuaauuccauauaauaacugaauucuuguga

SEQ ID NO: 603996 - RNA, 64 nt, hsa
ucaaauaauauagucauuagccaccuaaacauuuuaauuccagauauuauuuaauuccauauaa

SEQ ID NO: 603997 - RNA, 64 nt, hsa
aaagaggagaugacuacauuuagccccucucuuauaauuccagguagauaacugcauuuuguag

SEQ ID NO: 603998 - RNA, 64 nt, hsa
cacagcuguuuccucacguccaucacuggcucucuaauuccacuuguucauucugugacccuag

SEQ ID NO: 603999 - RNA, 64 nt, hsa
ucccucugcguaggaauaaccauaauuaucuuacuaauuccaucccagaaaagccugugauccc

SEQ ID NO: 604000 - RNA, 64 nt, hsa
aagggaucaugaaaaggucuggucagcuacaguuuaauuccacacuguuacagaaaagcauuuc

SEQ ID NO: 604001 - RNA, 64 nt, hsa
uuucuaagaaaugugaaauagaacaauuuucaucuaauuccauuuacuuuuagaugaauggcau

SEQ ID NO: 604002 - RNA, 64 nt, hsa
aaugaauuucaagagaauucucugguuuucuguguaauuccagaugagucacuguaacucuaga

SEQ ID NO: 604003 - RNA, 64 nt, hsa
gcauagcuaucaccuguagcucccucccuaccuguaauuccagucuuugugcauuugucaucug

SEQ ID NO: 604004 - RNA, 64 nt, hsa
uuccggacaacugccaaaucuauguaauuuucuuuaauuccaaacuagggcuuucaugacucaa

SEQ ID NO: 604005 - RNA, 64 nt, hsa
gagaauaacauuuuuuccuucuucaggguggcuguaauuccagguggccgugauuucuuucuuc

SEQ ID NO: 604006 - RNA, 64 nt, hsa
aagcuaauggcacaggagacaucagggcagcuguuaauuccaaauauuuguucccaaguagcua

SEQ ID NO: 604007 - RNA, 64 nt, hsa
ucugccuggcaacugugucucccugugcuauauuuaauuccaccagcaaagcuggcgaggcagg

SEQ ID NO: 604008 - RNA, 64 nt, hsa
uauauaggugaaugccuucaagaaauguguaauuuaauuccaaauaguuccccccaaaauacac

SEQ ID NO: 604009 - RNA, 64 nt, hsa
uauuugaaguuucuuaguaaaaaguaauuagguauaauuccaaauagauuucuguauaaauugu

SEQ ID NO: 604010 - RNA, 64 nt, hsa
ucaccuacauggccauuagaguaucuaucggugauaauuccaugauacagaguaucuuggcauu

SEQ ID NO: 604011 - RNA, 64 nt, hsa; identical to SEQ ID NO: 176114

SEQ ID NO: 604012 - RNA, 64 nt, hsa; identical to SEQ ID NO: 176115

SEQ ID NO: 604013 - RNA, 64 nt, hsa; identical to SEQ ID NO: 176116

SEQ ID NO: 604014 - RNA, 64 nt, hsa; identical to SEQ ID NO: 176117

SEQ ID NO: 604015 - RNA, 64 nt, hsa; identical to SEQ ID NO: 176118

SEQ ID NO: 604016 - RNA, 64 nt, hsa; identical to SEQ ID NO: 176119

SEQ ID NO: 604017 - RNA, 64 nt, hsa; identical to SEQ ID NO: 176120

SEQ ID NO: 604018 - RNA, 64 nt, hsa; identical to SEQ ID NO: 176121

SEQ ID NO: 604019 - RNA, 64 nt, hsa; identical to SEQ ID NO: 176122

SEQ ID NO: 604020 - RNA, 64 nt, hsa; identical to SEQ ID NO: 176123

SEQ ID NO: 604021 - RNA, 64 nt, hsa; identical to SEQ ID NO: 176124

SEQ ID NO: 604022 - RNA, 64 nt, hsa; identical to SEQ ID NO: 176125

SEQ ID NO: 604023 - RNA, 64 nt, hsa; identical to SEQ ID NO: 176126

SEQ ID NO: 604024 - RNA, 64 nt, hsa; identical to SEQ ID NO: 176127

SEQ ID NO: 604025 - RNA, 64 nt, hsa; identical to SEQ ID NO: 176128

SEQ ID NO: 604026 - RNA, 64 nt, hsa; identical to SEQ ID NO: 176129

SEQ ID NO: 604027 - RNA, 64 nt, hsa; identical to SEQ ID NO: 176130

SEQ ID NO: 604028 - RNA, 64 nt, hsa; identical to SEQ ID NO: 176131

SEQ ID NO: 604029 - RNA, 64 nt, hsa; identical to SEQ ID NO: 176132

SEQ ID NO: 604030 - RNA, 64 nt, hsa; identical to SEQ ID NO: 176133

SEQ ID NO: 604031 - RNA, 64 nt, hsa; identical to SEQ ID NO: 176134

SEQ ID NO: 604032 - RNA, 64 nt, hsa; identical to SEQ ID NO: 176135

SEQ ID NO: 604033 - RNA, 64 nt, hsa; identical to SEQ ID NO: 176136

SEQ ID NO: 604034 - RNA, 64 nt, hsa; identical to SEQ ID NO: 176137

SEQ ID NO: 604035 - RNA, 64 nt, hsa; identical to SEQ ID NO: 176138

SEQ ID NO: 604036 - RNA, 64 nt, hsa; identical to SEQ ID NO: 176139

SEQ ID NO: 604037 - RNA, 64 nt, hsa; identical to SEQ ID NO: 176140

SEQ ID NO: 604038 - RNA, 64 nt, hsa; identical to SEQ ID NO: 176141

SEQ ID NO: 604039 - RNA, 64 nt, hsa; identical to SEQ ID NO: 176142

SEQ ID NO: 604040 - RNA, 64 nt, hsa; identical to SEQ ID NO: 176143

SEQ ID NO: 604041 - RNA, 64 nt, hsa; identical to SEQ ID NO: 176144

SEQ ID NO: 604042 - RNA, 64 nt, hsa; identical to SEQ ID NO: 176145

SEQ ID NO: 604043 - RNA, 64 nt, hsa; identical to SEQ ID NO: 176146

SEQ ID NO: 604044 - RNA, 64 nt, hsa; identical to SEQ ID NO: 176147

SEQ ID NO: 604045 - RNA, 64 nt, hsa; identical to SEQ ID NO: 176148

SEQ ID NO: 604046 - RNA, 64 nt, hsa; identical to SEQ ID NO: 176149

SEQ ID NO: 604047 - RNA, 64 nt, hsa; identical to SEQ ID NO: 176150

SEQ ID NO: 604048 - RNA, 64 nt, hsa; identical to SEQ ID NO: 176151

SEQ ID NO: 604049 - RNA, 64 nt, hsa; identical to SEQ ID NO: 176152

SEQ ID NO: 604050 - RNA, 64 nt, hsa; identical to SEQ ID NO: 176153

SEQ ID NO: 604051 - RNA, 64 nt, hsa; identical to SEQ ID NO: 176154

SEQ ID NO: 604052 - RNA, 64 nt, hsa; identical to SEQ ID NO: 176155

SEQ ID NO: 604053 - RNA, 64 nt, hsa; identical to SEQ ID NO: 176156

SEQ ID NO: 604054 - RNA, 57 nt, hsa; identical to SEQ ID NO: 176157

SEQ ID NO: 604055 - RNA, 64 nt, hsa; identical to SEQ ID NO: 176158

SEQ ID NO: 604056 - RNA, 64 nt, hsa; identical to SEQ ID NO: 176159

SEQ ID NO: 604057 - RNA, 64 nt, hsa; identical to SEQ ID NO: 176160

SEQ ID NO: 604058 - RNA, 64 nt, hsa; identical to SEQ ID NO: 176161

SEQ ID NO: 604059 - RNA, 64 nt, hsa; identical to SEQ ID NO: 176162

SEQ ID NO: 604060 - RNA, 64 nt, hsa; identical to SEQ ID NO: 176163

SEQ ID NO: 604061 - RNA, 64 nt, hsa; identical to SEQ ID NO: 176164

SEQ ID NO: 604062 - RNA, 64 nt, hsa; identical to SEQ ID NO: 176165

SEQ ID NO: 604063 - RNA, 64 nt, hsa; identical to SEQ ID NO: 176166

SEQ ID NO: 604064 - RNA, 64 nt, hsa; identical to SEQ ID NO: 176167

SEQ ID NO: 604065 - RNA, 64 nt, hsa; identical to SEQ ID NO: 176168

SEQ ID NO: 604066 - RNA, 64 nt, hsa; identical to SEQ ID NO: 176169

SEQ ID NO: 604067 - RNA, 64 nt, hsa; identical to SEQ ID NO: 176170

SEQ ID NO: 604068 - RNA, 64 nt, hsa; identical to SEQ ID NO: 176171

SEQ ID NO: 604069 - RNA, 64 nt, hsa; identical to SEQ ID NO: 176172

SEQ ID NO: 604070 - RNA, 64 nt, hsa; identical to SEQ ID NO: 176173

SEQ ID NO: 604071 - RNA, 64 nt, hsa; identical to SEQ ID NO: 176174

SEQ ID NO: 604072 - RNA, 64 nt, hsa; identical to SEQ ID NO: 176175

SEQ ID NO: 604073 - RNA, 64 nt, hsa; identical to SEQ ID NO: 176176

SEQ ID NO: 604074 - RNA, 64 nt, hsa; identical to SEQ ID NO: 176177

SEQ ID NO: 604075 - RNA, 64 nt, hsa; identical to SEQ ID NO: 176178

SEQ ID NO: 604076 - RNA, 64 nt, hsa; identical to SEQ ID NO: 176179

SEQ ID NO: 604077 - RNA, 64 nt, hsa; identical to SEQ ID NO: 176180

SEQ ID NO: 604078 - RNA, 64 nt, hsa; identical to SEQ ID NO: 176181

SEQ ID NO: 604079 - RNA, 64 nt, hsa; identical to SEQ ID NO: 176182

SEQ ID NO: 604080 - RNA, 64 nt, hsa; identical to SEQ ID NO: 176183

SEQ ID NO: 604081 - RNA, 64 nt, hsa; identical to SEQ ID NO: 176184

SEQ ID NO: 604082 - RNA, 64 nt, hsa; identical to SEQ ID NO: 176185

SEQ ID NO: 604083 - RNA, 64 nt, hsa; identical to SEQ ID NO: 176186

SEQ ID NO: 604084 - RNA, 64 nt, hsa; identical to SEQ ID NO: 176187

SEQ ID NO: 604085 - RNA, 64 nt, hsa; identical to SEQ ID NO: 176188

SEQ ID NO: 604086 - RNA, 64 nt, hsa; identical to SEQ ID NO: 176189

SEQ ID NO: 604087 - RNA, 64 nt, hsa; identical to SEQ ID NO: 176190

SEQ ID NO: 604088 - RNA, 64 nt, hsa; identical to SEQ ID NO: 176191

SEQ ID NO: 604089 - RNA, 64 nt, hsa; identical to SEQ ID NO: 176192

SEQ ID NO: 604090 - RNA, 64 nt, hsa; identical to SEQ ID NO: 176193

SEQ ID NO: 604091 - RNA, 53 nt, hsa; identical to SEQ ID NO: 176194

SEQ ID NO: 604092 - RNA, 64 nt, hsa; identical to SEQ ID NO: 176195

SEQ ID NO: 604093 - RNA, 64 nt, hsa; identical to SEQ ID NO: 176196

SEQ ID NO: 604094 - RNA, 64 nt, hsa; identical to SEQ ID NO: 176197

SEQ ID NO: 604095 - RNA, 64 nt, hsa; identical to SEQ ID NO: 176198

SEQ ID NO: 604096 - RNA, 64 nt, hsa; identical to SEQ ID NO: 176199

SEQ ID NO: 604097 - RNA, 64 nt, hsa; identical to SEQ ID NO: 176200

SEQ ID NO: 604098 - RNA, 64 nt, hsa; identical to SEQ ID NO: 176201

SEQ ID NO: 604099 - RNA, 64 nt, hsa; identical to SEQ ID NO: 176202

SEQ ID NO: 604100 - RNA, 64 nt, hsa; identical to SEQ ID NO: 176203

SEQ ID NO: 604101 - RNA, 64 nt, hsa; identical to SEQ ID NO: 176204

SEQ ID NO: 604102 - RNA, 64 nt, hsa; identical to SEQ ID NO: 176205

SEQ ID NO: 604103 - RNA, 64 nt, hsa; identical to SEQ ID NO: 176206

SEQ ID NO: 604104 - RNA, 64 nt, hsa; identical to SEQ ID NO: 176207

SEQ ID NO: 604105 - RNA, 64 nt, hsa; identical to SEQ ID NO: 176208

SEQ ID NO: 604106 - RNA, 64 nt, hsa; identical to SEQ ID NO: 176209

SEQ ID NO: 604107 - RNA, 64 nt, hsa; identical to SEQ ID NO: 176210

SEQ ID NO: 604108 - RNA, 64 nt, hsa; identical to SEQ ID NO: 176211

SEQ ID NO: 604109 - RNA, 64 nt, hsa; identical to SEQ ID NO: 176212

SEQ ID NO: 604110 - RNA, 64 nt, hsa; identical to SEQ ID NO: 176213

SEQ ID NO: 604111 - RNA, 64 nt, hsa; identical to SEQ ID NO: 176214

SEQ ID NO: 604112 - RNA, 64 nt, hsa; identical to SEQ ID NO: 176215

SEQ ID NO: 604113 - RNA, 64 nt, hsa; identical to SEQ ID NO: 176216

SEQ ID NO: 604114 - RNA, 64 nt, hsa; identical to SEQ ID NO: 176217

SEQ ID NO: 604115 - RNA, 64 nt, hsa; identical to SEQ ID NO: 176218

SEQ ID NO: 604116 - RNA, 64 nt, hsa; identical to SEQ ID NO: 176219

SEQ ID NO: 604117 - RNA, 64 nt, hsa; identical to SEQ ID NO: 176220

SEQ ID NO: 604118 - RNA, 64 nt, hsa; identical to SEQ ID NO: 176221

SEQ ID NO: 604119 - RNA, 64 nt, hsa; identical to SEQ ID NO: 176222

SEQ ID NO: 604120 - RNA, 64 nt, hsa; identical to SEQ ID NO: 176223

SEQ ID NO: 604121 - RNA, 64 nt, hsa; identical to SEQ ID NO: 176220

SEQ ID NO: 604122 - RNA, 64 nt, hsa; identical to SEQ ID NO: 176225

SEQ ID NO: 604123 - RNA, 64 nt, hsa; identical to SEQ ID NO: 176226

SEQ ID NO: 604124 - RNA, 64 nt, hsa; identical to SEQ ID NO: 176227

SEQ ID NO: 604125 - RNA, 64 nt, hsa; identical to SEQ ID NO: 176228

SEQ ID NO: 604126 - RNA, 64 nt, hsa; identical to SEQ ID NO: 176229

SEQ ID NO: 604127 - RNA, 64 nt, hsa; identical to SEQ ID NO: 176230

SEQ ID NO: 604128 - RNA, 64 nt, hsa; identical to SEQ ID NO: 176231

SEQ ID NO: 604129 - RNA, 64 nt, hsa; identical to SEQ ID NO: 176232

SEQ ID NO: 604130 - RNA, 64 nt, hsa; identical to SEQ ID NO: 176233

SEQ ID NO: 604131 - RNA, 64 nt, hsa; identical to SEQ ID NO: 176234

SEQ ID NO: 604132 - RNA, 64 nt, hsa; identical to SEQ ID NO: 176235

SEQ ID NO: 604133 - RNA, 64 nt, hsa; identical to SEQ ID NO: 176236

SEQ ID NO: 604134 - RNA, 64 nt, hsa; identical to SEQ ID NO: 176237

SEQ ID NO: 604135 - RNA, 64 nt, hsa; identical to SEQ ID NO: 176238

SEQ ID NO: 604136 - RNA, 51 nt, hsa; identical to SEQ ID NO: 176239

SEQ ID NO: 604137 - RNA, 64 nt, hsa; identical to SEQ ID NO: 176240

SEQ ID NO: 604138 - RNA, 64 nt, hsa; identical to SEQ ID NO: 176241

SEQ ID NO: 604139 - RNA, 64 nt, hsa; identical to SEQ ID NO: 176242

SEQ ID NO: 604140 - RNA, 64 nt, hsa; identical to SEQ ID NO: 176243

SEQ ID NO: 604141 - RNA, 64 nt, hsa; identical to SEQ ID NO: 176244

SEQ ID NO: 604142 - RNA, 64 nt, hsa; identical to SEQ ID NO: 176245

SEQ ID NO: 604143 - RNA, 64 nt, hsa; identical to SEQ ID NO: 176246

SEQ ID NO: 604144 - RNA, 64 nt, hsa; identical to SEQ ID NO: 176247

SEQ ID NO: 604145 - RNA, 64 nt, hsa; identical to SEQ ID NO: 176248

SEQ ID NO: 604146 - RNA, 64 nt, hsa; identical to SEQ ID NO: 176249

SEQ ID NO: 604147 - RNA, 64 nt, hsa; identical to SEQ ID NO: 176250

SEQ ID NO: 604148 - RNA, 64 nt, hsa; identical to SEQ ID NO: 176251

SEQ ID NO: 604149 - RNA, 64 nt, hsa; identical to SEQ ID NO: 176252

SEQ ID NO: 604150 - RNA, 64 nt, hsa; identical to SEQ ID NO: 176253

SEQ ID NO: 604151 - RNA, 64 nt, hsa; identical to SEQ ID NO: 176254

SEQ ID NO: 604152 - RNA, 64 nt, hsa; identical to SEQ ID NO: 176255

SEQ ID NO: 604153 - RNA, 64 nt, hsa; identical to SEQ ID NO: 176256

SEQ ID NO: 604154 - RNA, 64 nt, hsa; identical to SEQ ID NO: 176257

SEQ ID NO: 604155 - RNA, 64 nt, hsa; identical to SEQ ID NO: 176258

SEQ ID NO: 604156 - RNA, 64 nt, hsa; identical to SEQ ID NO: 176259

SEQ ID NO: 604157 - RNA, 64 nt, hsa; identical to SEQ ID NO: 176260

SEQ ID NO: 604158 - RNA, 64 nt, hsa; identical to SEQ ID NO: 176261

SEQ ID NO: 604159 - RNA, 64 nt, hsa; identical to SEQ ID NO: 176262

SEQ ID NO: 604160 - RNA, 64 nt, hsa; identical to SEQ ID NO: 176263

SEQ ID NO: 604161 - RNA, 64 nt, hsa; identical to SEQ ID NO: 176264

SEQ ID NO: 604162 - RNA, 64 nt, hsa; identical to SEQ ID NO: 176265

SEQ ID NO: 604163 - RNA, 64 nt, hsa; identical to SEQ ID NO: 176266

SEQ ID NO: 604164 - RNA, 64 nt, hsa; identical to SEQ ID NO: 176267

SEQ ID NO: 604165 - RNA, 64 nt, hsa; identical to SEQ ID NO: 176268

SEQ ID NO: 604166 - RNA, 64 nt, hsa; identical to SEQ ID NO: 176269

SEQ ID NO: 604167 - RNA, 53 nt, hsa; identical to SEQ ID NO: 176270

SEQ ID NO: 604168 - RNA, 64 nt, hsa; identical to SEQ ID NO: 176271

SEQ ID NO: 604169 - RNA, 64 nt, hsa; identical to SEQ ID NO: 176272

SEQ ID NO: 604170 - RNA, 64 nt, hsa; identical to SEQ ID NO: 48305

SEQ ID NO: 604171 - RNA, 64 nt, hsa; identical to SEQ ID NO: 48306

SEQ ID NO: 604172 - RNA, 64 nt, hsa; identical to SEQ ID NO: 48307

SEQ ID NO: 604173 - RNA, 64 nt, hsa; identical to SEQ ID NO: 48308

SEQ ID NO: 604174 - RNA, 64 nt, hsa; identical to SEQ ID NO: 48309

SEQ ID NO: 604175 - RNA, 64 nt, hsa; identical to SEQ ID NO: 48310

SEQ ID NO: 604176 - RNA, 64 nt, hsa; identical to SEQ ID NO: 48311

SEQ ID NO: 604177 - RNA, 64 nt, hsa; identical to SEQ ID NO: 48312

SEQ ID NO: 604178 - RNA, 64 nt, hsa; identical to SEQ ID NO: 48313

SEQ ID NO: 604179 - RNA, 64 nt, hsa; identical to SEQ ID NO: 48314

SEQ ID NO: 604180 - RNA, 64 nt, hsa; identical to SEQ ID NO: 48315

SEQ ID NO: 604181 - RNA, 64 nt, hsa; identical to SEQ ID NO: 48316

SEQ ID NO: 604182 - RNA, 64 nt, hsa; identical to SEQ ID NO: 48317

SEQ ID NO: 604183 - RNA, 64 nt, hsa; identical to SEQ ID NO: 48318

SEQ ID NO: 604184 - RNA, 64 nt, hsa; identical to SEQ ID NO: 48319

SEQ ID NO: 604185 - RNA, 64 nt, hsa; identical to SEQ ID NO: 48320

SEQ ID NO: 604186 - RNA, 64 nt, hsa; identical to SEQ ID NO: 48321

SEQ ID NO: 604187 - RNA, 64 nt, hsa; identical to SEQ ID NO: 48322

SEQ ID NO: 604188 - RNA, 64 nt, hsa; identical to SEQ ID NO: 48323

SEQ ID NO: 604189 - RNA, 64 nt, hsa; identical to SEQ ID NO: 48324

SEQ ID NO: 604190 - RNA, 64 nt, hsa; identical to SEQ ID NO: 48325

SEQ ID NO: 604191 - RNA, 64 nt, hsa; identical to SEQ ID NO: 48326

SEQ ID NO: 604192 - RNA, 64 nt, hsa; identical to SEQ ID NO: 48327

SEQ ID NO: 604193 - RNA, 64 nt, hsa; identical to SEQ ID NO: 48328

SEQ ID NO: 604194 - RNA, 64 nt, hsa; identical to SEQ ID NO: 48329

SEQ ID NO: 604195 - RNA, 51 nt, hsa; identical to SEQ ID NO: 48330

SEQ ID NO: 604196 - RNA, 64 nt, hsa; identical to SEQ ID NO: 48331

SEQ ID NO: 604197 - RNA, 64 nt, hsa; identical to SEQ ID NO: 48332

SEQ ID NO: 604198 - RNA, 64 nt, hsa; identical to SEQ ID NO: 48333

SEQ ID NO: 604199 - RNA, 64 nt, hsa; identical to SEQ ID NO: 48334

SEQ ID NO: 604200 - RNA, 64 nt, hsa; identical to SEQ ID NO: 48335

SEQ ID NO: 604201 - RNA, 64 nt, hsa; identical to SEQ ID NO: 48336

SEQ ID NO: 604202 - RNA, 64 nt, hsa; identical to SEQ ID NO: 48337

SEQ ID NO: 604203 - RNA, 64 nt, hsa; identical to SEQ ID NO: 48338

SEQ ID NO: 604204 - RNA, 64 nt, hsa; identical to SEQ ID NO: 48339

SEQ ID NO: 604205 - RNA, 64 nt, hsa; identical to SEQ ID NO: 48340

SEQ ID NO: 604206 - RNA, 64 nt, hsa; identical to SEQ ID NO: 48341

SEQ ID NO: 604207 - RNA, 64 nt, hsa; identical to SEQ ID NO: 48342

SEQ ID NO: 604208 - RNA, 64 nt, hsa; identical to SEQ ID NO: 48343

SEQ ID NO: 604209 - RNA, 64 nt, hsa; identical to SEQ ID NO: 48344

SEQ ID NO: 604210 - RNA, 64 nt, hsa; identical to SEQ ID NO: 48345

SEQ ID NO: 604211 - RNA, 64 nt, hsa; identical to SEQ ID NO: 48346

SEQ ID NO: 604212 - RNA, 64 nt, hsa; identical to SEQ ID NO: 48347

SEQ ID NO: 604213 - RNA, 64 nt, hsa; identical to SEQ ID NO: 48348

SEQ ID NO: 604214 - RNA, 64 nt, hsa; identical to SEQ ID NO: 48349

SEQ ID NO: 604215 - RNA, 64 nt, hsa; identical to SEQ ID NO: 123549

SEQ ID NO: 604216 - RNA, 64 nt, hsa; identical to SEQ ID NO: 123550

SEQ ID NO: 604217 - RNA, 64 nt, hsa; identical to SEQ ID NO: 123551

SEQ ID NO: 604218 - RNA, 64 nt, hsa; identical to SEQ ID NO: 123552

SEQ ID NO: 604219 - RNA, 64 nt, hsa; identical to SEQ ID NO: 123553

SEQ ID NO: 604220 - RNA, 64 nt, hsa; identical to SEQ ID NO: 123554

SEQ ID NO: 604221 - RNA, 64 nt, hsa; identical to SEQ ID NO: 123555

SEQ ID NO: 604222 - RNA, 64 nt, hsa; identical to SEQ ID NO: 123556

SEQ ID NO: 604223 - RNA, 64 nt, hsa; identical to SEQ ID NO: 123557

SEQ ID NO: 604224 - RNA, 64 nt, hsa; identical to SEQ ID NO: 123558

SEQ ID NO: 604225 - RNA, 64 nt, hsa; identical to SEQ ID NO: 123559

SEQ ID NO: 604226 - RNA, 64 nt, hsa; identical to SEQ ID NO: 123560

SEQ ID NO: 604227 - RNA, 64 nt, hsa; identical to SEQ ID NO: 123561

SEQ ID NO: 604228 - RNA, 64 nt, hsa; identical to SEQ ID NO: 123562

SEQ ID NO: 604229 - RNA, 64 nt, hsa; identical to SEQ ID NO: 123563

SEQ ID NO: 604230 - RNA, 64 nt, hsa; identical to SEQ ID NO: 123564

SEQ ID NO: 604231 - RNA, 64 nt, hsa; identical to SEQ ID NO: 123565

SEQ ID NO: 604232 - RNA, 64 nt, hsa; identical to SEQ ID NO: 123566

SEQ ID NO: 604233 - RNA, 64 nt, hsa; identical to SEQ ID NO: 123567

SEQ ID NO: 604234 - RNA, 64 nt, hsa; identical to SEQ ID NO: 123568

SEQ ID NO: 604235 - RNA, 64 nt, hsa; identical to SEQ ID NO: 123569

SEQ ID NO: 604236 - RNA, 64 nt, hsa; identical to SEQ ID NO: 123570

SEQ ID NO: 604237 - RNA, 64 nt, hsa; identical to SEQ ID NO: 123571

SEQ ID NO: 604238 - RNA, 64 nt, hsa; identical to SEQ ID NO: 123572

SEQ ID NO: 604239 - RNA, 64 nt, hsa; identical to SEQ ID NO: 123573

SEQ ID NO: 604240 - RNA, 64 nt, hsa; identical to SEQ ID NO: 123574

SEQ ID NO: 604241 - RNA, 64 nt, hsa; identical to SEQ ID NO: 123575

SEQ ID NO: 604242 - RNA, 64 nt, hsa; identical to SEQ ID NO: 123576

SEQ ID NO: 604243 - RNA, 64 nt, hsa; identical to SEQ ID NO: 123577

SEQ ID NO: 604244 - RNA, 64 nt, hsa; identical to SEQ ID NO: 123578

SEQ ID NO: 604245 - RNA, 64 nt, hsa; identical to SEQ ID NO: 123579

SEQ ID NO: 604246 - RNA, 64 nt, hsa; identical to SEQ ID NO: 123580

SEQ ID NO: 604247 - RNA, 64 nt, hsa; identical to SEQ ID NO: 123581

SEQ ID NO: 604248 - RNA, 64 nt, hsa; identical to SEQ ID NO: 123582

SEQ ID NO: 604249 - RNA, 64 nt, hsa; identical to SEQ ID NO: 123583

SEQ ID NO: 604250 - RNA, 64 nt, hsa; identical to SEQ ID NO: 123584

SEQ ID NO: 604251 - RNA, 64 nt, hsa; identical to SEQ ID NO: 123585

SEQ ID NO: 604252 - RNA, 64 nt, hsa; identical to SEQ ID NO: 123586

SEQ ID NO: 604253 - RNA, 64 nt, hsa; identical to SEQ ID NO: 123587

SEQ ID NO: 604254 - RNA, 64 nt, hsa; identical to SEQ ID NO: 123588

SEQ ID NO: 604255 - RNA, 64 nt, hsa; identical to SEQ ID NO: 123589

SEQ ID NO: 604256 - RNA, 64 nt, hsa; identical to SEQ ID NO: 123590

SEQ ID NO: 604257 - RNA, 64 nt, hsa; identical to SEQ ID NO: 123591

SEQ ID NO: 604258 - RNA, 64 nt, hsa; identical to SEQ ID NO: 123592

SEQ ID NO: 604259 - RNA, 64 nt, hsa; identical to SEQ ID NO: 123593

SEQ ID NO: 604260 - RNA, 64 nt, hsa; identical to SEQ ID NO: 123594

SEQ ID NO: 604261 - RNA, 64 nt, hsa; identical to SEQ ID NO: 123595

SEQ ID NO: 604262 - RNA, 64 nt, hsa; identical to SEQ ID NO: 123596

SEQ ID NO: 604263 - RNA, 64 nt, hsa; identical to SEQ ID NO: 123597

SEQ ID NO: 604264 - RNA, 64 nt, hsa; identical to SEQ ID NO: 123598

SEQ ID NO: 604265 - RNA, 64 nt, hsa; identical to SEQ ID NO: 123599

SEQ ID NO: 604266 - RNA, 64 nt, hsa; identical to SEQ ID NO: 123600

SEQ ID NO: 604267 - RNA, 64 nt, hsa; identical to SEQ ID NO: 123601

SEQ ID NO: 604268 - RNA, 64 nt, hsa
gauucaccgcgugcucugcgcggccgaggccggagcaccacauccaccucgccccagagaggcu

SEQ ID NO: 604269 - RNA, 64 nt, hsa
gggugguggggacggcaguggugaugaagggggugcaccacaggccucaugaagcaguucccac

SEQ ID NO: 604270 - RNA, 64 nt, hsa
ccaccccaaaucaacagaauauacauucuucucagcaccacaucacacuuauuuccacauugac

SEQ ID NO: 604271 - RNA, 64 nt, hsa
uucggaaugccugcuuaccucuuuuucuguagaggcaccacagggaggugggugaagcacuucg

SEQ ID NO: 604272 - RNA, 64 nt, hsa
uacuaccuuuuaaaauauuuuagauaaaugcacagcaccacagcaccacaucuaagcauuagug

SEQ ID NO: 604273 - RNA, 64 nt, hsa
uuuaaaauauuuuagauaaaugcacagcaccacagcaccacaucuaagcauuagugauggguag

SEQ ID NO: 604274 - RNA, 64 nt, hsa
acucucucuucuccuuccuaacccuuugucuagagcaccacaccgcucacaaacucuuuccaaa

SEQ ID NO: 604275 - RNA, 64 nt, hsa
cucacaggaacuguucaguucccacccucagugggcaccacacaccccacuuccagcagagucc

SEQ ID NO: 604276 - RNA, 64 nt, hsa
gauccuuccgguggagugucggagaagagagcuugccgacgaugccuuccugugcagagcuugg

SEQ ID NO: 604277 - RNA, 64 nt, hsa
cgcgcugaacgaggccaagcagaugaucgccgucgccgacgagaaccagaaccaccaccuggag

SEQ ID NO: 604278 - RNA, 64 nt, hsa
ugucucaaccucccaaguaggauuacaagcaugcgccgacgaugcccagaauccagaacuuugu

SEQ ID NO: 604279 - RNA, 64 nt, hsa
gcugcucacccugcggcacgugguggacgagggugccgacgaguacaaggucaucaugcuccac

SEQ ID NO: 604280 - RNA, 64 nt, hsa
gaugcagggacgcgcgacgccggccccggucgcagccgacgacgccgccgccagccugaccuca

SEQ ID NO: 604281 - RNA, 64 nt, hsa
cugccauuccacccauggucccucacccugcccugccgacgagcuugucucugcagccccaggu

SEQ ID NO: 604282 - RNA, 64 nt, hsa
cugauuggcaucacauugaucuagaacugguccagccgacgaagaguaggaaaagagaagggcu

SEQ ID NO: 604283 - RNA, 64 nt, hsa
cauggccgaggagacaaggcagaagcaacuucuggccgacgagaagaugaagcagcucacagag

SEQ ID NO: 604284 - RNA, 64 nt, hsa
cuaccaguuugcuaaguacagaucauucaagguggccgacgaggcggagaaguacaaucugguc

SEQ ID NO: 604285 - RNA, 64 nt, hsa
gacuaacuccugcaacuggaaagcgggggcgcccgccgacgaggaggccaccgugccaagccgg

SEQ ID NO: 604286 - RNA, 64 nt, hsa
ccuacacaggggcauugacagacuggaguugaaagccgacgaaccgacacgcggcagagucaau

SEQ ID NO: 604287 - RNA, 64 nt, hsa
ccguggcccucggccuccagauggccacaccucugccgacgacggaccagcucccucucccuuc

SEQ ID NO: 604288 - RNA, 64 nt, hsa
ggaaaagcagaggaagguggaggucuacgcagaugccgacgaaauccuccaggaggagaucaag

SEQ ID NO: 604289 - RNA, 64 nt, hsa
ugcaagcauugaagcccacgcucugagucucagcgccgacgagaccauggaagagccaucuguc

SEQ ID NO: 604290 - RNA, 64 nt, hsa
guccagcaacgaggaugagggcagcagcuccgaggccgacgagauggccaaggcgcuggaggcg

SEQ ID NO: 604291 - RNA, 64 nt, hsa
ggggcugugacccucuucccccaggcccuccccagccgacgacagccaccggagaggagaucgg

SEQ ID NO: 604292 - RNA, 64 nt, hsa
cgugacuggggcaacgccucguccugcagagggagccgacgaccucuuuucugcagaaaagcuc

SEQ ID NO: 604293 - RNA, 64 nt, hsa
uaucgccagccguugcuuuguuacugaacgugccgccgacgaccucagaaaacccagaugggug

SEQ ID NO: 604294 - RNA, 64 nt, hsa
uagagaauccaugucgcucugacaccccaaggaagccgacgauccaaaugccgugugucaccaa

SEQ ID NO: 604295 - RNA, 64 nt, hsa
aaaaugugugaaauggaaaguugauggcagcagggccgacgaugucaccuggugccucgcgggc

SEQ ID NO: 604296 - RNA, 64 nt, hsa
uuauggaaccaagaaaacaaguaaacaugcagcugccgacgaggcuuugaaaauucuucaaaaa

SEQ ID NO: 604297 - RNA, 64 nt, hsa
aucucuuuggacaguggccacccugcacaauggggccgacgaggccuagggcccuccuaccugc

SEQ ID NO: 604298 - RNA, 64 nt, hsa; identical to SEQ ID NO: 333540

SEQ ID NO: 604299 - RNA, 64 nt, hsa; identical to SEQ ID NO: 333541

SEQ ID NO: 604300 - RNA, 64 nt, hsa; identical to SEQ ID NO: 333542

SEQ ID NO: 604301 - RNA, 64 nt, hsa; identical to SEQ ID NO: 333543

SEQ ID NO: 604302 - RNA, 64 nt, hsa; identical to SEQ ID NO: 333544

SEQ ID NO: 604303 - RNA, 64 nt, hsa; identical to SEQ ID NO: 333545

SEQ ID NO: 604304 - RNA, 54 nt, hsa; identical to SEQ ID NO: 333546

SEQ ID NO: 604305 - RNA, 64 nt, hsa; identical to SEQ ID NO: 333547

SEQ ID NO: 604306 - RNA, 60 nt, hsa; identical to SEQ ID NO: 333548

SEQ ID NO: 604307 - RNA, 64 nt, hsa; identical to SEQ ID NO: 333549

SEQ ID NO: 604308 - RNA, 64 nt, hsa; identical to SEQ ID NO: 333550

SEQ ID NO: 604309 - RNA, 64 nt, hsa; identical to SEQ ID NO: 333551

SEQ ID NO: 604310 - RNA, 64 nt, hsa; identical to SEQ ID NO: 333552

SEQ ID NO: 604311 - RNA, 64 nt, hsa; identical to SEQ ID NO: 333553

SEQ ID NO: 604312 - RNA, 64 nt, hsa; identical to SEQ ID NO: 333554

SEQ ID NO: 604313 - RNA, 64 nt, hsa; identical to SEQ ID NO: 333555

SEQ ID NO: 604314 - RNA, 64 nt, hsa; identical to SEQ ID NO: 333556

SEQ ID NO: 604315 - RNA, 64 nt, hsa; identical to SEQ ID NO: 333557

SEQ ID NO: 604316 - RNA, 64 nt, hsa; identical to SEQ ID NO: 333558

SEQ ID NO: 604317 - RNA, 64 nt, hsa; identical to SEQ ID NO: 333559

SEQ ID NO: 604318 - RNA, 64 nt, hsa; identical to SEQ ID NO: 333560

SEQ ID NO: 604319 - RNA, 64 nt, hsa; identical to SEQ ID NO: 333561

SEQ ID NO: 604320 - RNA, 64 nt, hsa; identical to SEQ ID NO: 333562

SEQ ID NO: 604321 - RNA, 64 nt, hsa; identical to SEQ ID NO: 333563

SEQ ID NO: 604322 - RNA, 64 nt, hsa; identical to SEQ ID NO: 333564

SEQ ID NO: 604323 - RNA, 64 nt, hsa; identical to SEQ ID NO: 333565

SEQ ID NO: 604324 - RNA, 64 nt, hsa; identical to SEQ ID NO: 333566

SEQ ID NO: 604325 - RNA, 64 nt, hsa; identical to SEQ ID NO: 333567

SEQ ID NO: 604326 - RNA, 64 nt, hsa; identical to SEQ ID NO: 333568

SEQ ID NO: 604327 - RNA, 64 nt, hsa; identical to SEQ ID NO: 333569

SEQ ID NO: 604328 - RNA, 64 nt, hsa; identical to SEQ ID NO: 333570

SEQ ID NO: 604329 - RNA, 64 nt, hsa; identical to SEQ ID NO: 333571

SEQ ID NO: 604330 - RNA, 64 nt, hsa; identical to SEQ ID NO: 333572

SEQ ID NO: 604331 - RNA, 64 nt, hsa; identical to SEQ ID NO: 333573

SEQ ID NO: 604332 - RNA, 64 nt, hsa; identical to SEQ ID NO: 333574

SEQ ID NO: 604333 - RNA, 64 nt, hsa; identical to SEQ ID NO: 333575

SEQ ID NO: 604334 - RNA, 64 nt, hsa; identical to SEQ ID NO: 333576

SEQ ID NO: 604335 - RNA, 64 nt, hsa; identical to SEQ ID NO: 333577

SEQ ID NO: 604336 - RNA, 64 nt, hsa; identical to SEQ ID NO: 333578

SEQ ID NO: 604337 - RNA, 64 nt, hsa; identical to SEQ ID NO: 333579

SEQ ID NO: 604338 - RNA, 64 nt, hsa; identical to SEQ ID NO: 333580

SEQ ID NO: 604339 - RNA, 64 nt, hsa; identical to SEQ ID NO: 333581

SEQ ID NO: 604340 - RNA, 64 nt, hsa; identical to SEQ ID NO: 333582

SEQ ID NO: 604341 - RNA, 64 nt, hsa; identical to SEQ ID NO: 333583

SEQ ID NO: 604342 - RNA, 64 nt, hsa; identical to SEQ ID NO: 333584

SEQ ID NO: 604343 - RNA, 64 nt, hsa; identical to SEQ ID NO: 333585

SEQ ID NO: 604344 - RNA, 64 nt, hsa; identical to SEQ ID NO: 333586

SEQ ID NO: 604345 - RNA, 64 nt, hsa; identical to SEQ ID NO: 333587

SEQ ID NO: 604346 - RNA, 64 nt, hsa; identical to SEQ ID NO: 333588

SEQ ID NO: 604347 - RNA, 64 nt, hsa; identical to SEQ ID NO: 333589

SEQ ID NO: 604348 - RNA, 64 nt, hsa; identical to SEQ ID NO: 333590

SEQ ID NO: 604349 - RNA, 64 nt, hsa; identical to SEQ ID NO: 52979

SEQ ID NO: 604350 - RNA, 64 nt, hsa; identical to SEQ ID NO: 52980

SEQ ID NO: 604351 - RNA, 64 nt, hsa; identical to SEQ ID NO: 52981

SEQ ID NO: 604352 - RNA, 64 nt, hsa; identical to SEQ ID NO: 52982

SEQ ID NO: 604353 - RNA, 64 nt, hsa; identical to SEQ ID NO: 52983

SEQ ID NO: 604354 - RNA, 64 nt, hsa; identical to SEQ ID NO: 52984

SEQ ID NO: 604355 - RNA, 64 nt, hsa; identical to SEQ ID NO: 52985

SEQ ID NO: 604356 - RNA, 64 nt, hsa; identical to SEQ ID NO: 52986

SEQ ID NO: 604357 - RNA, 64 nt, hsa; identical to SEQ ID NO: 52987

SEQ ID NO: 604358 - RNA, 64 nt, hsa; identical to SEQ ID NO: 52988

SEQ ID NO: 604359 - RNA, 64 nt, hsa; identical to SEQ ID NO: 52989

SEQ ID NO: 604360 - RNA, 64 nt, hsa; identical to SEQ ID NO: 52990

SEQ ID NO: 604361 - RNA, 64 nt, hsa; identical to SEQ ID NO: 52991

SEQ ID NO: 604362 - RNA, 64 nt, hsa; identical to SEQ ID NO: 52992

SEQ ID NO: 604363 - RNA, 64 nt, hsa; identical to SEQ ID NO: 52993

SEQ ID NO: 604364 - RNA, 64 nt, hsa; identical to SEQ ID NO: 52994

SEQ ID NO: 604365 - RNA, 64 nt, hsa; identical to SEQ ID NO: 52995

SEQ ID NO: 604366 - RNA, 64 nt, hsa; identical to SEQ ID NO: 52996

SEQ ID NO: 604367 - RNA, 64 nt, hsa; identical to SEQ ID NO: 52997

SEQ ID NO: 604368 - RNA, 64 nt, hsa; identical to SEQ ID NO: 52998

SEQ ID NO: 604369 - RNA, 64 nt, hsa; identical to SEQ ID NO: 52999

SEQ ID NO: 604370 - RNA, 64 nt, hsa; identical to SEQ ID NO: 53000

SEQ ID NO: 604371 - RNA, 64 nt, hsa; identical to SEQ ID NO: 53001

SEQ ID NO: 604372 - RNA, 64 nt, hsa; identical to SEQ ID NO: 53002

SEQ ID NO: 604373 - RNA, 64 nt, hsa; identical to SEQ ID NO: 53003

SEQ ID NO: 604374 - RNA, 64 nt, hsa; identical to SEQ ID NO: 53004

SEQ ID NO: 604375 - RNA, 59 nt, hsa; identical to SEQ ID NO: 53005

SEQ ID NO: 604376 - RNA, 64 nt, hsa; identical to SEQ ID NO: 53006

SEQ ID NO: 604377 - RNA, 64 nt, hsa; identical to SEQ ID NO: 53007

SEQ ID NO: 604378 - RNA, 64 nt, hsa; identical to SEQ ID NO: 53008

SEQ ID NO: 604379 - RNA, 64 nt, hsa; identical to SEQ ID NO: 53009

SEQ ID NO: 604380 - RNA, 64 nt, hsa; identical to SEQ ID NO: 53010

SEQ ID NO: 604381 - RNA, 64 nt, hsa; identical to SEQ ID NO: 53011

SEQ ID NO: 604382 - RNA, 64 nt, hsa; identical to SEQ ID NO: 53012

SEQ ID NO: 604383 - RNA, 64 nt, hsa; identical to SEQ ID NO: 53013

SEQ ID NO: 604384 - RNA, 64 nt, hsa; identical to SEQ ID NO: 53014

SEQ ID NO: 604385 - RNA, 64 nt, hsa; identical to SEQ ID NO: 53015

SEQ ID NO: 604386 - RNA, 64 nt, hsa; identical to SEQ ID NO: 53016

SEQ ID NO: 604387 - RNA, 64 nt, hsa; identical to SEQ ID NO: 53017

SEQ ID NO: 604388 - RNA, 64 nt, hsa; identical to SEQ ID NO: 217679

SEQ ID NO: 604389 - RNA, 64 nt, hsa; identical to SEQ ID NO: 217680

SEQ ID NO: 604390 - RNA, 64 nt, hsa; identical to SEQ ID NO: 217681

SEQ ID NO: 604391 - RNA, 64 nt, hsa; identical to SEQ ID NO: 217682

SEQ ID NO: 604392 - RNA, 64 nt, hsa; identical to SEQ ID NO: 217683

SEQ ID NO: 604393 - RNA, 64 nt, hsa; identical to SEQ ID NO: 217684

SEQ ID NO: 604394 - RNA, 64 nt, hsa; identical to SEQ ID NO: 217685

SEQ ID NO: 604395 - RNA, 64 nt, hsa; identical to SEQ ID NO: 217686

SEQ ID NO: 604396 - RNA, 64 nt, hsa; identical to SEQ ID NO: 217687

SEQ ID NO: 604397 - RNA, 64 nt, hsa; identical to SEQ ID NO: 217688

SEQ ID NO: 604398 - RNA, 64 nt, hsa; identical to SEQ ID NO: 217689

SEQ ID NO: 604399 - RNA, 64 nt, hsa; identical to SEQ ID NO: 217690

SEQ ID NO: 604400 - RNA, 64 nt, hsa; identical to SEQ ID NO: 217691

SEQ ID NO: 604401 - RNA, 64 nt, hsa; identical to SEQ ID NO: 217692

SEQ ID NO: 604402 - RNA, 64 nt, hsa; identical to SEQ ID NO: 217693

SEQ ID NO: 604403 - RNA, 64 nt, hsa; identical to SEQ ID NO: 217694

SEQ ID NO: 604404 - RNA, 64 nt, hsa; identical to SEQ ID NO: 217695

SEQ ID NO: 604405 - RNA, 64 nt, hsa; identical to SEQ ID NO: 217696

SEQ ID NO: 604406 - RNA, 64 nt, hsa; identical to SEQ ID NO: 217697

SEQ ID NO: 604407 - RNA, 64 nt, hsa; identical to SEQ ID NO: 217698

SEQ ID NO: 604408 - RNA, 64 nt, hsa; identical to SEQ ID NO: 217699

SEQ ID NO: 604409 - RNA, 64 nt, hsa; identical to SEQ ID NO: 217700

SEQ ID NO: 604410 - RNA, 64 nt, hsa; identical to SEQ ID NO: 217701

SEQ ID NO: 604411 - RNA, 64 nt, hsa; identical to SEQ ID NO: 217702

SEQ ID NO: 604412 - RNA, 64 nt, hsa; identical to SEQ ID NO: 217703

SEQ ID NO: 604413 - RNA, 64 nt, hsa; identical to SEQ ID NO: 217704

SEQ ID NO: 604414 - RNA, 64 nt, hsa; identical to SEQ ID NO: 217705

SEQ ID NO: 604415 - RNA, 64 nt, hsa; identical to SEQ ID NO: 217706

SEQ ID NO: 604416 - RNA, 64 nt, hsa; identical to SEQ ID NO: 217707

SEQ ID NO: 604417 - RNA, 64 nt, hsa; identical to SEQ ID NO: 217708

SEQ ID NO: 604418 - RNA, 64 nt, hsa; identical to SEQ ID NO: 217709

SEQ ID NO: 604419 - RNA, 64 nt, hsa; identical to SEQ ID NO: 217710

SEQ ID NO: 604420 - RNA, 64 nt, hsa; identical to SEQ ID NO: 217711

SEQ ID NO: 604421 - RNA, 64 nt, hsa; identical to SEQ ID NO: 217712

SEQ ID NO: 604422 - RNA, 64 nt, hsa; identical to SEQ ID NO: 217713

SEQ ID NO: 604423 - RNA, 58 nt, hsa; identical to SEQ ID NO: 217714

SEQ ID NO: 604424 - RNA, 64 nt, hsa; identical to SEQ ID NO: 217715

SEQ ID NO: 604425 - RNA, 64 nt, hsa; identical to SEQ ID NO: 217716

SEQ ID NO: 604426 - RNA, 64 nt, hsa; identical to SEQ ID NO: 217717

SEQ ID NO: 604427 - RNA, 64 nt, hsa; identical to SEQ ID NO: 217718

SEQ ID NO: 604428 - RNA, 64 nt, hsa; identical to SEQ ID NO: 217719

SEQ ID NO: 604429 - RNA, 64 nt, hsa; identical to SEQ ID NO: 217720

SEQ ID NO: 604430 - RNA, 64 nt, hsa; identical to SEQ ID NO: 217721

SEQ ID NO: 604431 - RNA, 64 nt, hsa; identical to SEQ ID NO: 217722

SEQ ID NO: 604432 - RNA, 64 nt, hsa; identical to SEQ ID NO: 217723

SEQ ID NO: 604433 - RNA, 64 nt, hsa; identical to SEQ ID NO: 217724

SEQ ID NO: 604434 - RNA, 64 nt, hsa; identical to SEQ ID NO: 217725

SEQ ID NO: 604435 - RNA, 64 nt, hsa; identical to SEQ ID NO: 217726

SEQ ID NO: 604436 - RNA, 64 nt, hsa; identical to SEQ ID NO: 217727

SEQ ID NO: 604437 - RNA, 64 nt, hsa; identical to SEQ ID NO: 217728

SEQ ID NO: 604438 - RNA, 64 nt, hsa; identical to SEQ ID NO: 217729

SEQ ID NO: 604439 - RNA, 64 nt, hsa; identical to SEQ ID NO: 217730

SEQ ID NO: 604440 - RNA, 64 nt, hsa; identical to SEQ ID NO: 217731

SEQ ID NO: 604441 - RNA, 64 nt, hsa; identical to SEQ ID NO: 217732

SEQ ID NO: 604442 - RNA, 64 nt, hsa; identical to SEQ ID NO: 217733

SEQ ID NO: 604443 - RNA, 64 nt, hsa; identical to SEQ ID NO: 217734

SEQ ID NO: 604444 - RNA, 64 nt, hsa; identical to SEQ ID NO: 217735

SEQ ID NO: 604445 - RNA, 64 nt, hsa; identical to SEQ ID NO: 217736

SEQ ID NO: 604446 - RNA, 64 nt, hsa; identical to SEQ ID NO: 217737

SEQ ID NO: 604447 - RNA, 64 nt, hsa; identical to SEQ ID NO: 217738

SEQ ID NO: 604448 - RNA, 64 nt, hsa; identical to SEQ ID NO: 217739

SEQ ID NO: 604449 - RNA, 64 nt, hsa; identical to SEQ ID NO: 217740

SEQ ID NO: 604450 - RNA, 64 nt, hsa; identical to SEQ ID NO: 217741

SEQ ID NO: 604451 - RNA, 64 nt, hsa; identical to SEQ ID NO: 217742

SEQ ID NO: 604452 - RNA, 64 nt, hsa; identical to SEQ ID NO: 217743

SEQ ID NO: 604453 - RNA, 64 nt, hsa; identical to SEQ ID NO: 217744

SEQ ID NO: 604454 - RNA, 64 nt, hsa; identical to SEQ ID NO: 217745

SEQ ID NO: 604455 - RNA, 64 nt, hsa; identical to SEQ ID NO: 217746

SEQ ID NO: 604456 - RNA, 64 nt, hsa; identical to SEQ ID NO: 217747

SEQ ID NO: 604457 - RNA, 64 nt, hsa; identical to SEQ ID NO: 217748

SEQ ID NO: 604458 - RNA, 64 nt, hsa; identical to SEQ ID NO: 217749

SEQ ID NO: 604459 - RNA, 64 nt, hsa; identical to SEQ ID NO: 217750

SEQ ID NO: 604460 - RNA, 64 nt, hsa; identical to SEQ ID NO: 217751

SEQ ID NO: 604461 - RNA, 64 nt, hsa; identical to SEQ ID NO: 217752

SEQ ID NO: 604462 - RNA, 64 nt, hsa; identical to SEQ ID NO: 217753

SEQ ID NO: 604463 - RNA, 64 nt, hsa; identical to SEQ ID NO: 217754

SEQ ID NO: 604464 - RNA, 64 nt, hsa; identical to SEQ ID NO: 217755

SEQ ID NO: 604465 - RNA, 64 nt, hsa; identical to SEQ ID NO: 217756

SEQ ID NO: 604466 - RNA, 64 nt, hsa; identical to SEQ ID NO: 217757

SEQ ID NO: 604467 - RNA, 64 nt, hsa; identical to SEQ ID NO: 217758

SEQ ID NO: 604468 - RNA, 64 nt, hsa; identical to SEQ ID NO: 217759

SEQ ID NO: 604469 - RNA, 64 nt, hsa; identical to SEQ ID NO: 217760

SEQ ID NO: 604470 - RNA, 64 nt, hsa; identical to SEQ ID NO: 217761

SEQ ID NO: 604471 - RNA, 64 nt, hsa; identical to SEQ ID NO: 217762

SEQ ID NO: 604472 - RNA, 64 nt, hsa; identical to SEQ ID NO: 217763

SEQ ID NO: 604473 - RNA, 64 nt, hsa; identical to SEQ ID NO: 217764

SEQ ID NO: 604474 - RNA, 64 nt, hsa; identical to SEQ ID NO: 217765

SEQ ID NO: 604475 - RNA, 64 nt, hsa; identical to SEQ ID NO: 217766

SEQ ID NO: 604476 - RNA, 64 nt, hsa; identical to SEQ ID NO: 217767

SEQ ID NO: 604477 - RNA, 64 nt, hsa; identical to SEQ ID NO: 217768

SEQ ID NO: 604478 - RNA, 64 nt, hsa; identical to SEQ ID NO: 217769

SEQ ID NO: 604479 - RNA, 64 nt, hsa; identical to SEQ ID NO: 217770

SEQ ID NO: 604480 - RNA, 64 nt, hsa; identical to SEQ ID NO: 217771

SEQ ID NO: 604481 - RNA, 64 nt, hsa; identical to SEQ ID NO: 217772

SEQ ID NO: 604482 - RNA, 64 nt, hsa; identical to SEQ ID NO: 217773

SEQ ID NO: 604483 - RNA, 64 nt, hsa; identical to SEQ ID NO: 217774

SEQ ID NO: 604484 - RNA, 64 nt, hsa; identical to SEQ ID NO: 217775

SEQ ID NO: 604485 - RNA, 64 nt, hsa; identical to SEQ ID NO: 217776

SEQ ID NO: 604486 - RNA, 64 nt, hsa; identical to SEQ ID NO: 217777

SEQ ID NO: 604487 - RNA, 64 nt, hsa; identical to SEQ ID NO: 217778

SEQ ID NO: 604488 - RNA, 64 nt, hsa; identical to SEQ ID NO: 217779

SEQ ID NO: 604489 - RNA, 64 nt, hsa; identical to SEQ ID NO: 217780

SEQ ID NO: 604490 - RNA, 64 nt, hsa; identical to SEQ ID NO: 217781

SEQ ID NO: 604491 - RNA, 64 nt, hsa; identical to SEQ ID NO: 217782

SEQ ID NO: 604492 - RNA, 64 nt, hsa; identical to SEQ ID NO: 217783

SEQ ID NO: 604493 - RNA, 64 nt, hsa; identical to SEQ ID NO: 217784

SEQ ID NO: 604494 - RNA, 64 nt, hsa; identical to SEQ ID NO: 217785

SEQ ID NO: 604495 - RNA, 64 nt, hsa; identical to SEQ ID NO: 217786

SEQ ID NO: 604496 - RNA, 64 nt, hsa; identical to SEQ ID NO: 217787

SEQ ID NO: 604497 - RNA, 64 nt, hsa; identical to SEQ ID NO: 217788

SEQ ID NO: 604498 - RNA, 64 nt, hsa; identical to SEQ ID NO: 217789

SEQ ID NO: 604499 - RNA, 64 nt, hsa; identical to SEQ ID NO: 217790

SEQ ID NO: 604500 - RNA, 64 nt, hsa; identical to SEQ ID NO: 217791

SEQ ID NO: 604501 - RNA, 64 nt, hsa; identical to SEQ ID NO: 217792

SEQ ID NO: 604502 - RNA, 64 nt, hsa; identical to SEQ ID NO: 217793

SEQ ID NO: 604503 - RNA, 64 nt, hsa; identical to SEQ ID NO: 217794

SEQ ID NO: 604504 - RNA, 64 nt, hsa; identical to SEQ ID NO: 50725

SEQ ID NO: 604505 - RNA, 64 nt, hsa; identical to SEQ ID NO: 50726

SEQ ID NO: 604506 - RNA, 64 nt, hsa; identical to SEQ ID NO: 50727

SEQ ID NO: 604507 - RNA, 64 nt, hsa; identical to SEQ ID NO: 50728

SEQ ID NO: 604508 - RNA, 64 nt, hsa; identical to SEQ ID NO: 50729

SEQ ID NO: 604509 - RNA, 64 nt, hsa; identical to SEQ ID NO: 50730

SEQ ID NO: 604510 - RNA, 64 nt, hsa; identical to SEQ ID NO: 50731

SEQ ID NO: 604511 - RNA, 64 nt, hsa; identical to SEQ ID NO: 50732

SEQ ID NO: 604512 - RNA, 64 nt, hsa; identical to SEQ ID NO: 50733

SEQ ID NO: 604513 - RNA, 64 nt, hsa; identical to SEQ ID NO: 50734

SEQ ID NO: 604514 - RNA, 51 nt, hsa; identical to SEQ ID NO: 50735

SEQ ID NO: 604515 - RNA, 64 nt, hsa; identical to SEQ ID NO: 50736

SEQ ID NO: 604516 - RNA, 64 nt, hsa; identical to SEQ ID NO: 50737

SEQ ID NO: 604517 - RNA, 64 nt, hsa; identical to SEQ ID NO: 50738

SEQ ID NO: 604518 - RNA, 64 nt, hsa; identical to SEQ ID NO: 217679

SEQ ID NO: 604519 - RNA, 64 nt, hsa; identical to SEQ ID NO: 217680

SEQ ID NO: 604520 - RNA, 64 nt, hsa; identical to SEQ ID NO: 217681

SEQ ID NO: 604521 - RNA, 64 nt, hsa; identical to SEQ ID NO: 217682

SEQ ID NO: 604522 - RNA, 64 nt, hsa; identical to SEQ ID NO: 217683

SEQ ID NO: 604523 - RNA, 64 nt, hsa; identical to SEQ ID NO: 217684

SEQ ID NO: 604524 - RNA, 64 nt, hsa; identical to SEQ ID NO: 217685

SEQ ID NO: 604525 - RNA, 64 nt, hsa; identical to SEQ ID NO: 217686

SEQ ID NO: 604526 - RNA, 64 nt, hsa; identical to SEQ ID NO: 217687

SEQ ID NO: 604527 - RNA, 64 nt, hsa; identical to SEQ ID NO: 217688

SEQ ID NO: 604528 - RNA, 64 nt, hsa; identical to SEQ ID NO: 217689

SEQ ID NO: 604529 - RNA, 64 nt, hsa; identical to SEQ ID NO: 217690

SEQ ID NO: 604530 - RNA, 64 nt, hsa; identical to SEQ ID NO: 217691

SEQ ID NO: 604531 - RNA, 64 nt, hsa; identical to SEQ ID NO: 217692

SEQ ID NO: 604532 - RNA, 64 nt, hsa; identical to SEQ ID NO: 217693

SEQ ID NO: 604533 - RNA, 64 nt, hsa; identical to SEQ ID NO: 217694

SEQ ID NO: 604534 - RNA, 64 nt, hsa; identical to SEQ ID NO: 217695

SEQ ID NO: 604535 - RNA, 64 nt, hsa; identical to SEQ ID NO: 217696

SEQ ID NO: 604536 - RNA, 64 nt, hsa; identical to SEQ ID NO: 217697

SEQ ID NO: 604537 - RNA, 64 nt, hsa; identical to SEQ ID NO: 217698

SEQ ID NO: 604538 - RNA, 64 nt, hsa; identical to SEQ ID NO: 217699

SEQ ID NO: 604539 - RNA, 64 nt, hsa; identical to SEQ ID NO: 217700

SEQ ID NO: 604540 - RNA, 64 nt, hsa; identical to SEQ ID NO: 217701

SEQ ID NO: 604541 - RNA, 64 nt, hsa; identical to SEQ ID NO: 217702

SEQ ID NO: 604542 - RNA, 64 nt, hsa; identical to SEQ ID NO: 217703

SEQ ID NO: 604543 - RNA, 64 nt, hsa; identical to SEQ ID NO: 217704

SEQ ID NO: 604544 - RNA, 64 nt, hsa; identical to SEQ ID NO: 217705

SEQ ID NO: 604545 - RNA, 64 nt, hsa; identical to SEQ ID NO: 217706

SEQ ID NO: 604546 - RNA, 64 nt, hsa; identical to SEQ ID NO: 217707

SEQ ID NO: 604547 - RNA, 64 nt, hsa; identical to SEQ ID NO: 217708

SEQ ID NO: 604548 - RNA, 64 nt, hsa; identical to SEQ ID NO: 217709

SEQ ID NO: 604549 - RNA, 64 nt, hsa; identical to SEQ ID NO: 217710

SEQ ID NO: 604550 - RNA, 64 nt, hsa; identical to SEQ ID NO: 217711

SEQ ID NO: 604551 - RNA, 64 nt, hsa; identical to SEQ ID NO: 217712

SEQ ID NO: 604552 - RNA, 64 nt, hsa; identical to SEQ ID NO: 217713

SEQ ID NO: 604553 - RNA, 58 nt, hsa; identical to SEQ ID NO: 217714

SEQ ID NO: 604554 - RNA, 64 nt, hsa; identical to SEQ ID NO: 217715

SEQ ID NO: 604555 - RNA, 64 nt, hsa; identical to SEQ ID NO: 217716

SEQ ID NO: 604556 - RNA, 64 nt, hsa; identical to SEQ ID NO: 217717

SEQ ID NO: 604557 - RNA, 64 nt, hsa; identical to SEQ ID NO: 217718

SEQ ID NO: 604558 - RNA, 64 nt, hsa; identical to SEQ ID NO: 217719

SEQ ID NO: 604559 - RNA, 64 nt, hsa; identical to SEQ ID NO: 217720

SEQ ID NO: 604560 - RNA, 64 nt, hsa; identical to SEQ ID NO: 217721

SEQ ID NO: 604561 - RNA, 64 nt, hsa; identical to SEQ ID NO: 217722

SEQ ID NO: 604562 - RNA, 64 nt, hsa; identical to SEQ ID NO: 217723

SEQ ID NO: 604563 - RNA, 64 nt, hsa; identical to SEQ ID NO: 217724

SEQ ID NO: 604564 - RNA, 64 nt, hsa; identical to SEQ ID NO: 217725

SEQ ID NO: 604565 - RNA, 64 nt, hsa; identical to SEQ ID NO: 217726

SEQ ID NO: 604566 - RNA, 64 nt, hsa; identical to SEQ ID NO: 217727

SEQ ID NO: 604567 - RNA, 64 nt, hsa; identical to SEQ ID NO: 217728

SEQ ID NO: 604568 - RNA, 64 nt, hsa; identical to SEQ ID NO: 217729

SEQ ID NO: 604569 - RNA, 64 nt, hsa; identical to SEQ ID NO: 217730

SEQ ID NO: 604570 - RNA, 64 nt, hsa; identical to SEQ ID NO: 217731

SEQ ID NO: 604571 - RNA, 64 nt, hsa; identical to SEQ ID NO: 217732

SEQ ID NO: 604572 - RNA, 64 nt, hsa; identical to SEQ ID NO: 217733

SEQ ID NO: 604573 - RNA, 64 nt, hsa; identical to SEQ ID NO: 217734

SEQ ID NO: 604574 - RNA, 64 nt, hsa; identical to SEQ ID NO: 217735

SEQ ID NO: 604575 - RNA, 64 nt, hsa; identical to SEQ ID NO: 217736

SEQ ID NO: 604576 - RNA, 64 nt, hsa; identical to SEQ ID NO: 217737

SEQ ID NO: 604577 - RNA, 64 nt, hsa; identical to SEQ ID NO: 217738

SEQ ID NO: 604578 - RNA, 64 nt, hsa; identical to SEQ ID NO: 217739

SEQ ID NO: 604579 - RNA, 64 nt, hsa; identical to SEQ ID NO: 217740

SEQ ID NO: 604580 - RNA, 64 nt, hsa; identical to SEQ ID NO: 217741

SEQ ID NO: 604581 - RNA, 64 nt, hsa; identical to SEQ ID NO: 217742

SEQ ID NO: 604582 - RNA, 64 nt, hsa; identical to SEQ ID NO: 217743

SEQ ID NO: 604583 - RNA, 64 nt, hsa; identical to SEQ ID NO: 217744

SEQ ID NO: 604584 - RNA, 64 nt, hsa; identical to SEQ ID NO: 217745

SEQ ID NO: 604585 - RNA, 64 nt, hsa; identical to SEQ ID NO: 217746

SEQ ID NO: 604586 - RNA, 64 nt, hsa; identical to SEQ ID NO: 217747

SEQ ID NO: 604587 - RNA, 64 nt, hsa; identical to SEQ ID NO: 217748

SEQ ID NO: 604588 - RNA, 64 nt, hsa; identical to SEQ ID NO: 217749

SEQ ID NO: 604589 - RNA, 64 nt, hsa; identical to SEQ ID NO: 217750

SEQ ID NO: 604590 - RNA, 64 nt, hsa; identical to SEQ ID NO: 217751

SEQ ID NO: 604591 - RNA, 64 nt, hsa; identical to SEQ ID NO: 217752

SEQ ID NO: 604592 - RNA, 64 nt, hsa; identical to SEQ ID NO: 217753

SEQ ID NO: 604593 - RNA, 64 nt, hsa; identical to SEQ ID NO: 217754

SEQ ID NO: 604594 - RNA, 64 nt, hsa; identical to SEQ ID NO: 217755

SEQ ID NO: 604595 - RNA, 64 nt, hsa; identical to SEQ ID NO: 217756

SEQ ID NO: 604596 - RNA, 64 nt, hsa; identical to SEQ ID NO: 217757

SEQ ID NO: 604597 - RNA, 64 nt, hsa; identical to SEQ ID NO: 217758

SEQ ID NO: 604598 - RNA, 64 nt, hsa; identical to SEQ ID NO: 217759

SEQ ID NO: 604599 - RNA, 64 nt, hsa; identical to SEQ ID NO: 217760

SEQ ID NO: 604600 - RNA, 64 nt, hsa; identical to SEQ ID NO: 217761

SEQ ID NO: 604601 - RNA, 64 nt, hsa; identical to SEQ ID NO: 217762

SEQ ID NO: 604602 - RNA, 64 nt, hsa; identical to SEQ ID NO: 217763

SEQ ID NO: 604603 - RNA, 64 nt, hsa; identical to SEQ ID NO: 217764

SEQ ID NO: 604604 - RNA, 64 nt, hsa; identical to SEQ ID NO: 217765

SEQ ID NO: 604605 - RNA, 64 nt, hsa; identical to SEQ ID NO: 217766

SEQ ID NO: 604606 - RNA, 64 nt, hsa; identical to SEQ ID NO: 217767

SEQ ID NO: 604607 - RNA, 64 nt, hsa; identical to SEQ ID NO: 217768

SEQ ID NO: 604608 - RNA, 64 nt, hsa; identical to SEQ ID NO: 217769

SEQ ID NO: 604609 - RNA, 64 nt, hsa; identical to SEQ ID NO: 217770

SEQ ID NO: 604610 - RNA, 64 nt, hsa; identical to SEQ ID NO: 217771

SEQ ID NO: 604611 - RNA, 64 nt, hsa; identical to SEQ ID NO: 217772

SEQ ID NO: 604612 - RNA, 64 nt, hsa; identical to SEQ ID NO: 217773

SEQ ID NO: 604613 - RNA, 64 nt, hsa; identical to SEQ ID NO: 217774

SEQ ID NO: 604614 - RNA, 64 nt, hsa; identical to SEQ ID NO: 217775

SEQ ID NO: 604615 - RNA, 64 nt, hsa; identical to SEQ ID NO: 217776

SEQ ID NO: 604616 - RNA, 64 nt, hsa; identical to SEQ ID NO: 217777

SEQ ID NO: 604617 - RNA, 64 nt, hsa; identical to SEQ ID NO: 217778

SEQ ID NO: 604618 - RNA, 64 nt, hsa; identical to SEQ ID NO: 217779

SEQ ID NO: 604619 - RNA, 64 nt, hsa; identical to SEQ ID NO: 217780

SEQ ID NO: 604620 - RNA, 64 nt, hsa; identical to SEQ ID NO: 217781

SEQ ID NO: 604621 - RNA, 64 nt, hsa; identical to SEQ ID NO: 217782

SEQ ID NO: 604622 - RNA, 64 nt, hsa; identical to SEQ ID NO: 217783

SEQ ID NO: 604623 - RNA, 64 nt, hsa; identical to SEQ ID NO: 217784

SEQ ID NO: 604624 - RNA, 64 nt, hsa; identical to SEQ ID NO: 217785

SEQ ID NO: 604625 - RNA, 64 nt, hsa; identical to SEQ ID NO: 217786

SEQ ID NO: 604626 - RNA, 64 nt, hsa; identical to SEQ ID NO: 217787

SEQ ID NO: 604627 - RNA, 64 nt, hsa; identical to SEQ ID NO: 217788

SEQ ID NO: 604628 - RNA, 64 nt, hsa; identical to SEQ ID NO: 217789

SEQ ID NO: 604629 - RNA, 64 nt, hsa; identical to SEQ ID NO: 217790

SEQ ID NO: 604630 - RNA, 64 nt, hsa; identical to SEQ ID NO: 217791

SEQ ID NO: 604631 - RNA, 64 nt, hsa; identical to SEQ ID NO: 217792

SEQ ID NO: 604632 - RNA, 64 nt, hsa; identical to SEQ ID NO: 217793

SEQ ID NO: 604633 - RNA, 64 nt, hsa; identical to SEQ ID NO: 217794

SEQ ID NO: 604634 - RNA, 64 nt, hsa; identical to SEQ ID NO: 50725

SEQ ID NO: 604635 - RNA, 64 nt, hsa; identical to SEQ ID NO: 50726

SEQ ID NO: 604636 - RNA, 64 nt, hsa; identical to SEQ ID NO: 50727

SEQ ID NO: 604637 - RNA, 64 nt, hsa; identical to SEQ ID NO: 50728

SEQ ID NO: 604638 - RNA, 64 nt, hsa; identical to SEQ ID NO: 50729

SEQ ID NO: 604639 - RNA, 64 nt, hsa; identical to SEQ ID NO: 50730

SEQ ID NO: 604640 - RNA, 64 nt, hsa; identical to SEQ ID NO: 50731

SEQ ID NO: 604641 - RNA, 64 nt, hsa; identical to SEQ ID NO: 50732

SEQ ID NO: 604642 - RNA, 64 nt, hsa; identical to SEQ ID NO: 50733

SEQ ID NO: 604643 - RNA, 64 nt, hsa; identical to SEQ ID NO: 50734

SEQ ID NO: 604644 - RNA, 51 nt, hsa; identical to SEQ ID NO: 50735

SEQ ID NO: 604645 - RNA, 64 nt, hsa; identical to SEQ ID NO: 50736

SEQ ID NO: 604646 - RNA, 64 nt, hsa; identical to SEQ ID NO: 50737

SEQ ID NO: 604647 - RNA, 64 nt, hsa; identical to SEQ ID NO: 50738

SEQ ID NO: 604648 - RNA, 64 nt, hsa
gcagugguuuuagugggugaaaaugucccaucugcaccaguacacaggcaggcauuaucauucu

SEQ ID NO: 604649 - RNA, 64 nt, hsa
augcauguauuuucuuuuaucuuuggaacaucagcaccaguauauugcuggcagcuauuguauu

SEQ ID NO: 604650 - RNA, 64 nt, hsa
aaaaauacaaaaauuagccgggugugguggcacacaccaguaaucccagcuacucaggaggcug

SEQ ID NO: 604651 - RNA, 64 nt, hsa
ccaaagauguggguggcaaaugccccuauagaaacaccaguaccugaaagcacuguagcccugg

SEQ ID NO: 604652 - RNA, 64 nt, hsa
agaaaaggagagaaaguaacuuuguuugguaaagcaccaguacuccaaccuuccagaaagccga

SEQ ID NO: 604653 - RNA, 64 nt, hsa
guacuuccuaaaaaaacccaaucuucuccccugacaccaguagagaaaugcacuuuugcacuac

SEQ ID NO: 604654 - RNA, 64 nt, hsa; identical to SEQ ID NO: 94836

SEQ ID NO: 604655 - RNA, 64 nt, hsa; identical to SEQ ID NO: 94837

SEQ ID NO: 604656 - RNA, 64 nt, hsa; identical to SEQ ID NO: 94838

SEQ ID NO: 604657 - RNA, 64 nt, hsa; identical to SEQ ID NO: 94839

SEQ ID NO: 604658 - RNA, 64 nt, hsa; identical to SEQ ID NO: 94840

SEQ ID NO: 604659 - RNA, 64 nt, hsa; identical to SEQ ID NO: 94841

SEQ ID NO: 604660 - RNA, 64 nt, hsa; identical to SEQ ID NO: 94842

SEQ ID NO: 604661 - RNA, 52 nt, hsa; identical to SEQ ID NO: 94843

SEQ ID NO: 604662 - RNA, 64 nt, hsa; identical to SEQ ID NO: 94844

SEQ ID NO: 604663 - RNA, 64 nt, hsa; identical to SEQ ID NO: 94845

SEQ ID NO: 604664 - RNA, 64 nt, hsa; identical to SEQ ID NO: 94846

SEQ ID NO: 604665 - RNA, 64 nt, hsa; identical to SEQ ID NO: 94847

SEQ ID NO: 604666 - RNA, 64 nt, hsa; identical to SEQ ID NO: 94848

SEQ ID NO: 604667 - RNA, 64 nt, hsa; identical to SEQ ID NO: 94849

SEQ ID NO: 604668 - RNA, 64 nt, hsa; identical to SEQ ID NO: 109251

SEQ ID NO: 604669 - RNA, 64 nt, hsa; identical to SEQ ID NO: 109252

SEQ ID NO: 604670 - RNA, 64 nt, hsa; identical to SEQ ID NO: 109253

SEQ ID NO: 604671 - RNA, 64 nt, hsa; identical to SEQ ID NO: 109254

SEQ ID NO: 604672 - RNA, 64 nt, hsa; identical to SEQ ID NO: 109255

SEQ ID NO: 604673 - RNA, 64 nt, hsa; identical to SEQ ID NO: 109256

SEQ ID NO: 604674 - RNA, 64 nt, hsa; identical to SEQ ID NO: 179815

SEQ ID NO: 604675 - RNA, 64 nt, hsa; identical to SEQ ID NO: 179816

SEQ ID NO: 604676 - RNA, 64 nt, hsa; identical to SEQ ID NO: 179817

SEQ ID NO: 604677 - RNA, 64 nt, hsa; identical to SEQ ID NO: 179818

SEQ ID NO: 604678 - RNA, 64 nt, hsa; identical to SEQ ID NO: 179819

SEQ ID NO: 604679 - RNA, 64 nt, hsa; identical to SEQ ID NO: 179820

SEQ ID NO: 604680 - RNA, 64 nt, hsa; identical to SEQ ID NO: 179821

SEQ ID NO: 604681 - RNA, 64 nt, hsa; identical to SEQ ID NO: 179822

SEQ ID NO: 604682 - RNA, 64 nt, hsa; identical to SEQ ID NO: 179823

SEQ ID NO: 604683 - RNA, 64 nt, hsa; identical to SEQ ID NO: 179824

SEQ ID NO: 604684 - RNA, 64 nt, hsa; identical to SEQ ID NO: 179825

SEQ ID NO: 604685 - RNA, 64 nt, hsa; identical to SEQ ID NO: 179826

SEQ ID NO: 604686 - RNA, 64 nt, hsa; identical to SEQ ID NO: 179827

SEQ ID NO: 604687 - RNA, 64 nt, hsa; identical to SEQ ID NO: 179828

SEQ ID NO: 604688 - RNA, 64 nt, hsa; identical to SEQ ID NO: 179829

SEQ ID NO: 604689 - RNA, 64 nt, hsa; identical to SEQ ID NO: 179830

SEQ ID NO: 604690 - RNA, 64 nt, hsa; identical to SEQ ID NO: 179831

SEQ ID NO: 604691 - RNA, 64 nt, hsa; identical to SEQ ID NO: 179832

SEQ ID NO: 604692 - RNA, 64 nt, hsa; identical to SEQ ID NO: 179833

SEQ ID NO: 604693 - RNA, 64 nt, hsa; identical to SEQ ID NO: 179834

SEQ ID NO: 604694 - RNA, 64 nt, hsa; identical to SEQ ID NO: 179835

SEQ ID NO: 604695 - RNA, 64 nt, hsa; identical to SEQ ID NO: 179836

SEQ ID NO: 604696 - RNA, 64 nt, hsa; identical to SEQ ID NO: 179837

SEQ ID NO: 604697 - RNA, 53 nt, hsa; identical to SEQ ID NO: 86549

SEQ ID NO: 604698 - RNA, 64 nt, hsa; identical to SEQ ID NO: 179839

SEQ ID NO: 604699 - RNA, 64 nt, hsa; identical to SEQ ID NO: 179840

SEQ ID NO: 604700 - RNA, 64 nt, hsa; identical to SEQ ID NO: 179841

SEQ ID NO: 604701 - RNA, 64 nt, hsa; identical to SEQ ID NO: 179842

SEQ ID NO: 604702 - RNA, 64 nt, hsa; identical to SEQ ID NO: 179843

SEQ ID NO: 604703 - RNA, 64 nt, hsa; identical to SEQ ID NO: 179844

SEQ ID NO: 604704 - RNA, 64 nt, hsa; identical to SEQ ID NO: 179845

SEQ ID NO: 604705 - RNA, 64 nt, hsa; identical to SEQ ID NO: 179846

SEQ ID NO: 604706 - RNA, 64 nt, hsa; identical to SEQ ID NO: 179847

SEQ ID NO: 604707 - RNA, 64 nt, hsa; identical to SEQ ID NO: 179848

SEQ ID NO: 604708 - RNA, 64 nt, hsa; identical to SEQ ID NO: 179849

SEQ ID NO: 604709 - RNA, 64 nt, hsa; identical to SEQ ID NO: 179850

SEQ ID NO: 604710 - RNA, 64 nt, hsa; identical to SEQ ID NO: 179851

SEQ ID NO: 604711 - RNA, 64 nt, hsa; identical to SEQ ID NO: 179852

SEQ ID NO: 604712 - RNA, 64 nt, hsa; identical to SEQ ID NO: 179853

SEQ ID NO: 604713 - RNA, 64 nt, hsa; identical to SEQ ID NO: 179854

SEQ ID NO: 604714 - RNA, 64 nt, hsa; identical to SEQ ID NO: 179855

SEQ ID NO: 604715 - RNA, 64 nt, hsa; identical to SEQ ID NO: 179856

SEQ ID NO: 604716 - RNA, 64 nt, hsa; identical to SEQ ID NO: 179857

SEQ ID NO: 604717 - RNA, 64 nt, hsa; identical to SEQ ID NO: 179858

SEQ ID NO: 604718 - RNA, 64 nt, hsa; identical to SEQ ID NO: 179859

SEQ ID NO: 604719 - RNA, 64 nt, hsa; identical to SEQ ID NO: 179860

SEQ ID NO: 604720 - RNA, 64 nt, hsa; identical to SEQ ID NO: 179861

SEQ ID NO: 604721 - RNA, 64 nt, hsa; identical to SEQ ID NO: 179862

SEQ ID NO: 604722 - RNA, 64 nt, hsa; identical to SEQ ID NO: 179863

SEQ ID NO: 604723 - RNA, 64 nt, hsa; identical to SEQ ID NO: 179864

SEQ ID NO: 604724 - RNA, 64 nt, hsa; identical to SEQ ID NO: 179865

SEQ ID NO: 604725 - RNA, 64 nt, hsa; identical to SEQ ID NO: 179866

SEQ ID NO: 604726 - RNA, 64 nt, hsa; identical to SEQ ID NO: 179867

SEQ ID NO: 604727 - RNA, 64 nt, hsa; identical to SEQ ID NO: 179868

SEQ ID NO: 604728 - RNA, 64 nt, hsa; identical to SEQ ID NO: 179869

SEQ ID NO: 604729 - RNA, 64 nt, hsa; identical to SEQ ID NO: 119443

SEQ ID NO: 604730 - RNA, 64 nt, hsa; identical to SEQ ID NO: 119444

SEQ ID NO: 604731 - RNA, 64 nt, hsa; identical to SEQ ID NO: 119445

SEQ ID NO: 604732 - RNA, 64 nt, hsa; identical to SEQ ID NO: 119446

SEQ ID NO: 604733 - RNA, 64 nt, hsa; identical to SEQ ID NO: 119447

SEQ ID NO: 604734 - RNA, 64 nt, hsa; identical to SEQ ID NO: 119448

SEQ ID NO: 604735 - RNA, 64 nt, hsa; identical to SEQ ID NO: 119449

SEQ ID NO: 604736 - RNA, 64 nt, hsa; identical to SEQ ID NO: 119450

SEQ ID NO: 604737 - RNA, 64 nt, hsa; identical to SEQ ID NO: 119451

SEQ ID NO: 604738 - RNA, 64 nt, hsa; identical to SEQ ID NO: 119452

SEQ ID NO: 604739 - RNA, 64 nt, hsa; identical to SEQ ID NO: 119453

SEQ ID NO: 604740 - RNA, 64 nt, hsa; identical to SEQ ID NO: 119454

SEQ ID NO: 604741 - RNA, 64 nt, hsa; identical to SEQ ID NO: 119455

SEQ ID NO: 604742 - RNA, 64 nt, hsa; identical to SEQ ID NO: 119456

SEQ ID NO: 604743 - RNA, 64 nt, hsa; identical to SEQ ID NO: 119457

SEQ ID NO: 604744 - RNA, 64 nt, hsa; identical to SEQ ID NO: 119458

SEQ ID NO: 604745 - RNA, 64 nt, hsa; identical to SEQ ID NO: 119459

SEQ ID NO: 604746 - RNA, 64 nt, hsa; identical to SEQ ID NO: 119460

SEQ ID NO: 604747 - RNA, 51 nt, hsa; identical to SEQ ID NO: 119461

SEQ ID NO: 604748 - RNA, 64 nt, hsa; identical to SEQ ID NO: 119462

SEQ ID NO: 604749 - RNA, 64 nt, hsa; identical to SEQ ID NO: 119463

SEQ ID NO: 604750 - RNA, 64 nt, hsa; identical to SEQ ID NO: 119464

SEQ ID NO: 604751 - RNA, 64 nt, hsa; identical to SEQ ID NO: 119465

SEQ ID NO: 604752 - RNA, 64 nt, hsa; identical to SEQ ID NO: 119466

SEQ ID NO: 604753 - RNA, 64 nt, hsa; identical to SEQ ID NO: 119467

SEQ ID NO: 604754 - RNA, 64 nt, hsa; identical to SEQ ID NO: 119468

SEQ ID NO: 604755 - RNA, 64 nt, hsa; identical to SEQ ID NO: 119469

SEQ ID NO: 604756 - RNA, 64 nt, hsa; identical to SEQ ID NO: 119470

SEQ ID NO: 604757 - RNA, 64 nt, hsa; identical to SEQ ID NO: 119471

SEQ ID NO: 604758 - RNA, 64 nt, hsa; identical to SEQ ID NO: 119472

SEQ ID NO: 604759 - RNA, 64 nt, hsa; identical to SEQ ID NO: 119473

SEQ ID NO: 604760 - RNA, 64 nt, hsa; identical to SEQ ID NO: 119474

SEQ ID NO: 604761 - RNA, 64 nt, hsa; identical to SEQ ID NO: 119475

SEQ ID NO: 604762 - RNA, 64 nt, hsa; identical to SEQ ID NO: 119476

SEQ ID NO: 604763 - RNA, 64 nt, hsa; identical to SEQ ID NO: 119477

SEQ ID NO: 604764 - RNA, 64 nt, hsa; identical to SEQ ID NO: 119478

SEQ ID NO: 604765 - RNA, 64 nt, hsa; identical to SEQ ID NO: 119479

SEQ ID NO: 604766 - RNA, 64 nt, hsa; identical to SEQ ID NO: 119480

SEQ ID NO: 604767 - RNA, 64 nt, hsa; identical to SEQ ID NO: 119481

SEQ ID NO: 604768 - RNA, 64 nt, hsa; identical to SEQ ID NO: 443640

SEQ ID NO: 604769 - RNA, 64 nt, hsa; identical to SEQ ID NO: 443641

SEQ ID NO: 604770 - RNA, 64 nt, hsa; identical to SEQ ID NO: 443642

SEQ ID NO: 604771 - RNA, 64 nt, hsa; identical to SEQ ID NO: 443643

SEQ ID NO: 604772 - RNA, 64 nt, hsa; identical to SEQ ID NO: 443644

SEQ ID NO: 604773 - RNA, 64 nt, hsa; identical to SEQ ID NO: 443645

SEQ ID NO: 604774 - RNA, 64 nt, hsa; identical to SEQ ID NO: 443646

SEQ ID NO: 604775 - RNA, 64 nt, hsa; identical to SEQ ID NO: 443647

SEQ ID NO: 604776 - RNA, 56 nt, hsa; identical to SEQ ID NO: 443648

SEQ ID NO: 604777 - RNA, 64 nt, hsa; identical to SEQ ID NO: 443649

SEQ ID NO: 604778 - RNA, 64 nt, hsa; identical to SEQ ID NO: 443650

SEQ ID NO: 604779 - RNA, 64 nt, hsa; identical to SEQ ID NO: 443651

SEQ ID NO: 604780 - RNA, 64 nt, hsa; identical to SEQ ID NO: 443652

SEQ ID NO: 604781 - RNA, 64 nt, hsa; identical to SEQ ID NO: 443653

SEQ ID NO: 604782 - RNA, 64 nt, hsa; identical to SEQ ID NO: 443654

SEQ ID NO: 604783 - RNA, 64 nt, hsa; identical to SEQ ID NO: 443655

SEQ ID NO: 604784 - RNA, 64 nt, hsa; identical to SEQ ID NO: 443656

SEQ ID NO: 604785 - RNA, 64 nt, hsa; identical to SEQ ID NO: 443657

SEQ ID NO: 604786 - RNA, 64 nt, hsa; identical to SEQ ID NO: 443658

SEQ ID NO: 604787 - RNA, 64 nt, hsa; identical to SEQ ID NO: 443659

SEQ ID NO: 604788 - RNA, 64 nt, hsa; identical to SEQ ID NO: 443660

SEQ ID NO: 604789 - RNA, 64 nt, hsa; identical to SEQ ID NO: 443661

SEQ ID NO: 604790 - RNA, 64 nt, hsa; identical to SEQ ID NO: 443662

SEQ ID NO: 604791 - RNA, 64 nt, hsa; identical to SEQ ID NO: 443663

SEQ ID NO: 604792 - RNA, 64 nt, hsa; identical to SEQ ID NO: 443664

SEQ ID NO: 604793 - RNA, 64 nt, hsa; identical to SEQ ID NO: 443665

SEQ ID NO: 604794 - RNA, 64 nt, hsa; identical to SEQ ID NO: 443666

SEQ ID NO: 604795 - RNA, 64 nt, hsa; identical to SEQ ID NO: 443667

SEQ ID NO: 604796 - RNA, 64 nt, hsa; identical to SEQ ID NO: 443668

SEQ ID NO: 604797 - RNA, 64 nt, hsa; identical to SEQ ID NO: 443669

SEQ ID NO: 604798 - RNA, 64 nt, hsa; identical to SEQ ID NO: 443670

SEQ ID NO: 604799 - RNA, 64 nt, hsa; identical to SEQ ID NO: 443671

SEQ ID NO: 604800 - RNA, 64 nt, hsa; identical to SEQ ID NO: 443672

SEQ ID NO: 604801 - RNA, 64 nt, hsa; identical to SEQ ID NO: 443673

SEQ ID NO: 604802 - RNA, 64 nt, hsa; identical to SEQ ID NO: 443674

SEQ ID NO: 604803 - RNA, 64 nt, hsa; identical to SEQ ID NO: 443675

SEQ ID NO: 604804 - RNA, 64 nt, hsa; identical to SEQ ID NO: 443676

SEQ ID NO: 604805 - RNA, 64 nt, hsa; identical to SEQ ID NO: 443677

SEQ ID NO: 604806 - RNA, 64 nt, hsa; identical to SEQ ID NO: 443678

SEQ ID NO: 604807 - RNA, 64 nt, hsa; identical to SEQ ID NO: 443679

SEQ ID NO: 604808 - RNA, 64 nt, hsa; identical to SEQ ID NO: 443680

SEQ ID NO: 604809 - RNA, 64 nt, hsa; identical to SEQ ID NO: 443681

SEQ ID NO: 604810 - RNA, 64 nt, hsa; identical to SEQ ID NO: 443682

SEQ ID NO: 604811 - RNA, 64 nt, hsa; identical to SEQ ID NO: 443683

SEQ ID NO: 604812 - RNA, 64 nt, hsa; identical to SEQ ID NO: 443684

SEQ ID NO: 604813 - RNA, 64 nt, hsa; identical to SEQ ID NO: 443685

SEQ ID NO: 604814 - RNA, 64 nt, hsa; identical to SEQ ID NO: 443686

SEQ ID NO: 604815 - RNA, 64 nt, hsa; identical to SEQ ID NO: 443687

SEQ ID NO: 604816 - RNA, 64 nt, hsa; identical to SEQ ID NO: 443688

SEQ ID NO: 604817 - RNA, 64 nt, hsa; identical to SEQ ID NO: 443689

SEQ ID NO: 604818 - RNA, 64 nt, hsa; identical to SEQ ID NO: 443690

SEQ ID NO: 604819 - RNA, 64 nt, hsa; identical to SEQ ID NO: 443691

SEQ ID NO: 604820 - RNA, 64 nt, hsa; identical to SEQ ID NO: 443692

SEQ ID NO: 604821 - RNA, 64 nt, hsa; identical to SEQ ID NO: 443693

SEQ ID NO: 604822 - RNA, 64 nt, hsa; identical to SEQ ID NO: 443694

SEQ ID NO: 604823 - RNA, 64 nt, hsa; identical to SEQ ID NO: 443695

SEQ ID NO: 604824 - RNA, 64 nt, hsa; identical to SEQ ID NO: 443696

SEQ ID NO: 604825 - RNA, 64 nt, hsa; identical to SEQ ID NO: 443697

SEQ ID NO: 604826 - RNA, 64 nt, hsa; identical to SEQ ID NO: 443698

SEQ ID NO: 604827 - RNA, 64 nt, hsa; identical to SEQ ID NO: 443699

SEQ ID NO: 604828 - RNA, 64 nt, hsa; identical to SEQ ID NO: 443700

SEQ ID NO: 604829 - RNA, 64 nt, hsa; identical to SEQ ID NO: 443701

SEQ ID NO: 604830 - RNA, 64 nt, hsa; identical to SEQ ID NO: 443702

SEQ ID NO: 604831 - RNA, 64 nt, hsa; identical to SEQ ID NO: 443703

SEQ ID NO: 604832 - RNA, 64 nt, hsa; identical to SEQ ID NO: 443704

SEQ ID NO: 604833 - RNA, 64 nt, hsa; identical to SEQ ID NO: 443705

SEQ ID NO: 604834 - RNA, 64 nt, hsa; identical to SEQ ID NO: 443706

SEQ ID NO: 604835 - RNA, 64 nt, hsa; identical to SEQ ID NO: 443707

SEQ ID NO: 604836 - RNA, 64 nt, hsa; identical to SEQ ID NO: 443708

SEQ ID NO: 604837 - RNA, 64 nt, hsa; identical to SEQ ID NO: 443709

SEQ ID NO: 604838 - RNA, 64 nt, hsa; identical to SEQ ID NO: 443710

SEQ ID NO: 604839 - RNA, 64 nt, hsa; identical to SEQ ID NO: 443711

SEQ ID NO: 604840 - RNA, 64 nt, hsa; identical to SEQ ID NO: 443712

SEQ ID NO: 604841 - RNA, 64 nt, hsa; identical to SEQ ID NO: 443713

SEQ ID NO: 604842 - RNA, 64 nt, hsa; identical to SEQ ID NO: 443714

SEQ ID NO: 604843 - RNA, 64 nt, hsa; identical to SEQ ID NO: 443715

SEQ ID NO: 604844 - RNA, 64 nt, hsa; identical to SEQ ID NO: 443716

SEQ ID NO: 604845 - RNA, 64 nt, hsa; identical to SEQ ID NO: 443717

SEQ ID NO: 604846 - RNA, 64 nt, hsa; identical to SEQ ID NO: 443718

SEQ ID NO: 604847 - RNA, 64 nt, hsa; identical to SEQ ID NO: 443719

SEQ ID NO: 604848 - RNA, 64 nt, hsa; identical to SEQ ID NO: 443720

SEQ ID NO: 604849 - RNA, 64 nt, hsa; identical to SEQ ID NO: 443721

SEQ ID NO: 604850 - RNA, 64 nt, hsa; identical to SEQ ID NO: 443722

SEQ ID NO: 604851 - RNA, 64 nt, hsa; identical to SEQ ID NO: 443723

SEQ ID NO: 604852 - RNA, 64 nt, hsa; identical to SEQ ID NO: 443724

SEQ ID NO: 604853 - RNA, 64 nt, hsa; identical to SEQ ID NO: 443725

SEQ ID NO: 604854 - RNA, 64 nt, hsa; identical to SEQ ID NO: 443726

SEQ ID NO: 604855 - RNA, 64 nt, hsa; identical to SEQ ID NO: 443727

SEQ ID NO: 604856 - RNA, 64 nt, hsa; identical to SEQ ID NO: 443728

SEQ ID NO: 604857 - RNA, 64 nt, hsa; identical to SEQ ID NO: 443729

SEQ ID NO: 604858 - RNA, 64 nt, hsa; identical to SEQ ID NO: 443730

SEQ ID NO: 604859 - RNA, 64 nt, hsa; identical to SEQ ID NO: 443731

SEQ ID NO: 604860 - RNA, 64 nt, hsa; identical to SEQ ID NO: 443732

SEQ ID NO: 604861 - RNA, 64 nt, hsa; identical to SEQ ID NO: 443733

SEQ ID NO: 604862 - RNA, 64 nt, hsa; identical to SEQ ID NO: 443734

SEQ ID NO: 604863 - RNA, 64 nt, hsa; identical to SEQ ID NO: 443735

SEQ ID NO: 604864 - RNA, 64 nt, hsa; identical to SEQ ID NO: 443736

SEQ ID NO: 604865 - RNA, 64 nt, hsa; identical to SEQ ID NO: 443737

SEQ ID NO: 604866 - RNA, 64 nt, hsa; identical to SEQ ID NO: 443738

SEQ ID NO: 604867 - RNA, 64 nt, hsa; identical to SEQ ID NO: 443739

SEQ ID NO: 604868 - RNA, 64 nt, hsa; identical to SEQ ID NO: 531886

SEQ ID NO: 604869 - RNA, 64 nt, hsa; identical to SEQ ID NO: 531887

SEQ ID NO: 604870 - RNA, 64 nt, hsa; identical to SEQ ID NO: 531888

SEQ ID NO: 604871 - RNA, 64 nt, hsa; identical to SEQ ID NO: 531889

SEQ ID NO: 604872 - RNA, 64 nt, hsa; identical to SEQ ID NO: 531890

SEQ ID NO: 604873 - RNA, 64 nt, hsa; identical to SEQ ID NO: 531891

SEQ ID NO: 604874 - RNA, 64 nt, hsa; identical to SEQ ID NO: 531892

SEQ ID NO: 604875 - RNA, 64 nt, hsa; identical to SEQ ID NO: 531893

SEQ ID NO: 604876 - RNA, 64 nt, hsa; identical to SEQ ID NO: 531894

SEQ ID NO: 604877 - RNA, 64 nt, hsa; identical to SEQ ID NO: 531895

SEQ ID NO: 604878 - RNA, 64 nt, hsa; identical to SEQ ID NO: 531896

SEQ ID NO: 604879 - RNA, 64 nt, hsa; identical to SEQ ID NO: 531897

SEQ ID NO: 604880 - RNA, 64 nt, hsa; identical to SEQ ID NO: 531898

SEQ ID NO: 604881 - RNA, 64 nt, hsa; identical to SEQ ID NO: 531899

SEQ ID NO: 604882 - RNA, 64 nt, hsa; identical to SEQ ID NO: 531900

SEQ ID NO: 604883 - RNA, 64 nt, hsa; identical to SEQ ID NO: 531901

SEQ ID NO: 604884 - RNA, 64 nt, hsa; identical to SEQ ID NO: 531902

SEQ ID NO: 604885 - RNA, 64 nt, hsa; identical to SEQ ID NO: 531903

SEQ ID NO: 604886 - RNA, 64 nt, hsa; identical to SEQ ID NO: 531904

SEQ ID NO: 604887 - RNA, 64 nt, hsa; identical to SEQ ID NO: 531905

SEQ ID NO: 604888 - RNA, 64 nt, hsa; identical to SEQ ID NO: 531906

SEQ ID NO: 604889 - RNA, 64 nt, hsa; identical to SEQ ID NO: 531907

SEQ ID NO: 604890 - RNA, 64 nt, hsa; identical to SEQ ID NO: 531908

SEQ ID NO: 604891 - RNA, 64 nt, hsa; identical to SEQ ID NO: 531909

SEQ ID NO: 604892 - RNA, 64 nt, hsa; identical to SEQ ID NO: 531910

SEQ ID NO: 604893 - RNA, 64 nt, hsa; identical to SEQ ID NO: 531911

SEQ ID NO: 604894 - RNA, 64 nt, hsa; identical to SEQ ID NO: 531912

SEQ ID NO: 604895 - RNA, 64 nt, hsa; identical to SEQ ID NO: 531913

SEQ ID NO: 604896 - RNA, 64 nt, hsa; identical to SEQ ID NO: 531914

SEQ ID NO: 604897 - RNA, 64 nt, hsa; identical to SEQ ID NO: 531915

SEQ ID NO: 604898 - RNA, 64 nt, hsa; identical to SEQ ID NO: 531916

SEQ ID NO: 604899 - RNA, 64 nt, hsa; identical to SEQ ID NO: 531917

SEQ ID NO: 604900 - RNA, 64 nt, hsa; identical to SEQ ID NO: 531918

SEQ ID NO: 604901 - RNA, 64 nt, hsa; identical to SEQ ID NO: 531919

SEQ ID NO: 604902 - RNA, 64 nt, hsa; identical to SEQ ID NO: 531920

SEQ ID NO: 604903 - RNA, 64 nt, hsa; identical to SEQ ID NO: 531921

SEQ ID NO: 604904 - RNA, 64 nt, hsa; identical to SEQ ID NO: 531922

SEQ ID NO: 604905 - RNA, 64 nt, hsa; identical to SEQ ID NO: 211201

SEQ ID NO: 604906 - RNA, 64 nt, hsa; identical to SEQ ID NO: 211202

SEQ ID NO: 604907 - RNA, 64 nt, hsa; identical to SEQ ID NO: 211203

SEQ ID NO: 604908 - RNA, 64 nt, hsa; identical to SEQ ID NO: 211204

SEQ ID NO: 604909 - RNA, 64 nt, hsa; identical to SEQ ID NO: 211205

SEQ ID NO: 604910 - RNA, 64 nt, hsa; identical to SEQ ID NO: 211206

SEQ ID NO: 604911 - RNA, 64 nt, hsa; identical to SEQ ID NO: 531886

SEQ ID NO: 604912 - RNA, 64 nt, hsa; identical to SEQ ID NO: 531887

SEQ ID NO: 604913 - RNA, 64 nt, hsa; identical to SEQ ID NO: 531888

SEQ ID NO: 604914 - RNA, 64 nt, hsa; identical to SEQ ID NO: 531889

SEQ ID NO: 604915 - RNA, 64 nt, hsa; identical to SEQ ID NO: 531890

SEQ ID NO: 604916 - RNA, 64 nt, hsa; identical to SEQ ID NO: 531891

SEQ ID NO: 604917 - RNA, 64 nt, hsa; identical to SEQ ID NO: 531892

SEQ ID NO: 604918 - RNA, 64 nt, hsa; identical to SEQ ID NO: 531893

SEQ ID NO: 604919 - RNA, 64 nt, hsa; identical to SEQ ID NO: 531894

SEQ ID NO: 604920 - RNA, 64 nt, hsa; identical to SEQ ID NO: 531895

SEQ ID NO: 604921 - RNA, 64 nt, hsa; identical to SEQ ID NO: 531896

SEQ ID NO: 604922 - RNA, 64 nt, hsa; identical to SEQ ID NO: 531897

SEQ ID NO: 604923 - RNA, 64 nt, hsa; identical to SEQ ID NO: 531898

SEQ ID NO: 604924 - RNA, 64 nt, hsa; identical to SEQ ID NO: 531899

SEQ ID NO: 604925 - RNA, 64 nt, hsa; identical to SEQ ID NO: 531900

SEQ ID NO: 604926 - RNA, 64 nt, hsa; identical to SEQ ID NO: 531901

SEQ ID NO: 604927 - RNA, 64 nt, hsa; identical to SEQ ID NO: 531902

SEQ ID NO: 604928 - RNA, 64 nt, hsa; identical to SEQ ID NO: 531903

SEQ ID NO: 604929 - RNA, 64 nt, hsa; identical to SEQ ID NO: 531904

SEQ ID NO: 604930 - RNA, 64 nt, hsa; identical to SEQ ID NO: 531905

SEQ ID NO: 604931 - RNA, 64 nt, hsa; identical to SEQ ID NO: 531906

SEQ ID NO: 604932 - RNA, 64 nt, hsa; identical to SEQ ID NO: 531907

SEQ ID NO: 604933 - RNA, 64 nt, hsa; identical to SEQ ID NO: 531908

SEQ ID NO: 604934 - RNA, 64 nt, hsa; identical to SEQ ID NO: 531909

SEQ ID NO: 604935 - RNA, 64 nt, hsa; identical to SEQ ID NO: 531910

SEQ ID NO: 604936 - RNA, 64 nt, hsa; identical to SEQ ID NO: 531911

SEQ ID NO: 604937 - RNA, 64 nt, hsa; identical to SEQ ID NO: 531912

SEQ ID NO: 604938 - RNA, 64 nt, hsa; identical to SEQ ID NO: 531913

SEQ ID NO: 604939 - RNA, 64 nt, hsa; identical to SEQ ID NO: 531914

SEQ ID NO: 604940 - RNA, 64 nt, hsa; identical to SEQ ID NO: 531915

SEQ ID NO: 604941 - RNA, 64 nt, hsa; identical to SEQ ID NO: 531916

SEQ ID NO: 604942 - RNA, 64 nt, hsa; identical to SEQ ID NO: 531917

SEQ ID NO: 604943 - RNA, 64 nt, hsa; identical to SEQ ID NO: 531918

SEQ ID NO: 604944 - RNA, 64 nt, hsa; identical to SEQ ID NO: 531919

SEQ ID NO: 604945 - RNA, 64 nt, hsa; identical to SEQ ID NO: 531920

SEQ ID NO: 604946 - RNA, 64 nt, hsa; identical to SEQ ID NO: 531921

SEQ ID NO: 604947 - RNA, 64 nt, hsa; identical to SEQ ID NO: 531922

SEQ ID NO: 604948 - RNA, 64 nt, hsa; identical to SEQ ID NO: 211201

SEQ ID NO: 604949 - RNA, 64 nt, hsa; identical to SEQ ID NO: 211202

SEQ ID NO: 604950 - RNA, 64 nt, hsa; identical to SEQ ID NO: 211203

SEQ ID NO: 604951 - RNA, 64 nt, hsa; identical to SEQ ID NO: 211204

SEQ ID NO: 604952 - RNA, 64 nt, hsa; identical to SEQ ID NO: 211205

SEQ ID NO: 604953 - RNA, 64 nt, hsa; identical to SEQ ID NO: 211206

SEQ ID NO: 604954 - RNA, 64 nt, hsa; identical to SEQ ID NO: 531886

SEQ ID NO: 604955 - RNA, 64 nt, hsa; identical to SEQ ID NO: 531887

SEQ ID NO: 604956 - RNA, 64 nt, hsa; identical to SEQ ID NO: 531888

SEQ ID NO: 604957 - RNA, 64 nt, hsa; identical to SEQ ID NO: 531889

SEQ ID NO: 604958 - RNA, 64 nt, hsa; identical to SEQ ID NO: 531890

SEQ ID NO: 604959 - RNA, 64 nt, hsa; identical to SEQ ID NO: 531891

SEQ ID NO: 604960 - RNA, 64 nt, hsa; identical to SEQ ID NO: 531892

SEQ ID NO: 604961 - RNA, 64 nt, hsa; identical to SEQ ID NO: 531893

SEQ ID NO: 604962 - RNA, 64 nt, hsa; identical to SEQ ID NO: 531894

SEQ ID NO: 604963 - RNA, 64 nt, hsa; identical to SEQ ID NO: 531895

SEQ ID NO: 604964 - RNA, 64 nt, hsa; identical to SEQ ID NO: 531896

SEQ ID NO: 604965 - RNA, 64 nt, hsa; identical to SEQ ID NO: 531897

SEQ ID NO: 604966 - RNA, 64 nt, hsa; identical to SEQ ID NO: 531898

SEQ ID NO: 604967 - RNA, 64 nt, hsa; identical to SEQ ID NO: 531899

SEQ ID NO: 604968 - RNA, 64 nt, hsa; identical to SEQ ID NO: 531900

SEQ ID NO: 604969 - RNA, 64 nt, hsa; identical to SEQ ID NO: 531901

SEQ ID NO: 604970 - RNA, 64 nt, hsa; identical to SEQ ID NO: 531902

SEQ ID NO: 604971 - RNA, 64 nt, hsa; identical to SEQ ID NO: 531903

SEQ ID NO: 604972 - RNA, 64 nt, hsa; identical to SEQ ID NO: 531904

SEQ ID NO: 604973 - RNA, 64 nt, hsa; identical to SEQ ID NO: 531905

SEQ ID NO: 604974 - RNA, 64 nt, hsa; identical to SEQ ID NO: 531906

SEQ ID NO: 604975 - RNA, 64 nt, hsa; identical to SEQ ID NO: 531907

SEQ ID NO: 604976 - RNA, 64 nt, hsa; identical to SEQ ID NO: 531908

SEQ ID NO: 604977 - RNA, 64 nt, hsa; identical to SEQ ID NO: 531909

SEQ ID NO: 604978 - RNA, 64 nt, hsa; identical to SEQ ID NO: 531910

SEQ ID NO: 604979 - RNA, 64 nt, hsa; identical to SEQ ID NO: 531911

SEQ ID NO: 604980 - RNA, 64 nt, hsa; identical to SEQ ID NO: 531912

SEQ ID NO: 604981 - RNA, 64 nt, hsa; identical to SEQ ID NO: 531913

SEQ ID NO: 604982 - RNA, 64 nt, hsa; identical to SEQ ID NO: 531914

SEQ ID NO: 604983 - RNA, 64 nt, hsa; identical to SEQ ID NO: 531915

SEQ ID NO: 604984 - RNA, 64 nt, hsa; identical to SEQ ID NO: 531916

SEQ ID NO: 604985 - RNA, 64 nt, hsa; identical to SEQ ID NO: 531917

SEQ ID NO: 604986 - RNA, 64 nt, hsa; identical to SEQ ID NO: 531918

SEQ ID NO: 604987 - RNA, 64 nt, hsa; identical to SEQ ID NO: 531919

SEQ ID NO: 604988 - RNA, 64 nt, hsa; identical to SEQ ID NO: 531920

SEQ ID NO: 604989 - RNA, 64 nt, hsa; identical to SEQ ID NO: 531921

SEQ ID NO: 604990 - RNA, 64 nt, hsa; identical to SEQ ID NO: 531922

SEQ ID NO: 604991 - RNA, 64 nt, hsa; identical to SEQ ID NO: 211201

SEQ ID NO: 604992 - RNA, 64 nt, hsa; identical to SEQ ID NO: 211202

SEQ ID NO: 604993 - RNA, 64 nt, hsa; identical to SEQ ID NO: 211203

SEQ ID NO: 604994 - RNA, 64 nt, hsa; identical to SEQ ID NO: 211204

SEQ ID NO: 604995 - RNA, 64 nt, hsa; identical to SEQ ID NO: 211205

SEQ ID NO: 604996 - RNA, 64 nt, hsa; identical to SEQ ID NO: 211206

SEQ ID NO: 604997 - RNA, 64 nt, hsa; identical to SEQ ID NO: 132924

SEQ ID NO: 604998 - RNA, 64 nt, hsa; identical to SEQ ID NO: 132925

SEQ ID NO: 604999 - RNA, 64 nt, hsa; identical to SEQ ID NO: 132926

SEQ ID NO: 605000 - RNA, 64 nt, hsa; identical to SEQ ID NO: 132927

SEQ ID NO: 605001 - RNA, 64 nt, hsa; identical to SEQ ID NO: 132928

SEQ ID NO: 605002 - RNA, 64 nt, hsa; identical to SEQ ID NO: 132929

SEQ ID NO: 605003 - RNA, 64 nt, hsa; identical to SEQ ID NO: 132930

SEQ ID NO: 605004 - RNA, 64 nt, hsa; identical to SEQ ID NO: 132931

SEQ ID NO: 605005 - RNA, 64 nt, hsa; identical to SEQ ID NO: 132932

SEQ ID NO: 605006 - RNA, 64 nt, hsa; identical to SEQ ID NO: 132933

SEQ ID NO: 605007 - RNA, 64 nt, hsa; identical to SEQ ID NO: 132934

SEQ ID NO: 605008 - RNA, 64 nt, hsa; identical to SEQ ID NO: 132935

SEQ ID NO: 605009 - RNA, 64 nt, hsa; identical to SEQ ID NO: 132936

SEQ ID NO: 605010 - RNA, 64 nt, hsa; identical to SEQ ID NO: 132937

SEQ ID NO: 605011 - RNA, 64 nt, hsa; identical to SEQ ID NO: 132938

SEQ ID NO: 605012 - RNA, 64 nt, hsa; identical to SEQ ID NO: 132939

SEQ ID NO: 605013 - RNA, 64 nt, hsa; identical to SEQ ID NO: 132940

SEQ ID NO: 605014 - RNA, 64 nt, hsa; identical to SEQ ID NO: 132941

SEQ ID NO: 605015 - RNA, 64 nt, hsa; identical to SEQ ID NO: 132942

SEQ ID NO: 605016 - RNA, 64 nt, hsa; identical to SEQ ID NO: 132943

SEQ ID NO: 605017 - RNA, 64 nt, hsa; identical to SEQ ID NO: 132944

SEQ ID NO: 605018 - RNA, 64 nt, hsa; identical to SEQ ID NO: 132945

SEQ ID NO: 605019 - RNA, 64 nt, hsa; identical to SEQ ID NO: 132946

SEQ ID NO: 605020 - RNA, 64 nt, hsa; identical to SEQ ID NO: 132947

SEQ ID NO: 605021 - RNA, 64 nt, hsa; identical to SEQ ID NO: 132948

SEQ ID NO: 605022 - RNA, 64 nt, hsa; identical to SEQ ID NO: 132949

SEQ ID NO: 605023 - RNA, 64 nt, hsa; identical to SEQ ID NO: 132950

SEQ ID NO: 605024 - RNA, 64 nt, hsa; identical to SEQ ID NO: 132951

SEQ ID NO: 605025 - RNA, 64 nt, hsa; identical to SEQ ID NO: 132952

SEQ ID NO: 605026 - RNA, 64 nt, hsa; identical to SEQ ID NO: 132953

SEQ ID NO: 605027 - RNA, 64 nt, hsa; identical to SEQ ID NO: 132954

SEQ ID NO: 605028 - RNA, 64 nt, hsa; identical to SEQ ID NO: 132955

SEQ ID NO: 605029 - RNA, 64 nt, hsa; identical to SEQ ID NO: 132956

SEQ ID NO: 605030 - RNA, 64 nt, hsa; identical to SEQ ID NO: 132957

SEQ ID NO: 605031 - RNA, 64 nt, hsa; identical to SEQ ID NO: 132958

SEQ ID NO: 605032 - RNA, 64 nt, hsa; identical to SEQ ID NO: 132959

SEQ ID NO: 605033 - RNA, 64 nt, hsa; identical to SEQ ID NO: 132960

SEQ ID NO: 605034 - RNA, 64 nt, hsa; identical to SEQ ID NO: 132961

SEQ ID NO: 605035 - RNA, 64 nt, hsa; identical to SEQ ID NO: 132962

SEQ ID NO: 605036 - RNA, 64 nt, hsa; identical to SEQ ID NO: 132963

SEQ ID NO: 605037 - RNA, 64 nt, hsa; identical to SEQ ID NO: 132964

SEQ ID NO: 605038 - RNA, 64 nt, hsa; identical to SEQ ID NO: 132965

SEQ ID NO: 605039 - RNA, 64 nt, hsa; identical to SEQ ID NO: 132966

SEQ ID NO: 605040 - RNA, 58 nt, hsa; identical to SEQ ID NO: 132967

SEQ ID NO: 605041 - RNA, 64 nt, hsa; identical to SEQ ID NO: 132968

SEQ ID NO: 605042 - RNA, 64 nt, hsa; identical to SEQ ID NO: 132969

SEQ ID NO: 605043 - RNA, 64 nt, hsa; identical to SEQ ID NO: 132970

SEQ ID NO: 605044 - RNA, 64 nt, hsa; identical to SEQ ID NO: 132971

SEQ ID NO: 605045 - RNA, 64 nt, hsa; identical to SEQ ID NO: 132972

SEQ ID NO: 605046 - RNA, 64 nt, hsa; identical to SEQ ID NO: 132973

SEQ ID NO: 605047 - RNA, 64 nt, hsa; identical to SEQ ID NO: 132974

SEQ ID NO: 605048 - RNA, 64 nt, hsa; identical to SEQ ID NO: 132975

SEQ ID NO: 605049 - RNA, 64 nt, hsa; identical to SEQ ID NO: 132976

SEQ ID NO: 605050 - RNA, 64 nt, hsa; identical to SEQ ID NO: 132977

SEQ ID NO: 605051 - RNA, 64 nt, hsa; identical to SEQ ID NO: 132978

SEQ ID NO: 605052 - RNA, 64 nt, hsa; identical to SEQ ID NO: 132979

SEQ ID NO: 605053 - RNA, 64 nt, hsa; identical to SEQ ID NO: 132980

SEQ ID NO: 605054 - RNA, 64 nt, hsa; identical to SEQ ID NO: 132981

SEQ ID NO: 605055 - RNA, 64 nt, hsa; identical to SEQ ID NO: 132982

SEQ ID NO: 605056 - RNA, 64 nt, hsa; identical to SEQ ID NO: 132983

SEQ ID NO: 605057 - RNA, 64 nt, hsa; identical to SEQ ID NO: 132984

SEQ ID NO: 605058 - RNA, 64 nt, hsa; identical to SEQ ID NO: 132985

SEQ ID NO: 605059 - RNA, 64 nt, hsa; identical to SEQ ID NO: 132986

SEQ ID NO: 605060 - RNA, 64 nt, hsa; identical to SEQ ID NO: 132987

SEQ ID NO: 605061 - RNA, 64 nt, hsa; identical to SEQ ID NO: 132988

SEQ ID NO: 605062 - RNA, 64 nt, hsa; identical to SEQ ID NO: 132989

SEQ ID NO: 605063 - RNA, 64 nt, hsa; identical to SEQ ID NO: 132990

SEQ ID NO: 605064 - RNA, 64 nt, hsa; identical to SEQ ID NO: 132991

SEQ ID NO: 605065 - RNA, 64 nt, hsa; identical to SEQ ID NO: 132992

SEQ ID NO: 605066 - RNA, 64 nt, hsa; identical to SEQ ID NO: 132993

SEQ ID NO: 605067 - RNA, 64 nt, hsa; identical to SEQ ID NO: 132994

SEQ ID NO: 605068 - RNA, 64 nt, hsa; identical to SEQ ID NO: 132995

SEQ ID NO: 605069 - RNA, 64 nt, hsa; identical to SEQ ID NO: 132996

SEQ ID NO: 605070 - RNA, 64 nt, hsa; identical to SEQ ID NO: 132997

SEQ ID NO: 605071 - RNA, 64 nt, hsa; identical to SEQ ID NO: 132998

SEQ ID NO: 605072 - RNA, 64 nt, hsa; identical to SEQ ID NO: 132999

SEQ ID NO: 605073 - RNA, 64 nt, hsa; identical to SEQ ID NO: 133000

SEQ ID NO: 605074 - RNA, 64 nt, hsa; identical to SEQ ID NO: 133001

SEQ ID NO: 605075 - RNA, 64 nt, hsa; identical to SEQ ID NO: 133002

SEQ ID NO: 605076 - RNA, 64 nt, hsa; identical to SEQ ID NO: 133003

SEQ ID NO: 605077 - RNA, 64 nt, hsa; identical to SEQ ID NO: 133004

SEQ ID NO: 605078 - RNA, 64 nt, hsa; identical to SEQ ID NO: 133005

SEQ ID NO: 605079 - RNA, 64 nt, hsa; identical to SEQ ID NO: 133006

SEQ ID NO: 605080 - RNA, 64 nt, hsa; identical to SEQ ID NO: 133007

SEQ ID NO: 605081 - RNA, 64 nt, hsa; identical to SEQ ID NO: 133008

SEQ ID NO: 605082 - RNA, 64 nt, hsa; identical to SEQ ID NO: 133009

SEQ ID NO: 605083 - RNA, 64 nt, hsa; identical to SEQ ID NO: 133010

SEQ ID NO: 605084 - RNA, 64 nt, hsa; identical to SEQ ID NO: 133011

SEQ ID NO: 605085 - RNA, 64 nt, hsa; identical to SEQ ID NO: 133012

SEQ ID NO: 605086 - RNA, 64 nt, hsa; identical to SEQ ID NO: 133013

SEQ ID NO: 605087 - RNA, 64 nt, hsa; identical to SEQ ID NO: 133014

SEQ ID NO: 605088 - RNA, 64 nt, hsa; identical to SEQ ID NO: 133015

SEQ ID NO: 605089 - RNA, 64 nt, hsa; identical to SEQ ID NO: 133016

SEQ ID NO: 605090 - RNA, 64 nt, hsa; identical to SEQ ID NO: 133017

SEQ ID NO: 605091 - RNA, 64 nt, hsa; identical to SEQ ID NO: 133018

SEQ ID NO: 605092 - RNA, 64 nt, hsa; identical to SEQ ID NO: 133019

SEQ ID NO: 605093 - RNA, 64 nt, hsa; identical to SEQ ID NO: 133020

SEQ ID NO: 605094 - RNA, 64 nt, hsa; identical to SEQ ID NO: 133021

SEQ ID NO: 605095 - RNA, 64 nt, hsa; identical to SEQ ID NO: 133022

SEQ ID NO: 605096 - RNA, 64 nt, hsa; identical to SEQ ID NO: 133023

SEQ ID NO: 605097 - RNA, 64 nt, hsa; identical to SEQ ID NO: 133024

SEQ ID NO: 605098 - RNA, 64 nt, hsa; identical to SEQ ID NO: 133025

SEQ ID NO: 605099 - RNA, 64 nt, hsa; identical to SEQ ID NO: 133026

SEQ ID NO: 605100 - RNA, 64 nt, hsa; identical to SEQ ID NO: 133027

SEQ ID NO: 605101 - RNA, 64 nt, hsa; identical to SEQ ID NO: 133028

SEQ ID NO: 605102 - RNA, 64 nt, hsa; identical to SEQ ID NO: 133029

SEQ ID NO: 605103 - RNA, 64 nt, hsa; identical to SEQ ID NO: 133030

SEQ ID NO: 605104 - RNA, 64 nt, hsa; identical to SEQ ID NO: 133031

SEQ ID NO: 605105 - RNA, 64 nt, hsa; identical to SEQ ID NO: 133032

SEQ ID NO: 605106 - RNA, 64 nt, hsa; identical to SEQ ID NO: 133033

SEQ ID NO: 605107 - RNA, 64 nt, hsa; identical to SEQ ID NO: 133034

SEQ ID NO: 605108 - RNA, 64 nt, hsa; identical to SEQ ID NO: 133035

SEQ ID NO: 605109 - RNA, 64 nt, hsa; identical to SEQ ID NO: 133036

SEQ ID NO: 605110 - RNA, 64 nt, hsa; identical to SEQ ID NO: 133037

SEQ ID NO: 605111 - RNA, 64 nt, hsa; identical to SEQ ID NO: 133038

SEQ ID NO: 605112 - RNA, 64 nt, hsa; identical to SEQ ID NO: 133039

SEQ ID NO: 605113 - RNA, 64 nt, hsa; identical to SEQ ID NO: 133040

SEQ ID NO: 605114 - RNA, 64 nt, hsa; identical to SEQ ID NO: 133041

SEQ ID NO: 605115 - RNA, 64 nt, hsa; identical to SEQ ID NO: 133042

SEQ ID NO: 605116 - RNA, 64 nt, hsa; identical to SEQ ID NO: 133043

SEQ ID NO: 605117 - RNA, 64 nt, hsa; identical to SEQ ID NO: 133044

SEQ ID NO: 605118 - RNA, 64 nt, hsa; identical to SEQ ID NO: 133045

SEQ ID NO: 605119 - RNA, 64 nt, hsa; identical to SEQ ID NO: 133046

SEQ ID NO: 605120 - RNA, 64 nt, hsa; identical to SEQ ID NO: 133047

SEQ ID NO: 605121 - RNA, 64 nt, hsa; identical to SEQ ID NO: 133048

SEQ ID NO: 605122 - RNA, 64 nt, hsa; identical to SEQ ID NO: 133049

SEQ ID NO: 605123 - RNA, 64 nt, hsa; identical to SEQ ID NO: 132958

SEQ ID NO: 605124 - RNA, 64 nt, hsa; identical to SEQ ID NO: 132959

SEQ ID NO: 605125 - RNA, 64 nt, hsa; identical to SEQ ID NO: 133052

SEQ ID NO: 605126 - RNA, 64 nt, hsa; identical to SEQ ID NO: 133053

SEQ ID NO: 605127 - RNA, 64 nt, hsa; identical to SEQ ID NO: 132959

SEQ ID NO: 605128 - RNA, 64 nt, hsa; identical to SEQ ID NO: 132958

SEQ ID NO: 605129 - RNA, 64 nt, hsa; identical to SEQ ID NO: 133056

SEQ ID NO: 605130 - RNA, 64 nt, hsa; identical to SEQ ID NO: 133057

SEQ ID NO: 605131 - RNA, 64 nt, hsa; identical to SEQ ID NO: 133058

SEQ ID NO: 605132 - RNA, 64 nt, hsa; identical to SEQ ID NO: 133059

SEQ ID NO: 605133 - RNA, 64 nt, hsa; identical to SEQ ID NO: 133060

SEQ ID NO: 605134 - RNA, 64 nt, hsa; identical to SEQ ID NO: 133061

SEQ ID NO: 605135 - RNA, 64 nt, hsa; identical to SEQ ID NO: 133062

SEQ ID NO: 605136 - RNA, 64 nt, hsa; identical to SEQ ID NO: 133063

SEQ ID NO: 605137 - RNA, 64 nt, hsa; identical to SEQ ID NO: 133064

SEQ ID NO: 605138 - RNA, 64 nt, hsa; identical to SEQ ID NO: 133065

SEQ ID NO: 605139 - RNA, 64 nt, hsa; identical to SEQ ID NO: 133066

SEQ ID NO: 605140 - RNA, 64 nt, hsa; identical to SEQ ID NO: 133067

SEQ ID NO: 605141 - RNA, 64 nt, hsa; identical to SEQ ID NO: 133068

SEQ ID NO: 605142 - RNA, 64 nt, hsa; identical to SEQ ID NO: 133069

SEQ ID NO: 605143 - RNA, 64 nt, hsa; identical to SEQ ID NO: 133070

SEQ ID NO: 605144 - RNA, 64 nt, hsa; identical to SEQ ID NO: 133071

SEQ ID NO: 605145 - RNA, 64 nt, hsa; identical to SEQ ID NO: 133072

SEQ ID NO: 605146 - RNA, 64 nt, hsa; identical to SEQ ID NO: 133073

SEQ ID NO: 605147 - RNA, 64 nt, hsa; identical to SEQ ID NO: 133074

SEQ ID NO: 605148 - RNA, 64 nt, hsa; identical to SEQ ID NO: 133075

SEQ ID NO: 605149 - RNA, 64 nt, hsa; identical to SEQ ID NO: 133076

SEQ ID NO: 605150 - RNA, 64 nt, hsa; identical to SEQ ID NO: 133077

SEQ ID NO: 605151 - RNA, 64 nt, hsa; identical to SEQ ID NO: 133078

SEQ ID NO: 605152 - RNA, 64 nt, hsa; identical to SEQ ID NO: 133079

SEQ ID NO: 605153 - RNA, 64 nt, hsa; identical to SEQ ID NO: 133080

SEQ ID NO: 605154 - RNA, 64 nt, hsa; identical to SEQ ID NO: 133081

SEQ ID NO: 605155 - RNA, 64 nt, hsa; identical to SEQ ID NO: 133082

SEQ ID NO: 605156 - RNA, 64 nt, hsa; identical to SEQ ID NO: 133083

SEQ ID NO: 605157 - RNA, 64 nt, hsa; identical to SEQ ID NO: 133084

SEQ ID NO: 605158 - RNA, 64 nt, hsa; identical to SEQ ID NO: 133085

SEQ ID NO: 605159 - RNA, 64 nt, hsa; identical to SEQ ID NO: 133086

SEQ ID NO: 605160 - RNA, 64 nt, hsa; identical to SEQ ID NO: 133087

SEQ ID NO: 605161 - RNA, 64 nt, hsa; identical to SEQ ID NO: 133088

SEQ ID NO: 605162 - RNA, 64 nt, hsa; identical to SEQ ID NO: 133089

SEQ ID NO: 605163 - RNA, 64 nt, hsa; identical to SEQ ID NO: 133090

SEQ ID NO: 605164 - RNA, 64 nt, hsa; identical to SEQ ID NO: 133091

SEQ ID NO: 605165 - RNA, 64 nt, hsa; identical to SEQ ID NO: 133092

SEQ ID NO: 605166 - RNA, 64 nt, hsa; identical to SEQ ID NO: 133093

SEQ ID NO: 605167 - RNA, 64 nt, hsa; identical to SEQ ID NO: 133094

SEQ ID NO: 605168 - RNA, 64 nt, hsa; identical to SEQ ID NO: 133095

SEQ ID NO: 605169 - RNA, 64 nt, hsa; identical to SEQ ID NO: 133096

SEQ ID NO: 605170 - RNA, 64 nt, hsa; identical to SEQ ID NO: 133097

SEQ ID NO: 605171 - RNA, 64 nt, hsa; identical to SEQ ID NO: 133098

SEQ ID NO: 605172 - RNA, 64 nt, hsa; identical to SEQ ID NO: 133099

SEQ ID NO: 605173 - RNA, 64 nt, hsa; identical to SEQ ID NO: 133100

SEQ ID NO: 605174 - RNA, 64 nt, hsa; identical to SEQ ID NO: 133101

SEQ ID NO: 605175 - RNA, 64 nt, hsa; identical to SEQ ID NO: 133102

SEQ ID NO: 605176 - RNA, 64 nt, hsa; identical to SEQ ID NO: 133103

SEQ ID NO: 605177 - RNA, 64 nt, hsa; identical to SEQ ID NO: 133104

SEQ ID NO: 605178 - RNA, 64 nt, hsa; identical to SEQ ID NO: 133105

SEQ ID NO: 605179 - RNA, 64 nt, hsa; identical to SEQ ID NO: 133106

SEQ ID NO: 605180 - RNA, 64 nt, hsa; identical to SEQ ID NO: 133107

SEQ ID NO: 605181 - RNA, 64 nt, hsa; identical to SEQ ID NO: 133108

SEQ ID NO: 605182 - RNA, 64 nt, hsa; identical to SEQ ID NO: 133109

SEQ ID NO: 605183 - RNA, 64 nt, hsa; identical to SEQ ID NO: 133110

SEQ ID NO: 605184 - RNA, 64 nt, hsa; identical to SEQ ID NO: 133111

SEQ ID NO: 605185 - RNA, 64 nt, hsa; identical to SEQ ID NO: 133112

SEQ ID NO: 605186 - RNA, 64 nt, hsa; identical to SEQ ID NO: 133113

SEQ ID NO: 605187 - RNA, 64 nt, hsa; identical to SEQ ID NO: 133114

SEQ ID NO: 605188 - RNA, 64 nt, hsa; identical to SEQ ID NO: 133115

SEQ ID NO: 605189 - RNA, 64 nt, hsa; identical to SEQ ID NO: 133116

SEQ ID NO: 605190 - RNA, 64 nt, hsa; identical to SEQ ID NO: 133117

SEQ ID NO: 605191 - RNA, 64 nt, hsa; identical to SEQ ID NO: 133118

SEQ ID NO: 605192 - RNA, 64 nt, hsa; identical to SEQ ID NO: 133119

SEQ ID NO: 605193 - RNA, 64 nt, hsa; identical to SEQ ID NO: 133120

SEQ ID NO: 605194 - RNA, 64 nt, hsa; identical to SEQ ID NO: 133121

SEQ ID NO: 605195 - RNA, 64 nt, hsa; identical to SEQ ID NO: 133122

SEQ ID NO: 605196 - RNA, 64 nt, hsa; identical to SEQ ID NO: 133123

SEQ ID NO: 605197 - RNA, 64 nt, hsa; identical to SEQ ID NO: 133124

SEQ ID NO: 605198 - RNA, 64 nt, hsa; identical to SEQ ID NO: 133125

SEQ ID NO: 605199 - RNA, 64 nt, hsa; identical to SEQ ID NO: 133126

SEQ ID NO: 605200 - RNA, 64 nt, hsa; identical to SEQ ID NO: 133127

SEQ ID NO: 605201 - RNA, 64 nt, hsa; identical to SEQ ID NO: 133128

SEQ ID NO: 605202 - RNA, 64 nt, hsa; identical to SEQ ID NO: 133129

SEQ ID NO: 605203 - RNA, 64 nt, hsa; identical to SEQ ID NO: 133130

SEQ ID NO: 605204 - RNA, 64 nt, hsa; identical to SEQ ID NO: 133131

SEQ ID NO: 605205 - RNA, 64 nt, hsa; identical to SEQ ID NO: 133132

SEQ ID NO: 605206 - RNA, 64 nt, hsa; identical to SEQ ID NO: 133133

SEQ ID NO: 605207 - RNA, 64 nt, hsa; identical to SEQ ID NO: 133134

SEQ ID NO: 605208 - RNA, 64 nt, hsa; identical to SEQ ID NO: 133135

SEQ ID NO: 605209 - RNA, 64 nt, hsa; identical to SEQ ID NO: 133136

SEQ ID NO: 605210 - RNA, 64 nt, hsa; identical to SEQ ID NO: 133137

SEQ ID NO: 605211 - RNA, 64 nt, hsa; identical to SEQ ID NO: 133138

SEQ ID NO: 605212 - RNA, 64 nt, hsa; identical to SEQ ID NO: 133139

SEQ ID NO: 605213 - RNA, 64 nt, hsa; identical to SEQ ID NO: 133140

SEQ ID NO: 605214 - RNA, 64 nt, hsa; identical to SEQ ID NO: 133141

SEQ ID NO: 605215 - RNA, 64 nt, hsa; identical to SEQ ID NO: 133142

SEQ ID NO: 605216 - RNA, 64 nt, hsa; identical to SEQ ID NO: 133143

SEQ ID NO: 605217 - RNA, 64 nt, hsa; identical to SEQ ID NO: 133144

SEQ ID NO: 605218 - RNA, 64 nt, hsa; identical to SEQ ID NO: 133145

SEQ ID NO: 605219 - RNA, 64 nt, hsa; identical to SEQ ID NO: 133146

SEQ ID NO: 605220 - RNA, 64 nt, hsa; identical to SEQ ID NO: 133147

SEQ ID NO: 605221 - RNA, 64 nt, hsa; identical to SEQ ID NO: 133148

SEQ ID NO: 605222 - RNA, 64 nt, hsa; identical to SEQ ID NO: 133149

SEQ ID NO: 605223 - RNA, 64 nt, hsa; identical to SEQ ID NO: 133150

SEQ ID NO: 605224 - RNA, 64 nt, hsa; identical to SEQ ID NO: 133151

SEQ ID NO: 605225 - RNA, 64 nt, hsa; identical to SEQ ID NO: 133152

SEQ ID NO: 605226 - RNA, 64 nt, hsa; identical to SEQ ID NO: 133153

SEQ ID NO: 605227 - RNA, 64 nt, hsa; identical to SEQ ID NO: 133154

SEQ ID NO: 605228 - RNA, 64 nt, hsa; identical to SEQ ID NO: 133155

SEQ ID NO: 605229 - RNA, 64 nt, hsa; identical to SEQ ID NO: 133156

SEQ ID NO: 605230 - RNA, 64 nt, hsa; identical to SEQ ID NO: 133157

SEQ ID NO: 605231 - RNA, 64 nt, hsa; identical to SEQ ID NO: 133158

SEQ ID NO: 605232 - RNA, 64 nt, hsa
aggaaucuccuauggccaauaagguaucuugacuuuaucaaaguagaagagagggucacuucgg

SEQ ID NO: 605233 - RNA, 64 nt, hsa
uuguguguauauauauaugccuuuguguauacacuuaucaaagcuauuuucuuaugaaaacguc

SEQ ID NO: 605234 - RNA, 64 nt, hsa
aacauugcugguuucaagaaaugaggugauccuauuaucaaauucaaucugaugucaaauagca

SEQ ID NO: 605235 - RNA, 64 nt, hsa
uaccauuugcuggaaauuugacauguguguggcauuaucaaaaugaagaggagcaaggagugaa

SEQ ID NO: 605236 - RNA, 64 nt, hsa
agaguuaauccauaaaauugcucuuuacuuuagcuuaucaaaugaaguauuauuuuguggacug

SEQ ID NO: 605237 - RNA, 64 nt, hsa
ggauauuaugugcccuaauuagcagauauagacauuaucaaauuauaaugauaguauaauuauc

SEQ ID NO: 605238 - RNA, 64 nt, hsa
cauuguaaugauuucacuccuaacugugacauuuuuaucaaaugugugaauaaauacauaaaga

SEQ ID NO: 605239 - RNA, 64 nt, hsa
ugaugucccauuucauucagagcccuuauugcucuuaucaaaacagaagaaggcuacauuugug

SEQ ID NO: 605240 - RNA, 64 nt, hsa
uucugaaacuucauaaauguucagcuucagacuuuuaucaaaaucccuauuuaauuuuccugga

SEQ ID NO: 605241 - RNA, 64 nt, hsa
ugucuauagagaaaaacuuucauuuuugguaggcuuaucaaaaucuuucagcacucagaaaaga

SEQ ID NO: 605242 - RNA, 64 nt, hsa
aacuugcucuugcuuguaaauccuaaucuuagaguuaucaaaagaagaaaaaacugaagguacu

SEQ ID NO: 605243 - RNA, 64 nt, hsa
ggaagaaaagagaugacuaagucaagugucugccuuaucaaaagagcaaaaaugccucugguuu

SEQ ID NO: 605244 - RNA, 64 nt, hsa
cauuugcuucaggaguuucauguuggaucugucauuaucaaaagugaucagcaaugaagaacug

SEQ ID NO: 605245 - RNA, 64 nt, hsa
uauucuucacgcagagauuuucaucuauuauacuuuaucaaagauuggccauguuccacuugga

SEQ ID NO: 605246 - RNA, 64 nt, hsa
uauaaaaaacaauuguauuuuuaagaauguuuauuuaucaaagucuuuccuucuucuauuaaau

SEQ ID NO: 605247 - RNA, 64 nt, hsa
aauaaaugcauugcuuaaugguuucucauuauguuuaucaaaaaacaacuguagcuguuauuuu

SEQ ID NO: 605248 - RNA, 64 nt, hsa
cucugcuaguaauuaugaauuuaagaccauauuauuaucaaaaaccuagagaccaaucauauau

SEQ ID NO: 605249 - RNA, 64 nt, hsa
aucaauugauugaauacaguuuuuacuaauuaguuuaucaaaccaaauacugugaacguaccag

SEQ ID NO: 605250 - RNA, 64 nt, hsa
guaguuaaggaucuucauauuagaauugugucauuuaucaaaccuuuuauuacagaaaaaaauc

SEQ ID NO: 605251 - RNA, 64 nt, hsa
aacaauaguggcaacacuccuauuggcuuuguucuuaucaaauuucucagugccuucucagggu

SEQ ID NO: 605252 - RNA, 64 nt, hsa
acuaauacuggugaaaauuuaccuaaaaccuugguuaucaaauacaucuccaguacauuccguu

SEQ ID NO: 605253 - RNA, 64 nt, hsa
ggcgugagccacugcgcccggccacauucaguucuuaucaaagaaauaacccagacuuaaucuu

SEQ ID NO: 605254 - RNA, 64 nt, hsa
acaguuucuguaaauuauuuagcagccuuaaaguuuaucaaaaaauuguccagauuccacgugc

SEQ ID NO: 605255 - RNA, 64 nt, hsa
gccuuaagagccucagugaagauuguauuuuauuuuaucaaaagccaccuagcagucaucugug

SEQ ID NO: 605256 - RNA, 64 nt, hsa
caacaggcacuguauucauugccaauguuccaaauuaucaaauucaagugaauuuauuugugug

SEQ ID NO: 605257 - RNA, 64 nt, hsa
uacuuugcagaucauaaggcuuuuuauacucuuguuaucaaaauggcuuauuuuucaggcacua

SEQ ID NO: 605258 - RNA, 64 nt, hsa
gaaaaugugugugaucccugcuauggagcagagguuaucaaacuaaagcccauggaccaaaucc

SEQ ID NO: 605259 - RNA, 64 nt, hsa
auccuaucugcugcuuguuuuuguaaauagaguuuuaucaaaccacagccaugcuuacuuguuu

SEQ ID NO: 605260 - RNA, 64 nt, hsa
caauuucuaguaaaaauauccuauauaaccauaauuaucaaaaccagaaaaacaacauugguag

SEQ ID NO: 605261 - RNA, 64 nt, hsa
cuguuuucuugaguuuugugagcccuguagcaaauuaucaaaccugaguagggcagugggaacu

SEQ ID NO: 605262 - RNA, 64 nt, hsa; identical to SEQ ID NO: 484797

SEQ ID NO: 605263 - RNA, 64 nt, hsa; identical to SEQ ID NO: 484798

SEQ ID NO: 605264 - RNA, 64 nt, hsa; identical to SEQ ID NO: 484799

SEQ ID NO: 605265 - RNA, 64 nt, hsa; identical to SEQ ID NO: 484800

SEQ ID NO: 605266 - RNA, 64 nt, hsa; identical to SEQ ID NO: 484801

SEQ ID NO: 605267 - RNA, 64 nt, hsa; identical to SEQ ID NO: 484802

SEQ ID NO: 605268 - RNA, 64 nt, hsa; identical to SEQ ID NO: 484803

SEQ ID NO: 605269 - RNA, 64 nt, hsa; identical to SEQ ID NO: 484804

SEQ ID NO: 605270 - RNA, 64 nt, hsa; identical to SEQ ID NO: 484805

SEQ ID NO: 605271 - RNA, 64 nt, hsa; identical to SEQ ID NO: 484806

SEQ ID NO: 605272 - RNA, 64 nt, hsa; identical to SEQ ID NO: 484807

SEQ ID NO: 605273 - RNA, 64 nt, hsa; identical to SEQ ID NO: 484808

SEQ ID NO: 605274 - RNA, 64 nt, hsa; identical to SEQ ID NO: 484809

SEQ ID NO: 605275 - RNA, 64 nt, hsa; identical to SEQ ID NO: 484810

SEQ ID NO: 605276 - RNA, 64 nt, hsa; identical to SEQ ID NO: 484811

SEQ ID NO: 605277 - RNA, 64 nt, hsa; identical to SEQ ID NO: 484812

SEQ ID NO: 605278 - RNA, 64 nt, hsa; identical to SEQ ID NO: 117329

SEQ ID NO: 605279 - RNA, 64 nt, hsa; identical to SEQ ID NO: 117330

SEQ ID NO: 605280 - RNA, 64 nt, hsa; identical to SEQ ID NO: 117331

SEQ ID NO: 605281 - RNA, 64 nt, hsa; identical to SEQ ID NO: 117332

SEQ ID NO: 605282 - RNA, 64 nt, hsa; identical to SEQ ID NO: 117333

SEQ ID NO: 605283 - RNA, 64 nt, hsa; identical to SEQ ID NO: 117334

SEQ ID NO: 605284 - RNA, 64 nt, hsa; identical to SEQ ID NO: 117335

SEQ ID NO: 605285 - RNA, 64 nt, hsa; identical to SEQ ID NO: 117336

SEQ ID NO: 605286 - RNA, 64 nt, hsa; identical to SEQ ID NO: 117337

SEQ ID NO: 605287 - RNA, 64 nt, hsa; identical to SEQ ID NO: 117338

SEQ ID NO: 605288 - RNA, 64 nt, hsa; identical to SEQ ID NO: 117339

SEQ ID NO: 605289 - RNA, 64 nt, hsa; identical to SEQ ID NO: 117340

SEQ ID NO: 605290 - RNA, 64 nt, hsa; identical to SEQ ID NO: 117341

SEQ ID NO: 605291 - RNA, 64 nt, hsa; identical to SEQ ID NO: 117342

SEQ ID NO: 605292 - RNA, 64 nt, hsa; identical to SEQ ID NO: 117343

SEQ ID NO: 605293 - RNA, 64 nt, hsa; identical to SEQ ID NO: 117344

SEQ ID NO: 605294 - RNA, 64 nt, hsa; identical to SEQ ID NO: 117345

SEQ ID NO: 605295 - RNA, 64 nt, hsa; identical to SEQ ID NO: 117346

SEQ ID NO: 605296 - RNA, 64 nt, hsa; identical to SEQ ID NO: 117347

SEQ ID NO: 605297 - RNA, 64 nt, hsa; identical to SEQ ID NO: 117348

SEQ ID NO: 605298 - RNA, 64 nt, hsa; identical to SEQ ID NO: 117349

SEQ ID NO: 605299 - RNA, 64 nt, hsa; identical to SEQ ID NO: 117350

SEQ ID NO: 605300 - RNA, 64 nt, hsa; identical to SEQ ID NO: 117351

SEQ ID NO: 605301 - RNA, 64 nt, hsa; identical to SEQ ID NO: 117352

SEQ ID NO: 605302 - RNA, 64 nt, hsa; identical to SEQ ID NO: 117353

SEQ ID NO: 605303 - RNA, 64 nt, hsa; identical to SEQ ID NO: 117354

SEQ ID NO: 605304 - RNA, 64 nt, hsa; identical to SEQ ID NO: 117355

SEQ ID NO: 605305 - RNA, 64 nt, hsa; identical to SEQ ID NO: 117356

SEQ ID NO: 605306 - RNA, 64 nt, hsa; identical to SEQ ID NO: 117357

SEQ ID NO: 605307 - RNA, 64 nt, hsa; identical to SEQ ID NO: 117358

SEQ ID NO: 605308 - RNA, 64 nt, hsa; identical to SEQ ID NO: 117359

SEQ ID NO: 605309 - RNA, 64 nt, hsa; identical to SEQ ID NO: 117360

SEQ ID NO: 605310 - RNA, 64 nt, hsa; identical to SEQ ID NO: 117361

SEQ ID NO: 605311 - RNA, 64 nt, hsa; identical to SEQ ID NO: 117362

SEQ ID NO: 605312 - RNA, 64 nt, hsa; identical to SEQ ID NO: 257521

SEQ ID NO: 605313 - RNA, 64 nt, hsa; identical to SEQ ID NO: 257522

SEQ ID NO: 605314 - RNA, 64 nt, hsa; identical to SEQ ID NO: 257523

SEQ ID NO: 605315 - RNA, 64 nt, hsa; identical to SEQ ID NO: 257524

SEQ ID NO: 605316 - RNA, 64 nt, hsa; identical to SEQ ID NO: 147779

SEQ ID NO: 605317 - RNA, 64 nt, hsa; identical to SEQ ID NO: 147780

SEQ ID NO: 605318 - RNA, 64 nt, hsa; identical to SEQ ID NO: 334556

SEQ ID NO: 605319 - RNA, 64 nt, hsa; identical to SEQ ID NO: 334557

SEQ ID NO: 605320 - RNA, 64 nt, hsa; identical to SEQ ID NO: 325832

SEQ ID NO: 605321 - RNA, 64 nt, hsa; identical to SEQ ID NO: 325833

SEQ ID NO: 605322 - RNA, 64 nt, hsa; identical to SEQ ID NO: 325834

SEQ ID NO: 605323 - RNA, 64 nt, hsa; identical to SEQ ID NO: 325835

SEQ ID NO: 605324 - RNA, 64 nt, hsa; identical to SEQ ID NO: 325836

SEQ ID NO: 605325 - RNA, 64 nt, hsa; identical to SEQ ID NO: 325837

SEQ ID NO: 605326 - RNA, 64 nt, hsa; identical to SEQ ID NO: 325838

SEQ ID NO: 605327 - RNA, 64 nt, hsa; identical to SEQ ID NO: 325839

SEQ ID NO: 605328 - RNA, 64 nt, hsa; identical to SEQ ID NO: 325840

SEQ ID NO: 605329 - RNA, 64 nt, hsa; identical to SEQ ID NO: 325841

SEQ ID NO: 605330 - RNA, 64 nt, hsa; identical to SEQ ID NO: 325842

SEQ ID NO: 605331 - RNA, 64 nt, hsa; identical to SEQ ID NO: 325843

SEQ ID NO: 605332 - RNA, 64 nt, hsa; identical to SEQ ID NO: 325844

SEQ ID NO: 605333 - RNA, 64 nt, hsa; identical to SEQ ID NO: 325845

SEQ ID NO: 605334 - RNA, 64 nt, hsa; identical to SEQ ID NO: 325846

SEQ ID NO: 605335 - RNA, 64 nt, hsa; identical to SEQ ID NO: 325847

SEQ ID NO: 605336 - RNA, 64 nt, hsa; identical to SEQ ID NO: 325848

SEQ ID NO: 605337 - RNA, 64 nt, hsa; identical to SEQ ID NO: 325849

SEQ ID NO: 605338 - RNA, 64 nt, hsa; identical to SEQ ID NO: 325850

SEQ ID NO: 605339 - RNA, 64 nt, hsa; identical to SEQ ID NO: 325851

SEQ ID NO: 605340 - RNA, 64 nt, hsa; identical to SEQ ID NO: 325852

SEQ ID NO: 605341 - RNA, 64 nt, hsa; identical to SEQ ID NO: 325853

SEQ ID NO: 605342 - RNA, 64 nt, hsa; identical to SEQ ID NO: 325854

SEQ ID NO: 605343 - RNA, 64 nt, hsa; identical to SEQ ID NO: 325855

SEQ ID NO: 605344 - RNA, 64 nt, hsa; identical to SEQ ID NO: 325856

SEQ ID NO: 605345 - RNA, 64 nt, hsa; identical to SEQ ID NO: 325857

SEQ ID NO: 605346 - RNA, 64 nt, hsa; identical to SEQ ID NO: 325858

SEQ ID NO: 605347 - RNA, 64 nt, hsa; identical to SEQ ID NO: 325859

SEQ ID NO: 605348 - RNA, 64 nt, hsa; identical to SEQ ID NO: 325860

SEQ ID NO: 605349 - RNA, 64 nt, hsa; identical to SEQ ID NO: 325861

SEQ ID NO: 605350 - RNA, 64 nt, hsa; identical to SEQ ID NO: 325862

SEQ ID NO: 605351 - RNA, 64 nt, hsa; identical to SEQ ID NO: 325863

SEQ ID NO: 605352 - RNA, 64 nt, hsa; identical to SEQ ID NO: 325864

SEQ ID NO: 605353 - RNA, 64 nt, hsa; identical to SEQ ID NO: 325865

SEQ ID NO: 605354 - RNA, 64 nt, hsa; identical to SEQ ID NO: 325866

SEQ ID NO: 605355 - RNA, 64 nt, hsa; identical to SEQ ID NO: 325867

SEQ ID NO: 605356 - RNA, 64 nt, hsa; identical to SEQ ID NO: 325868

SEQ ID NO: 605357 - RNA, 64 nt, hsa; identical to SEQ ID NO: 325869

SEQ ID NO: 605358 - RNA, 64 nt, hsa; identical to SEQ ID NO: 325870

SEQ ID NO: 605359 - RNA, 64 nt, hsa; identical to SEQ ID NO: 325871

SEQ ID NO: 605360 - RNA, 64 nt, hsa; identical to SEQ ID NO: 325872

SEQ ID NO: 605361 - RNA, 64 nt, hsa; identical to SEQ ID NO: 325873

SEQ ID NO: 605362 - RNA, 64 nt, hsa; identical to SEQ ID NO: 325874

SEQ ID NO: 605363 - RNA, 64 nt, hsa; identical to SEQ ID NO: 325875

SEQ ID NO: 605364 - RNA, 64 nt, hsa
uccuggacuuuuaaaugaccaugaaguuaucauugaauguuaagauuuuuucuucuugauuuuu

SEQ ID NO: 605365 - RNA, 64 nt, hsa
uaaaaauuuauauuauaggcuucaauguuuucaugaauguuacccaaaaagcuguguuuucuuu

SEQ ID NO: 605366 - RNA, 64 nt, hsa
aaacuaugauagaaucugugugaaugguuaagaugaauguuaaauacuaugcuuuuuuguaagu

SEQ ID NO: 605367 - RNA, 64 nt, hsa
gacauuacauacgcaagucuuucucgacaaucaagaauguuauuaauguguaauacugagcacu

SEQ ID NO: 605368 - RNA, 64 nt, hsa
uaugaccuuaugauaaaucuuuaaguauuggugugaauguuauuuaaauucuauauuuuucuua

SEQ ID NO: 605369 - RNA, 64 nt, hsa
uuauguguuuuauuucuccaagugcgguguuccugaauguuauguaugcuuuuuuuucuguacc

SEQ ID NO: 605370 - RNA, 64 nt, hsa
uccaauauagauguggucauguuugacuuguacagaauguuaaucauacagagaauccuugaug

SEQ ID NO: 605371 - RNA, 64 nt, hsa
ccuugauggaauuauauauguguguuuuacuuuugaauguuacaaaaggaaauaacuuuaaaac

SEQ ID NO: 605372 - RNA, 64 nt, hsa
uguuuauguauauaaucuuauucuguagucaucagaauguuaauguaagguacauuugauuuuu

SEQ ID NO: 605373 - RNA, 64 nt, hsa
uauacuccaaaagauauuugaauuaucuugauuggaauguuauucauaggaaauaacaggaaga

SEQ ID NO: 605374 - RNA, 64 nt, hsa
gaugugaccuuuucugacucugcccagucucuaugaauguuauggccuagggaagaaucaugaa

SEQ ID NO: 605375 - RNA, 64 nt, hsa
uaacccauccuuuacuacagaggcauauggguuugaauguuaccugggguucucucuauugagu

SEQ ID NO: 605376 - RNA, 64 nt, hsa
guuucuucacgagcagacucgcaucacaaagcaugaauguuaacccacagaauccaaggagcau

SEQ ID NO: 605377 - RNA, 64 nt, hsa
uuuauugacauauguacuguauguuacugagauugaauguuaggggaagccuuaagguagaggu

SEQ ID NO: 605378 - RNA, 64 nt, hsa
ucauauacguaagacuggugccuaagaaugacuugaauguuaucaguacuaccacagaacuaua

SEQ ID NO: 605379 - RNA, 64 nt, hsa
cugucccagaaauguaauuuuaugaucccagcaugaauguuauuuucauggaauacuugaaguc

SEQ ID NO: 605380 - RNA, 64 nt, hsa
uuacauaguuuuuaaagucaaugaaagagauugagaauguuaacauuuguugaucaauguggag

SEQ ID NO: 605381 - RNA, 64 nt, hsa
cagacauagaauuucacuuuuggaggggacccuugaauguuaguuucauucaaacuauauuuug

SEQ ID NO: 605382 - RNA, 64 nt, hsa; identical to SEQ ID NO: 169421

SEQ ID NO: 605383 - RNA, 64 nt, hsa; identical to SEQ ID NO: 169422

SEQ ID NO: 605384 - RNA, 64 nt, hsa; identical to SEQ ID NO: 169423

SEQ ID NO: 605385 - RNA, 64 nt, hsa; identical to SEQ ID NO: 169424

SEQ ID NO: 605386 - RNA, 64 nt, hsa; identical to SEQ ID NO: 169425

SEQ ID NO: 605387 - RNA, 64 nt, hsa; identical to SEQ ID NO: 169426

SEQ ID NO: 605388 - RNA, 64 nt, hsa; identical to SEQ ID NO: 169427

SEQ ID NO: 605389 - RNA, 64 nt, hsa; identical to SEQ ID NO: 169428

SEQ ID NO: 605390 - RNA, 64 nt, hsa; identical to SEQ ID NO: 169429

SEQ ID NO: 605391 - RNA, 64 nt, hsa; identical to SEQ ID NO: 169430

SEQ ID NO: 605392 - RNA, 64 nt, hsa; identical to SEQ ID NO: 169431

SEQ ID NO: 605393 - RNA, 64 nt, hsa; identical to SEQ ID NO: 169432

SEQ ID NO: 605394 - RNA, 64 nt, hsa; identical to SEQ ID NO: 169433

SEQ ID NO: 605395 - RNA, 64 nt, hsa; identical to SEQ ID NO: 169434

SEQ ID NO: 605396 - RNA, 64 nt, hsa; identical to SEQ ID NO: 169435

SEQ ID NO: 605397 - RNA, 64 nt, hsa; identical to SEQ ID NO: 169436

SEQ ID NO: 605398 - RNA, 64 nt, hsa; identical to SEQ ID NO: 169437

SEQ ID NO: 605399 - RNA, 64 nt, hsa; identical to SEQ ID NO: 169438

SEQ ID NO: 605400 - RNA, 64 nt, hsa; identical to SEQ ID NO: 169439

SEQ ID NO: 605401 - RNA, 64 nt, hsa; identical to SEQ ID NO: 169440

SEQ ID NO: 605402 - RNA, 64 nt, hsa; identical to SEQ ID NO: 169441

SEQ ID NO: 605403 - RNA, 64 nt, hsa; identical to SEQ ID NO: 169442

SEQ ID NO: 605404 - RNA, 64 nt, hsa; identical to SEQ ID NO: 169443

SEQ ID NO: 605405 - RNA, 64 nt, hsa; identical to SEQ ID NO: 169442

SEQ ID NO: 605406 - RNA, 64 nt, hsa; identical to SEQ ID NO: 169443

SEQ ID NO: 605407 - RNA, 64 nt, hsa
guucuaagcucuaaaugggucaacuccuuuguuuuccgccuagcgacaagggauuugcucgcac

SEQ ID NO: 605408 - RNA, 64 nt, hsa
cugucccguuucccgauugggucugucgucucucuccgccuagcgacagauuccuucuauuaag

SEQ ID NO: 605409 - RNA, 64 nt, hsa; identical to SEQ ID NO: 76340

SEQ ID NO: 605410 - RNA, 64 nt, hsa; identical to SEQ ID NO: 76341

SEQ ID NO: 605411 - RNA, 64 nt, hsa; identical to SEQ ID NO: 76342

SEQ ID NO: 605412 - RNA, 64 nt, hsa; identical to SEQ ID NO: 76343

SEQ ID NO: 605413 - RNA, 64 nt, hsa; identical to SEQ ID NO: 76344

SEQ ID NO: 605414 - RNA, 64 nt, hsa; identical to SEQ ID NO: 76345

SEQ ID NO: 605415 - RNA, 64 nt, hsa; identical to SEQ ID NO: 76346

SEQ ID NO: 605416 - RNA, 64 nt, hsa; identical to SEQ ID NO: 76347

SEQ ID NO: 605417 - RNA, 64 nt, hsa; identical to SEQ ID NO: 76348

SEQ ID NO: 605418 - RNA, 64 nt, hsa; identical to SEQ ID NO: 76349

SEQ ID NO: 605419 - RNA, 64 nt, hsa; identical to SEQ ID NO: 76350

SEQ ID NO: 605420 - RNA, 64 nt, hsa; identical to SEQ ID NO: 76351

SEQ ID NO: 605421 - RNA, 64 nt, hsa; identical to SEQ ID NO: 76352

SEQ ID NO: 605422 - RNA, 64 nt, hsa; identical to SEQ ID NO: 76353

SEQ ID NO: 605423 - RNA, 64 nt, hsa; identical to SEQ ID NO: 76354

SEQ ID NO: 605424 - RNA, 64 nt, hsa; identical to SEQ ID NO: 76355

SEQ ID NO: 605425 - RNA, 64 nt, hsa; identical to SEQ ID NO: 76356

SEQ ID NO: 605426 - RNA, 64 nt, hsa; identical to SEQ ID NO: 76357

SEQ ID NO: 605427 - RNA, 64 nt, hsa; identical to SEQ ID NO: 76358

SEQ ID NO: 605428 - RNA, 64 nt, hsa; identical to SEQ ID NO: 76359

SEQ ID NO: 605429 - RNA, 64 nt, hsa; identical to SEQ ID NO: 76360

SEQ ID NO: 605430 - RNA, 64 nt, hsa; identical to SEQ ID NO: 76361

SEQ ID NO: 605431 - RNA, 64 nt, hsa; identical to SEQ ID NO: 76362

SEQ ID NO: 605432 - RNA, 64 nt, hsa; identical to SEQ ID NO: 76363

SEQ ID NO: 605433 - RNA, 64 nt, hsa; identical to SEQ ID NO: 76364

SEQ ID NO: 605434 - RNA, 64 nt, hsa; identical to SEQ ID NO: 76365

SEQ ID NO: 605435 - RNA, 64 nt, hsa; identical to SEQ ID NO: 76366

SEQ ID NO: 605436 - RNA, 64 nt, hsa; identical to SEQ ID NO: 76367

SEQ ID NO: 605437 - RNA, 64 nt, hsa; identical to SEQ ID NO: 76368

SEQ ID NO: 605438 - RNA, 64 nt, hsa; identical to SEQ ID NO: 76369

SEQ ID NO: 605439 - RNA, 64 nt, hsa; identical to SEQ ID NO: 76370

SEQ ID NO: 605440 - RNA, 64 nt, hsa; identical to SEQ ID NO: 76371

SEQ ID NO: 605441 - RNA, 64 nt, hsa; identical to SEQ ID NO: 76372

SEQ ID NO: 605442 - RNA, 64 nt, hsa; identical to SEQ ID NO: 76373

SEQ ID NO: 605443 - RNA, 64 nt, hsa; identical to SEQ ID NO: 76374

SEQ ID NO: 605444 - RNA, 64 nt, hsa; identical to SEQ ID NO: 76375

SEQ ID NO: 605445 - RNA, 64 nt, hsa; identical to SEQ ID NO: 76376

SEQ ID NO: 605446 - RNA, 64 nt, hsa; identical to SEQ ID NO: 76377

SEQ ID NO: 605447 - RNA, 64 nt, hsa; identical to SEQ ID NO: 76378

SEQ ID NO: 605448 - RNA, 64 nt, hsa; identical to SEQ ID NO: 76379

SEQ ID NO: 605449 - RNA, 64 nt, hsa; identical to SEQ ID NO: 76380

SEQ ID NO: 605450 - RNA, 64 nt, hsa; identical to SEQ ID NO: 76381

SEQ ID NO: 605451 - RNA, 64 nt, hsa
uauuuuauauugaguugaauauugaacucuaacaguuuucuacauacaaaacacagugucauga

SEQ ID NO: 605452 - RNA, 64 nt, hsa
aauauuuucugauaauugcuuuuuuuauucuuguguuuucuacuuaaacauaaugucuguguca

SEQ ID NO: 605453 - RNA, 64 nt, hsa
ucuagaacuuuaaagaaaaaagaauguuauauuaguuuucuaaaacucaacuaucuuuagucau

SEQ ID NO: 605454 - RNA, 64 nt, hsa
ucaaaaaucuauugcuagaucauaguagauacugguuuucuauuaacucaaaaccuacauugac

SEQ ID NO: 605455 - RNA, 64 nt, hsa
uccguguuuuaacuuuuugagaaacugccagacuguuuucuauagcagcuguaccauuuuacau

SEQ ID NO: 605456 - RNA, 64 nt, hsa
auaucucuuuugugacuggcuucuuccacugaauguuuucuagggccguccaaguugaggaugu

SEQ ID NO: 605457 - RNA, 64 nt, hsa
ucuuuuaauugaauauaagggacauuccaauaagguuuucuaugaacuauauauuuauuaaggu

SEQ ID NO: 605458 - RNA, 64 nt, hsa
auaugaugucauuaauacuuuuucuaaauguuuaguuuucuaaauuguauaauaauucaaaauu

SEQ ID NO: 605459 - RNA, 64 nt, hsa
uauuauuuuacggagcugcaaccuccaauuuuguguuuucuaagugauuuacuuaagucaauaa

SEQ ID NO: 605460 - RNA, 64 nt, hsa
aacagauggaauccuguggacuaaugugccaccaguuuucuaacaaggguguacauaaaaugga

SEQ ID NO: 605461 - RNA, 64 nt, hsa
aaggacaaaguuuuaaaagcguauuuaacuugauguuuucuaucagcauaaauaaaauggucau

SEQ ID NO: 605462 - RNA, 64 nt, hsa
cagauugucucuucuauauugaaagcauuuuuauguuuucuaauuuaaaaauuaauauuuucuu

SEQ ID NO: 605463 - RNA, 64 nt, hsa
auucaauuuaaagcuauuuuuccucagaguuuuuguuuucuauauauuaagucuaaauuaaguu

SEQ ID NO: 605464 - RNA, 64 nt, hsa
aguuuuuguuuucuauauauuaagucuaaauuaaguuuucuacucauuaagacuaacaucuccc

SEQ ID NO: 605465 - RNA, 64 nt, hsa
augguaagggugagggucauagggcagguuuuggguuuucuaguacuguugaaaacugcaagua

SEQ ID NO: 605466 - RNA, 64 nt, hsa
ugucauuccaagguuucuucaugagucauuccaaguuuucuaguccauaccacagugccuugca

SEQ ID NO: 605467 - RNA, 64 nt, hsa
ggcuuaacuggguaauuuguggucuaggccuuuuguuuucuaagcuuacuaucuuguguuuguu

SEQ ID NO: 605468 - RNA, 64 nt, hsa
aaacacuaguaauuaaaaugugccuuuugaagauguuuucuaagagaaaggaaauacguugcag

SEQ ID NO: 605469 - RNA, 64 nt, hsa
guaacugguaguguucaguaaaagcaaaaugauaguuuucuagaugacauaaaauuuacauuua

SEQ ID NO: 605470 - RNA, 64 nt, hsa
aaacuaguggaaauuagagaguuguuuuauugguguuuucuacugugaguuaauuaaaaauugu

SEQ ID NO: 605471 - RNA, 64 nt, hsa
agauguccuuaauaagggaagucauguauaagauguuuucuaaaagacuuuucaguauuacaac

SEQ ID NO: 605472 - RNA, 64 nt, hsa
accuggccucuguccucuuuuagucuagugucugguuuucuagcaaacaguaaauuuaaacaag

SEQ ID NO: 605473 - RNA, 64 nt, hsa
accugcuguuaauguuuuuuccccccuugugaauguuuucuaacuuugucuugguaauugcaau

SEQ ID NO: 605474 - RNA, 64 nt, hsa
aggaaugguauuuucgguuuauugacauugaauuguuuucuaaguuuuuccaucacaagauagg

SEQ ID NO: 605475 - RNA, 64 nt, hsa
cugcuuuauuucuucuucaagagaugccuaaaauguuuucuauuuaaaaauuacaaaaaugaac

SEQ ID NO: 605476 - RNA, 64 nt, hsa
aaaacuuuuguaaaaauuaaauuuggaauuacuuguuuucuagcuuuaaaugccugcuuuauuu

SEQ ID NO: 605477 - RNA, 64 nt, hsa
augccaucuacuuucuagaaacacuaaaguuauuguuuucuaaguuaaauaacuauaauuuaua

SEQ ID NO: 605478 - RNA, 64 nt, hsa
ugcuauuuguugucaauuuauagcugauuugaagguuuucuauuuaacacugguugacaguaua

SEQ ID NO: 605479 - RNA, 64 nt, hsa
gagcaagauaauaaaggagaugggccauacaaauguuuucuacuuucguugugacaacauugau

SEQ ID NO: 605480 - RNA, 64 nt, hsa
guucuaauucaguagcuugaggaacaggaacauuguuuucuagagcaagauaauaaaggagaug

SEQ ID NO: 605481 - RNA, 64 nt, hsa
guauuaacucgcagacccucuggggguaggggcuguuuucuaaguuacaggcagagugggacug

SEQ ID NO: 605482 - RNA, 64 nt, hsa
guccucaaugcuguccuuuguuuuacagguacaaguuuucuagcucagacaaacuaugaaaaac

SEQ ID NO: 605483 - RNA, 64 nt, hsa
cuucucuugcauuauuuucccuuuugguugguuuguuuucuagaaguacguucagaugcuuugg

SEQ ID NO: 605484 - RNA, 64 nt, hsa
uggugauuuuuuaaauaucauguaauguuaaaacguuuucuaacaguuuacuguugcuuaucuc

SEQ ID NO: 605485 - RNA, 64 nt, hsa
uuuuuaaaccaccgauuccaagaggaugaggaguguuuucuaaaaugcaguaggcuuggggagu

SEQ ID NO: 605486 - RNA, 64 nt, hsa
gucacaagagggaaggacuuggagaggagaauuaguuuucuaggcucauuggcauuuaguuucc

SEQ ID NO: 605487 - RNA, 64 nt, hsa
ccuauuuuuguagugaccuguuuaugagaugcugguuuucuacccaacggcccugcagccagcu

SEQ ID NO: 605488 - RNA, 64 nt, hsa
uagcgcuguuuuuguugugugugcagggagggcaguuuucuaauggaaugguuugggaauaucc

SEQ ID NO: 605489 - RNA, 64 nt, hsa
uuacaucuugccuugauacccagguauggagagaguuuucuauuuuuuuagacuuuuuuuccuc

SEQ ID NO: 605490 - RNA, 64 nt, hsa
auauuugcuuggggaacuaagugcugacuaguuuguuuucuaugucaaggggcaauauuaaaaa

SEQ ID NO: 605491 - RNA, 64 nt, hsa
acuggcucguuuccgugcccaaauccaaggcgaaguuuucuagaggguucuugggcucuuggca

SEQ ID NO: 605492 - RNA, 64 nt, hsa
cuuuccuuguggauuuucuuauucucguugucaaguuuucuaggguugaauuuuuuucuuuuuu

SEQ ID NO: 605493 - RNA, 64 nt, hsa
ggugcuguucauuaauucuugugccuuuuggcuuguuuucuagaguuucugggcuuuggcugcu

SEQ ID NO: 605494 - RNA, 64 nt, hsa
cuagauauccuuaaaugauguuucaauuuuauauguuuucuaagauaauuggaucagguuuucu

SEQ ID NO: 605495 - RNA, 64 nt, hsa
cuuuuuaaaagaaaacucaguauuauuuuugcauguuuucuaaccaauuuucaacuauuuaacc

SEQ ID NO: 605496 - RNA, 64 nt, hsa
caacaacugacaagggcagggcaccgccuccucuguuuucuaggcuuuauaaaguccaauuuca

SEQ ID NO: 605497 - RNA, 64 nt, hsa
ugaaaacacugcauuuaagaauuuuuaaaaauugguuuucuaaaauuaaaauguccaaauuagg

SEQ ID NO: 605498 - RNA, 64 nt, hsa
gaaggaaccucgguacuucuuaagguuuguuuguguuuucuaaaaccagagaauaaggaacuga

SEQ ID NO: 605499 - RNA, 64 nt, hsa
augaaaauugucuauuuuuaucuauauauuuaaaguuuucuaaaaaugauaaaagguuauuacg

SEQ ID NO: 605500 - RNA, 64 nt, hsa
aaaguauugcuaguaaaugauuuguagaaacuugguuuucuaagcauaguucuuccauaaccac

SEQ ID NO: 605501 - RNA, 64 nt, hsa
uuugucaucauuaaaagcaaggcucaagggacauguuuucuagccuuaguuccccaucuacaaa

SEQ ID NO: 605502 - RNA, 64 nt, hsa
ggcgugagccaccacgcccggucaccuuuguccuguuuucuacagguuagaagcaaggcacaag

SEQ ID NO: 605503 - RNA, 64 nt, hsa
uuuuucugucucuguguuugaaguuucaguuucuguuuucuagguaaggcuuauuuuugauuag

SEQ ID NO: 605504 - RNA, 64 nt, hsa
uaucuugucugagacugcauucguaucugagcagguuuucuaugccuacugaugucaguauguu

SEQ ID NO: 605505 - RNA, 64 nt, hsa
aaugaagaaaggucacuaaagggagaaaugacauguuuucuauuuucuuuucaugaaaacacug

SEQ ID NO: 605506 - RNA, 64 nt, hsa
uuuaguuuuaguuuucuggaauagcuaguauuggguuuucuaguuuuuucaccuuuuaguuuuu

SEQ ID NO: 605507 - RNA, 64 nt, hsa
ucuguucccaaggaagcuccuuccuguuuguuuuguuuucuaagauguucauuuuuaaagccug

SEQ ID NO: 605508 - RNA, 64 nt, hsa
cccugccuuuaaaugaaacaagucuagucuucugguuuucuagccccucuggauucccuuuuga

SEQ ID NO: 605509 - RNA, 64 nt, hsa
agcacaucacugguuuucuaggagggacucuuaaguuuucuaccugggcugacguugccuuguc

SEQ ID NO: 605510 - RNA, 64 nt, hsa
ggccugugucccugaaagggccagcacaucacugguuuucuaggagggacucuuaaguuuucua

SEQ ID NO: 605511 - RNA, 64 nt, hsa; identical to SEQ ID NO: 217880

SEQ ID NO: 605512 - RNA, 64 nt, hsa; identical to SEQ ID NO: 217881

SEQ ID NO: 605513 - RNA, 64 nt, hsa; identical to SEQ ID NO: 217882

SEQ ID NO: 605514 - RNA, 64 nt, hsa; identical to SEQ ID NO: 217883

SEQ ID NO: 605515 - RNA, 64 nt, hsa; identical to SEQ ID NO: 217884

SEQ ID NO: 605516 - RNA, 64 nt, hsa; identical to SEQ ID NO: 217885

SEQ ID NO: 605517 - RNA, 64 nt, hsa; identical to SEQ ID NO: 217886

SEQ ID NO: 605518 - RNA, 64 nt, hsa; identical to SEQ ID NO: 217887

SEQ ID NO: 605519 - RNA, 64 nt, hsa; identical to SEQ ID NO: 217888

SEQ ID NO: 605520 - RNA, 64 nt, hsa; identical to SEQ ID NO: 217889

SEQ ID NO: 605521 - RNA, 64 nt, hsa; identical to SEQ ID NO: 217890

SEQ ID NO: 605522 - RNA, 64 nt, hsa; identical to SEQ ID NO: 217891

SEQ ID NO: 605523 - RNA, 64 nt, hsa; identical to SEQ ID NO: 217892

SEQ ID NO: 605524 - RNA, 64 nt, hsa; identical to SEQ ID NO: 217893

SEQ ID NO: 605525 - RNA, 64 nt, hsa; identical to SEQ ID NO: 217894

SEQ ID NO: 605526 - RNA, 64 nt, hsa; identical to SEQ ID NO: 217895

SEQ ID NO: 605527 - RNA, 64 nt, hsa; identical to SEQ ID NO: 217896

SEQ ID NO: 605528 - RNA, 64 nt, hsa; identical to SEQ ID NO: 217897

SEQ ID NO: 605529 - RNA, 64 nt, hsa; identical to SEQ ID NO: 217898

SEQ ID NO: 605530 - RNA, 64 nt, hsa; identical to SEQ ID NO: 217899

SEQ ID NO: 605531 - RNA, 64 nt, hsa; identical to SEQ ID NO: 217900

SEQ ID NO: 605532 - RNA, 64 nt, hsa; identical to SEQ ID NO: 217901

SEQ ID NO: 605533 - RNA, 64 nt, hsa; identical to SEQ ID NO: 217902

SEQ ID NO: 605534 - RNA, 64 nt, hsa; identical to SEQ ID NO: 217903

SEQ ID NO: 605535 - RNA, 64 nt, hsa; identical to SEQ ID NO: 217904

SEQ ID NO: 605536 - RNA, 64 nt, hsa; identical to SEQ ID NO: 217905

SEQ ID NO: 605537 - RNA, 64 nt, hsa; identical to SEQ ID NO: 217906

SEQ ID NO: 605538 - RNA, 64 nt, hsa; identical to SEQ ID NO: 217907

SEQ ID NO: 605539 - RNA, 64 nt, hsa; identical to SEQ ID NO: 217908

SEQ ID NO: 605540 - RNA, 64 nt, hsa; identical to SEQ ID NO: 217909

SEQ ID NO: 605541 - RNA, 64 nt, hsa; identical to SEQ ID NO: 217910

SEQ ID NO: 605542 - RNA, 64 nt, hsa; identical to SEQ ID NO: 217911

SEQ ID NO: 605543 - RNA, 64 nt, hsa
uggggguauucguuucuuaaacaauccaaaucuaagcuuagaagaaaaguuuagcguuaagcac

SEQ ID NO: 605544 - RNA, 64 nt, hsa
uucucuuggacauacuaaaaaauaccuaaaaggaagcuuagaugggcugugacacaaaaaauuc

SEQ ID NO: 605545 - RNA, 64 nt, hsa
cgauacacuugcuuuggucaccagaggaggacagagcuuagagcagcuguggagaaucugaagc

SEQ ID NO: 605546 - RNA, 64 nt, hsa
aagcaucuuaaagcuguuuggugauaaagaaggcagcuuagauucugugguuggaaacagugua

SEQ ID NO: 605547 - RNA, 64 nt, hsa
gagccucucaucaccgccugugaaauggggaccacccuccuaaucuacuauccagaccugccuu

SEQ ID NO: 605548 - RNA, 64 nt, hsa
cgaguguggacuggcccggcuucggugaaaggugcccuccuaccuagcagggucucggcacucu

SEQ ID NO: 605549 - RNA, 64 nt, hsa
cucucacuuugccuaagagacagacacacagaaacccuccuagcagcuguccuugcacgcagag

SEQ ID NO: 605550 - RNA, 64 nt, hsa
gacccggccaauaaggacccugugcgucuucucccccuccuaagcccuuguguccuuaaaaaua

SEQ ID NO: 605551 - RNA, 64 nt, hsa
ugaaacugacagagccugggcuccagaccucucucccuccuacagugcucucccucccugggca

SEQ ID NO: 605552 - RNA, 64 nt, hsa
agcagcugugaccagguuccucccuccccaccugcccuccuagcuccagcacugcccccguggc

SEQ ID NO: 605553 - RNA, 64 nt, hsa; identical to SEQ ID NO: 53437

SEQ ID NO: 605554 - RNA, 64 nt, hsa; identical to SEQ ID NO: 53438

SEQ ID NO: 605555 - RNA, 64 nt, hsa; identical to SEQ ID NO: 53439

SEQ ID NO: 605556 - RNA, 64 nt, hsa; identical to SEQ ID NO: 53440

SEQ ID NO: 605557 - RNA, 64 nt, hsa; identical to SEQ ID NO: 53441

SEQ ID NO: 605558 - RNA, 64 nt, hsa; identical to SEQ ID NO: 53442

SEQ ID NO: 605559 - RNA, 64 nt, hsa; identical to SEQ ID NO: 53443

SEQ ID NO: 605560 - RNA, 64 nt, hsa; identical to SEQ ID NO: 53444

SEQ ID NO: 605561 - RNA, 64 nt, hsa; identical to SEQ ID NO: 53445

SEQ ID NO: 605562 - RNA, 64 nt, hsa; identical to SEQ ID NO: 53446

SEQ ID NO: 605563 - RNA, 64 nt, hsa; identical to SEQ ID NO: 53447

SEQ ID NO: 605564 - RNA, 64 nt, hsa; identical to SEQ ID NO: 53448

SEQ ID NO: 605565 - RNA, 64 nt, hsa; identical to SEQ ID NO: 53449

SEQ ID NO: 605566 - RNA, 64 nt, hsa; identical to SEQ ID NO: 53450

SEQ ID NO: 605567 - RNA, 64 nt, hsa; identical to SEQ ID NO: 53451

SEQ ID NO: 605568 - RNA, 64 nt, hsa; identical to SEQ ID NO: 53452

SEQ ID NO: 605569 - RNA, 64 nt, hsa; identical to SEQ ID NO: 53453

SEQ ID NO: 605570 - RNA, 64 nt, hsa; identical to SEQ ID NO: 53454

SEQ ID NO: 605571 - RNA, 64 nt, hsa
ccaguuuaagauaggaggaaggagagcaauuucuaaguuucaauccugcgcuguacaguugaag

SEQ ID NO: 605572 - RNA, 64 nt, hsa
cuggcugcuggggcuacuucauucccccuccauaaaguuucagccauuaugggcacugguuuua

SEQ ID NO: 605573 - RNA, 64 nt, hsa
acacaugauuauguuaagaggcuuuaagauuuaaaaguuucacacaaccauaaguauaguauuu

SEQ ID NO: 605574 - RNA, 64 nt, hsa
guggacuggaauuuuuuucauuaauguguucaucaaguuucacaucuaaguugaaacagggugu

SEQ ID NO: 605575 - RNA, 64 nt, hsa
gaaaaaaaaaaaacaaaaacccaaaaaguacuuaaaguuucauuuacuuagcuaggagaaagac

SEQ ID NO: 605576 - RNA, 64 nt, hsa
gaaucuauuaaaaaugcacuuguuccuuaaaggaaaguuucauuuggccgggcgcgguggcuca

SEQ ID NO: 605577 - RNA, 64 nt, hsa
aaauguaugcauucacauuuagaaaagugaauugaaguuucaaguuuuaaaguucauugcaauu

SEQ ID NO: 605578 - RNA, 64 nt, hsa
cauaugcagaaauagacaaaaaguauauuaaacaaaguuucagaguauauuguugaagagacag

SEQ ID NO: 605579 - RNA, 64 nt, hsa
acaaaagauucuaaggccuaguaguauuuaaacuaaguuucagaauguucccuucuuguagaga

SEQ ID NO: 605580 - RNA, 64 nt, hsa
uguaacauaguacuucaaaguauuauucaacuucaaguuucagcaacuaccuacaaaagauucu

SEQ ID NO: 605581 - RNA, 64 nt, hsa
augaucauuugcccuuaaggacaaaaaugaacugaaguuucacaugagcuauuuccauuccaga

SEQ ID NO: 605582 - RNA, 64 nt, hsa
aguccagauauuucacauuuugaaaggucaaagcaaguuucaucagucaaugaggaagauuuug

SEQ ID NO: 605583 - RNA, 64 nt, hsa
uauuaaagaaccaaaaguuuuccugagaauaagaaaguuucacccaauaaaauauuuuugaaag

SEQ ID NO: 605584 - RNA, 64 nt, hsa
uccuaaaagacuugcggaaucacucuguccuuggaaguuucauauauuguuugauaugaagugu

SEQ ID NO: 605585 - RNA, 64 nt, hsa
uaaacccuuauaauaaaauccuucuguaauaauaaaguuucaaaagaaaauguuuauuuguucu

SEQ ID NO: 605586 - RNA, 64 nt, hsa
aaaacucaaucacauucaauuccagaguaguuucaaguuucacaucguaaccauuuucgccccc

SEQ ID NO: 605587 - RNA, 64 nt, hsa
uuugccuagcaugucccuguggcgucucaaaaaaaaguuucaucgucccgucauuguuucugau

SEQ ID NO: 605588 - RNA, 64 nt, hsa
uagcauuagaauuuugucuuaaaauaacagcgguaaguuucacuuuuuauucuguauugugcag

SEQ ID NO: 605589 - RNA, 64 nt, hsa
auuuauauuaucauucuaguuucagaguauacagaaguuucaucccaucauuuggaaaaauaaa

SEQ ID NO: 605590 - RNA, 64 nt, hsa
ucauuucagcauuaacccaaaaguccgcaguccaaaguuucaucugagacaaggcaagucccuu

SEQ ID NO: 605591 - RNA, 64 nt, hsa
aagucugugagauucauucaugucauguguacaaaaguuucauccuuuucauugccauguaggg

SEQ ID NO: 605592 - RNA, 64 nt, hsa
acaucaccacaguuuaauaccacagcuuuuuaccaaguuucagguauuaagaaaaucuauuuug

SEQ ID NO: 605593 - RNA, 64 nt, hsa
cauguaguaggacagagaacagaaggccgaauccaaguuucaugugguaggacagagaacggca

SEQ ID NO: 605594 - RNA, 64 nt, hsa
uauguuucuaaaagcuuuagugaaggcugaauccaaguuucauguaguaggacagagaacagaa

SEQ ID NO: 605595 - RNA, 64 nt, hsa
acaaagaugagacuguguuugguuacauuuuccaaaguuucauugcauucucccuuggggaggc

SEQ ID NO: 605596 - RNA, 64 nt, hsa
cuucaauauuucagcaggguacacaggcguuuccaaguuucagugacaccguccugccuaacca

SEQ ID NO: 605597 - RNA, 64 nt, hsa
ccuuuuguuuucuauauacccugaccuuuuaauaaaguuucaguguauuuaucauuggucuuua

SEQ ID NO: 605598 - RNA, 64 nt, hsa
cuugcuuuaaacagccuuuucuucuuucucuuaaaaguuucauuuggggagcuggucuucuaag

SEQ ID NO: 605599 - RNA, 64 nt, hsa
uuuagaauuauuaauauuucuaauauuuuaacacaaguuucaggaaacuugguuuugauuguuc

SEQ ID NO: 605600 - RNA, 64 nt, hsa
gccuagcuaauuuuuuguauuuuuaguagagaugaaguuucaccguguuggccaggauggucuu

SEQ ID NO: 605601 - RNA, 64 nt, hsa
aaggaagcacagaagucgcaggcagccucucagaaaguuucacccccagaggacgaagagguca

SEQ ID NO: 605602 - RNA, 64 nt, hsa
ugugaguugaaccccaguacugacagccuccuuaaaguuucacccccagagggagccgagacuc

SEQ ID NO: 605603 - RNA, 64 nt, hsa
ccugucugaggggagcccagaggcacauccggacaaguuucagauaacccguggggauaguuuu

SEQ ID NO: 605604 - RNA, 64 nt, hsa
guccauguuaucggcucgguacucaacacaacccaaguuucauccgaggaaauguccccgcagu

SEQ ID NO: 605605 - RNA, 64 nt, hsa
uuuaguauuuacaguaauaaauaaaauuuauacaaaguuucagagaacuaccaacucucuaguu

SEQ ID NO: 605606 - RNA, 64 nt, hsa
auuaaagcuugaaaacauuuagcauuugaauaguaaguuucaucacaaaucaugucuuuugccu

SEQ ID NO: 605607 - RNA, 64 nt, hsa
auugagaauuuauagccaaggauccucaaaacagaaguuucaucuuaggauaguguuugauaua

SEQ ID NO: 605608 - RNA, 64 nt, hsa
acuuuucugccuucuaucacugauaguagcauuuaaguuucagauucuacagccuagucagcag

SEQ ID NO: 605609 - RNA, 63 nt, hsa
acauagucuuuuuuaaauggaaggagaaaaugucagccacauuacugucuguguagugccagg

SEQ ID NO: 605610 - RNA, 63 nt, hsa
cagaggcuaguggucacagacagcugggaauggcagccacagaggguccccucugggagaaac

SEQ ID NO: 605611 - RNA, 63 nt, hsa
agccuggugccacagucacgugggggaagaccucagccacagcuguaagcagcucucugccag

SEQ ID NO: 605612 - RNA, 63 nt, hsa
agaccucagccacagcuguaagcagcucucugccagccacauggccggggaccgaaaaacucc

SEQ ID NO: 605613 - RNA, 63 nt, hsa
cacuuggaguaugaacaaugggcacgggguuuucagccacaguucccucgaggccaguguuca

SEQ ID NO: 605614 - RNA, 63 nt, hsa
uauguaaagaugaaggcagagaucggaguuuugcagccacaagcuaagaaacaccaaggauug

SEQ ID NO: 605615 - RNA, 63 nt, hsa
acuuacgugguaaaaaaugaagucuccugcccacagccacauuagugaaccuagaagcagaga

SEQ ID NO: 605616 - RNA, 63 nt, hsa
gacucuccacucccccugccgcccacacugcagcagccacauccauacacacacgcucgcaca

SEQ ID NO: 605617 - RNA, 63 nt, hsa
ugacucaguuucccucccuucucccuccauccgcagccacaggggaacucgucucuuacauac

SEQ ID NO: 605618 - RNA, 63 nt, hsa
ugaggggaggguugagggaggcucuggaaagcccagccacaccugagucccuggcaguagccu

SEQ ID NO: 605619 - RNA, 63 nt, hsa
cuggugguagaacuccaguucuguggcaaggggcagccacaccauuucucucucauugacuca

SEQ ID NO: 605620 - RNA, 63 nt, hsa
cacugccacugucccuuggcacgcacacagccacagccacacgugugaccugcugggccgugg

SEQ ID NO: 605621 - RNA, 63 nt, hsa
auggcacacugccacugucccuuggcacgcacacagccacagccacacgugugaccugcuggg

SEQ ID NO: 605622 - RNA, 63 nt, hsa
guuuacauuggccuuugguuuuuuuuuuucuuucagccacaacuauaugcugauauaacucag

SEQ ID NO: 605623 - RNA, 63 nt, hsa
uuggauagcugccacuaggguugcuucgaucuucagccacaugcuguccuugaagcagcuauu

SEQ ID NO: 605624 - RNA, 63 nt, hsa
agaaaggacagagccagcggcuccaacuccuuucagccacaugccccaggcucucgcugcccu

SEQ ID NO: 605625 - RNA, 63 nt, hsa
cagccacaggccaaauccuuggagucccaggggcagccacaccacugccauuacccagugccg

SEQ ID NO: 605626 - RNA, 63 nt, hsa
uccuuguuaccuaucucguguguguuauuuccccagccacaggccaaauccuuggagucccag

SEQ ID NO: 605627 - RNA, 63 nt, hsa
ucugcauccccugcacccgcuaccacaccagcucagccacagcagagccaaucacagacccac

SEQ ID NO: 605628 - RNA, 63 nt, hsa
acgaccauugaaaauaucucugugucuguccaccagccacagcccaaacacaucaaacuugcu

SEQ ID NO: 605629 - RNA, 63 nt, hsa
gccgaccauccucgcaguugcaugugacagccacagccacacgcauggacguuucauccaaca

SEQ ID NO: 605630 - RNA, 63 nt, hsa
uugggagccgaccauccucgcaguugcaugugacagccacagccacacgcauggacguuucau

SEQ ID NO: 605631 - RNA, 63 nt, hsa
cccccaguaugggaaccagcaccucccaccaaccagccacacccggugggggcacagcacaga

SEQ ID NO: 605632 - RNA, 63 nt, hsa
cccccggugugggaaccagcaccucccaccaaccagccacacccagugggggcacagcacaga

SEQ ID NO: 605633 - RNA, 63 nt, hsa
guugcaggacacuccgggggagaauguggaacccagccacacugccaccgccacacuagugcu

SEQ ID NO: 605634 - RNA, 63 nt, hsa
ggcaccagaugccagggaagggacagaggaaaacagccacaaacaagccaggggggcuccccg

SEQ ID NO: 605635 - RNA, 63 nt, hsa
aagaccccccgccagcuucccacaccucauacgcagccacaucugcccuauucuccaugcuuu

SEQ ID NO: 605636 - RNA, 63 nt, hsa
cccagaacaacaguuggcaggacaggugugacacagccacagcagaggcaaggggugccagga

SEQ ID NO: 605637 - RNA, 63 nt, hsa
gccagcaaugugguuccugugcacugagcccaccagccacagugcccauguccccucuggaag

SEQ ID NO: 605638 - RNA, 63 nt, hsa
aucaaauuacugaagaucucaucaugcaugugucagccacagcgaaucccaugucuugguuau

SEQ ID NO: 605639 - RNA, 63 nt, hsa
caaccaaaauuauuaagcucugugcgaggcugucagccacacuagguaucagggaucccgaga

SEQ ID NO: 605640 - RNA, 63 nt, hsa
ccucuucccccagggcuucccaagcucuuuccacagccacaucagucagggcauggcuccaau

SEQ ID NO: 605641 - RNA, 63 nt, hsa
auaugugagcauuggccaucaaccccaucaaaccagccacagccguggaacaggcaaggaugg

SEQ ID NO: 605642 - RNA, 63 nt, hsa
cagccauacuugacuguccccaaacucucccugcagccacauguuucccaugaccugugggcu

SEQ ID NO: 605643 - RNA, 63 nt, hsa
agugugcacgccguccggccaugcccacagccacagccacagcugaggaguggccgggcaggc

SEQ ID NO: 605644 - RNA, 63 nt, hsa
cggcccagugugcacgccguccggccaugcccacagccacagccacagcugaggaguggccgg

SEQ ID NO: 605645 - RNA, 63 nt, hsa
gauuuucccuacacuucucccuggcccaggcuccagccacaggcaccucuccugcccccgccc

SEQ ID NO: 605646 - RNA, 63 nt, hsa
agccagagucaaugccuucaugggaagggcucccagccacacccagaguggcccaaagcuguu

SEQ ID NO: 605647 - RNA, 63 nt, hsa
acacacacgcuuguucacacucagaacccaggacagccacagccaccgcuuaggggaagccac

SEQ ID NO: 605648 - RNA, 63 nt, hsa
agaacugcucagggacauuaaaggucaaaaguccagccacacucauucauccuuuccccaggc

SEQ ID NO: 605649 - RNA, 63 nt, hsa
gaaaaagucagcgggucaagcuagccuguggcccagccacaacuagcugacaaagcuuccugg

SEQ ID NO: 605650 - RNA, 63 nt, hsa
uuauucauccaucccuuucagaccuaacagccacagccacacggaaagagacuuugccucacu

SEQ ID NO: 605651 - RNA, 63 nt, hsa
gcuuaguuauucauccaucccuuucagaccuaacagccacagccacacggaaagagacuuugc

SEQ ID NO: 605652 - RNA, 63 nt, hsa
cacagagaaagccagcugucgucauuugagagccagccacagccucuggggagccagucauuu

SEQ ID NO: 605653 - RNA, 63 nt, hsa
aggaagauguccuuccuggggaagaagaagcaccagccacaggggcagguguccucccaggaa

SEQ ID NO: 605654 - RNA, 63 nt, hsa
acgaucaaguuacacagcuuuauuggcccccagcagccacaguucccccaagggggcuuuggg

SEQ ID NO: 605655 - RNA, 63 nt, hsa
cccagaccccacauccccucagaacgcugcgcccagccacacccacgaucaaguuacacagcu

SEQ ID NO: 605656 - RNA, 63 nt, hsa
gauccaggagggagccacccccaaggacccugccagccacagaccuccaauaaagacagcaug

SEQ ID NO: 605657 - RNA, 63 nt, hsa
ugauccaggguuccaccaccaggagggcagacccagccacauaccacaaccacccccaagccu

SEQ ID NO: 605658 - RNA, 63 nt, hsa
ugaauguaagagccuuggaaauuaacaaaauaacagccacauaaccuugcggcaagucugaug

SEQ ID NO: 605659 - RNA, 63 nt, hsa
aaggaaagauuucuccucucaagugccagggagcagccacacgucugucuguguuuagagagg

SEQ ID NO: 605660 - RNA, 63 nt, hsa
gugcacagguagccccgacccucucaggcauuccagccacagaacaucaaagugagcgaguac

SEQ ID NO: 605661 - RNA, 63 nt, hsa
gaagcaccuccgguuggaggcacccaggcuugccagccacagagcgccccaaagucaccguca

SEQ ID NO: 605662 - RNA, 63 nt, hsa
gaguggccuuggcucccuggagagcccacgucucagccacaguucuccacucgccucggacuu

SEQ ID NO: 605663 - RNA, 63 nt, hsa
ccucagaggaggaggaggaggaggcagcuccggcagccacagaaggcugcagcccagcccgcc

SEQ ID NO: 605664 - RNA, 63 nt, hsa
gccaccugagggagccgccugcaagcggcccugcagccacaaagcaacccgcccucugcaaaa

SEQ ID NO: 605665 - RNA, 63 nt, hsa
ggagcugguggugggagaaugacggcagggacgcagccacaguucagacccuguccccucagc

SEQ ID NO: 605666 - RNA, 63 nt, hsa
augcagacacaaacugguuucauauggugagagcagccacagcagcagcuugaccugguauuc

SEQ ID NO: 605667 - RNA, 63 nt, hsa
uauaucauucccaguuauuaguuaacacaaauucagccacauucugaguauuguuuguucacc

SEQ ID NO: 605668 - RNA, 64 nt, hsa; identical to SEQ ID NO: 480897

SEQ ID NO: 605669 - RNA, 64 nt, hsa; identical to SEQ ID NO: 480898

SEQ ID NO: 605670 - RNA, 64 nt, hsa; identical to SEQ ID NO: 480899

SEQ ID NO: 605671 - RNA, 64 nt, hsa; identical to SEQ ID NO: 480900

SEQ ID NO: 605672 - RNA, 64 nt, hsa; identical to SEQ ID NO: 480901

SEQ ID NO: 605673 - RNA, 64 nt, hsa; identical to SEQ ID NO: 480902

SEQ ID NO: 605674 - RNA, 64 nt, hsa; identical to SEQ ID NO: 480903

SEQ ID NO: 605675 - RNA, 64 nt, hsa; identical to SEQ ID NO: 480904

SEQ ID NO: 605676 - RNA, 64 nt, hsa; identical to SEQ ID NO: 480905

SEQ ID NO: 605677 - RNA, 64 nt, hsa; identical to SEQ ID NO: 480906

SEQ ID NO: 605678 - RNA, 64 nt, hsa; identical to SEQ ID NO: 480907

SEQ ID NO: 605679 - RNA, 64 nt, hsa; identical to SEQ ID NO: 480908

SEQ ID NO: 605680 - RNA, 64 nt, hsa; identical to SEQ ID NO: 480909

SEQ ID NO: 605681 - RNA, 64 nt, hsa; identical to SEQ ID NO: 480910

SEQ ID NO: 605682 - RNA, 64 nt, hsa; identical to SEQ ID NO: 480911

SEQ ID NO: 605683 - RNA, 64 nt, hsa; identical to SEQ ID NO: 480912

SEQ ID NO: 605684 - RNA, 64 nt, hsa; identical to SEQ ID NO: 480913

SEQ ID NO: 605685 - RNA, 64 nt, hsa; identical to SEQ ID NO: 480914

SEQ ID NO: 605686 - RNA, 64 nt, hsa; identical to SEQ ID NO: 480915

SEQ ID NO: 605687 - RNA, 64 nt, hsa; identical to SEQ ID NO: 480916

SEQ ID NO: 605688 - RNA, 64 nt, hsa; identical to SEQ ID NO: 480917

SEQ ID NO: 605689 - RNA, 64 nt, hsa; identical to SEQ ID NO: 480918

SEQ ID NO: 605690 - RNA, 64 nt, hsa; identical to SEQ ID NO: 480919

SEQ ID NO: 605691 - RNA, 64 nt, hsa; identical to SEQ ID NO: 480920

SEQ ID NO: 605692 - RNA, 64 nt, hsa; identical to SEQ ID NO: 480921

SEQ ID NO: 605693 - RNA, 64 nt, hsa; identical to SEQ ID NO: 480922

SEQ ID NO: 605694 - RNA, 64 nt, hsa; identical to SEQ ID NO: 480923

SEQ ID NO: 605695 - RNA, 64 nt, hsa; identical to SEQ ID NO: 480924

SEQ ID NO: 605696 - RNA, 64 nt, hsa; identical to SEQ ID NO: 480925

SEQ ID NO: 605697 - RNA, 64 nt, hsa; identical to SEQ ID NO: 480926

SEQ ID NO: 605698 - RNA, 64 nt, hsa; identical to SEQ ID NO: 480927

SEQ ID NO: 605699 - RNA, 64 nt, hsa; identical to SEQ ID NO: 126995

SEQ ID NO: 605700 - RNA, 64 nt, hsa; identical to SEQ ID NO: 126996

SEQ ID NO: 605701 - RNA, 64 nt, hsa; identical to SEQ ID NO: 126997

SEQ ID NO: 605702 - RNA, 64 nt, hsa; identical to SEQ ID NO: 126998

SEQ ID NO: 605703 - RNA, 64 nt, hsa; identical to SEQ ID NO: 126999

SEQ ID NO: 605704 - RNA, 64 nt, hsa; identical to SEQ ID NO: 127000

SEQ ID NO: 605705 - RNA, 64 nt, hsa; identical to SEQ ID NO: 127001

SEQ ID NO: 605706 - RNA, 64 nt, hsa; identical to SEQ ID NO: 127002

SEQ ID NO: 605707 - RNA, 64 nt, hsa; identical to SEQ ID NO: 127003

SEQ ID NO: 605708 - RNA, 64 nt, hsa; identical to SEQ ID NO: 127004

SEQ ID NO: 605709 - RNA, 64 nt, hsa; identical to SEQ ID NO: 127005

SEQ ID NO: 605710 - RNA, 64 nt, hsa; identical to SEQ ID NO: 127006

SEQ ID NO: 605711 - RNA, 64 nt, hsa; identical to SEQ ID NO: 127007

SEQ ID NO: 605712 - RNA, 64 nt, hsa; identical to SEQ ID NO: 127008

SEQ ID NO: 605713 - RNA, 64 nt, hsa; identical to SEQ ID NO: 127009

SEQ ID NO: 605714 - RNA, 62 nt, hsa; identical to SEQ ID NO: 127010

SEQ ID NO: 605715 - RNA, 64 nt, hsa; identical to SEQ ID NO: 127011

SEQ ID NO: 605716 - RNA, 64 nt, hsa; identical to SEQ ID NO: 127012

SEQ ID NO: 605717 - RNA, 64 nt, hsa; identical to SEQ ID NO: 127013

SEQ ID NO: 605718 - RNA, 64 nt, hsa; identical to SEQ ID NO: 127014

SEQ ID NO: 605719 - RNA, 64 nt, hsa; identical to SEQ ID NO: 127015

SEQ ID NO: 605720 - RNA, 64 nt, hsa; identical to SEQ ID NO: 127016

SEQ ID NO: 605721 - RNA, 64 nt, hsa; identical to SEQ ID NO: 127017

SEQ ID NO: 605722 - RNA, 64 nt, hsa; identical to SEQ ID NO: 127018

SEQ ID NO: 605723 - RNA, 64 nt, hsa; identical to SEQ ID NO: 127019

SEQ ID NO: 605724 - RNA, 64 nt, hsa; identical to SEQ ID NO: 127020

SEQ ID NO: 605725 - RNA, 64 nt, hsa; identical to SEQ ID NO: 127021

SEQ ID NO: 605726 - RNA, 64 nt, hsa; identical to SEQ ID NO: 127022

SEQ ID NO: 605727 - RNA, 64 nt, hsa; identical to SEQ ID NO: 127023

SEQ ID NO: 605728 - RNA, 64 nt, hsa; identical to SEQ ID NO: 127024

SEQ ID NO: 605729 - RNA, 64 nt, hsa; identical to SEQ ID NO: 127025

SEQ ID NO: 605730 - RNA, 64 nt, hsa; identical to SEQ ID NO: 127026

SEQ ID NO: 605731 - RNA, 64 nt, hsa; identical to SEQ ID NO: 127027

SEQ ID NO: 605732 - RNA, 64 nt, hsa; identical to SEQ ID NO: 127028

SEQ ID NO: 605733 - RNA, 64 nt, hsa; identical to SEQ ID NO: 127029

SEQ ID NO: 605734 - RNA, 64 nt, hsa; identical to SEQ ID NO: 127030

SEQ ID NO: 605735 - RNA, 64 nt, hsa; identical to SEQ ID NO: 127031

SEQ ID NO: 605736 - RNA, 64 nt, hsa; identical to SEQ ID NO: 127032

SEQ ID NO: 605737 - RNA, 64 nt, hsa; identical to SEQ ID NO: 127033

SEQ ID NO: 605738 - RNA, 64 nt, hsa; identical to SEQ ID NO: 127034

SEQ ID NO: 605739 - RNA, 64 nt, hsa; identical to SEQ ID NO: 127035

SEQ ID NO: 605740 - RNA, 64 nt, hsa; identical to SEQ ID NO: 127036

SEQ ID NO: 605741 - RNA, 64 nt, hsa; identical to SEQ ID NO: 127037

SEQ ID NO: 605742 - RNA, 64 nt, hsa; identical to SEQ ID NO: 127038

SEQ ID NO: 605743 - RNA, 64 nt, hsa; identical to SEQ ID NO: 45744

SEQ ID NO: 605744 - RNA, 64 nt, hsa; identical to SEQ ID NO: 45745

SEQ ID NO: 605745 - RNA, 64 nt, hsa; identical to SEQ ID NO: 45746

SEQ ID NO: 605746 - RNA, 64 nt, hsa; identical to SEQ ID NO: 45747

SEQ ID NO: 605747 - RNA, 64 nt, hsa; identical to SEQ ID NO: 45748

SEQ ID NO: 605748 - RNA, 64 nt, hsa; identical to SEQ ID NO: 45749

SEQ ID NO: 605749 - RNA, 64 nt, hsa; identical to SEQ ID NO: 45750

SEQ ID NO: 605750 - RNA, 64 nt, hsa; identical to SEQ ID NO: 45751

SEQ ID NO: 605751 - RNA, 64 nt, hsa; identical to SEQ ID NO: 45752

SEQ ID NO: 605752 - RNA, 64 nt, hsa; identical to SEQ ID NO: 45753

SEQ ID NO: 605753 - RNA, 64 nt, hsa; identical to SEQ ID NO: 45754

SEQ ID NO: 605754 - RNA, 64 nt, hsa; identical to SEQ ID NO: 45755

SEQ ID NO: 605755 - RNA, 64 nt, hsa; identical to SEQ ID NO: 45756

SEQ ID NO: 605756 - RNA, 64 nt, hsa; identical to SEQ ID NO: 45757

SEQ ID NO: 605757 - RNA, 64 nt, hsa; identical to SEQ ID NO: 45758

SEQ ID NO: 605758 - RNA, 64 nt, hsa; identical to SEQ ID NO: 45759

SEQ ID NO: 605759 - RNA, 64 nt, hsa; identical to SEQ ID NO: 45760

SEQ ID NO: 605760 - RNA, 64 nt, hsa; identical to SEQ ID NO: 45761

SEQ ID NO: 605761 - RNA, 64 nt, hsa; identical to SEQ ID NO: 45762

SEQ ID NO: 605762 - RNA, 64 nt, hsa; identical to SEQ ID NO: 45763

SEQ ID NO: 605763 - RNA, 64 nt, hsa; identical to SEQ ID NO: 45764

SEQ ID NO: 605764 - RNA, 64 nt, hsa; identical to SEQ ID NO: 45765

SEQ ID NO: 605765 - RNA, 64 nt, hsa; identical to SEQ ID NO: 45766

SEQ ID NO: 605766 - RNA, 64 nt, hsa; identical to SEQ ID NO: 45767

SEQ ID NO: 605767 - RNA, 64 nt, hsa; identical to SEQ ID NO: 45768

SEQ ID NO: 605768 - RNA, 64 nt, hsa; identical to SEQ ID NO: 45769

SEQ ID NO: 605769 - RNA, 64 nt, hsa; identical to SEQ ID NO: 45770

SEQ ID NO: 605770 - RNA, 64 nt, hsa; identical to SEQ ID NO: 45771

SEQ ID NO: 605771 - RNA, 64 nt, hsa; identical to SEQ ID NO: 45772

SEQ ID NO: 605772 - RNA, 64 nt, hsa; identical to SEQ ID NO: 45773

SEQ ID NO: 605773 - RNA, 64 nt, hsa; identical to SEQ ID NO: 45774

SEQ ID NO: 605774 - RNA, 64 nt, hsa; identical to SEQ ID NO: 45775

SEQ ID NO: 605775 - RNA, 64 nt, hsa; identical to SEQ ID NO: 45776

SEQ ID NO: 605776 - RNA, 64 nt, hsa; identical to SEQ ID NO: 45777

SEQ ID NO: 605777 - RNA, 64 nt, hsa; identical to SEQ ID NO: 45778

SEQ ID NO: 605778 - RNA, 64 nt, hsa; identical to SEQ ID NO: 45779

SEQ ID NO: 605779 - RNA, 64 nt, hsa
accaaaugaagcuuuuucuauccauuuuuaauauuguccuuacauaauauuguccuuagauuuu

SEQ ID NO: 605780 - RNA, 64 nt, hsa
ucuauccauuuuuaauauuguccuuacauaauauuguccuuagauuuugaucaauucuaugucu

SEQ ID NO: 605781 - RNA, 64 nt, hsa
uaauacuuuguacaggucaccugccuacucuaauuguccuuaguacuuggacaggcuuuaucau

SEQ ID NO: 605782 - RNA, 64 nt, hsa
uguggguuuuuuuuaaauaagaaauguuuauuuuuguccuuauauuuaaacaugauggaauuug

SEQ ID NO: 605783 - RNA, 64 nt, hsa
cuccccugcuccagccaaauugaucucccagucuuguccuuacccauuccaagugcucugccag

SEQ ID NO: 605784 - RNA, 64 nt, hsa
aaaaaccagucaauuacgccuaagaucauuuugcuguccuuaaaccccccagguuccuucuugc

SEQ ID NO: 605785 - RNA, 64 nt, hsa
ggguagaggcugcaugugggggccccugucugccuguccuuaggguguggauuaggcucuggcu

SEQ ID NO: 605786 - RNA, 64 nt, hsa
cuccugugcuuuccucucuucaggacaaaugguuuguccuuaugguccccuuuccacuaggauu

SEQ ID NO: 605787 - RNA, 64 nt, hsa
auacauucguaaagaguucauuucuuugggguaguguccuuacaagcuuuucuuaaaacgucaa

SEQ ID NO: 605788 - RNA, 64 nt, hsa
gccuguccacaucccucugcccauccgagaccucuguccuuacaccacuagccaccccacgugg

SEQ ID NO: 605789 - RNA, 64 nt, hsa
uagaagugcugauuuagauucaacaaauaccauauguccuuaucauuuuuuguaagaagaaauu

SEQ ID NO: 605790 - RNA, 64 nt, hsa
aacugaauucuccugcagugccaaguaucaaagguguccuuaaauacuuguagggaugagguua

SEQ ID NO: 605791 - RNA, 64 nt, hsa
ugggccugagggagggcuggagucgcacgcgcuuuguccuuagcgccugucugcucuccucuaa

SEQ ID NO: 605792 - RNA, 64 nt, hsa
cuuccgcuccaccagccuggucugaggcgugcucuguccuuagagaaggcgcgguggccggguu

SEQ ID NO: 605793 - RNA, 64 nt, hsa; identical to SEQ ID NO: 107849

SEQ ID NO: 605794 - RNA, 64 nt, hsa; identical to SEQ ID NO: 107850

SEQ ID NO: 605795 - RNA, 64 nt, hsa; identical to SEQ ID NO: 107851

SEQ ID NO: 605796 - RNA, 64 nt, hsa; identical to SEQ ID NO: 107852

SEQ ID NO: 605797 - RNA, 64 nt, hsa; identical to SEQ ID NO: 107853

SEQ ID NO: 605798 - RNA, 64 nt, hsa; identical to SEQ ID NO: 107854

SEQ ID NO: 605799 - RNA, 64 nt, hsa; identical to SEQ ID NO: 107855

SEQ ID NO: 605800 - RNA, 64 nt, hsa; identical to SEQ ID NO: 107856

SEQ ID NO: 605801 - RNA, 64 nt, hsa; identical to SEQ ID NO: 107857

SEQ ID NO: 605802 - RNA, 64 nt, hsa; identical to SEQ ID NO: 107858

SEQ ID NO: 605803 - RNA, 64 nt, hsa; identical to SEQ ID NO: 107859

SEQ ID NO: 605804 - RNA, 64 nt, hsa; identical to SEQ ID NO: 107860

SEQ ID NO: 605805 - RNA, 64 nt, hsa; identical to SEQ ID NO: 107861

SEQ ID NO: 605806 - RNA, 64 nt, hsa; identical to SEQ ID NO: 107862

SEQ ID NO: 605807 - RNA, 64 nt, hsa; identical to SEQ ID NO: 107863

SEQ ID NO: 605808 - RNA, 63 nt, hsa; identical to SEQ ID NO: 107864

SEQ ID NO: 605809 - RNA, 64 nt, hsa; identical to SEQ ID NO: 107865

SEQ ID NO: 605810 - RNA, 64 nt, hsa; identical to SEQ ID NO: 107866

SEQ ID NO: 605811 - RNA, 64 nt, hsa; identical to SEQ ID NO: 107867

SEQ ID NO: 605812 - RNA, 64 nt, hsa; identical to SEQ ID NO: 107868

SEQ ID NO: 605813 - RNA, 64 nt, hsa; identical to SEQ ID NO: 107869

SEQ ID NO: 605814 - RNA, 64 nt, hsa; identical to SEQ ID NO: 107870

SEQ ID NO: 605815 - RNA, 64 nt, hsa; identical to SEQ ID NO: 107871

SEQ ID NO: 605816 - RNA, 64 nt, hsa; identical to SEQ ID NO: 107872

SEQ ID NO: 605817 - RNA, 64 nt, hsa; identical to SEQ ID NO: 107873

SEQ ID NO: 605818 - RNA, 64 nt, hsa; identical to SEQ ID NO: 107874

SEQ ID NO: 605819 - RNA, 64 nt, hsa; identical to SEQ ID NO: 107875

SEQ ID NO: 605820 - RNA, 64 nt, hsa; identical to SEQ ID NO: 107876

SEQ ID NO: 605821 - RNA, 64 nt, hsa; identical to SEQ ID NO: 107877

SEQ ID NO: 605822 - RNA, 64 nt, hsa; identical to SEQ ID NO: 107878

SEQ ID NO: 605823 - RNA, 64 nt, hsa; identical to SEQ ID NO: 107879

SEQ ID NO: 605824 - RNA, 64 nt, hsa; identical to SEQ ID NO: 107880

SEQ ID NO: 605825 - RNA, 64 nt, hsa; identical to SEQ ID NO: 107881

SEQ ID NO: 605826 - RNA, 64 nt, hsa; identical to SEQ ID NO: 107882

SEQ ID NO: 605827 - RNA, 64 nt, hsa; identical to SEQ ID NO: 107883

SEQ ID NO: 605828 - RNA, 64 nt, hsa; identical to SEQ ID NO: 107884

SEQ ID NO: 605829 - RNA, 64 nt, hsa; identical to SEQ ID NO: 107885

SEQ ID NO: 605830 - RNA, 64 nt, hsa; identical to SEQ ID NO: 107886

SEQ ID NO: 605831 - RNA, 64 nt, hsa; identical to SEQ ID NO: 107887

SEQ ID NO: 605832 - RNA, 64 nt, hsa; identical to SEQ ID NO: 107888

SEQ ID NO: 605833 - RNA, 64 nt, hsa; identical to SEQ ID NO: 107889

SEQ ID NO: 605834 - RNA, 64 nt, hsa; identical to SEQ ID NO: 107890

SEQ ID NO: 605835 - RNA, 64 nt, hsa; identical to SEQ ID NO: 107891

SEQ ID NO: 605836 - RNA, 64 nt, hsa; identical to SEQ ID NO: 107892

SEQ ID NO: 605837 - RNA, 64 nt, hsa; identical to SEQ ID NO: 107893

SEQ ID NO: 605838 - RNA, 64 nt, hsa; identical to SEQ ID NO: 107894

SEQ ID NO: 605839 - RNA, 64 nt, hsa; identical to SEQ ID NO: 107895

SEQ ID NO: 605840 - RNA, 64 nt, hsa; identical to SEQ ID NO: 107896

SEQ ID NO: 605841 - RNA, 64 nt, hsa; identical to SEQ ID NO: 107897

SEQ ID NO: 605842 - RNA, 64 nt, hsa; identical to SEQ ID NO: 107898

SEQ ID NO: 605843 - RNA, 64 nt, hsa; identical to SEQ ID NO: 107899

SEQ ID NO: 605844 - RNA, 64 nt, hsa; identical to SEQ ID NO: 107900

SEQ ID NO: 605845 - RNA, 64 nt, hsa; identical to SEQ ID NO: 107901

SEQ ID NO: 605846 - RNA, 64 nt, hsa; identical to SEQ ID NO: 107902

SEQ ID NO: 605847 - RNA, 64 nt, hsa; identical to SEQ ID NO: 107903

SEQ ID NO: 605848 - RNA, 64 nt, hsa; identical to SEQ ID NO: 107904

SEQ ID NO: 605849 - RNA, 64 nt, hsa; identical to SEQ ID NO: 107905

SEQ ID NO: 605850 - RNA, 64 nt, hsa; identical to SEQ ID NO: 107906

SEQ ID NO: 605851 - RNA, 64 nt, hsa; identical to SEQ ID NO: 107907

SEQ ID NO: 605852 - RNA, 64 nt, hsa; identical to SEQ ID NO: 107908

SEQ ID NO: 605853 - RNA, 64 nt, hsa; identical to SEQ ID NO: 107909

SEQ ID NO: 605854 - RNA, 64 nt, hsa; identical to SEQ ID NO: 107910

SEQ ID NO: 605855 - RNA, 64 nt, hsa; identical to SEQ ID NO: 107911

SEQ ID NO: 605856 - RNA, 64 nt, hsa; identical to SEQ ID NO: 107912

SEQ ID NO: 605857 - RNA, 64 nt, hsa; identical to SEQ ID NO: 107913

SEQ ID NO: 605858 - RNA, 64 nt, hsa; identical to SEQ ID NO: 107914

SEQ ID NO: 605859 - RNA, 64 nt, hsa; identical to SEQ ID NO: 107915

SEQ ID NO: 605860 - RNA, 64 nt, hsa; identical to SEQ ID NO: 107916

SEQ ID NO: 605861 - RNA, 64 nt, hsa; identical to SEQ ID NO: 107917

SEQ ID NO: 605862 - RNA, 64 nt, hsa; identical to SEQ ID NO: 107918

SEQ ID NO: 605863 - RNA, 64 nt, hsa; identical to SEQ ID NO: 107919

SEQ ID NO: 605864 - RNA, 64 nt, hsa; identical to SEQ ID NO: 107920

SEQ ID NO: 605865 - RNA, 64 nt, hsa; identical to SEQ ID NO: 107921

SEQ ID NO: 605866 - RNA, 64 nt, hsa; identical to SEQ ID NO: 107922

SEQ ID NO: 605867 - RNA, 64 nt, hsa; identical to SEQ ID NO: 107923

SEQ ID NO: 605868 - RNA, 64 nt, hsa; identical to SEQ ID NO: 107924

SEQ ID NO: 605869 - RNA, 64 nt, hsa; identical to SEQ ID NO: 107925

SEQ ID NO: 605870 - RNA, 64 nt, hsa; identical to SEQ ID NO: 107926

SEQ ID NO: 605871 - RNA, 64 nt, hsa; identical to SEQ ID NO: 107927

SEQ ID NO: 605872 - RNA, 64 nt, hsa; identical to SEQ ID NO: 107928

SEQ ID NO: 605873 - RNA, 64 nt, hsa; identical to SEQ ID NO: 107929

SEQ ID NO: 605874 - RNA, 64 nt, hsa; identical to SEQ ID NO: 107930

SEQ ID NO: 605875 - RNA, 64 nt, hsa; identical to SEQ ID NO: 107931

SEQ ID NO: 605876 - RNA, 64 nt, hsa; identical to SEQ ID NO: 107932

SEQ ID NO: 605877 - RNA, 64 nt, hsa; identical to SEQ ID NO: 107933

SEQ ID NO: 605878 - RNA, 64 nt, hsa
ucuuccuaaagccucccccauaaaaagggagcuguggauccacuuagaucagggcggaaccauc

SEQ ID NO: 605879 - RNA, 64 nt, hsa
uccugcucugcugcaggagagggggcuaaggggcuggauccaccaaggcagcucacagcgggaa

SEQ ID NO: 605880 - RNA, 64 nt, hsa
uuucaaauggauuuuuaugacccacuacuggguuuggauccacaguuugaaaaauauugcuaca

SEQ ID NO: 605881 - RNA, 64 nt, hsa
uggauauuucagcccucuccauccuagucaacacuggauccaccuagugccucugggccauaag

SEQ ID NO: 605882 - RNA, 64 nt, hsa
cccgucucccagggcacaagcucccuagccucuuuggauccauugccccugagcucccagaguc

SEQ ID NO: 605883 - RNA, 64 nt, hsa
uuccagacagaugagagagggcaggacuucaggcuggauccaccacugggcucucccuccccca

SEQ ID NO: 605884 - RNA, 64 nt, hsa
uaacaccccacaugugcugguggauccacucccauggauccacucacaugcugcaggcaugcag

SEQ ID NO: 605885 - RNA, 64 nt, hsa
ggaucaucucaugcuaacaccccacaugugcugguggauccacucccauggauccacucacaug

SEQ ID NO: 605886 - RNA, 64 nt, hsa
agcuuucuccauccagauugugacgguugcuaccuggauccaucauuuuacugguauggcaaaa

SEQ ID NO: 605887 - RNA, 64 nt, hsa
uaaccauggucaacuguacuuuaaaguuauuaaauggauccagaaauaaacaauuccuacauuu

SEQ ID NO: 605888 - RNA, 64 nt, hsa
agggauuucuguaaagaugggaaaggcugauagauugaaauaagcuucugugaaagucuggauu

SEQ ID NO: 605889 - RNA, 64 nt, hsa
uuagaaggagccucuuuucccucuauuuuuuaaauugaaauauaauagcugcaucagcccugaa

SEQ ID NO: 605890 - RNA, 64 nt, hsa
uaugucugucaccaugaaaacuuagcugcaucuuuugaaauaucaaauaugaauuuucucuaaa

SEQ ID NO: 605891 - RNA, 64 nt, hsa
uuggagauuuuuuuuuuuuccuggaugguaagauuugaaauauuuacauuaacauaggcaaaaa

SEQ ID NO: 605892 - RNA, 64 nt, hsa
ucaugccaaggcacugaauuaagacuucuuaauguugaaauauuuuaagugauuucauauuaaa

SEQ ID NO: 605893 - RNA, 64 nt, hsa
cucacaaaacauuuugcuaaaaagauaugacugcuugaaauagucucucucccauggagaacca

SEQ ID NO: 605894 - RNA, 64 nt, hsa
aaguucucuccucuacgcucauugcagaaauacuuugaaauagguucugccagucuacaauagc

SEQ ID NO: 605895 - RNA, 64 nt, hsa
auuggcuuuauuugaugaauauugcuuuguagcuuugaaauacgacaguguuccaaaucccauc

SEQ ID NO: 605896 - RNA, 64 nt, hsa
acaaugauaacuauuauuugugcaacauuacucuuugaaauaaaaauuggcauguagccaaugu

SEQ ID NO: 605897 - RNA, 64 nt, hsa
uuacagccuaauuaauaccuagauaagacuucauuugaaauaagaaauaacucuuuuacuagug

SEQ ID NO: 605898 - RNA, 64 nt, hsa
aaaagaaauaugugaugaugugucuacuuuuuguuugaaauaacuguuggguguucccucuucu

SEQ ID NO: 605899 - RNA, 64 nt, hsa
uuaaguuuccuacacgcuaacuucguuugugcgauugaaauaaaauugcaguauauauauguug

SEQ ID NO: 605900 - RNA, 64 nt, hsa
uugaacucugauuaucagaaguuuuacuaaaacuuugaaauaauucacuuucaucugcuuucua

SEQ ID NO: 605901 - RNA, 64 nt, hsa
aauacuaaaacccaucaggcaagaucaccacgcauugaaauauuuucauaucaagauaaagucg

SEQ ID NO: 605902 - RNA, 64 nt, hsa
agaacauucugucauuccagucagaaacugucuuuugaaauauuucuuuacaaccuaccaaaaa

SEQ ID NO: 605903 - RNA, 64 nt, hsa
aagugugguuuauuuauggcaugaaccauguaacuugaaauaugaacuuacaaggaggggcacu

SEQ ID NO: 605904 - RNA, 64 nt, hsa
uucaagggaaauaccagcuuccacuugagucacuuugaaauaguuaauucaacagcaccauguu

SEQ ID NO: 605905 - RNA, 52 nt, hsa
aaaagaacaagagucgauaguuuugaaauagcugguuggcgacuguucuuuc

SEQ ID NO: 605906 - RNA, 64 nt, hsa
ggaccuaguaaacuagucaguguuggaaacggccuugaaauauuuaaaacauauuuguaaccag

SEQ ID NO: 605907 - RNA, 64 nt, hsa
cuuucuaucaaaagcauuggauccaagccauauauugaaauacaagcgugauuaaucaguaauu

SEQ ID NO: 605908 - RNA, 64 nt, hsa
ucugugaacaauggguuuacggucuauuucauaauugaaauauuuauuuuaaaaaugaauauua

SEQ ID NO: 605909 - RNA, 64 nt, hsa
auugcccuaugaaaacuuuaaaucucuaaaacauuugaaauacuaccauauuugugauuuauug

SEQ ID NO: 605910 - RNA, 64 nt, hsa
gaaaugaauuauucuuuaccaguuuugaaacacuuugaaauauccuaagguaacuuggaagcug

SEQ ID NO: 605911 - RNA, 64 nt, hsa
uuuuuuuaauuuuuauuuuucacuaaacaggcaauugaaauacaugguacaaaaauaaguggua

SEQ ID NO: 605912 - RNA, 64 nt, hsa
uaaggugacugaggucaaacguuguuuccuuagguugaaauagcagccaaaacauucuucacgc

SEQ ID NO: 605913 - RNA, 64 nt, hsa
uagcccguuaucucugauccuucucuaaaaccauuugaaauagcuucauugaucaacauuucau

SEQ ID NO: 605914 - RNA, 64 nt, hsa
gaagagaggcccugugugcucagugccuaucaguuugaaauauauacacauauauauauuuuuu

SEQ ID NO: 605915 - RNA, 64 nt, hsa
auguucuguggcaauccacaggucuagccaaauauugaaauaggaguuuaggguauaauuugcc

SEQ ID NO: 605916 - RNA, 64 nt, hsa
cuucuaauuugaaucuauaguuacuuuguaccauuugaaauauauguauauauauauauauaau

SEQ ID NO: 605917 - RNA, 64 nt, hsa
uuugaaauauauguauauauauauauauaauauuuugaaauauuaucuauucucuucaagaaau

SEQ ID NO: 605918 - RNA, 64 nt, hsa
uuuuguaaugauuuuuauucucuguuacaaagacuugaaauacguauuaaaugcacguuaaugu

SEQ ID NO: 605919 - RNA, 64 nt, hsa
uugcuuugcauuuuagguucagauuaugacuugauugaaauaaaugugccuauacauucauuug

SEQ ID NO: 605920 - RNA, 64 nt, hsa
ugcauaacuugcaaugaaauuaaugagauauauauugaaauaaagaauuauguaaaagccauuc

SEQ ID NO: 605921 - RNA, 64 nt, hsa
gcaaauguaggcugaucuccuucacaggauacacuugaaauauagaaguuauguuuuaaauauc

SEQ ID NO: 605922 - RNA, 64 nt, hsa
ucuucagucacagugagagcaucuugcuuugugguugaaauagguaguguaugucagucuuugc

SEQ ID NO: 605923 - RNA, 64 nt, hsa
caauuuucaaaccauauggccuagguaacuuuaauugaaauaauauagauuuaguugaauacua

SEQ ID NO: 605924 - RNA, 64 nt, hsa
uguucagauaaaaaaaaccaugaaauuacuguguuugaaauauuuucuuaugguuuguaauauu

SEQ ID NO: 605925 - RNA, 64 nt, hsa
acuccauuaugcacaguuugagauaaauaaauuuuugaaauauggacacugaaauuauucuuga

SEQ ID NO: 605926 - RNA, 64 nt, hsa
agaguaucugaagggaauuguuuuuauaaaaacauugaaauauuaguuacuugcuauaaauaga

SEQ ID NO: 605927 - RNA, 64 nt, hsa
uucauuagauguuuauuuagaaacugguucuguguugaaauauaguugaaaguaaaaaaauaau

SEQ ID NO: 605928 - RNA, 64 nt, hsa
cguuuuuuugaaauaccaguaaaaaacaaaguucuugaaauaaaacuuuuuaaaaaguuauuca

SEQ ID NO: 605929 - RNA, 64 nt, hsa
acugacuuuuuuuuguacuuugacccacguuuuuuugaaauaccaguaaaaaacaaaguucuug

SEQ ID NO: 605930 - RNA, 64 nt, hsa
guguggcacugggaaaaguggaaacaaacauguauugaaauacauauuggaaauaaaaaugguu

SEQ ID NO: 605931 - RNA, 64 nt, hsa
uaagccugacuggcaauaacgcacgguacuguucuugaaauaccuaauggcuugaaauucuagu

SEQ ID NO: 605932 - RNA, 64 nt, hsa
cccaaucagagggauggagcuaaucuuuuugcuguugaaauaaaaugaauuuaugagaaacuuu

SEQ ID NO: 605933 - RNA, 64 nt, hsa
uuacuguggcuuuaaacauauucagaacagaugcuugaaauaugcacuuagcacuuugguucca

SEQ ID NO: 605934 - RNA, 64 nt, hsa
cucaguguuugguuauuaugcaaacaaguaauguuugaaauauauaauagcacuggagauuuuc

SEQ ID NO: 605935 - RNA, 64 nt, hsa
guuccugcccuguugcuuccagccacugugauguuugaaauaugugauaguaccugguugugaa

SEQ ID NO: 605936 - RNA, 64 nt, hsa
uucuuagguuuaaauguuauaccaaugcauguguuugaaauauccauuaagaugauuuaaaauu

SEQ ID NO: 605937 - RNA, 64 nt, hsa
cauuuccacuucuguuuaucacaaaagacuguauuugaaauaugcauacggaaaauugaaauua

SEQ ID NO: 605938 - RNA, 64 nt, hsa
uucaaggaagacucuacaagcuuuuguucacagcuugaaauagaugccucacaauucagacagu

SEQ ID NO: 605939 - RNA, 64 nt, hsa
aaaauguaugugccaaguucuacuagaauuccauuugaaauagcaccuuccuuagguuucaugg

SEQ ID NO: 605940 - RNA, 64 nt, hsa
agagaggagcuuuaaauaagaugauuuuaguagauugaaauaaauaaccaguauuuaaguaaau

SEQ ID NO: 605941 - RNA, 64 nt, hsa
uuguuuuuucuugcuuuucauuugauuacccugcuugaaauacaguuaguugauaacauaaagc

SEQ ID NO: 605942 - RNA, 64 nt, hsa
aaacauggguaguggcgcauacauuuuguuauccuugaaauagccuaaguaauguuauugaaga

SEQ ID NO: 605943 - RNA, 64 nt, hsa
augagguauuuagauaugaacaacugaauacauauugaaauagugugcuggcuuuuguaguuuu

SEQ ID NO: 605944 - RNA, 64 nt, hsa
uuugagagcucuguacuuauagugacucuacuguuugaaauacuauuuuuuuaaaucaaguuuu

SEQ ID NO: 605945 - RNA, 64 nt, hsa
aguaccacuaauaggguguaucucagaaacugaauugaaauaagggaaaauaggauuuucuguc

SEQ ID NO: 605946 - RNA, 64 nt, hsa
ugaauaugguacagcucuucauuuacuuaggccuuugaaauaucuuucaauaaaguuuauaauu

SEQ ID NO: 605947 - RNA, 64 nt, hsa
acccacuucucuuuaagcugccuggauugcaccuuugaaauaugucugccaaguuguuagaauc

SEQ ID NO: 605948 - RNA, 64 nt, hsa
agaacuaaguuacugggaugacaauaauugcuauuugaaauauaugcuucuuuauuucuugcaa

SEQ ID NO: 605949 - RNA, 64 nt, hsa
uguuuaaaaugcuuuuguauuuacugccauguaauugaaauauauagauuauuguaaccuuuca

SEQ ID NO: 605950 - RNA, 64 nt, hsa
uuagcaagcauuaaagcaaauguauggcugccuuuugaaauauuugauguguugccuggcagga

SEQ ID NO: 605951 - RNA, 64 nt, hsa
gauucaacugcaucuccaaacauuacucaugaccuugaaauaaaauaggaaccuaugaaacuau

SEQ ID NO: 605952 - RNA, 64 nt, hsa
cauuuuuaauaugacaaaacaaauuuuaaaagauuugaaauaauuguauuucucugaauucagu

SEQ ID NO: 605953 - RNA, 64 nt, hsa
gaagaaaccguauuuuuccaugauaaaucacuguuugaaauauuugguucaugguaugaucgaa

SEQ ID NO: 605954 - RNA, 64 nt, hsa
aaaagaaaaaguaacaaaaggaaauuauuuguuuuugaaauaccaguucaacuuuguggauuau

SEQ ID NO: 605955 - RNA, 64 nt, hsa
aacggcacuacauaaaugugaaaaguuguugaucuugaaauaucucaggauagcacuuuuggca

SEQ ID NO: 605956 - RNA, 64 nt, hsa
uuuuuuuaaaaagaggaucccaaacuguaaaagauugaaauaaucuuucucaggauuuuuuaaa

SEQ ID NO: 605957 - RNA, 64 nt, hsa
gggcuuaaaacugaaagccaguuggcugaaagguuugaaauacguaccccaguaaaaccauuca

SEQ ID NO: 605958 - RNA, 64 nt, hsa
uuauuuuuacuaaugccuuauuguugcacucuuuuugaaauauccugcagugaauauaugaauc

SEQ ID NO: 605959 - RNA, 64 nt, hsa
auuaguuguuuucuuauuuuuuuggcuuaguauguugaaauaaacuaugguaucuucaucauuu

SEQ ID NO: 605960 - RNA, 64 nt, hsa
uugaucucaaaacagcuugacagagcaacuguuauugaaauauuacagauggaaagaaugaggc

SEQ ID NO: 605961 - RNA, 64 nt, hsa
aucaucuaccuucaggauugcugacagacagaauuugaaauaaaauaugcaaguuagcuaauac

SEQ ID NO: 605962 - RNA, 64 nt, hsa
auaugcagccuuuccucuguacuuuucuccaugguugaaauaaaacagggugacugggaguuac

SEQ ID NO: 605963 - RNA, 64 nt, hsa
aacauuauuggguaucaauuaccaccugguuguauugaaauaguaacuuaucaaugccauguaa

SEQ ID NO: 605964 - RNA, 64 nt, hsa
aguugcauuauacugggucaugaaaaauuaucccuugaaauagauaugaaacauguuacuucau

SEQ ID NO: 605965 - RNA, 64 nt, hsa
agaaacauuagugccugccuggauccccuuaguuuugaaauauuugccauuguuguuuaaauac

SEQ ID NO: 605966 - RNA, 64 nt, hsa
cuguugcuuuaguauuuauuacaauaaaaaggguuugaaauauagcuguucuuuaugcauaaaa

SEQ ID NO: 605967 - RNA, 64 nt, hsa
gacuguuuaaugacuggauaucuuccuucaacuuuugaaauacaaaaccaguguuuuuuacuug

SEQ ID NO: 605968 - RNA, 64 nt, hsa
cuuccaaucauugcuagaaaauuggcauauuccuuugaaauaaacuuaugaaauguuuucucuc

SEQ ID NO: 605969 - RNA, 64 nt, hsa
uauuuuaaaagcacuuucuauuuuuaaaaguaacuugaaauaauauaguauaagaauccuauug

SEQ ID NO: 605970 - RNA, 64 nt, hsa
agucugauacagaauuagaaaaaaaaaauucuuguugaaauauuuugaaaacaaauucccuacu

SEQ ID NO: 605971 - RNA, 64 nt, hsa
uguuauuguuuacacacuugcaguguagcccaguuugaaauauuuauuugguuaucaacugccc

SEQ ID NO: 605972 - RNA, 64 nt, hsa
uagcacauuuauaagaaccgcaaugaaaacugacuugaaauaaugcuuguaaucaggaaaguaa

SEQ ID NO: 605973 - RNA, 64 nt, hsa
aaguugauguuaauugaagaauucacuugucugguugaaauaaagccuguuucuguugugaugu

SEQ ID NO: 605974 - RNA, 64 nt, hsa
ucauuggauuuauuuuaugcuagguuauauuaaguugaaauagucugugauuaaauguccucau

SEQ ID NO: 605975 - RNA, 64 nt, hsa
cuacuuggaaauguaucacagccaucucugggauuugaaauauccagacuuguagggaagaaaa

SEQ ID NO: 605976 - RNA, 64 nt, hsa
caaaaaucuaagauuccaaaaagaacagcauucauugaaauaauauuccauugcauuggcuacu

SEQ ID NO: 605977 - RNA, 64 nt, hsa
auugagcuaaucaaaauaauucagccaagucuauuugaaauagaaaacugucuauuuaauauag

SEQ ID NO: 605978 - RNA, 64 nt, hsa
cagaauuaggaaaaaaaucuggagaacaauaugguugaaauagaaacaagagaaugcaccuagg

SEQ ID NO: 605979 - RNA, 64 nt, hsa
ggaaaaaauauacuucuguuuacuuacucugacuuugaaauaguguuauuuuucuauaucugaa

SEQ ID NO: 605980 - RNA, 64 nt, hsa
gggaagauguacuccguaucaaauaauaaugauguugaaauaaugauaguagguauguauuaug

SEQ ID NO: 605981 - RNA, 64 nt, hsa
uguuaguccagcucuaaaaauuuaaagguuguaauugaaauacaagaaaagagccuucuuuuag

SEQ ID NO: 605982 - RNA, 64 nt, hsa
gguuuuauuuucaguuuugcagcacagaacacuguugaaauauccauaucaacuugauuuuuuu

SEQ ID NO: 605983 - RNA, 64 nt, hsa
aaguagaauagugguugccaaugucucagggagguugaaauaggagaugaccacuaauugauag

SEQ ID NO: 605984 - RNA, 64 nt, hsa
uauuugcucugauacaaaaauucuaaaucaauuauugaaauaggaugcacacaauuacuaaagu

SEQ ID NO: 605985 - RNA, 64 nt, hsa
aggccuuucuuaggaauuauguguauauaaaucuuugaaauaucuuuauauaccugaguuuuag

SEQ ID NO: 605986 - RNA, 64 nt, hsa
uuuuaagcacuaaaacuuacuucauuguaacuauuugaaauagaaauaguucuuuaaaaauauu

SEQ ID NO: 605987 - RNA, 64 nt, hsa
guuuaaccacagugaaugaauuuuagcuuugcuuuugaaauacauuguaagauuugacuugagg

SEQ ID NO: 605988 - RNA, 64 nt, hsa
uguuuuuucauacuuugacccaaaauaugccauuuugaaauaaaauuuaagcuuugauacacuc

SEQ ID NO: 605989 - RNA, 64 nt, hsa
caggccuuugcaaauggccuaaaugguguucccuuugaaauaacgcuugccacaaguauauaau

SEQ ID NO: 605990 - RNA, 64 nt, hsa
uuguuuuauauuaaaaaaaaccuguuauguacaguugaaauaaauuuugcauuugcuagcccgu

SEQ ID NO: 605991 - RNA, 64 nt, hsa
gaaauuuaaaauguuaaagaaaaacauuucuauauugaaauauauauaauuuauaaugaaaauu

SEQ ID NO: 605992 - RNA, 64 nt, hsa
guacuguauuuuggauguguaaagcuucuauguauugaaauauuuuuuuacguuuuauuuauug

SEQ ID NO: 605993 - RNA, 64 nt, hsa
aaaguuccaaaacaugacauuuuuaagaauaaauuugaaauagaguauaacugaaugcagagaa

SEQ ID NO: 605994 - RNA, 64 nt, hsa
uauuguuuuuacuuuuugaaaaaaguguuaacucuugaaauaaaauauucugauaaaauaugua

SEQ ID NO: 605995 - RNA, 64 nt, hsa
uauggucgcacuaauggaagacaaauggcaaaucuugaaauagaauuggggcaauuaccuuuug

SEQ ID NO: 605996 - RNA, 64 nt, hsa
ccuaaucuucaaauguuagcuucauuuuuuaccuuugaaauacuuaaucuuucugaauaaauau

SEQ ID NO: 605997 - RNA, 64 nt, hsa
gcuuuaauaugagcuucaauauaagaagcaaucuuugaaauaaaaaaagauuuuuuuuuaauuc

SEQ ID NO: 605998 - RNA, 64 nt, hsa
cucuggacacucuauauguagugcauuuuuaaacuugaaauauauaauauucagccagcuuaaa

SEQ ID NO: 605999 - RNA, 64 nt, hsa
auugcgccgcuccuggagaccugauaacuuaggcuugaaauaauugacuugucuaaaaggacaa

SEQ ID NO: 606000 - RNA, 64 nt, hsa
aacagacucugcaguacauuaaucagguugagaauugaaauauuuucuugcaucaguauuggcu

SEQ ID NO: 606001 - RNA, 64 nt, hsa
acuaguuuaucugaugauuuucuuacaugagcuuuugaaauaccuggaaaugcaguuuuaauau

SEQ ID NO: 606002 - RNA, 64 nt, hsa
gucaaaccaaugacaaaaccgccuuccacaaaaguugaaauaagaaacaagaguauuacuuuuc

SEQ ID NO: 606003 - RNA, 64 nt, hsa
uuuaaaauguaaauacaucaguucauguucuguauugaaauaggucugguugaucgaugucagu

SEQ ID NO: 606004 - RNA, 64 nt, hsa
ucagcugccaauagcaaaugaaguuaugggugacuugaaauaccaaaaccugaggagugggcaa

SEQ ID NO: 606005 - RNA, 64 nt, hsa
agcacagaucuucuuaaaaacugugaacuauguuuugaaauacucguuacuaaagcuguuuaua

SEQ ID NO: 606006 - RNA, 64 nt, hsa
auuuuuaauuaugacuacugcaauuugacaccauuugaaauaaucaauucagagacacuaaaga

SEQ ID NO: 606007 - RNA, 64 nt, hsa
gucauugcuuaaauauagucuugaagggcuuguuuugaaauauuguauauauuuuuucaaaugu

SEQ ID NO: 606008 - RNA, 64 nt, hsa
uacauguuaugagaguucuggaggaaguaauauguugaaauaguaaaacauuuuaguuuuugag

SEQ ID NO: 606009 - RNA, 64 nt, hsa
ggucacaaauauuguggacacauuaucuuauguuuugaaauaccugugaauuguuggcauugag

SEQ ID NO: 606010 - RNA, 64 nt, hsa
gaaugaagaaacagucuuuaacagaaaaaagguauugaaauauuaaauggccaccaaguuuacu

SEQ ID NO: 606011 - RNA, 64 nt, hsa
ggugucccuguugugugguggaaccuaaugacuguugaaauaaaguucuguguuuucccugccc

SEQ ID NO: 606012 - RNA, 64 nt, hsa
cacacgggcggcauuuaaauaggaauuucuauuuuugaaauaagggauggucuaugaggcauac

SEQ ID NO: 606013 - RNA, 64 nt, hsa
accuggcaagaaaucuggaaauucuauaauuuuguugaaauauugaaaaaagaugaccugcauc

SEQ ID NO: 606014 - RNA, 64 nt, hsa
auuuuauugucuuaguuuguauauuuucugugacuugaaauaaacuuugaacacaauuuuagua

SEQ ID NO: 606015 - RNA, 56 nt, hsa
uaauaccagagucuuacuaaacuccuuugaaauacuagaaaguuuuguuuuggaug

SEQ ID NO: 606016 - RNA, 64 nt, hsa
auauugcguagaaucuccacuaggaagucuuuauuugaaauaguugaaucagugaucuaguauu

SEQ ID NO: 606017 - RNA, 64 nt, hsa
uaaauuaccuguaaauauucuggauaggaacuacuugaaauaguaauuuguuaaaagauaugac

SEQ ID NO: 606018 - RNA, 64 nt, hsa
aauguauugauuguguccccaguuguuacauaauuugaaauaaaaauauaacuucuugauuuau

SEQ ID NO: 606019 - RNA, 64 nt, hsa
uuacucuuugcauauucugcaucugagacacuacuugaaauaugguuggcaucacugaagguuc

SEQ ID NO: 606020 - RNA, 64 nt, hsa
guaaguuuuuucauagugguaugcaaacauaucauugaaauauuacauagauauaaagacuuag

SEQ ID NO: 606021 - RNA, 64 nt, hsa
aauuucauuuagcagggaaguggaauaauaucuuuugaaauaacuaaguccacuaaauuauaca

SEQ ID NO: 606022 - RNA, 64 nt, hsa
uacuugauaugaaacuccuauuaacagucuuuuuuugaaauaaaaaguagcuugagcuuucuuu

SEQ ID NO: 606023 - RNA, 64 nt, hsa
acagguugaaugcuuugaauuucuggugacuacuuugaaauaacuuguuuuguuugucaaauuc

SEQ ID NO: 606024 - RNA, 64 nt, hsa
accgugacugaaaacuagaguccuacuuacauaguugaaauaucaaggaggucagaagaaaauu

SEQ ID NO: 606025 - RNA, 64 nt, hsa
aaaauaagucaggaggaugcaauuguugaaagcuuugaaauaaaauaacaaugucuucuugaaa

SEQ ID NO: 606026 - RNA, 64 nt, hsa; identical to SEQ ID NO: 188672

SEQ ID NO: 606027 - RNA, 64 nt, hsa; identical to SEQ ID NO: 188673

SEQ ID NO: 606028 - RNA, 64 nt, hsa; identical to SEQ ID NO: 188674

SEQ ID NO: 606029 - RNA, 64 nt, hsa; identical to SEQ ID NO: 188675

SEQ ID NO: 606030 - RNA, 64 nt, hsa; identical to SEQ ID NO: 188676

SEQ ID NO: 606031 - RNA, 64 nt, hsa; identical to SEQ ID NO: 188677

SEQ ID NO: 606032 - RNA, 64 nt, hsa; identical to SEQ ID NO: 188678

SEQ ID NO: 606033 - RNA, 64 nt, hsa; identical to SEQ ID NO: 188679

SEQ ID NO: 606034 - RNA, 58 nt, hsa; identical to SEQ ID NO: 225639

SEQ ID NO: 606035 - RNA, 64 nt, hsa; identical to SEQ ID NO: 225640

SEQ ID NO: 606036 - RNA, 64 nt, hsa; identical to SEQ ID NO: 225641

SEQ ID NO: 606037 - RNA, 64 nt, hsa; identical to SEQ ID NO: 225642

SEQ ID NO: 606038 - RNA, 64 nt, hsa; identical to SEQ ID NO: 225643

SEQ ID NO: 606039 - RNA, 64 nt, hsa; identical to SEQ ID NO: 225644

SEQ ID NO: 606040 - RNA, 64 nt, hsa; identical to SEQ ID NO: 225645

SEQ ID NO: 606041 - RNA, 64 nt, hsa; identical to SEQ ID NO: 225646

SEQ ID NO: 606042 - RNA, 64 nt, hsa; identical to SEQ ID NO: 225647

SEQ ID NO: 606043 - RNA, 64 nt, hsa; identical to SEQ ID NO: 225648

SEQ ID NO: 606044 - RNA, 64 nt, hsa; identical to SEQ ID NO: 225649

SEQ ID NO: 606045 - RNA, 64 nt, hsa; identical to SEQ ID NO: 225650

SEQ ID NO: 606046 - RNA, 64 nt, hsa; identical to SEQ ID NO: 225651

SEQ ID NO: 606047 - RNA, 64 nt, hsa; identical to SEQ ID NO: 225652

SEQ ID NO: 606048 - RNA, 64 nt, hsa; identical to SEQ ID NO: 225653

SEQ ID NO: 606049 - RNA, 64 nt, hsa; identical to SEQ ID NO: 536781

SEQ ID NO: 606050 - RNA, 64 nt, hsa; identical to SEQ ID NO: 536782

SEQ ID NO: 606051 - RNA, 64 nt, hsa; identical to SEQ ID NO: 536783

SEQ ID NO: 606052 - RNA, 64 nt, hsa; identical to SEQ ID NO: 536784

SEQ ID NO: 606053 - RNA, 64 nt, hsa; identical to SEQ ID NO: 536785

SEQ ID NO: 606054 - RNA, 64 nt, hsa; identical to SEQ ID NO: 536786

SEQ ID NO: 606055 - RNA, 64 nt, hsa; identical to SEQ ID NO: 536787

SEQ ID NO: 606056 - RNA, 64 nt, hsa; identical to SEQ ID NO: 536788

SEQ ID NO: 606057 - RNA, 64 nt, hsa; identical to SEQ ID NO: 536789

SEQ ID NO: 606058 - RNA, 64 nt, hsa; identical to SEQ ID NO: 536790

SEQ ID NO: 606059 - RNA, 64 nt, hsa; identical to SEQ ID NO: 536791

SEQ ID NO: 606060 - RNA, 64 nt, hsa; identical to SEQ ID NO: 536792

SEQ ID NO: 606061 - RNA, 64 nt, hsa; identical to SEQ ID NO: 536793

SEQ ID NO: 606062 - RNA, 64 nt, hsa; identical to SEQ ID NO: 536794

SEQ ID NO: 606063 - RNA, 64 nt, hsa; identical to SEQ ID NO: 536795

SEQ ID NO: 606064 - RNA, 64 nt, hsa; identical to SEQ ID NO: 536796

SEQ ID NO: 606065 - RNA, 64 nt, hsa; identical to SEQ ID NO: 536797

SEQ ID NO: 606066 - RNA, 64 nt, hsa; identical to SEQ ID NO: 536798

SEQ ID NO: 606067 - RNA, 64 nt, hsa; identical to SEQ ID NO: 536799

SEQ ID NO: 606068 - RNA, 64 nt, hsa; identical to SEQ ID NO: 536800

SEQ ID NO: 606069 - RNA, 64 nt, hsa; identical to SEQ ID NO: 536801

SEQ ID NO: 606070 - RNA, 64 nt, hsa; identical to SEQ ID NO: 536802

SEQ ID NO: 606071 - RNA, 64 nt, hsa; identical to SEQ ID NO: 536803

SEQ ID NO: 606072 - RNA, 64 nt, hsa; identical to SEQ ID NO: 536804

SEQ ID NO: 606073 - RNA, 64 nt, hsa; identical to SEQ ID NO: 536805

SEQ ID NO: 606074 - RNA, 64 nt, hsa; identical to SEQ ID NO: 536806

SEQ ID NO: 606075 - RNA, 64 nt, hsa; identical to SEQ ID NO: 536807

SEQ ID NO: 606076 - RNA, 64 nt, hsa; identical to SEQ ID NO: 536808

SEQ ID NO: 606077 - RNA, 64 nt, hsa; identical to SEQ ID NO: 536809

SEQ ID NO: 606078 - RNA, 64 nt, hsa; identical to SEQ ID NO: 536810

SEQ ID NO: 606079 - RNA, 64 nt, hsa; identical to SEQ ID NO: 536811

SEQ ID NO: 606080 - RNA, 64 nt, hsa; identical to SEQ ID NO: 536812

SEQ ID NO: 606081 - RNA, 64 nt, hsa; identical to SEQ ID NO: 536813

SEQ ID NO: 606082 - RNA, 64 nt, hsa; identical to SEQ ID NO: 536814

SEQ ID NO: 606083 - RNA, 64 nt, hsa; identical to SEQ ID NO: 536815

SEQ ID NO: 606084 - RNA, 64 nt, hsa; identical to SEQ ID NO: 536816

SEQ ID NO: 606085 - RNA, 64 nt, hsa; identical to SEQ ID NO: 536817

SEQ ID NO: 606086 - RNA, 64 nt, hsa; identical to SEQ ID NO: 536818

SEQ ID NO: 606087 - RNA, 64 nt, hsa; identical to SEQ ID NO: 536819

SEQ ID NO: 606088 - RNA, 64 nt, hsa; identical to SEQ ID NO: 536820

SEQ ID NO: 606089 - RNA, 64 nt, hsa; identical to SEQ ID NO: 536821

SEQ ID NO: 606090 - RNA, 64 nt, hsa; identical to SEQ ID NO: 536822

SEQ ID NO: 606091 - RNA, 64 nt, hsa; identical to SEQ ID NO: 536823

SEQ ID NO: 606092 - RNA, 64 nt, hsa; identical to SEQ ID NO: 536824

SEQ ID NO: 606093 - RNA, 64 nt, hsa; identical to SEQ ID NO: 536825

SEQ ID NO: 606094 - RNA, 64 nt, hsa
ucuacuucuuccugugugggagcccauagcuguugucuaacagguaagaaaugaaauugaacua

SEQ ID NO: 606095 - RNA, 64 nt, hsa
aagcagucuaacuagaauggauuuuacugaaccagucuaacauuuacuuuccaagaaacauuca

SEQ ID NO: 606096 - RNA, 64 nt, hsa
uuuugcaaaccaagggagauuucuuagcaaaugagucuaacaaauaugacaucugucuuuggca

SEQ ID NO: 606097 - RNA, 64 nt, hsa
caaggcuaaagucagaucuagaguucugccacaggucuaacaaucaagucuuuagauggaagga

SEQ ID NO: 606098 - RNA, 64 nt, hsa
uauugauuuuuguauaaaaauguaacuucuacgugucuaacacguauuaaauauuuugaagcaa

SEQ ID NO: 606099 - RNA, 64 nt, hsa
uuguucuuguucuauauuuuguuuugaaaaugaugucuaacaaccaugauaagagcaaggcugu

SEQ ID NO: 606100 - RNA, 64 nt, hsa
aaggucuuugugaccccaggaaaauauugacucugucuaacacacaauagucacaauacuuuuu

SEQ ID NO: 606101 - RNA, 64 nt, hsa
cacaaaauuauuugaguacugugaaggauuauuugucuaacaguucauuccaaucagaccaggu

SEQ ID NO: 606102 - RNA, 64 nt, hsa
cugacaccguugccauaaaucccugauacucaaagucuaacaagaaagacauggaaaauuagca

SEQ ID NO: 606103 - RNA, 64 nt, hsa
aauccuacagcuuuguaauuuuuuuucuacaaaugucuaacauccaaaacugaggguugggaaa

SEQ ID NO: 606104 - RNA, 64 nt, hsa
aaugaaacgugaccuccuauugauguauuaaaaugucuaacauaaaggucaugugauuuguaau

SEQ ID NO: 606105 - RNA, 64 nt, hsa
aucauggaaugagaaaaugagaaaggaaugaguugucuaacaucacagugggaucuguuuuuug

SEQ ID NO: 606106 - RNA, 64 nt, hsa
ugaugucuuaacucuacuuagagaguguaugucugucuaacagaacaaaaagaugcucugugua

SEQ ID NO: 606107 - RNA, 64 nt, hsa
aaggcacaauggguacuacagaauuaaaauguaggucuaacauaaugccaguuccacuuuaacu

SEQ ID NO: 606108 - RNA, 64 nt, hsa
ggcaaaaccugaaccaccuucugcacuuaaagaagucuaacaguacaaauacacuaucuaucuu

SEQ ID NO: 606109 - RNA, 64 nt, hsa
cacugguauagcacccuuauguuacuaaagccuagucuaacacugaacucauguucuugaugag

SEQ ID NO: 606110 - RNA, 64 nt, hsa
acuaggugaacagaaauuaccugacuaauaauuugucuaacaucauauaucagaauuuuauugu

SEQ ID NO: 606111 - RNA, 64 nt, hsa
aauagcuucaggaaaguuaaagguaucaucuuaggucuaacacucuagucuuugagaguuacgg

SEQ ID NO: 606112 - RNA, 64 nt, hsa
guguauuaguuuuugcuuuucugagcuuuuuaaagucuaacaaaucuuuuuagucaucuuuuau

SEQ ID NO: 606113 - RNA, 64 nt, hsa
aguguacauugaaaaccauguaaaauauugaagugucuaacaaauggcauugaagugucuuuaa

SEQ ID NO: 606114 - RNA, 64 nt, hsa
guguaaaacuauauucucaguguagggcagagaggucuaacaccaacauaagguacuagcagug

SEQ ID NO: 606115 - RNA, 64 nt, hsa
agguuuccagcugacuugggaacugcaagucugagucuaacaguuuuuggcuuagauucugaga

SEQ ID NO: 606116 - RNA, 64 nt, hsa
cguccaggcuuuucauuaaggacauaauauuuacgucuaacagaccuuuuuucuuguguauaca

SEQ ID NO: 606117 - RNA, 64 nt, hsa
ccuccucuuuuuuccccccuaguugaaucagcuugucuaacaagcccauuuucaugccccagcu

SEQ ID NO: 606118 - RNA, 64 nt, hsa
acccguuguacagacggaggagcgagcaacacacgucuaacagccuagacaaucucgucagaug

SEQ ID NO: 606119 - RNA, 64 nt, hsa
cugauguaaugaauauauaauuacaacaaaagaggucuaacacuauaguagaaaaguuuggggc

SEQ ID NO: 606120 - RNA, 64 nt, hsa
gguucacucauugaauuuuuauugcuauuauuuagucuaacagcuacuaaaaguaaaacaucag

SEQ ID NO: 606121 - RNA, 64 nt, hsa
uuuucauaguacaugaccugcauuccacaucucagucuaacaguuuaguagugauguaaagaga

SEQ ID NO: 606122 - RNA, 64 nt, hsa
aagcuacuuuuagauuuggaaauugcuguuuacagucuaacaacauuaaaaugagagguagauu

SEQ ID NO: 606123 - RNA, 64 nt, hsa
aaggagagagaaggaaaggagugagguauuucccgucuaacagaaagcagcguaucaacuccua

SEQ ID NO: 606124 - RNA, 64 nt, hsa
aauuuuuccuugaucccacugaucuugacaucaagucuaacaaagaaaaaguuuugaguuuugu

SEQ ID NO: 606125 - RNA, 64 nt, hsa
uacauauauauaagugccauauuuaaaauaauuugucuaacaguagaacugugucggagcacuc

SEQ ID NO: 606126 - RNA, 64 nt, hsa
uuguuuaucacguuuugcacaaagcagagccacugucuaacacagcuguuaacgaaugauaaac

SEQ ID NO: 606127 - RNA, 64 nt, hsa
aaguuauugugauauccuucuagaucauacacaagucuaacaguuaauuaguuaacaguuuuua

SEQ ID NO: 606128 - RNA, 64 nt, hsa
ccaagguaugaagcagaugagggaccagcacucagucuaacauguaaacaucauacguaauaaa

SEQ ID NO: 606129 - RNA, 64 nt, hsa
gggauucacugcaucauagcuaugccuguauggagucuaacauaugaccaauaccaacccauaa

SEQ ID NO: 606130 - RNA, 64 nt, hsa
acacccacccagccuguuugaacacauucuaauugucuaacauuuguugcauuuuaaguaugag

SEQ ID NO: 606131 - RNA, 64 nt, hsa
uauuuuuaauaaaucauuguguuugaccguacaugucuaacauuuuuuuucuaggauccauucc

SEQ ID NO: 606132 - RNA, 64 nt, hsa
ccuuuuaggaaaaguagaaagcauagacuuacaagucuaacaggagauaggagagagucacuca

SEQ ID NO: 606133 - RNA, 64 nt, hsa
agggguaugggaaggauagacucauaauuaaaaugucuaacaugucucuguugagaaauuuauu

SEQ ID NO: 606134 - RNA, 64 nt, hsa
cuuaugaaagugcuugagcuuuuaaccagguacugucuaacaacagucaucuuuugguucuguu

SEQ ID NO: 606135 - RNA, 64 nt, hsa
cauuuuuuuaaagauuuuccacagcuacuugagugucuaacauacaguaacaucuaacucagcu

SEQ ID NO: 606136 - RNA, 64 nt, hsa
agaaauaacuacccugucucccaccugcaggaaugucuaacaaagcauccaucuuccuccuucu

SEQ ID NO: 606137 - RNA, 64 nt, hsa
caugcagccacuuuggguuuuguuauaggcaucagucuaacaagucauuaggucacucgggaag

SEQ ID NO: 606138 - RNA, 64 nt, hsa
ccuuaaaaggauuggcuuguguuguuauuauuaagucuaacaaguccaaaagcuggagugugag

SEQ ID NO: 606139 - RNA, 64 nt, hsa
ucuguaugcuagagaggggugaggaauggauacugucuaacagucucugauuucaacacuaaca

SEQ ID NO: 606140 - RNA, 64 nt, hsa
ccauucagugcagcauauacaauaauguaauuuagucuaacacaguugacccuauuuuuugaca

SEQ ID NO: 606141 - RNA, 64 nt, hsa
aaaugauguguaugcagaguuuuaaaauaaauucgucuaacaauaacuuccuuugguaguuuug

SEQ ID NO: 606142 - RNA, 64 nt, hsa
uuuuuuuuuuuuugcuuuguuuuuguacaaaagagucuaacauuuuuugccaaacagauauaua

SEQ ID NO: 606143 - RNA, 64 nt, hsa
aauccgacuggagaugauuuggcccccuguccuggucuaacauacaaaucuaggaauauuaugc

SEQ ID NO: 606144 - RNA, 64 nt, hsa
gagguuccucuuggagucuagaacauccuuaaaugucuaacaacaagggcuaccucugaguacc

SEQ ID NO: 606145 - RNA, 64 nt, hsa
uuuacugcauuuuucaauccagauucuugaaauugucuaacauguggguacugugucaucacaa

SEQ ID NO: 606146 - RNA, 64 nt, hsa
ccccuugcucauuguauguugaugaguugauuaagucuaacagauucaucaagacuccauugcu

SEQ ID NO: 606147 - RNA, 64 nt, hsa
uuguagagucugaggguuagaaggaagucauugugucuaacauaacaacagagcaguuuguguc

SEQ ID NO: 606148 - RNA, 64 nt, hsa
aguaaacuucaguugcuuaaucaaacuaaugauagucuaacaacugagcaagauccucaucuga

SEQ ID NO: 606149 - RNA, 64 nt, hsa
gagacugaaauuuaguacacuauguucuaggucagucuaacaguuugccugcuguauuuauagu

SEQ ID NO: 606150 - RNA, 64 nt, hsa
gaacuacuagaaaauugugcuggaaauggacacagucuaacaaauuccaaauucucacagaaga

SEQ ID NO: 606151 - RNA, 64 nt, hsa
cagcuuugggacuagucuguaucuuguuuuuuaagucuaacaacacugauaauaggaaguaaaa

SEQ ID NO: 606152 - RNA, 64 nt, hsa
ugacacugacuuauaguucacuguuuaccuguuggucuaacagcaaaucauaaacaguaguuuu

SEQ ID NO: 606153 - RNA, 64 nt, hsa
uaccaccucccaauaaucaacagcaaaauuauaggucuaacaauguuuuauagacaccccucca

SEQ ID NO: 606154 - RNA, 64 nt, hsa
accugugcaauaugaggccaaauuuaaucuuugagucuaacacaccacuuucugcuuucccgaa

SEQ ID NO: 606155 - RNA, 64 nt, hsa
uaccuaaaaucaauaccuaaauacagaagccuuggucuaacacgggacuuuuaguuugcgaagg

SEQ ID NO: 606156 - RNA, 64 nt, hsa
gguccagauuucuggugguuucugcccugcagaugucuaacacauaagccaggacauucugcug

SEQ ID NO: 606157 - RNA, 64 nt, hsa
cucucguggucaugccaagaacacaggagggugagucuaacaagcacaccucaagccucugcuu

SEQ ID NO: 606158 - RNA, 64 nt, hsa
uauuaagauuuuaucuuaaugaugaguagccaaggucuaacauagggccucuccucaaggagag

SEQ ID NO: 606159 - RNA, 64 nt, hsa
aaagugcccaucuggugcucaagagagccugggggucuaacagggagcccggcugccucaccug

SEQ ID NO: 606160 - RNA, 64 nt, hsa
gagacagugacuguuccugccacaguccuucccagucuaacacuauuccugggcugcaugauau

SEQ ID NO: 606161 - RNA, 64 nt, hsa
uuuguuuggcaaauguuacuccuguauugaguaagucuaacauuacgucccuuuucuuuuuggg

SEQ ID NO: 606162 - RNA, 64 nt, hsa
uggugacaacggaggaaauauccaacagaaauacgucuaacagggaaauugggaucauaguuua

SEQ ID NO: 606163 - RNA, 64 nt, hsa
uaaaucagagagcaaggcaucgggggugaaucuugucuaacauucccgaggucagccaggcugc

SEQ ID NO: 606164 - RNA, 64 nt, hsa
cuggguguaaggcaguagcggggagcggcaugcugucuaacagcuguuagcuccagcugguugu

SEQ ID NO: 606165 - RNA, 64 nt, hsa
ucuauuuacuguuuaucaaucuaucaauguaauugucuaacacuccuuucuauucucucccuac

SEQ ID NO: 606166 - RNA, 64 nt, hsa
ugaaguagaggugcaguuaaguggggggccacuagucuaacagacggucacaaccagugccaug

SEQ ID NO: 606167 - RNA, 64 nt, hsa
uuuaaauuguacaaucucuguauuauagcuauuugucuaacauuaccccacauguaauaaauaa

SEQ ID NO: 606168 - RNA, 64 nt, hsa
aacaacaaaacaaaacaauuccagucuuggaguagucuaacagaagaaaauguaaaauuauuug

SEQ ID NO: 606169 - RNA, 64 nt, hsa
guuuguucaaaaccugcagcaaagagaagcaucagucuaacaagccagaacucauuuugugcca

SEQ ID NO: 606170 - RNA, 64 nt, hsa
uucaaaauccuaguaugcuaaagggaugguacaagucuaacacaaauuguacguaaugauacau

SEQ ID NO: 606171 - RNA, 64 nt, hsa
gucuauuuaucuuuuauuuuuuuaagucaguauggucuaacacuggcauguucaaagccacauu

SEQ ID NO: 606172 - RNA, 64 nt, hsa
aucuagaaaucagcuuuuaaaaauauugucugaagucuaacaaaaguuuucaccucuaaugugu

SEQ ID NO: 606173 - RNA, 64 nt, hsa
auaaccugaccuuuucuuugcauuuguuuugaaugucuaacaccauuagcuuuugugaucuggu

SEQ ID NO: 606174 - RNA, 64 nt, hsa
ggcacuuggcccagaaguuguuugcuaaugaucagucuaacagcugaaagucaaagucaguggc

SEQ ID NO: 606175 - RNA, 64 nt, hsa
gaucccugugggaccuuugacagcagggaugggggucuaacagcuguagggugcugccacucca

SEQ ID NO: 606176 - RNA, 64 nt, hsa
auauauauccuaggguaugauacuacugugacgggucuaacagcccccggcuacucuuguucug

SEQ ID NO: 606177 - RNA, 64 nt, hsa
uugaacuaauucuacuauuuaggaauuuguaagagucuaacauaggcuuagcuacagugaaguu

SEQ ID NO: 606178 - RNA, 64 nt, hsa
aagaauuuuuggaucaagcggaaagaguuuaagugucuaacaaacuuaaagcuacuguaguacc

SEQ ID NO: 606179 - RNA, 64 nt, hsa
gugucuaccuggccaguggagugguccaugcuaagucuaacacuccugggagcucaggaggcuu

SEQ ID NO: 606180 - RNA, 64 nt, hsa
gcaagccauuuacagaaacccacucggcaccccagucuaacaccacaacuaauuucacccaagg

SEQ ID NO: 606181 - RNA, 64 nt, hsa
ucucugaggaaaacaaaaccuguuuucuacuugagucuaacauauggucccaauuuauuaauac

SEQ ID NO: 606182 - RNA, 64 nt, hsa
uuucaaucuuacaaagcaacuguuagaaacuucugucuaacaccaucacaaauagguucauggu

SEQ ID NO: 606183 - RNA, 64 nt, hsa
agacuuaaaggacugcaauaaauguagaguugaugucuaacacccacauggcgugagcugaaac

SEQ ID NO: 606184 - RNA, 64 nt, hsa
gaacccugaagcgcaccgcacugucugccccaaugucuaacaaaggccggaggcgacucuuccu

SEQ ID NO: 606185 - RNA, 64 nt, hsa
uuauugaaugugugggguuuccccucaggaauuugucuaacacauuucaaggauagaaaauacu

SEQ ID NO: 606186 - RNA, 64 nt, hsa
gcggaucacaaggucaggaguucgagaccauccugucuaacacggugaaaccccaucucuacua

SEQ ID NO: 606187 - RNA, 64 nt, hsa
gagagaaaaguagaaaaccagagugcacguaggugucuaacacagaggagaguaggaacagggc

SEQ ID NO: 606188 - RNA, 64 nt, hsa
cuggaaacugggcacagaaggacugugugccugggucuaacaugugguccccuuugucccuagc

SEQ ID NO: 606189 - RNA, 64 nt, hsa
uccaucagagcugauagccuguuaauaagcacuggucuaacacagccaacccuccuccacagcg

SEQ ID NO: 606190 - RNA, 64 nt, hsa
aggcaaaaaaaaaaagcuucuccuacgagaaucagucuaacagagaugccgaugucagcacagc

SEQ ID NO: 606191 - RNA, 64 nt, hsa
ggugaaccugaagcaugcuuuaaccucuaagacugucuaacacgcguuucauucaaugucucca

SEQ ID NO: 606192 - RNA, 64 nt, hsa
agaaacucucacccucacuccaucucccacugcggucuaacaaaucuccuuucgucucucagaa

SEQ ID NO: 606193 - RNA, 64 nt, hsa
caugccggcagcagcuagcaaagccagaaagcaagucuaacaggaucuaagaugaccaucagga

SEQ ID NO: 606194 - RNA, 64 nt, hsa
uuuacuguauuauacuuuuccuuuuuuauauaaugucuaacaaaaaauacagcugcaacauuuu

SEQ ID NO: 606195 - RNA, 64 nt, hsa
auaacccccuaaggaauccaucggacaagaccccgucuaacacugcauccucccaacugggcau

SEQ ID NO: 606196 - RNA, 64 nt, hsa
auuugacauuuuacauuucaaagaaagguauguugucuaacaggggaccaacagaagguaguau

SEQ ID NO: 606197 - RNA, 64 nt, hsa
gugaaucauauguuguaggaaaagcuguucccaugucuaacaggacuugaauucaaagcauguc

SEQ ID NO: 606198 - RNA, 64 nt, hsa
gaacacuugcucaacaaccuugcuguuggcccaagucuaacacauucuuuaugacugugagcau

SEQ ID NO: 606199 - RNA, 64 nt, hsa
uaauucugucaaaaccuaugaaggugacuaaauugucuaacaugaaguguucuuucuuuuucuu

SEQ ID NO: 606200 - RNA, 64 nt, hsa
aauuuauccuauaagaugacaauguuuacucaaagucuaacauauucaaugcaaguaagacuuu

SEQ ID NO: 606201 - RNA, 64 nt, hsa
aaaauaacagcaauaaaccuaaccuuuuaacagggucuaacaugagaguuggagucaaagccau

SEQ ID NO: 606202 - RNA, 64 nt, hsa
uaagucaugguuaauaacaaaugaauccagacuugucuaacagauuuuccaucaacaaauauug

SEQ ID NO: 606203 - RNA, 64 nt, hsa
uauggccuuguuggagggggccaggcucuagaacgucuaacacaguggagaaccgaaacccccc

SEQ ID NO: 606204 - RNA, 64 nt, hsa
uauaaaacagauauauaauaaauagccuagcuuagucuaacaucucuuuagaauuacacagcua

SEQ ID NO: 606205 - RNA, 64 nt, hsa
auuuacucaguauuuuucuugagguugaucugaggucuaacauuguuauccuauaucauuuuca

SEQ ID NO: 606206 - RNA, 64 nt, hsa
gcccuugauuggaagggcuuuucaaaaucauuuagucuaacaacugcccaguuuccagucgggg

SEQ ID NO: 606207 - RNA, 64 nt, hsa
agggacuucauauaccugauuccucuagaaggcugucuaacauaccacaugauuacaugaacug

SEQ ID NO: 606208 - RNA, 64 nt, hsa; identical to SEQ ID NO: 382199

SEQ ID NO: 606209 - RNA, 64 nt, hsa; identical to SEQ ID NO: 382200

SEQ ID NO: 606210 - RNA, 64 nt, hsa; identical to SEQ ID NO: 382201

SEQ ID NO: 606211 - RNA, 57 nt, hsa; identical to SEQ ID NO: 382202

SEQ ID NO: 606212 - RNA, 64 nt, hsa; identical to SEQ ID NO: 382203

SEQ ID NO: 606213 - RNA, 64 nt, hsa; identical to SEQ ID NO: 382204

SEQ ID NO: 606214 - RNA, 64 nt, hsa; identical to SEQ ID NO: 382205

SEQ ID NO: 606215 - RNA, 64 nt, hsa; identical to SEQ ID NO: 382206

SEQ ID NO: 606216 - RNA, 64 nt, hsa; identical to SEQ ID NO: 382207

SEQ ID NO: 606217 - RNA, 64 nt, hsa; identical to SEQ ID NO: 382208

SEQ ID NO: 606218 - RNA, 64 nt, hsa; identical to SEQ ID NO: 382209

SEQ ID NO: 606219 - RNA, 64 nt, hsa; identical to SEQ ID NO: 382210

SEQ ID NO: 606220 - RNA, 64 nt, hsa; identical to SEQ ID NO: 382211

SEQ ID NO: 606221 - RNA, 64 nt, hsa; identical to SEQ ID NO: 382212

SEQ ID NO: 606222 - RNA, 64 nt, hsa; identical to SEQ ID NO: 382213

SEQ ID NO: 606223 - RNA, 64 nt, hsa; identical to SEQ ID NO: 382214

SEQ ID NO: 606224 - RNA, 64 nt, hsa; identical to SEQ ID NO: 382215

SEQ ID NO: 606225 - RNA, 64 nt, hsa; identical to SEQ ID NO: 382216

SEQ ID NO: 606226 - RNA, 64 nt, hsa; identical to SEQ ID NO: 382217

SEQ ID NO: 606227 - RNA, 64 nt, hsa; identical to SEQ ID NO: 382218

SEQ ID NO: 606228 - RNA, 64 nt, hsa; identical to SEQ ID NO: 382219

SEQ ID NO: 606229 - RNA, 64 nt, hsa; identical to SEQ ID NO: 382220

SEQ ID NO: 606230 - RNA, 64 nt, hsa; identical to SEQ ID NO: 382221

SEQ ID NO: 606231 - RNA, 64 nt, hsa; identical to SEQ ID NO: 382222

SEQ ID NO: 606232 - RNA, 63 nt, hsa; identical to SEQ ID NO: 382223

SEQ ID NO: 606233 - RNA, 64 nt, hsa; identical to SEQ ID NO: 382224

SEQ ID NO: 606234 - RNA, 64 nt, hsa; identical to SEQ ID NO: 382225

SEQ ID NO: 606235 - RNA, 64 nt, hsa; identical to SEQ ID NO: 382226

SEQ ID NO: 606236 - RNA, 64 nt, hsa; identical to SEQ ID NO: 382227

SEQ ID NO: 606237 - RNA, 64 nt, hsa; identical to SEQ ID NO: 382228

SEQ ID NO: 606238 - RNA, 64 nt, hsa; identical to SEQ ID NO: 382229

SEQ ID NO: 606239 - RNA, 64 nt, hsa; identical to SEQ ID NO: 382230

SEQ ID NO: 606240 - RNA, 64 nt, hsa; identical to SEQ ID NO: 382231

SEQ ID NO: 606241 - RNA, 64 nt, hsa; identical to SEQ ID NO: 382232

SEQ ID NO: 606242 - RNA, 64 nt, hsa; identical to SEQ ID NO: 382233

SEQ ID NO: 606243 - RNA, 64 nt, hsa; identical to SEQ ID NO: 382234

SEQ ID NO: 606244 - RNA, 64 nt, hsa; identical to SEQ ID NO: 382235

SEQ ID NO: 606245 - RNA, 64 nt, hsa; identical to SEQ ID NO: 382236

SEQ ID NO: 606246 - RNA, 64 nt, hsa; identical to SEQ ID NO: 382237

SEQ ID NO: 606247 - RNA, 64 nt, hsa; identical to SEQ ID NO: 259689

SEQ ID NO: 606248 - RNA, 64 nt, hsa; identical to SEQ ID NO: 259690

SEQ ID NO: 606249 - RNA, 64 nt, hsa; identical to SEQ ID NO: 259691

SEQ ID NO: 606250 - RNA, 64 nt, hsa; identical to SEQ ID NO: 259692

SEQ ID NO: 606251 - RNA, 64 nt, hsa; identical to SEQ ID NO: 259693

SEQ ID NO: 606252 - RNA, 64 nt, hsa; identical to SEQ ID NO: 259694

SEQ ID NO: 606253 - RNA, 64 nt, hsa; identical to SEQ ID NO: 259695

SEQ ID NO: 606254 - RNA, 64 nt, hsa; identical to SEQ ID NO: 259696

SEQ ID NO: 606255 - RNA, 64 nt, hsa; identical to SEQ ID NO: 193272

SEQ ID NO: 606256 - RNA, 64 nt, hsa; identical to SEQ ID NO: 193273

SEQ ID NO: 606257 - RNA, 64 nt, hsa; identical to SEQ ID NO: 193274

SEQ ID NO: 606258 - RNA, 64 nt, hsa; identical to SEQ ID NO: 193275

SEQ ID NO: 606259 - RNA, 64 nt, hsa; identical to SEQ ID NO: 193276

SEQ ID NO: 606260 - RNA, 64 nt, hsa; identical to SEQ ID NO: 193277

SEQ ID NO: 606261 - RNA, 64 nt, hsa; identical to SEQ ID NO: 193278

SEQ ID NO: 606262 - RNA, 64 nt, hsa; identical to SEQ ID NO: 193279

SEQ ID NO: 606263 - RNA, 64 nt, hsa; identical to SEQ ID NO: 193280

SEQ ID NO: 606264 - RNA, 64 nt, hsa; identical to SEQ ID NO: 193281

SEQ ID NO: 606265 - RNA, 64 nt, hsa; identical to SEQ ID NO: 193282

SEQ ID NO: 606266 - RNA, 64 nt, hsa; identical to SEQ ID NO: 193283

SEQ ID NO: 606267 - RNA, 64 nt, hsa; identical to SEQ ID NO: 87097

SEQ ID NO: 606268 - RNA, 64 nt, hsa; identical to SEQ ID NO: 87098

SEQ ID NO: 606269 - RNA, 64 nt, hsa; identical to SEQ ID NO: 87099

SEQ ID NO: 606270 - RNA, 64 nt, hsa; identical to SEQ ID NO: 87100

SEQ ID NO: 606271 - RNA, 64 nt, hsa; identical to SEQ ID NO: 87101

SEQ ID NO: 606272 - RNA, 64 nt, hsa; identical to SEQ ID NO: 87102

SEQ ID NO: 606273 - RNA, 64 nt, hsa; identical to SEQ ID NO: 87103

SEQ ID NO: 606274 - RNA, 64 nt, hsa; identical to SEQ ID NO: 87104

SEQ ID NO: 606275 - RNA, 64 nt, hsa; identical to SEQ ID NO: 87105

SEQ ID NO: 606276 - RNA, 64 nt, hsa; identical to SEQ ID NO: 87106

SEQ ID NO: 606277 - RNA, 64 nt, hsa; identical to SEQ ID NO: 87107

SEQ ID NO: 606278 - RNA, 64 nt, hsa; identical to SEQ ID NO: 87108

SEQ ID NO: 606279 - RNA, 64 nt, hsa; identical to SEQ ID NO: 87109

SEQ ID NO: 606280 - RNA, 64 nt, hsa; identical to SEQ ID NO: 87110

SEQ ID NO: 606281 - RNA, 64 nt, hsa; identical to SEQ ID NO: 87111

SEQ ID NO: 606282 - RNA, 64 nt, hsa; identical to SEQ ID NO: 87112

SEQ ID NO: 606283 - RNA, 64 nt, hsa; identical to SEQ ID NO: 87113

SEQ ID NO: 606284 - RNA, 64 nt, hsa; identical to SEQ ID NO: 87114

SEQ ID NO: 606285 - RNA, 64 nt, hsa; identical to SEQ ID NO: 87115

SEQ ID NO: 606286 - RNA, 64 nt, hsa; identical to SEQ ID NO: 87116

SEQ ID NO: 606287 - RNA, 64 nt, hsa; identical to SEQ ID NO: 87117

SEQ ID NO: 606288 - RNA, 64 nt, hsa; identical to SEQ ID NO: 87118

SEQ ID NO: 606289 - RNA, 64 nt, hsa; identical to SEQ ID NO: 87119

SEQ ID NO: 606290 - RNA, 64 nt, hsa; identical to SEQ ID NO: 87120

SEQ ID NO: 606291 - RNA, 64 nt, hsa; identical to SEQ ID NO: 87121

SEQ ID NO: 606292 - RNA, 64 nt, hsa; identical to SEQ ID NO: 87122

SEQ ID NO: 606293 - RNA, 64 nt, hsa; identical to SEQ ID NO: 87123

SEQ ID NO: 606294 - RNA, 64 nt, hsa; identical to SEQ ID NO: 87124

SEQ ID NO: 606295 - RNA, 64 nt, hsa; identical to SEQ ID NO: 87125

SEQ ID NO: 606296 - RNA, 64 nt, hsa; identical to SEQ ID NO: 87126

SEQ ID NO: 606297 - RNA, 64 nt, hsa; identical to SEQ ID NO: 87127

SEQ ID NO: 606298 - RNA, 64 nt, hsa; identical to SEQ ID NO: 87128

SEQ ID NO: 606299 - RNA, 64 nt, hsa; identical to SEQ ID NO: 87129

SEQ ID NO: 606300 - RNA, 64 nt, hsa; identical to SEQ ID NO: 87130

SEQ ID NO: 606301 - RNA, 64 nt, hsa; identical to SEQ ID NO: 87131

SEQ ID NO: 606302 - RNA, 64 nt, hsa; identical to SEQ ID NO: 87132

SEQ ID NO: 606303 - RNA, 64 nt, hsa; identical to SEQ ID NO: 87133

SEQ ID NO: 606304 - RNA, 64 nt, hsa; identical to SEQ ID NO: 87134

SEQ ID NO: 606305 - RNA, 64 nt, hsa; identical to SEQ ID NO: 87135

SEQ ID NO: 606306 - RNA, 64 nt, hsa; identical to SEQ ID NO: 87136

SEQ ID NO: 606307 - RNA, 64 nt, hsa; identical to SEQ ID NO: 245916

SEQ ID NO: 606308 - RNA, 64 nt, hsa; identical to SEQ ID NO: 245917

SEQ ID NO: 606309 - RNA, 64 nt, hsa; identical to SEQ ID NO: 245918

SEQ ID NO: 606310 - RNA, 64 nt, hsa; identical to SEQ ID NO: 245919

SEQ ID NO: 606311 - RNA, 64 nt, hsa; identical to SEQ ID NO: 245920

SEQ ID NO: 606312 - RNA, 64 nt, hsa; identical to SEQ ID NO: 245921

SEQ ID NO: 606313 - RNA, 64 nt, hsa; identical to SEQ ID NO: 245922

SEQ ID NO: 606314 - RNA, 64 nt, hsa; identical to SEQ ID NO: 245923

SEQ ID NO: 606315 - RNA, 64 nt, hsa; identical to SEQ ID NO: 245924

SEQ ID NO: 606316 - RNA, 64 nt, hsa; identical to SEQ ID NO: 245925

SEQ ID NO: 606317 - RNA, 64 nt, hsa; identical to SEQ ID NO: 245926

SEQ ID NO: 606318 - RNA, 64 nt, hsa; identical to SEQ ID NO: 245927

SEQ ID NO: 606319 - RNA, 64 nt, hsa; identical to SEQ ID NO: 245928

SEQ ID NO: 606320 - RNA, 64 nt, hsa; identical to SEQ ID NO: 245929

SEQ ID NO: 606321 - RNA, 64 nt, hsa; identical to SEQ ID NO: 245930

SEQ ID NO: 606322 - RNA, 64 nt, hsa; identical to SEQ ID NO: 245931

SEQ ID NO: 606323 - RNA, 64 nt, hsa; identical to SEQ ID NO: 245932

SEQ ID NO: 606324 - RNA, 64 nt, hsa; identical to SEQ ID NO: 245933

SEQ ID NO: 606325 - RNA, 64 nt, hsa; identical to SEQ ID NO: 245934

SEQ ID NO: 606326 - RNA, 64 nt, hsa; identical to SEQ ID NO: 245935

SEQ ID NO: 606327 - RNA, 64 nt, hsa; identical to SEQ ID NO: 245936

SEQ ID NO: 606328 - RNA, 64 nt, hsa; identical to SEQ ID NO: 145091

SEQ ID NO: 606329 - RNA, 64 nt, hsa; identical to SEQ ID NO: 145092

SEQ ID NO: 606330 - RNA, 64 nt, hsa; identical to SEQ ID NO: 145093

SEQ ID NO: 606331 - RNA, 64 nt, hsa; identical to SEQ ID NO: 145094

SEQ ID NO: 606332 - RNA, 64 nt, hsa; identical to SEQ ID NO: 145095

SEQ ID NO: 606333 - RNA, 64 nt, hsa; identical to SEQ ID NO: 145096

SEQ ID NO: 606334 - RNA, 64 nt, hsa; identical to SEQ ID NO: 145097

SEQ ID NO: 606335 - RNA, 64 nt, hsa; identical to SEQ ID NO: 145098

SEQ ID NO: 606336 - RNA, 64 nt, hsa; identical to SEQ ID NO: 145099

SEQ ID NO: 606337 - RNA, 64 nt, hsa; identical to SEQ ID NO: 145100

SEQ ID NO: 606338 - RNA, 64 nt, hsa; identical to SEQ ID NO: 145101

SEQ ID NO: 606339 - RNA, 64 nt, hsa; identical to SEQ ID NO: 145102

SEQ ID NO: 606340 - RNA, 64 nt, hsa; identical to SEQ ID NO: 145103

SEQ ID NO: 606341 - RNA, 64 nt, hsa; identical to SEQ ID NO: 145104

SEQ ID NO: 606342 - RNA, 64 nt, hsa; identical to SEQ ID NO: 145105

SEQ ID NO: 606343 - RNA, 64 nt, hsa; identical to SEQ ID NO: 145106

SEQ ID NO: 606344 - RNA, 64 nt, hsa; identical to SEQ ID NO: 145107

SEQ ID NO: 606345 - RNA, 64 nt, hsa; identical to SEQ ID NO: 145108

SEQ ID NO: 606346 - RNA, 64 nt, hsa; identical to SEQ ID NO: 145109

SEQ ID NO: 606347 - RNA, 64 nt, hsa; identical to SEQ ID NO: 145110

SEQ ID NO: 606348 - RNA, 64 nt, hsa; identical to SEQ ID NO: 145111

SEQ ID NO: 606349 - RNA, 64 nt, hsa; identical to SEQ ID NO: 145112

SEQ ID NO: 606350 - RNA, 64 nt, hsa; identical to SEQ ID NO: 145113

SEQ ID NO: 606351 - RNA, 64 nt, hsa; identical to SEQ ID NO: 145114

SEQ ID NO: 606352 - RNA, 64 nt, hsa; identical to SEQ ID NO: 145115

SEQ ID NO: 606353 - RNA, 64 nt, hsa; identical to SEQ ID NO: 145116

SEQ ID NO: 606354 - RNA, 64 nt, hsa; identical to SEQ ID NO: 145117

SEQ ID NO: 606355 - RNA, 64 nt, hsa; identical to SEQ ID NO: 145118

SEQ ID NO: 606356 - RNA, 64 nt, hsa; identical to SEQ ID NO: 145119

SEQ ID NO: 606357 - RNA, 64 nt, hsa; identical to SEQ ID NO: 145120

SEQ ID NO: 606358 - RNA, 64 nt, hsa; identical to SEQ ID NO: 145121

SEQ ID NO: 606359 - RNA, 64 nt, hsa; identical to SEQ ID NO: 145122

SEQ ID NO: 606360 - RNA, 64 nt, hsa; identical to SEQ ID NO: 145123

SEQ ID NO: 606361 - RNA, 64 nt, hsa; identical to SEQ ID NO: 145124

SEQ ID NO: 606362 - RNA, 64 nt, hsa; identical to SEQ ID NO: 145125

SEQ ID NO: 606363 - RNA, 64 nt, hsa; identical to SEQ ID NO: 145126

SEQ ID NO: 606364 - RNA, 64 nt, hsa
ugagagucagaggucacccgugauucugccugcaccuuaucauugaucugcagugauuucugca

SEQ ID NO: 606365 - RNA, 64 nt, hsa
uguagauacugagaggugguggcaguaauuguggccuuaucagccgcucaguuccaggcuuuug

SEQ ID NO: 606366 - RNA, 64 nt, hsa
ggggauauggggacgugacugggacagguuccugccuuaucauuuucucccuaggacauucccu

SEQ ID NO: 606367 - RNA, 64 nt, hsa
uagcccuuuucuacuuuccuccccuccucccaguccuuaucaaucuuuuuuccuuuuuccugac

SEQ ID NO: 606368 - RNA, 64 nt, hsa
gagucaacaaacuggcucuugauuuucagcacccuacucucaugaaaaaagccugaaaggaccc

SEQ ID NO: 606369 - RNA, 64 nt, hsa
uaaugauuauacaugucuauggauuaccuggacauacucucauuuggguuguucuucaaagaag

SEQ ID NO: 606370 - RNA, 64 nt, hsa
gucagcuggagugcugcuuaacaaguaucucuccuacucucaguggucagaggcuguguuggac

SEQ ID NO: 606371 - RNA, 64 nt, hsa
ggcuuucaguggucaugcuaccuacccauacucguacucucagaccuuuuauuaguagccuugc

SEQ ID NO: 606372 - RNA, 64 nt, hsa; identical to SEQ ID NO: 420116

SEQ ID NO: 606373 - RNA, 64 nt, hsa; identical to SEQ ID NO: 420117

SEQ ID NO: 606374 - RNA, 64 nt, hsa; identical to SEQ ID NO: 420118

SEQ ID NO: 606375 - RNA, 64 nt, hsa; identical to SEQ ID NO: 420119

SEQ ID NO: 606376 - RNA, 64 nt, hsa; identical to SEQ ID NO: 420120

SEQ ID NO: 606377 - RNA, 64 nt, hsa; identical to SEQ ID NO: 420121

SEQ ID NO: 606378 - RNA, 64 nt, hsa; identical to SEQ ID NO: 420122

SEQ ID NO: 606379 - RNA, 64 nt, hsa; identical to SEQ ID NO: 420123

SEQ ID NO: 606380 - RNA, 64 nt, hsa; identical to SEQ ID NO: 420124

SEQ ID NO: 606381 - RNA, 64 nt, hsa; identical to SEQ ID NO: 420125

SEQ ID NO: 606382 - RNA, 64 nt, hsa; identical to SEQ ID NO: 420126

SEQ ID NO: 606383 - RNA, 64 nt, hsa; identical to SEQ ID NO: 420127

SEQ ID NO: 606384 - RNA, 64 nt, hsa; identical to SEQ ID NO: 420128

SEQ ID NO: 606385 - RNA, 64 nt, hsa; identical to SEQ ID NO: 420129

SEQ ID NO: 606386 - RNA, 64 nt, hsa; identical to SEQ ID NO: 420130

SEQ ID NO: 606387 - RNA, 64 nt, hsa; identical to SEQ ID NO: 420131

SEQ ID NO: 606388 - RNA, 64 nt, hsa; identical to SEQ ID NO: 420132

SEQ ID NO: 606389 - RNA, 64 nt, hsa; identical to SEQ ID NO: 420133

SEQ ID NO: 606390 - RNA, 64 nt, hsa; identical to SEQ ID NO: 420134

SEQ ID NO: 606391 - RNA, 64 nt, hsa; identical to SEQ ID NO: 420135

SEQ ID NO: 606392 - RNA, 64 nt, hsa; identical to SEQ ID NO: 420136

SEQ ID NO: 606393 - RNA, 64 nt, hsa; identical to SEQ ID NO: 420137

SEQ ID NO: 606394 - RNA, 64 nt, hsa; identical to SEQ ID NO: 420138

SEQ ID NO: 606395 - RNA, 64 nt, hsa; identical to SEQ ID NO: 420139

SEQ ID NO: 606396 - RNA, 64 nt, hsa; identical to SEQ ID NO: 420140

SEQ ID NO: 606397 - RNA, 64 nt, hsa
uaugauucuauaucuagaaaaccccaugaucuuggcccaaaagcuccuagaucugauaaacaac

SEQ ID NO: 606398 - RNA, 64 nt, hsa
aaaagcauuaaaauuuauuugaaaccaaaaaagagcccaaaaagccaaagcaauccuaagcaaa

SEQ ID NO: 606399 - RNA, 64 nt, hsa; identical to SEQ ID NO: 100733

SEQ ID NO: 606400 - RNA, 64 nt, hsa; identical to SEQ ID NO: 100734

SEQ ID NO: 606401 - RNA, 64 nt, hsa; identical to SEQ ID NO: 100735

SEQ ID NO: 606402 - RNA, 64 nt, hsa; identical to SEQ ID NO: 100736

SEQ ID NO: 606403 - RNA, 64 nt, hsa; identical to SEQ ID NO: 100737

SEQ ID NO: 606404 - RNA, 64 nt, hsa; identical to SEQ ID NO: 100738

SEQ ID NO: 606405 - RNA, 64 nt, hsa; identical to SEQ ID NO: 100739

SEQ ID NO: 606406 - RNA, 64 nt, hsa; identical to SEQ ID NO: 100740

SEQ ID NO: 606407 - RNA, 64 nt, hsa; identical to SEQ ID NO: 100741

SEQ ID NO: 606408 - RNA, 64 nt, hsa; identical to SEQ ID NO: 100742

SEQ ID NO: 606409 - RNA, 64 nt, hsa; identical to SEQ ID NO: 100743

SEQ ID NO: 606410 - RNA, 64 nt, hsa; identical to SEQ ID NO: 100744

SEQ ID NO: 606411 - RNA, 64 nt, hsa; identical to SEQ ID NO: 100745

SEQ ID NO: 606412 - RNA, 64 nt, hsa; identical to SEQ ID NO: 100746

SEQ ID NO: 606413 - RNA, 64 nt, hsa; identical to SEQ ID NO: 100747

SEQ ID NO: 606414 - RNA, 64 nt, hsa; identical to SEQ ID NO: 100748

SEQ ID NO: 606415 - RNA, 64 nt, hsa; identical to SEQ ID NO: 100749

SEQ ID NO: 606416 - RNA, 64 nt, hsa; identical to SEQ ID NO: 100750

SEQ ID NO: 606417 - RNA, 64 nt, hsa; identical to SEQ ID NO: 100751

SEQ ID NO: 606418 - RNA, 64 nt, hsa; identical to SEQ ID NO: 100752

SEQ ID NO: 606419 - RNA, 64 nt, hsa; identical to SEQ ID NO: 100753

SEQ ID NO: 606420 - RNA, 64 nt, hsa; identical to SEQ ID NO: 100754

SEQ ID NO: 606421 - RNA, 64 nt, hsa; identical to SEQ ID NO: 100755

SEQ ID NO: 606422 - RNA, 64 nt, hsa; identical to SEQ ID NO: 100756

SEQ ID NO: 606423 - RNA, 64 nt, hsa; identical to SEQ ID NO: 100757

SEQ ID NO: 606424 - RNA, 64 nt, hsa; identical to SEQ ID NO: 100758

SEQ ID NO: 606425 - RNA, 64 nt, hsa; identical to SEQ ID NO: 100759

SEQ ID NO: 606426 - RNA, 64 nt, hsa; identical to SEQ ID NO: 100760

SEQ ID NO: 606427 - RNA, 64 nt, hsa; identical to SEQ ID NO: 100761

SEQ ID NO: 606428 - RNA, 64 nt, hsa; identical to SEQ ID NO: 100762

SEQ ID NO: 606429 - RNA, 64 nt, hsa; identical to SEQ ID NO: 100763

SEQ ID NO: 606430 - RNA, 64 nt, hsa; identical to SEQ ID NO: 100764

SEQ ID NO: 606431 - RNA, 64 nt, hsa; identical to SEQ ID NO: 100765

SEQ ID NO: 606432 - RNA, 64 nt, hsa; identical to SEQ ID NO: 100766

SEQ ID NO: 606433 - RNA, 64 nt, hsa; identical to SEQ ID NO: 100767

SEQ ID NO: 606434 - RNA, 64 nt, hsa; identical to SEQ ID NO: 100768

SEQ ID NO: 606435 - RNA, 64 nt, hsa; identical to SEQ ID NO: 100769

SEQ ID NO: 606436 - RNA, 64 nt, hsa; identical to SEQ ID NO: 100770

SEQ ID NO: 606437 - RNA, 64 nt, hsa; identical to SEQ ID NO: 100771

SEQ ID NO: 606438 - RNA, 64 nt, hsa; identical to SEQ ID NO: 100772

SEQ ID NO: 606439 - RNA, 64 nt, hsa; identical to SEQ ID NO: 100773

SEQ ID NO: 606440 - RNA, 64 nt, hsa; identical to SEQ ID NO: 100774

SEQ ID NO: 606441 - RNA, 64 nt, hsa; identical to SEQ ID NO: 100775

SEQ ID NO: 606442 - RNA, 64 nt, hsa; identical to SEQ ID NO: 100776

SEQ ID NO: 606443 - RNA, 64 nt, hsa; identical to SEQ ID NO: 100777

SEQ ID NO: 606444 - RNA, 64 nt, hsa
cccugucaaaccucagaacuugaggcugaaacauugcuuccacccaccaucagugaagauguaa

SEQ ID NO: 606445 - RNA, 64 nt, hsa
accugcuugggaagaaacuccaagaagauuggaaugcuuccaaagcaagaaucuuucucaguga

SEQ ID NO: 606446 - RNA, 64 nt, hsa
cuagaucugaaauucagaguguagcucugagacuugcuuccaaagucauuucccaccacaugca

SEQ ID NO: 606447 - RNA, 64 nt, hsa
ccccaaaggaguucuugaucuggacgauggauauugcuuccaaugaaagguuugcccccaaaac

SEQ ID NO: 606448 - RNA, 64 nt, hsa
ugggaucuccaagucccaguuugagugugggaugugcuuccagcagugccuucccuuuaugaaa

SEQ ID NO: 606449 - RNA, 64 nt, hsa
gggaccauguaacugaggugaggguuguaguagaugcuuccagugucaguaugccuguuaauuu

SEQ ID NO: 606450 - RNA, 64 nt, hsa
agaaaauugucucguuuauuuuaaauagaaucuaugcuuccaccaauaaaccaucgggagcuaa

SEQ ID NO: 606451 - RNA, 64 nt, hsa
gacuucaaaggcaaaguucauuucuuccauuaacugcuuccagagaugucauguaaaaaaguua

SEQ ID NO: 606452 - RNA, 64 nt, hsa
ccuuaugagcuugcuguauuucuugguaucauguugcuuccaaauuuuguuuuuacuguagaag

SEQ ID NO: 606453 - RNA, 64 nt, hsa
uuagggcauaggacagauuccccaaauugcuuuaugcuuccacauaacuagagcacuucaaucu

SEQ ID NO: 606454 - RNA, 64 nt, hsa
cugcuucuacuacccaaaauaugaauuccaacacugcuuccaagagacauuuacauaaaauugc

SEQ ID NO: 606455 - RNA, 64 nt, hsa
ccaacacugcuuccaagagacauuuacauaaaauugcuuccauuuuuggaugagaaugaaaaau

SEQ ID NO: 606456 - RNA, 64 nt, hsa
gugcaggugacuaugccuccucuucugcacagaaugcuuccaccagcauccugagaagaaauga

SEQ ID NO: 606457 - RNA, 64 nt, hsa
caucaggauggaaacagucaggcacugacuggggugcuuccaagaggcaugagagugccuacuc

SEQ ID NO: 606458 - RNA, 64 nt, hsa
uuuaucagccucugcaaggagcuuugucccaucgugcuuccauucccaggagggggagcuugga

SEQ ID NO: 606459 - RNA, 64 nt, hsa
uuucccauauuuaucucaucugguuagcugccucugcuuccagcuuuguguaauucucuuugcc

SEQ ID NO: 606460 - RNA, 64 nt, hsa
uuugcuuuuuuauuuaccuuuuaagacauuuucaugcuuccagguaaaaacagauauuguacca

SEQ ID NO: 606461 - RNA, 64 nt, hsa
gccagagucauaauauuuucuuaugugggucuuaugcuuccauuaacaaaugcucugucuucaa

SEQ ID NO: 606462 - RNA, 64 nt, hsa
ucaugacauuggguagcauuaacuguaaguuuugugcuuccaaaucacuuuuugguuuuuaaga

SEQ ID NO: 606463 - RNA, 64 nt, hsa
guacauuguggcuucaaaagggccaguguaaaacugcuuccaugucuaagcaaagaaaacugcc

SEQ ID NO: 606464 - RNA, 64 nt, hsa
acuuuaaaaucaacuuauaacugugagauguuauugcuuccauuuuauuagaagagaaacaaau

SEQ ID NO: 606465 - RNA, 64 nt, hsa
aucuaggaacauuacaaagcaaagacuauuuuuaugcuuccauaaccuagaauuaaaaccaaau

SEQ ID NO: 606466 - RNA, 64 nt, hsa
ucuguuccuaugggugcuauucaucuggaaggccugcuuccaggccucuuugcugucagcccuu

SEQ ID NO: 606467 - RNA, 64 nt, hsa
auucaaaauguuuagucuucucacuaauugagucugcuuccacguccucucccaggaacauucu

SEQ ID NO: 606468 - RNA, 64 nt, hsa
ccucuguccacucccugcagagccaauauagucgugcuuccaccucguaggcauuguccugcag

SEQ ID NO: 606469 - RNA, 64 nt, hsa
uagacagaucuuucucuuugucugccuugaauauugcuuccauguauuuuggaaaagaaaauga

SEQ ID NO: 606470 - RNA, 64 nt, hsa
gagcacaccuaguugguuucauguauguuacacaugcuuccacuccacaguaccuaauuucucu

SEQ ID NO: 606471 - RNA, 64 nt, hsa
cuguuccuacgcccauuucacccucauuaccuucugcuuccaaggaauaugacagaucaccagg

SEQ ID NO: 606472 - RNA, 64 nt, hsa
cacguugccgaguggaagaaccaugaccuccacuugcuuccaaggugcuagggaaguuucaggg

SEQ ID NO: 606473 - RNA, 64 nt, hsa
ugucaaauuacgaaaacuucagggugaaauccuaugcuuccauguacauuacauggcuuaagau

SEQ ID NO: 606474 - RNA, 64 nt, hsa
cuugaucccugagguguuuccaugcugcggguggugcuuccaggcagagugggugggggcccac

SEQ ID NO: 606475 - RNA, 64 nt, hsa
aggugaaacuggggucccuuggggcgccccacgcugcuuccacacccaccaccucuggccuugg

SEQ ID NO: 606476 - RNA, 64 nt, hsa
ccccauuugagugcucuccggggaugccaaaugcugcuuccaaguuugaguccauguggcuaaa

SEQ ID NO: 606477 - RNA, 64 nt, hsa
agcagacggccccgaucccgccagaacggccuuuugcuuccagccaaagaacaccgccaacacg

SEQ ID NO: 606478 - RNA, 64 nt, hsa
gauuaagaaaagaaccaauagugacaaaaaucagugcuuccaguagauuuuagaacauucuuug

SEQ ID NO: 606479 - RNA, 64 nt, hsa
acuuuuuauuaugaccauuagaaacuauuuugaaugcuuccaacuggcucaauuggccgggaaa

SEQ ID NO: 606480 - RNA, 64 nt, hsa; identical to SEQ ID NO: 251941

SEQ ID NO: 606481 - RNA, 64 nt, hsa; identical to SEQ ID NO: 251942

SEQ ID NO: 606482 - RNA, 64 nt, hsa; identical to SEQ ID NO: 93186

SEQ ID NO: 606483 - RNA, 64 nt, hsa; identical to SEQ ID NO: 93187

SEQ ID NO: 606484 - RNA, 64 nt, hsa; identical to SEQ ID NO: 93188

SEQ ID NO: 606485 - RNA, 64 nt, hsa; identical to SEQ ID NO: 93189

SEQ ID NO: 606486 - RNA, 64 nt, hsa; identical to SEQ ID NO: 93190

SEQ ID NO: 606487 - RNA, 64 nt, hsa; identical to SEQ ID NO: 93191

SEQ ID NO: 606488 - RNA, 64 nt, hsa; identical to SEQ ID NO: 93192

SEQ ID NO: 606489 - RNA, 64 nt, hsa; identical to SEQ ID NO: 93193

SEQ ID NO: 606490 - RNA, 64 nt, hsa; identical to SEQ ID NO: 93194

SEQ ID NO: 606491 - RNA, 64 nt, hsa; identical to SEQ ID NO: 93195

SEQ ID NO: 606492 - RNA, 64 nt, hsa; identical to SEQ ID NO: 93196

SEQ ID NO: 606493 - RNA, 64 nt, hsa; identical to SEQ ID NO: 93197

SEQ ID NO: 606494 - RNA, 64 nt, hsa; identical to SEQ ID NO: 93198

SEQ ID NO: 606495 - RNA, 64 nt, hsa; identical to SEQ ID NO: 93199

SEQ ID NO: 606496 - RNA, 64 nt, hsa
ugaauuaagacaaagaacaggugccauagaaguagauuucuaggaaugaaguggggcagaucuu

SEQ ID NO: 606497 - RNA, 64 nt, hsa
ccauuuccucauguugcugaccaggugcccauaugauuucuacacuucccaagccuuacccugg

SEQ ID NO: 606498 - RNA, 64 nt, hsa
aaauaacuuccugauuggaguguguaagcugagcgauuucuaauaaaauuuuaguuguacacuu

SEQ ID NO: 606499 - RNA, 64 nt, hsa
uguaucacauggauuauaaagcaaaguuauggucgauuucuauucuugaaagaaucaacuacag

SEQ ID NO: 606500 - RNA, 64 nt, hsa
uuaaaggacuacagagcuguauggaaugaaaggugauuucuaguucagaguggauagaagaacu

SEQ ID NO: 606501 - RNA, 64 nt, hsa
uucccaggaccucuggucuggcuccuccuacuuggauuucuagcugugucuaagaaccuauuca

SEQ ID NO: 606502 - RNA, 64 nt, hsa
gugaggaaaugcuacuaauaucugaaaagugaaagauuucuauguauuaacucuuaagugcacc

SEQ ID NO: 606503 - RNA, 64 nt, hsa
accuccccacaacagaauucugcccaacacaggagauuucuauaguuauuguuuucugucauuu

SEQ ID NO: 606504 - RNA, 64 nt, hsa
agauuucaguuuacauaucgacagcauauccacugauuucuaaaugggcuggucccaucaucug

SEQ ID NO: 606505 - RNA, 64 nt, hsa
auauuccuuuaugcugcaaguggugacauguucagauuucuaauuugguucauuguggccuauc

SEQ ID NO: 606506 - RNA, 64 nt, hsa
aagucagagguaaaccggucaguuacagaagcaggauuucuaggauuucuaacuccagcuguuc

SEQ ID NO: 606507 - RNA, 64 nt, hsa
guaaaccggucaguuacagaagcaggauuucuaggauuucuaacuccagcuguucccauacugu

SEQ ID NO: 606508 - RNA, 64 nt, hsa
gucugccgaagaggacuagggggcgccaacguucgauuucuaccucagcagcaguuggaucuuu

SEQ ID NO: 606509 - RNA, 64 nt, hsa
aauuuuuaaaauacuuguuucagcuucucugcuagauuucuacauuaacuugaaaauuuuuuaa

SEQ ID NO: 606510 - RNA, 64 nt, hsa
caauguaacucuggccucaaucauauuccucugggauuucuaaacagcaguuaagcuacaaaaa

SEQ ID NO: 606511 - RNA, 64 nt, hsa
augccuuccaucugaauguaaaauaaguacccaugauuucuauuauaguaucaguguaauuauu

SEQ ID NO: 606512 - RNA, 64 nt, hsa
uagggagauauguaugugugcucccugggguggggauuucuaguuacuagaccaucuccauuuu

SEQ ID NO: 606513 - RNA, 64 nt, hsa
uagaccaaauaaugcggcuaguuaacagugguacgauuucuagcccguggcuuuaaaaugcacu

SEQ ID NO: 606514 - RNA, 64 nt, hsa
gagccuacagaccuguccucaccaacuguuuugugauuucuacucaacuacaaagauuuauuua

SEQ ID NO: 606515 - RNA, 64 nt, hsa
gggugcagaggccugagguuucuaaaagaagguagauuucuacagagcugaguguugguuccuu

SEQ ID NO: 606516 - RNA, 64 nt, hsa
auauacucagaaaugguggugcuggaucauauaggauuucuauuuuuuuuuuuuguuuguuuuu

SEQ ID NO: 606517 - RNA, 64 nt, hsa
gggauuacgggcgugagccaccgcgccuggccaggauuucuauuuuuaauauuuuugggaaaau

SEQ ID NO: 606518 - RNA, 64 nt, hsa
caaauaucuaugugcuuggagccacaguuuccuaagcgcauaguuuuugguccugccucaugua

SEQ ID NO: 606519 - RNA, 64 nt, hsa
ugaugugaauuugcauuuguuacauuacauugccagcgcauaucauuuagcaaguuggcauuaa

SEQ ID NO: 606520 - RNA, 54 nt, hsa
cucgggcagcagggcccuaguagcagcgcauacaggagcuggggaagggggccu

SEQ ID NO: 606521 - RNA, 64 nt, hsa
agcccauaacugauagaugcauuagaagucagccagcgcauaggugcucccucuauauuaugga

SEQ ID NO: 606522 - RNA, 64 nt, hsa
auagacuuaauaauucauuucuuuuggacuauggagcgcauaucuguuccuucuuuaugaugcc

SEQ ID NO: 606523 - RNA, 64 nt, hsa
cacucauaacuuuccaaaugaaaccccacaguauagcgcauauuuucgauauuuuugugaauuc

SEQ ID NO: 606524 - RNA, 64 nt, hsa
uguccaccucuucuccccugcccaccagcugcucagcgcauaagaccuucccgacaggcucugc

SEQ ID NO: 606525 - RNA, 64 nt, hsa
augagagaaucaaauaauagauguccguacaaguagcgcauauauuuaaccauuuaguuugggg

SEQ ID NO: 606526 - RNA, 64 nt, hsa
gccaccacaagacuaaguaaagaccgaguugaaaagcgcauaaaaacaaaggcucuuuucagag

SEQ ID NO: 606527 - RNA, 64 nt, hsa
gaggcuucccaggccauuuaaagccuggaguaccagcgcauaucaucucaugggguccagagug

SEQ ID NO: 606528 - RNA, 64 nt, hsa
aucaaauuggauaaaacaauguuuucuuucugguagcgcauaauaacagagcacaagcaucuuu

SEQ ID NO: 606529 - RNA, 64 nt, hsa
uggauggauggaauauaauugagucaucugguagagcgcauauaggacaggacgcuagguuguu

SEQ ID NO: 606530 - RNA, 64 nt, hsa
gacuguaccuuagcaaguugcucccucuccagggagcgcauagauacagcagagcucacaguga

SEQ ID NO: 606531 - RNA, 64 nt, hsa
guucugaaguuucacagcuuggcuucagccuaucagcgcauacauuggcaugaauuuugugaau

SEQ ID NO: 606532 - RNA, 64 nt, hsa
ugacuggaagggguuuuuguauaacuaaaaccucagcgcauaaaggagauuuaaaaggagcaca

SEQ ID NO: 606533 - RNA, 64 nt, hsa
ucacggcagccaggagaccccaggugaguuucugagcgcauacguaguugguucuuacccccag

SEQ ID NO: 606534 - RNA, 64 nt, hsa
cagccgggccuucuucucucugggacccuccgccagcgcauagccgcaggccggugugacuucu

SEQ ID NO: 606535 - RNA, 64 nt, hsa
gggccuuagguuugacauggagguggaggaagauagcgcauauauuugcaguaugaacuauugc

SEQ ID NO: 606536 - RNA, 64 nt, hsa
agaccaguggggauuuguaagacuuagaugagauagcgcauaauaaggggaagacuuuaaagua

SEQ ID NO: 606537 - RNA, 64 nt, hsa
ucaccgugugugucccagcugccccaucuuccccagcgcauaccuguuccucuucucauucucu

SEQ ID NO: 606538 - RNA, 64 nt, hsa; identical to SEQ ID NO: 281120

SEQ ID NO: 606539 - RNA, 64 nt, hsa; identical to SEQ ID NO: 281120

SEQ ID NO: 606540 - RNA, 64 nt, hsa; identical to SEQ ID NO: 281122

SEQ ID NO: 606541 - RNA, 64 nt, hsa; identical to SEQ ID NO: 281123

SEQ ID NO: 606542 - RNA, 64 nt, hsa; identical to SEQ ID NO: 281124

SEQ ID NO: 606543 - RNA, 64 nt, hsa; identical to SEQ ID NO: 281125

SEQ ID NO: 606544 - RNA, 64 nt, hsa; identical to SEQ ID NO: 281126

SEQ ID NO: 606545 - RNA, 64 nt, hsa; identical to SEQ ID NO: 281127

SEQ ID NO: 606546 - RNA, 64 nt, hsa; identical to SEQ ID NO: 281128

SEQ ID NO: 606547 - RNA, 64 nt, hsa; identical to SEQ ID NO: 281129

SEQ ID NO: 606548 - RNA, 64 nt, hsa; identical to SEQ ID NO: 281130

SEQ ID NO: 606549 - RNA, 64 nt, hsa; identical to SEQ ID NO: 281131

SEQ ID NO: 606550 - RNA, 64 nt, hsa; identical to SEQ ID NO: 606518

SEQ ID NO: 606551 - RNA, 64 nt, hsa; identical to SEQ ID NO: 606519

SEQ ID NO: 606552 - RNA, 54 nt, hsa; identical to SEQ ID NO: 606520

SEQ ID NO: 606553 - RNA, 64 nt, hsa; identical to SEQ ID NO: 606521

SEQ ID NO: 606554 - RNA, 64 nt, hsa; identical to SEQ ID NO: 606522

SEQ ID NO: 606555 - RNA, 64 nt, hsa; identical to SEQ ID NO: 606523

SEQ ID NO: 606556 - RNA, 64 nt, hsa; identical to SEQ ID NO: 606524

SEQ ID NO: 606557 - RNA, 64 nt, hsa; identical to SEQ ID NO: 606525

SEQ ID NO: 606558 - RNA, 64 nt, hsa; identical to SEQ ID NO: 606526

SEQ ID NO: 606559 - RNA, 64 nt, hsa; identical to SEQ ID NO: 606527

SEQ ID NO: 606560 - RNA, 64 nt, hsa; identical to SEQ ID NO: 606528

SEQ ID NO: 606561 - RNA, 64 nt, hsa; identical to SEQ ID NO: 606529

SEQ ID NO: 606562 - RNA, 64 nt, hsa; identical to SEQ ID NO: 606530

SEQ ID NO: 606563 - RNA, 64 nt, hsa; identical to SEQ ID NO: 606531

SEQ ID NO: 606564 - RNA, 64 nt, hsa; identical to SEQ ID NO: 606532

SEQ ID NO: 606565 - RNA, 64 nt, hsa; identical to SEQ ID NO: 606533

SEQ ID NO: 606566 - RNA, 64 nt, hsa; identical to SEQ ID NO: 606534

SEQ ID NO: 606567 - RNA, 64 nt, hsa; identical to SEQ ID NO: 606535

SEQ ID NO: 606568 - RNA, 64 nt, hsa; identical to SEQ ID NO: 606536

SEQ ID NO: 606569 - RNA, 64 nt, hsa; identical to SEQ ID NO: 606537

SEQ ID NO: 606570 - RNA, 64 nt, hsa; identical to SEQ ID NO: 281120

SEQ ID NO: 606571 - RNA, 64 nt, hsa; identical to SEQ ID NO: 281120

SEQ ID NO: 606572 - RNA, 64 nt, hsa; identical to SEQ ID NO: 281122

SEQ ID NO: 606573 - RNA, 64 nt, hsa; identical to SEQ ID NO: 281123

SEQ ID NO: 606574 - RNA, 64 nt, hsa; identical to SEQ ID NO: 281124

SEQ ID NO: 606575 - RNA, 64 nt, hsa; identical to SEQ ID NO: 281125

SEQ ID NO: 606576 - RNA, 64 nt, hsa; identical to SEQ ID NO: 281126

SEQ ID NO: 606577 - RNA, 64 nt, hsa; identical to SEQ ID NO: 281127

SEQ ID NO: 606578 - RNA, 64 nt, hsa; identical to SEQ ID NO: 281128

SEQ ID NO: 606579 - RNA, 64 nt, hsa; identical to SEQ ID NO: 281129

SEQ ID NO: 606580 - RNA, 64 nt, hsa; identical to SEQ ID NO: 281130

SEQ ID NO: 606581 - RNA, 64 nt, hsa; identical to SEQ ID NO: 281131

SEQ ID NO: 606582 - RNA, 64 nt, hsa; identical to SEQ ID NO: 606518

SEQ ID NO: 606583 - RNA, 64 nt, hsa; identical to SEQ ID NO: 606519

SEQ ID NO: 606584 - RNA, 54 nt, hsa; identical to SEQ ID NO: 606520

SEQ ID NO: 606585 - RNA, 64 nt, hsa; identical to SEQ ID NO: 606521

SEQ ID NO: 606586 - RNA, 64 nt, hsa; identical to SEQ ID NO: 606522

SEQ ID NO: 606587 - RNA, 64 nt, hsa; identical to SEQ ID NO: 606523

SEQ ID NO: 606588 - RNA, 64 nt, hsa; identical to SEQ ID NO: 606524

SEQ ID NO: 606589 - RNA, 64 nt, hsa; identical to SEQ ID NO: 606525

SEQ ID NO: 606590 - RNA, 64 nt, hsa; identical to SEQ ID NO: 606526

SEQ ID NO: 606591 - RNA, 64 nt, hsa; identical to SEQ ID NO: 606527

SEQ ID NO: 606592 - RNA, 64 nt, hsa; identical to SEQ ID NO: 606528

SEQ ID NO: 606593 - RNA, 64 nt, hsa; identical to SEQ ID NO: 606529

SEQ ID NO: 606594 - RNA, 64 nt, hsa; identical to SEQ ID NO: 606530

SEQ ID NO: 606595 - RNA, 64 nt, hsa; identical to SEQ ID NO: 606531

SEQ ID NO: 606596 - RNA, 64 nt, hsa; identical to SEQ ID NO: 606532

SEQ ID NO: 606597 - RNA, 64 nt, hsa; identical to SEQ ID NO: 606533

SEQ ID NO: 606598 - RNA, 64 nt, hsa; identical to SEQ ID NO: 606534

SEQ ID NO: 606599 - RNA, 64 nt, hsa; identical to SEQ ID NO: 606535

SEQ ID NO: 606600 - RNA, 64 nt, hsa; identical to SEQ ID NO: 606536

SEQ ID NO: 606601 - RNA, 64 nt, hsa; identical to SEQ ID NO: 606537

SEQ ID NO: 606602 - RNA, 64 nt, hsa; identical to SEQ ID NO: 281120

SEQ ID NO: 606603 - RNA, 64 nt, hsa; identical to SEQ ID NO: 281120

SEQ ID NO: 606604 - RNA, 64 nt, hsa; identical to SEQ ID NO: 281122

SEQ ID NO: 606605 - RNA, 64 nt, hsa; identical to SEQ ID NO: 281123

SEQ ID NO: 606606 - RNA, 64 nt, hsa; identical to SEQ ID NO: 281124

SEQ ID NO: 606607 - RNA, 64 nt, hsa; identical to SEQ ID NO: 281125

SEQ ID NO: 606608 - RNA, 64 nt, hsa; identical to SEQ ID NO: 281126

SEQ ID NO: 606609 - RNA, 64 nt, hsa; identical to SEQ ID NO: 281127

SEQ ID NO: 606610 - RNA, 64 nt, hsa; identical to SEQ ID NO: 281128

SEQ ID NO: 606611 - RNA, 64 nt, hsa; identical to SEQ ID NO: 281129

SEQ ID NO: 606612 - RNA, 64 nt, hsa; identical to SEQ ID NO: 281130

SEQ ID NO: 606613 - RNA, 64 nt, hsa; identical to SEQ ID NO: 281131

SEQ ID NO: 606614 - RNA, 64 nt, hsa; identical to SEQ ID NO: 606518

SEQ ID NO: 606615 - RNA, 64 nt, hsa; identical to SEQ ID NO: 606519

SEQ ID NO: 606616 - RNA, 54 nt, hsa; identical to SEQ ID NO: 606520

SEQ ID NO: 606617 - RNA, 64 nt, hsa; identical to SEQ ID NO: 606521

SEQ ID NO: 606618 - RNA, 64 nt, hsa; identical to SEQ ID NO: 606522

SEQ ID NO: 606619 - RNA, 64 nt, hsa; identical to SEQ ID NO: 606523

SEQ ID NO: 606620 - RNA, 64 nt, hsa; identical to SEQ ID NO: 606524

SEQ ID NO: 606621 - RNA, 64 nt, hsa; identical to SEQ ID NO: 606525

SEQ ID NO: 606622 - RNA, 64 nt, hsa; identical to SEQ ID NO: 606526

SEQ ID NO: 606623 - RNA, 64 nt, hsa; identical to SEQ ID NO: 606527

SEQ ID NO: 606624 - RNA, 64 nt, hsa; identical to SEQ ID NO: 606528

SEQ ID NO: 606625 - RNA, 64 nt, hsa; identical to SEQ ID NO: 606529

SEQ ID NO: 606626 - RNA, 64 nt, hsa; identical to SEQ ID NO: 606530

SEQ ID NO: 606627 - RNA, 64 nt, hsa; identical to SEQ ID NO: 606531

SEQ ID NO: 606628 - RNA, 64 nt, hsa; identical to SEQ ID NO: 606532

SEQ ID NO: 606629 - RNA, 64 nt, hsa; identical to SEQ ID NO: 606533

SEQ ID NO: 606630 - RNA, 64 nt, hsa; identical to SEQ ID NO: 606534

SEQ ID NO: 606631 - RNA, 64 nt, hsa; identical to SEQ ID NO: 606535

SEQ ID NO: 606632 - RNA, 64 nt, hsa; identical to SEQ ID NO: 606536

SEQ ID NO: 606633 - RNA, 64 nt, hsa; identical to SEQ ID NO: 606537

SEQ ID NO: 606634 - RNA, 64 nt, hsa; identical to SEQ ID NO: 281120

SEQ ID NO: 606635 - RNA, 64 nt, hsa; identical to SEQ ID NO: 281120

SEQ ID NO: 606636 - RNA, 64 nt, hsa; identical to SEQ ID NO: 281122

SEQ ID NO: 606637 - RNA, 64 nt, hsa; identical to SEQ ID NO: 281123

SEQ ID NO: 606638 - RNA, 64 nt, hsa; identical to SEQ ID NO: 281124

SEQ ID NO: 606639 - RNA, 64 nt, hsa; identical to SEQ ID NO: 281125

SEQ ID NO: 606640 - RNA, 64 nt, hsa; identical to SEQ ID NO: 281126

SEQ ID NO: 606641 - RNA, 64 nt, hsa; identical to SEQ ID NO: 281127

SEQ ID NO: 606642 - RNA, 64 nt, hsa; identical to SEQ ID NO: 281128

SEQ ID NO: 606643 - RNA, 64 nt, hsa; identical to SEQ ID NO: 281129

SEQ ID NO: 606644 - RNA, 64 nt, hsa; identical to SEQ ID NO: 281130

SEQ ID NO: 606645 - RNA, 64 nt, hsa; identical to SEQ ID NO: 281131

SEQ ID NO: 606646 - RNA, 64 nt, hsa; identical to SEQ ID NO: 215308

SEQ ID NO: 606647 - RNA, 64 nt, hsa; identical to SEQ ID NO: 215309

SEQ ID NO: 606648 - RNA, 64 nt, hsa; identical to SEQ ID NO: 215310

SEQ ID NO: 606649 - RNA, 64 nt, hsa; identical to SEQ ID NO: 215311

SEQ ID NO: 606650 - RNA, 64 nt, hsa; identical to SEQ ID NO: 215312

SEQ ID NO: 606651 - RNA, 64 nt, hsa; identical to SEQ ID NO: 215313

SEQ ID NO: 606652 - RNA, 64 nt, hsa; identical to SEQ ID NO: 215314

SEQ ID NO: 606653 - RNA, 64 nt, hsa; identical to SEQ ID NO: 215315

SEQ ID NO: 606654 - RNA, 64 nt, hsa; identical to SEQ ID NO: 215316

SEQ ID NO: 606655 - RNA, 64 nt, hsa; identical to SEQ ID NO: 215317

SEQ ID NO: 606656 - RNA, 64 nt, hsa; identical to SEQ ID NO: 215318

SEQ ID NO: 606657 - RNA, 64 nt, hsa; identical to SEQ ID NO: 215319

SEQ ID NO: 606658 - RNA, 64 nt, hsa; identical to SEQ ID NO: 215320

SEQ ID NO: 606659 - RNA, 64 nt, hsa; identical to SEQ ID NO: 215321

SEQ ID NO: 606660 - RNA, 64 nt, hsa; identical to SEQ ID NO: 215322

SEQ ID NO: 606661 - RNA, 64 nt, hsa; identical to SEQ ID NO: 215323

SEQ ID NO: 606662 - RNA, 64 nt, hsa; identical to SEQ ID NO: 215324

SEQ ID NO: 606663 - RNA, 58 nt, hsa; identical to SEQ ID NO: 215325

SEQ ID NO: 606664 - RNA, 64 nt, hsa; identical to SEQ ID NO: 215326

SEQ ID NO: 606665 - RNA, 64 nt, hsa; identical to SEQ ID NO: 215327

SEQ ID NO: 606666 - RNA, 64 nt, hsa; identical to SEQ ID NO: 531886

SEQ ID NO: 606667 - RNA, 64 nt, hsa; identical to SEQ ID NO: 531887

SEQ ID NO: 606668 - RNA, 64 nt, hsa; identical to SEQ ID NO: 531888

SEQ ID NO: 606669 - RNA, 64 nt, hsa; identical to SEQ ID NO: 531889

SEQ ID NO: 606670 - RNA, 64 nt, hsa; identical to SEQ ID NO: 531890

SEQ ID NO: 606671 - RNA, 64 nt, hsa; identical to SEQ ID NO: 531891

SEQ ID NO: 606672 - RNA, 64 nt, hsa; identical to SEQ ID NO: 531892

SEQ ID NO: 606673 - RNA, 64 nt, hsa; identical to SEQ ID NO: 531893

SEQ ID NO: 606674 - RNA, 64 nt, hsa; identical to SEQ ID NO: 531894

SEQ ID NO: 606675 - RNA, 64 nt, hsa; identical to SEQ ID NO: 531895

SEQ ID NO: 606676 - RNA, 64 nt, hsa; identical to SEQ ID NO: 531896

SEQ ID NO: 606677 - RNA, 64 nt, hsa; identical to SEQ ID NO: 531897

SEQ ID NO: 606678 - RNA, 64 nt, hsa; identical to SEQ ID NO: 531898

SEQ ID NO: 606679 - RNA, 64 nt, hsa; identical to SEQ ID NO: 531899

SEQ ID NO: 606680 - RNA, 64 nt, hsa; identical to SEQ ID NO: 531900

SEQ ID NO: 606681 - RNA, 64 nt, hsa; identical to SEQ ID NO: 531901

SEQ ID NO: 606682 - RNA, 64 nt, hsa; identical to SEQ ID NO: 531902

SEQ ID NO: 606683 - RNA, 64 nt, hsa; identical to SEQ ID NO: 531903

SEQ ID NO: 606684 - RNA, 64 nt, hsa; identical to SEQ ID NO: 531904

SEQ ID NO: 606685 - RNA, 64 nt, hsa; identical to SEQ ID NO: 531905

SEQ ID NO: 606686 - RNA, 64 nt, hsa; identical to SEQ ID NO: 531906

SEQ ID NO: 606687 - RNA, 64 nt, hsa; identical to SEQ ID NO: 531907

SEQ ID NO: 606688 - RNA, 64 nt, hsa; identical to SEQ ID NO: 531908

SEQ ID NO: 606689 - RNA, 64 nt, hsa; identical to SEQ ID NO: 531909

SEQ ID NO: 606690 - RNA, 64 nt, hsa; identical to SEQ ID NO: 531910

SEQ ID NO: 606691 - RNA, 64 nt, hsa; identical to SEQ ID NO: 531911

SEQ ID NO: 606692 - RNA, 64 nt, hsa; identical to SEQ ID NO: 531912

SEQ ID NO: 606693 - RNA, 64 nt, hsa; identical to SEQ ID NO: 531913

SEQ ID NO: 606694 - RNA, 64 nt, hsa; identical to SEQ ID NO: 531914

SEQ ID NO: 606695 - RNA, 64 nt, hsa; identical to SEQ ID NO: 531915

SEQ ID NO: 606696 - RNA, 64 nt, hsa; identical to SEQ ID NO: 531916

SEQ ID NO: 606697 - RNA, 64 nt, hsa; identical to SEQ ID NO: 531917

SEQ ID NO: 606698 - RNA, 64 nt, hsa; identical to SEQ ID NO: 531918

SEQ ID NO: 606699 - RNA, 64 nt, hsa; identical to SEQ ID NO: 531919

SEQ ID NO: 606700 - RNA, 64 nt, hsa; identical to SEQ ID NO: 531920

SEQ ID NO: 606701 - RNA, 64 nt, hsa; identical to SEQ ID NO: 531921

SEQ ID NO: 606702 - RNA, 64 nt, hsa; identical to SEQ ID NO: 531922

SEQ ID NO: 606703 - RNA, 64 nt, hsa; identical to SEQ ID NO: 307734

SEQ ID NO: 606704 - RNA, 64 nt, hsa; identical to SEQ ID NO: 307735

SEQ ID NO: 606705 - RNA, 64 nt, hsa; identical to SEQ ID NO: 307736

SEQ ID NO: 606706 - RNA, 64 nt, hsa; identical to SEQ ID NO: 307737

SEQ ID NO: 606707 - RNA, 64 nt, hsa; identical to SEQ ID NO: 307738

SEQ ID NO: 606708 - RNA, 64 nt, hsa; identical to SEQ ID NO: 307739

SEQ ID NO: 606709 - RNA, 64 nt, hsa; identical to SEQ ID NO: 307740

SEQ ID NO: 606710 - RNA, 64 nt, hsa; identical to SEQ ID NO: 307741

SEQ ID NO: 606711 - RNA, 59 nt, hsa; identical to SEQ ID NO: 307742

SEQ ID NO: 606712 - RNA, 64 nt, hsa; identical to SEQ ID NO: 307743

SEQ ID NO: 606713 - RNA, 64 nt, hsa; identical to SEQ ID NO: 307744

SEQ ID NO: 606714 - RNA, 64 nt, hsa; identical to SEQ ID NO: 307745

SEQ ID NO: 606715 - RNA, 64 nt, hsa; identical to SEQ ID NO: 307746

SEQ ID NO: 606716 - RNA, 64 nt, hsa; identical to SEQ ID NO: 307747

SEQ ID NO: 606717 - RNA, 64 nt, hsa; identical to SEQ ID NO: 307748

SEQ ID NO: 606718 - RNA, 64 nt, hsa; identical to SEQ ID NO: 307749

SEQ ID NO: 606719 - RNA, 64 nt, hsa; identical to SEQ ID NO: 307750

SEQ ID NO: 606720 - RNA, 64 nt, hsa; identical to SEQ ID NO: 307751

SEQ ID NO: 606721 - RNA, 64 nt, hsa; identical to SEQ ID NO: 307752

SEQ ID NO: 606722 - RNA, 64 nt, hsa; identical to SEQ ID NO: 307753

SEQ ID NO: 606723 - RNA, 64 nt, hsa; identical to SEQ ID NO: 307754

SEQ ID NO: 606724 - RNA, 64 nt, hsa; identical to SEQ ID NO: 307755

SEQ ID NO: 606725 - RNA, 64 nt, hsa; identical to SEQ ID NO: 307756

SEQ ID NO: 606726 - RNA, 64 nt, hsa; identical to SEQ ID NO: 307757

SEQ ID NO: 606727 - RNA, 64 nt, hsa; identical to SEQ ID NO: 307758

SEQ ID NO: 606728 - RNA, 64 nt, hsa; identical to SEQ ID NO: 307759

SEQ ID NO: 606729 - RNA, 64 nt, hsa; identical to SEQ ID NO: 307760

SEQ ID NO: 606730 - RNA, 64 nt, hsa; identical to SEQ ID NO: 307761

SEQ ID NO: 606731 - RNA, 64 nt, hsa; identical to SEQ ID NO: 307762

SEQ ID NO: 606732 - RNA, 64 nt, hsa; identical to SEQ ID NO: 307763

SEQ ID NO: 606733 - RNA, 64 nt, hsa; identical to SEQ ID NO: 307764

SEQ ID NO: 606734 - RNA, 64 nt, hsa; identical to SEQ ID NO: 307765

SEQ ID NO: 606735 - RNA, 64 nt, hsa; identical to SEQ ID NO: 307766

SEQ ID NO: 606736 - RNA, 64 nt, hsa; identical to SEQ ID NO: 307767

SEQ ID NO: 606737 - RNA, 64 nt, hsa; identical to SEQ ID NO: 307768

SEQ ID NO: 606738 - RNA, 64 nt, hsa; identical to SEQ ID NO: 307769

SEQ ID NO: 606739 - RNA, 64 nt, hsa; identical to SEQ ID NO: 307770

SEQ ID NO: 606740 - RNA, 64 nt, hsa; identical to SEQ ID NO: 307771

SEQ ID NO: 606741 - RNA, 64 nt, hsa; identical to SEQ ID NO: 307772

SEQ ID NO: 606742 - RNA, 64 nt, hsa; identical to SEQ ID NO: 307773

SEQ ID NO: 606743 - RNA, 64 nt, hsa; identical to SEQ ID NO: 307774

SEQ ID NO: 606744 - RNA, 64 nt, hsa; identical to SEQ ID NO: 307775

SEQ ID NO: 606745 - RNA, 64 nt, hsa; identical to SEQ ID NO: 307776

SEQ ID NO: 606746 - RNA, 64 nt, hsa; identical to SEQ ID NO: 307777

SEQ ID NO: 606747 - RNA, 64 nt, hsa; identical to SEQ ID NO: 307778

SEQ ID NO: 606748 - RNA, 64 nt, hsa; identical to SEQ ID NO: 307779

SEQ ID NO: 606749 - RNA, 64 nt, hsa; identical to SEQ ID NO: 307780

SEQ ID NO: 606750 - RNA, 64 nt, hsa; identical to SEQ ID NO: 307781

SEQ ID NO: 606751 - RNA, 64 nt, hsa; identical to SEQ ID NO: 307782

SEQ ID NO: 606752 - RNA, 64 nt, hsa; identical to SEQ ID NO: 307783

SEQ ID NO: 606753 - RNA, 64 nt, hsa; identical to SEQ ID NO: 307784

SEQ ID NO: 606754 - RNA, 64 nt, hsa; identical to SEQ ID NO: 307785

SEQ ID NO: 606755 - RNA, 64 nt, hsa; identical to SEQ ID NO: 307786

SEQ ID NO: 606756 - RNA, 64 nt, hsa; identical to SEQ ID NO: 307787

SEQ ID NO: 606757 - RNA, 64 nt, hsa; identical to SEQ ID NO: 307788

SEQ ID NO: 606758 - RNA, 64 nt, hsa; identical to SEQ ID NO: 307789

SEQ ID NO: 606759 - RNA, 64 nt, hsa; identical to SEQ ID NO: 307790

SEQ ID NO: 606760 - RNA, 64 nt, hsa; identical to SEQ ID NO: 307791

SEQ ID NO: 606761 - RNA, 64 nt, hsa; identical to SEQ ID NO: 307792

SEQ ID NO: 606762 - RNA, 64 nt, hsa; identical to SEQ ID NO: 307793

SEQ ID NO: 606763 - RNA, 64 nt, hsa; identical to SEQ ID NO: 307794

SEQ ID NO: 606764 - RNA, 64 nt, hsa; identical to SEQ ID NO: 307795

SEQ ID NO: 606765 - RNA, 64 nt, hsa; identical to SEQ ID NO: 307796

SEQ ID NO: 606766 - RNA, 62 nt, hsa; identical to SEQ ID NO: 307797

SEQ ID NO: 606767 - RNA, 64 nt, hsa; identical to SEQ ID NO: 307798

SEQ ID NO: 606768 - RNA, 64 nt, hsa; identical to SEQ ID NO: 307799

SEQ ID NO: 606769 - RNA, 64 nt, hsa; identical to SEQ ID NO: 307800

SEQ ID NO: 606770 - RNA, 64 nt, hsa; identical to SEQ ID NO: 307801

SEQ ID NO: 606771 - RNA, 64 nt, hsa; identical to SEQ ID NO: 307802

SEQ ID NO: 606772 - RNA, 64 nt, hsa; identical to SEQ ID NO: 307803

SEQ ID NO: 606773 - RNA, 64 nt, hsa; identical to SEQ ID NO: 307804

SEQ ID NO: 606774 - RNA, 64 nt, hsa; identical to SEQ ID NO: 307805

SEQ ID NO: 606775 - RNA, 64 nt, hsa; identical to SEQ ID NO: 307806

SEQ ID NO: 606776 - RNA, 64 nt, hsa; identical to SEQ ID NO: 307807

SEQ ID NO: 606777 - RNA, 64 nt, hsa; identical to SEQ ID NO: 307808

SEQ ID NO: 606778 - RNA, 64 nt, hsa; identical to SEQ ID NO: 307809

SEQ ID NO: 606779 - RNA, 64 nt, hsa
ugcaacugcucuaggcugugcaggggguuuaaauggagaucagaacaaaggcucaccugguauu

SEQ ID NO: 606780 - RNA, 64 nt, hsa
gggucacauuuacaacuggaaaagaacuacauugggagaucagagaaagccaaguggccaaguc

SEQ ID NO: 606781 - RNA, 64 nt, hsa
cggagagggcugcgagcauuucccucccgggagaggagaucagggcgaccugcacgcacugcgu

SEQ ID NO: 606782 - RNA, 64 nt, hsa
cccagagaggggacauuucccuccugggagagaaggagaucagggcaacucggagagggcugcg

SEQ ID NO: 606783 - RNA, 64 nt, hsa; identical to SEQ ID NO: 112922

SEQ ID NO: 606784 - RNA, 64 nt, hsa; identical to SEQ ID NO: 112923

SEQ ID NO: 606785 - RNA, 64 nt, hsa; identical to SEQ ID NO: 112924

SEQ ID NO: 606786 - RNA, 64 nt, hsa; identical to SEQ ID NO: 112925

SEQ ID NO: 606787 - RNA, 64 nt, hsa; identical to SEQ ID NO: 112926

SEQ ID NO: 606788 - RNA, 64 nt, hsa; identical to SEQ ID NO: 112927

SEQ ID NO: 606789 - RNA, 64 nt, hsa; identical to SEQ ID NO: 112928

SEQ ID NO: 606790 - RNA, 64 nt, hsa; identical to SEQ ID NO: 112929

SEQ ID NO: 606791 - RNA, 64 nt, hsa; identical to SEQ ID NO: 112930

SEQ ID NO: 606792 - RNA, 64 nt, hsa; identical to SEQ ID NO: 112931

SEQ ID NO: 606793 - RNA, 64 nt, hsa; identical to SEQ ID NO: 112932

SEQ ID NO: 606794 - RNA, 64 nt, hsa; identical to SEQ ID NO: 112933

SEQ ID NO: 606795 - RNA, 64 nt, hsa; identical to SEQ ID NO: 112934

SEQ ID NO: 606796 - RNA, 64 nt, hsa; identical to SEQ ID NO: 112935

SEQ ID NO: 606797 - RNA, 64 nt, hsa; identical to SEQ ID NO: 112936

SEQ ID NO: 606798 - RNA, 64 nt, hsa; identical to SEQ ID NO: 112937

SEQ ID NO: 606799 - RNA, 64 nt, hsa; identical to SEQ ID NO: 112938

SEQ ID NO: 606800 - RNA, 64 nt, hsa; identical to SEQ ID NO: 112939

SEQ ID NO: 606801 - RNA, 64 nt, hsa; identical to SEQ ID NO: 112940

SEQ ID NO: 606802 - RNA, 64 nt, hsa; identical to SEQ ID NO: 112941

SEQ ID NO: 606803 - RNA, 64 nt, hsa; identical to SEQ ID NO: 112942

SEQ ID NO: 606804 - RNA, 64 nt, hsa; identical to SEQ ID NO: 112943

SEQ ID NO: 606805 - RNA, 64 nt, hsa; identical to SEQ ID NO: 112944

SEQ ID NO: 606806 - RNA, 64 nt, hsa; identical to SEQ ID NO: 112945

SEQ ID NO: 606807 - RNA, 64 nt, hsa; identical to SEQ ID NO: 112946

SEQ ID NO: 606808 - RNA, 64 nt, hsa; identical to SEQ ID NO: 112947

SEQ ID NO: 606809 - RNA, 64 nt, hsa; identical to SEQ ID NO: 112948

SEQ ID NO: 606810 - RNA, 64 nt, hsa; identical to SEQ ID NO: 112949

SEQ ID NO: 606811 - RNA, 64 nt, hsa; identical to SEQ ID NO: 112950

SEQ ID NO: 606812 - RNA, 64 nt, hsa; identical to SEQ ID NO: 112951

SEQ ID NO: 606813 - RNA, 64 nt, hsa; identical to SEQ ID NO: 112952

SEQ ID NO: 606814 - RNA, 64 nt, hsa; identical to SEQ ID NO: 112953

SEQ ID NO: 606815 - RNA, 64 nt, hsa; identical to SEQ ID NO: 112954

SEQ ID NO: 606816 - RNA, 50 nt, hsa; identical to SEQ ID NO: 112955

SEQ ID NO: 606817 - RNA, 64 nt, hsa; identical to SEQ ID NO: 112956

SEQ ID NO: 606818 - RNA, 64 nt, hsa; identical to SEQ ID NO: 112957

SEQ ID NO: 606819 - RNA, 64 nt, hsa; identical to SEQ ID NO: 112958

SEQ ID NO: 606820 - RNA, 64 nt, hsa; identical to SEQ ID NO: 112959

SEQ ID NO: 606821 - RNA, 64 nt, hsa; identical to SEQ ID NO: 112960

SEQ ID NO: 606822 - RNA, 64 nt, hsa; identical to SEQ ID NO: 112961

SEQ ID NO: 606823 - RNA, 64 nt, hsa; identical to SEQ ID NO: 218966

SEQ ID NO: 606824 - RNA, 64 nt, hsa; identical to SEQ ID NO: 218967

SEQ ID NO: 606825 - RNA, 64 nt, hsa; identical to SEQ ID NO: 218968

SEQ ID NO: 606826 - RNA, 64 nt, hsa; identical to SEQ ID NO: 218969

SEQ ID NO: 606827 - RNA, 64 nt, hsa; identical to SEQ ID NO: 218970

SEQ ID NO: 606828 - RNA, 64 nt, hsa; identical to SEQ ID NO: 218971

SEQ ID NO: 606829 - RNA, 64 nt, hsa; identical to SEQ ID NO: 218972

SEQ ID NO: 606830 - RNA, 64 nt, hsa; identical to SEQ ID NO: 218973

SEQ ID NO: 606831 - RNA, 64 nt, hsa; identical to SEQ ID NO: 218974

SEQ ID NO: 606832 - RNA, 64 nt, hsa; identical to SEQ ID NO: 218975

SEQ ID NO: 606833 - RNA, 64 nt, hsa; identical to SEQ ID NO: 218976

SEQ ID NO: 606834 - RNA, 64 nt, hsa; identical to SEQ ID NO: 218977

SEQ ID NO: 606835 - RNA, 64 nt, hsa; identical to SEQ ID NO: 218978

SEQ ID NO: 606836 - RNA, 64 nt, hsa; identical to SEQ ID NO: 218979

SEQ ID NO: 606837 - RNA, 64 nt, hsa; identical to SEQ ID NO: 218980

SEQ ID NO: 606838 - RNA, 64 nt, hsa; identical to SEQ ID NO: 218981

SEQ ID NO: 606839 - RNA, 64 nt, hsa; identical to SEQ ID NO: 218982

SEQ ID NO: 606840 - RNA, 64 nt, hsa; identical to SEQ ID NO: 218983

SEQ ID NO: 606841 - RNA, 64 nt, hsa; identical to SEQ ID NO: 218984

SEQ ID NO: 606842 - RNA, 64 nt, hsa; identical to SEQ ID NO: 218985

SEQ ID NO: 606843 - RNA, 64 nt, hsa; identical to SEQ ID NO: 218986

SEQ ID NO: 606844 - RNA, 64 nt, hsa; identical to SEQ ID NO: 218987

SEQ ID NO: 606845 - RNA, 64 nt, hsa; identical to SEQ ID NO: 218988

SEQ ID NO: 606846 - RNA, 64 nt, hsa; identical to SEQ ID NO: 218989

SEQ ID NO: 606847 - RNA, 64 nt, hsa; identical to SEQ ID NO: 218990

SEQ ID NO: 606848 - RNA, 64 nt, hsa; identical to SEQ ID NO: 218991

SEQ ID NO: 606849 - RNA, 64 nt, hsa; identical to SEQ ID NO: 218992

SEQ ID NO: 606850 - RNA, 64 nt, hsa; identical to SEQ ID NO: 218993

SEQ ID NO: 606851 - RNA, 64 nt, hsa; identical to SEQ ID NO: 218994

SEQ ID NO: 606852 - RNA, 64 nt, hsa; identical to SEQ ID NO: 218995

SEQ ID NO: 606853 - RNA, 64 nt, hsa; identical to SEQ ID NO: 218996

SEQ ID NO: 606854 - RNA, 64 nt, hsa; identical to SEQ ID NO: 59958

SEQ ID NO: 606855 - RNA, 64 nt, hsa; identical to SEQ ID NO: 59959

SEQ ID NO: 606856 - RNA, 64 nt, hsa; identical to SEQ ID NO: 59960

SEQ ID NO: 606857 - RNA, 64 nt, hsa; identical to SEQ ID NO: 59961

SEQ ID NO: 606858 - RNA, 64 nt, hsa; identical to SEQ ID NO: 59962

SEQ ID NO: 606859 - RNA, 64 nt, hsa; identical to SEQ ID NO: 59963

SEQ ID NO: 606860 - RNA, 64 nt, hsa; identical to SEQ ID NO: 59964

SEQ ID NO: 606861 - RNA, 64 nt, hsa; identical to SEQ ID NO: 59965

SEQ ID NO: 606862 - RNA, 64 nt, hsa; identical to SEQ ID NO: 59966

SEQ ID NO: 606863 - RNA, 64 nt, hsa; identical to SEQ ID NO: 59967

SEQ ID NO: 606864 - RNA, 64 nt, hsa; identical to SEQ ID NO: 59968

SEQ ID NO: 606865 - RNA, 64 nt, hsa; identical to SEQ ID NO: 59969

SEQ ID NO: 606866 - RNA, 64 nt, hsa; identical to SEQ ID NO: 59970

SEQ ID NO: 606867 - RNA, 64 nt, hsa; identical to SEQ ID NO: 59971

SEQ ID NO: 606868 - RNA, 64 nt, hsa; identical to SEQ ID NO: 59972

SEQ ID NO: 606869 - RNA, 64 nt, hsa; identical to SEQ ID NO: 59973

SEQ ID NO: 606870 - RNA, 64 nt, hsa; identical to SEQ ID NO: 59974

SEQ ID NO: 606871 - RNA, 64 nt, hsa; identical to SEQ ID NO: 59975

SEQ ID NO: 606872 - RNA, 64 nt, hsa; identical to SEQ ID NO: 59976

SEQ ID NO: 606873 - RNA, 64 nt, hsa; identical to SEQ ID NO: 59977

SEQ ID NO: 606874 - RNA, 64 nt, hsa; identical to SEQ ID NO: 59978

SEQ ID NO: 606875 - RNA, 64 nt, hsa; identical to SEQ ID NO: 59979

SEQ ID NO: 606876 - RNA, 64 nt, hsa; identical to SEQ ID NO: 59980

SEQ ID NO: 606877 - RNA, 64 nt, hsa; identical to SEQ ID NO: 59981

SEQ ID NO: 606878 - RNA, 64 nt, hsa; identical to SEQ ID NO: 59982

SEQ ID NO: 606879 - RNA, 64 nt, hsa; identical to SEQ ID NO: 59983

SEQ ID NO: 606880 - RNA, 64 nt, hsa; identical to SEQ ID NO: 59984

SEQ ID NO: 606881 - RNA, 64 nt, hsa; identical to SEQ ID NO: 59985

SEQ ID NO: 606882 - RNA, 64 nt, hsa; identical to SEQ ID NO: 59986

SEQ ID NO: 606883 - RNA, 64 nt, hsa; identical to SEQ ID NO: 59987

SEQ ID NO: 606884 - RNA, 64 nt, hsa; identical to SEQ ID NO: 59988

SEQ ID NO: 606885 - RNA, 64 nt, hsa; identical to SEQ ID NO: 59989

SEQ ID NO: 606886 - RNA, 64 nt, hsa; identical to SEQ ID NO: 59990

SEQ ID NO: 606887 - RNA, 64 nt, hsa; identical to SEQ ID NO: 59991

SEQ ID NO: 606888 - RNA, 64 nt, hsa; identical to SEQ ID NO: 59992

SEQ ID NO: 606889 - RNA, 64 nt, hsa; identical to SEQ ID NO: 59993

SEQ ID NO: 606890 - RNA, 64 nt, hsa; identical to SEQ ID NO: 59994

SEQ ID NO: 606891 - RNA, 64 nt, hsa; identical to SEQ ID NO: 59995

SEQ ID NO: 606892 - RNA, 64 nt, hsa; identical to SEQ ID NO: 59996

SEQ ID NO: 606893 - RNA, 64 nt, hsa; identical to SEQ ID NO: 59997

SEQ ID NO: 606894 - RNA, 64 nt, hsa; identical to SEQ ID NO: 59998

SEQ ID NO: 606895 - RNA, 64 nt, hsa; identical to SEQ ID NO: 59999

SEQ ID NO: 606896 - RNA, 64 nt, hsa; identical to SEQ ID NO: 60000

SEQ ID NO: 606897 - RNA, 64 nt, hsa; identical to SEQ ID NO: 60001

SEQ ID NO: 606898 - RNA, 64 nt, hsa; identical to SEQ ID NO: 60002

SEQ ID NO: 606899 - RNA, 64 nt, hsa; identical to SEQ ID NO: 60003

SEQ ID NO: 606900 - RNA, 64 nt, hsa; identical to SEQ ID NO: 60004

SEQ ID NO: 606901 - RNA, 64 nt, hsa; identical to SEQ ID NO: 60005

SEQ ID NO: 606902 - RNA, 64 nt, hsa; identical to SEQ ID NO: 60006

SEQ ID NO: 606903 - RNA, 64 nt, hsa; identical to SEQ ID NO: 60007

SEQ ID NO: 606904 - RNA, 64 nt, hsa; identical to SEQ ID NO: 60008

SEQ ID NO: 606905 - RNA, 64 nt, hsa; identical to SEQ ID NO: 60009

SEQ ID NO: 606906 - RNA, 64 nt, hsa; identical to SEQ ID NO: 60010

SEQ ID NO: 606907 - RNA, 64 nt, hsa; identical to SEQ ID NO: 60011

SEQ ID NO: 606908 - RNA, 64 nt, hsa; identical to SEQ ID NO: 79907

SEQ ID NO: 606909 - RNA, 64 nt, hsa; identical to SEQ ID NO: 79908

SEQ ID NO: 606910 - RNA, 64 nt, hsa; identical to SEQ ID NO: 82601

SEQ ID NO: 606911 - RNA, 64 nt, hsa; identical to SEQ ID NO: 82602

SEQ ID NO: 606912 - RNA, 64 nt, hsa; identical to SEQ ID NO: 82603

SEQ ID NO: 606913 - RNA, 64 nt, hsa; identical to SEQ ID NO: 82604

SEQ ID NO: 606914 - RNA, 64 nt, hsa; identical to SEQ ID NO: 82605

SEQ ID NO: 606915 - RNA, 64 nt, hsa; identical to SEQ ID NO: 82606

SEQ ID NO: 606916 - RNA, 64 nt, hsa; identical to SEQ ID NO: 82607

SEQ ID NO: 606917 - RNA, 64 nt, hsa; identical to SEQ ID NO: 82608

SEQ ID NO: 606918 - RNA, 64 nt, hsa; identical to SEQ ID NO: 82609

SEQ ID NO: 606919 - RNA, 64 nt, hsa; identical to SEQ ID NO: 82610

SEQ ID NO: 606920 - RNA, 64 nt, hsa; identical to SEQ ID NO: 82611

SEQ ID NO: 606921 - RNA, 64 nt, hsa; identical to SEQ ID NO: 82612

SEQ ID NO: 606922 - RNA, 64 nt, hsa; identical to SEQ ID NO: 82613

SEQ ID NO: 606923 - RNA, 64 nt, hsa; identical to SEQ ID NO: 82614

SEQ ID NO: 606924 - RNA, 64 nt, hsa; identical to SEQ ID NO: 82615

SEQ ID NO: 606925 - RNA, 64 nt, hsa; identical to SEQ ID NO: 82616

SEQ ID NO: 606926 - RNA, 64 nt, hsa; identical to SEQ ID NO: 82617

SEQ ID NO: 606927 - RNA, 64 nt, hsa; identical to SEQ ID NO: 82618

SEQ ID NO: 606928 - RNA, 64 nt, hsa; identical to SEQ ID NO: 82619

SEQ ID NO: 606929 - RNA, 64 nt, hsa; identical to SEQ ID NO: 82620

SEQ ID NO: 606930 - RNA, 64 nt, hsa; identical to SEQ ID NO: 82621

SEQ ID NO: 606931 - RNA, 64 nt, hsa; identical to SEQ ID NO: 82622

SEQ ID NO: 606932 - RNA, 64 nt, hsa; identical to SEQ ID NO: 82623

SEQ ID NO: 606933 - RNA, 64 nt, hsa; identical to SEQ ID NO: 82624

SEQ ID NO: 606934 - RNA, 64 nt, hsa; identical to SEQ ID NO: 82625

SEQ ID NO: 606935 - RNA, 64 nt, hsa; identical to SEQ ID NO: 82626

SEQ ID NO: 606936 - RNA, 64 nt, hsa; identical to SEQ ID NO: 82627

SEQ ID NO: 606937 - RNA, 64 nt, hsa; identical to SEQ ID NO: 82628

SEQ ID NO: 606938 - RNA, 64 nt, hsa; identical to SEQ ID NO: 82629

SEQ ID NO: 606939 - RNA, 64 nt, hsa; identical to SEQ ID NO: 82630

SEQ ID NO: 606940 - RNA, 64 nt, hsa; identical to SEQ ID NO: 82631

SEQ ID NO: 606941 - RNA, 64 nt, hsa; identical to SEQ ID NO: 82632

SEQ ID NO: 606942 - RNA, 64 nt, hsa; identical to SEQ ID NO: 82633

SEQ ID NO: 606943 - RNA, 64 nt, hsa; identical to SEQ ID NO: 82634

SEQ ID NO: 606944 - RNA, 64 nt, hsa; identical to SEQ ID NO: 82635

SEQ ID NO: 606945 - RNA, 64 nt, hsa; identical to SEQ ID NO: 82636

SEQ ID NO: 606946 - RNA, 64 nt, hsa; identical to SEQ ID NO: 82637

SEQ ID NO: 606947 - RNA, 64 nt, hsa; identical to SEQ ID NO: 82638

SEQ ID NO: 606948 - RNA, 64 nt, hsa; identical to SEQ ID NO: 82639

SEQ ID NO: 606949 - RNA, 64 nt, hsa; identical to SEQ ID NO: 82640

SEQ ID NO: 606950 - RNA, 64 nt, hsa; identical to SEQ ID NO: 82641

SEQ ID NO: 606951 - RNA, 64 nt, hsa; identical to SEQ ID NO: 82642

SEQ ID NO: 606952 - RNA, 64 nt, hsa; identical to SEQ ID NO: 82643

SEQ ID NO: 606953 - RNA, 64 nt, hsa; identical to SEQ ID NO: 82644

SEQ ID NO: 606954 - RNA, 64 nt, hsa; identical to SEQ ID NO: 82645

SEQ ID NO: 606955 - RNA, 64 nt, hsa; identical to SEQ ID NO: 82646

SEQ ID NO: 606956 - RNA, 64 nt, hsa; identical to SEQ ID NO: 82647

SEQ ID NO: 606957 - RNA, 64 nt, hsa; identical to SEQ ID NO: 82648

SEQ ID NO: 606958 - RNA, 64 nt, hsa; identical to SEQ ID NO: 82649

SEQ ID NO: 606959 - RNA, 64 nt, hsa; identical to SEQ ID NO: 82650

SEQ ID NO: 606960 - RNA, 64 nt, hsa; identical to SEQ ID NO: 82651

SEQ ID NO: 606961 - RNA, 64 nt, hsa; identical to SEQ ID NO: 82652

SEQ ID NO: 606962 - RNA, 64 nt, hsa; identical to SEQ ID NO: 82653

SEQ ID NO: 606963 - RNA, 64 nt, hsa; identical to SEQ ID NO: 82654

SEQ ID NO: 606964 - RNA, 64 nt, hsa; identical to SEQ ID NO: 82655

SEQ ID NO: 606965 - RNA, 64 nt, hsa; identical to SEQ ID NO: 82656

SEQ ID NO: 606966 - RNA, 64 nt, hsa; identical to SEQ ID NO: 82657

SEQ ID NO: 606967 - RNA, 64 nt, hsa; identical to SEQ ID NO: 82658

SEQ ID NO: 606968 - RNA, 64 nt, hsa; identical to SEQ ID NO: 82659

SEQ ID NO: 606969 - RNA, 64 nt, hsa; identical to SEQ ID NO: 82660

SEQ ID NO: 606970 - RNA, 64 nt, hsa; identical to SEQ ID NO: 82661

SEQ ID NO: 606971 - RNA, 64 nt, hsa; identical to SEQ ID NO: 82662

SEQ ID NO: 606972 - RNA, 64 nt, hsa; identical to SEQ ID NO: 82663

SEQ ID NO: 606973 - RNA, 64 nt, hsa; identical to SEQ ID NO: 82664

SEQ ID NO: 606974 - RNA, 64 nt, hsa; identical to SEQ ID NO: 82665

SEQ ID NO: 606975 - RNA, 64 nt, hsa; identical to SEQ ID NO: 82666

SEQ ID NO: 606976 - RNA, 64 nt, hsa; identical to SEQ ID NO: 82667

SEQ ID NO: 606977 - RNA, 64 nt, hsa; identical to SEQ ID NO: 82668

SEQ ID NO: 606978 - RNA, 64 nt, hsa; identical to SEQ ID NO: 82669

SEQ ID NO: 606979 - RNA, 64 nt, hsa; identical to SEQ ID NO: 82670

SEQ ID NO: 606980 - RNA, 64 nt, hsa; identical to SEQ ID NO: 82671

SEQ ID NO: 606981 - RNA, 64 nt, hsa; identical to SEQ ID NO: 82672

SEQ ID NO: 606982 - RNA, 64 nt, hsa; identical to SEQ ID NO: 82673

SEQ ID NO: 606983 - RNA, 64 nt, hsa; identical to SEQ ID NO: 82674

SEQ ID NO: 606984 - RNA, 64 nt, hsa; identical to SEQ ID NO: 82675

SEQ ID NO: 606985 - RNA, 64 nt, hsa; identical to SEQ ID NO: 82676

SEQ ID NO: 606986 - RNA, 64 nt, hsa; identical to SEQ ID NO: 82677

SEQ ID NO: 606987 - RNA, 64 nt, hsa; identical to SEQ ID NO: 155383

SEQ ID NO: 606988 - RNA, 64 nt, hsa; identical to SEQ ID NO: 155384

SEQ ID NO: 606989 - RNA, 64 nt, hsa; identical to SEQ ID NO: 155385

SEQ ID NO: 606990 - RNA, 64 nt, hsa; identical to SEQ ID NO: 155386

SEQ ID NO: 606991 - RNA, 64 nt, hsa; identical to SEQ ID NO: 155387

SEQ ID NO: 606992 - RNA, 64 nt, hsa; identical to SEQ ID NO: 155388

SEQ ID NO: 606993 - RNA, 64 nt, hsa; identical to SEQ ID NO: 155389

SEQ ID NO: 606994 - RNA, 64 nt, hsa; identical to SEQ ID NO: 155390

SEQ ID NO: 606995 - RNA, 64 nt, hsa; identical to SEQ ID NO: 155391

SEQ ID NO: 606996 - RNA, 64 nt, hsa; identical to SEQ ID NO: 155392

SEQ ID NO: 606997 - RNA, 64 nt, hsa; identical to SEQ ID NO: 155393

SEQ ID NO: 606998 - RNA, 64 nt, hsa; identical to SEQ ID NO: 155394

SEQ ID NO: 606999 - RNA, 64 nt, hsa; identical to SEQ ID NO: 155395

SEQ ID NO: 607000 - RNA, 64 nt, hsa; identical to SEQ ID NO: 155396

SEQ ID NO: 607001 - RNA, 64 nt, hsa; identical to SEQ ID NO: 155397

SEQ ID NO: 607002 - RNA, 64 nt, hsa; identical to SEQ ID NO: 155398

SEQ ID NO: 607003 - RNA, 64 nt, hsa; identical to SEQ ID NO: 155399

SEQ ID NO: 607004 - RNA, 64 nt, hsa; identical to SEQ ID NO: 155400

SEQ ID NO: 607005 - RNA, 64 nt, hsa; identical to SEQ ID NO: 155401

SEQ ID NO: 607006 - RNA, 64 nt, hsa; identical to SEQ ID NO: 155402

SEQ ID NO: 607007 - RNA, 64 nt, hsa; identical to SEQ ID NO: 155403

SEQ ID NO: 607008 - RNA, 64 nt, hsa; identical to SEQ ID NO: 155404

SEQ ID NO: 607009 - RNA, 64 nt, hsa; identical to SEQ ID NO: 155405

SEQ ID NO: 607010 - RNA, 64 nt, hsa; identical to SEQ ID NO: 155406

SEQ ID NO: 607011 - RNA, 64 nt, hsa; identical to SEQ ID NO: 155407

SEQ ID NO: 607012 - RNA, 64 nt, hsa; identical to SEQ ID NO: 155408

SEQ ID NO: 607013 - RNA, 64 nt, hsa; identical to SEQ ID NO: 155409

SEQ ID NO: 607014 - RNA, 64 nt, hsa; identical to SEQ ID NO: 155410

SEQ ID NO: 607015 - RNA, 64 nt, hsa; identical to SEQ ID NO: 155411

SEQ ID NO: 607016 - RNA, 64 nt, hsa; identical to SEQ ID NO: 155412

SEQ ID NO: 607017 - RNA, 64 nt, hsa; identical to SEQ ID NO: 155413

SEQ ID NO: 607018 - RNA, 64 nt, hsa; identical to SEQ ID NO: 155414

SEQ ID NO: 607019 - RNA, 64 nt, hsa; identical to SEQ ID NO: 155415

SEQ ID NO: 607020 - RNA, 64 nt, hsa; identical to SEQ ID NO: 155416

SEQ ID NO: 607021 - RNA, 64 nt, hsa; identical to SEQ ID NO: 155417

SEQ ID NO: 607022 - RNA, 64 nt, hsa; identical to SEQ ID NO: 155418

SEQ ID NO: 607023 - RNA, 64 nt, hsa; identical to SEQ ID NO: 155419

SEQ ID NO: 607024 - RNA, 64 nt, hsa; identical to SEQ ID NO: 155420

SEQ ID NO: 607025 - RNA, 64 nt, hsa; identical to SEQ ID NO: 155421

SEQ ID NO: 607026 - RNA, 64 nt, hsa; identical to SEQ ID NO: 155422

SEQ ID NO: 607027 - RNA, 64 nt, hsa; identical to SEQ ID NO: 155423

SEQ ID NO: 607028 - RNA, 64 nt, hsa; identical to SEQ ID NO: 155424

SEQ ID NO: 607029 - RNA, 64 nt, hsa; identical to SEQ ID NO: 155425

SEQ ID NO: 607030 - RNA, 64 nt, hsa; identical to SEQ ID NO: 155426

SEQ ID NO: 607031 - RNA, 64 nt, hsa; identical to SEQ ID NO: 155427

SEQ ID NO: 607032 - RNA, 64 nt, hsa; identical to SEQ ID NO: 155428

SEQ ID NO: 607033 - RNA, 64 nt, hsa; identical to SEQ ID NO: 155429

SEQ ID NO: 607034 - RNA, 64 nt, hsa; identical to SEQ ID NO: 155430

SEQ ID NO: 607035 - RNA, 64 nt, hsa; identical to SEQ ID NO: 155431

SEQ ID NO: 607036 - RNA, 64 nt, hsa; identical to SEQ ID NO: 155432

SEQ ID NO: 607037 - RNA, 64 nt, hsa; identical to SEQ ID NO: 155433

SEQ ID NO: 607038 - RNA, 64 nt, hsa; identical to SEQ ID NO: 155434

SEQ ID NO: 607039 - RNA, 64 nt, hsa; identical to SEQ ID NO: 155435

SEQ ID NO: 607040 - RNA, 64 nt, hsa; identical to SEQ ID NO: 155436

SEQ ID NO: 607041 - RNA, 64 nt, hsa; identical to SEQ ID NO: 155437

SEQ ID NO: 607042 - RNA, 64 nt, hsa; identical to SEQ ID NO: 155438

SEQ ID NO: 607043 - RNA, 64 nt, hsa; identical to SEQ ID NO: 155439

SEQ ID NO: 607044 - RNA, 64 nt, hsa; identical to SEQ ID NO: 155440

SEQ ID NO: 607045 - RNA, 64 nt, hsa; identical to SEQ ID NO: 155441

SEQ ID NO: 607046 - RNA, 64 nt, hsa; identical to SEQ ID NO: 155442

SEQ ID NO: 607047 - RNA, 64 nt, hsa; identical to SEQ ID NO: 155443

SEQ ID NO: 607048 - RNA, 64 nt, hsa; identical to SEQ ID NO: 155444

SEQ ID NO: 607049 - RNA, 64 nt, hsa; identical to SEQ ID NO: 155445

SEQ ID NO: 607050 - RNA, 64 nt, hsa; identical to SEQ ID NO: 155446

SEQ ID NO: 607051 - RNA, 64 nt, hsa; identical to SEQ ID NO: 155447

SEQ ID NO: 607052 - RNA, 64 nt, hsa; identical to SEQ ID NO: 155448

SEQ ID NO: 607053 - RNA, 64 nt, hsa; identical to SEQ ID NO: 155449

SEQ ID NO: 607054 - RNA, 64 nt, hsa; identical to SEQ ID NO: 155450

SEQ ID NO: 607055 - RNA, 64 nt, hsa; identical to SEQ ID NO: 155451

SEQ ID NO: 607056 - RNA, 64 nt, hsa; identical to SEQ ID NO: 155452

SEQ ID NO: 607057 - RNA, 64 nt, hsa; identical to SEQ ID NO: 155453

SEQ ID NO: 607058 - RNA, 64 nt, hsa; identical to SEQ ID NO: 155454

SEQ ID NO: 607059 - RNA, 64 nt, hsa; identical to SEQ ID NO: 155455

SEQ ID NO: 607060 - RNA, 64 nt, hsa; identical to SEQ ID NO: 155456

SEQ ID NO: 607061 - RNA, 64 nt, hsa; identical to SEQ ID NO: 155457

SEQ ID NO: 607062 - RNA, 64 nt, hsa; identical to SEQ ID NO: 155458

SEQ ID NO: 607063 - RNA, 64 nt, hsa; identical to SEQ ID NO: 155459

SEQ ID NO: 607064 - RNA, 64 nt, hsa; identical to SEQ ID NO: 155460

SEQ ID NO: 607065 - RNA, 64 nt, hsa; identical to SEQ ID NO: 155461

SEQ ID NO: 607066 - RNA, 64 nt, hsa; identical to SEQ ID NO: 155462

SEQ ID NO: 607067 - RNA, 64 nt, hsa; identical to SEQ ID NO: 155463

SEQ ID NO: 607068 - RNA, 64 nt, hsa; identical to SEQ ID NO: 155464

SEQ ID NO: 607069 - RNA, 64 nt, hsa; identical to SEQ ID NO: 155465

SEQ ID NO: 607070 - RNA, 64 nt, hsa; identical to SEQ ID NO: 155466

SEQ ID NO: 607071 - RNA, 64 nt, hsa; identical to SEQ ID NO: 155467

SEQ ID NO: 607072 - RNA, 64 nt, hsa; identical to SEQ ID NO: 155468

SEQ ID NO: 607073 - RNA, 64 nt, hsa; identical to SEQ ID NO: 155469

SEQ ID NO: 607074 - RNA, 64 nt, hsa; identical to SEQ ID NO: 155470

SEQ ID NO: 607075 - RNA, 64 nt, hsa; identical to SEQ ID NO: 155471

SEQ ID NO: 607076 - RNA, 64 nt, hsa; identical to SEQ ID NO: 155472

SEQ ID NO: 607077 - RNA, 64 nt, hsa; identical to SEQ ID NO: 155473

SEQ ID NO: 607078 - RNA, 64 nt, hsa; identical to SEQ ID NO: 155474

SEQ ID NO: 607079 - RNA, 64 nt, hsa; identical to SEQ ID NO: 155475

SEQ ID NO: 607080 - RNA, 64 nt, hsa; identical to SEQ ID NO: 155476

SEQ ID NO: 607081 - RNA, 64 nt, hsa; identical to SEQ ID NO: 155477

SEQ ID NO: 607082 - RNA, 64 nt, hsa; identical to SEQ ID NO: 155478

SEQ ID NO: 607083 - RNA, 64 nt, hsa; identical to SEQ ID NO: 155479

SEQ ID NO: 607084 - RNA, 64 nt, hsa; identical to SEQ ID NO: 155480

SEQ ID NO: 607085 - RNA, 64 nt, hsa; identical to SEQ ID NO: 155481

SEQ ID NO: 607086 - RNA, 64 nt, hsa; identical to SEQ ID NO: 155482

SEQ ID NO: 607087 - RNA, 64 nt, hsa; identical to SEQ ID NO: 155483

SEQ ID NO: 607088 - RNA, 64 nt, hsa; identical to SEQ ID NO: 155484

SEQ ID NO: 607089 - RNA, 64 nt, hsa; identical to SEQ ID NO: 155485

SEQ ID NO: 607090 - RNA, 64 nt, hsa; identical to SEQ ID NO: 155486

SEQ ID NO: 607091 - RNA, 64 nt, hsa; identical to SEQ ID NO: 155487

SEQ ID NO: 607092 - RNA, 64 nt, hsa; identical to SEQ ID NO: 155488

SEQ ID NO: 607093 - RNA, 64 nt, hsa; identical to SEQ ID NO: 82601

SEQ ID NO: 607094 - RNA, 64 nt, hsa; identical to SEQ ID NO: 82602

SEQ ID NO: 607095 - RNA, 64 nt, hsa; identical to SEQ ID NO: 82603

SEQ ID NO: 607096 - RNA, 64 nt, hsa; identical to SEQ ID NO: 82604

SEQ ID NO: 607097 - RNA, 64 nt, hsa; identical to SEQ ID NO: 82605

SEQ ID NO: 607098 - RNA, 64 nt, hsa; identical to SEQ ID NO: 82606

SEQ ID NO: 607099 - RNA, 64 nt, hsa; identical to SEQ ID NO: 82607

SEQ ID NO: 607100 - RNA, 64 nt, hsa; identical to SEQ ID NO: 82608

SEQ ID NO: 607101 - RNA, 64 nt, hsa; identical to SEQ ID NO: 82609

SEQ ID NO: 607102 - RNA, 64 nt, hsa; identical to SEQ ID NO: 82610

SEQ ID NO: 607103 - RNA, 64 nt, hsa; identical to SEQ ID NO: 82611

SEQ ID NO: 607104 - RNA, 64 nt, hsa; identical to SEQ ID NO: 82612

SEQ ID NO: 607105 - RNA, 64 nt, hsa; identical to SEQ ID NO: 82613

SEQ ID NO: 607106 - RNA, 64 nt, hsa; identical to SEQ ID NO: 82614

SEQ ID NO: 607107 - RNA, 64 nt, hsa; identical to SEQ ID NO: 82615

SEQ ID NO: 607108 - RNA, 64 nt, hsa; identical to SEQ ID NO: 82616

SEQ ID NO: 607109 - RNA, 64 nt, hsa; identical to SEQ ID NO: 82617

SEQ ID NO: 607110 - RNA, 64 nt, hsa; identical to SEQ ID NO: 82618

SEQ ID NO: 607111 - RNA, 64 nt, hsa; identical to SEQ ID NO: 82619

SEQ ID NO: 607112 - RNA, 64 nt, hsa; identical to SEQ ID NO: 82620

SEQ ID NO: 607113 - RNA, 64 nt, hsa; identical to SEQ ID NO: 82621

SEQ ID NO: 607114 - RNA, 64 nt, hsa; identical to SEQ ID NO: 82622

SEQ ID NO: 607115 - RNA, 64 nt, hsa; identical to SEQ ID NO: 82623

SEQ ID NO: 607116 - RNA, 64 nt, hsa; identical to SEQ ID NO: 82624

SEQ ID NO: 607117 - RNA, 64 nt, hsa; identical to SEQ ID NO: 82625

SEQ ID NO: 607118 - RNA, 64 nt, hsa; identical to SEQ ID NO: 82626

SEQ ID NO: 607119 - RNA, 64 nt, hsa; identical to SEQ ID NO: 82627

SEQ ID NO: 607120 - RNA, 64 nt, hsa; identical to SEQ ID NO: 82628

SEQ ID NO: 607121 - RNA, 64 nt, hsa; identical to SEQ ID NO: 82629

SEQ ID NO: 607122 - RNA, 64 nt, hsa; identical to SEQ ID NO: 82630

SEQ ID NO: 607123 - RNA, 64 nt, hsa; identical to SEQ ID NO: 82631

SEQ ID NO: 607124 - RNA, 64 nt, hsa; identical to SEQ ID NO: 82632

SEQ ID NO: 607125 - RNA, 64 nt, hsa; identical to SEQ ID NO: 82633

SEQ ID NO: 607126 - RNA, 64 nt, hsa; identical to SEQ ID NO: 82634

SEQ ID NO: 607127 - RNA, 64 nt, hsa; identical to SEQ ID NO: 82635

SEQ ID NO: 607128 - RNA, 64 nt, hsa; identical to SEQ ID NO: 82636

SEQ ID NO: 607129 - RNA, 64 nt, hsa; identical to SEQ ID NO: 82637

SEQ ID NO: 607130 - RNA, 64 nt, hsa; identical to SEQ ID NO: 82638

SEQ ID NO: 607131 - RNA, 64 nt, hsa; identical to SEQ ID NO: 82639

SEQ ID NO: 607132 - RNA, 64 nt, hsa; identical to SEQ ID NO: 82640

SEQ ID NO: 607133 - RNA, 64 nt, hsa; identical to SEQ ID NO: 82641

SEQ ID NO: 607134 - RNA, 64 nt, hsa; identical to SEQ ID NO: 82642

SEQ ID NO: 607135 - RNA, 64 nt, hsa; identical to SEQ ID NO: 82643

SEQ ID NO: 607136 - RNA, 64 nt, hsa; identical to SEQ ID NO: 82644

SEQ ID NO: 607137 - RNA, 64 nt, hsa; identical to SEQ ID NO: 82645

SEQ ID NO: 607138 - RNA, 64 nt, hsa; identical to SEQ ID NO: 82646

SEQ ID NO: 607139 - RNA, 64 nt, hsa; identical to SEQ ID NO: 82647

SEQ ID NO: 607140 - RNA, 64 nt, hsa; identical to SEQ ID NO: 82648

SEQ ID NO: 607141 - RNA, 64 nt, hsa; identical to SEQ ID NO: 82649

SEQ ID NO: 607142 - RNA, 64 nt, hsa; identical to SEQ ID NO: 82650

SEQ ID NO: 607143 - RNA, 64 nt, hsa; identical to SEQ ID NO: 82651

SEQ ID NO: 607144 - RNA, 64 nt, hsa; identical to SEQ ID NO: 82652

SEQ ID NO: 607145 - RNA, 64 nt, hsa; identical to SEQ ID NO: 82653

SEQ ID NO: 607146 - RNA, 64 nt, hsa; identical to SEQ ID NO: 82654

SEQ ID NO: 607147 - RNA, 64 nt, hsa; identical to SEQ ID NO: 82655

SEQ ID NO: 607148 - RNA, 64 nt, hsa; identical to SEQ ID NO: 82656

SEQ ID NO: 607149 - RNA, 64 nt, hsa; identical to SEQ ID NO: 82657

SEQ ID NO: 607150 - RNA, 64 nt, hsa; identical to SEQ ID NO: 82658

SEQ ID NO: 607151 - RNA, 64 nt, hsa; identical to SEQ ID NO: 82659

SEQ ID NO: 607152 - RNA, 64 nt, hsa; identical to SEQ ID NO: 82660

SEQ ID NO: 607153 - RNA, 64 nt, hsa; identical to SEQ ID NO: 82661

SEQ ID NO: 607154 - RNA, 64 nt, hsa; identical to SEQ ID NO: 82662

SEQ ID NO: 607155 - RNA, 64 nt, hsa; identical to SEQ ID NO: 82663

SEQ ID NO: 607156 - RNA, 64 nt, hsa; identical to SEQ ID NO: 82664

SEQ ID NO: 607157 - RNA, 64 nt, hsa; identical to SEQ ID NO: 82665

SEQ ID NO: 607158 - RNA, 64 nt, hsa; identical to SEQ ID NO: 82666

SEQ ID NO: 607159 - RNA, 64 nt, hsa; identical to SEQ ID NO: 82667

SEQ ID NO: 607160 - RNA, 64 nt, hsa; identical to SEQ ID NO: 82668

SEQ ID NO: 607161 - RNA, 64 nt, hsa; identical to SEQ ID NO: 82669

SEQ ID NO: 607162 - RNA, 64 nt, hsa; identical to SEQ ID NO: 82670

SEQ ID NO: 607163 - RNA, 64 nt, hsa; identical to SEQ ID NO: 82671

SEQ ID NO: 607164 - RNA, 64 nt, hsa; identical to SEQ ID NO: 82672

SEQ ID NO: 607165 - RNA, 64 nt, hsa; identical to SEQ ID NO: 82673

SEQ ID NO: 607166 - RNA, 64 nt, hsa; identical to SEQ ID NO: 82674

SEQ ID NO: 607167 - RNA, 64 nt, hsa; identical to SEQ ID NO: 82675

SEQ ID NO: 607168 - RNA, 64 nt, hsa; identical to SEQ ID NO: 82676

SEQ ID NO: 607169 - RNA, 64 nt, hsa; identical to SEQ ID NO: 82677

SEQ ID NO: 607170 - RNA, 64 nt, hsa; identical to SEQ ID NO: 155383

SEQ ID NO: 607171 - RNA, 64 nt, hsa; identical to SEQ ID NO: 155384

SEQ ID NO: 607172 - RNA, 64 nt, hsa; identical to SEQ ID NO: 155385

SEQ ID NO: 607173 - RNA, 64 nt, hsa; identical to SEQ ID NO: 155386

SEQ ID NO: 607174 - RNA, 64 nt, hsa; identical to SEQ ID NO: 155387

SEQ ID NO: 607175 - RNA, 64 nt, hsa; identical to SEQ ID NO: 155388

SEQ ID NO: 607176 - RNA, 64 nt, hsa; identical to SEQ ID NO: 155389

SEQ ID NO: 607177 - RNA, 64 nt, hsa; identical to SEQ ID NO: 155390

SEQ ID NO: 607178 - RNA, 64 nt, hsa; identical to SEQ ID NO: 155391

SEQ ID NO: 607179 - RNA, 64 nt, hsa; identical to SEQ ID NO: 155392

SEQ ID NO: 607180 - RNA, 64 nt, hsa; identical to SEQ ID NO: 155393

SEQ ID NO: 607181 - RNA, 64 nt, hsa; identical to SEQ ID NO: 155394

SEQ ID NO: 607182 - RNA, 64 nt, hsa; identical to SEQ ID NO: 155395

SEQ ID NO: 607183 - RNA, 64 nt, hsa; identical to SEQ ID NO: 155396

SEQ ID NO: 607184 - RNA, 64 nt, hsa; identical to SEQ ID NO: 155397

SEQ ID NO: 607185 - RNA, 64 nt, hsa; identical to SEQ ID NO: 155398

SEQ ID NO: 607186 - RNA, 64 nt, hsa; identical to SEQ ID NO: 155399

SEQ ID NO: 607187 - RNA, 64 nt, hsa; identical to SEQ ID NO: 155400

SEQ ID NO: 607188 - RNA, 64 nt, hsa; identical to SEQ ID NO: 155401

SEQ ID NO: 607189 - RNA, 64 nt, hsa; identical to SEQ ID NO: 155402

SEQ ID NO: 607190 - RNA, 64 nt, hsa; identical to SEQ ID NO: 155403

SEQ ID NO: 607191 - RNA, 64 nt, hsa; identical to SEQ ID NO: 155404

SEQ ID NO: 607192 - RNA, 64 nt, hsa; identical to SEQ ID NO: 155405

SEQ ID NO: 607193 - RNA, 64 nt, hsa; identical to SEQ ID NO: 155406

SEQ ID NO: 607194 - RNA, 64 nt, hsa; identical to SEQ ID NO: 155407

SEQ ID NO: 607195 - RNA, 64 nt, hsa; identical to SEQ ID NO: 155408

SEQ ID NO: 607196 - RNA, 64 nt, hsa; identical to SEQ ID NO: 155409

SEQ ID NO: 607197 - RNA, 64 nt, hsa; identical to SEQ ID NO: 155410

SEQ ID NO: 607198 - RNA, 64 nt, hsa; identical to SEQ ID NO: 155411

SEQ ID NO: 607199 - RNA, 64 nt, hsa; identical to SEQ ID NO: 155412

SEQ ID NO: 607200 - RNA, 64 nt, hsa; identical to SEQ ID NO: 155413

SEQ ID NO: 607201 - RNA, 64 nt, hsa; identical to SEQ ID NO: 155414

SEQ ID NO: 607202 - RNA, 64 nt, hsa; identical to SEQ ID NO: 155415

SEQ ID NO: 607203 - RNA, 64 nt, hsa; identical to SEQ ID NO: 155416

SEQ ID NO: 607204 - RNA, 64 nt, hsa; identical to SEQ ID NO: 155417

SEQ ID NO: 607205 - RNA, 64 nt, hsa; identical to SEQ ID NO: 155418

SEQ ID NO: 607206 - RNA, 64 nt, hsa; identical to SEQ ID NO: 155419

SEQ ID NO: 607207 - RNA, 64 nt, hsa; identical to SEQ ID NO: 155420

SEQ ID NO: 607208 - RNA, 64 nt, hsa; identical to SEQ ID NO: 155421

SEQ ID NO: 607209 - RNA, 64 nt, hsa; identical to SEQ ID NO: 155422

SEQ ID NO: 607210 - RNA, 64 nt, hsa; identical to SEQ ID NO: 155423

SEQ ID NO: 607211 - RNA, 64 nt, hsa; identical to SEQ ID NO: 155424

SEQ ID NO: 607212 - RNA, 64 nt, hsa; identical to SEQ ID NO: 155425

SEQ ID NO: 607213 - RNA, 64 nt, hsa; identical to SEQ ID NO: 155426

SEQ ID NO: 607214 - RNA, 64 nt, hsa; identical to SEQ ID NO: 155427

SEQ ID NO: 607215 - RNA, 64 nt, hsa; identical to SEQ ID NO: 155428

SEQ ID NO: 607216 - RNA, 64 nt, hsa; identical to SEQ ID NO: 155429

SEQ ID NO: 607217 - RNA, 64 nt, hsa; identical to SEQ ID NO: 155430

SEQ ID NO: 607218 - RNA, 64 nt, hsa; identical to SEQ ID NO: 155431

SEQ ID NO: 607219 - RNA, 64 nt, hsa; identical to SEQ ID NO: 155432

SEQ ID NO: 607220 - RNA, 64 nt, hsa; identical to SEQ ID NO: 155433

SEQ ID NO: 607221 - RNA, 64 nt, hsa; identical to SEQ ID NO: 155434

SEQ ID NO: 607222 - RNA, 64 nt, hsa; identical to SEQ ID NO: 155435

SEQ ID NO: 607223 - RNA, 64 nt, hsa; identical to SEQ ID NO: 155436

SEQ ID NO: 607224 - RNA, 64 nt, hsa; identical to SEQ ID NO: 155437

SEQ ID NO: 607225 - RNA, 64 nt, hsa; identical to SEQ ID NO: 155438

SEQ ID NO: 607226 - RNA, 64 nt, hsa; identical to SEQ ID NO: 155439

SEQ ID NO: 607227 - RNA, 64 nt, hsa; identical to SEQ ID NO: 155440

SEQ ID NO: 607228 - RNA, 64 nt, hsa; identical to SEQ ID NO: 155441

SEQ ID NO: 607229 - RNA, 64 nt, hsa; identical to SEQ ID NO: 155442

SEQ ID NO: 607230 - RNA, 64 nt, hsa; identical to SEQ ID NO: 155443

SEQ ID NO: 607231 - RNA, 64 nt, hsa; identical to SEQ ID NO: 155444

SEQ ID NO: 607232 - RNA, 64 nt, hsa; identical to SEQ ID NO: 155445

SEQ ID NO: 607233 - RNA, 64 nt, hsa; identical to SEQ ID NO: 155446

SEQ ID NO: 607234 - RNA, 64 nt, hsa; identical to SEQ ID NO: 155447

SEQ ID NO: 607235 - RNA, 64 nt, hsa; identical to SEQ ID NO: 155448

SEQ ID NO: 607236 - RNA, 64 nt, hsa; identical to SEQ ID NO: 155449

SEQ ID NO: 607237 - RNA, 64 nt, hsa; identical to SEQ ID NO: 155450

SEQ ID NO: 607238 - RNA, 64 nt, hsa; identical to SEQ ID NO: 155451

SEQ ID NO: 607239 - RNA, 64 nt, hsa; identical to SEQ ID NO: 155452

SEQ ID NO: 607240 - RNA, 64 nt, hsa; identical to SEQ ID NO: 155453

SEQ ID NO: 607241 - RNA, 64 nt, hsa; identical to SEQ ID NO: 155454

SEQ ID NO: 607242 - RNA, 64 nt, hsa; identical to SEQ ID NO: 155455

SEQ ID NO: 607243 - RNA, 64 nt, hsa; identical to SEQ ID NO: 155456

SEQ ID NO: 607244 - RNA, 64 nt, hsa; identical to SEQ ID NO: 155457

SEQ ID NO: 607245 - RNA, 64 nt, hsa; identical to SEQ ID NO: 155458

SEQ ID NO: 607246 - RNA, 64 nt, hsa; identical to SEQ ID NO: 155459

SEQ ID NO: 607247 - RNA, 64 nt, hsa; identical to SEQ ID NO: 155460

SEQ ID NO: 607248 - RNA, 64 nt, hsa; identical to SEQ ID NO: 155461

SEQ ID NO: 607249 - RNA, 64 nt, hsa; identical to SEQ ID NO: 155462

SEQ ID NO: 607250 - RNA, 64 nt, hsa; identical to SEQ ID NO: 155463

SEQ ID NO: 607251 - RNA, 64 nt, hsa; identical to SEQ ID NO: 155464

SEQ ID NO: 607252 - RNA, 64 nt, hsa; identical to SEQ ID NO: 155465

SEQ ID NO: 607253 - RNA, 64 nt, hsa; identical to SEQ ID NO: 155466

SEQ ID NO: 607254 - RNA, 64 nt, hsa; identical to SEQ ID NO: 155467

SEQ ID NO: 607255 - RNA, 64 nt, hsa; identical to SEQ ID NO: 155468

SEQ ID NO: 607256 - RNA, 64 nt, hsa; identical to SEQ ID NO: 155469

SEQ ID NO: 607257 - RNA, 64 nt, hsa; identical to SEQ ID NO: 155470

SEQ ID NO: 607258 - RNA, 64 nt, hsa; identical to SEQ ID NO: 155471

SEQ ID NO: 607259 - RNA, 64 nt, hsa; identical to SEQ ID NO: 155472

SEQ ID NO: 607260 - RNA, 64 nt, hsa; identical to SEQ ID NO: 155473

SEQ ID NO: 607261 - RNA, 64 nt, hsa; identical to SEQ ID NO: 155474

SEQ ID NO: 607262 - RNA, 64 nt, hsa; identical to SEQ ID NO: 155475

SEQ ID NO: 607263 - RNA, 64 nt, hsa; identical to SEQ ID NO: 155476

SEQ ID NO: 607264 - RNA, 64 nt, hsa; identical to SEQ ID NO: 155477

SEQ ID NO: 607265 - RNA, 64 nt, hsa; identical to SEQ ID NO: 155478

SEQ ID NO: 607266 - RNA, 64 nt, hsa; identical to SEQ ID NO: 155479

SEQ ID NO: 607267 - RNA, 64 nt, hsa; identical to SEQ ID NO: 155480

SEQ ID NO: 607268 - RNA, 64 nt, hsa; identical to SEQ ID NO: 155481

SEQ ID NO: 607269 - RNA, 64 nt, hsa; identical to SEQ ID NO: 155482

SEQ ID NO: 607270 - RNA, 64 nt, hsa; identical to SEQ ID NO: 155483

SEQ ID NO: 607271 - RNA, 64 nt, hsa; identical to SEQ ID NO: 155484

SEQ ID NO: 607272 - RNA, 64 nt, hsa; identical to SEQ ID NO: 155485

SEQ ID NO: 607273 - RNA, 64 nt, hsa; identical to SEQ ID NO: 155486

SEQ ID NO: 607274 - RNA, 64 nt, hsa; identical to SEQ ID NO: 155487

SEQ ID NO: 607275 - RNA, 64 nt, hsa; identical to SEQ ID NO: 155488

SEQ ID NO: 607276 - RNA, 64 nt, hsa
acuguuuucugcuuuuacagcagcuucucucccacaccacaacuuuauuaagguauaguggaua

SEQ ID NO: 607277 - RNA, 64 nt, hsa
uacaacuugauauguguauauacaguaaaguguucaccacaagcaagccaauuaacauauccuc

SEQ ID NO: 607278 - RNA, 64 nt, hsa
ggccucccaaacuggugagauuacaggcaugagccaccacaacuggccugaaauucuuaaagga

SEQ ID NO: 607279 - RNA, 64 nt, hsa
cucagccucccaaauaacuggggccacaggugugcaccacaacucucagcuaauuuuuaaaauu

SEQ ID NO: 607280 - RNA, 64 nt, hsa
aagcaaccucagcaguucccaucaaggccaccuccaccacaaccgaaaguaucaucucagggaa

SEQ ID NO: 607281 - RNA, 64 nt, hsa
agccuuucuguugcaacuaugaaugaaaacaaaacaccacaaaacagacuucacuaacacagaa

SEQ ID NO: 607282 - RNA, 64 nt, hsa
ugcacacaggaucacucacauauguacauguacccaccacaaacgugcaagcuccugcacacau

SEQ ID NO: 607283 - RNA, 64 nt, hsa
ugcagccuccugcacacgugcacauucauguguacaccacaaaugaguucccagacguguaaac

SEQ ID NO: 607284 - RNA, 64 nt, hsa
cgcacaggcuccuacacacaugcacacacguguacaccacaaacgagcucccagacauguaaac

SEQ ID NO: 607285 - RNA, 64 nt, hsa
cgugagcucccacacguacacaugcacauguacgcaccacaaacacaugcgcaggcuccugcag

SEQ ID NO: 607286 - RNA, 64 nt, hsa; identical to SEQ ID NO: 124148

SEQ ID NO: 607287 - RNA, 64 nt, hsa; identical to SEQ ID NO: 124149

SEQ ID NO: 607288 - RNA, 64 nt, hsa; identical to SEQ ID NO: 124150

SEQ ID NO: 607289 - RNA, 64 nt, hsa; identical to SEQ ID NO: 124151

SEQ ID NO: 607290 - RNA, 64 nt, hsa; identical to SEQ ID NO: 124152

SEQ ID NO: 607291 - RNA, 64 nt, hsa; identical to SEQ ID NO: 124153

SEQ ID NO: 607292 - RNA, 64 nt, hsa; identical to SEQ ID NO: 124154

SEQ ID NO: 607293 - RNA, 64 nt, hsa; identical to SEQ ID NO: 124155

SEQ ID NO: 607294 - RNA, 64 nt, hsa; identical to SEQ ID NO: 124156

SEQ ID NO: 607295 - RNA, 64 nt, hsa; identical to SEQ ID NO: 124157

SEQ ID NO: 607296 - RNA, 64 nt, hsa; identical to SEQ ID NO: 124158

SEQ ID NO: 607297 - RNA, 64 nt, hsa; identical to SEQ ID NO: 124159

SEQ ID NO: 607298 - RNA, 64 nt, hsa; identical to SEQ ID NO: 124160

SEQ ID NO: 607299 - RNA, 64 nt, hsa; identical to SEQ ID NO: 124161

SEQ ID NO: 607300 - RNA, 64 nt, hsa; identical to SEQ ID NO: 124162

SEQ ID NO: 607301 - RNA, 64 nt, hsa; identical to SEQ ID NO: 124163

SEQ ID NO: 607302 - RNA, 64 nt, hsa; identical to SEQ ID NO: 124164

SEQ ID NO: 607303 - RNA, 64 nt, hsa; identical to SEQ ID NO: 124165

SEQ ID NO: 607304 - RNA, 64 nt, hsa; identical to SEQ ID NO: 124166

SEQ ID NO: 607305 - RNA, 64 nt, hsa; identical to SEQ ID NO: 124167

SEQ ID NO: 607306 - RNA, 64 nt, hsa; identical to SEQ ID NO: 124168

SEQ ID NO: 607307 - RNA, 64 nt, hsa; identical to SEQ ID NO: 124169

SEQ ID NO: 607308 - RNA, 64 nt, hsa; identical to SEQ ID NO: 124170

SEQ ID NO: 607309 - RNA, 64 nt, hsa; identical to SEQ ID NO: 124171

SEQ ID NO: 607310 - RNA, 64 nt, hsa; identical to SEQ ID NO: 124172

SEQ ID NO: 607311 - RNA, 64 nt, hsa; identical to SEQ ID NO: 124173

SEQ ID NO: 607312 - RNA, 64 nt, hsa; identical to SEQ ID NO: 124174

SEQ ID NO: 607313 - RNA, 64 nt, hsa; identical to SEQ ID NO: 124175

SEQ ID NO: 607314 - RNA, 64 nt, hsa; identical to SEQ ID NO: 124176

SEQ ID NO: 607315 - RNA, 64 nt, hsa; identical to SEQ ID NO: 124177

SEQ ID NO: 607316 - RNA, 62 nt, hsa; identical to SEQ ID NO: 124178

SEQ ID NO: 607317 - RNA, 64 nt, hsa; identical to SEQ ID NO: 124179

SEQ ID NO: 607318 - RNA, 64 nt, hsa; identical to SEQ ID NO: 124180

SEQ ID NO: 607319 - RNA, 64 nt, hsa; identical to SEQ ID NO: 124181

SEQ ID NO: 607320 - RNA, 64 nt, hsa; identical to SEQ ID NO: 124182

SEQ ID NO: 607321 - RNA, 64 nt, hsa; identical to SEQ ID NO: 124183

SEQ ID NO: 607322 - RNA, 64 nt, hsa; identical to SEQ ID NO: 124184

SEQ ID NO: 607323 - RNA, 64 nt, hsa; identical to SEQ ID NO: 124185

SEQ ID NO: 607324 - RNA, 64 nt, hsa; identical to SEQ ID NO: 124186

SEQ ID NO: 607325 - RNA, 64 nt, hsa; identical to SEQ ID NO: 124187

SEQ ID NO: 607326 - RNA, 60 nt, hsa; identical to SEQ ID NO: 124188

SEQ ID NO: 607327 - RNA, 64 nt, hsa; identical to SEQ ID NO: 124189

SEQ ID NO: 607328 - RNA, 64 nt, hsa; identical to SEQ ID NO: 124190

SEQ ID NO: 607329 - RNA, 64 nt, hsa; identical to SEQ ID NO: 124191

SEQ ID NO: 607330 - RNA, 64 nt, hsa; identical to SEQ ID NO: 124192

SEQ ID NO: 607331 - RNA, 64 nt, hsa; identical to SEQ ID NO: 124193

SEQ ID NO: 607332 - RNA, 64 nt, hsa; identical to SEQ ID NO: 124194

SEQ ID NO: 607333 - RNA, 64 nt, hsa; identical to SEQ ID NO: 124195

SEQ ID NO: 607334 - RNA, 64 nt, hsa; identical to SEQ ID NO: 124196

SEQ ID NO: 607335 - RNA, 64 nt, hsa; identical to SEQ ID NO: 124197

SEQ ID NO: 607336 - RNA, 64 nt, hsa; identical to SEQ ID NO: 124198

SEQ ID NO: 607337 - RNA, 64 nt, hsa; identical to SEQ ID NO: 124199

SEQ ID NO: 607338 - RNA, 64 nt, hsa; identical to SEQ ID NO: 124200

SEQ ID NO: 607339 - RNA, 64 nt, hsa; identical to SEQ ID NO: 124201

SEQ ID NO: 607340 - RNA, 64 nt, hsa; identical to SEQ ID NO: 124202

SEQ ID NO: 607341 - RNA, 64 nt, hsa; identical to SEQ ID NO: 124203

SEQ ID NO: 607342 - RNA, 64 nt, hsa; identical to SEQ ID NO: 124204

SEQ ID NO: 607343 - RNA, 64 nt, hsa; identical to SEQ ID NO: 124205

SEQ ID NO: 607344 - RNA, 64 nt, hsa; identical to SEQ ID NO: 124206

SEQ ID NO: 607345 - RNA, 64 nt, hsa; identical to SEQ ID NO: 124207

SEQ ID NO: 607346 - RNA, 64 nt, hsa; identical to SEQ ID NO: 124208

SEQ ID NO: 607347 - RNA, 64 nt, hsa; identical to SEQ ID NO: 124209

SEQ ID NO: 607348 - RNA, 64 nt, hsa; identical to SEQ ID NO: 124210

SEQ ID NO: 607349 - RNA, 64 nt, hsa; identical to SEQ ID NO: 124211

SEQ ID NO: 607350 - RNA, 64 nt, hsa; identical to SEQ ID NO: 124212

SEQ ID NO: 607351 - RNA, 64 nt, hsa; identical to SEQ ID NO: 124213

SEQ ID NO: 607352 - RNA, 64 nt, hsa; identical to SEQ ID NO: 124214

SEQ ID NO: 607353 - RNA, 64 nt, hsa; identical to SEQ ID NO: 124215

SEQ ID NO: 607354 - RNA, 64 nt, hsa; identical to SEQ ID NO: 124216

SEQ ID NO: 607355 - RNA, 64 nt, hsa; identical to SEQ ID NO: 87818

SEQ ID NO: 607356 - RNA, 64 nt, hsa; identical to SEQ ID NO: 87819

SEQ ID NO: 607357 - RNA, 64 nt, hsa; identical to SEQ ID NO: 87820

SEQ ID NO: 607358 - RNA, 64 nt, hsa; identical to SEQ ID NO: 87821

SEQ ID NO: 607359 - RNA, 64 nt, hsa; identical to SEQ ID NO: 87822

SEQ ID NO: 607360 - RNA, 64 nt, hsa; identical to SEQ ID NO: 87823

SEQ ID NO: 607361 - RNA, 64 nt, hsa; identical to SEQ ID NO: 87824

SEQ ID NO: 607362 - RNA, 64 nt, hsa; identical to SEQ ID NO: 87825

SEQ ID NO: 607363 - RNA, 64 nt, hsa; identical to SEQ ID NO: 87826

SEQ ID NO: 607364 - RNA, 64 nt, hsa; identical to SEQ ID NO: 87827

SEQ ID NO: 607365 - RNA, 64 nt, hsa; identical to SEQ ID NO: 87828

SEQ ID NO: 607366 - RNA, 64 nt, hsa; identical to SEQ ID NO: 87829

SEQ ID NO: 607367 - RNA, 64 nt, hsa; identical to SEQ ID NO: 87830

SEQ ID NO: 607368 - RNA, 64 nt, hsa; identical to SEQ ID NO: 87831

SEQ ID NO: 607369 - RNA, 64 nt, hsa; identical to SEQ ID NO: 87832

SEQ ID NO: 607370 - RNA, 64 nt, hsa; identical to SEQ ID NO: 87833

SEQ ID NO: 607371 - RNA, 64 nt, hsa; identical to SEQ ID NO: 87834

SEQ ID NO: 607372 - RNA, 64 nt, hsa; identical to SEQ ID NO: 87835

SEQ ID NO: 607373 - RNA, 64 nt, hsa; identical to SEQ ID NO: 87836

SEQ ID NO: 607374 - RNA, 64 nt, hsa; identical to SEQ ID NO: 87837

SEQ ID NO: 607375 - RNA, 64 nt, hsa; identical to SEQ ID NO: 87838

SEQ ID NO: 607376 - RNA, 64 nt, hsa; identical to SEQ ID NO: 87839

SEQ ID NO: 607377 - RNA, 64 nt, hsa; identical to SEQ ID NO: 87840

SEQ ID NO: 607378 - RNA, 64 nt, hsa; identical to SEQ ID NO: 87841

SEQ ID NO: 607379 - RNA, 64 nt, hsa; identical to SEQ ID NO: 87842

SEQ ID NO: 607380 - RNA, 64 nt, hsa; identical to SEQ ID NO: 87843

SEQ ID NO: 607381 - RNA, 64 nt, hsa; identical to SEQ ID NO: 87844

SEQ ID NO: 607382 - RNA, 64 nt, hsa; identical to SEQ ID NO: 87845

SEQ ID NO: 607383 - RNA, 64 nt, hsa; identical to SEQ ID NO: 87846

SEQ ID NO: 607384 - RNA, 64 nt, hsa; identical to SEQ ID NO: 87847

SEQ ID NO: 607385 - RNA, 64 nt, hsa; identical to SEQ ID NO: 87848

SEQ ID NO: 607386 - RNA, 64 nt, hsa; identical to SEQ ID NO: 87849

SEQ ID NO: 607387 - RNA, 64 nt, hsa; identical to SEQ ID NO: 87850

SEQ ID NO: 607388 - RNA, 64 nt, hsa; identical to SEQ ID NO: 87851

SEQ ID NO: 607389 - RNA, 64 nt, hsa; identical to SEQ ID NO: 246998

SEQ ID NO: 607390 - RNA, 64 nt, hsa; identical to SEQ ID NO: 246999

SEQ ID NO: 607391 - RNA, 64 nt, hsa; identical to SEQ ID NO: 247000

SEQ ID NO: 607392 - RNA, 64 nt, hsa; identical to SEQ ID NO: 247001

SEQ ID NO: 607393 - RNA, 64 nt, hsa; identical to SEQ ID NO: 247002

SEQ ID NO: 607394 - RNA, 64 nt, hsa; identical to SEQ ID NO: 247003

SEQ ID NO: 607395 - RNA, 64 nt, hsa; identical to SEQ ID NO: 247004

SEQ ID NO: 607396 - RNA, 64 nt, hsa; identical to SEQ ID NO: 247005

SEQ ID NO: 607397 - RNA, 64 nt, hsa; identical to SEQ ID NO: 247006

SEQ ID NO: 607398 - RNA, 64 nt, hsa; identical to SEQ ID NO: 247007

SEQ ID NO: 607399 - RNA, 64 nt, hsa; identical to SEQ ID NO: 247008

SEQ ID NO: 607400 - RNA, 64 nt, hsa; identical to SEQ ID NO: 247009

SEQ ID NO: 607401 - RNA, 64 nt, hsa; identical to SEQ ID NO: 247010

SEQ ID NO: 607402 - RNA, 64 nt, hsa; identical to SEQ ID NO: 247011

SEQ ID NO: 607403 - RNA, 64 nt, hsa; identical to SEQ ID NO: 283135

SEQ ID NO: 607404 - RNA, 64 nt, hsa; identical to SEQ ID NO: 283136

SEQ ID NO: 607405 - RNA, 64 nt, hsa; identical to SEQ ID NO: 283137

SEQ ID NO: 607406 - RNA, 64 nt, hsa; identical to SEQ ID NO: 283138

SEQ ID NO: 607407 - RNA, 64 nt, hsa; identical to SEQ ID NO: 283139

SEQ ID NO: 607408 - RNA, 64 nt, hsa; identical to SEQ ID NO: 283140

SEQ ID NO: 607409 - RNA, 64 nt, hsa; identical to SEQ ID NO: 283141

SEQ ID NO: 607410 - RNA, 64 nt, hsa; identical to SEQ ID NO: 283142

SEQ ID NO: 607411 - RNA, 64 nt, hsa; identical to SEQ ID NO: 283143

SEQ ID NO: 607412 - RNA, 64 nt, hsa; identical to SEQ ID NO: 283144

SEQ ID NO: 607413 - RNA, 64 nt, hsa; identical to SEQ ID NO: 283145

SEQ ID NO: 607414 - RNA, 64 nt, hsa; identical to SEQ ID NO: 283146

SEQ ID NO: 607415 - RNA, 64 nt, hsa; identical to SEQ ID NO: 283147

SEQ ID NO: 607416 - RNA, 64 nt, hsa; identical to SEQ ID NO: 283148

SEQ ID NO: 607417 - RNA, 64 nt, hsa; identical to SEQ ID NO: 283149

SEQ ID NO: 607418 - RNA, 64 nt, hsa; identical to SEQ ID NO: 283150

SEQ ID NO: 607419 - RNA, 64 nt, hsa; identical to SEQ ID NO: 283151

SEQ ID NO: 607420 - RNA, 64 nt, hsa; identical to SEQ ID NO: 283152

SEQ ID NO: 607421 - RNA, 64 nt, hsa; identical to SEQ ID NO: 283153

SEQ ID NO: 607422 - RNA, 64 nt, hsa; identical to SEQ ID NO: 283154

SEQ ID NO: 607423 - RNA, 64 nt, hsa; identical to SEQ ID NO: 283155

SEQ ID NO: 607424 - RNA, 64 nt, hsa; identical to SEQ ID NO: 283156

SEQ ID NO: 607425 - RNA, 64 nt, hsa; identical to SEQ ID NO: 283157

SEQ ID NO: 607426 - RNA, 64 nt, hsa; identical to SEQ ID NO: 283158

SEQ ID NO: 607427 - RNA, 64 nt, hsa; identical to SEQ ID NO: 283159

SEQ ID NO: 607428 - RNA, 64 nt, hsa; identical to SEQ ID NO: 283160

SEQ ID NO: 607429 - RNA, 64 nt, hsa; identical to SEQ ID NO: 283161

SEQ ID NO: 607430 - RNA, 64 nt, hsa; identical to SEQ ID NO: 283162

SEQ ID NO: 607431 - RNA, 64 nt, hsa; identical to SEQ ID NO: 283163

SEQ ID NO: 607432 - RNA, 64 nt, hsa; identical to SEQ ID NO: 283164

SEQ ID NO: 607433 - RNA, 64 nt, hsa; identical to SEQ ID NO: 283165

SEQ ID NO: 607434 - RNA, 64 nt, hsa; identical to SEQ ID NO: 283166

SEQ ID NO: 607435 - RNA, 64 nt, hsa; identical to SEQ ID NO: 283167

SEQ ID NO: 607436 - RNA, 64 nt, hsa
cacuccagcgugggcgacagcaagagacuucauuucgauaaauaaguaaauaaauaaauaaagu

SEQ ID NO: 607437 - RNA, 64 nt, hsa
auucaacuuucauggacugccccuggcaagguccucgauaaaggaagagguaaguuugacauua

SEQ ID NO: 607438 - RNA, 64 nt, hsa
gauggacagguuucuuuucuguggcuuuuuccuuucgauaaaccaucagauuucaguaguacau

SEQ ID NO: 607439 - RNA, 64 nt, hsa
gcuucagaaguccauagcccagcucugaacuuucucgauaaaaugccaucaguucaccuuuaaa

SEQ ID NO: 607440 - RNA, 64 nt, hsa
ucuguuaauaugucagaauguaagauuuggcaacucgauaaauuuuuuucauuuucuuuuccaa

SEQ ID NO: 607441 - RNA, 64 nt, hsa
cacuuuuaauuguuacucauuuuauucacuaagcucgauaaaucuaacaguuacucuuaaaaaa

SEQ ID NO: 607442 - RNA, 53 nt, hsa
aagauggaaauggacaguaaguuucgauaaauaauuguugcaucacagaaggg

SEQ ID NO: 607443 - RNA, 64 nt, hsa
ccuuuuuagaaauccaguuuuaguuuugucauuuucgauaaaucuuucuucaguuagaaauaua

SEQ ID NO: 607444 - RNA, 64 nt, hsa
ugaauuuagaaucacuuaaagcuuuuauaaagaaucgauaaauucaccuguauuuguuguuaga

SEQ ID NO: 607445 - RNA, 64 nt, hsa
cauuguuacgucacuuuucuauaguuuugagaguucgauaaaagccauuaaagauauguaucuc

SEQ ID NO: 607446 - RNA, 64 nt, hsa
uugguaguauuaauuuuguggucauuguuucucuucgauaaauuuauuuucauuaaauacuugu

SEQ ID NO: 607447 - RNA, 64 nt, hsa
gaccacaaaagggaacaagcaaaaaaguuuggauucgauaaagugauauguaauaguugcagaa

SEQ ID NO: 607448 - RNA, 64 nt, hsa
ucagaauuauuaauuaucgugucugcauuuucuuucgauaaaggaagacacacgaugcuaaucc

SEQ ID NO: 607449 - RNA, 64 nt, hsa
uuuaacauacaaucaugugaaauuuaggcagaguucgauaaauuacuggcaaaaacaaaacucu

SEQ ID NO: 607450 - RNA, 64 nt, hsa
cguuaaccaauauaucuauagcuuuagauuauauucgauaaaaguaauuggacuuuuuuucuuu

SEQ ID NO: 607451 - RNA, 64 nt, hsa
acuguguaaacuuuuuuuuaacaaaauguaucauucgauaaagugaauuuuaaaaaaguuacau

SEQ ID NO: 607452 - RNA, 64 nt, hsa
uagaguaaaaaucauugaaauugaaaagagaaaaucgauaaaacccaaaacugguuccuugaaa

SEQ ID NO: 607453 - RNA, 64 nt, hsa
auauaccuguugaguuuugagugcacccaaacacucgauaaaccaggugaagaaauuuagcuuc

SEQ ID NO: 607454 - RNA, 64 nt, hsa
uuaaucuacuuaaccuggcccccucuaacaugagucgauaaauguuguccuacucaccgguggu

SEQ ID NO: 607455 - RNA, 64 nt, hsa
gugaugaugccaguauuuggcgcugggaucgacuucgauaaaauacuuuugccuaaucaaaauu

SEQ ID NO: 607456 - RNA, 64 nt, hsa
gggccgugauagaauuaagugauuugauguccucucgauaaauccagguaacgacauaggguuu

SEQ ID NO: 607457 - RNA, 64 nt, hsa
acuugucauucaguaauauuagcagauagcugcuucgauaaaggaauuuggaguuuaaaaauca

SEQ ID NO: 607458 - RNA, 64 nt, hsa
acuuccccacauuuccugcuugccaguaaagccuucgauaaacgcuugugucgggagucgguga

SEQ ID NO: 607459 - RNA, 64 nt, hsa
uacaccuuuucaauuguggcaauaauugaaagaaucgauaaaaguucaucuuuggacagaaagc

SEQ ID NO: 607460 - RNA, 64 nt, hsa
ucuccccgggaaucucuaacaugcucuguuuacaucgauaaaugcacuuaaggaaaacaaacaa

SEQ ID NO: 607461 - RNA, 64 nt, hsa
uuuaaauuguacagcaaggugcucuaaguaauauucgauaaaauauauuuaauagaaauuugcg

SEQ ID NO: 607462 - RNA, 64 nt, hsa
ucauaaugcuuugugaggauuaaaugaauuaagaucgauaaagugcuuagaauugugccugaca

SEQ ID NO: 607463 - RNA, 64 nt, hsa
cugagugugaggcaccugaaguuucccugcggagucgauaaauuagcagaaccacauccccauc

SEQ ID NO: 607464 - RNA, 64 nt, hsa
uuuggagagucagaucuuucuccuugaauaucuuucgauaaacaacaagguggugugaucuuaa

SEQ ID NO: 607465 - RNA, 64 nt, hsa
gguggcaaaugaauuuaucauuuuaguauaguuuucgauaaaggauauagcaacaucuuuugau

SEQ ID NO: 607466 - RNA, 64 nt, hsa
cuuggguguuagugaggcugauaugucaugucaaucgauaaacccuacuuuccaaauuaucuaa

SEQ ID NO: 607467 - RNA, 64 nt, hsa
uugauuuuuucuuuuauauuauaaagcaauugcaucgauaaaagcuuggacuccauuuuagugu

SEQ ID NO: 607468 - RNA, 64 nt, hsa
ucugucccauccuucccaagaagagagaacuuuuucgauaaacuaacuacuguagaagaaguga

SEQ ID NO: 607469 - RNA, 64 nt, hsa
acaugugcugcccuacagcacccuguggucuuccucgauaaagggaaccacuuucuuauuuuuu

SEQ ID NO: 607470 - RNA, 64 nt, hsa; identical to SEQ ID NO: 68768

SEQ ID NO: 607471 - RNA, 64 nt, hsa; identical to SEQ ID NO: 68769

SEQ ID NO: 607472 - RNA, 64 nt, hsa; identical to SEQ ID NO: 68770

SEQ ID NO: 607473 - RNA, 64 nt, hsa; identical to SEQ ID NO: 68771

SEQ ID NO: 607474 - RNA, 64 nt, hsa; identical to SEQ ID NO: 68772

SEQ ID NO: 607475 - RNA, 64 nt, hsa; identical to SEQ ID NO: 68773

SEQ ID NO: 607476 - RNA, 64 nt, hsa; identical to SEQ ID NO: 68774

SEQ ID NO: 607477 - RNA, 64 nt, hsa; identical to SEQ ID NO: 68775

SEQ ID NO: 607478 - RNA, 64 nt, hsa; identical to SEQ ID NO: 68776

SEQ ID NO: 607479 - RNA, 64 nt, hsa; identical to SEQ ID NO: 68777

SEQ ID NO: 607480 - RNA, 64 nt, hsa; identical to SEQ ID NO: 68778

SEQ ID NO: 607481 - RNA, 64 nt, hsa; identical to SEQ ID NO: 68779

SEQ ID NO: 607482 - RNA, 64 nt, hsa; identical to SEQ ID NO: 68780

SEQ ID NO: 607483 - RNA, 64 nt, hsa; identical to SEQ ID NO: 68781

SEQ ID NO: 607484 - RNA, 64 nt, hsa; identical to SEQ ID NO: 68782

SEQ ID NO: 607485 - RNA, 64 nt, hsa; identical to SEQ ID NO: 68783

SEQ ID NO: 607486 - RNA, 64 nt, hsa; identical to SEQ ID NO: 68784

SEQ ID NO: 607487 - RNA, 64 nt, hsa; identical to SEQ ID NO: 68785

SEQ ID NO: 607488 - RNA, 64 nt, hsa; identical to SEQ ID NO: 68786

SEQ ID NO: 607489 - RNA, 64 nt, hsa; identical to SEQ ID NO: 68787

SEQ ID NO: 607490 - RNA, 64 nt, hsa; identical to SEQ ID NO: 68788

SEQ ID NO: 607491 - RNA, 64 nt, hsa; identical to SEQ ID NO: 68789

SEQ ID NO: 607492 - RNA, 64 nt, hsa; identical to SEQ ID NO: 68790

SEQ ID NO: 607493 - RNA, 64 nt, hsa; identical to SEQ ID NO: 68791

SEQ ID NO: 607494 - RNA, 64 nt, hsa; identical to SEQ ID NO: 68792

SEQ ID NO: 607495 - RNA, 64 nt, hsa; identical to SEQ ID NO: 68793

SEQ ID NO: 607496 - RNA, 64 nt, hsa; identical to SEQ ID NO: 68794

SEQ ID NO: 607497 - RNA, 64 nt, hsa; identical to SEQ ID NO: 68795

SEQ ID NO: 607498 - RNA, 64 nt, hsa; identical to SEQ ID NO: 68796

SEQ ID NO: 607499 - RNA, 64 nt, hsa; identical to SEQ ID NO: 68797

SEQ ID NO: 607500 - RNA, 64 nt, hsa; identical to SEQ ID NO: 68798

SEQ ID NO: 607501 - RNA, 64 nt, hsa; identical to SEQ ID NO: 68799

SEQ ID NO: 607502 - RNA, 64 nt, hsa; identical to SEQ ID NO: 68800

SEQ ID NO: 607503 - RNA, 64 nt, hsa; identical to SEQ ID NO: 68801

SEQ ID NO: 607504 - RNA, 59 nt, hsa; identical to SEQ ID NO: 68802

SEQ ID NO: 607505 - RNA, 64 nt, hsa; identical to SEQ ID NO: 68803

SEQ ID NO: 607506 - RNA, 64 nt, hsa; identical to SEQ ID NO: 68804

SEQ ID NO: 607507 - RNA, 64 nt, hsa; identical to SEQ ID NO: 68805

SEQ ID NO: 607508 - RNA, 64 nt, hsa; identical to SEQ ID NO: 68806

SEQ ID NO: 607509 - RNA, 64 nt, hsa; identical to SEQ ID NO: 68807

SEQ ID NO: 607510 - RNA, 64 nt, hsa; identical to SEQ ID NO: 68808

SEQ ID NO: 607511 - RNA, 64 nt, hsa; identical to SEQ ID NO: 68809

SEQ ID NO: 607512 - RNA, 64 nt, hsa; identical to SEQ ID NO: 68810

SEQ ID NO: 607513 - RNA, 64 nt, hsa; identical to SEQ ID NO: 68811

SEQ ID NO: 607514 - RNA, 64 nt, hsa; identical to SEQ ID NO: 68812

SEQ ID NO: 607515 - RNA, 64 nt, hsa; identical to SEQ ID NO: 200816

SEQ ID NO: 607516 - RNA, 64 nt, hsa; identical to SEQ ID NO: 200817

SEQ ID NO: 607517 - RNA, 64 nt, hsa; identical to SEQ ID NO: 200818

SEQ ID NO: 607518 - RNA, 64 nt, hsa; identical to SEQ ID NO: 200819

SEQ ID NO: 607519 - RNA, 64 nt, hsa; identical to SEQ ID NO: 200820

SEQ ID NO: 607520 - RNA, 64 nt, hsa; identical to SEQ ID NO: 200821

SEQ ID NO: 607521 - RNA, 64 nt, hsa; identical to SEQ ID NO: 200822

SEQ ID NO: 607522 - RNA, 64 nt, hsa; identical to SEQ ID NO: 200823

SEQ ID NO: 607523 - RNA, 64 nt, hsa; identical to SEQ ID NO: 200824

SEQ ID NO: 607524 - RNA, 64 nt, hsa; identical to SEQ ID NO: 200825

SEQ ID NO: 607525 - RNA, 64 nt, hsa; identical to SEQ ID NO: 200826

SEQ ID NO: 607526 - RNA, 64 nt, hsa; identical to SEQ ID NO: 200827

SEQ ID NO: 607527 - RNA, 64 nt, hsa; identical to SEQ ID NO: 583005

SEQ ID NO: 607528 - RNA, 64 nt, hsa; identical to SEQ ID NO: 583006

SEQ ID NO: 607529 - RNA, 64 nt, hsa; identical to SEQ ID NO: 583007

SEQ ID NO: 607530 - RNA, 64 nt, hsa; identical to SEQ ID NO: 583008

SEQ ID NO: 607531 - RNA, 64 nt, hsa; identical to SEQ ID NO: 583009

SEQ ID NO: 607532 - RNA, 64 nt, hsa; identical to SEQ ID NO: 583010

SEQ ID NO: 607533 - RNA, 64 nt, hsa; identical to SEQ ID NO: 583011

SEQ ID NO: 607534 - RNA, 64 nt, hsa; identical to SEQ ID NO: 583012

SEQ ID NO: 607535 - RNA, 64 nt, hsa; identical to SEQ ID NO: 583013

SEQ ID NO: 607536 - RNA, 64 nt, hsa; identical to SEQ ID NO: 583014

SEQ ID NO: 607537 - RNA, 64 nt, hsa; identical to SEQ ID NO: 583015

SEQ ID NO: 607538 - RNA, 64 nt, hsa; identical to SEQ ID NO: 583016

SEQ ID NO: 607539 - RNA, 64 nt, hsa; identical to SEQ ID NO: 583017

SEQ ID NO: 607540 - RNA, 64 nt, hsa; identical to SEQ ID NO: 583018

SEQ ID NO: 607541 - RNA, 64 nt, hsa; identical to SEQ ID NO: 583019

SEQ ID NO: 607542 - RNA, 64 nt, hsa; identical to SEQ ID NO: 583020

SEQ ID NO: 607543 - RNA, 64 nt, hsa; identical to SEQ ID NO: 583021

SEQ ID NO: 607544 - RNA, 64 nt, hsa; identical to SEQ ID NO: 583022

SEQ ID NO: 607545 - RNA, 64 nt, hsa; identical to SEQ ID NO: 583023

SEQ ID NO: 607546 - RNA, 64 nt, hsa; identical to SEQ ID NO: 583024

SEQ ID NO: 607547 - RNA, 64 nt, hsa; identical to SEQ ID NO: 583025

SEQ ID NO: 607548 - RNA, 64 nt, hsa; identical to SEQ ID NO: 583026

SEQ ID NO: 607549 - RNA, 64 nt, hsa; identical to SEQ ID NO: 583027

SEQ ID NO: 607550 - RNA, 64 nt, hsa; identical to SEQ ID NO: 583028

SEQ ID NO: 607551 - RNA, 64 nt, hsa; identical to SEQ ID NO: 583029

SEQ ID NO: 607552 - RNA, 64 nt, hsa; identical to SEQ ID NO: 583030

SEQ ID NO: 607553 - RNA, 64 nt, hsa; identical to SEQ ID NO: 583031

SEQ ID NO: 607554 - RNA, 64 nt, hsa; identical to SEQ ID NO: 583032

SEQ ID NO: 607555 - RNA, 64 nt, hsa; identical to SEQ ID NO: 583033

SEQ ID NO: 607556 - RNA, 64 nt, hsa; identical to SEQ ID NO: 583034

SEQ ID NO: 607557 - RNA, 64 nt, hsa; identical to SEQ ID NO: 583035

SEQ ID NO: 607558 - RNA, 64 nt, hsa; identical to SEQ ID NO: 583036

SEQ ID NO: 607559 - RNA, 64 nt, hsa; identical to SEQ ID NO: 583037

SEQ ID NO: 607560 - RNA, 64 nt, hsa; identical to SEQ ID NO: 583038

SEQ ID NO: 607561 - RNA, 64 nt, hsa; identical to SEQ ID NO: 583039

SEQ ID NO: 607562 - RNA, 64 nt, hsa; identical to SEQ ID NO: 583040

SEQ ID NO: 607563 - RNA, 64 nt, hsa; identical to SEQ ID NO: 583041

SEQ ID NO: 607564 - RNA, 64 nt, hsa; identical to SEQ ID NO: 583042

SEQ ID NO: 607565 - RNA, 64 nt, hsa; identical to SEQ ID NO: 583043

SEQ ID NO: 607566 - RNA, 64 nt, hsa; identical to SEQ ID NO: 583044

SEQ ID NO: 607567 - RNA, 64 nt, hsa; identical to SEQ ID NO: 583045

SEQ ID NO: 607568 - RNA, 64 nt, hsa; identical to SEQ ID NO: 583046

SEQ ID NO: 607569 - RNA, 64 nt, hsa; identical to SEQ ID NO: 583047

SEQ ID NO: 607570 - RNA, 64 nt, hsa; identical to SEQ ID NO: 583048

SEQ ID NO: 607571 - RNA, 64 nt, hsa; identical to SEQ ID NO: 583049

SEQ ID NO: 607572 - RNA, 64 nt, hsa; identical to SEQ ID NO: 583050

SEQ ID NO: 607573 - RNA, 64 nt, hsa; identical to SEQ ID NO: 583051

SEQ ID NO: 607574 - RNA, 64 nt, hsa; identical to SEQ ID NO: 583052

SEQ ID NO: 607575 - RNA, 64 nt, hsa; identical to SEQ ID NO: 583053

SEQ ID NO: 607576 - RNA, 64 nt, hsa; identical to SEQ ID NO: 583054

SEQ ID NO: 607577 - RNA, 64 nt, hsa; identical to SEQ ID NO: 583055

SEQ ID NO: 607578 - RNA, 64 nt, hsa; identical to SEQ ID NO: 583056

SEQ ID NO: 607579 - RNA, 64 nt, hsa; identical to SEQ ID NO: 583057

SEQ ID NO: 607580 - RNA, 64 nt, hsa; identical to SEQ ID NO: 583058

SEQ ID NO: 607581 - RNA, 64 nt, hsa; identical to SEQ ID NO: 583059

SEQ ID NO: 607582 - RNA, 64 nt, hsa; identical to SEQ ID NO: 583060

SEQ ID NO: 607583 - RNA, 64 nt, hsa; identical to SEQ ID NO: 583061

SEQ ID NO: 607584 - RNA, 64 nt, hsa; identical to SEQ ID NO: 583062

SEQ ID NO: 607585 - RNA, 64 nt, hsa; identical to SEQ ID NO: 583063

SEQ ID NO: 607586 - RNA, 64 nt, hsa; identical to SEQ ID NO: 583064

SEQ ID NO: 607587 - RNA, 64 nt, hsa; identical to SEQ ID NO: 583065

SEQ ID NO: 607588 - RNA, 62 nt, hsa
guaacaguuauuucaggauauuuuguuucuuuaaucugcacacuuucuagauagauuuuauu

SEQ ID NO: 607589 - RNA, 62 nt, hsa
gagcucagagaagcuccgugggccuguuucccaaucugcaaagugugaagggauuagauggg

SEQ ID NO: 607590 - RNA, 62 nt, hsa
ccuguggccucugagaccgccccauuuacaggaaucugcacugggucucagugaaugaacgu

SEQ ID NO: 607591 - RNA, 62 nt, hsa
ugauucauuccugagaauggcuuaguccugagaaucugcaaagucucugaagagaacucucu

SEQ ID NO: 607592 - RNA, 62 nt, hsa
uguuuuugucucaagaacaagaauaaaauugaaaucugcauucaugccaauucagcauaaaa

SEQ ID NO: 607593 - RNA, 62 nt, hsa
aauguaugaugagguuaacacugaaauauuaaaaucugcaaaugcacauuaaugcaaauuaa

SEQ ID NO: 607594 - RNA, 62 nt, hsa
cuaucuacaugagcccucuuagagaccucagaaaucugcagaaaguucccugugucugucua

SEQ ID NO: 607595 - RNA, 62 nt, hsa
aagucuguuggcugugacgucauuauaccuaaaaucugcaucauaccugcaagccaacaguu

SEQ ID NO: 607596 - RNA, 62 nt, hsa
aauaaucagcagaaacggaauggaaugccaagaaucugcauugagaauaacuaaacauuguu

SEQ ID NO: 607597 - RNA, 62 nt, hsa
accguaucauuauuuguuugaggaaaaaaagaaaucugcauuuuaauucauguuggucaaag

SEQ ID NO: 607598 - RNA, 62 nt, hsa
cucugauuuccuucugcuaugacaaaaccuuuaaucugcaccuuacaacucggggacaaaug

SEQ ID NO: 607599 - RNA, 62 nt, hsa
cuugcgacaccucaagguguucucuguagcucaaucugcaaacaugccaggccucagggauc

SEQ ID NO: 607600 - RNA, 62 nt, hsa
gaucucuguuuuuccuggggcaaacagaaagaaaucugcaugaguugcuuuuguacccuuua

SEQ ID NO: 607601 - RNA, 62 nt, hsa
acaucauaaccagcuuuuacauccauuuuagaaaucugcacaaauuaagagagcugauuaga

SEQ ID NO: 607602 - RNA, 64 nt, hsa
guaaagcaaguuauugaaauaggacuuaagaauuaccuauuaaaaagaaaucugauauauaaaa

SEQ ID NO: 607603 - RNA, 64 nt, hsa
caacuauuauuauucccccaaacccuaaaauucuaccuauuaggugucagguuaaaguucuaau

SEQ ID NO: 607604 - RNA, 64 nt, hsa
cacccaagauucagcagucagauguuuacugcacaccuauuaccuauuauuugcuguucuugca

SEQ ID NO: 607605 - RNA, 64 nt, hsa
gauucagcagucagauguuuacugcacaccuauuaccuauuauuugcuguucuugcaugguuca

SEQ ID NO: 607606 - RNA, 64 nt, hsa
gcccggaucacaugcuguuacuggacugcccaggucaccucauugaggugagcgcugucccucc

SEQ ID NO: 607607 - RNA, 64 nt, hsa
gccucaggaauucucccuuccacaccugcccaccucaccucacugcaccgcaccgcaccagagc

SEQ ID NO: 607608 - RNA, 64 nt, hsa
cugaaggccgugcaccuccaccuccagccuccagucaccucaccuagcucacugcucucucucc

SEQ ID NO: 607609 - RNA, 64 nt, hsa
aaucccagcacuuugggaggcugaggcagguggaucaccucaagucaggaguucgagaccagcc

SEQ ID NO: 607610 - RNA, 64 nt, hsa
cuauucuacaagucaguaaaggaacaauugguacucaccucagugcugcacucaacuauggaaa

SEQ ID NO: 607611 - RNA, 64 nt, hsa
uauguaugcagacuggacccccuacuacuauuugucaccucacccacagauuguauuuaugucu

SEQ ID NO: 607612 - RNA, 64 nt, hsa
gucaagggacugcuuuggcauccagggccuccagucaccucacugccauacauuagaaaugaga

SEQ ID NO: 607613 - RNA, 64 nt, hsa
gugaccuacagagcaugcuccacaagccccugccucaccucacugucaucacuaauaaacauca

SEQ ID NO: 607614 - RNA, 64 nt, hsa
caccuaggauaaagugcagugaugcaaucacagcucaccucagugcggccuugaacuccuggac

SEQ ID NO: 607615 - RNA, 64 nt, hsa
uagagguggggaagugcagugaugcaaucacagcucaccucagugcggccuugaacuccuggac

SEQ ID NO: 607616 - RNA, 64 nt, hsa; identical to SEQ ID NO: 377431

SEQ ID NO: 607617 - RNA, 64 nt, hsa; identical to SEQ ID NO: 377432

SEQ ID NO: 607618 - RNA, 64 nt, hsa; identical to SEQ ID NO: 377433

SEQ ID NO: 607619 - RNA, 64 nt, hsa; identical to SEQ ID NO: 377434

SEQ ID NO: 607620 - RNA, 64 nt, hsa; identical to SEQ ID NO: 377435

SEQ ID NO: 607621 - RNA, 64 nt, hsa; identical to SEQ ID NO: 377436

SEQ ID NO: 607622 - RNA, 64 nt, hsa; identical to SEQ ID NO: 377437

SEQ ID NO: 607623 - RNA, 64 nt, hsa; identical to SEQ ID NO: 377438

SEQ ID NO: 607624 - RNA, 64 nt, hsa; identical to SEQ ID NO: 377439

SEQ ID NO: 607625 - RNA, 64 nt, hsa; identical to SEQ ID NO: 377440

SEQ ID NO: 607626 - RNA, 64 nt, hsa; identical to SEQ ID NO: 377441

SEQ ID NO: 607627 - RNA, 64 nt, hsa; identical to SEQ ID NO: 377442

SEQ ID NO: 607628 - RNA, 64 nt, hsa; identical to SEQ ID NO: 377443

SEQ ID NO: 607629 - RNA, 64 nt, hsa; identical to SEQ ID NO: 377444

SEQ ID NO: 607630 - RNA, 64 nt, hsa; identical to SEQ ID NO: 377445

SEQ ID NO: 607631 - RNA, 64 nt, hsa; identical to SEQ ID NO: 377446

SEQ ID NO: 607632 - RNA, 64 nt, hsa; identical to SEQ ID NO: 377447

SEQ ID NO: 607633 - RNA, 64 nt, hsa; identical to SEQ ID NO: 377448

SEQ ID NO: 607634 - RNA, 64 nt, hsa; identical to SEQ ID NO: 377449

SEQ ID NO: 607635 - RNA, 64 nt, hsa; identical to SEQ ID NO: 377450

SEQ ID NO: 607636 - RNA, 64 nt, hsa; identical to SEQ ID NO: 377451

SEQ ID NO: 607637 - RNA, 64 nt, hsa; identical to SEQ ID NO: 377452

SEQ ID NO: 607638 - RNA, 64 nt, hsa; identical to SEQ ID NO: 377453

SEQ ID NO: 607639 - RNA, 64 nt, hsa; identical to SEQ ID NO: 377454

SEQ ID NO: 607640 - RNA, 64 nt, hsa; identical to SEQ ID NO: 377455

SEQ ID NO: 607641 - RNA, 64 nt, hsa; identical to SEQ ID NO: 377456

SEQ ID NO: 607642 - RNA, 64 nt, hsa; identical to SEQ ID NO: 377457

SEQ ID NO: 607643 - RNA, 64 nt, hsa; identical to SEQ ID NO: 377458

SEQ ID NO: 607644 - RNA, 64 nt, hsa; identical to SEQ ID NO: 377459

SEQ ID NO: 607645 - RNA, 64 nt, hsa; identical to SEQ ID NO: 377460

SEQ ID NO: 607646 - RNA, 64 nt, hsa; identical to SEQ ID NO: 377461

SEQ ID NO: 607647 - RNA, 64 nt, hsa; identical to SEQ ID NO: 377462

SEQ ID NO: 607648 - RNA, 64 nt, hsa; identical to SEQ ID NO: 377463

SEQ ID NO: 607649 - RNA, 64 nt, hsa; identical to SEQ ID NO: 377464

SEQ ID NO: 607650 - RNA, 64 nt, hsa; identical to SEQ ID NO: 377465

SEQ ID NO: 607651 - RNA, 64 nt, hsa; identical to SEQ ID NO: 377466

SEQ ID NO: 607652 - RNA, 64 nt, hsa; identical to SEQ ID NO: 377467

SEQ ID NO: 607653 - RNA, 64 nt, hsa; identical to SEQ ID NO: 377468

SEQ ID NO: 607654 - RNA, 64 nt, hsa; identical to SEQ ID NO: 377469

SEQ ID NO: 607655 - RNA, 64 nt, hsa; identical to SEQ ID NO: 377470

SEQ ID NO: 607656 - RNA, 64 nt, hsa; identical to SEQ ID NO: 377471

SEQ ID NO: 607657 - RNA, 64 nt, hsa; identical to SEQ ID NO: 377472

SEQ ID NO: 607658 - RNA, 64 nt, hsa; identical to SEQ ID NO: 377473

SEQ ID NO: 607659 - RNA, 64 nt, hsa; identical to SEQ ID NO: 377474

SEQ ID NO: 607660 - RNA, 64 nt, hsa; identical to SEQ ID NO: 377475

SEQ ID NO: 607661 - RNA, 64 nt, hsa; identical to SEQ ID NO: 377476

SEQ ID NO: 607662 - RNA, 64 nt, hsa; identical to SEQ ID NO: 377477

SEQ ID NO: 607663 - RNA, 64 nt, hsa; identical to SEQ ID NO: 377478

SEQ ID NO: 607664 - RNA, 64 nt, hsa; identical to SEQ ID NO: 377479

SEQ ID NO: 607665 - RNA, 64 nt, hsa; identical to SEQ ID NO: 377480

SEQ ID NO: 607666 - RNA, 64 nt, hsa; identical to SEQ ID NO: 377481

SEQ ID NO: 607667 - RNA, 64 nt, hsa; identical to SEQ ID NO: 377482

SEQ ID NO: 607668 - RNA, 64 nt, hsa; identical to SEQ ID NO: 377483

SEQ ID NO: 607669 - RNA, 64 nt, hsa; identical to SEQ ID NO: 377484

SEQ ID NO: 607670 - RNA, 64 nt, hsa; identical to SEQ ID NO: 377485

SEQ ID NO: 607671 - RNA, 64 nt, hsa; identical to SEQ ID NO: 377486

SEQ ID NO: 607672 - RNA, 64 nt, hsa; identical to SEQ ID NO: 377487

SEQ ID NO: 607673 - RNA, 64 nt, hsa; identical to SEQ ID NO: 377488

SEQ ID NO: 607674 - RNA, 64 nt, hsa; identical to SEQ ID NO: 377489

SEQ ID NO: 607675 - RNA, 64 nt, hsa; identical to SEQ ID NO: 377490

SEQ ID NO: 607676 - RNA, 64 nt, hsa; identical to SEQ ID NO: 377491

SEQ ID NO: 607677 - RNA, 64 nt, hsa; identical to SEQ ID NO: 377492

SEQ ID NO: 607678 - RNA, 64 nt, hsa; identical to SEQ ID NO: 377493

SEQ ID NO: 607679 - RNA, 64 nt, hsa; identical to SEQ ID NO: 377494

SEQ ID NO: 607680 - RNA, 64 nt, hsa; identical to SEQ ID NO: 377495

SEQ ID NO: 607681 - RNA, 64 nt, hsa; identical to SEQ ID NO: 377496

SEQ ID NO: 607682 - RNA, 64 nt, hsa; identical to SEQ ID NO: 377497

SEQ ID NO: 607683 - RNA, 64 nt, hsa; identical to SEQ ID NO: 377498

SEQ ID NO: 607684 - RNA, 64 nt, hsa; identical to SEQ ID NO: 377499

SEQ ID NO: 607685 - RNA, 64 nt, hsa; identical to SEQ ID NO: 377500

SEQ ID NO: 607686 - RNA, 64 nt, hsa; identical to SEQ ID NO: 377501

SEQ ID NO: 607687 - RNA, 64 nt, hsa; identical to SEQ ID NO: 377502

SEQ ID NO: 607688 - RNA, 64 nt, hsa; identical to SEQ ID NO: 377503

SEQ ID NO: 607689 - RNA, 64 nt, hsa; identical to SEQ ID NO: 377504

SEQ ID NO: 607690 - RNA, 64 nt, hsa; identical to SEQ ID NO: 377505

SEQ ID NO: 607691 - RNA, 64 nt, hsa; identical to SEQ ID NO: 377506

SEQ ID NO: 607692 - RNA, 64 nt, hsa; identical to SEQ ID NO: 377507

SEQ ID NO: 607693 - RNA, 64 nt, hsa; identical to SEQ ID NO: 377508

SEQ ID NO: 607694 - RNA, 64 nt, hsa; identical to SEQ ID NO: 377509

SEQ ID NO: 607695 - RNA, 64 nt, hsa
uccuaaacccaucaucuaaggugacagagcagugcuggaauagcaucuccuuucacuuucccaa

SEQ ID NO: 607696 - RNA, 64 nt, hsa
ggaaagcaaauauacaaugauuuucaguaggcuucuggaauagaaacagugguuugaagacccc

SEQ ID NO: 607697 - RNA, 64 nt, hsa
aaugugggaaagacucccuauucgaaaauuagugcuggaauaucuggccaaccauaugcagaag

SEQ ID NO: 607698 - RNA, 64 nt, hsa
agauuuaaauauaaguacuaaaacuguaaaaauccuggaauauaaccuaagaaauaccaaugug

SEQ ID NO: 607699 - RNA, 64 nt, hsa
aagaaggagauugaugcaucagguucaguuuaaccuggaauaucugacuaccccugaauccacc

SEQ ID NO: 607700 - RNA, 64 nt, hsa
uuauuugcaguguguugagggacugguguauccacuggaauaguugguacucuuggauguguuu

SEQ ID NO: 607701 - RNA, 64 nt, hsa
cuguuuguugagggucuguauucauagaccuugacuggaauauguaagacugugcaaaaaaaaa

SEQ ID NO: 607702 - RNA, 64 nt, hsa
aaacuguuaacauagaauguuacuuggaaaaagucuggaauaugugguguacacaagcagugcu

SEQ ID NO: 607703 - RNA, 64 nt, hsa
gggcuuuuuuucaagguugggauuaccacaccaccuggaauaucauacugugguuucugccuaa

SEQ ID NO: 607704 - RNA, 64 nt, hsa
ucccaaauaaaaccagccugugauguucaagggacuggaauaaaguggcuuacgaccugaagga

SEQ ID NO: 607705 - RNA, 64 nt, hsa
gguuuaaucuaugugcaugguuagggagccaggucuggaauauucaguuucccugccccuguua

SEQ ID NO: 607706 - RNA, 64 nt, hsa
accaucucucaagccccaaggacuggagccaccucuggaauaauguguuaaauaucuguauauu

SEQ ID NO: 607707 - RNA, 64 nt, hsa
uuggaacaccugugagagagauuguucuauagggcuggaauauucagaguuacauucuuggaag

SEQ ID NO: 607708 - RNA, 63 nt, hsa
gagagccggauccggaguuaccugagggaggugagcuccuaccccuccacggugggugcggag

SEQ ID NO: 607709 - RNA, 63 nt, hsa
gaagguaccuagaaauuugaaacuucccuaaaaagcuccuaaugcccaccugcuagauagcuu

SEQ ID NO: 607710 - RNA, 63 nt, hsa
accugggauggacauccaggugcccuucauccaagcuccuaugugaggggaauggacauuauu

SEQ ID NO: 607711 - RNA, 63 nt, hsa
cuagaugccuaaaagaguuuauauacuucuaaaagcuccuaacuuauauccaaagaauugcuu

SEQ ID NO: 607712 - RNA, 63 nt, hsa
auuuugcacugagccaaaggucuagcauugucaagcuccuaaaggguucauuuggccccuccu

SEQ ID NO: 607713 - RNA, 63 nt, hsa
uuacuugcucagcacugguuauguagcacaaauagcuccuaggaaaauguuucuggggcaacc

SEQ ID NO: 607714 - RNA, 63 nt, hsa
ugacccgaagucucugggcuagcuacuccccccagcuccuaguugauagaaauggggguucug

SEQ ID NO: 607715 - RNA, 63 nt, hsa
cccuugagcugguuuucucugauggcacuuuugagcuccuaagcugccagccuucccuucuuu

SEQ ID NO: 607716 - RNA, 63 nt, hsa
accagguuuaccaucucacucccaguaauacccagcuccuaucuaaagccccauucugcauga

SEQ ID NO: 607717 - RNA, 63 nt, hsa
uggagcuauuuuuuuuucuuaaucccauaauacagcuccuaaaaguugugugggauuugcguu

SEQ ID NO: 607718 - RNA, 63 nt, hsa
aaccacaggcagaucugaaaaagaaccaaauagagcuccuaaaaaugagaaauauuuauugaa

SEQ ID NO: 607719 - RNA, 63 nt, hsa
cugaccccucuugcucguuccccuuccuuccgcagcuccuagucucguccgugacuuuccggu

SEQ ID NO: 607720 - RNA, 63 nt, hsa
cuugaguugagguuaucaucucaaugaggcuuaagcuccuagaguacaggaccauuuuguuga

SEQ ID NO: 607721 - RNA, 63 nt, hsa
aaaugcaaaacacauuuuauucuucuaauuaacagcuccuaggaaaauguagacuuuugcuuu

SEQ ID NO: 607722 - RNA, 63 nt, hsa
ucgaggccacauugcuggcugcccccucuuuguagcuccuauaaagggcccacaccuggugga

SEQ ID NO: 607723 - RNA, 63 nt, hsa
uuuucauuugggagcuacccaagggcacccaugagcuccuaucaagaagugaucaacgugacc

SEQ ID NO: 607724 - RNA, 63 nt, hsa
cauaugagauaagccugcaaccucuugaccuucagcuccuaugcaggcuucucuugagcccag

SEQ ID NO: 607725 - RNA, 63 nt, hsa
uacauguuugucucccugccagcugcccuauguagcuccuaacuguugugugauuuggacggc

SEQ ID NO: 607726 - RNA, 63 nt, hsa
ccauuauucaaauauugcucaauacagcaaauuagcuccuaaccuaacaaaguuuaaguuuac

SEQ ID NO: 607727 - RNA, 63 nt, hsa
aguggagacacguggcaaggcaggagggcccucagcuccuagggcugucgaauagaggaggag

SEQ ID NO: 607728 - RNA, 63 nt, hsa
gcucugcacccccauauggucauagcccagaucagcuccuaacccuuaucaccagcugccucu

SEQ ID NO: 607729 - RNA, 63 nt, hsa
ggggggacccagcugcucuuggacaaguggcugagcuccuaucuggccuccucuuuuuuuuuu

SEQ ID NO: 607730 - RNA, 63 nt, hsa
cccacaaccuuacucuaaauuugaguagagaaaagcuccuaaagugaccuuccgggugggaag

SEQ ID NO: 607731 - RNA, 63 nt, hsa
cgggguuucgcuguguuggccgggcuggucuccagcuccuaaccgcgagugauccgccagccu

SEQ ID NO: 607732 - RNA, 63 nt, hsa
ucauccucugaguagggcugccagaaggcccccagcuccuacccacuccccuugaggcugcug

SEQ ID NO: 607733 - RNA, 63 nt, hsa
ucucaguucuuugguuggaaggagcaggaaaucagcuccuauucuccaguggagagaucuggc

SEQ ID NO: 607734 - RNA, 63 nt, hsa
aucccugauugaugcuaucugaauaaaguuauaagcuccuauaagccauaauuuacuuuuaaa

SEQ ID NO: 607735 - RNA, 63 nt, hsa
ccccaccgcgucggcgggaagcgugggagguguagcuccuacuuuugcacaggcaccagcuac

SEQ ID NO: 607736 - RNA, 63 nt, hsa
cagauuuaaaacuuucuacauauuauauguaggagcuccuaguguuuuugagaaauuagacug

SEQ ID NO: 607737 - RNA, 63 nt, hsa
ucugagcuaguuuuuuuguacuauuauacuaaaagcuccuacugugaugugaaaugcucauac

SEQ ID NO: 607738 - RNA, 63 nt, hsa
auuggacuauuaggaauaaaacaaucucagagcagcuccuaaacaagagaauaaaaaugggcc

SEQ ID NO: 607739 - RNA, 63 nt, hsa
agucuuaggugaacaaucaacuaguauuuguugagcuccuauuugcccagagauggucauauu

SEQ ID NO: 607740 - RNA, 63 nt, hsa
aauccugagcuuuccuguccauucccagcauccagcuccuauucuagugccucuucccugcag

SEQ ID NO: 607741 - RNA, 63 nt, hsa
ugguccacaugaacacaggcuccauccaggcccagcuccuacccaccgccucucugugggcca

SEQ ID NO: 607742 - RNA, 63 nt, hsa
aagauuacaacugugauuuccuuuuccucagcaagcuccuauguguauauuuuccugaauuuc

SEQ ID NO: 607743 - RNA, 63 nt, hsa
aggcccacugcaguuccuauggcgccagucaccagcuccuagacagcacuuggguaccccauu

SEQ ID NO: 607744 - RNA, 63 nt, hsa
ggagacuaaggcaaauugggccauuaaaagcucagcuccuauguugguauuaacggugguggg

SEQ ID NO: 607745 - RNA, 63 nt, hsa
aauuucuuauugcccuguuagaaaaauuaacugagcuccuagagaagaacaauccucauguaa

SEQ ID NO: 607746 - RNA, 63 nt, hsa
ggcuccugggccaucuucaugugcugcuugaagagcuccuauuuuguacuccuggcuagaaug

SEQ ID NO: 607747 - RNA, 63 nt, hsa
cugcucccagugcugcugcugaccuucacugacagcuccuaguggaagcccaagggccucuga

SEQ ID NO: 607748 - RNA, 63 nt, hsa
caguaguggugacugugggcuccauucaaagugagcuccuaagccaugggagacacugaugua

SEQ ID NO: 607749 - RNA, 63 nt, hsa
auguuguuccuauggaaucuggaaugagugcagagcuccuacccacacaugacugccccgcca

SEQ ID NO: 607750 - RNA, 63 nt, hsa
ggcuccccagggccccgcuucuccguacaccccagcuccuaggucucagagaacucccccacc

SEQ ID NO: 607751 - RNA, 63 nt, hsa
ggccuggcucucccugggaggcuggggccccuaagcuccuagguuuuccuuccaagcacccag

SEQ ID NO: 607752 - RNA, 63 nt, hsa
gagggaaaagcagauggacuugaaaaagauccaagcuccuauuagaaaagguaugaaaaucuu

SEQ ID NO: 607753 - RNA, 63 nt, hsa
uagaugaagagaguaucauuuauaccuucuaggagcuccuauugggagacaugaaacauaugu

SEQ ID NO: 607754 - RNA, 63 nt, hsa
uuuaauucuuauaauuugcaccuauauaaacaaagcuccuacuguauucuucucuucaucaac

SEQ ID NO: 607755 - RNA, 63 nt, hsa
uuacuuuguggauauauuuaaaauucauauuauagcuccuauuaaauuccuuccaugauagau

SEQ ID NO: 607756 - RNA, 63 nt, hsa
agucugaaucacuaauauuccugaguuuuuaugagcuccuaguacagcuaaaguuugccuaug

SEQ ID NO: 607757 - RNA, 63 nt, hsa
ggguggggcaauacccaugaguugauagugauaagcuccuaaggauuuuuaacuuguacuuuu

SEQ ID NO: 607758 - RNA, 53 nt, hsa
cagguauccaggaaucgugaagaagcuccuacggaggcucucacaguucaaca

SEQ ID NO: 607759 - RNA, 63 nt, hsa
cacuccuauguccauguagacauacacuucagaagcuccuaaaacagagacugaaaggccacc

SEQ ID NO: 607760 - RNA, 63 nt, hsa
uauuaaauugauguaaaucagaucuuuucuacaagcuccuauccagccuuuuuuuugaaauuu

SEQ ID NO: 607761 - RNA, 63 nt, hsa
ucuuauguuuucuuuuggauuggaaagaaauaaagcuccuaguaaaguuauucauauuauauu

SEQ ID NO: 607762 - RNA, 63 nt, hsa
gugugauucauuuuuaaagaaauauuuuucucaagcuccuauuacuauuugugguuguauuau

SEQ ID NO: 607763 - RNA, 63 nt, hsa
aacauaagcauagugcaaggagcuccauuuccgagcuccuaagaaauaugcuucaaaggucaa

SEQ ID NO: 607764 - RNA, 63 nt, hsa
cagcccccuacaccaagaguguaucugugaaagagcuccuacacuuugaaaacuuaagaaucc

SEQ ID NO: 607765 - RNA, 63 nt, hsa
uuuaaguuauguuaagauuacuaaaacaauaaaagcuccuaaaaaaucaaacuguauucuggu

SEQ ID NO: 607766 - RNA, 63 nt, hsa
gaaauguguucaucaaaucuggucaagggacuaagcuccuagcugaccauucauucugaagau

SEQ ID NO: 607767 - RNA, 63 nt, hsa
ugaccgaccccaaaccagacuguuggugggcugagcuccuagccuggaagcauucaggagagc

SEQ ID NO: 607768 - RNA, 63 nt, hsa
gauggugugaacucgguugggucccgugacucgagcuccuaccaguggcuggccgcggauugg

SEQ ID NO: 607769 - RNA, 63 nt, hsa
auuuucaugcucauaaaucugauaggcaacaguagcuccuacugaaauuucuuagguagggaa

SEQ ID NO: 607770 - RNA, 63 nt, hsa
ugugcauucuccaccccuccgccaauggcuuccagcuccuaaaacaccuggacauuccccauc

SEQ ID NO: 607771 - RNA, 63 nt, hsa
aggggagcuugagaagaauaaaagggauaaacgagcuccuaguuuuaaaaucucugccauugc

SEQ ID NO: 607772 - RNA, 63 nt, hsa
gcugcauuucacacaacugugaaccgaauaaauagcuccuauuuggucuaugacuucugccac

SEQ ID NO: 607773 - RNA, 63 nt, hsa
uuuucuuguuuugguuugguuugguuuuuuaauagcuccuauuuugauggcuguguguuuggc

SEQ ID NO: 607774 - RNA, 63 nt, hsa
uggauuuagaagcgucaugaaagcacgagugacagcuccuaaccucuccuuguuuuauuaaac

SEQ ID NO: 607775 - RNA, 63 nt, hsa
gugugugaaagcagguggaccauuccacuuuuuagcuccuauugaugcaccaaaccaagugcc

SEQ ID NO: 607776 - RNA, 63 nt, hsa
cuguaccuauuuaaaguccaccaaggggacugcagcuccuagaacaugagaaucaagccucuu

SEQ ID NO: 607777 - RNA, 63 nt, hsa
uccccaagaagagggaaggcaggaggggccuacagcuccuaccuugggcccucaggggcugca

SEQ ID NO: 607778 - RNA, 63 nt, hsa
gagcgccaguggaaggccgaguuccaccgcuggagcuccuacauggugcacuggaagaaccag

SEQ ID NO: 607779 - RNA, 63 nt, hsa
gguuuuguauugaaacaauguuuauauuuacugagcuccuaaaaaugguagaauacacaugaa

SEQ ID NO: 607780 - RNA, 63 nt, hsa
uuagcagcuucgaccucauuuuccagaugcaccagcuccuauuaauaaguuagcaaggaaagu

SEQ ID NO: 607781 - RNA, 63 nt, hsa
aucuuucugggagcugcgccggacagaguggggagcuccuaguuuguggggggaagcuuugau

SEQ ID NO: 607782 - RNA, 63 nt, hsa
agcaguauuauuaaauggauucauuuuaaaaauagcuccuauauuuuguaacaugucucaaac

SEQ ID NO: 607783 - RNA, 63 nt, hsa
caagauugccccaacuuaaacgccacauaaaacagcuccuaauugacaugggcaaaguacagc

SEQ ID NO: 607784 - RNA, 63 nt, hsa
gggugauugggcagggccugagcuggacaggggagcuccuaguaggggaggggaggggaugcu

SEQ ID NO: 607785 - RNA, 63 nt, hsa
agaggcuuucaugagccccaaggcuggggccacagcuccuaccccugcccagcagcccugagc

SEQ ID NO: 607786 - RNA, 63 nt, hsa
acugccugaagacacacagcaauaagugauuacagcuccuagacuaccuuccaaaaccuguuu

SEQ ID NO: 607787 - RNA, 63 nt, hsa
gagaccggaauaaacucaaucuuuucuuucccaagcuccuagccaacacuauccuugggagaa

SEQ ID NO: 607788 - RNA, 63 nt, hsa
aacuuauucauaguccuauuggacagcaggagcagcuccuacagugaacuauuggcaccaccg

SEQ ID NO: 607789 - RNA, 63 nt, hsa
aaaaagcagaaauacacaaugaucucccuuguaagcuccuaagguggcuuuucuuucucuaac

SEQ ID NO: 607790 - RNA, 63 nt, hsa
aaugaaaaauagugucuuugugauuuugaguaaagcuccuaucuguuuucuccuucugucucu

SEQ ID NO: 607791 - RNA, 63 nt, hsa
gucuagucugcccaaaauuacuuauccucaccuagcuccuaccacucuucuuagagacucucc

SEQ ID NO: 607792 - RNA, 63 nt, hsa
uuaguuuuguuaauauuuguguugucuugaccaagcuccuacuaaguauaggacacaaauguu

SEQ ID NO: 607793 - RNA, 63 nt, hsa
gcuggcaguguuuggggacauuaugcuggaaagagcuccuagcaucagaggauuaacacuagc

SEQ ID NO: 607794 - RNA, 63 nt, hsa
ccuccugccccagcccaaccucugggaacaggcagcuccuaucugcaaacuguguucacccuu

SEQ ID NO: 607795 - RNA, 63 nt, hsa
ucaccauguacuaggagcucugauagccagcucagcuccuaauccuugaggcaacauucuuuu

SEQ ID NO: 607796 - RNA, 63 nt, hsa
ugcaaagggcagaggcugggaguuuggacgcuuagcuccuaccccuguccuaccucaccgggg

SEQ ID NO: 607797 - RNA, 63 nt, hsa
uuggaauuuucaucauguuugcuuauuaaacaaagcuccuacugccaucauacuaaucaugca

SEQ ID NO: 607798 - RNA, 63 nt, hsa
uaaagucaccuuccuaccauuagagcagaagacagcuccuauaguuuuguauuuuggcagcua

SEQ ID NO: 607799 - RNA, 63 nt, hsa
auauuauaucaggugccaggaaucccuugggucagcuccuauccucuggacggggagcaucau

SEQ ID NO: 607800 - RNA, 63 nt, hsa
ccuuuugaccuuuucaaauaaauauggauggcgagcuccuaggccucuggcuuccugguagag

SEQ ID NO: 607801 - RNA, 63 nt, hsa
ucaauugcuuaucuacaauucuguuuuauuuguagcuccuagaggauagagcuggacagauuc

SEQ ID NO: 607802 - RNA, 63 nt, hsa
aaaaauaaaagaauaaaaguaugucugucauccagcuccuaugucuguuauccagcuccaagu

SEQ ID NO: 607803 - RNA, 63 nt, hsa
cagagccugcuuggccccacuguuaguccagcgagcuccuauaucaaaaugccguaggccggg

SEQ ID NO: 607804 - RNA, 63 nt, hsa
guaccccagccccacucagcacugacaguccccagcuccuaguagugagcugggaggcgcuuc

SEQ ID NO: 607805 - RNA, 63 nt, hsa
cccgcagggagcugguggcuccagccccacuagagcuccuaaagaucacacagcagcugcucc

SEQ ID NO: 607806 - RNA, 63 nt, hsa
ugaacagauuuaaaauggcugguguuaaauaucagcuccuaauaagauguggacugaaaacac

SEQ ID NO: 607807 - RNA, 63 nt, hsa
gucuaggggguuccauucuggccaugcgagcccagcuccuaccaacgucgguaacuugagcag

SEQ ID NO: 607808 - RNA, 63 nt, hsa
agcgugaccccuccugcugggaccuguguuguaagcuccuauuugcuuaucuuguuuauuuca

SEQ ID NO: 607809 - RNA, 63 nt, hsa
caguucccagaaucaaagcaaugcauuuuggaaagcuccuagcagagagacuuucagcccuaa

SEQ ID NO: 607810 - RNA, 63 nt, hsa
cuguuugcuguguugaacucuucacucugcugaagcuccuaauggaaaaagcuuucuucugac

SEQ ID NO: 607811 - RNA, 63 nt, hsa
uuacauguguuuauucauccagcaguguugcucagcuccuaccucugugccagggcagcauuu

SEQ ID NO: 607812 - RNA, 63 nt, hsa
gcuggagcaggggucaugugaggccaggccuguagcuccuaccuggggccuauuucuacuuuc

SEQ ID NO: 607813 - RNA, 63 nt, hsa
gaaauaucaacugaugauauccuauccucuccaagcuccuauuccaggaaaaaagauccaaug

SEQ ID NO: 607814 - RNA, 63 nt, hsa
cuggguaacaagcccuaacuucuguaauuuaaaagcuccuacuuuugccacaagguggugcuu

SEQ ID NO: 607815 - RNA, 63 nt, hsa
uuuaaaagauaaccuuuggccuuagacuccguuagcuccuauuuccugccuucagacaaacag

SEQ ID NO: 607816 - RNA, 63 nt, hsa
ggcuuuucaacgggaguaaagcaaagucucuaaagcuccuaguaccuagaagcauuaugaagc

SEQ ID NO: 607817 - RNA, 63 nt, hsa
ccagcgagaauucuucauccuccacgguucacuagcuccuaccugaagaggaaagggggccau

SEQ ID NO: 607818 - RNA, 63 nt, hsa
caugcauuugaauaaagugccucccuuagccugagcuccuaaagaccucuuguacuugguugc

SEQ ID NO: 607819 - RNA, 63 nt, hsa
ucaagccuccaaguaguggcauaucagucuuggagcuccuagcuggugauacggagagggcuu

SEQ ID NO: 607820 - RNA, 63 nt, hsa
cuuuccuucccuggagagaaccgucuuuaccucagcuccuagggccuccagccccccagcucc

SEQ ID NO: 607821 - RNA, 63 nt, hsa
cacuauuuuagcauaauaaaagaaaguccaaagagcuccuauauagacuacuccagauaacuu

SEQ ID NO: 607822 - RNA, 63 nt, hsa
uaaucucuagccauaaaaacauaaguaauaguaagcuccuaagcuuggacaaaggcuggauuc

SEQ ID NO: 607823 - RNA, 63 nt, hsa
gguacaggcuaggcagaaugugccuagaugaucagcuccuaguaaaaaccuugagaacuaagu

SEQ ID NO: 607824 - RNA, 63 nt, hsa
caucagggguuuucuuuauggcaaagccaaaauagcuccuacaauuucuuauaucccucguca

SEQ ID NO: 607825 - RNA, 63 nt, hsa
agaaacucccugucuuuggggcagggcuaaagcagcuccuaaggaccacuggccauuagcucu

SEQ ID NO: 607826 - RNA, 63 nt, hsa
ccguguccguagcugucaguaugacuuagaucuagcuccuaccuacugguugauguguuuuuu

SEQ ID NO: 607827 - RNA, 63 nt, hsa
uuacauguucuguuauuuaauguuguuaucucaagcuccuaucucuugauguuuucuugucau

SEQ ID NO: 607828 - RNA, 63 nt, hsa
cauucuaaacuccuuuccugcaaacccauuuccagcuccuaguagcuuuccucccaaaggcuu

SEQ ID NO: 607829 - RNA, 63 nt, hsa
acaugcaugcacacaaacguguacacaagugugagcuccuacacgcauacacacacacacgug

SEQ ID NO: 607830 - RNA, 63 nt, hsa
acacaugcauguacagguaagcacacauguacaagcuccuacaggcuugcucucacacacgug

SEQ ID NO: 607831 - RNA, 63 nt, hsa
aaccccagccccaacuuaaaauucuuacauucaagcuccuaagaguucuuaauuuauaacuaa

SEQ ID NO: 607832 - RNA, 63 nt, hsa
acucuugguugggccugguugacuuugccagucagcuccuacagugaucaguuggccaccucu

SEQ ID NO: 607833 - RNA, 63 nt, hsa
gagcauucuaucuuuuggcuuucagagugauagagcuccuaacagguguacaggcccaagagu

SEQ ID NO: 607834 - RNA, 63 nt, hsa
uccacaaaggggagcauuuggaaaugaaggacuagcuccuauguaucagguuaagagcaaggg

SEQ ID NO: 607835 - RNA, 63 nt, hsa
cauagauuuuucccagccuuauaauauaccauaagcuccuacuucccugccccucccuaauca

SEQ ID NO: 607836 - RNA, 63 nt, hsa
cuugcuauaaccuaagcaugccuucuuuauuccagcuccuauguucuguguauaucauuaaca

SEQ ID NO: 607837 - RNA, 63 nt, hsa
aaagguugggauaggcgcagcagcuauaagacaagcuccuacgcucacuguucccugaucauu

SEQ ID NO: 607838 - RNA, 63 nt, hsa
cagcuggccugcugcucuccagucaaguagcgaagcuccuaccacccagacacccaaacagcc

SEQ ID NO: 607839 - RNA, 63 nt, hsa
uccccuuguacccccuuccacuucgucuccccuagcuccuagaagcaaccacugaugugauuu

SEQ ID NO: 607840 - RNA, 63 nt, hsa
cccagauugcguagcauucagauugauuugagcagcuccuacugugauaaguguaucccagau

SEQ ID NO: 607841 - RNA, 63 nt, hsa
cgcuccaacuuccuucccugccuuuucccuccaagcuccuauuuuacugugucagcuggaagg

SEQ ID NO: 607842 - RNA, 63 nt, hsa
aguggaucagagagacuaggacaguuacugcagagcuccuaagucaccacucaaccaguggcu

SEQ ID NO: 607843 - RNA, 63 nt, hsa
uugucuucuggucacaccucacuauguccccucagcuccuaucucuguauggccugguuuuuc

SEQ ID NO: 607844 - RNA, 63 nt, hsa
ugagcagaggcugggcauugccacuaggaccugagcuccuagagaacaaggaccuggguggcc

SEQ ID NO: 607845 - RNA, 63 nt, hsa
uccuccagggcgacggccggggacugccuggagagcuccuauuucaaggagaagccccuacgu

SEQ ID NO: 607846 - RNA, 63 nt, hsa
cuaaucagcaaguccaguggccacuuagagcccagcuccuaccucuucauucacuuaacaagu

SEQ ID NO: 607847 - RNA, 63 nt, hsa
acacagaaaccccucuucuccccgcccucccccagcuccuaccugccucccacgccucaggug

SEQ ID NO: 607848 - RNA, 63 nt, hsa
accaacucgaguguucagcccugugugcucuccagcuccuaagucgugggccugguuucagcu

SEQ ID NO: 607849 - RNA, 63 nt, hsa
ggagaccacuuuuauuuacucaugagaaguggaagcuccuaguaucagaagaagcugauacau

SEQ ID NO: 607850 - RNA, 63 nt, hsa
gaguaggguugugccuuauucaacugcauacauagcuccuagcacagugccuuauucgguagg

SEQ ID NO: 607851 - RNA, 63 nt, hsa
uauaucuagaaaaccccaugaucuuggcccaaaagcuccuagaucugauaaacaacuucagcu

SEQ ID NO: 607852 - RNA, 63 nt, hsa
agaaccuuguguccuuugaauucucgcccugccagcuccuagaaauaguuucaaucuuggaau

SEQ ID NO: 607853 - RNA, 63 nt, hsa
cuucucucagccuccccaccagugauggauaacagcuccuauucucagcugaccugacugagc

SEQ ID NO: 607854 - RNA, 63 nt, hsa
uggucccuuccauuccccugaaaccugcaugagagcuccuaacauguuucuccaaugcaauca

SEQ ID NO: 607855 - RNA, 63 nt, hsa
uuuacucuagggaaaacacugacgaauggucagagcuccuauccugaucuuuucaucaaggcg

SEQ ID NO: 607856 - RNA, 63 nt, hsa
uuuccuggggcaugccugaucagcgugggcuggagcuccuagaccaaccccagcuuucucacc

SEQ ID NO: 607857 - RNA, 63 nt, hsa
aaaugguuauacgugggcaaaagaagaucugacagcuccuauauaccuuaucuuacugaauuc

SEQ ID NO: 607858 - RNA, 63 nt, hsa
gccaggaaguauaugugaguugcccagaguggaagcuccuaguagaggcugaaggccacaggg

SEQ ID NO: 607859 - RNA, 63 nt, hsa
ggggcuggcagaggcccccauauacucugcuacagcuccuaucaugaaaaauaaaauguuugu

SEQ ID NO: 607860 - RNA, 63 nt, hsa
ugaugggccacaaggaaagagagaccccagucaagcuccuaguaugcccuguaauuuuucugg

SEQ ID NO: 607861 - RNA, 63 nt, hsa
ugacagaggagaagucaaguguguggacaggcaagcuccuaauaaacagaguccagugggauu

SEQ ID NO: 607862 - RNA, 63 nt, hsa
gguaaaguagguaucuuucaggucgugauaaugagcuccuaugaaaggaugcaauauaaugac

SEQ ID NO: 607863 - RNA, 63 nt, hsa
uucuuugaauuuggauauuccuucccugguccaagcuccuaucuucggucaaaugcuguuuuu

SEQ ID NO: 607864 - RNA, 63 nt, hsa
uccuauguucuuuuguucagugaauaucccuagagcuccuaccauaugucaggcccuaugccu

SEQ ID NO: 607865 - RNA, 63 nt, hsa
gcccguggaagcagcgucaaagaggggucuuggagcuccuauggagcagacugccccccgagc

SEQ ID NO: 607866 - RNA, 63 nt, hsa
gcuacuaaacugcuuuguauucuauuaagaaauagcuccuaaggauguagucuuguuucauag

SEQ ID NO: 607867 - RNA, 63 nt, hsa
aggcgcuggagccuccaggcccaaacaggcugaagcuccuaaacuuggccauucccaggaggc

SEQ ID NO: 607868 - RNA, 63 nt, hsa
aauguucagugauaucacugaggaaauggugaaagcuccuaucagaacuauaggauuucuucu

SEQ ID NO: 607869 - RNA, 63 nt, hsa
ccaaacuggaacucuacauuuuguaucuuuuaaagcuccuauaaguaaaauaacuauuggcuu

SEQ ID NO: 607870 - RNA, 63 nt, hsa
cgagauaugacaccuaaggaauuccccugcuucagcuccuagcucagccacugacugccccuc

SEQ ID NO: 607871 - RNA, 63 nt, hsa
ucucuuaguccccuuuagcugucuucuauccccagcuccuaacugggacucugugucuaugca

SEQ ID NO: 607872 - RNA, 63 nt, hsa
ccucaccuuucaccccccaccccccacagcgucagcuccuaccucugaccccagcuucucucu

SEQ ID NO: 607873 - RNA, 63 nt, hsa
cuugccucaccuuuaaccccccaccugagccccagcuccuaccucugaccccaacuucucuuu

SEQ ID NO: 607874 - RNA, 63 nt, hsa
acuggauuucuuuuucuccugauuuucggccucagcuccuagaguggccucagcuagguaacc

SEQ ID NO: 607875 - RNA, 63 nt, hsa
ucccugucccucaugccgcuccucagcucccucagcuccuagagggggaagaggagagacccc

SEQ ID NO: 607876 - RNA, 63 nt, hsa
guaucuuccaucagcauaacaacacaacacuugagcuccuagccaauguauuaaguaaggaaa

SEQ ID NO: 607877 - RNA, 63 nt, hsa
acauuuggucuuuguuccugguuccuggcauagagcuccuaaaacgcuuagaauuucaugagu

SEQ ID NO: 607878 - RNA, 63 nt, hsa
gcgguuaggaguucugggugaccauccuggcucagcuccuaacucaccaugugacaucaggcu

SEQ ID NO: 607879 - RNA, 63 nt, hsa
uuuucaaaggcaaauuuaaacuauuuaagaaauagcuccuaauacuugggaucuuguuuagag

SEQ ID NO: 607880 - RNA, 63 nt, hsa
ggauuuugcuuccuccccggugcuaaauuagcaagcuccuagagaagccaugugauucccaga

SEQ ID NO: 607881 - RNA, 55 nt, hsa
caagauccugccucuggugagagguagcuccuaaaaugaacagauuuaaagacag

SEQ ID NO: 607882 - RNA, 63 nt, hsa
auuuccugcuccucuugguuggucaggcacugaagcuccuacacaggucacuguugaaacuca

SEQ ID NO: 607883 - RNA, 63 nt, hsa
ccccaccucacuuucuagagcccugucuguccuagcuccuaucugaccuuguguguaaauacg

SEQ ID NO: 607884 - RNA, 63 nt, hsa
accaguaagagacuaaaucugcaauauauaaagagcuccuacaaaucaguaacaugaagaaca

SEQ ID NO: 607885 - RNA, 63 nt, hsa
agccugccucacagaguuuagacaugacuagccagcuccuacaaucacugaagucaauuccuu

SEQ ID NO: 607886 - RNA, 63 nt, hsa
caccaaagagaagauggaccggcucuugcucccagcuccuauuaggcccggggugggaccaga

SEQ ID NO: 607887 - RNA, 63 nt, hsa
uaaccugugaugucacacucaagaggccuuggcagcuccuagccauagagcuuccuuuccaga

SEQ ID NO: 607888 - RNA, 63 nt, hsa
ugccucccccaccuccugggccucucugaccucagcuccuagacccuggacccuuggcuggga

SEQ ID NO: 607889 - RNA, 63 nt, hsa
gugacugagagggaugaccuccuucagcagggcagcuccuaagaggcugcgugcaggugcgug

SEQ ID NO: 607890 - RNA, 63 nt, hsa
aauauuuauagaguucauagaaauacaucaauaagcuccuaaauuauagagccucaauuuugg

SEQ ID NO: 607891 - RNA, 63 nt, hsa
cuaauugguaauuuauagaacaaauauuugauaagcuccuauuaauugucaccccaccaagcg

SEQ ID NO: 607892 - RNA, 63 nt, hsa
ugacaacaacuucaguauggucuggagcuuaccagcuccuaccaguccagugugcuuauaagu

SEQ ID NO: 607893 - RNA, 63 nt, hsa
gccuagagccuggcacucaagcccaccgguggcagcuccuagugacuggacaugccuggaaga

SEQ ID NO: 607894 - RNA, 65 nt, hsa
gugagagccggauccggaguuaccugagggaggugagcuccuaccccuccacggugggugcggag

SEQ ID NO: 607895 - RNA, 65 nt, hsa
aagaagguaccuagaaauuugaaacuucccuaaaaagcuccuaaugcccaccugcuagauagcuu

SEQ ID NO: 607896 - RNA, 65 nt, hsa
auaccugggauggacauccaggugcccuucauccaagcuccuaugugaggggaauggacauuauu

SEQ ID NO: 607897 - RNA, 65 nt, hsa
cucuagaugccuaaaagaguuuauauacuucuaaaagcuccuaacuuauauccaaagaauugcuu

SEQ ID NO: 607898 - RNA, 65 nt, hsa
ugauuuugcacugagccaaaggucuagcauugucaagcuccuaaaggguucauuuggccccuccu

SEQ ID NO: 607899 - RNA, 65 nt, hsa
ccuuacuugcucagcacugguuauguagcacaaauagcuccuaggaaaauguuucuggggcaacc

SEQ ID NO: 607900 - RNA, 65 nt, hsa
ccugacccgaagucucugggcuagcuacuccccccagcuccuaguugauagaaauggggguucug

SEQ ID NO: 607901 - RNA, 65 nt, hsa
cucccuugagcugguuuucucugauggcacuuuugagcuccuaagcugccagccuucccuucuuu

SEQ ID NO: 607902 - RNA, 65 nt, hsa
uaaccagguuuaccaucucacucccaguaauacccagcuccuaucuaaagccccauucugcauga

SEQ ID NO: 607903 - RNA, 65 nt, hsa
cauggagcuauuuuuuuuucuuaaucccauaauacagcuccuaaaaguugugugggauuugcguu

SEQ ID NO: 607904 - RNA, 65 nt, hsa
ggaaccacaggcagaucugaaaaagaaccaaauagagcuccuaaaaaugagaaauauuuauugaa

SEQ ID NO: 607905 - RNA, 65 nt, hsa
cccugaccccucuugcucguuccccuuccuuccgcagcuccuagucucguccgugacuuuccggu

SEQ ID NO: 607906 - RNA, 65 nt, hsa
gucuugaguugagguuaucaucucaaugaggcuuaagcuccuagaguacaggaccauuuuguuga

SEQ ID NO: 607907 - RNA, 65 nt, hsa
aaaaaugcaaaacacauuuuauucuucuaauuaacagcuccuaggaaaauguagacuuuugcuuu

SEQ ID NO: 607908 - RNA, 65 nt, hsa
ugucgaggccacauugcuggcugcccccucuuuguagcuccuauaaagggcccacaccuggugga

SEQ ID NO: 607909 - RNA, 65 nt, hsa
aguuuucauuugggagcuacccaagggcacccaugagcuccuaucaagaagugaucaacgugacc

SEQ ID NO: 607910 - RNA, 65 nt, hsa
ugcauaugagauaagccugcaaccucuugaccuucagcuccuaugcaggcuucucuugagcccag

SEQ ID NO: 607911 - RNA, 65 nt, hsa
acuacauguuugucucccugccagcugcccuauguagcuccuaacuguugugugauuuggacggc

SEQ ID NO: 607912 - RNA, 65 nt, hsa
uaccauuauucaaauauugcucaauacagcaaauuagcuccuaaccuaacaaaguuuaaguuuac

SEQ ID NO: 607913 - RNA, 65 nt, hsa
acaguggagacacguggcaaggcaggagggcccucagcuccuagggcugucgaauagaggaggag

SEQ ID NO: 607914 - RNA, 65 nt, hsa
uugcucugcacccccauauggucauagcccagaucagcuccuaacccuuaucaccagcugccucu

SEQ ID NO: 607915 - RNA, 65 nt, hsa
cuggggggacccagcugcucuuggacaaguggcugagcuccuaucuggccuccucuuuuuuuuuu

SEQ ID NO: 607916 - RNA, 65 nt, hsa
gccccacaaccuuacucuaaauuugaguagagaaaagcuccuaaagugaccuuccgggugggaag

SEQ ID NO: 607917 - RNA, 65 nt, hsa
gacgggguuucgcuguguuggccgggcuggucuccagcuccuaaccgcgagugauccgccagccu

SEQ ID NO: 607918 - RNA, 65 nt, hsa
gaucauccucugaguagggcugccagaaggcccccagcuccuacccacuccccuugaggcugcug

SEQ ID NO: 607919 - RNA, 65 nt, hsa
cuucucaguucuuugguuggaaggagcaggaaaucagcuccuauucuccaguggagagaucuggc

SEQ ID NO: 607920 - RNA, 65 nt, hsa
ucaucccugauugaugcuaucugaauaaaguuauaagcuccuauaagccauaauuuacuuuuaaa

SEQ ID NO: 607921 - RNA, 65 nt, hsa
acccccaccgcgucggcgggaagcgugggagguguagcuccuacuuuugcacaggcaccagcuac

SEQ ID NO: 607922 - RNA, 65 nt, hsa
uacagauuuaaaacuuucuacauauuauauguaggagcuccuaguguuuuugagaaauuagacug

SEQ ID NO: 607923 - RNA, 65 nt, hsa
uuucugagcuaguuuuuuuguacuauuauacuaaaagcuccuacugugaugugaaaugcucauac

SEQ ID NO: 607924 - RNA, 65 nt, hsa
aaauuggacuauuaggaauaaaacaaucucagagcagcuccuaaacaagagaauaaaaaugggcc

SEQ ID NO: 607925 - RNA, 65 nt, hsa
aaagucuuaggugaacaaucaacuaguauuuguugagcuccuauuugcccagagauggucauauu

SEQ ID NO: 607926 - RNA, 65 nt, hsa
aaaauccugagcuuuccuguccauucccagcauccagcuccuauucuagugccucuucccugcag

SEQ ID NO: 607927 - RNA, 65 nt, hsa
ucugguccacaugaacacaggcuccauccaggcccagcuccuacccaccgccucucugugggcca

SEQ ID NO: 607928 - RNA, 65 nt, hsa
ugaagauuacaacugugauuuccuuuuccucagcaagcuccuauguguauauuuuccugaauuuc

SEQ ID NO: 607929 - RNA, 65 nt, hsa
caaggcccacugcaguuccuauggcgccagucaccagcuccuagacagcacuuggguaccccauu

SEQ ID NO: 607930 - RNA, 65 nt, hsa
cuggagacuaaggcaaauugggccauuaaaagcucagcuccuauguugguauuaacggugguggg

SEQ ID NO: 607931 - RNA, 65 nt, hsa
agaauuucuuauugcccuguuagaaaaauuaacugagcuccuagagaagaacaauccucauguaa

SEQ ID NO: 607932 - RNA, 65 nt, hsa
aaggcuccugggccaucuucaugugcugcuugaagagcuccuauuuuguacuccuggcuagaaug

SEQ ID NO: 607933 - RNA, 65 nt, hsa
cacugcucccagugcugcugcugaccuucacugacagcuccuaguggaagcccaagggccucuga

SEQ ID NO: 607934 - RNA, 65 nt, hsa
cccaguaguggugacugugggcuccauucaaagugagcuccuaagccaugggagacacugaugua

SEQ ID NO: 607935 - RNA, 65 nt, hsa
uuauguuguuccuauggaaucuggaaugagugcagagcuccuacccacacaugacugccccgcca

SEQ ID NO: 607936 - RNA, 65 nt, hsa
gaggcuccccagggccccgcuucuccguacaccccagcuccuaggucucagagaacucccccacc

SEQ ID NO: 607937 - RNA, 65 nt, hsa
agggccuggcucucccugggaggcuggggccccuaagcuccuagguuuuccuuccaagcacccag

SEQ ID NO: 607938 - RNA, 65 nt, hsa
aggagggaaaagcagauggacuugaaaaagauccaagcuccuauuagaaaagguaugaaaaucuu

SEQ ID NO: 607939 - RNA, 65 nt, hsa
ccuagaugaagagaguaucauuuauaccuucuaggagcuccuauugggagacaugaaacauaugu

SEQ ID NO: 607940 - RNA, 65 nt, hsa
auuuuaauucuuauaauuugcaccuauauaaacaaagcuccuacuguauucuucucuucaucaac

SEQ ID NO: 607941 - RNA, 65 nt, hsa
cuuuacuuuguggauauauuuaaaauucauauuauagcuccuauuaaauuccuuccaugauagau

SEQ ID NO: 607942 - RNA, 65 nt, hsa
guagucugaaucacuaauauuccugaguuuuuaugagcuccuaguacagcuaaaguuugccuaug

SEQ ID NO: 607943 - RNA, 65 nt, hsa
uuggguggggcaauacccaugaguugauagugauaagcuccuaaggauuuuuaacuuguacuuuu

SEQ ID NO: 607944 - RNA, 53 nt, hsa; identical to SEQ ID NO: 607758

SEQ ID NO: 607945 - RNA, 65 nt, hsa
uccacuccuauguccauguagacauacacuucagaagcuccuaaaacagagacugaaaggccacc

SEQ ID NO: 607946 - RNA, 65 nt, hsa
uuuauuaaauugauguaaaucagaucuuuucuacaagcuccuauccagccuuuuuuuugaaauuu

SEQ ID NO: 607947 - RNA, 65 nt, hsa
uaucuuauguuuucuuuuggauuggaaagaaauaaagcuccuaguaaaguuauucauauuauauu

SEQ ID NO: 607948 - RNA, 65 nt, hsa
gugugugauucauuuuuaaagaaauauuuuucucaagcuccuauuacuauuugugguuguauuau

SEQ ID NO: 607949 - RNA, 65 nt, hsa
acaacauaagcauagugcaaggagcuccauuuccgagcuccuaagaaauaugcuucaaaggucaa

SEQ ID NO: 607950 - RNA, 65 nt, hsa
uacagcccccuacaccaagaguguaucugugaaagagcuccuacacuuugaaaacuuaagaaucc

SEQ ID NO: 607951 - RNA, 65 nt, hsa
auuuuaaguuauguuaagauuacuaaaacaauaaaagcuccuaaaaaaucaaacuguauucuggu

SEQ ID NO: 607952 - RNA, 65 nt, hsa
cagaaauguguucaucaaaucuggucaagggacuaagcuccuagcugaccauucauucugaagau

SEQ ID NO: 607953 - RNA, 65 nt, hsa
ggugaccgaccccaaaccagacuguuggugggcugagcuccuagccuggaagcauucaggagagc

SEQ ID NO: 607954 - RNA, 65 nt, hsa
aggauggugugaacucgguugggucccgugacucgagcuccuaccaguggcuggccgcggauugg

SEQ ID NO: 607955 - RNA, 65 nt, hsa
gcauuuucaugcucauaaaucugauaggcaacaguagcuccuacugaaauuucuuagguagggaa

SEQ ID NO: 607956 - RNA, 65 nt, hsa
ccugugcauucuccaccccuccgccaauggcuuccagcuccuaaaacaccuggacauuccccauc

SEQ ID NO: 607957 - RNA, 65 nt, hsa
caaggggagcuugagaagaauaaaagggauaaacgagcuccuaguuuuaaaaucucugccauugc

SEQ ID NO: 607958 - RNA, 65 nt, hsa
uugcugcauuucacacaacugugaaccgaauaaauagcuccuauuuggucuaugacuucugccac

SEQ ID NO: 607959 - RNA, 65 nt, hsa
guuuuucuuguuuugguuugguuugguuuuuuaauagcuccuauuuugauggcuguguguuuggc

SEQ ID NO: 607960 - RNA, 65 nt, hsa
uuuggauuuagaagcgucaugaaagcacgagugacagcuccuaaccucuccuuguuuuauuaaac

SEQ ID NO: 607961 - RNA, 65 nt, hsa
gcgugugugaaagcagguggaccauuccacuuuuuagcuccuauugaugcaccaaaccaagugcc

SEQ ID NO: 607962 - RNA, 65 nt, hsa
uucuguaccuauuuaaaguccaccaaggggacugcagcuccuagaacaugagaaucaagccucuu

SEQ ID NO: 607963 - RNA, 65 nt, hsa
gauccccaagaagagggaaggcaggaggggccuacagcuccuaccuugggcccucaggggcugca

SEQ ID NO: 607964 - RNA, 65 nt, hsa
cggagcgccaguggaaggccgaguuccaccgcuggagcuccuacauggugcacuggaagaaccag

SEQ ID NO: 607965 - RNA, 65 nt, hsa
aagguuuuguauugaaacaauguuuauauuuacugagcuccuaaaaaugguagaauacacaugaa

SEQ ID NO: 607966 - RNA, 65 nt, hsa
cauuagcagcuucgaccucauuuuccagaugcaccagcuccuauuaauaaguuagcaaggaaagu

SEQ ID NO: 607967 - RNA, 65 nt, hsa
ggaucuuucugggagcugcgccggacagaguggggagcuccuaguuuguggggggaagcuuugau

SEQ ID NO: 607968 - RNA, 65 nt, hsa
cuagcaguauuauuaaauggauucauuuuaaaaauagcuccuauauuuuguaacaugucucaaac

SEQ ID NO: 607969 - RNA, 65 nt, hsa
ugcaagauugccccaacuuaaacgccacauaaaacagcuccuaauugacaugggcaaaguacagc

SEQ ID NO: 607970 - RNA, 65 nt, hsa
gugggugauugggcagggccugagcuggacaggggagcuccuaguaggggaggggaggggaugcu

SEQ ID NO: 607971 - RNA, 65 nt, hsa
ccagaggcuuucaugagccccaaggcuggggccacagcuccuaccccugcccagcagcccugagc

SEQ ID NO: 607972 - RNA, 65 nt, hsa
acacugccugaagacacacagcaauaagugauuacagcuccuagacuaccuuccaaaaccuguuu

SEQ ID NO: 607973 - RNA, 65 nt, hsa
gagagaccggaauaaacucaaucuuuucuuucccaagcuccuagccaacacuauccuugggagaa

SEQ ID NO: 607974 - RNA, 65 nt, hsa
uuaacuuauucauaguccuauuggacagcaggagcagcuccuacagugaacuauuggcaccaccg

SEQ ID NO: 607975 - RNA, 65 nt, hsa
aaaaaaagcagaaauacacaaugaucucccuuguaagcuccuaagguggcuuuucuuucucuaac

SEQ ID NO: 607976 - RNA, 65 nt, hsa
ucaaugaaaaauagugucuuugugauuuugaguaaagcuccuaucuguuuucuccuucugucucu

SEQ ID NO: 607977 - RNA, 65 nt, hsa
uugucuagucugcccaaaauuacuuauccucaccuagcuccuaccacucuucuuagagacucucc

SEQ ID NO: 607978 - RNA, 65 nt, hsa
cauuaguuuuguuaauauuuguguugucuugaccaagcuccuacuaaguauaggacacaaauguu

SEQ ID NO: 607979 - RNA, 65 nt, hsa
gugcuggcaguguuuggggacauuaugcuggaaagagcuccuagcaucagaggauuaacacuagc

SEQ ID NO: 607980 - RNA, 65 nt, hsa
uuccuccugccccagcccaaccucugggaacaggcagcuccuaucugcaaacuguguucacccuu

SEQ ID NO: 607981 - RNA, 65 nt, hsa
gaucaccauguacuaggagcucugauagccagcucagcuccuaauccuugaggcaacauucuuuu

SEQ ID NO: 607982 - RNA, 65 nt, hsa
uaugcaaagggcagaggcugggaguuuggacgcuuagcuccuaccccuguccuaccucaccgggg

SEQ ID NO: 607983 - RNA, 65 nt, hsa
uuuuggaauuuucaucauguuugcuuauuaaacaaagcuccuacugccaucauacuaaucaugca

SEQ ID NO: 607984 - RNA, 65 nt, hsa
auuaaagucaccuuccuaccauuagagcagaagacagcuccuauaguuuuguauuuuggcagcua

SEQ ID NO: 607985 - RNA, 65 nt, hsa
ggauauuauaucaggugccaggaaucccuugggucagcuccuauccucuggacggggagcaucau

SEQ ID NO: 607986 - RNA, 65 nt, hsa
cuccuuuugaccuuuucaaauaaauauggauggcgagcuccuaggccucuggcuuccugguagag

SEQ ID NO: 607987 - RNA, 65 nt, hsa
uuucaauugcuuaucuacaauucuguuuuauuuguagcuccuagaggauagagcuggacagauuc

SEQ ID NO: 607988 - RNA, 65 nt, hsa
ucaaaaauaaaagaauaaaaguaugucugucauccagcuccuaugucuguuauccagcuccaagu

SEQ ID NO: 607989 - RNA, 65 nt, hsa
gacagagccugcuuggccccacuguuaguccagcgagcuccuauaucaaaaugccguaggccggg

SEQ ID NO: 607990 - RNA, 65 nt, hsa
cuguaccccagccccacucagcacugacaguccccagcuccuaguagugagcugggaggcgcuuc

SEQ ID NO: 607991 - RNA, 65 nt, hsa
gccccgcagggagcugguggcuccagccccacuagagcuccuaaagaucacacagcagcugcucc

SEQ ID NO: 607992 - RNA, 65 nt, hsa
caugaacagauuuaaaauggcugguguuaaauaucagcuccuaauaagauguggacugaaaacac

SEQ ID NO: 607993 - RNA, 65 nt, hsa
aagucuaggggguuccauucuggccaugcgagcccagcuccuaccaacgucgguaacuugagcag

SEQ ID NO: 607994 - RNA, 65 nt, hsa
agagcgugaccccuccugcugggaccuguguuguaagcuccuauuugcuuaucuuguuuauuuca

SEQ ID NO: 607995 - RNA, 65 nt, hsa
uucaguucccagaaucaaagcaaugcauuuuggaaagcuccuagcagagagacuuucagcccuaa

SEQ ID NO: 607996 - RNA, 65 nt, hsa
gccuguuugcuguguugaacucuucacucugcugaagcuccuaauggaaaaagcuuucuucugac

SEQ ID NO: 607997 - RNA, 65 nt, hsa
cauuacauguguuuauucauccagcaguguugcucagcuccuaccucugugccagggcagcauuu

SEQ ID NO: 607998 - RNA, 65 nt, hsa
uugcuggagcaggggucaugugaggccaggccuguagcuccuaccuggggccuauuucuacuuuc

SEQ ID NO: 607999 - RNA, 65 nt, hsa
aagaaauaucaacugaugauauccuauccucuccaagcuccuauuccaggaaaaaagauccaaug

SEQ ID NO: 608000 - RNA, 65 nt, hsa
uucuggguaacaagcccuaacuucuguaauuuaaaagcuccuacuuuugccacaagguggugcuu

SEQ ID NO: 608001 - RNA, 65 nt, hsa
uauuuaaaagauaaccuuuggccuuagacuccguuagcuccuauuuccugccuucagacaaacag

SEQ ID NO: 608002 - RNA, 65 nt, hsa
guggcuuuucaacgggaguaaagcaaagucucuaaagcuccuaguaccuagaagcauuaugaagc

SEQ ID NO: 608003 - RNA, 65 nt, hsa
uuccagcgagaauucuucauccuccacgguucacuagcuccuaccugaagaggaaagggggccau

SEQ ID NO: 608004 - RNA, 65 nt, hsa
gccaugcauuugaauaaagugccucccuuagccugagcuccuaaagaccucuuguacuugguugc

SEQ ID NO: 608005 - RNA, 65 nt, hsa
acucaagccuccaaguaguggcauaucagucuuggagcuccuagcuggugauacggagagggcuu

SEQ ID NO: 608006 - RNA, 65 nt, hsa
agcuuuccuucccuggagagaaccgucuuuaccucagcuccuagggccuccagccccccagcucc

SEQ ID NO: 608007 - RNA, 65 nt, hsa
accacuauuuuagcauaauaaaagaaaguccaaagagcuccuauauagacuacuccagauaacuu

SEQ ID NO: 608008 - RNA, 65 nt, hsa
uuuaaucucuagccauaaaaacauaaguaauaguaagcuccuaagcuuggacaaaggcuggauuc

SEQ ID NO: 608009 - RNA, 65 nt, hsa
uugguacaggcuaggcagaaugugccuagaugaucagcuccuaguaaaaaccuugagaacuaagu

SEQ ID NO: 608010 - RNA, 65 nt, hsa
accaucagggguuuucuuuauggcaaagccaaaauagcuccuacaauuucuuauaucccucguca

SEQ ID NO: 608011 - RNA, 65 nt, hsa
ccagaaacucccugucuuuggggcagggcuaaagcagcuccuaaggaccacuggccauuagcucu

SEQ ID NO: 608012 - RNA, 65 nt, hsa
ggccguguccguagcugucaguaugacuuagaucuagcuccuaccuacugguugauguguuuuuu

SEQ ID NO: 608013 - RNA, 65 nt, hsa
uguuacauguucuguuauuuaauguuguuaucucaagcuccuaucucuugauguuuucuugucau

SEQ ID NO: 608014 - RNA, 65 nt, hsa
cccauucuaaacuccuuuccugcaaacccauuuccagcuccuaguagcuuuccucccaaaggcuu

SEQ ID NO: 608015 - RNA, 65 nt, hsa
acacaugcaugcacacaaacguguacacaagugugagcuccuacacgcauacacacacacacgug

SEQ ID NO: 608016 - RNA, 65 nt, hsa
acacacaugcauguacagguaagcacacauguacaagcuccuacaggcuugcucucacacacgug

SEQ ID NO: 608017 - RNA, 65 nt, hsa
auaaccccagccccaacuuaaaauucuuacauucaagcuccuaagaguucuuaauuuauaacuaa

SEQ ID NO: 608018 - RNA, 65 nt, hsa
ucacucuugguugggccugguugacuuugccagucagcuccuacagugaucaguuggccaccucu

SEQ ID NO: 608019 - RNA, 65 nt, hsa
augagcauucuaucuuuuggcuuucagagugauagagcuccuaacagguguacaggcccaagagu

SEQ ID NO: 608020 - RNA, 65 nt, hsa
acuccacaaaggggagcauuuggaaaugaaggacuagcuccuauguaucagguuaagagcaaggg

SEQ ID NO: 608021 - RNA, 65 nt, hsa
aucauagauuuuucccagccuuauaauauaccauaagcuccuacuucccugccccucccuaauca

SEQ ID NO: 608022 - RNA, 65 nt, hsa
accuugcuauaaccuaagcaugccuucuuuauuccagcuccuauguucuguguauaucauuaaca

SEQ ID NO: 608023 - RNA, 65 nt, hsa
gcaaagguugggauaggcgcagcagcuauaagacaagcuccuacgcucacuguucccugaucauu

SEQ ID NO: 608024 - RNA, 65 nt, hsa
gccagcuggccugcugcucuccagucaaguagcgaagcuccuaccacccagacacccaaacagcc

SEQ ID NO: 608025 - RNA, 65 nt, hsa
acuccccuuguacccccuuccacuucgucuccccuagcuccuagaagcaaccacugaugugauuu

SEQ ID NO: 608026 - RNA, 65 nt, hsa
uucccagauugcguagcauucagauugauuugagcagcuccuacugugauaaguguaucccagau

SEQ ID NO: 608027 - RNA, 65 nt, hsa
ggcgcuccaacuuccuucccugccuuuucccuccaagcuccuauuuuacugugucagcuggaagg

SEQ ID NO: 608028 - RNA, 65 nt, hsa
agaguggaucagagagacuaggacaguuacugcagagcuccuaagucaccacucaaccaguggcu

SEQ ID NO: 608029 - RNA, 65 nt, hsa
ucuugucuucuggucacaccucacuauguccccucagcuccuaucucuguauggccugguuuuuc

SEQ ID NO: 608030 - RNA, 65 nt, hsa
ccugagcagaggcugggcauugccacuaggaccugagcuccuagagaacaaggaccuggguggcc

SEQ ID NO: 608031 - RNA, 65 nt, hsa
ccuccuccagggcgacggccggggacugccuggagagcuccuauuucaaggagaagccccuacgu

SEQ ID NO: 608032 - RNA, 65 nt, hsa
uucuaaucagcaaguccaguggccacuuagagcccagcuccuaccucuucauucacuuaacaagu

SEQ ID NO: 608033 - RNA, 65 nt, hsa
acacacagaaaccccucuucuccccgcccucccccagcuccuaccugccucccacgccucaggug

SEQ ID NO: 608034 - RNA, 65 nt, hsa
ucaccaacucgaguguucagcccugugugcucuccagcuccuaagucgugggccugguuucagcu

SEQ ID NO: 608035 - RNA, 65 nt, hsa
uuggagaccacuuuuauuuacucaugagaaguggaagcuccuaguaucagaagaagcugauacau

SEQ ID NO: 608036 - RNA, 65 nt, hsa
aagaguaggguugugccuuauucaacugcauacauagcuccuagcacagugccuuauucgguagg

SEQ ID NO: 608037 - RNA, 65 nt, hsa
ucuauaucuagaaaaccccaugaucuuggcccaaaagcuccuagaucugauaaacaacuucagcu

SEQ ID NO: 608038 - RNA, 65 nt, hsa
cuagaaccuuguguccuuugaauucucgcccugccagcuccuagaaauaguuucaaucuuggaau

SEQ ID NO: 608039 - RNA, 65 nt, hsa
ggcuucucucagccuccccaccagugauggauaacagcuccuauucucagcugaccugacugagc

SEQ ID NO: 608040 - RNA, 65 nt, hsa
gauggucccuuccauuccccugaaaccugcaugagagcuccuaacauguuucuccaaugcaauca

SEQ ID NO: 608041 - RNA, 65 nt, hsa
uuuuuacucuagggaaaacacugacgaauggucagagcuccuauccugaucuuuucaucaaggcg

SEQ ID NO: 608042 - RNA, 65 nt, hsa
gcuuuccuggggcaugccugaucagcgugggcuggagcuccuagaccaaccccagcuuucucacc

SEQ ID NO: 608043 - RNA, 65 nt, hsa
agaaaugguuauacgugggcaaaagaagaucugacagcuccuauauaccuuaucuuacugaauuc

SEQ ID NO: 608044 - RNA, 65 nt, hsa
cagccaggaaguauaugugaguugcccagaguggaagcuccuaguagaggcugaaggccacaggg

SEQ ID NO: 608045 - RNA, 65 nt, hsa
ugggggcuggcagaggcccccauauacucugcuacagcuccuaucaugaaaaauaaaauguuugu

SEQ ID NO: 608046 - RNA, 65 nt, hsa
ugugaugggccacaaggaaagagagaccccagucaagcuccuaguaugcccuguaauuuuucugg

SEQ ID NO: 608047 - RNA, 65 nt, hsa
acugacagaggagaagucaaguguguggacaggcaagcuccuaauaaacagaguccagugggauu

SEQ ID NO: 608048 - RNA, 65 nt, hsa
aagguaaaguagguaucuuucaggucgugauaaugagcuccuaugaaaggaugcaauauaaugac

SEQ ID NO: 608049 - RNA, 65 nt, hsa
ucuucuuugaauuuggauauuccuucccugguccaagcuccuaucuucggucaaaugcuguuuuu

SEQ ID NO: 608050 - RNA, 65 nt, hsa
uuuccuauguucuuuuguucagugaauaucccuagagcuccuaccauaugucaggcccuaugccu

SEQ ID NO: 608051 - RNA, 65 nt, hsa
gggcccguggaagcagcgucaaagaggggucuuggagcuccuauggagcagacugccccccgagc

SEQ ID NO: 608052 - RNA, 65 nt, hsa
aagcuacuaaacugcuuuguauucuauuaagaaauagcuccuaaggauguagucuuguuucauag

SEQ ID NO: 608053 - RNA, 65 nt, hsa
gcaggcgcuggagccuccaggcccaaacaggcugaagcuccuaaacuuggccauucccaggaggc

SEQ ID NO: 608054 - RNA, 65 nt, hsa
uuaauguucagugauaucacugaggaaauggugaaagcuccuaucagaacuauaggauuucuucu

SEQ ID NO: 608055 - RNA, 65 nt, hsa
uuccaaacuggaacucuacauuuuguaucuuuuaaagcuccuauaaguaaaauaacuauuggcuu

SEQ ID NO: 608056 - RNA, 65 nt, hsa
gacgagauaugacaccuaaggaauuccccugcuucagcuccuagcucagccacugacugccccuc

SEQ ID NO: 608057 - RNA, 65 nt, hsa
ucucucuuaguccccuuuagcugucuucuauccccagcuccuaacugggacucugugucuaugca

SEQ ID NO: 608058 - RNA, 65 nt, hsa
ugccucaccuuucaccccccaccccccacagcgucagcuccuaccucugaccccagcuucucucu

SEQ ID NO: 608059 - RNA, 65 nt, hsa
accuugccucaccuuuaaccccccaccugagccccagcuccuaccucugaccccaacuucucuuu

SEQ ID NO: 608060 - RNA, 65 nt, hsa
uuacuggauuucuuuuucuccugauuuucggccucagcuccuagaguggccucagcuagguaacc

SEQ ID NO: 608061 - RNA, 65 nt, hsa
ccucccugucccucaugccgcuccucagcucccucagcuccuagagggggaagaggagagacccc

SEQ ID NO: 608062 - RNA, 65 nt, hsa
agguaucuuccaucagcauaacaacacaacacuugagcuccuagccaauguauuaaguaaggaaa

SEQ ID NO: 608063 - RNA, 65 nt, hsa
auacauuuggucuuuguuccugguuccuggcauagagcuccuaaaacgcuuagaauuucaugagu

SEQ ID NO: 608064 - RNA, 65 nt, hsa
gggcgguuaggaguucugggugaccauccuggcucagcuccuaacucaccaugugacaucaggcu

SEQ ID NO: 608065 - RNA, 65 nt, hsa
uuuuuucaaaggcaaauuuaaacuauuuaagaaauagcuccuaauacuugggaucuuguuuagag

SEQ ID NO: 608066 - RNA, 65 nt, hsa
uaggauuuugcuuccuccccggugcuaaauuagcaagcuccuagagaagccaugugauucccaga

SEQ ID NO: 608067 - RNA, 55 nt, hsa; identical to SEQ ID NO: 607881

SEQ ID NO: 608068 - RNA, 65 nt, hsa
caauuuccugcuccucuugguuggucaggcacugaagcuccuacacaggucacuguugaaacuca

SEQ ID NO: 608069 - RNA, 65 nt, hsa
cgccccaccucacuuucuagagcccugucuguccuagcuccuaucugaccuuguguguaaauacg

SEQ ID NO: 608070 - RNA, 65 nt, hsa
uaaccaguaagagacuaaaucugcaauauauaaagagcuccuacaaaucaguaacaugaagaaca

SEQ ID NO: 608071 - RNA, 65 nt, hsa
auagccugccucacagaguuuagacaugacuagccagcuccuacaaucacugaagucaauuccuu

SEQ ID NO: 608072 - RNA, 65 nt, hsa
cucaccaaagagaagauggaccggcucuugcucccagcuccuauuaggcccggggugggaccaga

SEQ ID NO: 608073 - RNA, 65 nt, hsa
ucuaaccugugaugucacacucaagaggccuuggcagcuccuagccauagagcuuccuuuccaga

SEQ ID NO: 608074 - RNA, 65 nt, hsa
ccugccucccccaccuccugggccucucugaccucagcuccuagacccuggacccuuggcuggga

SEQ ID NO: 608075 - RNA, 65 nt, hsa
augugacugagagggaugaccuccuucagcagggcagcuccuaagaggcugcgugcaggugcgug

SEQ ID NO: 608076 - RNA, 65 nt, hsa
uuaauauuuauagaguucauagaaauacaucaauaagcuccuaaauuauagagccucaauuuugg

SEQ ID NO: 608077 - RNA, 65 nt, hsa
aucuaauugguaauuuauagaacaaauauuugauaagcuccuauuaauugucaccccaccaagcg

SEQ ID NO: 608078 - RNA, 65 nt, hsa
acugacaacaacuucaguauggucuggagcuuaccagcuccuaccaguccagugugcuuauaagu

SEQ ID NO: 608079 - RNA, 65 nt, hsa
aagccuagagccuggcacucaagcccaccgguggcagcuccuagugacuggacaugccuggaaga

SEQ ID NO: 608080 - RNA, 64 nt, hsa
augucagauguuuuuucauucauuaucaggaaguuuuaguuaucugucauuuuuuuuuuucaca

SEQ ID NO: 608081 - RNA, 64 nt, hsa
auauuuuagcauauucgaacuaauuucuaagaaauuuaguuauaacucuauguaguuauagaaa

SEQ ID NO: 608082 - RNA, 64 nt, hsa
auuuuguggcuauuucauguauaaaaugaaaggcuuuaguuauuucuagaggagucccauccaa

SEQ ID NO: 608083 - RNA, 64 nt, hsa
ucaacuucagauucauuaaauuuuaacagcuguauuuaguuauaauuuuuguaucuuacaacag

SEQ ID NO: 608084 - RNA, 64 nt, hsa
cguuaccaucaaacucacaaauagguugaaauccuuuaguuauaacucagccuuuaggaacacc

SEQ ID NO: 608085 - RNA, 64 nt, hsa
uagaaaucuuuucguguuccccauugagaaaugcuuuaguuagcaucuucaugcuuggaaaucu

SEQ ID NO: 608086 - RNA, 64 nt, hsa
uucacuuuuaacacaaguuagaaauuauaucccauuuaguuaagugcgugauuuauauucagaa

SEQ ID NO: 608087 - RNA, 64 nt, hsa
aaaacuuaaaauuaguacuguuuuauugagagaauuuaguuauauuuuaaaucagaaguauggg

SEQ ID NO: 608088 - RNA, 64 nt, hsa
ucacauguuugagucuauuuguuucuacacauaauuuaguuaucuucugcuaggaaggcagaaa

SEQ ID NO: 608089 - RNA, 64 nt, hsa
uacacuaucugccaguuagucacuuacuugacauuuuaguuaucagaucaccugucaggguaug

SEQ ID NO: 608090 - RNA, 64 nt, hsa
auccaucuaauccaggauucccucacucuuuuuuuuuaguuacuaaucauuuuaugaaaauaau

SEQ ID NO: 608091 - RNA, 64 nt, hsa
ucuaggcauuaauacuacuuuacuaucuauacuguuuaguuauuccuuucuuuacccaccuaaa

SEQ ID NO: 608092 - RNA, 64 nt, hsa
uguuggaauaugcaaaggucauucuuuacuaacuuuuaguuacuaaauuauagcuaaguuuugu

SEQ ID NO: 608093 - RNA, 64 nt, hsa
augucuacaaaaauagauuacagcuuauuuuauuuuuaguuaaaucucuuaauacacagagaac

SEQ ID NO: 608094 - RNA, 64 nt, hsa
uaguauaaucaccauuaucuguuuaaaggauccauuuaguuaaaaucgggcacucuauauucau

SEQ ID NO: 608095 - RNA, 64 nt, hsa
acuagguuacuuauaaugcaaggaaucaggaaacuuuaguuauuuauaguauaaucaccauuau

SEQ ID NO: 608096 - RNA, 64 nt, hsa
cucugcauuauuaugaaugaaaagcauucuuaauuuuaguuaaaauuaaguuagucauauguua

SEQ ID NO: 608097 - RNA, 64 nt, hsa
auucuuuuuauuacaagcaauucaauuguacacuuuuaguuauuuuuaaauuuacaauguuauu

SEQ ID NO: 608098 - RNA, 64 nt, hsa
ucauuuuguuuuuaguuggagaacucuauagcccuuuaguuauuuuucuuuucacuuuuuauag

SEQ ID NO: 608099 - RNA, 64 nt, hsa
uaauuccacaauuaguguauuaaguuacauuuuauuuaguuagaacacuucauuuuguuuuuag

SEQ ID NO: 608100 - RNA, 64 nt, hsa
auccuuuguauuacaagcaacccaguuuuauacuuuuaguuauuuuaaaauguaaaauuaaauu

SEQ ID NO: 608101 - RNA, 64 nt, hsa
cauaacuugagcuacacuaaaccacaugacaguguuuaguuaauucuuguauaaauuaguauau

SEQ ID NO: 608102 - RNA, 64 nt, hsa
uggaugucuuuuuuacuuguguuguuucaagaguuuuaguuaaauaggaaguaggcaaauguaa

SEQ ID NO: 608103 - RNA, 64 nt, hsa
acuuuguuuuaguuagaacaaagcucaaaacuacuuuaguuaacuuggucaucugauuuuauau

SEQ ID NO: 608104 - RNA, 64 nt, hsa
guauauuauaaaaauuguaaaacuacuacuuuguuuuaguuagaacaaagcucaaaacuacuuu

SEQ ID NO: 608105 - RNA, 64 nt, hsa
uuguuaaaguuuucuugcacuaucacaauugcuuuuuaguuauuucucaagaagcauguucgua

SEQ ID NO: 608106 - RNA, 64 nt, hsa
ggcaguaacauuuuccuuucugugaaguucuaaauuuaguuaugaccuauuuagcaaugccuuu

SEQ ID NO: 608107 - RNA, 64 nt, hsa
gauuuuauaaacugggggauuucuuaauuagauaaaaguucauuacugaagauggaauauuaua

SEQ ID NO: 608108 - RNA, 64 nt, hsa
aauaccuguggucauuugguuccucuauccugacaaaguucacuggaaauugcccucagauuuu

SEQ ID NO: 608109 - RNA, 64 nt, hsa
aggacauauagaaauguggauuucagcaccuuccaaaguucagccaguuaucaguagauacaau

SEQ ID NO: 608110 - RNA, 64 nt, hsa
auuagaaaugaaauauuuuuuauucauuggccaaaaaguucacagacagcaguguuugcuauuu

SEQ ID NO: 608111 - RNA, 64 nt, hsa
aagcaaagaaggguugauaaaaguucuugaucaaaaaguucaaagaaaccagaauuuuagacag

SEQ ID NO: 608112 - RNA, 64 nt, hsa
aaaaagcauugaauggaaaaucaauauuuaaaacaaaguucaauuuagcuggauuucugaacua

SEQ ID NO: 608113 - RNA, 64 nt, hsa
uugcaguacuuuuuaauuuugauaaaaaagauacaaaguucauaauaucaaaauauguguucaa

SEQ ID NO: 608114 - RNA, 64 nt, hsa
aaauuggcaucaguguagacggugcugauugggaaaaguucaugauuaggaaauucauguaaga

SEQ ID NO: 608115 - RNA, 64 nt, hsa
ggggccaccugaccaguaaacuguggacuaguagaaaguucauauucuaccucuaaaaacaggu

SEQ ID NO: 608116 - RNA, 64 nt, hsa
gaugaaagugugaauuagagggacuccuuccaauaaaguucaaacuuaaaaaaaaucauuuuaa

SEQ ID NO: 608117 - RNA, 64 nt, hsa
accuaccuggcauauuuauuuugcagucuuguugaaaguucaugaaacuuuguacuuuuuaaua

SEQ ID NO: 608118 - RNA, 64 nt, hsa
gacgaccauacugccucugagcugaaaacauucaaaaguucacaucccuguuugggggauacca

SEQ ID NO: 608119 - RNA, 64 nt, hsa
uuuuuccuugaaggacaaccgaaccauagccucuaaaguucaagugcacugaggugucggaacg

SEQ ID NO: 608120 - RNA, 64 nt, hsa
aaugaccauuacuguagaguuacaacaagaggguaaaguucauacauggcgaccugugucaaau

SEQ ID NO: 608121 - RNA, 64 nt, hsa
gguaccuagacauagcggaacagaaaacccuucaaaaguucagucuagucuggaaaacaaacau

SEQ ID NO: 608122 - RNA, 64 nt, hsa
agcucauuguucucuagagcugagcucuucugcuaaaguucaaaguucacaucaguguagccag

SEQ ID NO: 608123 - RNA, 64 nt, hsa
uguucucuagagcugagcucuucugcuaaaguucaaaguucacaucaguguagccagagugaag

SEQ ID NO: 608124 - RNA, 64 nt, hsa
ucaguaggauacauagcuuuucuuccagugaaacaaaguucauaucauccauuguuuuucaagc

SEQ ID NO: 608125 - RNA, 64 nt, hsa
ucaaagaauacauguggcuaacaaguguaaugagaaaguucaugugucacaugaaaaugaucau

SEQ ID NO: 608126 - RNA, 64 nt, hsa
cagcggucacuauuuucucuuaacacauaggaaaaaaguucagacaucgcuacaauaaaugugc

SEQ ID NO: 608127 - RNA, 64 nt, hsa
accuuuuuuccuuuuuauaugaauuauuuuguacaaaguucagagagcgguaccuuuccuacug

SEQ ID NO: 608128 - RNA, 64 nt, hsa
uuuuagccaaaauucccaccucauucggcaccaaaaaguucacacuagggaaagaacuuacaaa

SEQ ID NO: 608129 - RNA, 64 nt, hsa
cuuuaaccaaaauucucaucucauucagcaccagaaaguucacaccagauaaagaauguauaua

SEQ ID NO: 608130 - RNA, 64 nt, hsa
aagacacuugaccuguuugggcuguugccacuuaaaaguucaugaccacaaauguccacagugu

SEQ ID NO: 608131 - RNA, 64 nt, hsa
cuuuguggcagauaacuggcuuaugacaccuugaaaaguucaagugcucauauaacacaccaca

SEQ ID NO: 608132 - RNA, 64 nt, hsa
gcugaauguaaucauugaaccucgagucacuguaaaaguucaguaauugcuuauuguauuaguu

SEQ ID NO: 608133 - RNA, 64 nt, hsa
augugcucuguuuauucugauuuuacuaaaauaaaaaguucaaaagucuuccugcugucacuug

SEQ ID NO: 608134 - RNA, 64 nt, hsa; identical to SEQ ID NO: 517561

SEQ ID NO: 608135 - RNA, 64 nt, hsa; identical to SEQ ID NO: 517562

SEQ ID NO: 608136 - RNA, 64 nt, hsa; identical to SEQ ID NO: 517563

SEQ ID NO: 608137 - RNA, 64 nt, hsa; identical to SEQ ID NO: 517564

SEQ ID NO: 608138 - RNA, 64 nt, hsa; identical to SEQ ID NO: 517565

SEQ ID NO: 608139 - RNA, 64 nt, hsa; identical to SEQ ID NO: 517566

SEQ ID NO: 608140 - RNA, 64 nt, hsa; identical to SEQ ID NO: 517567

SEQ ID NO: 608141 - RNA, 64 nt, hsa; identical to SEQ ID NO: 517568

SEQ ID NO: 608142 - RNA, 64 nt, hsa; identical to SEQ ID NO: 517569

SEQ ID NO: 608143 - RNA, 64 nt, hsa; identical to SEQ ID NO: 517570

SEQ ID NO: 608144 - RNA, 61 nt, hsa; identical to SEQ ID NO: 517571

SEQ ID NO: 608145 - RNA, 64 nt, hsa; identical to SEQ ID NO: 517572

SEQ ID NO: 608146 - RNA, 64 nt, hsa; identical to SEQ ID NO: 517573

SEQ ID NO: 608147 - RNA, 64 nt, hsa; identical to SEQ ID NO: 517574

SEQ ID NO: 608148 - RNA, 64 nt, hsa; identical to SEQ ID NO: 517575

SEQ ID NO: 608149 - RNA, 59 nt, hsa; identical to SEQ ID NO: 517576

SEQ ID NO: 608150 - RNA, 64 nt, hsa; identical to SEQ ID NO: 517577

SEQ ID NO: 608151 - RNA, 64 nt, hsa; identical to SEQ ID NO: 517578

SEQ ID NO: 608152 - RNA, 64 nt, hsa; identical to SEQ ID NO: 517579

SEQ ID NO: 608153 - RNA, 64 nt, hsa; identical to SEQ ID NO: 517580

SEQ ID NO: 608154 - RNA, 64 nt, hsa; identical to SEQ ID NO: 517581

SEQ ID NO: 608155 - RNA, 64 nt, hsa; identical to SEQ ID NO: 517582

SEQ ID NO: 608156 - RNA, 64 nt, hsa; identical to SEQ ID NO: 517583

SEQ ID NO: 608157 - RNA, 64 nt, hsa; identical to SEQ ID NO: 517584

SEQ ID NO: 608158 - RNA, 64 nt, hsa; identical to SEQ ID NO: 517585

SEQ ID NO: 608159 - RNA, 64 nt, hsa; identical to SEQ ID NO: 517586

SEQ ID NO: 608160 - RNA, 64 nt, hsa; identical to SEQ ID NO: 517587

SEQ ID NO: 608161 - RNA, 64 nt, hsa; identical to SEQ ID NO: 517588

SEQ ID NO: 608162 - RNA, 64 nt, hsa; identical to SEQ ID NO: 517589

SEQ ID NO: 608163 - RNA, 64 nt, hsa; identical to SEQ ID NO: 517590

SEQ ID NO: 608164 - RNA, 64 nt, hsa; identical to SEQ ID NO: 517591

SEQ ID NO: 608165 - RNA, 64 nt, hsa; identical to SEQ ID NO: 517592

SEQ ID NO: 608166 - RNA, 64 nt, hsa; identical to SEQ ID NO: 517593

SEQ ID NO: 608167 - RNA, 64 nt, hsa; identical to SEQ ID NO: 517594

SEQ ID NO: 608168 - RNA, 64 nt, hsa; identical to SEQ ID NO: 517595

SEQ ID NO: 608169 - RNA, 64 nt, hsa; identical to SEQ ID NO: 517596

SEQ ID NO: 608170 - RNA, 64 nt, hsa; identical to SEQ ID NO: 517597

SEQ ID NO: 608171 - RNA, 64 nt, hsa; identical to SEQ ID NO: 517598

SEQ ID NO: 608172 - RNA, 64 nt, hsa; identical to SEQ ID NO: 517599

SEQ ID NO: 608173 - RNA, 64 nt, hsa; identical to SEQ ID NO: 517600

SEQ ID NO: 608174 - RNA, 64 nt, hsa; identical to SEQ ID NO: 517601

SEQ ID NO: 608175 - RNA, 64 nt, hsa; identical to SEQ ID NO: 517602

SEQ ID NO: 608176 - RNA, 64 nt, hsa; identical to SEQ ID NO: 517603

SEQ ID NO: 608177 - RNA, 64 nt, hsa; identical to SEQ ID NO: 517604

SEQ ID NO: 608178 - RNA, 64 nt, hsa; identical to SEQ ID NO: 517605

SEQ ID NO: 608179 - RNA, 64 nt, hsa; identical to SEQ ID NO: 517606

SEQ ID NO: 608180 - RNA, 64 nt, hsa; identical to SEQ ID NO: 517607

SEQ ID NO: 608181 - RNA, 64 nt, hsa; identical to SEQ ID NO: 517608

SEQ ID NO: 608182 - RNA, 64 nt, hsa; identical to SEQ ID NO: 517609

SEQ ID NO: 608183 - RNA, 64 nt, hsa; identical to SEQ ID NO: 517610

SEQ ID NO: 608184 - RNA, 64 nt, hsa; identical to SEQ ID NO: 517611

SEQ ID NO: 608185 - RNA, 64 nt, hsa; identical to SEQ ID NO: 517612

SEQ ID NO: 608186 - RNA, 64 nt, hsa; identical to SEQ ID NO: 517613

SEQ ID NO: 608187 - RNA, 64 nt, hsa; identical to SEQ ID NO: 517614

SEQ ID NO: 608188 - RNA, 64 nt, hsa; identical to SEQ ID NO: 517615

SEQ ID NO: 608189 - RNA, 64 nt, hsa; identical to SEQ ID NO: 289985

SEQ ID NO: 608190 - RNA, 64 nt, hsa; identical to SEQ ID NO: 289986

SEQ ID NO: 608191 - RNA, 64 nt, hsa; identical to SEQ ID NO: 289987

SEQ ID NO: 608192 - RNA, 64 nt, hsa; identical to SEQ ID NO: 289988

SEQ ID NO: 608193 - RNA, 58 nt, hsa; identical to SEQ ID NO: 289989

SEQ ID NO: 608194 - RNA, 64 nt, hsa; identical to SEQ ID NO: 289990

SEQ ID NO: 608195 - RNA, 64 nt, hsa; identical to SEQ ID NO: 289991

SEQ ID NO: 608196 - RNA, 64 nt, hsa; identical to SEQ ID NO: 289992

SEQ ID NO: 608197 - RNA, 64 nt, hsa; identical to SEQ ID NO: 289993

SEQ ID NO: 608198 - RNA, 64 nt, hsa; identical to SEQ ID NO: 289994

SEQ ID NO: 608199 - RNA, 64 nt, hsa; identical to SEQ ID NO: 289995

SEQ ID NO: 608200 - RNA, 64 nt, hsa; identical to SEQ ID NO: 289996

SEQ ID NO: 608201 - RNA, 64 nt, hsa; identical to SEQ ID NO: 289997

SEQ ID NO: 608202 - RNA, 64 nt, hsa; identical to SEQ ID NO: 289998

SEQ ID NO: 608203 - RNA, 64 nt, hsa; identical to SEQ ID NO: 289999

SEQ ID NO: 608204 - RNA, 64 nt, hsa
uugguucuuuuuaaauuguuuguaacuuggaugcugccgcuacugaauguuuacaaauugcuug

SEQ ID NO: 608205 - RNA, 64 nt, hsa
gugcuacuggcauccaguaaauagaagccaggggugccgcuaaacauccuauaaugcacagggc

SEQ ID NO: 608206 - RNA, 64 nt, hsa
gugugauuccuuaauggccaacugaagauugaauugccgcuaacaaccauaucguguuagugaa

SEQ ID NO: 608207 - RNA, 64 nt, hsa
uuuuaaugcaccugaauguuagauaguuacuauaugccgcuacaaaaagguaaaacuuuuuaua

SEQ ID NO: 608208 - RNA, 64 nt, hsa
augcacccaguacugcuacaucgacuccacgcccugccgcuacuucaccugagggccgugagga

SEQ ID NO: 608209 - RNA, 64 nt, hsa
ggcugcuccuuguaauacagauguaguacgcacuugccgcuaagccuuaccaggagacucucau

SEQ ID NO: 608210 - RNA, 64 nt, hsa
uucauaacuagaguauaaaguaauuguaugugcuugccgcuauuuuuuucuuccuuuuaggaug

SEQ ID NO: 608211 - RNA, 64 nt, hsa
auauaaauauauaacuguccuuuucaucccauguugccgcuaagugauauuucauauguguggu

SEQ ID NO: 608212 - RNA, 64 nt, hsa
ugagaugaggccccacaccaggacuggacugggaugccgcuagugaggcugaggggugccagcg

SEQ ID NO: 608213 - RNA, 64 nt, hsa
ccucgucgggaggacaggagaccgcugcugcugcugccgcuacugcugcugcugccuuaaguag

SEQ ID NO: 608214 - RNA, 64 nt, hsa
gguugaucagaaacucacccuaaaucugaacgggugccgcuauaauuugugacaucuggcaaga

SEQ ID NO: 608215 - RNA, 64 nt, hsa
auauuauccuuuucuaauagucucauguaaaauaugccgcuauuacaacuuacaacuaauugaa

SEQ ID NO: 608216 - RNA, 64 nt, hsa
agcccaggagguugaggcugcagugagcagagcgugccgcuacacuccagccugaugacagacc

SEQ ID NO: 608217 - RNA, 54 nt, hsa
uauuggaugagcuggugugagugcugccgcuacaccgagaccuggagaagaccu

SEQ ID NO: 608218 - RNA, 64 nt, hsa
augccacuccucccuccggcuugaccuguuucucugccgcuaccucccuccccgucucauuccg

SEQ ID NO: 608219 - RNA, 64 nt, hsa
gauacuauauuuuaggucuuaauacacacaguuaugccgcuagauacaugcuuuuuaaugagau

SEQ ID NO: 608220 - RNA, 64 nt, hsa
ucucuggagcccaccagggaaggcccucauccccugccgcuacuucucuggggaauguggguuc

SEQ ID NO: 608221 - RNA, 64 nt, hsa
cuuauuguuuacagauguaguucuuguuagaggaugccgcuagcuccugcccggggucccuaug

SEQ ID NO: 608222 - RNA, 64 nt, hsa
uuuuucuucugccaauuuacuaugauuguguaugugccgcuaccaccaccccccccaugggggg

SEQ ID NO: 608223 - RNA, 64 nt, hsa
cacacagagcauuuuagugacauccacuacuuauugccgcuaugaguuagagucuaucaguguu

SEQ ID NO: 608224 - RNA, 64 nt, hsa
aaauaguguaucucguggaaucagugguuagcauugccgcuauuauauuuacucauuuuaucau

SEQ ID NO: 608225 - RNA, 64 nt, hsa
aaccugaaauuauuagggauuuacucagcccugcugccgcuaacaguggaguuaugucacugau

SEQ ID NO: 608226 - RNA, 64 nt, hsa
gcaguaugaggacauggugguggacgagugcggcugccgcuaacccggggcgggcagggacgcg

SEQ ID NO: 608227 - RNA, 64 nt, hsa
gagguccgacaaaccuggcgucuauaccaacaucugccgcuaccuggacuggaucaagaagauc

SEQ ID NO: 608228 - RNA, 64 nt, hsa
ugagguuuagcaauagcuagcuauauaugguaggugccgcuacaguuuuuauuuagcaugggga

SEQ ID NO: 608229 - RNA, 64 nt, hsa
gagcuuccagaauccucgcagacagcccagagccugccgcuacccucggccugcccaccaccaa

SEQ ID NO: 608230 - RNA, 64 nt, hsa
uauuccuggcaggcuucaagaacagcugcacaugugccgcuaacugaccgcguugccauuggcg

SEQ ID NO: 608231 - RNA, 64 nt, hsa
aaaagguuguuucugaagcucgaguacuucccaaugccgcuacuuugcuguggacaccccugcu

SEQ ID NO: 608232 - RNA, 64 nt, hsa
uguggauguagcacugaguggugauacccagaccagcagucaccccaggaagugggggcuaccc

SEQ ID NO: 608233 - RNA, 64 nt, hsa
uuuaaucuccuguuuaugauauauucaccucuagagcagucacugucaggguguugcgaaaaua

SEQ ID NO: 608234 - RNA, 64 nt, hsa
aauacugguuauccugugcuacagagaaaaucaaagcagucauaagcuccaguuuucguauugc

SEQ ID NO: 608235 - RNA, 64 nt, hsa
cccuuuuugaguaauuuucugaugggaggaaaguagcagucaucaucuuuuugugugcaggcug

SEQ ID NO: 608236 - RNA, 64 nt, hsa
aaguauggcaaagcuuauccaauuuuaugcuuggagcagucaguacauaccaguuucugauguu

SEQ ID NO: 608237 - RNA, 64 nt, hsa
ucaacuugacguacauuuuuagugacauuuuaaaagcagucagauucuauaaauggcaaguaag

SEQ ID NO: 608238 - RNA, 64 nt, hsa
ugaugauaaucauagcagcacuuuucacagcaucagcagucaucucacuaguuauguucaaaaa

SEQ ID NO: 608239 - RNA, 64 nt, hsa
ucaugaaaucauagucauaaaauggucuucacacagcagucauccgugucauuuaucauuuugu

SEQ ID NO: 608240 - RNA, 64 nt, hsa
acgagcggucaccagaaucgcccgaucacagacgagcagucaucggaaucacccgaucacagac

SEQ ID NO: 608241 - RNA, 64 nt, hsa
acgagcagucaucggaaucacccgaucacagacgagcagucaucggacucacccgaucacagac

SEQ ID NO: 608242 - RNA, 64 nt, hsa
acgagcggucaccagacucgcccgaucacagacgagcagucaucggaaucacccgaucacagac

SEQ ID NO: 608243 - RNA, 64 nt, hsa
acaagcagucaucggaaucacccgaucacagacgagcagucaucggacucacccgaucacagac

SEQ ID NO: 608244 - RNA, 64 nt, hsa
acgagcggccaccggaaucgcccaaucacagacaagcagucaucggaaucacccgaucacagac

SEQ ID NO: 608245 - RNA, 64 nt, hsa
acgagcggucaccggaaucgcccggucacagacgagcagucaucggacucacccgaucacagac

SEQ ID NO: 608246 - RNA, 64 nt, hsa
aggaguuaaauauauauuguuaaaggagaccuguagcagucaaagauuuuauugauuuaaugac

SEQ ID NO: 608247 - RNA, 64 nt, hsa
uuccuuuaaaagaaaaaaacuucuguuuguuuuuagcagucauuauuuacaauuugcagugauu

SEQ ID NO: 608248 - RNA, 64 nt, hsa
uccuuccccuguccuuucauuucucuauccaaguagcagucagguucuuggugugaugggacug

SEQ ID NO: 608249 - RNA, 64 nt, hsa
gggagacagcaggauuagcuucagcuugggcuggagcagucaauauaggaucucaggccaggcc

SEQ ID NO: 608250 - RNA, 64 nt, hsa
cugugaagcaaaaccaggagcccuggcugaagcaagcagucaguacuugcccacugacagucaa

SEQ ID NO: 608251 - RNA, 64 nt, hsa
cagggucauaauuugugaucugugguggauuucuagcagucaucacaggcuucuacugaaaguc

SEQ ID NO: 608252 - RNA, 64 nt, hsa
aacuaagaccccgaaaacuccagaccuucaggagagcagucagcagagccccucugugaaguga

SEQ ID NO: 608253 - RNA, 64 nt, hsa
ccacacuuucucuccgagcaugugggucucgcugagcagucauggaaugcgguagagccagggg

SEQ ID NO: 608254 - RNA, 64 nt, hsa
cccggggaggagcagcuauccuugcccccagaggagcagucauugcccucugcggaggggacca

SEQ ID NO: 608255 - RNA, 64 nt, hsa
cagccuauggagguggagcuguggcccgcggagaagcagucaucaucauccauggaguggcugc

SEQ ID NO: 608256 - RNA, 64 nt, hsa; identical to SEQ ID NO: 212887

SEQ ID NO: 608257 - RNA, 64 nt, hsa; identical to SEQ ID NO: 212888

SEQ ID NO: 608258 - RNA, 64 nt, hsa; identical to SEQ ID NO: 212889

SEQ ID NO: 608259 - RNA, 64 nt, hsa; identical to SEQ ID NO: 212890

SEQ ID NO: 608260 - RNA, 64 nt, hsa; identical to SEQ ID NO: 212891

SEQ ID NO: 608261 - RNA, 64 nt, hsa; identical to SEQ ID NO: 212892

SEQ ID NO: 608262 - RNA, 64 nt, hsa; identical to SEQ ID NO: 212893

SEQ ID NO: 608263 - RNA, 64 nt, hsa; identical to SEQ ID NO: 212894

SEQ ID NO: 608264 - RNA, 64 nt, hsa; identical to SEQ ID NO: 212895

SEQ ID NO: 608265 - RNA, 64 nt, hsa; identical to SEQ ID NO: 212896

SEQ ID NO: 608266 - RNA, 64 nt, hsa; identical to SEQ ID NO: 212897

SEQ ID NO: 608267 - RNA, 64 nt, hsa; identical to SEQ ID NO: 212898

SEQ ID NO: 608268 - RNA, 64 nt, hsa; identical to SEQ ID NO: 212899

SEQ ID NO: 608269 - RNA, 64 nt, hsa; identical to SEQ ID NO: 212900

SEQ ID NO: 608270 - RNA, 64 nt, hsa; identical to SEQ ID NO: 212901

SEQ ID NO: 608271 - RNA, 64 nt, hsa; identical to SEQ ID NO: 212902

SEQ ID NO: 608272 - RNA, 64 nt, hsa; identical to SEQ ID NO: 212903

SEQ ID NO: 608273 - RNA, 64 nt, hsa; identical to SEQ ID NO: 212904

SEQ ID NO: 608274 - RNA, 64 nt, hsa; identical to SEQ ID NO: 212905

SEQ ID NO: 608275 - RNA, 64 nt, hsa; identical to SEQ ID NO: 212906

SEQ ID NO: 608276 - RNA, 64 nt, hsa; identical to SEQ ID NO: 212907

SEQ ID NO: 608277 - RNA, 64 nt, hsa; identical to SEQ ID NO: 212908

SEQ ID NO: 608278 - RNA, 64 nt, hsa; identical to SEQ ID NO: 212909

SEQ ID NO: 608279 - RNA, 64 nt, hsa; identical to SEQ ID NO: 212910

SEQ ID NO: 608280 - RNA, 64 nt, hsa; identical to SEQ ID NO: 212911

SEQ ID NO: 608281 - RNA, 64 nt, hsa; identical to SEQ ID NO: 101831

SEQ ID NO: 608282 - RNA, 64 nt, hsa; identical to SEQ ID NO: 101832

SEQ ID NO: 608283 - RNA, 64 nt, hsa; identical to SEQ ID NO: 101833

SEQ ID NO: 608284 - RNA, 64 nt, hsa; identical to SEQ ID NO: 101834

SEQ ID NO: 608285 - RNA, 61 nt, hsa; identical to SEQ ID NO: 101835

SEQ ID NO: 608286 - RNA, 64 nt, hsa; identical to SEQ ID NO: 101836

SEQ ID NO: 608287 - RNA, 64 nt, hsa; identical to SEQ ID NO: 101837

SEQ ID NO: 608288 - RNA, 64 nt, hsa; identical to SEQ ID NO: 101838

SEQ ID NO: 608289 - RNA, 64 nt, hsa; identical to SEQ ID NO: 101839

SEQ ID NO: 608290 - RNA, 64 nt, hsa; identical to SEQ ID NO: 101840

SEQ ID NO: 608291 - RNA, 64 nt, hsa; identical to SEQ ID NO: 101841

SEQ ID NO: 608292 - RNA, 64 nt, hsa; identical to SEQ ID NO: 101842

SEQ ID NO: 608293 - RNA, 64 nt, hsa; identical to SEQ ID NO: 101843

SEQ ID NO: 608294 - RNA, 64 nt, hsa; identical to SEQ ID NO: 101844

SEQ ID NO: 608295 - RNA, 64 nt, hsa; identical to SEQ ID NO: 101845

SEQ ID NO: 608296 - RNA, 64 nt, hsa; identical to SEQ ID NO: 101846

SEQ ID NO: 608297 - RNA, 64 nt, hsa; identical to SEQ ID NO: 101847

SEQ ID NO: 608298 - RNA, 64 nt, hsa; identical to SEQ ID NO: 101848

SEQ ID NO: 608299 - RNA, 64 nt, hsa; identical to SEQ ID NO: 101849

SEQ ID NO: 608300 - RNA, 64 nt, hsa; identical to SEQ ID NO: 101850

SEQ ID NO: 608301 - RNA, 64 nt, hsa; identical to SEQ ID NO: 101851

SEQ ID NO: 608302 - RNA, 64 nt, hsa; identical to SEQ ID NO: 101852

SEQ ID NO: 608303 - RNA, 64 nt, hsa; identical to SEQ ID NO: 101853

SEQ ID NO: 608304 - RNA, 64 nt, hsa; identical to SEQ ID NO: 101854

SEQ ID NO: 608305 - RNA, 64 nt, hsa
ugcagucccccagauaccuauuauuuuacacaauuugaccuauaggaggacacugaguaauuua

SEQ ID NO: 608306 - RNA, 64 nt, hsa
ccgagaccucaucuuccggugagugccuucaguguugaccuaaguccucgccgggccauggcuc

SEQ ID NO: 608307 - RNA, 64 nt, hsa
auggagaggaaaguaucuaauauuagucaugguuuugaccuaaauugcuagacagucgugccau

SEQ ID NO: 608308 - RNA, 64 nt, hsa
ccauucugguaggaaaaucugaguuuucuuaucuuugaccuagaagagauucuuuuuggaccaa

SEQ ID NO: 608309 - RNA, 64 nt, hsa
agaaagcuaucuuuuuauggauguuagcaguuuauugaccuaauauuuguaaauggucuguuug

SEQ ID NO: 608310 - RNA, 64 nt, hsa
aggaaugcccuucagguuucuucccuccccccucuugaccuaccccagauauuuguguggaaga

SEQ ID NO: 608311 - RNA, 64 nt, hsa
cuguugggaauuaugcccuggaauucugccugaauugaccuacgcaucuccuccuccuuggaca

SEQ ID NO: 608312 - RNA, 64 nt, hsa
cugauugggcaauacucauuugaguuccuuccauuugaccuaauuuaacuggugaaauuuaaag

SEQ ID NO: 608313 - RNA, 64 nt, hsa
aggaaacuuuuuaauugugcaaaggauaaauuuuuugaccuauuuuaggguucuaaaugcaaua

SEQ ID NO: 608314 - RNA, 64 nt, hsa
gaaauuccauuuuucccucuuucccugaguuguauugaccuacagaguuaauuuccuuuguauu

SEQ ID NO: 608315 - RNA, 64 nt, hsa
cucgcuuugagguacccaccguccugucagcuccuugaccuaugagccggggccugacuaggaa

SEQ ID NO: 608316 - RNA, 64 nt, hsa
ggaguuggcggggaggaaauaaggcuaacagagguugaccuaaaauuagccuuacaaaggagaa

SEQ ID NO: 608317 - RNA, 64 nt, hsa
agccaagacuucaugaacuacauaggucuuaccauugaccuaagaucaaucugaacuaucuuag

SEQ ID NO: 608318 - RNA, 64 nt, hsa
ccuagagguuuuuuuuuugcuuguuacucaucuguugaccuaccugggggaaguagcacccuug

SEQ ID NO: 608319 - RNA, 64 nt, hsa
gauagaacaaauagcaaugguuaacuauuaaauguugaccuagccagcgcaguggcucaugccu

SEQ ID NO: 608320 - RNA, 64 nt, hsa
auaauauuuuuauaacuuuaagagacuguaguaauugaccuaaaaacuuauguuagcuucagua

SEQ ID NO: 608321 - RNA, 64 nt, hsa
uaauuuuugucuuuaaaaaaagcaaaaaagcacauugaccuaaguugaaaauuaaguaaguuua

SEQ ID NO: 608322 - RNA, 64 nt, hsa
aucaaucagaauuagagcaugggaggucaucacuuugaccuaaauuauuuacugcaaaaagaaa

SEQ ID NO: 608323 - RNA, 64 nt, hsa
ugagcaauagaguagaaaauauaucuuaaacuaguugaccuagauuguauuaauagcuacuuaa

SEQ ID NO: 608324 - RNA, 64 nt, hsa
uggucaugugggacucaguggugguguugugacuuugaccuaggguccgagugucacagcugau

SEQ ID NO: 608325 - RNA, 64 nt, hsa
caugcuuugaaguuucuggaaaguagaucuuuucuugaccuaguauaucagugacaguugcagc

SEQ ID NO: 608326 - RNA, 64 nt, hsa
auauacauauacugccucuucuaugauguuucauuugaccuacaccaucagcaucuucaggaaa

SEQ ID NO: 608327 - RNA, 64 nt, hsa
gggagggggcaaagccuucugacuucaccuuuguuugaccuauguauggaacuuacuuuuacuu

SEQ ID NO: 608328 - RNA, 64 nt, hsa
uucugacuuaagugugcaaaauauuuuuauagauuugaccuacaaaucaaucacagcuuguauu

SEQ ID NO: 608329 - RNA, 64 nt, hsa
ccauuuaucuuguacaacugagaagaaucauacuuugaccuaccuuguagagaugugaggauuu

SEQ ID NO: 608330 - RNA, 64 nt, hsa
uucaaaaauauucauuucaaucuuuucauaauuguugaccuaagaauauaauacauuugcuagu

SEQ ID NO: 608331 - RNA, 64 nt, hsa
acuaguuaagagucucaguugauuucuguaauguuugaccuaauaauagcccguuucgucucug

SEQ ID NO: 608332 - RNA, 64 nt, hsa
gugugacucuguggggacugcauagguuuguuaauugaccuauagcuaaaccuuaauguguuug

SEQ ID NO: 608333 - RNA, 56 nt, hsa
cuauacaaagcuacuauuaaucgacauugaccuauuuccagaaauacaauuuuaga

SEQ ID NO: 608334 - RNA, 64 nt, hsa
agaaaguauuaauaucucuuuagauaagcuuguauugaccuaauuugguuuaugaugugucaga

SEQ ID NO: 608335 - RNA, 64 nt, hsa
guaauagcguuguucuuuaaguguacaucguaauuugaccuaauuuaaaaauaauauauuuucg

SEQ ID NO: 608336 - RNA, 64 nt, hsa
augaagaauucaaguauucugacugagugauugguugaccuaaaccacuuugaauguuucuauu

SEQ ID NO: 608337 - RNA, 64 nt, hsa
cuguuucaaaggaaguugguuucugguccaaguuuugaccuaaaccauguccaucuucuauuac

SEQ ID NO: 608338 - RNA, 64 nt, hsa
ugcugaguacugcuucauugaauagauuuguucauugaccuaucgauggacaccuggguuguuu

SEQ ID NO: 608339 - RNA, 64 nt, hsa
aauacaucuucauucucaacacucuccaaagaacuugaccuaccuuauggguuccauauuuuuc

SEQ ID NO: 608340 - RNA, 64 nt, hsa
aaagugaauuuaaccacaacugagaccuaagaaauugaccuagggguguguguguguguguauu

SEQ ID NO: 608341 - RNA, 64 nt, hsa
guuuguauauacauuugugauagagggcuagaguuugaccuagagagaguuuaaggaagugaaa

SEQ ID NO: 608342 - RNA, 64 nt, hsa
ugauuuuguuuuaaauaauuuuaaauuauggagcuugaccuagauuugccaauaaacuuucuag

SEQ ID NO: 608343 - RNA, 64 nt, hsa
gaaccgauaaauuuuaaaaaggagaaaaaauaauuugaccuaguaguauaaaacaugaggcuuu

SEQ ID NO: 608344 - RNA, 64 nt, hsa
gaugguauauuugguacuguauuucccucucauuuugaccuacucucaugcugcagaggguacu

SEQ ID NO: 608345 - RNA, 64 nt, hsa
agugcucuccagaccuccucucuaaacugcuucauugaccuaagucacucucuucaaucccaca

SEQ ID NO: 608346 - RNA, 64 nt, hsa
gaaauguaacauucuaaguauuggaucucuuuucuugaccuaguauaaugacaacugcagugac

SEQ ID NO: 608347 - RNA, 64 nt, hsa
gucugaauaggucaaccugcaggcguaacuauuuuugaccuagucaguuuuuaaacaaugugca

SEQ ID NO: 608348 - RNA, 64 nt, hsa
agugcaacaugaaaaaaaucuaugaaaagauuauuugaccuaauuauucacugauaguacauac

SEQ ID NO: 608349 - RNA, 64 nt, hsa
uuccaggcucaccuuuagaacaggagacuugagcuugaccuaaggauaugcauuaaccacucua

SEQ ID NO: 608350 - RNA, 64 nt, hsa
uuucugaaguacuuaaacuuccacaagagugaauuugaccuaggcaaguuuguucaaaagguag

SEQ ID NO: 608351 - RNA, 64 nt, hsa
gaugaaaaauaugaaugaugcauuguuuuugcaauugaccuaugacaaacugugaaccugcaga

SEQ ID NO: 608352 - RNA, 64 nt, hsa
ugccuuugaagacagaugcuucuauagagguucuuugaccuaaauaguucagcauuuguauuuu

SEQ ID NO: 608353 - RNA, 64 nt, hsa
uuuggggagcagggccucgacagcuccagcucccuugaccuaccuuccuccccgcaccccgccc

SEQ ID NO: 608354 - RNA, 64 nt, hsa
guugaaauuuguagcauccauuuaguuauucuuuuugaccuaaauaacuuaauaguuuauuaaa

SEQ ID NO: 608355 - RNA, 64 nt, hsa
cccugucucacauugaguugggcccauugguuauuugaccuaaaaccuaaucaccgcuaccaua

SEQ ID NO: 608356 - RNA, 64 nt, hsa
aaccugcuuuauauuguuguucugaagcuuacaauugaccuauacauugcauucagcaagcucc

SEQ ID NO: 608357 - RNA, 64 nt, hsa
accauaacaugcuuaagaaaacuuucccaaaauguugaccuaguuaaaugaggcuauauaaauu

SEQ ID NO: 608358 - RNA, 64 nt, hsa
uccacuccugccagcucauuuccuucaauuuccuuugaccuauaggcuaaaaaagaaaggcuca

SEQ ID NO: 608359 - RNA, 64 nt, hsa
guguuuuucaaagugauuucuuuucuguagcuuuuugaccuaagaucucagcaauuugaacacu

SEQ ID NO: 608360 - RNA, 64 nt, hsa
gcaauuuuuuuuuuaggaugagccucuccuagacuugaccuagaauauuacauauuccuccagu

SEQ ID NO: 608361 - RNA, 64 nt, hsa
uggaugguggagaccauaggucaccccagauuccuugaccuauuucugggacaccauauuuccc

SEQ ID NO: 608362 - RNA, 64 nt, hsa
auuuuaauuauauuugacagguuuugcaucuaaauugaccuauuuauucauucuugauuaaaug

SEQ ID NO: 608363 - RNA, 64 nt, hsa
auugauacacaacugcuauuuuuaauuuagaacuuugaccuaauuuggguuuucaaaaccauuu

SEQ ID NO: 608364 - RNA, 64 nt, hsa
aguaacuuaauuggguuuuucaggcaguugauauuugaccuaagcuuuuuuuuuuuuuuuuuuu

SEQ ID NO: 608365 - RNA, 64 nt, hsa
aggguggcccaaggcuauagccccuccuucaauauugaccuaacgggggagaaaagauuuagau

SEQ ID NO: 608366 - RNA, 64 nt, hsa
ugacuuuuugucguggcagccaguggugacuggauugaccuacuagguacccaguggcagucuc

SEQ ID NO: 608367 - RNA, 64 nt, hsa
gaagccgggcccccacacccuggcugaagucagcuugaccuaggucuugacccucauccagcaa

SEQ ID NO: 608368 - RNA, 64 nt, hsa
uguauuaagaccccuuuaauauggauaauccaaauugaccuagaaucuuugugagguuuuuucu

SEQ ID NO: 608369 - RNA, 64 nt, hsa
cccucugcauugaccuggaggggagaggucagccuugaccuaaugagguagcuauaguugcagc

SEQ ID NO: 608370 - RNA, 64 nt, hsa
auauaaaaaaauuuuuccaaguuauuccugcccauugaccuaacauauggauuacaguuucccu

SEQ ID NO: 608371 - RNA, 64 nt, hsa
ucuuuuauuugggaguuuauuuuuuauuuucuucuugaccuaccccuucccuccuuuaaguguu

SEQ ID NO: 608372 - RNA, 64 nt, hsa
ggggcucuuuuuauagcaccagacucugccuuccuugaccuagauccaggaggcucaggggcuc

SEQ ID NO: 608373 - RNA, 64 nt, hsa
aaugcaagcaaaguaucaaagaaaaacaaugaaauugaccuaguucagauacagggugcuccuu

SEQ ID NO: 608374 - RNA, 64 nt, hsa
uuuuuuuggagaagagcauccucuuuuguguaguuugaccuaaaaaugaaccuuggcucugcuu

SEQ ID NO: 608375 - RNA, 64 nt, hsa
ccgguggacauguucacugguggaccaguuggcauugaccuaaacggacagagaaaugcacaug

SEQ ID NO: 608376 - RNA, 64 nt, hsa
gucuuugguauugucuuaaauaaaucaagaaucauugaccuaauuguuaaauuuaaaaauaggu

SEQ ID NO: 608377 - RNA, 64 nt, hsa
uaacaaaauucagaaaauucaccugaaacguauuuugaccuaaaagaaacauauuuuuguauca

SEQ ID NO: 608378 - RNA, 64 nt, hsa
ugaacuaauaaaauuuuauuucuuaaauauaaauuugaccuaaaauauuuucucaaacuaauuc

SEQ ID NO: 608379 - RNA, 64 nt, hsa
auccuggggucuuucuaggacugugccucccugcuugaccuaugcuccaggacccugcccucaa

SEQ ID NO: 608380 - RNA, 64 nt, hsa
aaauuuuuaaagcaacuuggguuagacuuuguuuuugaccuaacaucccuuccuuaaaugccuu

SEQ ID NO: 608381 - RNA, 64 nt, hsa
auaaggacagugucaaagugauaaagcuuaacacuugaccuaaacuucuauuuucuuaaggaag

SEQ ID NO: 608382 - RNA, 64 nt, hsa
guuuaauaaauguaaaauugcaucauaguauuuguugaccuaauguaacccuuguaugauugca

SEQ ID NO: 608383 - RNA, 64 nt, hsa
ucucaggauaauuaauccuaaauauugucgcauguugaccuacguuaaaagaugaauaggucua

SEQ ID NO: 608384 - RNA, 64 nt, hsa
auuuagucuucucucauuggccauguuucagauuuugaccuagaaaugcgagcugugguuaggc

SEQ ID NO: 608385 - RNA, 64 nt, hsa
ucucaggaagaauauaaugaacuguacaguuacuuugaccuauuaaaaagguguuaccaguaaa

SEQ ID NO: 608386 - RNA, 64 nt, hsa
ggcaccgagcugaugcaguauuuguaauauuaaguugaccuaacaagguauuugcaugagucac

SEQ ID NO: 608387 - RNA, 64 nt, hsa
uccccugcauggcugagagggugugggugcccuguugaccuacccuggaccgaguggaccacga

SEQ ID NO: 608388 - RNA, 64 nt, hsa
gaggaauugauuucaaaauaguucguucuuguguuugaccuaagaaugauugucgcaugaagug

SEQ ID NO: 608389 - RNA, 64 nt, hsa
agggcugucucuguggguacaguggcauucucuguugaccuaaccaagcagccugaaccuugcu

SEQ ID NO: 608390 - RNA, 64 nt, hsa
gaacuuagagacgggagggacccgagccuggcuuuugaccuaagaacccuagcaggagaauaca

SEQ ID NO: 608391 - RNA, 64 nt, hsa
ugcuaauuuuucauucauaguucauugcuuccauuugaccuaagauuggccauuuguuggugug

SEQ ID NO: 608392 - RNA, 64 nt, hsa
uuccaucugggcaaccugguuuuccaaauaucauuugaccuaagugaauguugauacuagcuaa

SEQ ID NO: 608393 - RNA, 64 nt, hsa
ccuuaacuuacagaccugugaaauaaagggcauuuugaccuaauacaauuaauuuucuggauaa

SEQ ID NO: 608394 - RNA, 64 nt, hsa
uuuuaugaagucacaagauacauauauuuuuauuuugaccuaaauuuguacagucccauuguaa

SEQ ID NO: 608395 - RNA, 64 nt, hsa
agcuagaauguuaaacuucauccuuuuuuuacuguugaccuauuugugggagggaugaaaggcu

SEQ ID NO: 608396 - RNA, 64 nt, hsa
guucacuuguguuggauagagcaguggcauggcuuugaccuaguaugaacuggugucugcccag

SEQ ID NO: 608397 - RNA, 64 nt, hsa
uggagcuuccaccuggccagggaggacggagacuuugaccuacuccacauggagaggcaaccau

SEQ ID NO: 608398 - RNA, 64 nt, hsa
ucugaugucagaguaguagguuaaggguggaagguugaccuacuuggaucuuggcaugcaccca

SEQ ID NO: 608399 - RNA, 64 nt, hsa
auucacuuuuuaaaugaagaaauuagugaaaaaauugaccuaaugaaggaaacauuugugcuuu

SEQ ID NO: 608400 - RNA, 64 nt, hsa
aaacacaagaguaggacacaucuguucuggguucuugaccuaucugucuccaauucaucucccc

SEQ ID NO: 608401 - RNA, 64 nt, hsa
gcaaaagaaaaugauggguugaauuuacugauuauugaccuaauggauggcuuuuuaaaauguu

SEQ ID NO: 608402 - RNA, 64 nt, hsa
ugcaaaacauacuguugcuaugauguaacugcauuugaccuaaccacugcgaaaauucauuccg

SEQ ID NO: 608403 - RNA, 64 nt, hsa
agcacaucacaccucccagugagagagcuguccauugaccuacaugguucagagaacaccccac

SEQ ID NO: 608404 - RNA, 64 nt, hsa
agauacaucacagucacaugcuugaugguuuauguugaccuaagauuuauuuuguuaaaaucuc

SEQ ID NO: 608405 - RNA, 64 nt, hsa
gucucccggcuccccucccaggggagccagcugcuugaccuagcucuuugggccucuccugccc

SEQ ID NO: 608406 - RNA, 64 nt, hsa
gaagcauggcauuaauuuguauuugcccuguucuuugaccuaaaguugaaggguuuagaguuuu

SEQ ID NO: 608407 - RNA, 64 nt, hsa
gcuucagucucagcagagaauuuccuaaaugcguuugaccuaaugaaacugaucauggcuuccc

SEQ ID NO: 608408 - RNA, 64 nt, hsa
cucaauucacauagauuucuucucuuuaguauaauugaccuacuuugguaguggaauagugaau

SEQ ID NO: 608409 - RNA, 64 nt, hsa
uuuuugugaacuugagucaguccuauugaacauuuugaccuauauucuugcaaauuauguuaau

SEQ ID NO: 608410 - RNA, 64 nt, hsa
aaaguccauaauuguuaucuucagaaaauauuauuugaccuacaguauguccaaaucaauuuaa

SEQ ID NO: 608411 - RNA, 64 nt, hsa
gcucaagagaaucugacagauaccauaaagggauuugaccuaaucacuaauuuucagguggugg

SEQ ID NO: 608412 - RNA, 64 nt, hsa
uauuucuacuguacauuguuuucuuugucccaaguugaccuagggugacuuuuauaagcaugaa

SEQ ID NO: 608413 - RNA, 64 nt, hsa
uaggccacagugaccugcgcaauguuuauaugcuuugaccuacuaacuuucuccuaacuaaaua

SEQ ID NO: 608414 - RNA, 64 nt, hsa
acaaacacacagacacaccuuuugauauguaagcuugaccuaaagucaaaggaccuguguagca

SEQ ID NO: 608415 - RNA, 64 nt, hsa
uugcacguuaaagaccucuaaucgcaugcaagcauugaccuaccacaccuacaucccacugugc

SEQ ID NO: 608416 - RNA, 64 nt, hsa
auaaugaaauaaaaucugaaaaguggauuucuuauugaccuauauucaugaaagcauauaaauu

SEQ ID NO: 608417 - RNA, 64 nt, hsa
uuaucuaaccagcuauuuucuuaauugcuacagcuugaccuaccaguauuccggaguaaccagc

SEQ ID NO: 608418 - RNA, 64 nt, hsa
uuuaaugaaugauggucucacaauucaguugacuuugaccuaauauuuaagaauauaaauauau

SEQ ID NO: 608419 - RNA, 64 nt, hsa
acaaaaacaauagauucauuuaauuuuccugugguugaccuauacgaccaggauguagaaaacu

SEQ ID NO: 608420 - RNA, 64 nt, hsa
cuugaguuuuguuuguaaaauacauaauuaauauuugaccuaccucaaaauguauugaggaucu

SEQ ID NO: 608421 - RNA, 64 nt, hsa
acuuccauaucaauuauuugaacucgguaguuguuugaccuaguuagaugugguguuuauucaa

SEQ ID NO: 608422 - RNA, 64 nt, hsa
cucagcagcugaagaaugucccuaccagagcaucuugaccuaaucagcuuacaguuugaaaacc

SEQ ID NO: 608423 - RNA, 64 nt, hsa
uccuaggauaguuaguaaaagacuuuuuagcauuuugaccuagggccuuuggcuuucacuaaaa

SEQ ID NO: 608424 - RNA, 64 nt, hsa
ucccaucucuuaucuccuugauauaauuuugaacuugaccuacuuuaaacuuuuuugcucugca

SEQ ID NO: 608425 - RNA, 64 nt, hsa
cauuuuaaaaugaguuuuugaaucuugccucaaauugaccuacuuggauaaaaucagugcuuuu

SEQ ID NO: 608426 - RNA, 64 nt, hsa
gucacccaaauagcugcuacccagaggggcgggguugaccuaggcugaauauccacuuuguuuu

SEQ ID NO: 608427 - RNA, 64 nt, hsa
ccagauguuuuuagucaggcuauccugacaagacuugaccuaaacuucguuuuuauuggucaua

SEQ ID NO: 608428 - RNA, 64 nt, hsa
uaugugucauguggccuaaaagccuccaugucauuugaccuacgaauucuaucuuugggaauuu

SEQ ID NO: 608429 - RNA, 64 nt, hsa
ggcuuuaagaaucacugaaucacuguggccucacuugaccuagucauggcaggacaacuagugg

SEQ ID NO: 608430 - RNA, 64 nt, hsa
guggcucagccucgaaggacagacugcacaccuguugaccuaaacucacuggacagacuccagg

SEQ ID NO: 608431 - RNA, 64 nt, hsa
uacucugaauucagugcugcuuugggacauauacuugaccuagcuugguuuaccagugauggaa

SEQ ID NO: 608432 - RNA, 64 nt, hsa
uuaaguaacauuuaaaaauauuaaagcauguuauuugaccuaauuuuuuagcauuugaguuguu

SEQ ID NO: 608433 - RNA, 64 nt, hsa
accaucauguuuuccaucacuuuaaucaaucauuuugaccuaaguauauugauuaccaccaugg

SEQ ID NO: 608434 - RNA, 64 nt, hsa
cacaaauuucuuaucacauuuucgacuucuucacuugaccuaacugauuaugcgaaauacccaa

SEQ ID NO: 608435 - RNA, 64 nt, hsa
ucuagaaauaagugugaaggauaaauuuucuuuguugaccuaugaagauuuuagaguuuaccuu

SEQ ID NO: 608436 - RNA, 64 nt, hsa
ugcgugcucccgaugcugcuauggaaggugcuacuugaccuaagggacucccacaacaacaaaa

SEQ ID NO: 608437 - RNA, 64 nt, hsa
ugugggaaagccuuugucaguauuaaucccuuaauugaccuaaguauacucacacuaggaaaaa

SEQ ID NO: 608438 - RNA, 64 nt, hsa
ccaaaggauggcagaaaacuguucucagucuaguuugaccuaauuuacacuauugcccuaggcu

SEQ ID NO: 608439 - RNA, 64 nt, hsa
ugcgcccggccuugcaugcucuuugacccugaauuugaccuacuugcugggguacaguugcuuc

SEQ ID NO: 608440 - RNA, 64 nt, hsa
aguaugaauguaaacauugugauuaagccuucaguugaccuaauucauuucaaagacaggacuc

SEQ ID NO: 608441 - RNA, 64 nt, hsa
ggaugugucaugucaucaugucaaacccaaauauuugaccuaagggauccuuuauucugcccag

SEQ ID NO: 608442 - RNA, 64 nt, hsa
gucuccuuucuacccuuguccucuuuccuuuccuuugaccuaauggagcuagaaauaugucugu

SEQ ID NO: 608443 - RNA, 64 nt, hsa
cgugagccacugugccuggccuuauguaaagcucuugaccuagcaucugacuggaaacaagcgg

SEQ ID NO: 608444 - RNA, 64 nt, hsa
gggaugaaacuaaagcaauagaaacaacacaguuuugaccuaacauaccguuuauaaugccauu

SEQ ID NO: 608445 - RNA, 64 nt, hsa
aggaggcagggaucacuguggaccaucuuagcaguugaccuaacacaucuucuuuucaauaucu

SEQ ID NO: 608446 - RNA, 64 nt, hsa
gaguugaacaacuuuguuccucuggugugguaaauugaccuaaaggugaccucugacgauuucc

SEQ ID NO: 608447 - RNA, 64 nt, hsa
gacagcuguuuuuuaacccucuucugcaaguuuguugaccuacaugggcuaauauggauacuaa

SEQ ID NO: 608448 - RNA, 64 nt, hsa
uacuuuaggcaucccuccuguugcuagcagccuuuugaccuaucugcaaugcaguguucucagu

SEQ ID NO: 608449 - RNA, 64 nt, hsa
ccaaacaauguuacuuugaaaauugaguuuauguuugaccuaaaugggcuaaaauuacauuaga

SEQ ID NO: 608450 - RNA, 64 nt, hsa
ugagugguuugggauguguucgccauuucuguguuugaccuacauggccucuaauucuuuggac

SEQ ID NO: 608451 - RNA, 64 nt, hsa
uuucaguuccuguuuuugcuauuguuuccuaaauuugaccuacauauuacauggguguagugug

SEQ ID NO: 608452 - RNA, 64 nt, hsa
accuuugcuguguccuugguacagaaccauccacuugaccuaacuaccuccccuggccgcgcuc

SEQ ID NO: 608453 - RNA, 63 nt, hsa
acaguuuagacacugugguuuacaaaacagcaugcacucaacuugggacuuuaugaaaaguac

SEQ ID NO: 608454 - RNA, 63 nt, hsa
acaauuucuaaauuaucaguuuucacaguuucagcacucaaccucaucauacgcugauuuaau

SEQ ID NO: 608455 - RNA, 63 nt, hsa
auggaaacuucugggacugaugcccaacucagugcacucaagacgcaucuccaguuuucgggg

SEQ ID NO: 608456 - RNA, 63 nt, hsa
cuaauacaaaacacggacauauuuuuacucguagcacucaauuuaguaacuucuagaugcuac

SEQ ID NO: 608457 - RNA, 64 nt, hsa
uuaugaaauggucuuuaauauuuccacaauaauccugugcuauauuuguuuuaagaaacaaagu

SEQ ID NO: 608458 - RNA, 64 nt, hsa
aggacccugcaagacgacgacaaaggccuuuggccugugcuacuaaacaagaagccuaugaaaa

SEQ ID NO: 608459 - RNA, 64 nt, hsa
cauguugcugccaaccauaccuuccuucccugggcugugcuaccuggguccuuuucagaaguga

SEQ ID NO: 608460 - RNA, 64 nt, hsa
augauucugcuuuuaccaugccccugagcaaugucugugcuagggaaacuucccgucccauauc

SEQ ID NO: 608461 - RNA, 64 nt, hsa
aagaggacaggcuauuagguucuuggacuuuuuucugugcuaccgcugcugcuugguggaagua

SEQ ID NO: 608462 - RNA, 64 nt, hsa
caucugugucuggaggggcagcuguguucaugcccugugcuacuggacauuucacaauucuggc

SEQ ID NO: 608463 - RNA, 64 nt, hsa
gcuagaauccaguaaaucauuuugguagcucuggcugugcuaucaauaaaaagaugaaagcaac

SEQ ID NO: 608464 - RNA, 64 nt, hsa
caacaaucuauaccuggacuguccaguucuccuccugugcuaucuucucuucuauccaaguaga

SEQ ID NO: 608465 - RNA, 64 nt, hsa
agcauucccuugcuagaagcccgugugccaggcacugugcuaggcguggugggcaguauaaaga

SEQ ID NO: 608466 - RNA, 64 nt, hsa
ccaaagcccccaaggguggcaagugccaccuucgcugugcuagaguuguguuguaggaauuagu

SEQ ID NO: 608467 - RNA, 64 nt, hsa; identical to SEQ ID NO: 261649

SEQ ID NO: 608468 - RNA, 64 nt, hsa; identical to SEQ ID NO: 261650

SEQ ID NO: 608469 - RNA, 64 nt, hsa; identical to SEQ ID NO: 261651

SEQ ID NO: 608470 - RNA, 64 nt, hsa; identical to SEQ ID NO: 261652

SEQ ID NO: 608471 - RNA, 64 nt, hsa; identical to SEQ ID NO: 261653

SEQ ID NO: 608472 - RNA, 64 nt, hsa; identical to SEQ ID NO: 261654

SEQ ID NO: 608473 - RNA, 64 nt, hsa; identical to SEQ ID NO: 261655

SEQ ID NO: 608474 - RNA, 64 nt, hsa; identical to SEQ ID NO: 261656

SEQ ID NO: 608475 - RNA, 64 nt, hsa; identical to SEQ ID NO: 261657

SEQ ID NO: 608476 - RNA, 64 nt, hsa; identical to SEQ ID NO: 261658

SEQ ID NO: 608477 - RNA, 64 nt, hsa
gcccaaacccacauuccaaagugguaggcucauuuguuucuagagauuucaucaugucgcuuuu

SEQ ID NO: 608478 - RNA, 64 nt, hsa
ggcguagacacaguaagaaccuaguaaauauuacuguuucuagccaucagggagauuguggaac

SEQ ID NO: 608479 - RNA, 64 nt, hsa
cucuuaccuagcgaacaagaucuuuucagagugguguuucuaaaagagcauguacaaaaguggc

SEQ ID NO: 608480 - RNA, 64 nt, hsa
uuaagaugcagcauuuuagaaauuuacauaucaauguuucuacaguauuguuugcuaauuuuua

SEQ ID NO: 608481 - RNA, 64 nt, hsa
gcccaccuccaagggaaggcuuaggcaaugauccuguuucuaccaacacugcaccuuaucccag

SEQ ID NO: 608482 - RNA, 64 nt, hsa
ggauuuagaacuagcaggguggacaucaucugguuguuucuacuuuucucugccuagcacaaaa

SEQ ID NO: 608483 - RNA, 62 nt, hsa
cuaaaaaacaaagaagacaacauuaaaacaauauuguuucuaauugcugagguuuagcuguc

SEQ ID NO: 608484 - RNA, 64 nt, hsa
auucccuccugcuacucuguuccuucacauccuguguuucuagggaaaugaaagaaaggccagc

SEQ ID NO: 608485 - RNA, 64 nt, hsa
agaacuaugguuuuuggcauguugggucaagacguguuucuauaggaaaugcuugcacguggca

SEQ ID NO: 608486 - RNA, 64 nt, hsa
guuugagaccagccugggcaacauggcgagacccuguuucuacaaaaagaaaaagggaaaaaaa

SEQ ID NO: 608487 - RNA, 64 nt, hsa
uuauguggauaauguuauauacagccaaaguggauguuucuauuuggcaaggaagguaggauuu

SEQ ID NO: 608488 - RNA, 64 nt, hsa
uuugccaccuauuucuuguuguaaaacagauguuuguuucuaaaauauaaugaauuaaugauua

SEQ ID NO: 608489 - RNA, 64 nt, hsa
ucauuauauguguuuuggugauuagugacuuuuauguuucuauuguaauuguuuuggggugcca

SEQ ID NO: 608490 - RNA, 64 nt, hsa
uaagccagaaggcaagaucagauuaaaaacaccauguuucuaagcauccauuuuucccuuucuu

SEQ ID NO: 608491 - RNA, 64 nt, hsa
uugacuaagaaugaaccagauuugguggugguuuuguuucuaugcaaacuggacacaaauuaca

SEQ ID NO: 608492 - RNA, 64 nt, hsa
guccacuauuucuuaugucauucguuagucuacauguuucuaaacauauaaaugugaauuuaau

SEQ ID NO: 608493 - RNA, 64 nt, hsa
aucaaaaguucggcauguagcucaugaucuaugcuguuucuaugucguggaagcacuggauggg

SEQ ID NO: 608494 - RNA, 64 nt, hsa
uagaguccuaagccccucauguucagcugugcuguguuucuacugaccaagcaggagagccagc

SEQ ID NO: 608495 - RNA, 64 nt, hsa
cauccccaggcagcaccuuugggcuuuguuuugguguuucuacagggacaauacagacccugga

SEQ ID NO: 608496 - RNA, 64 nt, hsa
aggaagaauuugccaucaagccauuucccccuuuuguuucuaaaauuauuucagagaugugugc

SEQ ID NO: 608497 - RNA, 64 nt, hsa
gaagagaaguaaaauccucagguugugggguauuuguuucuacuccagccuggcaggcaaggcu

SEQ ID NO: 608498 - RNA, 64 nt, hsa
uucugaaacuuaaaaacaauaaauucuuuuucuguguuucuagguuagaacuuuuuuauuuuau

SEQ ID NO: 608499 - RNA, 64 nt, hsa
cagguauauuuaccugguagaaaaacauguagauuguuucuauuacuuaaauguuuuaauugga

SEQ ID NO: 608500 - RNA, 64 nt, hsa
ugauucuuucaaacuauugccagguaguuguuaguguuucuaauuggacucuuaauaugaacuu

SEQ ID NO: 608501 - RNA, 64 nt, hsa
uucacaagacagcacuuugauucuauguugaguuuguuucuauauuagaaaagcagcaagucag

SEQ ID NO: 608502 - RNA, 64 nt, hsa
guuugugaccagccuggccaacauagugaaauccuguuucuacuaaaaauacaaaaauuagcug

SEQ ID NO: 608503 - RNA, 64 nt, hsa
agccagguccaccgcccaccacccuuucaggccauguuucuacucagugugcuuuucccaaaug

SEQ ID NO: 608504 - RNA, 64 nt, hsa
uacucagugugcuuuucccaaaugaugugugugguguuucuaagagaaacagggcccauaacca

SEQ ID NO: 608505 - RNA, 64 nt, hsa
caagccaaggacaggagcaagugugcccucauuuuguuucuacuuuuaauuucuguguguuggc

SEQ ID NO: 608506 - RNA, 63 nt, hsa
guauucaaaauaacaaaaauaaagccugauucuuuguuucuagaaaucucuuguaccuugcuu

SEQ ID NO: 608507 - RNA, 64 nt, hsa
cccagaaucagcuuaggcuucuaugaauucagccuguuucuaaaagcugaaaaucucaguuuaa

SEQ ID NO: 608508 - RNA, 64 nt, hsa
aauacuauaaugagagccacaucuguaauuuaaauguuucuaguaaccacauuuuuuuaaaagu

SEQ ID NO: 608509 - RNA, 64 nt, hsa
uuguaucuaagaccugccagggaauaccaagaguuguuucuacagacuuuuuuuuuuuuuuuug

SEQ ID NO: 608510 - RNA, 64 nt, hsa
cuacauugggugaaaccguugguccauuuuugucuguuucuaugaagauaaaauaauugggggc

SEQ ID NO: 608511 - RNA, 64 nt, hsa
uguugcaaguuugugaggggaaaauguuuugguuuguuucuacugaccugaauguguuggaucu

SEQ ID NO: 608512 - RNA, 64 nt, hsa
guuagucuuauguauagacauuauuuucgucguauguuucuauauuuugaaacaaagguaugua

SEQ ID NO: 608513 - RNA, 64 nt, hsa
ggaaaaacaaauucguuuuuuauguccucuucucuguuucuaccuuucagaauggacuuaaauc

SEQ ID NO: 608514 - RNA, 64 nt, hsa
aucuggacuuugcccucaaaagagcagugguuccuguuucuagguuguggaucuucagauaaau

SEQ ID NO: 608515 - RNA, 64 nt, hsa
aaauguauauuaagguaaaauaaaacugacaaaguguuucuaggguguagcuggguacauauua

SEQ ID NO: 608516 - RNA, 64 nt, hsa
auaugacguuuguauuuuuaggucuuuaauacaguguuucuaccucucauuuguaacugcaugc

SEQ ID NO: 608517 - RNA, 64 nt, hsa
aaacaucacguucucuauuggcuuuuugguuuaguguuucuaaauuuucuccuucugauuuugc

SEQ ID NO: 608518 - RNA, 64 nt, hsa
uuuuagaguuuuuguauagacuucuuugguagucuguuucuaaaaugaaauguauuucaauaag

SEQ ID NO: 608519 - RNA, 64 nt, hsa
aaaauuucaaauugguuuuucuacuaguagauuguguuucuagagaaagauacaaggcauaggu

SEQ ID NO: 608520 - RNA, 64 nt, hsa
augccauugucaccuuggauuuaugagugaaaaguguuucuaaaaauauagaaauaaugucaga

SEQ ID NO: 608521 - RNA, 64 nt, hsa
aauguucaccuagaacucuaauuuuaccuucuuuuguuucuauugugcagauucccaacagugg

SEQ ID NO: 608522 - RNA, 64 nt, hsa
auuuugggccauuaccuacuacagacauugaaguuguuucuaauguucaccuagaacucuaauu

SEQ ID NO: 608523 - RNA, 64 nt, hsa
ucaaugguagcuuuauugacuguucugauugugcuguuucuaauuuauugaaucugcuagguuu

SEQ ID NO: 608524 - RNA, 64 nt, hsa
aucacuuuguggcagggguacuuuuaaacauaaauguuucuacaaaaguagguugaguucauug

SEQ ID NO: 608525 - RNA, 64 nt, hsa
ggcucuuuuggccucuuacuaggggggauagucuuguuucuagcuuaaacaauuuuuuuuuugc

SEQ ID NO: 608526 - RNA, 64 nt, hsa
auaauuuuuuuuucuuugccacacuggagcacaauguuucuauguaaagaauuauuuucauucu

SEQ ID NO: 608527 - RNA, 64 nt, hsa
gagaugaucgaugugugugugugagagagagcuauguuucuaaccaagggccuaauguuuguua

SEQ ID NO: 608528 - RNA, 64 nt, hsa
acuccauugacccaccgaaaaaagaaaagaaaucuguuucuaccaaacauuuccagaaacguau

SEQ ID NO: 608529 - RNA, 64 nt, hsa
ucaauacacgucaaggucgcuuccaguuuuagaaaacagaaaucugcaucucagccugagacgc

SEQ ID NO: 608530 - RNA, 64 nt, hsa
cauguaagauacuaaccuagccacccugggagagaacagaaagcugucccuggcugcgcuuucu

SEQ ID NO: 608531 - RNA, 64 nt, hsa
uagacugccucgcaagcuauuccagaggucauggaacagaaagccuuauaaaccaaauaaaaau

SEQ ID NO: 608532 - RNA, 64 nt, hsa
aaaacuugccucuauuuauaaugaagauaacuuaaacagaaauauccauuuuguaguuauagcu

SEQ ID NO: 608533 - RNA, 64 nt, hsa
aaaagugaugauuguuuaguaacuaaauuuuagcaacagaaauuagaauuuugcuuuuucaacc

SEQ ID NO: 608534 - RNA, 64 nt, hsa
cauuuuuaaaaaauacauuauuugaacauuuuaaaacagaaagguacuauuuuccaaauguuuu

SEQ ID NO: 608535 - RNA, 64 nt, hsa
ucuauucugugugcugcagccugaguuuuuaaaaaacagaaaaugaggggccaggugugguggu

SEQ ID NO: 608536 - RNA, 64 nt, hsa
gguacuuuuauucagacuuguuuccuuucuaguuaacagaaauagugacauuuagagguuuuaa

SEQ ID NO: 608537 - RNA, 64 nt, hsa
cagagaauugcugauucuugaguuuagugaucugaacagaaauaccaaaauuauuucagaaaug

SEQ ID NO: 608538 - RNA, 64 nt, hsa
uauuccagaugccuucuccagacaaaccagaagcaacagaaaaaaucgucucucccucccuuug

SEQ ID NO: 608539 - RNA, 64 nt, hsa
augacucaggauuuuaucuccuagauauauauucaacagaaaugcaugaguaugugcaccaaca

SEQ ID NO: 608540 - RNA, 64 nt, hsa
ccaaacuggaaacccaaguguccaucuccaucggaacagaaaacuauacuuuggucugcuucua

SEQ ID NO: 608541 - RNA, 64 nt, hsa
gggcggaguuuguuguaaggcaaucaccugucaaaacagaaauugggugggaaaggagucuuua

SEQ ID NO: 608542 - RNA, 64 nt, hsa
ucauauucuaguauuucucacaggggguaugagaaacagaaagcuauauguagcagcuggucuu

SEQ ID NO: 608543 - RNA, 64 nt, hsa
auuacaggugugagccacugugcccggccaaaagaacagaaauuauuuuauccugaaguaagcu

SEQ ID NO: 608544 - RNA, 64 nt, hsa
caggccugcauaggcagcagcgguccaucuguuuaacagaaaugugcugagcacucccauacac

SEQ ID NO: 608545 - RNA, 64 nt, hsa
cuagcucuccugagcagggacgcuccccagaaccaacagaaaucagugccaagcaugcgauauu

SEQ ID NO: 608546 - RNA, 64 nt, hsa
cuucaaaugcagccagucuacuccauguccuguuaacagaaagcuauggauucccuggaugaaa

SEQ ID NO: 608547 - RNA, 64 nt, hsa
uuucaaaaaaucugaccaaaacaaacaaacagaaaacagaaaacaaaaaaaccucuaugcaauc

SEQ ID NO: 608548 - RNA, 64 nt, hsa
gaagauguuucaaaaaaucugaccaaaacaaacaaacagaaaacagaaaacaaaaaaaccucua

SEQ ID NO: 608549 - RNA, 64 nt, hsa
aauuggagauguugaaaaucauuuucccuucuuaaacagaaauaaauauuuggaaugaagggga

SEQ ID NO: 608550 - RNA, 64 nt, hsa
guacuagaacacccuuuuugccacggguaaaaauaacagaaauguaugguuuguuuuaccuuca

SEQ ID NO: 608551 - RNA, 64 nt, hsa
agaacaaauuaccacaaacuggguggcuuuaaacaacagaaauuuauucucuuaacaguuccag

SEQ ID NO: 608552 - RNA, 64 nt, hsa
acuauauauguuacauacuaacauauauauacacaacagaaaguuuauuggauuuaguacugau

SEQ ID NO: 608553 - RNA, 64 nt, hsa
aauguuuucuauuuugcauauuuucaggcaugguaacagaaauuuaccuuuuaauaaauuaaaa

SEQ ID NO: 608554 - RNA, 64 nt, hsa
cggagaaggaaaagaacuuacgaccuuucuuuauaacagaaacucaacucuaaauucaacaaga

SEQ ID NO: 608555 - RNA, 64 nt, hsa
acugguaggggccaaggccaugcuccccuugggaaacagaaacaagugcccagucagcaccuac

SEQ ID NO: 608556 - RNA, 64 nt, hsa
uggggaggcagggagcuagggcagggaccaaaugaacagaaagucucagcccaggauggggcuu

SEQ ID NO: 608557 - RNA, 64 nt, hsa
ucugugguccccucacucagucucucauuugguaaacagaaagcuguuuucccuacaaggugcu

SEQ ID NO: 608558 - RNA, 64 nt, hsa
uuaaaacaauuuguucagaagaacugagcaaacuaacagaaauacaaggcuacgaacaguuuag

SEQ ID NO: 608559 - RNA, 64 nt, hsa
ucaugaagaagacacuaaaaacaauugcaacaaaaacagaaauugacaaauggggccucauuaa

SEQ ID NO: 608560 - RNA, 64 nt, hsa
cuagaggcuauuauccuaagcaaccuaaugcaagaacagaaaaccacauacugcaucuucccau

SEQ ID NO: 608561 - RNA, 64 nt, hsa
aagaauaagaaugaaaacugcugacguauuacaaaacagaaaaauaaaugauuuaaaaucaaau

SEQ ID NO: 608562 - RNA, 64 nt, hsa
acuaauuccaaaauuauggcugaauauacuaaauaacagaaaaguuacagauaagaauuuauuu

SEQ ID NO: 608563 - RNA, 64 nt, hsa
cuuucuucagaauuaaaacuaaaaucuuaaauaaaacagaaaacuugauggugacacuuggguu

SEQ ID NO: 608564 - RNA, 64 nt, hsa
guuugugcaguauugaaaagacaggagaaaagaaaacagaaaccugguuauaaccugacgcuaa

SEQ ID NO: 608565 - RNA, 64 nt, hsa
auuuuagcaucaguuuacaaacaacuuuauuaucaacagaaauuuuagcucuuuucuuugcaag

SEQ ID NO: 608566 - RNA, 64 nt, hsa
accuuuuaauuugaaaacaaggaaauuaaauuuuaacagaaaucuuuuaaguauguuauaacca

SEQ ID NO: 608567 - RNA, 64 nt, hsa
ggaacuuagccuggaaagcgaaaguggacuguccaacagaaagaugucaacaaggaaaagagga

SEQ ID NO: 608568 - RNA, 64 nt, hsa
auucagaccuuugaaaaucuggcuuucaguguagaacagaaaguuagaugaaucagugcccaag

SEQ ID NO: 608569 - RNA, 64 nt, hsa
aaaggccccagucggggguauuuaaaaaggacugaacagaaauccuuagcuaguagaauggcag

SEQ ID NO: 608570 - RNA, 64 nt, hsa
guuuugcuguaaauaauaacacuguauaaauucuaacagaaaaauagaauaaaauguugauaag

SEQ ID NO: 608571 - RNA, 64 nt, hsa
auggacaaggaaggaauaaagggagaagagggaaaacagaaaaccugaugcuggggacacagca

SEQ ID NO: 608572 - RNA, 64 nt, hsa
ucauggauauguuauacugaaccaggccagagcaaacagaaaaagaagguugagggcaauggac

SEQ ID NO: 608573 - RNA, 64 nt, hsa
cguauaagcauggagaacagugauuuuuuuuuagaacagaaaacaacaaaaaauaaccccaaaa

SEQ ID NO: 608574 - RNA, 64 nt, hsa
uugugaauugauaauaaacuguccucuuucagaaaacagaaaaaaaacacacacacacacaaca

SEQ ID NO: 608575 - RNA, 64 nt, hsa
cucacgccaggcaggccagugggccuaagccagaaacagaaagacagcaguggccagguggaga

SEQ ID NO: 608576 - RNA, 64 nt, hsa
uagcaagaucccugagacgggguaaguuauaauaaacagaaauguauuggcucagagcucugga

SEQ ID NO: 608577 - RNA, 64 nt, hsa
caaauuucucagugccuucucagggucuggugugaacagaaaaaacaguguuccugcauuuacc

SEQ ID NO: 608578 - RNA, 64 nt, hsa
uaaaaguauuauaguaacguauuguccuuccguuaacagaaacaucacaauucaaaagugaguu

SEQ ID NO: 608579 - RNA, 64 nt, hsa
cugaaaauggacucucuuugugacaaagauauucaacagaaaauauugacccugcauugcaaaa

SEQ ID NO: 608580 - RNA, 64 nt, hsa
aauaauuauugcauaguagaauuuauuacuccagaacagaaagaccuuacuucauuucaaauga

SEQ ID NO: 608581 - RNA, 64 nt, hsa
ugucuucucuaaaucuuucuuucuuuuuuuuuuuaacagaaacagcuaauuuccaauguauugu

SEQ ID NO: 608582 - RNA, 64 nt, hsa
aaaccaaaacuguaaauaugguuguugcaugagcaacagaaaaaauuguuuaaaugcuugaagc

SEQ ID NO: 608583 - RNA, 64 nt, hsa
uugagguccagccuugguguagagaagcggcagaaacagaaaucccaaaaggugucaugcuugg

SEQ ID NO: 608584 - RNA, 64 nt, hsa
cucuuccuuuaugucagguaccuagacauagcggaacagaaaacccuucaaaaguucagucuag

SEQ ID NO: 608585 - RNA, 64 nt, hsa
uccuguuauaaacuaguauuuguuguuuagccaaaacagaaaaugauuuccacuggacaguaga

SEQ ID NO: 608586 - RNA, 64 nt, hsa
cgguuuaaaccaugguuuaagaauuugcccaaauaacagaaauuuuguucgggaagggauaaac

SEQ ID NO: 608587 - RNA, 64 nt, hsa
gcuaaaagccuuugaacaccacgcuguagucuccaacagaaaaacaccaccaaaacagauaccc

SEQ ID NO: 608588 - RNA, 64 nt, hsa
ucagccuauuggucccauccaugaugcugagacaaacagaaacuggaagcugaagucagugucu

SEQ ID NO: 608589 - RNA, 64 nt, hsa
aguauacugcuaucgagacauguuuguucggaaaaacagaaagauccauaaagaugcagagucc

SEQ ID NO: 608590 - RNA, 64 nt, hsa
aagaaagacauaugaaaggaauuguaauuggcuuaacagaaacagucuguaaaaaccuaacagu

SEQ ID NO: 608591 - RNA, 64 nt, hsa
gguuuacgagauuuggcugccuuaagaauacaaaaacagaaaugcagaauuucuggggcugcuc

SEQ ID NO: 608592 - RNA, 64 nt, hsa
agaugaagccagugcuagcugagaagcagcaaugaacagaaagcuguaacacuuaugacaacaa

SEQ ID NO: 608593 - RNA, 64 nt, hsa
agggaauaucuuugucacauaggaauuguucagcaacagaaagauacuuuguaaugagaaggua

SEQ ID NO: 608594 - RNA, 64 nt, hsa
auguuguuuuaugcuuauaaagcauuuucauaugaacagaaaguuuauauuuuucuguuuuuga

SEQ ID NO: 608595 - RNA, 64 nt, hsa
aaagcccuuuucuggugggugacccagugcauccaacagaaacagccgcugcccgaaccucugu

SEQ ID NO: 608596 - RNA, 64 nt, hsa
agcuagcccaaaaucccaaacucaaaccaaaccaaacagaaagcaguggagguggggguugcug

SEQ ID NO: 608597 - RNA, 64 nt, hsa
gcucugagcguacauagggaagggaggaagggaaaacagaaagcagacaaagaaaaaagagcua

SEQ ID NO: 608598 - RNA, 64 nt, hsa
cagaagaacccauagaugaagaugaagauauucaaacagaaagaauaagaacagccacugcucu

SEQ ID NO: 608599 - RNA, 64 nt, hsa
ucaaaauauacuuuuggaaguagaugacuuugaaaacagaaaugguacugauggccucucauac

SEQ ID NO: 608600 - RNA, 64 nt, hsa
ucauuacucaucacauccccgaugcuaaauuaaaaacagaaaacaaagaaaagcuuguauauac

SEQ ID NO: 608601 - RNA, 64 nt, hsa
gauggaguagccagugguaauacaaagcagggagaacagaaagguagaguuacuaaggccuuca

SEQ ID NO: 608602 - RNA, 64 nt, hsa
gaacagaaagguagaguuacuaaggccuucagugaacagaaaggagcagagagcaagauuagau

SEQ ID NO: 608603 - RNA, 64 nt, hsa
gugaaaguuuaggcacauuuucacuaaaagugggaacagaaaauggaggccuguuuuuuauugc

SEQ ID NO: 608604 - RNA, 64 nt, hsa
ugaacuauacacaaaagugaauccagagauuaaaaacagaaauauggaaaagcuauguacuaaa

SEQ ID NO: 608605 - RNA, 64 nt, hsa
cuguaaaaugcaacaaaugaaauccacauguauuaacagaaagaucccagaauuguugaggggg

SEQ ID NO: 608606 - RNA, 64 nt, hsa
ugaaagaaaacugucagcaauucuaugcugacauaacagaaaauguagaugagauagaugaaau

SEQ ID NO: 608607 - RNA, 64 nt, hsa
uguguccuaugcccagcugcacagcuuacccucaaacagaaaauaaugaagccuucuuccuccc

SEQ ID NO: 608608 - RNA, 64 nt, hsa
uuauaauaucaaacugcauauucaccuuuauagcaacagaaaacagacauuaaauuaagccaaa

SEQ ID NO: 608609 - RNA, 64 nt, hsa
uucccucccuuucacuuuucaaagugagccacuaaacagaaagucuaagaguucagaaaugucc

SEQ ID NO: 608610 - RNA, 64 nt, hsa
ugaaugaauuucuaaauacaguaugugcuggguaaacagaaagugguuuagacauucuugauua

SEQ ID NO: 608611 - RNA, 64 nt, hsa
ucugugcugaugagauucaugcuaccuaaaaauuaacagaaaugacacugugaacaauguaguu

SEQ ID NO: 608612 - RNA, 64 nt, hsa
acaaauuaccaccaauaauaugauggcuuaacacaacagaaacuuauuugcuuacauuuuugaa

SEQ ID NO: 608613 - RNA, 64 nt, hsa
gaggccaaauuccucuuccucugagaaccagugaaacagaaaaguuaaucugcuuucaaauuac

SEQ ID NO: 608614 - RNA, 64 nt, hsa
acauuguaaagaacagaaauuacuuuaaaaaauaaacagaaauggagaccugagcuucacauug

SEQ ID NO: 608615 - RNA, 64 nt, hsa
ugcacauguguguguguaauaacacauuguaaagaacagaaauuacuuuaaaaaauaaacagaa

SEQ ID NO: 608616 - RNA, 64 nt, hsa
ggauuccugcgaguugcuuucagucauucagggaaacagaaagacguuuuccaacauguagaac

SEQ ID NO: 608617 - RNA, 64 nt, hsa
ugaguacaaaaaugcagacacuuaacaaaaagcaaacagaaaaaaaaguguggaauguguugua

SEQ ID NO: 608618 - RNA, 64 nt, hsa
gaauuaguucuauaaaaguauugugaauacaauguauguccaauuggauuguuuaaaaacuacu

SEQ ID NO: 608619 - RNA, 64 nt, hsa
aucagagcaaagcaaugagaucaucaugaagacauauguccacuaaguacuccaauuaccagcg

SEQ ID NO: 608620 - RNA, 64 nt, hsa
uauauaaagaguuguauauguccaccuaaauuccuauguccacacuuaaccuuuaaagauguac

SEQ ID NO: 608621 - RNA, 64 nt, hsa
uuacauuaacauuccuuuuauauaaagaguuguauauguccaccuaaauuccuauguccacacu

SEQ ID NO: 608622 - RNA, 64 nt, hsa
aaguauuuuaucuuuuaucuagaauccacauauguauguccaauuugauugggauaguaguuag

SEQ ID NO: 608623 - RNA, 64 nt, hsa
uuuagccuguuauauuuccuucuguaaaauaaaauauguccagaagaggcauguuguuucuaga

SEQ ID NO: 608624 - RNA, 64 nt, hsa; identical to SEQ ID NO: 608622

SEQ ID NO: 608625 - RNA, 64 nt, hsa; identical to SEQ ID NO: 608623

SEQ ID NO: 608626 - RNA, 64 nt, hsa; identical to SEQ ID NO: 214864

SEQ ID NO: 608627 - RNA, 64 nt, hsa; identical to SEQ ID NO: 214865

SEQ ID NO: 608628 - RNA, 64 nt, hsa; identical to SEQ ID NO: 214866

SEQ ID NO: 608629 - RNA, 64 nt, hsa; identical to SEQ ID NO: 214867

SEQ ID NO: 608630 - RNA, 64 nt, hsa; identical to SEQ ID NO: 214868

SEQ ID NO: 608631 - RNA, 64 nt, hsa; identical to SEQ ID NO: 214869

SEQ ID NO: 608632 - RNA, 64 nt, hsa; identical to SEQ ID NO: 214870

SEQ ID NO: 608633 - RNA, 64 nt, hsa; identical to SEQ ID NO: 214871

SEQ ID NO: 608634 - RNA, 64 nt, hsa; identical to SEQ ID NO: 214872

SEQ ID NO: 608635 - RNA, 64 nt, hsa; identical to SEQ ID NO: 214873

SEQ ID NO: 608636 - RNA, 64 nt, hsa; identical to SEQ ID NO: 214874

SEQ ID NO: 608637 - RNA, 64 nt, hsa; identical to SEQ ID NO: 214875

SEQ ID NO: 608638 - RNA, 64 nt, hsa; identical to SEQ ID NO: 214876

SEQ ID NO: 608639 - RNA, 64 nt, hsa; identical to SEQ ID NO: 214877

SEQ ID NO: 608640 - RNA, 64 nt, hsa; identical to SEQ ID NO: 214878

SEQ ID NO: 608641 - RNA, 64 nt, hsa; identical to SEQ ID NO: 214879

SEQ ID NO: 608642 - RNA, 64 nt, hsa; identical to SEQ ID NO: 214880

SEQ ID NO: 608643 - RNA, 64 nt, hsa; identical to SEQ ID NO: 214881

SEQ ID NO: 608644 - RNA, 64 nt, hsa; identical to SEQ ID NO: 214882

SEQ ID NO: 608645 - RNA, 64 nt, hsa; identical to SEQ ID NO: 214883

SEQ ID NO: 608646 - RNA, 64 nt, hsa; identical to SEQ ID NO: 214884

SEQ ID NO: 608647 - RNA, 64 nt, hsa; identical to SEQ ID NO: 214885

SEQ ID NO: 608648 - RNA, 64 nt, hsa; identical to SEQ ID NO: 214886

SEQ ID NO: 608649 - RNA, 64 nt, hsa; identical to SEQ ID NO: 214887

SEQ ID NO: 608650 - RNA, 64 nt, hsa; identical to SEQ ID NO: 214888

SEQ ID NO: 608651 - RNA, 64 nt, hsa; identical to SEQ ID NO: 214889

SEQ ID NO: 608652 - RNA, 64 nt, hsa; identical to SEQ ID NO: 214890

SEQ ID NO: 608653 - RNA, 64 nt, hsa; identical to SEQ ID NO: 214891

SEQ ID NO: 608654 - RNA, 64 nt, hsa; identical to SEQ ID NO: 214892

SEQ ID NO: 608655 - RNA, 64 nt, hsa; identical to SEQ ID NO: 214893

SEQ ID NO: 608656 - RNA, 64 nt, hsa; identical to SEQ ID NO: 214894

SEQ ID NO: 608657 - RNA, 64 nt, hsa; identical to SEQ ID NO: 214895

SEQ ID NO: 608658 - RNA, 64 nt, hsa; identical to SEQ ID NO: 214896

SEQ ID NO: 608659 - RNA, 64 nt, hsa; identical to SEQ ID NO: 214897

SEQ ID NO: 608660 - RNA, 64 nt, hsa
aauaugaagagauuguugucuaaagucacauauugacauugagcucaguggccuguuucaucac

SEQ ID NO: 608661 - RNA, 64 nt, hsa
acaaaagauuuccacuuucaaaucaaugucaguagacauugauaaaaguauagcagcauccucu

SEQ ID NO: 608662 - RNA, 64 nt, hsa
ugugaagauuuugcucaucuuuuuuaugccuuuugacauugaaugaccuauuacuguaugcgca

SEQ ID NO: 608663 - RNA, 64 nt, hsa
aggugaugaaacucagugguaacucaugauuuaugacauugaaaauaaagaggaacauugaccu

SEQ ID NO: 608664 - RNA, 64 nt, hsa
cuguaaguucaaauuuaugauuaggugacgaguugacauugagauuguccuuuucccugaucaa

SEQ ID NO: 608665 - RNA, 64 nt, hsa
ggaggagauguuaaaguaacccaucuugcaggacgacauugaagauuggucuucuguugaucua

SEQ ID NO: 608666 - RNA, 64 nt, hsa
cugaaucaauuuuauuuaaauuugugauuaaagugacauugaauuucugaugcuaugcugccau

SEQ ID NO: 608667 - RNA, 64 nt, hsa
aggaggcugaggcgagagaaucgcuugagccugggacauugaggcugcagugaacugugauggc

SEQ ID NO: 608668 - RNA, 64 nt, hsa
acuguuccaggaaauugaucaacucuuccaaugggacauugaugaucacauucugcccuuuacu

SEQ ID NO: 608669 - RNA, 64 nt, hsa
cucuuucagucaggaccuauuucagacuguugaugacauugacauuucauggauucggaugaug

SEQ ID NO: 608670 - RNA, 64 nt, hsa
cagcacacacacaaguuggcccccagcugcgccugacauugagccaguggacucugugucugaa

SEQ ID NO: 608671 - RNA, 64 nt, hsa
cccaaacaggguuuccguggccuguuugcagcuagacauugaccuccgccauugagcuccacgg

SEQ ID NO: 608672 - RNA, 64 nt, hsa; identical to SEQ ID NO: 187826

SEQ ID NO: 608673 - RNA, 64 nt, hsa; identical to SEQ ID NO: 187827

SEQ ID NO: 608674 - RNA, 64 nt, hsa; identical to SEQ ID NO: 187967

SEQ ID NO: 608675 - RNA, 64 nt, hsa; identical to SEQ ID NO: 187968

SEQ ID NO: 608676 - RNA, 64 nt, hsa; identical to SEQ ID NO: 153638

SEQ ID NO: 608677 - RNA, 64 nt, hsa; identical to SEQ ID NO: 153639

SEQ ID NO: 608678 - RNA, 64 nt, hsa; identical to SEQ ID NO: 153640

SEQ ID NO: 608679 - RNA, 64 nt, hsa; identical to SEQ ID NO: 153641

SEQ ID NO: 608680 - RNA, 64 nt, hsa; identical to SEQ ID NO: 153642

SEQ ID NO: 608681 - RNA, 64 nt, hsa; identical to SEQ ID NO: 153643

SEQ ID NO: 608682 - RNA, 64 nt, hsa; identical to SEQ ID NO: 153644

SEQ ID NO: 608683 - RNA, 64 nt, hsa; identical to SEQ ID NO: 153645

SEQ ID NO: 608684 - RNA, 64 nt, hsa; identical to SEQ ID NO: 153646

SEQ ID NO: 608685 - RNA, 64 nt, hsa; identical to SEQ ID NO: 153647

SEQ ID NO: 608686 - RNA, 64 nt, hsa; identical to SEQ ID NO: 153648

SEQ ID NO: 608687 - RNA, 64 nt, hsa; identical to SEQ ID NO: 153649

SEQ ID NO: 608688 - RNA, 64 nt, hsa; identical to SEQ ID NO: 153650

SEQ ID NO: 608689 - RNA, 64 nt, hsa; identical to SEQ ID NO: 153651

SEQ ID NO: 608690 - RNA, 64 nt, hsa; identical to SEQ ID NO: 153652

SEQ ID NO: 608691 - RNA, 64 nt, hsa; identical to SEQ ID NO: 153653

SEQ ID NO: 608692 - RNA, 64 nt, hsa; identical to SEQ ID NO: 153654

SEQ ID NO: 608693 - RNA, 64 nt, hsa; identical to SEQ ID NO: 153655

SEQ ID NO: 608694 - RNA, 64 nt, hsa; identical to SEQ ID NO: 153656

SEQ ID NO: 608695 - RNA, 64 nt, hsa; identical to SEQ ID NO: 153657

SEQ ID NO: 608696 - RNA, 64 nt, hsa; identical to SEQ ID NO: 153658

SEQ ID NO: 608697 - RNA, 64 nt, hsa; identical to SEQ ID NO: 153659

SEQ ID NO: 608698 - RNA, 64 nt, hsa; identical to SEQ ID NO: 153660

SEQ ID NO: 608699 - RNA, 64 nt, hsa; identical to SEQ ID NO: 153661

SEQ ID NO: 608700 - RNA, 64 nt, hsa; identical to SEQ ID NO: 153662

SEQ ID NO: 608701 - RNA, 64 nt, hsa; identical to SEQ ID NO: 153663

SEQ ID NO: 608702 - RNA, 64 nt, hsa; identical to SEQ ID NO: 153664

SEQ ID NO: 608703 - RNA, 64 nt, hsa; identical to SEQ ID NO: 153665

SEQ ID NO: 608704 - RNA, 64 nt, hsa; identical to SEQ ID NO: 153666

SEQ ID NO: 608705 - RNA, 64 nt, hsa; identical to SEQ ID NO: 153667

SEQ ID NO: 608706 - RNA, 64 nt, hsa; identical to SEQ ID NO: 153668

SEQ ID NO: 608707 - RNA, 64 nt, hsa; identical to SEQ ID NO: 153669

SEQ ID NO: 608708 - RNA, 64 nt, hsa; identical to SEQ ID NO: 153670

SEQ ID NO: 608709 - RNA, 64 nt, hsa; identical to SEQ ID NO: 153671

SEQ ID NO: 608710 - RNA, 64 nt, hsa; identical to SEQ ID NO: 153672

SEQ ID NO: 608711 - RNA, 64 nt, hsa; identical to SEQ ID NO: 153673

SEQ ID NO: 608712 - RNA, 64 nt, hsa; identical to SEQ ID NO: 125643

SEQ ID NO: 608713 - RNA, 64 nt, hsa; identical to SEQ ID NO: 125644

SEQ ID NO: 608714 - RNA, 64 nt, hsa; identical to SEQ ID NO: 125645

SEQ ID NO: 608715 - RNA, 64 nt, hsa; identical to SEQ ID NO: 125646

SEQ ID NO: 608716 - RNA, 64 nt, hsa; identical to SEQ ID NO: 125647

SEQ ID NO: 608717 - RNA, 64 nt, hsa; identical to SEQ ID NO: 125648

SEQ ID NO: 608718 - RNA, 64 nt, hsa; identical to SEQ ID NO: 125649

SEQ ID NO: 608719 - RNA, 64 nt, hsa; identical to SEQ ID NO: 125650

SEQ ID NO: 608720 - RNA, 64 nt, hsa; identical to SEQ ID NO: 125651

SEQ ID NO: 608721 - RNA, 64 nt, hsa; identical to SEQ ID NO: 125652

SEQ ID NO: 608722 - RNA, 64 nt, hsa; identical to SEQ ID NO: 125653

SEQ ID NO: 608723 - RNA, 64 nt, hsa; identical to SEQ ID NO: 125654

SEQ ID NO: 608724 - RNA, 64 nt, hsa; identical to SEQ ID NO: 125655

SEQ ID NO: 608725 - RNA, 64 nt, hsa; identical to SEQ ID NO: 125656

SEQ ID NO: 608726 - RNA, 64 nt, hsa; identical to SEQ ID NO: 77858

SEQ ID NO: 608727 - RNA, 64 nt, hsa; identical to SEQ ID NO: 77859

SEQ ID NO: 608728 - RNA, 64 nt, hsa; identical to SEQ ID NO: 77860

SEQ ID NO: 608729 - RNA, 64 nt, hsa; identical to SEQ ID NO: 77861

SEQ ID NO: 608730 - RNA, 64 nt, hsa; identical to SEQ ID NO: 77862

SEQ ID NO: 608731 - RNA, 64 nt, hsa; identical to SEQ ID NO: 77863

SEQ ID NO: 608732 - RNA, 64 nt, hsa; identical to SEQ ID NO: 77864

SEQ ID NO: 608733 - RNA, 64 nt, hsa; identical to SEQ ID NO: 77865

SEQ ID NO: 608734 - RNA, 64 nt, hsa; identical to SEQ ID NO: 77866

SEQ ID NO: 608735 - RNA, 62 nt, hsa; identical to SEQ ID NO: 77867

SEQ ID NO: 608736 - RNA, 64 nt, hsa; identical to SEQ ID NO: 77868

SEQ ID NO: 608737 - RNA, 64 nt, hsa; identical to SEQ ID NO: 77869

SEQ ID NO: 608738 - RNA, 64 nt, hsa; identical to SEQ ID NO: 77870

SEQ ID NO: 608739 - RNA, 64 nt, hsa; identical to SEQ ID NO: 77871

SEQ ID NO: 608740 - RNA, 64 nt, hsa; identical to SEQ ID NO: 77872

SEQ ID NO: 608741 - RNA, 64 nt, hsa; identical to SEQ ID NO: 77873

SEQ ID NO: 608742 - RNA, 64 nt, hsa; identical to SEQ ID NO: 77874

SEQ ID NO: 608743 - RNA, 64 nt, hsa; identical to SEQ ID NO: 77875

SEQ ID NO: 608744 - RNA, 64 nt, hsa; identical to SEQ ID NO: 77876

SEQ ID NO: 608745 - RNA, 64 nt, hsa
agagacuuccauagaauuaagaggguucucauggaggggauaggaaguagguuuaaagccuacc

SEQ ID NO: 608746 - RNA, 64 nt, hsa
cucuauccaggacaucaggagugagggauggaaaaggggauaaaaggccuggagccacacucua

SEQ ID NO: 608747 - RNA, 64 nt, hsa
cuggcugguuccuuagcccugggaaggaguugucaggggauauaagaaacugagcaagcucccu

SEQ ID NO: 608748 - RNA, 64 nt, hsa
aauguuuaauuagaauugugguggugguaguggaaggggauaauuguaaauaggaaacaugaau

SEQ ID NO: 608749 - RNA, 64 nt, hsa
gagcaagucagaauagagagguguuuuuccuuugaggggauaggggaaguaagccaauaagaac

SEQ ID NO: 608750 - RNA, 64 nt, hsa
ccucucugggggaccagaaguagugagagaaggaaggggauaggcagcuuugacaggugcugcu

SEQ ID NO: 608751 - RNA, 64 nt, hsa
ggucaccugugcacagccauggcuggaaugaugaaggggauacgcuggaguugcccugccaucg

SEQ ID NO: 608752 - RNA, 64 nt, hsa
ggaauugaaaagaaagcaugaccaacccaauuacaggggauaaauguaagcuuguuaaaguaag

SEQ ID NO: 608753 - RNA, 64 nt, hsa
auuggcaagucaagcaggaaggagggagauggaaaggggauaucagauugguuucccccggugg

SEQ ID NO: 608754 - RNA, 64 nt, hsa
uauugccacccugcacaucaaguauccuaaggacaggggauaucaagaugccagcacaaaaauu

SEQ ID NO: 608755 - RNA, 64 nt, hsa
agaaguuauaccaauaaaaagcauuuaaaaauuuaggggauauuguaacccaguauaauuuucu

SEQ ID NO: 608756 - RNA, 64 nt, hsa
uugguaauagcauaaugacagugggagggguacaaggggauaagaaaaaugucaugauuuuuuu

SEQ ID NO: 608757 - RNA, 64 nt, hsa
uagcuagggucuuuccugauuuuuauggaauuuuaggggauauuuugagcuuuggguucucagu

SEQ ID NO: 608758 - RNA, 64 nt, hsa
auuuguaaauauuuagggaaagccggguggggggaggggauacagauguagaagguggguaggg

SEQ ID NO: 608759 - RNA, 64 nt, hsa
cuuuugucuuggucgcugcuucuagaaucuaugcaggggauagcagugaggucagaagucuuuc

SEQ ID NO: 608760 - RNA, 64 nt, hsa
acgcccaaaauaauuaguaggaguucaucuuuaaaggggauauucauuugauuauacgggggag

SEQ ID NO: 608761 - RNA, 64 nt, hsa
ccuuuucuccuaugcacaccaggauagacaaggcaggggauacuggcagccugcaucauccucc

SEQ ID NO: 608762 - RNA, 64 nt, hsa
uccugcugcaggaauugggggcugggaacagcagaggggauagaagucugguggagguggagug

SEQ ID NO: 608763 - RNA, 64 nt, hsa
aaucuugguagugccugccuuugaaacaggguguaggggauauuaguuuuccauuuuucuauuu

SEQ ID NO: 608764 - RNA, 64 nt, hsa
cuuggcccuaagaauguuuugcacugacagugggaggggauaagguggcagaaggaaccugagc

SEQ ID NO: 608765 - RNA, 64 nt, hsa
ucccagccugggggccaguggggaacugagggcaaggggauauagugauggggcucagauggac

SEQ ID NO: 608766 - RNA, 64 nt, hsa
aaacaauuagcuuuuucuuuaggacugaccuguuaggggauaaacaucacaauaaucugaauuc

SEQ ID NO: 608767 - RNA, 64 nt, hsa
augccuuaaaaggcuguuucuuaaagguguuacaaggggauaaugguauuucaacuaguuauca

SEQ ID NO: 608768 - RNA, 64 nt, hsa
ccauuuaacccuuuugauccaaggccccggaccaaggggauacuguaaucagguuauguacacc

SEQ ID NO: 608769 - RNA, 64 nt, hsa
aguuuuauuuuuguucaucuccuuaucuauaaaaaggggauauucuuaggauaaauacaugaaa

SEQ ID NO: 608770 - RNA, 64 nt, hsa
uaagucugcagaauucccuucuacuuugaagagaaggggauaggaauguauauuuggcuggggg

SEQ ID NO: 608771 - RNA, 64 nt, hsa
guuuuccaauauuuuaauaaaguaguuauuuuauaggggauacuugaaaccaguauuuaagcuu

SEQ ID NO: 608772 - RNA, 64 nt, hsa
guauuauuuugugcauuuaaaaaacacaaucuuaaggggauagacuagacugccacagcagccc

SEQ ID NO: 608773 - RNA, 64 nt, hsa
acacacuuuccaaaaugagccuuaaaaauuguaaaggggauacuauaaaugugcuaaguuauuu

SEQ ID NO: 608774 - RNA, 64 nt, hsa
auuucuacuaaaaauacaaaaauuagcuggggcgaggggauaggccgaguuccggguguaaggg

SEQ ID NO: 608775 - RNA, 64 nt, hsa
gugcgugcgcgcgcguguguaccugugugggugaaggggauagggcgaggcugugccugugccc

SEQ ID NO: 608776 - RNA, 64 nt, hsa
auguacacuuguauuauaauaaccucccaguucuaggggauauuugugcaauaaauacacaugu

SEQ ID NO: 608777 - RNA, 64 nt, hsa
cuguccugcccugcagcaugugccuaaaggcucaaggggauauuccucugggguggccacuccc

SEQ ID NO: 608778 - RNA, 64 nt, hsa
gugggagugcagagaaagaaagggaaacuggcugaggggauaccauaaaaagaggaugauuuca

SEQ ID NO: 608779 - RNA, 64 nt, hsa
uacuaaaagauacagcaguuacccccuuauccacaggggauacaguggauaucuaaaaccagac

SEQ ID NO: 608780 - RNA, 64 nt, hsa
cagagcgagacuuugucccaaaacaaaauaggugaggggauagcgaaugcacucagggucagca

SEQ ID NO: 608781 - RNA, 64 nt, hsa
gcugugugccaaaaacucccacccaaggucccucaggggauauuucacugaagaaccaguuaga

SEQ ID NO: 608782 - RNA, 50 nt, hsa
uguuggcuggaaucuucugaaggggauaccacucaaaggcaaggccuggu

SEQ ID NO: 608783 - RNA, 64 nt, hsa
acuggggguguaugggguagauggguggagagggaggggauaagagaggugcauguugguauuu

SEQ ID NO: 608784 - RNA, 64 nt, hsa
acaagaagaacagguucacagaaggagauaccaaaggggauagaaaaaugggaaaaaugguaag

SEQ ID NO: 608785 - RNA, 64 nt, hsa
auuuguauuuauaguuuuuuauuuguauagauuuaggggauacaagauuucuuacaugcaugua

SEQ ID NO: 608786 - RNA, 64 nt, hsa
uggggaguuggggaaaggaacgaacccuggcuggaggggauaggagggcuuuuaauuuauuucu

SEQ ID NO: 608787 - RNA, 64 nt, hsa
uuauggaaacucugagaagcugaaugauacaugcaggggauauuuuuugagaugauuuaaaugu

SEQ ID NO: 608788 - RNA, 64 nt, hsa
agccugcauuguggaagaucuccagccuccuuguaggggauaaggggaugugcagcaucugugu

SEQ ID NO: 608789 - RNA, 64 nt, hsa
aguuauggcaaaaagcaaaaggaacacaggguaaaggggauaggugccauuugguggugagaau

SEQ ID NO: 608790 - RNA, 64 nt, hsa
gcauuauaaaccuggaauguaucgacuuucuuucaggggauauuggaaagauaauggucauuau

SEQ ID NO: 608791 - RNA, 55 nt, hsa
cucucuaggacaagcacugauccugaggggauacuguggagcagcccaguccaca

SEQ ID NO: 608792 - RNA, 64 nt, hsa
ccuccccucaucugcucuaguggugaccuggccaaggggauacagacccugcaguccgcucagg

SEQ ID NO: 608793 - RNA, 64 nt, hsa
ucuuccuucuuccuucugugacuuaacuuuguaaaggggauauggacaaguaaguaacacgcau

SEQ ID NO: 608794 - RNA, 64 nt, hsa
caugucugccuggagugcugugcuguguuuaaucaggggauacaggccccuggguuucuuuuuu

SEQ ID NO: 608795 - RNA, 64 nt, hsa
ucacauuuauguggaaguccaaagucaaguccuuaggggauaauuuuguuuuggcucaguuguu

SEQ ID NO: 608796 - RNA, 64 nt, hsa
gcaauuuugagggauaccuaauuugcauucgguuaggggauauuuuucaaccucuugcuuuaua

SEQ ID NO: 608797 - RNA, 64 nt, hsa
aucauggugucugucacugguuagggguaagaugaggggauaaggaaagagacuuuucaauaag

SEQ ID NO: 608798 - RNA, 64 nt, hsa
uucaaccauaaaaacaaagggcucugauugcuuuaggggauaagugauuuaauauccacaaacg

SEQ ID NO: 608799 - RNA, 64 nt, hsa
cuugaaaauaacacuagggcauaacaauuacuucaggggauacgccauccacccuggcucuugu

SEQ ID NO: 608800 - RNA, 64 nt, hsa
uaggcaacacucagagcagaucucccuuacugucaggggauauggaacuucaaaggcccacaug

SEQ ID NO: 608801 - RNA, 64 nt, hsa
auccauggagauggaacauagauuagugguugccaggggauagaggaguaauuguuagugggca

SEQ ID NO: 608802 - RNA, 64 nt, hsa
ugccaugcaaagguggacaccauucuccagcuucaggggauaugcucgucccgggcaccggugg

SEQ ID NO: 608803 - RNA, 64 nt, hsa
accaguaugaaagucauucauuuagugcuaccaaaggggauacacaagcccuuuaggaagcagu

SEQ ID NO: 608804 - RNA, 64 nt, hsa
acaaacucaccuuauguuacuccaaaguaauaguaggggauaaacccauagacuacaacaauua

SEQ ID NO: 608805 - RNA, 64 nt, hsa
caauaacaacuuagugcuuagcccaugauguaucaggggauaugaugugaugauuuucaaggug

SEQ ID NO: 608806 - RNA, 64 nt, hsa
acuaucacuuaguaccuguuugaccaagguguuaaggggauaguaccucccaauucaagcagag

SEQ ID NO: 608807 - RNA, 64 nt, hsa
aaaaagaaucccaauguuugacaaaacacagccaaggggauauuuacugcucuuuauugcagaa

SEQ ID NO: 608808 - RNA, 64 nt, hsa
acaaacucgccuuauguuacuccaaaguaacaguaggggauaaacccauagacuacaacaacua

SEQ ID NO: 608809 - RNA, 64 nt, hsa
accccucagcccaccucacuauggugcuggguagaggggauaccuggguucuaaccucuaaaua

SEQ ID NO: 608810 - RNA, 64 nt, hsa
ggaggagggagguggguguuggagccccugagacaggggauacagaaacuagggcuaaaggacu

SEQ ID NO: 608811 - RNA, 64 nt, hsa
guaacucaucauagaaacauuguggugggaggagaggggauagucuacagcuaaugagggaaac

SEQ ID NO: 608812 - RNA, 64 nt, hsa
uccugggggccuggagaggacugagccuacggaaaggggauaccuucccacucagcacugcuuc

SEQ ID NO: 608813 - RNA, 64 nt, hsa
augcuuuacacucauuuucaauuucuaaauuugcaggggauacugaaaaauacggcagguggcc

SEQ ID NO: 608814 - RNA, 64 nt, hsa
guuaugaaaaaauagacgucaacaaaaauguguaaggggauauuagguuugcuaaauucuuuca

SEQ ID NO: 608815 - RNA, 64 nt, hsa
uaucuaugugugacaaaugaggaaacugaggcucaggggauaaagggacuugcccaagucccac

SEQ ID NO: 608816 - RNA, 64 nt, hsa
cuuuuccucccuuggguucugauauugccgcacuaggggauauaggagaggaaaaguaaggugc

SEQ ID NO: 608817 - RNA, 64 nt, hsa
aaauggccauacuucaggaacugcagugcuuaugaggggauauuuaggccucuugaauuuuuga

SEQ ID NO: 608818 - RNA, 64 nt, hsa
agcccugagcugggggaaggggucaugcagcaccaggggauaugcccaacucacugccugcugg

SEQ ID NO: 608819 - RNA, 64 nt, hsa
auccuggaggggcuuuggaccaccugaaagaccaaggggauagggaggaggaggcuucagccau

SEQ ID NO: 608820 - RNA, 64 nt, hsa
accuuuguaaauauuuuugcuuguguugucgcaaaggggauaaucugggaaagacaccaaauca

SEQ ID NO: 608821 - RNA, 64 nt, hsa
gauuaacuuauuuagagaugcuguaacuuaaaauaggggauauuuaagguagcuucagcuagcu

SEQ ID NO: 608822 - RNA, 64 nt, hsa
ccguuuguucacucguacaugccuagccuacagaaggggauauauauuaugaaauggucauuuu

SEQ ID NO: 608823 - RNA, 64 nt, hsa
uacuuguucuuauuauucaagagucauuuauuacaggggauaaauguuggguagcaagaacuuu

SEQ ID NO: 608824 - RNA, 64 nt, hsa
cggcaaaugcccugcaacgguggcuccugacaccaggggauagggagaugugccagaguccuuc

SEQ ID NO: 608825 - RNA, 64 nt, hsa
aaggagaaaauuucagaacuaaguugaguaauauaggggauauauauuugugaaaaauaauuuu

SEQ ID NO: 608826 - RNA, 64 nt, hsa
uucacaacaggcauuccagaauuaugaggcauugaggggauagaugaauacuaaaugguugucu

SEQ ID NO: 608827 - RNA, 64 nt, hsa
gaagggacagggaaagauaauuacugauaaaugaaggggauauucgacuguauaaccauaugga

SEQ ID NO: 608828 - RNA, 64 nt, hsa
ugcucaucaagugccaauucaauggagcaggaggaggggauaucauauauuuaggggaaagacu

SEQ ID NO: 608829 - RNA, 64 nt, hsa
aagugguagaugggacagguaaguggcagaggugaggggauaaguuagaauguaaaagggcagu

SEQ ID NO: 608830 - RNA, 64 nt, hsa
ucucuaaaaaauaaaauauaagaaaauaaaacuuaggggauauacagauuuaaauauucaaauc

SEQ ID NO: 608831 - RNA, 64 nt, hsa
gcggcuucgcccgggcuccuagcggggaaaaggaaggggauaacucagaggaacagacacucaa

SEQ ID NO: 608832 - RNA, 64 nt, hsa
cagccugagggcugguggggacuuuugagucuugaggggauagcggaaaaagcugagcucauag

SEQ ID NO: 608833 - RNA, 64 nt, hsa
auggggcagaggagcuccaggcacagaccaggggaggggauauuuaggggcuccccuuacaauc

SEQ ID NO: 608834 - RNA, 64 nt, hsa
cucagcaccuggccccaggacugagguccugagaaggggauagcacugcccaggacgugugucc

SEQ ID NO: 608835 - RNA, 64 nt, hsa
gauauuaagacuuaauucacuaaaauuuauucuaaggggauauuuauacuuuuauacuuuuuua

SEQ ID NO: 608836 - RNA, 64 nt, hsa
guggcuggguuggagggugucccaaaaagaaaggaggggauagagagagaccacuuuucauaac

SEQ ID NO: 608837 - RNA, 64 nt, hsa
ugugcauagaaaaauaauuaucuguaaaaaaugaaggggauaauauaugauaaauuauguucug

SEQ ID NO: 608838 - RNA, 64 nt, hsa
acaaccugagauggagaggccaggagagaguauaaggggauagcagcaaaccaccuaucuggcc

SEQ ID NO: 608839 - RNA, 64 nt, hsa
aucccaauguucuaccucucccugucccucuuguaggggauagggaggcagagagagccagccc

SEQ ID NO: 608840 - RNA, 64 nt, hsa
uccgccacuuucaugacuagaguugaggaagaacaggggauaguucuguaaguguucgggggac

SEQ ID NO: 608841 - RNA, 64 nt, hsa
accgacucugccuacauucuuuucuaugagcagcaggggauagacuacgcacaauuucugccaa

SEQ ID NO: 608842 - RNA, 64 nt, hsa
uaauccccacuucccugcagaaucaaucugagggaggggauaaagaggaagcaauaaaaaaaaa

SEQ ID NO: 608843 - RNA, 64 nt, hsa
acuacacuuugcugguuccuguccccucugagaaaggggauagaaagcuccuuccucuaugucc

SEQ ID NO: 608844 - RNA, 64 nt, hsa
uucuagaggggcccacucccagcugggagaguguaggggauaugcucacaccacauuagcagca

SEQ ID NO: 608845 - RNA, 64 nt, hsa
uucucuucuauccugcaauuucucccgaauccugaggggauaucccuaugucccagccccuggu

SEQ ID NO: 608846 - RNA, 64 nt, hsa
ucuugauuuaggguggcugguggcaaggaggggcaggggauauggggacgugacugggacaggu

SEQ ID NO: 608847 - RNA, 64 nt, hsa
ccaagcugcuuaaaguagaaggaucaggacuggcaggggauaugagggccaguguagagauuaa

SEQ ID NO: 608848 - RNA, 64 nt, hsa
uuuuagguccuccaagccaggccaugugggcuuuaggggauaagauugcaucuuccauaguggc

SEQ ID NO: 608849 - RNA, 64 nt, hsa
accguggaucaccugcaacaagcucugauacuccaggggauacuuaagcccucaucacuucaaa

SEQ ID NO: 608850 - RNA, 64 nt, hsa
guauaguuugcacacccaucccaguggaggggaaaggggauaaguguuucaaggcaaccuuuuc

SEQ ID NO: 608851 - RNA, 64 nt, hsa
ugcuugcuuuuauaucccagacuucuccucaaagaggggauaggccugguuuccuuuguacuaa

SEQ ID NO: 608852 - RNA, 64 nt, hsa
guugggaagaauaaaugucuguaugcccuggaagaggggauaguccgcuacacuaaggaggucu

SEQ ID NO: 608853 - RNA, 64 nt, hsa
uaacccuuuagcccuaggauggcuuuggugggagaggggauagaagcccaugacuucagacaga

SEQ ID NO: 608854 - RNA, 64 nt, hsa
gccuugccagagggcucaggaugggaaaggaagaaggggauaggaaaagaagagguaauuuuac

SEQ ID NO: 608855 - RNA, 64 nt, hsa
ugcuucugcaccccagcccccuguccugccuguaaggggauacagagaagcuccccgucucugc

SEQ ID NO: 608856 - RNA, 64 nt, hsa
acugacauuguuuuguuacugcuccuacccaccaaggggauaaagaaggcgaguucugaguguu

SEQ ID NO: 608857 - RNA, 64 nt, hsa
ucuuuuuccaguauacuagcuugucuuuuaagaaaggggauauuaaaaaaaaaaaaagacaaaa

SEQ ID NO: 608858 - RNA, 64 nt, hsa
agaaauccagaguggggagacagagaccaagagcaggggauagaagccgggcgaaguggcccau

SEQ ID NO: 608859 - RNA, 64 nt, hsa
aggaaauagaaaccacacuagguauuucaaacagaggggauauaaguuagggacugauugugca

SEQ ID NO: 608860 - RNA, 64 nt, hsa
guucagaacacuuuuuaugacaaaaauuggguggaggggauaacuuucauaucuggcucaacau

SEQ ID NO: 608861 - RNA, 64 nt, hsa
agauaaauuuucugcccugugagugacacuggccaggggauagguugaggcagauggugcccag

SEQ ID NO: 608862 - RNA, 64 nt, hsa
ugaauuaauuuuagacauauuuuggauccuauugaggggauaagaggaugucaaaaaaguuaaa

SEQ ID NO: 608863 - RNA, 64 nt, hsa
cuacauuuguaucaaaguauguccugauccccuuaggggauagcucauuguuuuuauucagauu

SEQ ID NO: 608864 - RNA, 64 nt, hsa
gggcuuaauugaaacaacauuauuuuaaaaucaaaggggauauauguuuguggaauggauuuuc

SEQ ID NO: 608865 - RNA, 64 nt, hsa
gguggccaagccucaguuucccccaaaugagcaaaggggauaaagaggggcccgacuuuugcca

SEQ ID NO: 608866 - RNA, 64 nt, hsa
uuugcuaucaccaguaccucucagcuuacucuucaggggauaugaaacaaucuguagauugguu

SEQ ID NO: 608867 - RNA, 64 nt, hsa
guuuuuuguuuuucguuacuagauuucauggaugaggggauaugguugaccuuuuacuuuuuaa

SEQ ID NO: 608868 - RNA, 64 nt, hsa
aggacaaagggcaguuuagggagaggcagggugaaggggauagcucgauugggcauccagagug

SEQ ID NO: 608869 - RNA, 64 nt, hsa
ccugggcgcgcugggagugugguuguguuucugaaggggauaaaagagggcacgguggugccaa

SEQ ID NO: 608870 - RNA, 64 nt, hsa; identical to SEQ ID NO: 246823

SEQ ID NO: 608871 - RNA, 64 nt, hsa; identical to SEQ ID NO: 246824

SEQ ID NO: 608872 - RNA, 64 nt, hsa; identical to SEQ ID NO: 246825

SEQ ID NO: 608873 - RNA, 64 nt, hsa; identical to SEQ ID NO: 246826

SEQ ID NO: 608874 - RNA, 64 nt, hsa; identical to SEQ ID NO: 246827

SEQ ID NO: 608875 - RNA, 64 nt, hsa; identical to SEQ ID NO: 246828

SEQ ID NO: 608876 - RNA, 64 nt, hsa; identical to SEQ ID NO: 246829

SEQ ID NO: 608877 - RNA, 50 nt, hsa; identical to SEQ ID NO: 246830

SEQ ID NO: 608878 - RNA, 64 nt, hsa; identical to SEQ ID NO: 246831

SEQ ID NO: 608879 - RNA, 64 nt, hsa; identical to SEQ ID NO: 246832

SEQ ID NO: 608880 - RNA, 64 nt, hsa; identical to SEQ ID NO: 246833

SEQ ID NO: 608881 - RNA, 64 nt, hsa; identical to SEQ ID NO: 246834

SEQ ID NO: 608882 - RNA, 64 nt, hsa; identical to SEQ ID NO: 246835

SEQ ID NO: 608883 - RNA, 64 nt, hsa; identical to SEQ ID NO: 246836

SEQ ID NO: 608884 - RNA, 64 nt, hsa; identical to SEQ ID NO: 246837

SEQ ID NO: 608885 - RNA, 64 nt, hsa; identical to SEQ ID NO: 246838

SEQ ID NO: 608886 - RNA, 64 nt, hsa; identical to SEQ ID NO: 246839

SEQ ID NO: 608887 - RNA, 64 nt, hsa; identical to SEQ ID NO: 246840

SEQ ID NO: 608888 - RNA, 64 nt, hsa; identical to SEQ ID NO: 246841

SEQ ID NO: 608889 - RNA, 64 nt, hsa; identical to SEQ ID NO: 246842

SEQ ID NO: 608890 - RNA, 64 nt, hsa; identical to SEQ ID NO: 246843

SEQ ID NO: 608891 - RNA, 64 nt, hsa; identical to SEQ ID NO: 246844

SEQ ID NO: 608892 - RNA, 64 nt, hsa; identical to SEQ ID NO: 246845

SEQ ID NO: 608893 - RNA, 64 nt, hsa; identical to SEQ ID NO: 246846

SEQ ID NO: 608894 - RNA, 64 nt, hsa; identical to SEQ ID NO: 246847

SEQ ID NO: 608895 - RNA, 64 nt, hsa; identical to SEQ ID NO: 246848

SEQ ID NO: 608896 - RNA, 64 nt, hsa; identical to SEQ ID NO: 246849

SEQ ID NO: 608897 - RNA, 64 nt, hsa; identical to SEQ ID NO: 246850

SEQ ID NO: 608898 - RNA, 64 nt, hsa; identical to SEQ ID NO: 246851

SEQ ID NO: 608899 - RNA, 64 nt, hsa; identical to SEQ ID NO: 246852

SEQ ID NO: 608900 - RNA, 64 nt, hsa; identical to SEQ ID NO: 246853

SEQ ID NO: 608901 - RNA, 64 nt, hsa; identical to SEQ ID NO: 246854

SEQ ID NO: 608902 - RNA, 64 nt, hsa; identical to SEQ ID NO: 246855

SEQ ID NO: 608903 - RNA, 64 nt, hsa; identical to SEQ ID NO: 246856

SEQ ID NO: 608904 - RNA, 64 nt, hsa; identical to SEQ ID NO: 246857

SEQ ID NO: 608905 - RNA, 64 nt, hsa; identical to SEQ ID NO: 246858

SEQ ID NO: 608906 - RNA, 64 nt, hsa; identical to SEQ ID NO: 246859

SEQ ID NO: 608907 - RNA, 64 nt, hsa; identical to SEQ ID NO: 246860

SEQ ID NO: 608908 - RNA, 64 nt, hsa; identical to SEQ ID NO: 246861

SEQ ID NO: 608909 - RNA, 64 nt, hsa; identical to SEQ ID NO: 246862

SEQ ID NO: 608910 - RNA, 64 nt, hsa; identical to SEQ ID NO: 246863

SEQ ID NO: 608911 - RNA, 64 nt, hsa; identical to SEQ ID NO: 246864

SEQ ID NO: 608912 - RNA, 64 nt, hsa; identical to SEQ ID NO: 246865

SEQ ID NO: 608913 - RNA, 64 nt, hsa; identical to SEQ ID NO: 246866

SEQ ID NO: 608914 - RNA, 64 nt, hsa; identical to SEQ ID NO: 246867

SEQ ID NO: 608915 - RNA, 64 nt, hsa; identical to SEQ ID NO: 246868

SEQ ID NO: 608916 - RNA, 64 nt, hsa; identical to SEQ ID NO: 246869

SEQ ID NO: 608917 - RNA, 64 nt, hsa; identical to SEQ ID NO: 246870

SEQ ID NO: 608918 - RNA, 64 nt, hsa; identical to SEQ ID NO: 246871

SEQ ID NO: 608919 - RNA, 64 nt, hsa; identical to SEQ ID NO: 246872

SEQ ID NO: 608920 - RNA, 64 nt, hsa; identical to SEQ ID NO: 246873

SEQ ID NO: 608921 - RNA, 64 nt, hsa; identical to SEQ ID NO: 246874

SEQ ID NO: 608922 - RNA, 64 nt, hsa; identical to SEQ ID NO: 246875

SEQ ID NO: 608923 - RNA, 64 nt, hsa; identical to SEQ ID NO: 246876

SEQ ID NO: 608924 - RNA, 52 nt, hsa; identical to SEQ ID NO: 246877

SEQ ID NO: 608925 - RNA, 64 nt, hsa; identical to SEQ ID NO: 246878

SEQ ID NO: 608926 - RNA, 64 nt, hsa; identical to SEQ ID NO: 246879

SEQ ID NO: 608927 - RNA, 64 nt, hsa; identical to SEQ ID NO: 246880

SEQ ID NO: 608928 - RNA, 64 nt, hsa; identical to SEQ ID NO: 246881

SEQ ID NO: 608929 - RNA, 64 nt, hsa; identical to SEQ ID NO: 246882

SEQ ID NO: 608930 - RNA, 64 nt, hsa; identical to SEQ ID NO: 246883

SEQ ID NO: 608931 - RNA, 64 nt, hsa; identical to SEQ ID NO: 246884

SEQ ID NO: 608932 - RNA, 64 nt, hsa; identical to SEQ ID NO: 246885

SEQ ID NO: 608933 - RNA, 64 nt, hsa; identical to SEQ ID NO: 246886

SEQ ID NO: 608934 - RNA, 64 nt, hsa; identical to SEQ ID NO: 246887

SEQ ID NO: 608935 - RNA, 64 nt, hsa; identical to SEQ ID NO: 246888

SEQ ID NO: 608936 - RNA, 64 nt, hsa; identical to SEQ ID NO: 246889

SEQ ID NO: 608937 - RNA, 64 nt, hsa; identical to SEQ ID NO: 246890

SEQ ID NO: 608938 - RNA, 64 nt, hsa; identical to SEQ ID NO: 246891

SEQ ID NO: 608939 - RNA, 64 nt, hsa; identical to SEQ ID NO: 246892

SEQ ID NO: 608940 - RNA, 64 nt, hsa; identical to SEQ ID NO: 246893

SEQ ID NO: 608941 - RNA, 64 nt, hsa; identical to SEQ ID NO: 246894

SEQ ID NO: 608942 - RNA, 64 nt, hsa; identical to SEQ ID NO: 246895

SEQ ID NO: 608943 - RNA, 64 nt, hsa; identical to SEQ ID NO: 246896

SEQ ID NO: 608944 - RNA, 64 nt, hsa; identical to SEQ ID NO: 246897

SEQ ID NO: 608945 - RNA, 57 nt, hsa; identical to SEQ ID NO: 246898

SEQ ID NO: 608946 - RNA, 64 nt, hsa; identical to SEQ ID NO: 246899

SEQ ID NO: 608947 - RNA, 54 nt, hsa; identical to SEQ ID NO: 246900

SEQ ID NO: 608948 - RNA, 64 nt, hsa; identical to SEQ ID NO: 246901

SEQ ID NO: 608949 - RNA, 64 nt, hsa; identical to SEQ ID NO: 246823

SEQ ID NO: 608950 - RNA, 64 nt, hsa; identical to SEQ ID NO: 246824

SEQ ID NO: 608951 - RNA, 64 nt, hsa; identical to SEQ ID NO: 246825

SEQ ID NO: 608952 - RNA, 64 nt, hsa; identical to SEQ ID NO: 246826

SEQ ID NO: 608953 - RNA, 64 nt, hsa; identical to SEQ ID NO: 246827

SEQ ID NO: 608954 - RNA, 64 nt, hsa; identical to SEQ ID NO: 246828

SEQ ID NO: 608955 - RNA, 64 nt, hsa; identical to SEQ ID NO: 246829

SEQ ID NO: 608956 - RNA, 50 nt, hsa; identical to SEQ ID NO: 246830

SEQ ID NO: 608957 - RNA, 64 nt, hsa; identical to SEQ ID NO: 246831

SEQ ID NO: 608958 - RNA, 64 nt, hsa; identical to SEQ ID NO: 246832

SEQ ID NO: 608959 - RNA, 64 nt, hsa; identical to SEQ ID NO: 246833

SEQ ID NO: 608960 - RNA, 64 nt, hsa; identical to SEQ ID NO: 246834

SEQ ID NO: 608961 - RNA, 64 nt, hsa; identical to SEQ ID NO: 246835

SEQ ID NO: 608962 - RNA, 64 nt, hsa; identical to SEQ ID NO: 246836

SEQ ID NO: 608963 - RNA, 64 nt, hsa; identical to SEQ ID NO: 246837

SEQ ID NO: 608964 - RNA, 64 nt, hsa; identical to SEQ ID NO: 246838

SEQ ID NO: 608965 - RNA, 64 nt, hsa; identical to SEQ ID NO: 246839

SEQ ID NO: 608966 - RNA, 64 nt, hsa; identical to SEQ ID NO: 246840

SEQ ID NO: 608967 - RNA, 64 nt, hsa; identical to SEQ ID NO: 246841

SEQ ID NO: 608968 - RNA, 64 nt, hsa; identical to SEQ ID NO: 246842

SEQ ID NO: 608969 - RNA, 64 nt, hsa; identical to SEQ ID NO: 246843

SEQ ID NO: 608970 - RNA, 64 nt, hsa; identical to SEQ ID NO: 246844

SEQ ID NO: 608971 - RNA, 64 nt, hsa; identical to SEQ ID NO: 246845

SEQ ID NO: 608972 - RNA, 64 nt, hsa; identical to SEQ ID NO: 246846

SEQ ID NO: 608973 - RNA, 64 nt, hsa; identical to SEQ ID NO: 246847

SEQ ID NO: 608974 - RNA, 64 nt, hsa; identical to SEQ ID NO: 246848

SEQ ID NO: 608975 - RNA, 64 nt, hsa; identical to SEQ ID NO: 246849

SEQ ID NO: 608976 - RNA, 64 nt, hsa; identical to SEQ ID NO: 246850

SEQ ID NO: 608977 - RNA, 64 nt, hsa; identical to SEQ ID NO: 246851

SEQ ID NO: 608978 - RNA, 64 nt, hsa; identical to SEQ ID NO: 246852

SEQ ID NO: 608979 - RNA, 64 nt, hsa; identical to SEQ ID NO: 246853

SEQ ID NO: 608980 - RNA, 64 nt, hsa; identical to SEQ ID NO: 246854

SEQ ID NO: 608981 - RNA, 64 nt, hsa; identical to SEQ ID NO: 246855

SEQ ID NO: 608982 - RNA, 64 nt, hsa; identical to SEQ ID NO: 246856

SEQ ID NO: 608983 - RNA, 64 nt, hsa; identical to SEQ ID NO: 246857

SEQ ID NO: 608984 - RNA, 64 nt, hsa; identical to SEQ ID NO: 246858

SEQ ID NO: 608985 - RNA, 64 nt, hsa; identical to SEQ ID NO: 246859

SEQ ID NO: 608986 - RNA, 64 nt, hsa; identical to SEQ ID NO: 246860

SEQ ID NO: 608987 - RNA, 64 nt, hsa; identical to SEQ ID NO: 246861

SEQ ID NO: 608988 - RNA, 64 nt, hsa; identical to SEQ ID NO: 246862

SEQ ID NO: 608989 - RNA, 64 nt, hsa; identical to SEQ ID NO: 246863

SEQ ID NO: 608990 - RNA, 64 nt, hsa; identical to SEQ ID NO: 246864

SEQ ID NO: 608991 - RNA, 64 nt, hsa; identical to SEQ ID NO: 246865

SEQ ID NO: 608992 - RNA, 64 nt, hsa; identical to SEQ ID NO: 246866

SEQ ID NO: 608993 - RNA, 64 nt, hsa; identical to SEQ ID NO: 246867

SEQ ID NO: 608994 - RNA, 64 nt, hsa; identical to SEQ ID NO: 246868

SEQ ID NO: 608995 - RNA, 64 nt, hsa; identical to SEQ ID NO: 246869

SEQ ID NO: 608996 - RNA, 64 nt, hsa; identical to SEQ ID NO: 246870

SEQ ID NO: 608997 - RNA, 64 nt, hsa; identical to SEQ ID NO: 246871

SEQ ID NO: 608998 - RNA, 64 nt, hsa; identical to SEQ ID NO: 246872

SEQ ID NO: 608999 - RNA, 64 nt, hsa; identical to SEQ ID NO: 246873

SEQ ID NO: 609000 - RNA, 64 nt, hsa; identical to SEQ ID NO: 246874

SEQ ID NO: 609001 - RNA, 64 nt, hsa; identical to SEQ ID NO: 246875

SEQ ID NO: 609002 - RNA, 64 nt, hsa; identical to SEQ ID NO: 246876

SEQ ID NO: 609003 - RNA, 52 nt, hsa; identical to SEQ ID NO: 246877

SEQ ID NO: 609004 - RNA, 64 nt, hsa; identical to SEQ ID NO: 246878

SEQ ID NO: 609005 - RNA, 64 nt, hsa; identical to SEQ ID NO: 246879

SEQ ID NO: 609006 - RNA, 64 nt, hsa; identical to SEQ ID NO: 246880

SEQ ID NO: 609007 - RNA, 64 nt, hsa; identical to SEQ ID NO: 246881

SEQ ID NO: 609008 - RNA, 64 nt, hsa; identical to SEQ ID NO: 246882

SEQ ID NO: 609009 - RNA, 64 nt, hsa; identical to SEQ ID NO: 246883

SEQ ID NO: 609010 - RNA, 64 nt, hsa; identical to SEQ ID NO: 246884

SEQ ID NO: 609011 - RNA, 64 nt, hsa; identical to SEQ ID NO: 246885

SEQ ID NO: 609012 - RNA, 64 nt, hsa; identical to SEQ ID NO: 246886

SEQ ID NO: 609013 - RNA, 64 nt, hsa; identical to SEQ ID NO: 246887

SEQ ID NO: 609014 - RNA, 64 nt, hsa; identical to SEQ ID NO: 246888

SEQ ID NO: 609015 - RNA, 64 nt, hsa; identical to SEQ ID NO: 246889

SEQ ID NO: 609016 - RNA, 64 nt, hsa; identical to SEQ ID NO: 246890

SEQ ID NO: 609017 - RNA, 64 nt, hsa; identical to SEQ ID NO: 246891

SEQ ID NO: 609018 - RNA, 64 nt, hsa; identical to SEQ ID NO: 246892

SEQ ID NO: 609019 - RNA, 64 nt, hsa; identical to SEQ ID NO: 246893

SEQ ID NO: 609020 - RNA, 64 nt, hsa; identical to SEQ ID NO: 246894

SEQ ID NO: 609021 - RNA, 64 nt, hsa; identical to SEQ ID NO: 246895

SEQ ID NO: 609022 - RNA, 64 nt, hsa; identical to SEQ ID NO: 246896

SEQ ID NO: 609023 - RNA, 64 nt, hsa; identical to SEQ ID NO: 246897

SEQ ID NO: 609024 - RNA, 57 nt, hsa; identical to SEQ ID NO: 246898

SEQ ID NO: 609025 - RNA, 64 nt, hsa; identical to SEQ ID NO: 246899

SEQ ID NO: 609026 - RNA, 54 nt, hsa; identical to SEQ ID NO: 246900

SEQ ID NO: 609027 - RNA, 64 nt, hsa; identical to SEQ ID NO: 246901

SEQ ID NO: 609028 - RNA, 64 nt, hsa; identical to SEQ ID NO: 76580

SEQ ID NO: 609029 - RNA, 64 nt, hsa; identical to SEQ ID NO: 76581

SEQ ID NO: 609030 - RNA, 64 nt, hsa; identical to SEQ ID NO: 76582

SEQ ID NO: 609031 - RNA, 64 nt, hsa; identical to SEQ ID NO: 76583

SEQ ID NO: 609032 - RNA, 64 nt, hsa; identical to SEQ ID NO: 76584

SEQ ID NO: 609033 - RNA, 64 nt, hsa; identical to SEQ ID NO: 76585

SEQ ID NO: 609034 - RNA, 64 nt, hsa; identical to SEQ ID NO: 76586

SEQ ID NO: 609035 - RNA, 64 nt, hsa; identical to SEQ ID NO: 76587

SEQ ID NO: 609036 - RNA, 64 nt, hsa; identical to SEQ ID NO: 76588

SEQ ID NO: 609037 - RNA, 64 nt, hsa; identical to SEQ ID NO: 76589

SEQ ID NO: 609038 - RNA, 64 nt, hsa; identical to SEQ ID NO: 76590

SEQ ID NO: 609039 - RNA, 64 nt, hsa; identical to SEQ ID NO: 76591

SEQ ID NO: 609040 - RNA, 64 nt, hsa; identical to SEQ ID NO: 76592

SEQ ID NO: 609041 - RNA, 64 nt, hsa; identical to SEQ ID NO: 76593

SEQ ID NO: 609042 - RNA, 51 nt, hsa; identical to SEQ ID NO: 516816

SEQ ID NO: 609043 - RNA, 64 nt, hsa; identical to SEQ ID NO: 516817

SEQ ID NO: 609044 - RNA, 64 nt, hsa; identical to SEQ ID NO: 516818

SEQ ID NO: 609045 - RNA, 64 nt, hsa; identical to SEQ ID NO: 516819

SEQ ID NO: 609046 - RNA, 64 nt, hsa; identical to SEQ ID NO: 516820

SEQ ID NO: 609047 - RNA, 64 nt, hsa; identical to SEQ ID NO: 516821

SEQ ID NO: 609048 - RNA, 64 nt, hsa; identical to SEQ ID NO: 516822

SEQ ID NO: 609049 - RNA, 64 nt, hsa; identical to SEQ ID NO: 516823

SEQ ID NO: 609050 - RNA, 64 nt, hsa; identical to SEQ ID NO: 516824

SEQ ID NO: 609051 - RNA, 64 nt, hsa; identical to SEQ ID NO: 516825

SEQ ID NO: 609052 - RNA, 64 nt, hsa; identical to SEQ ID NO: 516826

SEQ ID NO: 609053 - RNA, 64 nt, hsa; identical to SEQ ID NO: 516827

SEQ ID NO: 609054 - RNA, 64 nt, hsa; identical to SEQ ID NO: 516828

SEQ ID NO: 609055 - RNA, 64 nt, hsa; identical to SEQ ID NO: 516829

SEQ ID NO: 609056 - RNA, 64 nt, hsa; identical to SEQ ID NO: 516830

SEQ ID NO: 609057 - RNA, 64 nt, hsa; identical to SEQ ID NO: 516831

SEQ ID NO: 609058 - RNA, 64 nt, hsa; identical to SEQ ID NO: 516832

SEQ ID NO: 609059 - RNA, 64 nt, hsa; identical to SEQ ID NO: 516833

SEQ ID NO: 609060 - RNA, 64 nt, hsa; identical to SEQ ID NO: 516834

SEQ ID NO: 609061 - RNA, 64 nt, hsa; identical to SEQ ID NO: 516835

SEQ ID NO: 609062 - RNA, 64 nt, hsa; identical to SEQ ID NO: 516836

SEQ ID NO: 609063 - RNA, 64 nt, hsa; identical to SEQ ID NO: 516837

SEQ ID NO: 609064 - RNA, 64 nt, hsa; identical to SEQ ID NO: 516838

SEQ ID NO: 609065 - RNA, 64 nt, hsa; identical to SEQ ID NO: 516839

SEQ ID NO: 609066 - RNA, 64 nt, hsa; identical to SEQ ID NO: 516840

SEQ ID NO: 609067 - RNA, 64 nt, hsa; identical to SEQ ID NO: 516841

SEQ ID NO: 609068 - RNA, 64 nt, hsa; identical to SEQ ID NO: 516842

SEQ ID NO: 609069 - RNA, 64 nt, hsa; identical to SEQ ID NO: 516843

SEQ ID NO: 609070 - RNA, 64 nt, hsa; identical to SEQ ID NO: 516844

SEQ ID NO: 609071 - RNA, 64 nt, hsa; identical to SEQ ID NO: 516845

SEQ ID NO: 609072 - RNA, 64 nt, hsa; identical to SEQ ID NO: 516846

SEQ ID NO: 609073 - RNA, 64 nt, hsa; identical to SEQ ID NO: 516847

SEQ ID NO: 609074 - RNA, 64 nt, hsa; identical to SEQ ID NO: 516848

SEQ ID NO: 609075 - RNA, 64 nt, hsa; identical to SEQ ID NO: 516849

SEQ ID NO: 609076 - RNA, 64 nt, hsa; identical to SEQ ID NO: 516850

SEQ ID NO: 609077 - RNA, 64 nt, hsa; identical to SEQ ID NO: 516851

SEQ ID NO: 609078 - RNA, 64 nt, hsa; identical to SEQ ID NO: 516852

SEQ ID NO: 609079 - RNA, 64 nt, hsa; identical to SEQ ID NO: 516853

SEQ ID NO: 609080 - RNA, 64 nt, hsa; identical to SEQ ID NO: 516854

SEQ ID NO: 609081 - RNA, 64 nt, hsa; identical to SEQ ID NO: 516855

SEQ ID NO: 609082 - RNA, 64 nt, hsa; identical to SEQ ID NO: 516856

SEQ ID NO: 609083 - RNA, 64 nt, hsa; identical to SEQ ID NO: 516857

SEQ ID NO: 609084 - RNA, 64 nt, hsa; identical to SEQ ID NO: 516858

SEQ ID NO: 609085 - RNA, 64 nt, hsa; identical to SEQ ID NO: 516859

SEQ ID NO: 609086 - RNA, 64 nt, hsa; identical to SEQ ID NO: 516860

SEQ ID NO: 609087 - RNA, 64 nt, hsa; identical to SEQ ID NO: 516861

SEQ ID NO: 609088 - RNA, 64 nt, hsa; identical to SEQ ID NO: 516862

SEQ ID NO: 609089 - RNA, 64 nt, hsa; identical to SEQ ID NO: 516863

SEQ ID NO: 609090 - RNA, 64 nt, hsa; identical to SEQ ID NO: 516864

SEQ ID NO: 609091 - RNA, 64 nt, hsa; identical to SEQ ID NO: 516865

SEQ ID NO: 609092 - RNA, 64 nt, hsa; identical to SEQ ID NO: 516866

SEQ ID NO: 609093 - RNA, 64 nt, hsa
gaagguucuuuggaaggaggacgaauagaauggaguaaugaaauucuugccaugugcugaggag

SEQ ID NO: 609094 - RNA, 64 nt, hsa
caucauuuuccuguuucuugaaauaguuuaucuuguaaugaaauauaaggcaccucccacuuuu

SEQ ID NO: 609095 - RNA, 64 nt, hsa
aguaaaugaacaaaaacaucaacauggaguccaaguaaugaauuuauagaggaaaauguaugcu

SEQ ID NO: 609096 - RNA, 64 nt, hsa
aaggauuuaaaguagcuucuaauaaaggacauguguaaugaaacuuaaaauaugauauuuucuu

SEQ ID NO: 609097 - RNA, 64 nt, hsa
ucugaucaauaaaaucaaacucuuaauauaccgaguaaugaaaccauagugugauugccucaga

SEQ ID NO: 609098 - RNA, 64 nt, hsa
auuguucacaucccaucugaugauuagcauguguguaaugaaugcugucuuggucuccccugug

SEQ ID NO: 609099 - RNA, 64 nt, hsa
caaagaauucacacaggagagaaagcacaugaauguaaugaauguggaaaagcuuucagucaaa

SEQ ID NO: 609100 - RNA, 64 nt, hsa
aucagagcauucauaccaaagagaacucaugaauguaaugaagaugggaagauauuuaucaaau

SEQ ID NO: 609101 - RNA, 64 nt, hsa
cagacauagugcuggucucacagcuuaauauuugguaaugaauaaauucugcuagugguauaug

SEQ ID NO: 609102 - RNA, 64 nt, hsa
aaauguggaaugucucuugacuaauugacaaaguguaaugaaaugacaagcugguugaagcugg

SEQ ID NO: 609103 - RNA, 64 nt, hsa
cugcgccacccaccaucaaaggaauauaagaaaaguaaugaagaaucacgauuucauccuugaa

SEQ ID NO: 609104 - RNA, 64 nt, hsa
uuaguuuuacacuaggaaacguguuguaucuacaguaaugaaauguuuacuaaguggacuggug

SEQ ID NO: 609105 - RNA, 64 nt, hsa
ccugagaagacacacuuggagaaaccuuuuggguguaaugaaugugggaaaaccuuucaucaga

SEQ ID NO: 609106 - RNA, 64 nt, hsa
cacagaacucauauaagacagaaacccuauggguguaaugaauguggaaaaucauucuguguga

SEQ ID NO: 609107 - RNA, 64 nt, hsa
uuuggaaguaaauucuaguuuguaguucucauuuguaaugaacacauuaacgacuagauuaaaa

SEQ ID NO: 609108 - RNA, 64 nt, hsa
gggaaauggccacugcagauggaguuuuagaguaguaaugaaauucuaccuagaaugcaaaauu

SEQ ID NO: 609109 - RNA, 64 nt, hsa
uuuucaaaaugcaguaaucaaaaugugaucuaguguaaugaaauaaaaugugaucuaguguaau

SEQ ID NO: 609110 - RNA, 64 nt, hsa
uuuuuuacccaaaauaauuuuuagagaaaaugauguaaugaaaaauuguaccaugaauuaggag

SEQ ID NO: 609111 - RNA, 64 nt, hsa
uaucaucagaaucucaguugauaggguuucucuuguaaugaagucucuacaaauuggguuagcu

SEQ ID NO: 609112 - RNA, 64 nt, hsa
ccaggccuguauauuuaaccccuauguaccaggaguaaugaauaguaauaauucuauuuaugua

SEQ ID NO: 609113 - RNA, 64 nt, hsa
gucaauauaaguuagaagcuuauucuugguuuguguaaugaauuuauguauuguagugaauacc

SEQ ID NO: 609114 - RNA, 64 nt, hsa
uguguauuguauagcucuagcuguuugacuaucuguaaugaaaaugcugcacuucaacugguau

SEQ ID NO: 609115 - RNA, 64 nt, hsa
aguguuccauuauguccuggauaaucuggucaauguaaugaauggauacugccuuccagauccu

SEQ ID NO: 609116 - RNA, 64 nt, hsa
uguguuugccggccagugcuaugcugagauugagguaaugaagaugguaaugaccuuaacagcu

SEQ ID NO: 609117 - RNA, 64 nt, hsa
gaaaaaauucauacuggagagaaaccauucaaauguaaugaaugugguaaagccuucucucgaa

SEQ ID NO: 609118 - RNA, 64 nt, hsa
augagaagucauacuggugagaaacccuuugaauguaaugaaugugggaaagcauucucucaaa

SEQ ID NO: 609119 - RNA, 64 nt, hsa
caaagaauuccuacuggugagaaacccuaugaauguaaugaaugugagaaggccucuucuuguc

SEQ ID NO: 609120 - RNA, 64 nt, hsa
cagagaauucacaguggggagaaacccuaugaauguaaugaaugugggaaugccuucauuuguu

SEQ ID NO: 609121 - RNA, 64 nt, hsa
aaggcaauucguauuggagagaaacccuacaaguguaaugaauguggcauaguuuuuaaucaac

SEQ ID NO: 609122 - RNA, 64 nt, hsa
aaagccauucauacuggagagaaacuuuacaaguguaaugaauguggcaagguuuuuaaucaaa

SEQ ID NO: 609123 - RNA, 64 nt, hsa
aggaagccuucuaaauuaaacucugggaaauauaguaaugaaaauauccuuuagcuaacuuucc

SEQ ID NO: 609124 - RNA, 64 nt, hsa
accucacugggcuauaaauguuccuucuaacucuguaaugaaaguucagugacaaacuagauag

SEQ ID NO: 609125 - RNA, 64 nt, hsa; identical to SEQ ID NO: 73453

SEQ ID NO: 609126 - RNA, 64 nt, hsa; identical to SEQ ID NO: 73454

SEQ ID NO: 609127 - RNA, 64 nt, hsa; identical to SEQ ID NO: 73455

SEQ ID NO: 609128 - RNA, 64 nt, hsa; identical to SEQ ID NO: 73456

SEQ ID NO: 609129 - RNA, 64 nt, hsa; identical to SEQ ID NO: 73457

SEQ ID NO: 609130 - RNA, 64 nt, hsa; identical to SEQ ID NO: 73458

SEQ ID NO: 609131 - RNA, 64 nt, hsa; identical to SEQ ID NO: 73459

SEQ ID NO: 609132 - RNA, 64 nt, hsa; identical to SEQ ID NO: 73460

SEQ ID NO: 609133 - RNA, 64 nt, hsa; identical to SEQ ID NO: 73461

SEQ ID NO: 609134 - RNA, 64 nt, hsa; identical to SEQ ID NO: 73462

SEQ ID NO: 609135 - RNA, 64 nt, hsa; identical to SEQ ID NO: 73463

SEQ ID NO: 609136 - RNA, 64 nt, hsa; identical to SEQ ID NO: 73464

SEQ ID NO: 609137 - RNA, 64 nt, hsa; identical to SEQ ID NO: 73465

SEQ ID NO: 609138 - RNA, 64 nt, hsa; identical to SEQ ID NO: 73466

SEQ ID NO: 609139 - RNA, 64 nt, hsa; identical to SEQ ID NO: 73467

SEQ ID NO: 609140 - RNA, 64 nt, hsa; identical to SEQ ID NO: 73468

SEQ ID NO: 609141 - RNA, 64 nt, hsa; identical to SEQ ID NO: 73469

SEQ ID NO: 609142 - RNA, 64 nt, hsa; identical to SEQ ID NO: 73470

SEQ ID NO: 609143 - RNA, 64 nt, hsa; identical to SEQ ID NO: 73471

SEQ ID NO: 609144 - RNA, 64 nt, hsa; identical to SEQ ID NO: 73472

SEQ ID NO: 609145 - RNA, 64 nt, hsa; identical to SEQ ID NO: 73473

SEQ ID NO: 609146 - RNA, 64 nt, hsa; identical to SEQ ID NO: 73474

SEQ ID NO: 609147 - RNA, 64 nt, hsa; identical to SEQ ID NO: 73475

SEQ ID NO: 609148 - RNA, 64 nt, hsa; identical to SEQ ID NO: 73476

SEQ ID NO: 609149 - RNA, 64 nt, hsa; identical to SEQ ID NO: 73477

SEQ ID NO: 609150 - RNA, 64 nt, hsa; identical to SEQ ID NO: 73478

SEQ ID NO: 609151 - RNA, 64 nt, hsa; identical to SEQ ID NO: 73479

SEQ ID NO: 609152 - RNA, 64 nt, hsa; identical to SEQ ID NO: 73480

SEQ ID NO: 609153 - RNA, 64 nt, hsa; identical to SEQ ID NO: 73481

SEQ ID NO: 609154 - RNA, 64 nt, hsa; identical to SEQ ID NO: 73482

SEQ ID NO: 609155 - RNA, 64 nt, hsa; identical to SEQ ID NO: 73483

SEQ ID NO: 609156 - RNA, 64 nt, hsa; identical to SEQ ID NO: 73484

SEQ ID NO: 609157 - RNA, 64 nt, hsa; identical to SEQ ID NO: 73485

SEQ ID NO: 609158 - RNA, 64 nt, hsa; identical to SEQ ID NO: 73486

SEQ ID NO: 609159 - RNA, 64 nt, hsa; identical to SEQ ID NO: 73487

SEQ ID NO: 609160 - RNA, 64 nt, hsa; identical to SEQ ID NO: 73488

SEQ ID NO: 609161 - RNA, 64 nt, hsa; identical to SEQ ID NO: 73489

SEQ ID NO: 609162 - RNA, 64 nt, hsa; identical to SEQ ID NO: 73490

SEQ ID NO: 609163 - RNA, 64 nt, hsa; identical to SEQ ID NO: 73491

SEQ ID NO: 609164 - RNA, 64 nt, hsa; identical to SEQ ID NO: 73492

SEQ ID NO: 609165 - RNA, 64 nt, hsa; identical to SEQ ID NO: 73493

SEQ ID NO: 609166 - RNA, 64 nt, hsa; identical to SEQ ID NO: 73494

SEQ ID NO: 609167 - RNA, 64 nt, hsa; identical to SEQ ID NO: 73495

SEQ ID NO: 609168 - RNA, 64 nt, hsa; identical to SEQ ID NO: 73496

SEQ ID NO: 609169 - RNA, 64 nt, hsa; identical to SEQ ID NO: 73497

SEQ ID NO: 609170 - RNA, 64 nt, hsa; identical to SEQ ID NO: 73498

SEQ ID NO: 609171 - RNA, 64 nt, hsa; identical to SEQ ID NO: 73499

SEQ ID NO: 609172 - RNA, 64 nt, hsa; identical to SEQ ID NO: 73500

SEQ ID NO: 609173 - RNA, 64 nt, hsa; identical to SEQ ID NO: 73501

SEQ ID NO: 609174 - RNA, 64 nt, hsa; identical to SEQ ID NO: 73502

SEQ ID NO: 609175 - RNA, 64 nt, hsa; identical to SEQ ID NO: 73503

SEQ ID NO: 609176 - RNA, 64 nt, hsa; identical to SEQ ID NO: 73504

SEQ ID NO: 609177 - RNA, 64 nt, hsa; identical to SEQ ID NO: 73505

SEQ ID NO: 609178 - RNA, 64 nt, hsa; identical to SEQ ID NO: 73506

SEQ ID NO: 609179 - RNA, 64 nt, hsa; identical to SEQ ID NO: 73507

SEQ ID NO: 609180 - RNA, 64 nt, hsa; identical to SEQ ID NO: 73508

SEQ ID NO: 609181 - RNA, 64 nt, hsa; identical to SEQ ID NO: 73509

SEQ ID NO: 609182 - RNA, 64 nt, hsa; identical to SEQ ID NO: 73510

SEQ ID NO: 609183 - RNA, 64 nt, hsa; identical to SEQ ID NO: 73511

SEQ ID NO: 609184 - RNA, 64 nt, hsa; identical to SEQ ID NO: 73512

SEQ ID NO: 609185 - RNA, 64 nt, hsa; identical to SEQ ID NO: 73513

SEQ ID NO: 609186 - RNA, 64 nt, hsa
uuaguaucauuguuucauuuaguauuugguacaaucuaauaaauacuaauccaguccaauacua

SEQ ID NO: 609187 - RNA, 64 nt, hsa
aauacuaauaauacuaacaguaguauugauacaaucuaauaaauaauguguuugacaguguagc

SEQ ID NO: 609188 - RNA, 64 nt, hsa
ucuuagauuuuaagaacucuugaauugugugguaucuaauaaaagggaagguaagauggauaau

SEQ ID NO: 609189 - RNA, 64 nt, hsa
acuggguaucugcaaggcuuauugauuauucuaaucuaauaagacaaguuuguggaaaugcaag

SEQ ID NO: 609190 - RNA, 64 nt, hsa
agcaaaagaacuuagaguucuaauaaaugggaugucuaauaaauuaugaaguuacugauuugaa

SEQ ID NO: 609191 - RNA, 64 nt, hsa
guuucauuuauauaaaagcaaaagaacuuagaguucuaauaaaugggaugucuaauaaauuaug

SEQ ID NO: 609192 - RNA, 64 nt, hsa
ccacguaugauauguguguuucaguauguguguuucuaauaagugaggaaguggcuguccugaa

SEQ ID NO: 609193 - RNA, 64 nt, hsa
caaaacuagaauuuguaaugcaaauggagcucagucuaauaaaaaagagguuuugguauuaaaa

SEQ ID NO: 609194 - RNA, 64 nt, hsa
ugcaugucuuucuaauaauccacacauuucaugcucuaauaauccacacauuucaugcucauuu

SEQ ID NO: 609195 - RNA, 64 nt, hsa
gucacuagauguucauuucacaagugcaugucuuucuaauaauccacacauuucaugcucuaau

SEQ ID NO: 609196 - RNA, 64 nt, hsa
cuuccuucacaguuuuaucucacaaaaccauuuuucuaauaagagacaucauguuggaaagaug

SEQ ID NO: 609197 - RNA, 64 nt, hsa
cuaagaacuaagcuuugaguauuauuuaauaauuucuaauaacacucauuccucaagugauauu

SEQ ID NO: 609198 - RNA, 64 nt, hsa
uuuuuuuuugguauuugauaauuaagauuaggaaucuaauaacacagaauuccauauugcuaua

SEQ ID NO: 609199 - RNA, 64 nt, hsa
cauuaaugguaccagccugucacaacugagcaguucuaauaaugcagaauaaauacauguugcc

SEQ ID NO: 609200 - RNA, 64 nt, hsa
uacacaauacagaaaugaaugagugugguuauguucuaauaaaacuuauuuauaaaaacaaggg

SEQ ID NO: 609201 - RNA, 64 nt, hsa
gcaugauccgugcuuaaugaucaaguguuacuuaucuaauaauccucuagaaagaacccuguua

SEQ ID NO: 609202 - RNA, 64 nt, hsa
gaugaaaagaaauuuauuuuauacguguuaugucucuaauaaaguauucauuugauaaucuuug

SEQ ID NO: 609203 - RNA, 64 nt, hsa
uuucagauaaaacugggugaacgaauccucugugucuaauaaagacaggucuugugcuugugcu

SEQ ID NO: 609204 - RNA, 64 nt, hsa
uggccuggagcgaggacagcugccaugagucagcucuaauaaguuaaacggcauuguaguaagg

SEQ ID NO: 609205 - RNA, 64 nt, hsa
guauuuguggaggaaaguccucucuuuugcauauucuaauaaaugagccgcguuugcuccuccg

SEQ ID NO: 609206 - RNA, 64 nt, hsa
cuauuuuuuauuuuaauagguuuggugcuuaucuucuaauaagauuuaaaugucacaaacugua

SEQ ID NO: 609207 - RNA, 64 nt, hsa
cuuaaauacuaauguauuaaguauuuaaguacuuucuaauaaaaucuuuaacaauaauaaugua

SEQ ID NO: 609208 - RNA, 64 nt, hsa
gagaccaucgugacuaacacagugaaaccccgucucuaauaaaaauacgaaaaauuagccaggc

SEQ ID NO: 609209 - RNA, 64 nt, hsa
aauuuuaguguugauaccguauguguauuuuuauucuaauaaacuuuuguguuccagauugaau

SEQ ID NO: 609210 - RNA, 64 nt, hsa
agauccuaaguagaaccagguaauugucucuuuuucuaauaaggaauuuggguaauuuuuaauu

SEQ ID NO: 609211 - RNA, 64 nt, hsa
auuuaauguuugaaucuaaaucauugggcaaacuucuaauaauaacaauuaauaauagguuaca

SEQ ID NO: 609212 - RNA, 64 nt, hsa
uccuuuguuuuggcucgggauuacuuccuggcugucuaauaauugaaccauaaccauguaauau

SEQ ID NO: 609213 - RNA, 64 nt, hsa
auacaauuucguuuucacuugcuucucaaccuagucuaauaaacuaaggugaugagauauacau

SEQ ID NO: 609214 - RNA, 64 nt, hsa
guuucuugauccuuaaaaugaccuucgagcauauucuaauaaagugcauugccaguuuucuguc

SEQ ID NO: 609215 - RNA, 64 nt, hsa
aagaauggcuacuuuuuucuaugcuggaguauuuucuaauaauccugcuugacccuuaucugac

SEQ ID NO: 609216 - RNA, 64 nt, hsa
gguuaucugagauaggagauacaaacuuuguaauucuaauaaugcacucaguuuacucucuccc

SEQ ID NO: 609217 - RNA, 64 nt, hsa
ugguguuuguuuuuaucaaaaugucaaaauaacauacuuggagaaguauguaauuuugucuuug

SEQ ID NO: 609218 - RNA, 64 nt, hsa
auuuuucuagagguuggcuuucaauucuguagcauacuuggagaaacugcauuaucuuaaaagg

SEQ ID NO: 609219 - RNA, 64 nt, hsa
uugauaaccuggcuacagcguuuucuaugaaaucuacuuggaucccaugccugaaauuuggaag

SEQ ID NO: 609220 - RNA, 64 nt, hsa
uuacagucauugauggacucuauuuuuuuauuauuacuuggaccuuggucguuuuuauacuagc

SEQ ID NO: 609221 - RNA, 64 nt, hsa
aaaggauucucacuccaaacauggccucucucuuuacuuggacuuugaacaaaagucaacuguu

SEQ ID NO: 609222 - RNA, 64 nt, hsa
guguuuagaguuaagagugaacacuguuugauuuuacuuggaauuuccucuguuauauagcuuu

SEQ ID NO: 609223 - RNA, 64 nt, hsa
gggcuguaucuacucuguggaguagaaccaagucuacuuggagaaaagaaccaaguccuuggau

SEQ ID NO: 609224 - RNA, 64 nt, hsa
ggcacuggaacaggguugaaaacccaggguuuuguacuuggagaggaaagaugccaagcugcuu

SEQ ID NO: 609225 - RNA, 64 nt, hsa
augacacuuguacaauuaauuaucuuuucaaagguacuuggauaauaaugaaauaaaacuguuu

SEQ ID NO: 609226 - RNA, 64 nt, hsa
ccaaggaggcagccuggaccacuccucauagcaauacuuggagggcccagcccaagugaggcag

SEQ ID NO: 609227 - RNA, 64 nt, hsa
agagacauaucaacuaaauucaguauguuggcauuacuuggaccugguuugaacaaaacauaaa

SEQ ID NO: 609228 - RNA, 64 nt, hsa
uggaauaggauuguugcaaggaguaaguaguuaauacuuggaggaaucacagucauauagcaug

SEQ ID NO: 609229 - RNA, 64 nt, hsa
gccucaagcucaagauacuuauugaaaacauccucaauugcaauaaaaacauuauaacaugaaa

SEQ ID NO: 609230 - RNA, 64 nt, hsa
agaguuauaacaaaggagagccucaaauauuagacaauugcagugcggcuuucugggcacaggu

SEQ ID NO: 609231 - RNA, 64 nt, hsa
cacccaagguggcaguucucaguauuuggcagaacaauugcaauugcacuggguauauuauaua

SEQ ID NO: 609232 - RNA, 64 nt, hsa
agguggcaguucucaguauuuggcagaacaauugcaauugcacuggguauauuauauauauaua

SEQ ID NO: 609233 - RNA, 64 nt, hsa
uugcuuugaccugccauguggcacuccacaaugucaauugcaguuuacacacauugccuaaagu

SEQ ID NO: 609234 - RNA, 64 nt, hsa
guuuauucucaggaguugcuuguacauucuugggcaauugcagauaauuccaagaaugcauauu

SEQ ID NO: 609235 - RNA, 64 nt, hsa
gacagggacgcauucugauaaaugugucauuaggcaauugcauuguagugugauuaucacagau

SEQ ID NO: 609236 - RNA, 64 nt, hsa
accuguacagcaugugacuacugaauacuauaggcaauugcagcacaaugggaaauauuugugu

SEQ ID NO: 609237 - RNA, 64 nt, hsa; identical to SEQ ID NO: 328547

SEQ ID NO: 609238 - RNA, 64 nt, hsa; identical to SEQ ID NO: 328548

SEQ ID NO: 609239 - RNA, 64 nt, hsa; identical to SEQ ID NO: 328549

SEQ ID NO: 609240 - RNA, 64 nt, hsa; identical to SEQ ID NO: 328550

SEQ ID NO: 609241 - RNA, 64 nt, hsa; identical to SEQ ID NO: 328551

SEQ ID NO: 609242 - RNA, 64 nt, hsa; identical to SEQ ID NO: 328552

SEQ ID NO: 609243 - RNA, 64 nt, hsa; identical to SEQ ID NO: 328553

SEQ ID NO: 609244 - RNA, 64 nt, hsa; identical to SEQ ID NO: 328554

SEQ ID NO: 609245 - RNA, 64 nt, hsa; identical to SEQ ID NO: 328555

SEQ ID NO: 609246 - RNA, 64 nt, hsa; identical to SEQ ID NO: 328556

SEQ ID NO: 609247 - RNA, 64 nt, hsa; identical to SEQ ID NO: 328557

SEQ ID NO: 609248 - RNA, 64 nt, hsa; identical to SEQ ID NO: 328558

SEQ ID NO: 609249 - RNA, 64 nt, hsa; identical to SEQ ID NO: 328559

SEQ ID NO: 609250 - RNA, 64 nt, hsa; identical to SEQ ID NO: 328560

SEQ ID NO: 609251 - RNA, 64 nt, hsa; identical to SEQ ID NO: 328561

SEQ ID NO: 609252 - RNA, 64 nt, hsa; identical to SEQ ID NO: 328562

SEQ ID NO: 609253 - RNA, 64 nt, hsa; identical to SEQ ID NO: 328563

SEQ ID NO: 609254 - RNA, 64 nt, hsa; identical to SEQ ID NO: 328564

SEQ ID NO: 609255 - RNA, 64 nt, hsa; identical to SEQ ID NO: 328565

SEQ ID NO: 609256 - RNA, 64 nt, hsa; identical to SEQ ID NO: 328566

SEQ ID NO: 609257 - RNA, 64 nt, hsa; identical to SEQ ID NO: 328567

SEQ ID NO: 609258 - RNA, 64 nt, hsa; identical to SEQ ID NO: 328568

SEQ ID NO: 609259 - RNA, 64 nt, hsa; identical to SEQ ID NO: 328569

SEQ ID NO: 609260 - RNA, 64 nt, hsa; identical to SEQ ID NO: 328570

SEQ ID NO: 609261 - RNA, 64 nt, hsa; identical to SEQ ID NO: 328571

SEQ ID NO: 609262 - RNA, 64 nt, hsa; identical to SEQ ID NO: 328572

SEQ ID NO: 609263 - RNA, 64 nt, hsa; identical to SEQ ID NO: 328573

SEQ ID NO: 609264 - RNA, 64 nt, hsa; identical to SEQ ID NO: 328574

SEQ ID NO: 609265 - RNA, 64 nt, hsa; identical to SEQ ID NO: 328575

SEQ ID NO: 609266 - RNA, 64 nt, hsa; identical to SEQ ID NO: 328576

SEQ ID NO: 609267 - RNA, 64 nt, hsa; identical to SEQ ID NO: 328577

SEQ ID NO: 609268 - RNA, 64 nt, hsa; identical to SEQ ID NO: 328578

SEQ ID NO: 609269 - RNA, 64 nt, hsa; identical to SEQ ID NO: 328579

SEQ ID NO: 609270 - RNA, 64 nt, hsa; identical to SEQ ID NO: 328580

SEQ ID NO: 609271 - RNA, 64 nt, hsa; identical to SEQ ID NO: 328581

SEQ ID NO: 609272 - RNA, 64 nt, hsa; identical to SEQ ID NO: 328582

SEQ ID NO: 609273 - RNA, 64 nt, hsa; identical to SEQ ID NO: 328583

SEQ ID NO: 609274 - RNA, 64 nt, hsa; identical to SEQ ID NO: 328584

SEQ ID NO: 609275 - RNA, 64 nt, hsa; identical to SEQ ID NO: 328585

SEQ ID NO: 609276 - RNA, 64 nt, hsa; identical to SEQ ID NO: 328586

SEQ ID NO: 609277 - RNA, 64 nt, hsa; identical to SEQ ID NO: 328587

SEQ ID NO: 609278 - RNA, 64 nt, hsa; identical to SEQ ID NO: 328588

SEQ ID NO: 609279 - RNA, 64 nt, hsa; identical to SEQ ID NO: 328589

SEQ ID NO: 609280 - RNA, 64 nt, hsa; identical to SEQ ID NO: 328590

SEQ ID NO: 609281 - RNA, 64 nt, hsa; identical to SEQ ID NO: 328591

SEQ ID NO: 609282 - RNA, 64 nt, hsa; identical to SEQ ID NO: 328592

SEQ ID NO: 609283 - RNA, 64 nt, hsa; identical to SEQ ID NO: 328593

SEQ ID NO: 609284 - RNA, 64 nt, hsa; identical to SEQ ID NO: 328594

SEQ ID NO: 609285 - RNA, 64 nt, hsa; identical to SEQ ID NO: 328595

SEQ ID NO: 609286 - RNA, 64 nt, hsa; identical to SEQ ID NO: 328596

SEQ ID NO: 609287 - RNA, 64 nt, hsa; identical to SEQ ID NO: 328597

SEQ ID NO: 609288 - RNA, 64 nt, hsa; identical to SEQ ID NO: 328598

SEQ ID NO: 609289 - RNA, 64 nt, hsa; identical to SEQ ID NO: 328599

SEQ ID NO: 609290 - RNA, 55 nt, hsa; identical to SEQ ID NO: 328600

SEQ ID NO: 609291 - RNA, 64 nt, hsa; identical to SEQ ID NO: 328601

SEQ ID NO: 609292 - RNA, 64 nt, hsa; identical to SEQ ID NO: 328602

SEQ ID NO: 609293 - RNA, 64 nt, hsa; identical to SEQ ID NO: 328603

SEQ ID NO: 609294 - RNA, 64 nt, hsa; identical to SEQ ID NO: 328604

SEQ ID NO: 609295 - RNA, 64 nt, hsa; identical to SEQ ID NO: 328605

SEQ ID NO: 609296 - RNA, 64 nt, hsa; identical to SEQ ID NO: 328606

SEQ ID NO: 609297 - RNA, 64 nt, hsa; identical to SEQ ID NO: 328607

SEQ ID NO: 609298 - RNA, 64 nt, hsa; identical to SEQ ID NO: 328608

SEQ ID NO: 609299 - RNA, 64 nt, hsa; identical to SEQ ID NO: 328609

SEQ ID NO: 609300 - RNA, 64 nt, hsa; identical to SEQ ID NO: 328610

SEQ ID NO: 609301 - RNA, 64 nt, hsa; identical to SEQ ID NO: 328611

SEQ ID NO: 609302 - RNA, 64 nt, hsa; identical to SEQ ID NO: 328612

SEQ ID NO: 609303 - RNA, 64 nt, hsa; identical to SEQ ID NO: 328613

SEQ ID NO: 609304 - RNA, 64 nt, hsa; identical to SEQ ID NO: 328614

SEQ ID NO: 609305 - RNA, 64 nt, hsa; identical to SEQ ID NO: 328615

SEQ ID NO: 609306 - RNA, 64 nt, hsa; identical to SEQ ID NO: 328616

SEQ ID NO: 609307 - RNA, 64 nt, hsa; identical to SEQ ID NO: 328617

SEQ ID NO: 609308 - RNA, 64 nt, hsa; identical to SEQ ID NO: 328618

SEQ ID NO: 609309 - RNA, 64 nt, hsa; identical to SEQ ID NO: 328619

SEQ ID NO: 609310 - RNA, 64 nt, hsa; identical to SEQ ID NO: 328620

SEQ ID NO: 609311 - RNA, 64 nt, hsa; identical to SEQ ID NO: 328621

SEQ ID NO: 609312 - RNA, 64 nt, hsa; identical to SEQ ID NO: 328622

SEQ ID NO: 609313 - RNA, 64 nt, hsa; identical to SEQ ID NO: 328623

SEQ ID NO: 609314 - RNA, 64 nt, hsa; identical to SEQ ID NO: 328624

SEQ ID NO: 609315 - RNA, 64 nt, hsa; identical to SEQ ID NO: 328625

SEQ ID NO: 609316 - RNA, 64 nt, hsa; identical to SEQ ID NO: 328626

SEQ ID NO: 609317 - RNA, 64 nt, hsa; identical to SEQ ID NO: 328627

SEQ ID NO: 609318 - RNA, 64 nt, hsa; identical to SEQ ID NO: 328628

SEQ ID NO: 609319 - RNA, 57 nt, hsa; identical to SEQ ID NO: 328629

SEQ ID NO: 609320 - RNA, 64 nt, hsa; identical to SEQ ID NO: 328630

SEQ ID NO: 609321 - RNA, 64 nt, hsa; identical to SEQ ID NO: 328631

SEQ ID NO: 609322 - RNA, 64 nt, hsa; identical to SEQ ID NO: 328632

SEQ ID NO: 609323 - RNA, 64 nt, hsa; identical to SEQ ID NO: 328633

SEQ ID NO: 609324 - RNA, 64 nt, hsa; identical to SEQ ID NO: 328633

SEQ ID NO: 609325 - RNA, 64 nt, hsa; identical to SEQ ID NO: 328632

SEQ ID NO: 609326 - RNA, 64 nt, hsa; identical to SEQ ID NO: 328636

SEQ ID NO: 609327 - RNA, 64 nt, hsa; identical to SEQ ID NO: 328637

SEQ ID NO: 609328 - RNA, 64 nt, hsa; identical to SEQ ID NO: 328638

SEQ ID NO: 609329 - RNA, 64 nt, hsa; identical to SEQ ID NO: 328639

SEQ ID NO: 609330 - RNA, 64 nt, hsa; identical to SEQ ID NO: 328640

SEQ ID NO: 609331 - RNA, 64 nt, hsa; identical to SEQ ID NO: 328641

SEQ ID NO: 609332 - RNA, 64 nt, hsa; identical to SEQ ID NO: 328642

SEQ ID NO: 609333 - RNA, 64 nt, hsa; identical to SEQ ID NO: 328643

SEQ ID NO: 609334 - RNA, 64 nt, hsa; identical to SEQ ID NO: 328644

SEQ ID NO: 609335 - RNA, 64 nt, hsa; identical to SEQ ID NO: 328645

SEQ ID NO: 609336 - RNA, 64 nt, hsa; identical to SEQ ID NO: 328646

SEQ ID NO: 609337 - RNA, 64 nt, hsa; identical to SEQ ID NO: 328647

SEQ ID NO: 609338 - RNA, 64 nt, hsa; identical to SEQ ID NO: 328648

SEQ ID NO: 609339 - RNA, 64 nt, hsa; identical to SEQ ID NO: 328649

SEQ ID NO: 609340 - RNA, 64 nt, hsa; identical to SEQ ID NO: 328650

SEQ ID NO: 609341 - RNA, 64 nt, hsa; identical to SEQ ID NO: 328651

SEQ ID NO: 609342 - RNA, 64 nt, hsa; identical to SEQ ID NO: 328652

SEQ ID NO: 609343 - RNA, 64 nt, hsa; identical to SEQ ID NO: 328653

SEQ ID NO: 609344 - RNA, 64 nt, hsa; identical to SEQ ID NO: 328654

SEQ ID NO: 609345 - RNA, 64 nt, hsa; identical to SEQ ID NO: 328655

SEQ ID NO: 609346 - RNA, 64 nt, hsa; identical to SEQ ID NO: 328656

SEQ ID NO: 609347 - RNA, 64 nt, hsa; identical to SEQ ID NO: 328657

SEQ ID NO: 609348 - RNA, 64 nt, hsa; identical to SEQ ID NO: 328658

SEQ ID NO: 609349 - RNA, 64 nt, hsa; identical to SEQ ID NO: 328659

SEQ ID NO: 609350 - RNA, 64 nt, hsa; identical to SEQ ID NO: 328660

SEQ ID NO: 609351 - RNA, 64 nt, hsa; identical to SEQ ID NO: 328661

SEQ ID NO: 609352 - RNA, 64 nt, hsa; identical to SEQ ID NO: 328662

SEQ ID NO: 609353 - RNA, 64 nt, hsa; identical to SEQ ID NO: 328663

SEQ ID NO: 609354 - RNA, 64 nt, hsa; identical to SEQ ID NO: 328664

SEQ ID NO: 609355 - RNA, 64 nt, hsa; identical to SEQ ID NO: 328665

SEQ ID NO: 609356 - RNA, 64 nt, hsa; identical to SEQ ID NO: 328664

SEQ ID NO: 609357 - RNA, 64 nt, hsa; identical to SEQ ID NO: 328665

SEQ ID NO: 609358 - RNA, 64 nt, hsa; identical to SEQ ID NO: 214386

SEQ ID NO: 609359 - RNA, 64 nt, hsa; identical to SEQ ID NO: 214387

SEQ ID NO: 609360 - RNA, 64 nt, hsa; identical to SEQ ID NO: 214444

SEQ ID NO: 609361 - RNA, 64 nt, hsa; identical to SEQ ID NO: 214445

SEQ ID NO: 609362 - RNA, 64 nt, hsa; identical to SEQ ID NO: 214448

SEQ ID NO: 609363 - RNA, 64 nt, hsa; identical to SEQ ID NO: 214449

SEQ ID NO: 609364 - RNA, 64 nt, hsa; identical to SEQ ID NO: 214534

SEQ ID NO: 609365 - RNA, 64 nt, hsa; identical to SEQ ID NO: 214535

SEQ ID NO: 609366 - RNA, 64 nt, hsa; identical to SEQ ID NO: 281120

SEQ ID NO: 609367 - RNA, 64 nt, hsa; identical to SEQ ID NO: 281120

SEQ ID NO: 609368 - RNA, 64 nt, hsa; identical to SEQ ID NO: 281122

SEQ ID NO: 609369 - RNA, 64 nt, hsa; identical to SEQ ID NO: 281123

SEQ ID NO: 609370 - RNA, 64 nt, hsa; identical to SEQ ID NO: 281124

SEQ ID NO: 609371 - RNA, 64 nt, hsa; identical to SEQ ID NO: 281125

SEQ ID NO: 609372 - RNA, 64 nt, hsa; identical to SEQ ID NO: 281126

SEQ ID NO: 609373 - RNA, 64 nt, hsa; identical to SEQ ID NO: 281127

SEQ ID NO: 609374 - RNA, 64 nt, hsa; identical to SEQ ID NO: 281128

SEQ ID NO: 609375 - RNA, 64 nt, hsa; identical to SEQ ID NO: 281129

SEQ ID NO: 609376 - RNA, 64 nt, hsa; identical to SEQ ID NO: 281130

SEQ ID NO: 609377 - RNA, 64 nt, hsa; identical to SEQ ID NO: 281131

SEQ ID NO: 609378 - RNA, 64 nt, hsa; identical to SEQ ID NO: 81713

SEQ ID NO: 609379 - RNA, 64 nt, hsa; identical to SEQ ID NO: 81714

SEQ ID NO: 609380 - RNA, 64 nt, hsa; identical to SEQ ID NO: 81715

SEQ ID NO: 609381 - RNA, 64 nt, hsa; identical to SEQ ID NO: 81716

SEQ ID NO: 609382 - RNA, 64 nt, hsa; identical to SEQ ID NO: 81717

SEQ ID NO: 609383 - RNA, 64 nt, hsa; identical to SEQ ID NO: 81718

SEQ ID NO: 609384 - RNA, 64 nt, hsa
aaaaaaggcauugggauuuauaaugugcuguuuaaagucugaagcucggccaggugcgguggcu

SEQ ID NO: 609385 - RNA, 64 nt, hsa
acuucauuucgauaaauaaguaaauaaauaaauaaagucugaagcuccacuggucacuccuuuu

SEQ ID NO: 609386 - RNA, 64 nt, hsa
caauuuagguaaaaaucacauuaugaaacugggaaagucugaaggaauaugggcaaaauauuuc

SEQ ID NO: 609387 - RNA, 64 nt, hsa
ucuucugcccugguccccuuucucuugauguggaaagucugaaugcaguauuuauagacuucua

SEQ ID NO: 609388 - RNA, 64 nt, hsa
agaauuuagcagggacagggaaaaauuucccaguaagucugaagucuugauguaagugggaauu

SEQ ID NO: 609389 - RNA, 64 nt, hsa
uuauaaaaucuacuucauaagcaaaaaucaaaagaagucugacuaaauucaguagaaucuuuug

SEQ ID NO: 609390 - RNA, 64 nt, hsa
ugguuuaaaucacauuugauacuauccuucugaaaagucugagacagaucuacaaacuacaguc

SEQ ID NO: 609391 - RNA, 64 nt, hsa
cuaucuacagccuaaguuacacauaaguuucagaaagucugauuagacuaaagagauauuucuu

SEQ ID NO: 609392 - RNA, 64 nt, hsa
gacuuugguaaagucugacccuagucugcugcugaagucugaacuugggccucugaccugggcc

SEQ ID NO: 609393 - RNA, 58 nt, hsa
acaugaaccucgaguucugacuuugguaaagucugacccuagucugcugcugaagucu

SEQ ID NO: 609394 - RNA, 64 nt, hsa
uguugucguuuacuaucuucaucucacccauuucaagucugagguaaaaaaauaauaaugauaa

SEQ ID NO: 609395 - RNA, 64 nt, hsa
aauacaaaaacuaaguagacagauauuuguacugaagucugauacagaauuagaaaaaaaaaau

SEQ ID NO: 609396 - RNA, 64 nt, hsa
ugggagucacuuuuaaucuguaauuuuaaaauacaagucugaauauuuauaguugauucuuaac

SEQ ID NO: 609397 - RNA, 64 nt, hsa
uaaauaauauugaaagauuuuaaaauucauuugaaagucugauggcuuuuacaauaaaagauau

SEQ ID NO: 609398 - RNA, 64 nt, hsa
aaguuggucacagccugcaaaugacuucauuuggaagucugauuguuucaguugccugacaaau

SEQ ID NO: 609399 - RNA, 64 nt, hsa
gagcgaaugucugccaacuacccguucauuauauaagucugaacuugguaauauauggcuaaug

SEQ ID NO: 609400 - RNA, 64 nt, hsa; identical to SEQ ID NO: 105714

SEQ ID NO: 609401 - RNA, 64 nt, hsa; identical to SEQ ID NO: 105715

SEQ ID NO: 609402 - RNA, 64 nt, hsa; identical to SEQ ID NO: 105716

SEQ ID NO: 609403 - RNA, 64 nt, hsa; identical to SEQ ID NO: 105717

SEQ ID NO: 609404 - RNA, 64 nt, hsa; identical to SEQ ID NO: 105718

SEQ ID NO: 609405 - RNA, 64 nt, hsa; identical to SEQ ID NO: 105719

SEQ ID NO: 609406 - RNA, 64 nt, hsa; identical to SEQ ID NO: 105720

SEQ ID NO: 609407 - RNA, 64 nt, hsa; identical to SEQ ID NO: 105721

SEQ ID NO: 609408 - RNA, 64 nt, hsa; identical to SEQ ID NO: 105722

SEQ ID NO: 609409 - RNA, 64 nt, hsa; identical to SEQ ID NO: 105723

SEQ ID NO: 609410 - RNA, 64 nt, hsa; identical to SEQ ID NO: 105724

SEQ ID NO: 609411 - RNA, 64 nt, hsa; identical to SEQ ID NO: 105725

SEQ ID NO: 609412 - RNA, 64 nt, hsa; identical to SEQ ID NO: 105726

SEQ ID NO: 609413 - RNA, 64 nt, hsa; identical to SEQ ID NO: 105727

SEQ ID NO: 609414 - RNA, 64 nt, hsa; identical to SEQ ID NO: 105728

SEQ ID NO: 609415 - RNA, 64 nt, hsa; identical to SEQ ID NO: 105729

SEQ ID NO: 609416 - RNA, 64 nt, hsa; identical to SEQ ID NO: 105730

SEQ ID NO: 609417 - RNA, 64 nt, hsa; identical to SEQ ID NO: 105731

SEQ ID NO: 609418 - RNA, 64 nt, hsa; identical to SEQ ID NO: 105732

SEQ ID NO: 609419 - RNA, 64 nt, hsa; identical to SEQ ID NO: 105733

SEQ ID NO: 609420 - RNA, 64 nt, hsa; identical to SEQ ID NO: 105734

SEQ ID NO: 609421 - RNA, 64 nt, hsa; identical to SEQ ID NO: 105735

SEQ ID NO: 609422 - RNA, 64 nt, hsa; identical to SEQ ID NO: 105736

SEQ ID NO: 609423 - RNA, 64 nt, hsa; identical to SEQ ID NO: 105737

SEQ ID NO: 609424 - RNA, 64 nt, hsa; identical to SEQ ID NO: 105738

SEQ ID NO: 609425 - RNA, 64 nt, hsa; identical to SEQ ID NO: 105739

SEQ ID NO: 609426 - RNA, 64 nt, hsa; identical to SEQ ID NO: 105740

SEQ ID NO: 609427 - RNA, 64 nt, hsa; identical to SEQ ID NO: 105741

SEQ ID NO: 609428 - RNA, 64 nt, hsa; identical to SEQ ID NO: 105742

SEQ ID NO: 609429 - RNA, 64 nt, hsa; identical to SEQ ID NO: 105743

SEQ ID NO: 609430 - RNA, 64 nt, hsa; identical to SEQ ID NO: 105744

SEQ ID NO: 609431 - RNA, 64 nt, hsa; identical to SEQ ID NO: 105745

SEQ ID NO: 609432 - RNA, 64 nt, hsa; identical to SEQ ID NO: 105746

SEQ ID NO: 609433 - RNA, 64 nt, hsa; identical to SEQ ID NO: 105747

SEQ ID NO: 609434 - RNA, 64 nt, hsa; identical to SEQ ID NO: 105748

SEQ ID NO: 609435 - RNA, 64 nt, hsa; identical to SEQ ID NO: 105749

SEQ ID NO: 609436 - RNA, 64 nt, hsa; identical to SEQ ID NO: 105750

SEQ ID NO: 609437 - RNA, 64 nt, hsa; identical to SEQ ID NO: 105751

SEQ ID NO: 609438 - RNA, 64 nt, hsa; identical to SEQ ID NO: 105752

SEQ ID NO: 609439 - RNA, 64 nt, hsa; identical to SEQ ID NO: 105753

SEQ ID NO: 609440 - RNA, 64 nt, hsa; identical to SEQ ID NO: 105754

SEQ ID NO: 609441 - RNA, 64 nt, hsa; identical to SEQ ID NO: 105755

SEQ ID NO: 609442 - RNA, 64 nt, hsa; identical to SEQ ID NO: 105756

SEQ ID NO: 609443 - RNA, 64 nt, hsa; identical to SEQ ID NO: 105757

SEQ ID NO: 609444 - RNA, 64 nt, hsa; identical to SEQ ID NO: 105758

SEQ ID NO: 609445 - RNA, 64 nt, hsa; identical to SEQ ID NO: 105759

SEQ ID NO: 609446 - RNA, 64 nt, hsa; identical to SEQ ID NO: 105760

SEQ ID NO: 609447 - RNA, 64 nt, hsa; identical to SEQ ID NO: 105761

SEQ ID NO: 609448 - RNA, 64 nt, hsa; identical to SEQ ID NO: 105762

SEQ ID NO: 609449 - RNA, 64 nt, hsa; identical to SEQ ID NO: 105763

SEQ ID NO: 609450 - RNA, 64 nt, hsa; identical to SEQ ID NO: 105764

SEQ ID NO: 609451 - RNA, 64 nt, hsa; identical to SEQ ID NO: 105765

SEQ ID NO: 609452 - RNA, 64 nt, hsa; identical to SEQ ID NO: 105766

SEQ ID NO: 609453 - RNA, 64 nt, hsa; identical to SEQ ID NO: 105767

SEQ ID NO: 609454 - RNA, 64 nt, hsa; identical to SEQ ID NO: 105768

SEQ ID NO: 609455 - RNA, 64 nt, hsa; identical to SEQ ID NO: 105769

SEQ ID NO: 609456 - RNA, 64 nt, hsa; identical to SEQ ID NO: 105770

SEQ ID NO: 609457 - RNA, 64 nt, hsa; identical to SEQ ID NO: 105771

SEQ ID NO: 609458 - RNA, 64 nt, hsa; identical to SEQ ID NO: 105772

SEQ ID NO: 609459 - RNA, 64 nt, hsa; identical to SEQ ID NO: 105773

SEQ ID NO: 609460 - RNA, 64 nt, hsa; identical to SEQ ID NO: 105774

SEQ ID NO: 609461 - RNA, 64 nt, hsa; identical to SEQ ID NO: 105775

SEQ ID NO: 609462 - RNA, 64 nt, hsa; identical to SEQ ID NO: 105776

SEQ ID NO: 609463 - RNA, 64 nt, hsa; identical to SEQ ID NO: 105777

SEQ ID NO: 609464 - RNA, 64 nt, hsa; identical to SEQ ID NO: 105778

SEQ ID NO: 609465 - RNA, 64 nt, hsa; identical to SEQ ID NO: 105779

SEQ ID NO: 609466 - RNA, 64 nt, hsa; identical to SEQ ID NO: 105780

SEQ ID NO: 609467 - RNA, 64 nt, hsa; identical to SEQ ID NO: 105781

SEQ ID NO: 609468 - RNA, 64 nt, hsa; identical to SEQ ID NO: 105782

SEQ ID NO: 609469 - RNA, 64 nt, hsa; identical to SEQ ID NO: 105783

SEQ ID NO: 609470 - RNA, 64 nt, hsa; identical to SEQ ID NO: 105784

SEQ ID NO: 609471 - RNA, 64 nt, hsa; identical to SEQ ID NO: 105785

SEQ ID NO: 609472 - RNA, 64 nt, hsa; identical to SEQ ID NO: 105786

SEQ ID NO: 609473 - RNA, 64 nt, hsa; identical to SEQ ID NO: 105787

SEQ ID NO: 609474 - RNA, 64 nt, hsa; identical to SEQ ID NO: 105788

SEQ ID NO: 609475 - RNA, 64 nt, hsa; identical to SEQ ID NO: 105789

SEQ ID NO: 609476 - RNA, 60 nt, hsa
cuuagguuccaagauuuuacuucaaauuacaccuucaaaacuggagcagcauauagccga

SEQ ID NO: 609477 - RNA, 60 nt, hsa
aguuguuuuugaaauuuaacuuuuguuuguaccuucaauguguaaguacaugcauguuuu

SEQ ID NO: 609478 - RNA, 64 nt, hsa; identical to SEQ ID NO: 354586

SEQ ID NO: 609479 - RNA, 64 nt, hsa; identical to SEQ ID NO: 354587

SEQ ID NO: 609480 - RNA, 64 nt, hsa; identical to SEQ ID NO: 354588

SEQ ID NO: 609481 - RNA, 64 nt, hsa; identical to SEQ ID NO: 354589

SEQ ID NO: 609482 - RNA, 64 nt, hsa; identical to SEQ ID NO: 354590

SEQ ID NO: 609483 - RNA, 64 nt, hsa; identical to SEQ ID NO: 354591

SEQ ID NO: 609484 - RNA, 61 nt, hsa; identical to SEQ ID NO: 354592

SEQ ID NO: 609485 - RNA, 64 nt, hsa; identical to SEQ ID NO: 354593

SEQ ID NO: 609486 - RNA, 64 nt, hsa; identical to SEQ ID NO: 354594

SEQ ID NO: 609487 - RNA, 64 nt, hsa; identical to SEQ ID NO: 354595

SEQ ID NO: 609488 - RNA, 64 nt, hsa; identical to SEQ ID NO: 354596

SEQ ID NO: 609489 - RNA, 64 nt, hsa; identical to SEQ ID NO: 354597

SEQ ID NO: 609490 - RNA, 64 nt, hsa; identical to SEQ ID NO: 354598

SEQ ID NO: 609491 - RNA, 64 nt, hsa; identical to SEQ ID NO: 354599

SEQ ID NO: 609492 - RNA, 64 nt, hsa; identical to SEQ ID NO: 354600

SEQ ID NO: 609493 - RNA, 64 nt, hsa; identical to SEQ ID NO: 354601

SEQ ID NO: 609494 - RNA, 64 nt, hsa; identical to SEQ ID NO: 354602

SEQ ID NO: 609495 - RNA, 64 nt, hsa; identical to SEQ ID NO: 354603

SEQ ID NO: 609496 - RNA, 64 nt, hsa; identical to SEQ ID NO: 354604

SEQ ID NO: 609497 - RNA, 64 nt, hsa; identical to SEQ ID NO: 354605

SEQ ID NO: 609498 - RNA, 64 nt, hsa; identical to SEQ ID NO: 354606

SEQ ID NO: 609499 - RNA, 64 nt, hsa; identical to SEQ ID NO: 354607

SEQ ID NO: 609500 - RNA, 64 nt, hsa; identical to SEQ ID NO: 354608

SEQ ID NO: 609501 - RNA, 64 nt, hsa; identical to SEQ ID NO: 354609

SEQ ID NO: 609502 - RNA, 64 nt, hsa; identical to SEQ ID NO: 354610

SEQ ID NO: 609503 - RNA, 64 nt, hsa; identical to SEQ ID NO: 354611

SEQ ID NO: 609504 - RNA, 64 nt, hsa; identical to SEQ ID NO: 354612

SEQ ID NO: 609505 - RNA, 64 nt, hsa; identical to SEQ ID NO: 354613

SEQ ID NO: 609506 - RNA, 64 nt, hsa; identical to SEQ ID NO: 354614

SEQ ID NO: 609507 - RNA, 64 nt, hsa; identical to SEQ ID NO: 354615

SEQ ID NO: 609508 - RNA, 64 nt, hsa; identical to SEQ ID NO: 354616

SEQ ID NO: 609509 - RNA, 64 nt, hsa; identical to SEQ ID NO: 354617

SEQ ID NO: 609510 - RNA, 64 nt, hsa; identical to SEQ ID NO: 354618

SEQ ID NO: 609511 - RNA, 64 nt, hsa; identical to SEQ ID NO: 354619

SEQ ID NO: 609512 - RNA, 64 nt, hsa; identical to SEQ ID NO: 354620

SEQ ID NO: 609513 - RNA, 64 nt, hsa; identical to SEQ ID NO: 354621

SEQ ID NO: 609514 - RNA, 64 nt, hsa; identical to SEQ ID NO: 354622

SEQ ID NO: 609515 - RNA, 64 nt, hsa; identical to SEQ ID NO: 354623

SEQ ID NO: 609516 - RNA, 64 nt, hsa; identical to SEQ ID NO: 354624

SEQ ID NO: 609517 - RNA, 64 nt, hsa; identical to SEQ ID NO: 354625

SEQ ID NO: 609518 - RNA, 64 nt, hsa; identical to SEQ ID NO: 106519

SEQ ID NO: 609519 - RNA, 64 nt, hsa; identical to SEQ ID NO: 106520

SEQ ID NO: 609520 - RNA, 64 nt, hsa; identical to SEQ ID NO: 106521

SEQ ID NO: 609521 - RNA, 64 nt, hsa; identical to SEQ ID NO: 106522

SEQ ID NO: 609522 - RNA, 64 nt, hsa; identical to SEQ ID NO: 106523

SEQ ID NO: 609523 - RNA, 64 nt, hsa; identical to SEQ ID NO: 106524

SEQ ID NO: 609524 - RNA, 64 nt, hsa; identical to SEQ ID NO: 106525

SEQ ID NO: 609525 - RNA, 64 nt, hsa; identical to SEQ ID NO: 106526

SEQ ID NO: 609526 - RNA, 64 nt, hsa; identical to SEQ ID NO: 106527

SEQ ID NO: 609527 - RNA, 64 nt, hsa; identical to SEQ ID NO: 106528

SEQ ID NO: 609528 - RNA, 64 nt, hsa; identical to SEQ ID NO: 106529

SEQ ID NO: 609529 - RNA, 64 nt, hsa; identical to SEQ ID NO: 106530

SEQ ID NO: 609530 - RNA, 64 nt, hsa; identical to SEQ ID NO: 106531

SEQ ID NO: 609531 - RNA, 64 nt, hsa; identical to SEQ ID NO: 106532

SEQ ID NO: 609532 - RNA, 64 nt, hsa; identical to SEQ ID NO: 106533

SEQ ID NO: 609533 - RNA, 64 nt, hsa; identical to SEQ ID NO: 106534

SEQ ID NO: 609534 - RNA, 64 nt, hsa; identical to SEQ ID NO: 106535

SEQ ID NO: 609535 - RNA, 64 nt, hsa; identical to SEQ ID NO: 106536

SEQ ID NO: 609536 - RNA, 64 nt, hsa; identical to SEQ ID NO: 106537

SEQ ID NO: 609537 - RNA, 64 nt, hsa; identical to SEQ ID NO: 106538

SEQ ID NO: 609538 - RNA, 64 nt, hsa; identical to SEQ ID NO: 106539

SEQ ID NO: 609539 - RNA, 64 nt, hsa; identical to SEQ ID NO: 106540

SEQ ID NO: 609540 - RNA, 64 nt, hsa; identical to SEQ ID NO: 106541

SEQ ID NO: 609541 - RNA, 64 nt, hsa; identical to SEQ ID NO: 106542

SEQ ID NO: 609542 - RNA, 64 nt, hsa; identical to SEQ ID NO: 106543

SEQ ID NO: 609543 - RNA, 64 nt, hsa; identical to SEQ ID NO: 106544

SEQ ID NO: 609544 - RNA, 64 nt, hsa; identical to SEQ ID NO: 106545

SEQ ID NO: 609545 - RNA, 64 nt, hsa; identical to SEQ ID NO: 106546

SEQ ID NO: 609546 - RNA, 64 nt, hsa; identical to SEQ ID NO: 106547

SEQ ID NO: 609547 - RNA, 64 nt, hsa; identical to SEQ ID NO: 106548

SEQ ID NO: 609548 - RNA, 64 nt, hsa; identical to SEQ ID NO: 106549

SEQ ID NO: 609549 - RNA, 64 nt, hsa; identical to SEQ ID NO: 106550

SEQ ID NO: 609550 - RNA, 64 nt, hsa; identical to SEQ ID NO: 106551

SEQ ID NO: 609551 - RNA, 64 nt, hsa; identical to SEQ ID NO: 106552

SEQ ID NO: 609552 - RNA, 64 nt, hsa; identical to SEQ ID NO: 106553

SEQ ID NO: 609553 - RNA, 64 nt, hsa; identical to SEQ ID NO: 106554

SEQ ID NO: 609554 - RNA, 64 nt, hsa; identical to SEQ ID NO: 106555

SEQ ID NO: 609555 - RNA, 64 nt, hsa; identical to SEQ ID NO: 106556

SEQ ID NO: 609556 - RNA, 64 nt, hsa; identical to SEQ ID NO: 106557

SEQ ID NO: 609557 - RNA, 64 nt, hsa; identical to SEQ ID NO: 106558

SEQ ID NO: 609558 - RNA, 64 nt, hsa; identical to SEQ ID NO: 106559

SEQ ID NO: 609559 - RNA, 64 nt, hsa; identical to SEQ ID NO: 106560

SEQ ID NO: 609560 - RNA, 64 nt, hsa; identical to SEQ ID NO: 106561

SEQ ID NO: 609561 - RNA, 64 nt, hsa; identical to SEQ ID NO: 106562

SEQ ID NO: 609562 - RNA, 64 nt, hsa; identical to SEQ ID NO: 106563

SEQ ID NO: 609563 - RNA, 64 nt, hsa; identical to SEQ ID NO: 106564

SEQ ID NO: 609564 - RNA, 64 nt, hsa; identical to SEQ ID NO: 106565

SEQ ID NO: 609565 - RNA, 64 nt, hsa; identical to SEQ ID NO: 106566

SEQ ID NO: 609566 - RNA, 64 nt, hsa; identical to SEQ ID NO: 106567

SEQ ID NO: 609567 - RNA, 64 nt, hsa; identical to SEQ ID NO: 106568

SEQ ID NO: 609568 - RNA, 64 nt, hsa; identical to SEQ ID NO: 106569

SEQ ID NO: 609569 - RNA, 64 nt, hsa; identical to SEQ ID NO: 106570

SEQ ID NO: 609570 - RNA, 64 nt, hsa; identical to SEQ ID NO: 106571

SEQ ID NO: 609571 - RNA, 64 nt, hsa; identical to SEQ ID NO: 106572

SEQ ID NO: 609572 - RNA, 64 nt, hsa; identical to SEQ ID NO: 106573

SEQ ID NO: 609573 - RNA, 64 nt, hsa; identical to SEQ ID NO: 106574

SEQ ID NO: 609574 - RNA, 64 nt, hsa; identical to SEQ ID NO: 106575

SEQ ID NO: 609575 - RNA, 64 nt, hsa; identical to SEQ ID NO: 106576

SEQ ID NO: 609576 - RNA, 64 nt, hsa; identical to SEQ ID NO: 106577

SEQ ID NO: 609577 - RNA, 64 nt, hsa; identical to SEQ ID NO: 106578

SEQ ID NO: 609578 - RNA, 64 nt, hsa; identical to SEQ ID NO: 106579

SEQ ID NO: 609579 - RNA, 64 nt, hsa; identical to SEQ ID NO: 106580

SEQ ID NO: 609580 - RNA, 64 nt, hsa; identical to SEQ ID NO: 106581

SEQ ID NO: 609581 - RNA, 64 nt, hsa; identical to SEQ ID NO: 106582

SEQ ID NO: 609582 - RNA, 64 nt, hsa; identical to SEQ ID NO: 106583

SEQ ID NO: 609583 - RNA, 64 nt, hsa; identical to SEQ ID NO: 106584

SEQ ID NO: 609584 - RNA, 64 nt, hsa; identical to SEQ ID NO: 106585

SEQ ID NO: 609585 - RNA, 64 nt, hsa; identical to SEQ ID NO: 106586

SEQ ID NO: 609586 - RNA, 64 nt, hsa; identical to SEQ ID NO: 106587

SEQ ID NO: 609587 - RNA, 64 nt, hsa; identical to SEQ ID NO: 106588

SEQ ID NO: 609588 - RNA, 64 nt, hsa; identical to SEQ ID NO: 106589

SEQ ID NO: 609589 - RNA, 64 nt, hsa; identical to SEQ ID NO: 106590

SEQ ID NO: 609590 - RNA, 64 nt, hsa; identical to SEQ ID NO: 106591

SEQ ID NO: 609591 - RNA, 64 nt, hsa; identical to SEQ ID NO: 106592

SEQ ID NO: 609592 - RNA, 64 nt, hsa; identical to SEQ ID NO: 106593

SEQ ID NO: 609593 - RNA, 64 nt, hsa; identical to SEQ ID NO: 106594

SEQ ID NO: 609594 - RNA, 64 nt, hsa; identical to SEQ ID NO: 106595

SEQ ID NO: 609595 - RNA, 64 nt, hsa; identical to SEQ ID NO: 106596

SEQ ID NO: 609596 - RNA, 64 nt, hsa; identical to SEQ ID NO: 106597

SEQ ID NO: 609597 - RNA, 64 nt, hsa; identical to SEQ ID NO: 106598

SEQ ID NO: 609598 - RNA, 64 nt, hsa; identical to SEQ ID NO: 106599

SEQ ID NO: 609599 - RNA, 64 nt, hsa; identical to SEQ ID NO: 106600

SEQ ID NO: 609600 - RNA, 64 nt, hsa; identical to SEQ ID NO: 106601

SEQ ID NO: 609601 - RNA, 64 nt, hsa; identical to SEQ ID NO: 106602

SEQ ID NO: 609602 - RNA, 64 nt, hsa; identical to SEQ ID NO: 106603

SEQ ID NO: 609603 - RNA, 64 nt, hsa; identical to SEQ ID NO: 106604

SEQ ID NO: 609604 - RNA, 64 nt, hsa; identical to SEQ ID NO: 106605

SEQ ID NO: 609605 - RNA, 64 nt, hsa; identical to SEQ ID NO: 106606

SEQ ID NO: 609606 - RNA, 64 nt, hsa; identical to SEQ ID NO: 106607

SEQ ID NO: 609607 - RNA, 64 nt, hsa; identical to SEQ ID NO: 106608

SEQ ID NO: 609608 - RNA, 64 nt, hsa; identical to SEQ ID NO: 106609

SEQ ID NO: 609609 - RNA, 64 nt, hsa; identical to SEQ ID NO: 106610

SEQ ID NO: 609610 - RNA, 64 nt, hsa; identical to SEQ ID NO: 106611

SEQ ID NO: 609611 - RNA, 64 nt, hsa; identical to SEQ ID NO: 106612

SEQ ID NO: 609612 - RNA, 64 nt, hsa
ccugcugaaguuucuuauuuaauuccagaguacuguccucuacucuaaggcauuacuuuuaagu

SEQ ID NO: 609613 - RNA, 64 nt, hsa
uuuaacuagacuacacucuauugaguuuaauuuuguccucuaggauuuauuucuguuguccaaa

SEQ ID NO: 609614 - RNA, 64 nt, hsa
uuaguugcaggggaaguuugggauauaccccaaaguccucuacccccucacuuuuauggcccuu

SEQ ID NO: 609615 - RNA, 64 nt, hsa
guuacaugccugguuacaugggccuggacagcauguccucuaccugugacuucucauuuuccug

SEQ ID NO: 609616 - RNA, 64 nt, hsa
uucauuuuccgcgcauccacuuguugcaguccaaguccucuagugcaacgccauagcaaauaua

SEQ ID NO: 609617 - RNA, 64 nt, hsa
aaacacacuauaguauucccuuauuguagccaugguccucuagaugcaguuaaccaaauagggu

SEQ ID NO: 609618 - RNA, 64 nt, hsa
gcuccaauuauauuuuuaacauuuaaaaaccaaaguccucuacacuugauuuauauuauaugug

SEQ ID NO: 609619 - RNA, 64 nt, hsa
uuugaaaacucuuagaaaaaaaaaauucuguaauguccucuagauuuagauuaugagcccugag

SEQ ID NO: 609620 - RNA, 64 nt, hsa
uuugucuuacgcuucucucagggaaaaacaugcaguccucuaguguuucauguacauucugugg

SEQ ID NO: 609621 - RNA, 64 nt, hsa
guaaaccaacuaauauuuauugaagaccuacuuuguccucuacauaggguagcuucugucaggg

SEQ ID NO: 609622 - RNA, 64 nt, hsa
gucguggaguuggggggguugggggugggauuguguccucuaaggggacggguucaucugagua

SEQ ID NO: 609623 - RNA, 64 nt, hsa
cuccaugugucuuaugagagcccguaguuacaguguccucuaauuugaaauccauaaguuaaca

SEQ ID NO: 609624 - RNA, 64 nt, hsa
uauuuuuuaaaacauggaauuauaaagaaauuagguccucuauuacuuuugauaccaauuuuua

SEQ ID NO: 609625 - RNA, 64 nt, hsa
guucacuugcccugacgaguaugaagacccagcaguccucuacgaggccauccaguccuucgag

SEQ ID NO: 609626 - RNA, 64 nt, hsa
ucauuguucaagguguaacaacauuuaauugcauguccucuaacgcuuugaaaccuuuagaggg

SEQ ID NO: 609627 - RNA, 64 nt, hsa
cggcggaauucaccaguguuccugaagcugcuguguccucuaguugaguuucuggcgccccugc

SEQ ID NO: 609628 - RNA, 64 nt, hsa
aaaauuucaaacaaaguaaacauggcguuuuauaguccucuaaaaucuaggugcucccacccac

SEQ ID NO: 609629 - RNA, 64 nt, hsa
caucccggggagggcccgggagccuccgucaaccguccucuaauccagaguuuacuccaccugc

SEQ ID NO: 609630 - RNA, 64 nt, hsa
gguuaggaucuuggguaugucuuggaauuaacuuguccucuaacaaucuucaugggguauggcu

SEQ ID NO: 609631 - RNA, 64 nt, hsa
uauccaugguggucuggucccugccuuuuaauccguccucuacgcuugggcuuuucuguuacca

SEQ ID NO: 609632 - RNA, 64 nt, hsa
ggagccugggucagccucagcagccuauccccauguccucuaugccccuaauuugcuuccucau

SEQ ID NO: 609633 - RNA, 64 nt, hsa
guacucaucggcaggcgcaugaguaucugugggaguccucuagagagaugagaagccaggaggc

SEQ ID NO: 609634 - RNA, 64 nt, hsa
uuaacagcagauccagaagaccuugagaguaggcguccucuaaccacgggggagaguggcugug

SEQ ID NO: 609635 - RNA, 64 nt, hsa
aaacgggcaaugcugugagagccauuggaagacuguccucuauggcaaugaucucagggcucag

SEQ ID NO: 609636 - RNA, 64 nt, hsa
cuggacucaguugcuuauuuguguaauggaugugguccucuaaagccccucauuguuuuugauu

SEQ ID NO: 609637 - RNA, 64 nt, hsa
gcuuggguuuuuguuaccuuuaugguuucuccagguccucuacuuaaugagauaguagcauaca

SEQ ID NO: 609638 - RNA, 64 nt, hsa
gguaauaauguguguacuccuaaaucuuuaugcuguccucuaaagacaaacacaaacucucaga

SEQ ID NO: 609639 - RNA, 64 nt, hsa
caguaauuuuuagaagcaagaagaaagccauuguguccucuacaauuaacaaaacuuaucucug

SEQ ID NO: 609640 - RNA, 64 nt, hsa
aauaaauuuacuuucccuuuuucuaucaccuuauguccucuaccauuuucuccuuccucccuuc

SEQ ID NO: 609641 - RNA, 64 nt, hsa
uuggaguggggagaugcgggaagcugacccagugguccucuaggcaggcagggugcuccuggug

SEQ ID NO: 609642 - RNA, 64 nt, hsa
acaaaagauaugaagaacuauuauauugaggccuguccucuacauaccacacuuaaaagauggu

SEQ ID NO: 609643 - RNA, 64 nt, hsa
cacagggauguagauaaguugaaacaaaaccaguguccucuaagucucuaucauauacuuauuc

SEQ ID NO: 609644 - RNA, 64 nt, hsa
aauauuuuuaagauuugaaauauauuucauagaaguccucuauucaaaaucauauuccacagau

SEQ ID NO: 609645 - RNA, 64 nt, hsa
uguaauuuuccugcuacuuuaucauuuucaagauguccucuaggaauuuuuuuucuaguaauuu

SEQ ID NO: 609646 - RNA, 64 nt, hsa
acacacuguacacauaagccaaaacugagcauaaguccucuagugaauguaggcuggcuuucag

SEQ ID NO: 609647 - RNA, 64 nt, hsa
guaaaaaagaaaugaaaaucugcuggccagcuauguccucuaggaaaugacagacccaaccacc

SEQ ID NO: 609648 - RNA, 64 nt, hsa
uuaugugguguuauaugaagguacugagucacaaguccucuagugcucuuguugguuugaagau

SEQ ID NO: 609649 - RNA, 64 nt, hsa
guuauauuggaaaucaugacugugagacuuuauuguccucuaggauggauguauauuggagaag

SEQ ID NO: 609650 - RNA, 64 nt, hsa
aaaggguugaauugauggaucucuaaaggcuuuuguccucuaugaggaugugaaaaacuaggga

SEQ ID NO: 609651 - RNA, 64 nt, hsa
agaauugaugcaccauugccacuguaauauugcuguccucuaauuaauuuuagguacugaagaa

SEQ ID NO: 609652 - RNA, 64 nt, hsa
uguguuccguuugaccagcacagaaauauuaaacguccucuauucaccgggcccuguguguguc

SEQ ID NO: 609653 - RNA, 64 nt, hsa
aaggacccucaggacacccucucugcacccugugguccucuagaguagcuagcucugaggcccc

SEQ ID NO: 609654 - RNA, 63 nt, hsa
ucucagaaaggccucuguagagccucaaguccaguccucuaucacuuuugcaugaauuaaagu

SEQ ID NO: 609655 - RNA, 64 nt, hsa
gugcacuuguacaguuguagcugcgaguccagaaguccucuagagcauguguacuggcacugag

SEQ ID NO: 609656 - RNA, 64 nt, hsa
aaaacagcaaaguugacuaaauuuuauauuucuuguccucuaaauauuuugauaauuucuggau

SEQ ID NO: 609657 - RNA, 64 nt, hsa
ugaaucuuuuugagagaaccuuauauuuuauauaguccucuagcuacacuauugcauuguucag

SEQ ID NO: 609658 - RNA, 64 nt, hsa
ggugugcacggcuguggcagcuguugaugccaguguccucuaacucaugcuguccuugugauua

SEQ ID NO: 609659 - RNA, 64 nt, hsa
guucuucuuuaaccacauuuuguuauaucagacaguccucuauaacucuguacuacccaacaac

SEQ ID NO: 609660 - RNA, 64 nt, hsa
uaaacgacuacagacuuaguaguggagaaaugguguccucuaguggaagaaauaguaggcuccg

SEQ ID NO: 609661 - RNA, 64 nt, hsa
aggcgcccggugcagauggccccgggcggcccagguccucuacugugaaggagcagggagcugc

SEQ ID NO: 609662 - RNA, 64 nt, hsa
caucucuuccucacacccauuuagugggggauggguccucuagacuugaggggcuacccuggga

SEQ ID NO: 609663 - RNA, 64 nt, hsa
ucuauguguaacaucaaagcaaaauccuauacguguccucuauuggaaaauuugggaguuuguu

SEQ ID NO: 609664 - RNA, 64 nt, hsa
uggcuugguagcucugggauuugccuuccuucauguccucuacacacuugugauuccuauucga

SEQ ID NO: 609665 - RNA, 64 nt, hsa
cuuuaccaaguaagguguaagguugcauguuucaguccucuaccauccugcacugugagcagca

SEQ ID NO: 609666 - RNA, 64 nt, hsa
acugaaaccgaaacgaaaaaucaacaaacacucuguccucuaucccuccaaagaaugaaaauca

SEQ ID NO: 609667 - RNA, 64 nt, hsa
gugucuccccuugguauaacugauuuccuuuuuaguccucuacugcuaaauaaguuaauuuugc

SEQ ID NO: 609668 - RNA, 64 nt, hsa
uggccuggccggcaggcgucuucuuaacuccucuguccucuauauucagcauguuccuugucag

SEQ ID NO: 609669 - RNA, 64 nt, hsa
auggauuccuuuuuaccgugucacauuuacuuugguccucuauguauuuaaauguuugaagugc

SEQ ID NO: 609670 - RNA, 64 nt, hsa
gugcugccggaacucgggccuuuuuacgcgguucguccucuagugccuuuaacugcguuacuac

SEQ ID NO: 609671 - RNA, 64 nt, hsa
uguuagcagcaaaauaugaaagaugagguggacaguccucuaagcccuauuuagggaagcuuuu

SEQ ID NO: 609672 - RNA, 64 nt, hsa
aaaguuguugaauauaauccuuagugaaaacaguguccucuaaccaaugccuauacaacuaaau

SEQ ID NO: 609673 - RNA, 64 nt, hsa
aaagccaccucuuccaggcagccuucccugaucuguccucuaacuucugucaaccugcaggacc

SEQ ID NO: 609674 - RNA, 64 nt, hsa
ucugcauuucccuuccauucccaucacuagcacuguccucuaaugccccacccaguggggaagu

SEQ ID NO: 609675 - RNA, 64 nt, hsa
cuaugagaucugaggaggcuucgugggcuuuuggguccucuaacuaggacucccucauuccuag

SEQ ID NO: 609676 - RNA, 64 nt, hsa
cuguggcucaugcuacccaauuccagauuucuuuguccucuaagaguugauugcuguauauuaa

SEQ ID NO: 609677 - RNA, 64 nt, hsa
guucugccuccccucuggucuccagaguuuuccuguccucuagaggcaagccaggccagggagc

SEQ ID NO: 609678 - RNA, 64 nt, hsa
aacaacuaaacgauggaagagagagcgagcccggguccucuaaggcuccuuccuucuccccugg

SEQ ID NO: 609679 - RNA, 64 nt, hsa
ccagaguuugcagccgaguagggacuccuccccuguccucuacgaaggaaaagauugcuauugu

SEQ ID NO: 609680 - RNA, 64 nt, hsa
cuaguccucccccagccccuccagccaccaggguguccucuaggaugcagcugccagauccacu

SEQ ID NO: 609681 - RNA, 64 nt, hsa
uuuccagggccccagccugauggggcugcccucaguccucuagaucaagaugcugacuauuagg

SEQ ID NO: 609682 - RNA, 64 nt, hsa
uguggaauuuaacuuuucagagaaaauuuccaaaguccucuaccuuauuuggcuuuuaucugug

SEQ ID NO: 609683 - RNA, 64 nt, hsa
uaaugcaauccuuaguccuacccugaaccuauguguccucuaagucaggcccugaucuagugca

SEQ ID NO: 609684 - RNA, 64 nt, hsa
cacuuuuuggccagacuacacugggaagaagguaguccucuaaagcaaaaucugagugccacua

SEQ ID NO: 609685 - RNA, 64 nt, hsa
ccaacccccugccccaggagcgggccugagccacguccucuaggagcagcuggagauggccaaa

SEQ ID NO: 609686 - RNA, 64 nt, hsa
gguuuuuaaaauaaccuuuuuuggggagagaauuguccucuaaugagguauugcgaguggacau

SEQ ID NO: 609687 - RNA, 64 nt, hsa
gucgguaagcuagaggauuguaaauaucuuuuauguccucuagauaaaacacccgauuaacaga

SEQ ID NO: 609688 - RNA, 64 nt, hsa
cuaaacucaggcgaccgugcugugugacaucauaguccucuacugcaugaagaaaagacucuac

SEQ ID NO: 609689 - RNA, 64 nt, hsa
auuuuuauaagagaaauuucugcacuuugaaacuguccucuaagagaauaagcauuuccuguuc

SEQ ID NO: 609690 - RNA, 64 nt, hsa
uauuuuuguccuuuuuuucccucucuccaccccuguccucuagccacagcauuuuucuuuuugu

SEQ ID NO: 609691 - RNA, 64 nt, hsa
ugcaauuauagaaacagcuccuuuuuuauuuuauguccucuauaugccaggugcuucaccuguu

SEQ ID NO: 609692 - RNA, 64 nt, hsa
uggauauuucuguauuacuagggaggcauuuacaguccucuaauguugauuaauaugugaaaag

SEQ ID NO: 609693 - RNA, 64 nt, hsa
gaacacuuucagagaccaugugcaggugagcuguguccucuaggcugccagcucacagccccca

SEQ ID NO: 609694 - RNA, 64 nt, hsa
uugcuuccugcaccacaccugguggggugggagcguccucuaggugccccuaguucuuuguccu

SEQ ID NO: 609695 - RNA, 64 nt, hsa
ucuauccuauccuaccaaauauuuauccuucucuguccucuauucucuuacucuccucucuccc

SEQ ID NO: 609696 - RNA, 64 nt, hsa
cuccuuuacuaacauucauguuauggcaagaguuguccucuacauuggaaagcuaauccuaccu

SEQ ID NO: 609697 - RNA, 64 nt, hsa
gggaucacuggcuggccugagcaacaucucgggaguccucuagcaggccuaagacaugugagga

SEQ ID NO: 609698 - RNA, 64 nt, hsa
ucagagucugaggauguuaacuuuggaacucgcaguccucuagaacagcuucagauuauggcuu

SEQ ID NO: 609699 - RNA, 64 nt, hsa
auuuuuuuuuuuuguagaaaaugugaauuuuuugguccucuaauuuguuguugcccuguguacu

SEQ ID NO: 609700 - RNA, 64 nt, hsa
uggguagacagggaggugcucaaccccagcucggguccucuagucugccuggcuaccaugcuuc

SEQ ID NO: 609701 - RNA, 64 nt, hsa
ucaaguuugcuuaauaaaagcuaugagacaaauaguccucuaguuccaggaaacacagucuuuu

SEQ ID NO: 609702 - RNA, 64 nt, hsa
gggauuaagggcaaaucuauuacuuuugcaaacuguccucuacaucaauuaacaucguggguca

SEQ ID NO: 609703 - RNA, 64 nt, hsa
ucauucccuguaguugacaauucugcauguacuaguccucuagaaauagguuaaacugaagcaa

SEQ ID NO: 609704 - RNA, 64 nt, hsa
gccaggugcauuucaagugaagugugcugaugaaguccucuauaagguauuuauguucacauuu

SEQ ID NO: 609705 - RNA, 64 nt, hsa
aaagcagggucugggcaggacucagcuccccagaguccucuaugaacuauggacggugcuccag

SEQ ID NO: 609706 - RNA, 64 nt, hsa
gcagcucguuuuauugaaauucauaaucagggguguccucuagcucccacggucuccagagcag

SEQ ID NO: 609707 - RNA, 64 nt, hsa
ugaagugcaucuuuccaagaccaucauggaccagguccucuauaaaaugaagaacuaacaaaaa

SEQ ID NO: 609708 - RNA, 64 nt, hsa
ugacuguauuuuucaguugccgauacagcuuuuuguccucuaacuguggaaacucuuuauguua

SEQ ID NO: 609709 - RNA, 64 nt, hsa
agagccugagaccagguuuauuggggccuggccuguccucuaagucaaguuuaggaaaacaagg

SEQ ID NO: 609710 - RNA, 64 nt, hsa
cuugucucggcuguaggaaucaacagaaggagacguccucuacauaaaagcuccaugugaaaag

SEQ ID NO: 609711 - RNA, 64 nt, hsa
uuccugucucucuuccccuccucucucucuuccuguccucuaucucuuccccuccucuaucucu

SEQ ID NO: 609712 - RNA, 64 nt, hsa
cagagggcugacccucucugcaaaacucuccccuguccucuagaccccacccuggguguaugug

SEQ ID NO: 609713 - RNA, 64 nt, hsa
uucaucaccacuguagauuuugcugcaugugcagguccucuauuuuuaauugcuguuuucguug

SEQ ID NO: 609714 - RNA, 64 nt, hsa
uuugaugaacccucaugcugcaccuucagagccaguccucuaguuuggaauaaaaauugcagag

SEQ ID NO: 609715 - RNA, 64 nt, hsa
guguguaucucuccaauaaagcucugugggccaaguccucuaggacuccagucuguuaaugagg

SEQ ID NO: 609716 - RNA, 64 nt, hsa
gccucgucucuaacugccgucguccugccucccuguccucuacugccgguagugucccuucucu

SEQ ID NO: 609717 - RNA, 64 nt, hsa
uucucuccaaggaguggggucuacgugaccuuuaguccucuaccucagagccccgagucauuuc

SEQ ID NO: 609718 - RNA, 64 nt, hsa
aaacuggagcagaggaauugcaauuuagcaggagguccucuacuggugauacccucaccuuggg

SEQ ID NO: 609719 - RNA, 64 nt, hsa
auggcuggggcggcgccccacaguguguauuccuguccucuauguuagagugcaucagaagcac

SEQ ID NO: 609720 - RNA, 64 nt, hsa
aaauaccaaaggaacuuacgcaacacaccacugaguccucuaacuaaucauaugugcucagaca

SEQ ID NO: 609721 - RNA, 64 nt, hsa
gcugagaugggaaugagccccuacacagaauggaguccucuagccuaaagauaucagcuguucc

SEQ ID NO: 609722 - RNA, 64 nt, hsa
ggggcugcccccacccgaaagacccuccacgcucguccucuacagaguccggcuucgggaagug

SEQ ID NO: 609723 - RNA, 64 nt, hsa
cugugggucaagagccugggugcagguuggcuggguccucuacuugggaucucaggaggcugca

SEQ ID NO: 609724 - RNA, 64 nt, hsa
cugccccucucugggccucagaggccuuaugaggguccucuacuucaggaacacccccaugaca

SEQ ID NO: 609725 - RNA, 64 nt, hsa
caagaaaaaauaaaagugggaaaaucuuccaacuguccucuagagugugaauauaugaaaggag

SEQ ID NO: 609726 - RNA, 64 nt, hsa
ccccacuuaagaccccuccucuacuuccuucugaguccucuacaaagacauccggguacuacau

SEQ ID NO: 609727 - RNA, 64 nt, hsa
auagccaugagcuccaauuaccucagagcuccgaguccucuacucaguacccguugagauuuau

SEQ ID NO: 609728 - RNA, 64 nt, hsa
caucccugucucucccuuucacccuugcccuccaguccucuaccucuggccugccccuauuucu

SEQ ID NO: 609729 - RNA, 64 nt, hsa
cucacugccuaggaggcuggccaagguguccaggguccucuagcccacucccugccuacacaca

SEQ ID NO: 609730 - RNA, 64 nt, hsa
ugaagaguucccugucaccucaaguuugaggauaguccucuaagagugaccuaagcauaaguga

SEQ ID NO: 609731 - RNA, 64 nt, hsa
uuugggugggagggugggaaauuuggguuuuuaaguccucuaaacacacuugggcacggaaaug

SEQ ID NO: 609732 - RNA, 64 nt, hsa
ccuaggggacacacagcuuccaggaggagggaauguccucuaagcaugcuccuggccucucaag

SEQ ID NO: 609733 - RNA, 64 nt, hsa
ucccaucuccugguucagccuagguguuucacugguccucuaugaaucccagcacuuauaaucc

SEQ ID NO: 609734 - RNA, 64 nt, hsa
auuucacgacaguccggguaacauaaugagaccuguccucuaugaaaaaacuuuuuuaaaaauu

SEQ ID NO: 609735 - RNA, 64 nt, hsa
uacauacauaguaucaauauuguuucaacuugauguccucuaagcuaucauccaguuacccaag

SEQ ID NO: 609736 - RNA, 64 nt, hsa
uggcuauuccagcaccccaaccuguaauugccaaguccucuaagguacuaauuuguagcugcuc

SEQ ID NO: 609737 - RNA, 64 nt, hsa
auaguacacaucagcauaugagaaucucugagagguccucuagaaaggagagaaaaagcaccuc

SEQ ID NO: 609738 - RNA, 64 nt, hsa
uuccacagugacugggcccuguccagggcagugaguccucuacuuugcuccguggaggaagcug

SEQ ID NO: 609739 - RNA, 64 nt, hsa
uagcugaguucaaaaacuacauauuucuugggcaguccucuacugguaugugaugccaacuuuu

SEQ ID NO: 609740 - RNA, 64 nt, hsa
uuuccaagaaaugugaauuauuugacugugagacguccucuaguuuguggccuucagaaaucag

SEQ ID NO: 609741 - RNA, 64 nt, hsa; identical to SEQ ID NO: 526624

SEQ ID NO: 609742 - RNA, 64 nt, hsa; identical to SEQ ID NO: 526625

SEQ ID NO: 609743 - RNA, 64 nt, hsa; identical to SEQ ID NO: 526626

SEQ ID NO: 609744 - RNA, 64 nt, hsa; identical to SEQ ID NO: 526627

SEQ ID NO: 609745 - RNA, 64 nt, hsa; identical to SEQ ID NO: 526628

SEQ ID NO: 609746 - RNA, 64 nt, hsa; identical to SEQ ID NO: 526629

SEQ ID NO: 609747 - RNA, 64 nt, hsa; identical to SEQ ID NO: 526630

SEQ ID NO: 609748 - RNA, 64 nt, hsa; identical to SEQ ID NO: 526631

SEQ ID NO: 609749 - RNA, 64 nt, hsa; identical to SEQ ID NO: 526632

SEQ ID NO: 609750 - RNA, 64 nt, hsa; identical to SEQ ID NO: 526633

SEQ ID NO: 609751 - RNA, 64 nt, hsa; identical to SEQ ID NO: 526634

SEQ ID NO: 609752 - RNA, 64 nt, hsa; identical to SEQ ID NO: 526635

SEQ ID NO: 609753 - RNA, 64 nt, hsa; identical to SEQ ID NO: 526636

SEQ ID NO: 609754 - RNA, 64 nt, hsa; identical to SEQ ID NO: 526637

SEQ ID NO: 609755 - RNA, 64 nt, hsa; identical to SEQ ID NO: 526638

SEQ ID NO: 609756 - RNA, 64 nt, hsa; identical to SEQ ID NO: 526639

SEQ ID NO: 609757 - RNA, 64 nt, hsa; identical to SEQ ID NO: 526640

SEQ ID NO: 609758 - RNA, 64 nt, hsa; identical to SEQ ID NO: 526641

SEQ ID NO: 609759 - RNA, 64 nt, hsa; identical to SEQ ID NO: 526642

SEQ ID NO: 609760 - RNA, 64 nt, hsa; identical to SEQ ID NO: 526643

SEQ ID NO: 609761 - RNA, 64 nt, hsa; identical to SEQ ID NO: 526644

SEQ ID NO: 609762 - RNA, 64 nt, hsa; identical to SEQ ID NO: 526645

SEQ ID NO: 609763 - RNA, 64 nt, hsa; identical to SEQ ID NO: 526646

SEQ ID NO: 609764 - RNA, 64 nt, hsa; identical to SEQ ID NO: 526647

SEQ ID NO: 609765 - RNA, 64 nt, hsa; identical to SEQ ID NO: 526648

SEQ ID NO: 609766 - RNA, 64 nt, hsa; identical to SEQ ID NO: 526649

SEQ ID NO: 609767 - RNA, 64 nt, hsa; identical to SEQ ID NO: 526650

SEQ ID NO: 609768 - RNA, 64 nt, hsa; identical to SEQ ID NO: 526651

SEQ ID NO: 609769 - RNA, 64 nt, hsa; identical to SEQ ID NO: 526652

SEQ ID NO: 609770 - RNA, 64 nt, hsa; identical to SEQ ID NO: 526653

SEQ ID NO: 609771 - RNA, 64 nt, hsa; identical to SEQ ID NO: 526654

SEQ ID NO: 609772 - RNA, 64 nt, hsa; identical to SEQ ID NO: 526655

SEQ ID NO: 609773 - RNA, 64 nt, hsa; identical to SEQ ID NO: 526656

SEQ ID NO: 609774 - RNA, 64 nt, hsa; identical to SEQ ID NO: 526657

SEQ ID NO: 609775 - RNA, 64 nt, hsa; identical to SEQ ID NO: 526658

SEQ ID NO: 609776 - RNA, 64 nt, hsa; identical to SEQ ID NO: 526659

SEQ ID NO: 609777 - RNA, 64 nt, hsa; identical to SEQ ID NO: 526660

SEQ ID NO: 609778 - RNA, 64 nt, hsa; identical to SEQ ID NO: 526661

SEQ ID NO: 609779 - RNA, 64 nt, hsa; identical to SEQ ID NO: 526662

SEQ ID NO: 609780 - RNA, 64 nt, hsa; identical to SEQ ID NO: 526663

SEQ ID NO: 609781 - RNA, 64 nt, hsa; identical to SEQ ID NO: 526664

SEQ ID NO: 609782 - RNA, 64 nt, hsa; identical to SEQ ID NO: 526665

SEQ ID NO: 609783 - RNA, 64 nt, hsa; identical to SEQ ID NO: 526666

SEQ ID NO: 609784 - RNA, 64 nt, hsa; identical to SEQ ID NO: 526667

SEQ ID NO: 609785 - RNA, 64 nt, hsa; identical to SEQ ID NO: 526668

SEQ ID NO: 609786 - RNA, 64 nt, hsa; identical to SEQ ID NO: 526669

SEQ ID NO: 609787 - RNA, 64 nt, hsa; identical to SEQ ID NO: 526670

SEQ ID NO: 609788 - RNA, 64 nt, hsa; identical to SEQ ID NO: 526671

SEQ ID NO: 609789 - RNA, 64 nt, hsa; identical to SEQ ID NO: 526672

SEQ ID NO: 609790 - RNA, 64 nt, hsa; identical to SEQ ID NO: 526673

SEQ ID NO: 609791 - RNA, 64 nt, hsa; identical to SEQ ID NO: 526674

SEQ ID NO: 609792 - RNA, 64 nt, hsa; identical to SEQ ID NO: 526675

SEQ ID NO: 609793 - RNA, 64 nt, hsa; identical to SEQ ID NO: 526676

SEQ ID NO: 609794 - RNA, 64 nt, hsa; identical to SEQ ID NO: 526677

SEQ ID NO: 609795 - RNA, 64 nt, hsa; identical to SEQ ID NO: 526678

SEQ ID NO: 609796 - RNA, 64 nt, hsa; identical to SEQ ID NO: 526679

SEQ ID NO: 609797 - RNA, 64 nt, hsa; identical to SEQ ID NO: 526680

SEQ ID NO: 609798 - RNA, 64 nt, hsa; identical to SEQ ID NO: 526681

SEQ ID NO: 609799 - RNA, 64 nt, hsa; identical to SEQ ID NO: 526682

SEQ ID NO: 609800 - RNA, 64 nt, hsa; identical to SEQ ID NO: 526683

SEQ ID NO: 609801 - RNA, 64 nt, hsa; identical to SEQ ID NO: 526684

SEQ ID NO: 609802 - RNA, 64 nt, hsa; identical to SEQ ID NO: 526685

SEQ ID NO: 609803 - RNA, 64 nt, hsa; identical to SEQ ID NO: 526686

SEQ ID NO: 609804 - RNA, 64 nt, hsa; identical to SEQ ID NO: 526687

SEQ ID NO: 609805 - RNA, 64 nt, hsa; identical to SEQ ID NO: 526688

SEQ ID NO: 609806 - RNA, 64 nt, hsa; identical to SEQ ID NO: 526689

SEQ ID NO: 609807 - RNA, 64 nt, hsa; identical to SEQ ID NO: 526690

SEQ ID NO: 609808 - RNA, 64 nt, hsa; identical to SEQ ID NO: 526691

SEQ ID NO: 609809 - RNA, 64 nt, hsa; identical to SEQ ID NO: 526692

SEQ ID NO: 609810 - RNA, 64 nt, hsa; identical to SEQ ID NO: 526693

SEQ ID NO: 609811 - RNA, 64 nt, hsa; identical to SEQ ID NO: 526694

SEQ ID NO: 609812 - RNA, 64 nt, hsa; identical to SEQ ID NO: 526695

SEQ ID NO: 609813 - RNA, 64 nt, hsa; identical to SEQ ID NO: 526696

SEQ ID NO: 609814 - RNA, 64 nt, hsa; identical to SEQ ID NO: 526697

SEQ ID NO: 609815 - RNA, 64 nt, hsa; identical to SEQ ID NO: 526698

SEQ ID NO: 609816 - RNA, 64 nt, hsa; identical to SEQ ID NO: 526699

SEQ ID NO: 609817 - RNA, 64 nt, hsa; identical to SEQ ID NO: 526700

SEQ ID NO: 609818 - RNA, 64 nt, hsa; identical to SEQ ID NO: 526701

SEQ ID NO: 609819 - RNA, 64 nt, hsa; identical to SEQ ID NO: 526702

SEQ ID NO: 609820 - RNA, 64 nt, hsa; identical to SEQ ID NO: 526703

SEQ ID NO: 609821 - RNA, 64 nt, hsa; identical to SEQ ID NO: 526704

SEQ ID NO: 609822 - RNA, 64 nt, hsa; identical to SEQ ID NO: 526705

SEQ ID NO: 609823 - RNA, 64 nt, hsa; identical to SEQ ID NO: 526706

SEQ ID NO: 609824 - RNA, 64 nt, hsa; identical to SEQ ID NO: 526707

SEQ ID NO: 609825 - RNA, 64 nt, hsa; identical to SEQ ID NO: 526708

SEQ ID NO: 609826 - RNA, 64 nt, hsa; identical to SEQ ID NO: 526709

SEQ ID NO: 609827 - RNA, 64 nt, hsa; identical to SEQ ID NO: 526710

SEQ ID NO: 609828 - RNA, 64 nt, hsa; identical to SEQ ID NO: 526711

SEQ ID NO: 609829 - RNA, 64 nt, hsa; identical to SEQ ID NO: 526712

SEQ ID NO: 609830 - RNA, 64 nt, hsa; identical to SEQ ID NO: 526713

SEQ ID NO: 609831 - RNA, 64 nt, hsa; identical to SEQ ID NO: 526714

SEQ ID NO: 609832 - RNA, 64 nt, hsa; identical to SEQ ID NO: 526715

SEQ ID NO: 609833 - RNA, 64 nt, hsa; identical to SEQ ID NO: 526716

SEQ ID NO: 609834 - RNA, 64 nt, hsa; identical to SEQ ID NO: 526717

SEQ ID NO: 609835 - RNA, 64 nt, hsa; identical to SEQ ID NO: 526718

SEQ ID NO: 609836 - RNA, 64 nt, hsa; identical to SEQ ID NO: 526719

SEQ ID NO: 609837 - RNA, 64 nt, hsa; identical to SEQ ID NO: 526720

SEQ ID NO: 609838 - RNA, 64 nt, hsa; identical to SEQ ID NO: 526721

SEQ ID NO: 609839 - RNA, 64 nt, hsa; identical to SEQ ID NO: 526722

SEQ ID NO: 609840 - RNA, 64 nt, hsa; identical to SEQ ID NO: 526723

SEQ ID NO: 609841 - RNA, 64 nt, hsa; identical to SEQ ID NO: 526724

SEQ ID NO: 609842 - RNA, 64 nt, hsa; identical to SEQ ID NO: 526725

SEQ ID NO: 609843 - RNA, 64 nt, hsa; identical to SEQ ID NO: 526726

SEQ ID NO: 609844 - RNA, 64 nt, hsa; identical to SEQ ID NO: 526727

SEQ ID NO: 609845 - RNA, 64 nt, hsa; identical to SEQ ID NO: 526728

SEQ ID NO: 609846 - RNA, 64 nt, hsa; identical to SEQ ID NO: 526729

SEQ ID NO: 609847 - RNA, 64 nt, hsa; identical to SEQ ID NO: 526730

SEQ ID NO: 609848 - RNA, 64 nt, hsa; identical to SEQ ID NO: 526731

SEQ ID NO: 609849 - RNA, 64 nt, hsa; identical to SEQ ID NO: 526732

SEQ ID NO: 609850 - RNA, 64 nt, hsa; identical to SEQ ID NO: 526733

SEQ ID NO: 609851 - RNA, 64 nt, hsa; identical to SEQ ID NO: 526734

SEQ ID NO: 609852 - RNA, 64 nt, hsa; identical to SEQ ID NO: 526735

SEQ ID NO: 609853 - RNA, 64 nt, hsa; identical to SEQ ID NO: 526736

SEQ ID NO: 609854 - RNA, 64 nt, hsa; identical to SEQ ID NO: 526737

SEQ ID NO: 609855 - RNA, 64 nt, hsa; identical to SEQ ID NO: 526738

SEQ ID NO: 609856 - RNA, 64 nt, hsa; identical to SEQ ID NO: 526739

SEQ ID NO: 609857 - RNA, 64 nt, hsa; identical to SEQ ID NO: 526740

SEQ ID NO: 609858 - RNA, 64 nt, hsa; identical to SEQ ID NO: 526741

SEQ ID NO: 609859 - RNA, 64 nt, hsa; identical to SEQ ID NO: 526742

SEQ ID NO: 609860 - RNA, 64 nt, hsa; identical to SEQ ID NO: 526743

SEQ ID NO: 609861 - RNA, 64 nt, hsa; identical to SEQ ID NO: 526744

SEQ ID NO: 609862 - RNA, 64 nt, hsa; identical to SEQ ID NO: 526745

SEQ ID NO: 609863 - RNA, 64 nt, hsa; identical to SEQ ID NO: 526746

SEQ ID NO: 609864 - RNA, 64 nt, hsa; identical to SEQ ID NO: 526747

SEQ ID NO: 609865 - RNA, 64 nt, hsa; identical to SEQ ID NO: 526748

SEQ ID NO: 609866 - RNA, 64 nt, hsa; identical to SEQ ID NO: 526749

SEQ ID NO: 609867 - RNA, 64 nt, hsa; identical to SEQ ID NO: 526750

SEQ ID NO: 609868 - RNA, 64 nt, hsa; identical to SEQ ID NO: 526751

SEQ ID NO: 609869 - RNA, 64 nt, hsa; identical to SEQ ID NO: 526752

SEQ ID NO: 609870 - RNA, 64 nt, hsa; identical to SEQ ID NO: 526753

SEQ ID NO: 609871 - RNA, 64 nt, hsa; identical to SEQ ID NO: 526754

SEQ ID NO: 609872 - RNA, 64 nt, hsa; identical to SEQ ID NO: 526755

SEQ ID NO: 609873 - RNA, 64 nt, hsa; identical to SEQ ID NO: 526756

SEQ ID NO: 609874 - RNA, 64 nt, hsa; identical to SEQ ID NO: 526757

SEQ ID NO: 609875 - RNA, 64 nt, hsa; identical to SEQ ID NO: 526758

SEQ ID NO: 609876 - RNA, 64 nt, hsa; identical to SEQ ID NO: 526759

SEQ ID NO: 609877 - RNA, 64 nt, hsa; identical to SEQ ID NO: 526760

SEQ ID NO: 609878 - RNA, 64 nt, hsa; identical to SEQ ID NO: 526761

SEQ ID NO: 609879 - RNA, 64 nt, hsa; identical to SEQ ID NO: 526762

SEQ ID NO: 609880 - RNA, 64 nt, hsa; identical to SEQ ID NO: 526763

SEQ ID NO: 609881 - RNA, 64 nt, hsa; identical to SEQ ID NO: 526764

SEQ ID NO: 609882 - RNA, 64 nt, hsa; identical to SEQ ID NO: 526765

SEQ ID NO: 609883 - RNA, 64 nt, hsa; identical to SEQ ID NO: 526766

SEQ ID NO: 609884 - RNA, 64 nt, hsa; identical to SEQ ID NO: 526767

SEQ ID NO: 609885 - RNA, 64 nt, hsa; identical to SEQ ID NO: 526768

SEQ ID NO: 609886 - RNA, 64 nt, hsa; identical to SEQ ID NO: 526769

SEQ ID NO: 609887 - RNA, 64 nt, hsa; identical to SEQ ID NO: 526770

SEQ ID NO: 609888 - RNA, 64 nt, hsa; identical to SEQ ID NO: 526771

SEQ ID NO: 609889 - RNA, 64 nt, hsa; identical to SEQ ID NO: 526772

SEQ ID NO: 609890 - RNA, 64 nt, hsa; identical to SEQ ID NO: 526773

SEQ ID NO: 609891 - RNA, 64 nt, hsa; identical to SEQ ID NO: 526774

SEQ ID NO: 609892 - RNA, 64 nt, hsa; identical to SEQ ID NO: 526775

SEQ ID NO: 609893 - RNA, 64 nt, hsa; identical to SEQ ID NO: 526776

SEQ ID NO: 609894 - RNA, 64 nt, hsa; identical to SEQ ID NO: 526777

SEQ ID NO: 609895 - RNA, 64 nt, hsa; identical to SEQ ID NO: 526778

SEQ ID NO: 609896 - RNA, 64 nt, hsa; identical to SEQ ID NO: 526779

SEQ ID NO: 609897 - RNA, 64 nt, hsa; identical to SEQ ID NO: 526780

SEQ ID NO: 609898 - RNA, 64 nt, hsa; identical to SEQ ID NO: 526781

SEQ ID NO: 609899 - RNA, 64 nt, hsa; identical to SEQ ID NO: 526782

SEQ ID NO: 609900 - RNA, 64 nt, hsa; identical to SEQ ID NO: 526783

SEQ ID NO: 609901 - RNA, 64 nt, hsa; identical to SEQ ID NO: 526784

SEQ ID NO: 609902 - RNA, 64 nt, hsa; identical to SEQ ID NO: 526785

SEQ ID NO: 609903 - RNA, 64 nt, hsa; identical to SEQ ID NO: 526786

SEQ ID NO: 609904 - RNA, 64 nt, hsa; identical to SEQ ID NO: 526787

SEQ ID NO: 609905 - RNA, 64 nt, hsa; identical to SEQ ID NO: 526788

SEQ ID NO: 609906 - RNA, 64 nt, hsa; identical to SEQ ID NO: 526789

SEQ ID NO: 609907 - RNA, 64 nt, hsa; identical to SEQ ID NO: 526790

SEQ ID NO: 609908 - RNA, 64 nt, hsa; identical to SEQ ID NO: 526791

SEQ ID NO: 609909 - RNA, 64 nt, hsa; identical to SEQ ID NO: 526792

SEQ ID NO: 609910 - RNA, 64 nt, hsa; identical to SEQ ID NO: 526793

SEQ ID NO: 609911 - RNA, 64 nt, hsa; identical to SEQ ID NO: 526794

SEQ ID NO: 609912 - RNA, 64 nt, hsa; identical to SEQ ID NO: 526795

SEQ ID NO: 609913 - RNA, 64 nt, hsa; identical to SEQ ID NO: 526796

SEQ ID NO: 609914 - RNA, 64 nt, hsa; identical to SEQ ID NO: 526797

SEQ ID NO: 609915 - RNA, 64 nt, hsa; identical to SEQ ID NO: 526798

SEQ ID NO: 609916 - RNA, 64 nt, hsa; identical to SEQ ID NO: 526799

SEQ ID NO: 609917 - RNA, 64 nt, hsa; identical to SEQ ID NO: 526800

SEQ ID NO: 609918 - RNA, 64 nt, hsa; identical to SEQ ID NO: 526801

SEQ ID NO: 609919 - RNA, 64 nt, hsa; identical to SEQ ID NO: 526802

SEQ ID NO: 609920 - RNA, 64 nt, hsa; identical to SEQ ID NO: 526803

SEQ ID NO: 609921 - RNA, 64 nt, hsa; identical to SEQ ID NO: 526804

SEQ ID NO: 609922 - RNA, 64 nt, hsa; identical to SEQ ID NO: 526805

SEQ ID NO: 609923 - RNA, 64 nt, hsa; identical to SEQ ID NO: 526806

SEQ ID NO: 609924 - RNA, 64 nt, hsa; identical to SEQ ID NO: 526807

SEQ ID NO: 609925 - RNA, 64 nt, hsa; identical to SEQ ID NO: 526808

SEQ ID NO: 609926 - RNA, 64 nt, hsa; identical to SEQ ID NO: 526809

SEQ ID NO: 609927 - RNA, 64 nt, hsa; identical to SEQ ID NO: 526810

SEQ ID NO: 609928 - RNA, 64 nt, hsa; identical to SEQ ID NO: 526811

SEQ ID NO: 609929 - RNA, 64 nt, hsa; identical to SEQ ID NO: 526812

SEQ ID NO: 609930 - RNA, 64 nt, hsa; identical to SEQ ID NO: 526813

SEQ ID NO: 609931 - RNA, 64 nt, hsa; identical to SEQ ID NO: 526814

SEQ ID NO: 609932 - RNA, 64 nt, hsa; identical to SEQ ID NO: 504627

SEQ ID NO: 609933 - RNA, 64 nt, hsa; identical to SEQ ID NO: 504628

SEQ ID NO: 609934 - RNA, 64 nt, hsa; identical to SEQ ID NO: 504629

SEQ ID NO: 609935 - RNA, 64 nt, hsa; identical to SEQ ID NO: 504630

SEQ ID NO: 609936 - RNA, 64 nt, hsa; identical to SEQ ID NO: 504631

SEQ ID NO: 609937 - RNA, 64 nt, hsa; identical to SEQ ID NO: 504632

SEQ ID NO: 609938 - RNA, 64 nt, hsa; identical to SEQ ID NO: 504633

SEQ ID NO: 609939 - RNA, 64 nt, hsa; identical to SEQ ID NO: 504634

SEQ ID NO: 609940 - RNA, 64 nt, hsa; identical to SEQ ID NO: 504635

SEQ ID NO: 609941 - RNA, 64 nt, hsa; identical to SEQ ID NO: 504636

SEQ ID NO: 609942 - RNA, 64 nt, hsa; identical to SEQ ID NO: 504637

SEQ ID NO: 609943 - RNA, 64 nt, hsa; identical to SEQ ID NO: 504638

SEQ ID NO: 609944 - RNA, 64 nt, hsa; identical to SEQ ID NO: 504639

SEQ ID NO: 609945 - RNA, 64 nt, hsa; identical to SEQ ID NO: 504640

SEQ ID NO: 609946 - RNA, 64 nt, hsa; identical to SEQ ID NO: 504641

SEQ ID NO: 609947 - RNA, 64 nt, hsa; identical to SEQ ID NO: 504642

SEQ ID NO: 609948 - RNA, 64 nt, hsa; identical to SEQ ID NO: 504643

SEQ ID NO: 609949 - RNA, 64 nt, hsa; identical to SEQ ID NO: 504644

SEQ ID NO: 609950 - RNA, 64 nt, hsa; identical to SEQ ID NO: 504645

SEQ ID NO: 609951 - RNA, 64 nt, hsa; identical to SEQ ID NO: 504646

SEQ ID NO: 609952 - RNA, 64 nt, hsa; identical to SEQ ID NO: 504647

SEQ ID NO: 609953 - RNA, 64 nt, hsa; identical to SEQ ID NO: 504648

SEQ ID NO: 609954 - RNA, 64 nt, hsa; identical to SEQ ID NO: 504649

SEQ ID NO: 609955 - RNA, 64 nt, hsa; identical to SEQ ID NO: 504650

SEQ ID NO: 609956 - RNA, 64 nt, hsa; identical to SEQ ID NO: 504651

SEQ ID NO: 609957 - RNA, 64 nt, hsa; identical to SEQ ID NO: 504652

SEQ ID NO: 609958 - RNA, 64 nt, hsa; identical to SEQ ID NO: 504653

SEQ ID NO: 609959 - RNA, 64 nt, hsa; identical to SEQ ID NO: 504654

SEQ ID NO: 609960 - RNA, 64 nt, hsa; identical to SEQ ID NO: 504655

SEQ ID NO: 609961 - RNA, 64 nt, hsa; identical to SEQ ID NO: 504656

SEQ ID NO: 609962 - RNA, 64 nt, hsa; identical to SEQ ID NO: 504657

SEQ ID NO: 609963 - RNA, 64 nt, hsa; identical to SEQ ID NO: 504658

SEQ ID NO: 609964 - RNA, 64 nt, hsa; identical to SEQ ID NO: 504659

SEQ ID NO: 609965 - RNA, 64 nt, hsa; identical to SEQ ID NO: 504660

SEQ ID NO: 609966 - RNA, 64 nt, hsa; identical to SEQ ID NO: 504661

SEQ ID NO: 609967 - RNA, 64 nt, hsa; identical to SEQ ID NO: 504662

SEQ ID NO: 609968 - RNA, 64 nt, hsa; identical to SEQ ID NO: 504663

SEQ ID NO: 609969 - RNA, 64 nt, hsa; identical to SEQ ID NO: 504664

SEQ ID NO: 609970 - RNA, 64 nt, hsa; identical to SEQ ID NO: 504665

SEQ ID NO: 609971 - RNA, 64 nt, hsa; identical to SEQ ID NO: 504666

SEQ ID NO: 609972 - RNA, 64 nt, hsa; identical to SEQ ID NO: 504667

SEQ ID NO: 609973 - RNA, 64 nt, hsa; identical to SEQ ID NO: 504668

SEQ ID NO: 609974 - RNA, 64 nt, hsa; identical to SEQ ID NO: 504669

SEQ ID NO: 609975 - RNA, 64 nt, hsa; identical to SEQ ID NO: 504670

SEQ ID NO: 609976 - RNA, 64 nt, hsa; identical to SEQ ID NO: 504671

SEQ ID NO: 609977 - RNA, 64 nt, hsa; identical to SEQ ID NO: 504672

SEQ ID NO: 609978 - RNA, 64 nt, hsa; identical to SEQ ID NO: 557304

SEQ ID NO: 609979 - RNA, 64 nt, hsa; identical to SEQ ID NO: 557305

SEQ ID NO: 609980 - RNA, 64 nt, hsa; identical to SEQ ID NO: 557306

SEQ ID NO: 609981 - RNA, 64 nt, hsa; identical to SEQ ID NO: 557307

SEQ ID NO: 609982 - RNA, 64 nt, hsa; identical to SEQ ID NO: 557308

SEQ ID NO: 609983 - RNA, 64 nt, hsa; identical to SEQ ID NO: 557309

SEQ ID NO: 609984 - RNA, 64 nt, hsa; identical to SEQ ID NO: 557310

SEQ ID NO: 609985 - RNA, 64 nt, hsa; identical to SEQ ID NO: 557311

SEQ ID NO: 609986 - RNA, 64 nt, hsa; identical to SEQ ID NO: 557312

SEQ ID NO: 609987 - RNA, 64 nt, hsa; identical to SEQ ID NO: 557313

SEQ ID NO: 609988 - RNA, 64 nt, hsa; identical to SEQ ID NO: 557314

SEQ ID NO: 609989 - RNA, 64 nt, hsa; identical to SEQ ID NO: 557315

SEQ ID NO: 609990 - RNA, 64 nt, hsa; identical to SEQ ID NO: 557316

SEQ ID NO: 609991 - RNA, 64 nt, hsa; identical to SEQ ID NO: 557317

SEQ ID NO: 609992 - RNA, 64 nt, hsa; identical to SEQ ID NO: 557318

SEQ ID NO: 609993 - RNA, 64 nt, hsa; identical to SEQ ID NO: 557319

SEQ ID NO: 609994 - RNA, 64 nt, hsa; identical to SEQ ID NO: 557320

SEQ ID NO: 609995 - RNA, 64 nt, hsa; identical to SEQ ID NO: 557321

SEQ ID NO: 609996 - RNA, 64 nt, hsa; identical to SEQ ID NO: 557322

SEQ ID NO: 609997 - RNA, 64 nt, hsa; identical to SEQ ID NO: 557323

SEQ ID NO: 609998 - RNA, 64 nt, hsa; identical to SEQ ID NO: 557324

SEQ ID NO: 609999 - RNA, 64 nt, hsa; identical to SEQ ID NO: 557325

SEQ ID NO: 610000 - RNA, 64 nt, hsa; identical to SEQ ID NO: 557326

SEQ ID NO: 610001 - RNA, 64 nt, hsa; identical to SEQ ID NO: 557327

SEQ ID NO: 610002 - RNA, 64 nt, hsa; identical to SEQ ID NO: 56362

SEQ ID NO: 610003 - RNA, 64 nt, hsa; identical to SEQ ID NO: 56363

SEQ ID NO: 610004 - RNA, 64 nt, hsa; identical to SEQ ID NO: 56364

SEQ ID NO: 610005 - RNA, 64 nt, hsa; identical to SEQ ID NO: 56365

SEQ ID NO: 610006 - RNA, 64 nt, hsa; identical to SEQ ID NO: 56366

SEQ ID NO: 610007 - RNA, 64 nt, hsa; identical to SEQ ID NO: 56367

SEQ ID NO: 610008 - RNA, 64 nt, hsa; identical to SEQ ID NO: 56368

SEQ ID NO: 610009 - RNA, 64 nt, hsa; identical to SEQ ID NO: 56369

SEQ ID NO: 610010 - RNA, 64 nt, hsa; identical to SEQ ID NO: 56370

SEQ ID NO: 610011 - RNA, 64 nt, hsa; identical to SEQ ID NO: 56371

SEQ ID NO: 610012 - RNA, 64 nt, hsa; identical to SEQ ID NO: 56372

SEQ ID NO: 610013 - RNA, 64 nt, hsa; identical to SEQ ID NO: 56373

SEQ ID NO: 610014 - RNA, 64 nt, hsa; identical to SEQ ID NO: 56374

SEQ ID NO: 610015 - RNA, 64 nt, hsa; identical to SEQ ID NO: 56375

SEQ ID NO: 610016 - RNA, 64 nt, hsa; identical to SEQ ID NO: 56376

SEQ ID NO: 610017 - RNA, 64 nt, hsa; identical to SEQ ID NO: 56377

SEQ ID NO: 610018 - RNA, 64 nt, hsa; identical to SEQ ID NO: 147194

SEQ ID NO: 610019 - RNA, 64 nt, hsa; identical to SEQ ID NO: 147195

SEQ ID NO: 610020 - RNA, 64 nt, hsa; identical to SEQ ID NO: 147196

SEQ ID NO: 610021 - RNA, 64 nt, hsa; identical to SEQ ID NO: 147197

SEQ ID NO: 610022 - RNA, 64 nt, hsa; identical to SEQ ID NO: 147198

SEQ ID NO: 610023 - RNA, 64 nt, hsa; identical to SEQ ID NO: 147199

SEQ ID NO: 610024 - RNA, 64 nt, hsa; identical to SEQ ID NO: 147200

SEQ ID NO: 610025 - RNA, 64 nt, hsa; identical to SEQ ID NO: 147201

SEQ ID NO: 610026 - RNA, 64 nt, hsa; identical to SEQ ID NO: 147202

SEQ ID NO: 610027 - RNA, 64 nt, hsa; identical to SEQ ID NO: 147203

SEQ ID NO: 610028 - RNA, 64 nt, hsa; identical to SEQ ID NO: 147204

SEQ ID NO: 610029 - RNA, 64 nt, hsa; identical to SEQ ID NO: 147205

SEQ ID NO: 610030 - RNA, 64 nt, hsa; identical to SEQ ID NO: 147206

SEQ ID NO: 610031 - RNA, 64 nt, hsa; identical to SEQ ID NO: 147207

SEQ ID NO: 610032 - RNA, 64 nt, hsa; identical to SEQ ID NO: 147208

SEQ ID NO: 610033 - RNA, 64 nt, hsa; identical to SEQ ID NO: 147209

SEQ ID NO: 610034 - RNA, 64 nt, hsa; identical to SEQ ID NO: 147210

SEQ ID NO: 610035 - RNA, 64 nt, hsa; identical to SEQ ID NO: 147211

SEQ ID NO: 610036 - RNA, 64 nt, hsa; identical to SEQ ID NO: 147212

SEQ ID NO: 610037 - RNA, 64 nt, hsa; identical to SEQ ID NO: 147213

SEQ ID NO: 610038 - RNA, 64 nt, hsa; identical to SEQ ID NO: 147214

SEQ ID NO: 610039 - RNA, 64 nt, hsa; identical to SEQ ID NO: 147215

SEQ ID NO: 610040 - RNA, 64 nt, hsa; identical to SEQ ID NO: 147216

SEQ ID NO: 610041 - RNA, 64 nt, hsa; identical to SEQ ID NO: 147217

SEQ ID NO: 610042 - RNA, 64 nt, hsa; identical to SEQ ID NO: 147218

SEQ ID NO: 610043 - RNA, 64 nt, hsa; identical to SEQ ID NO: 147219

SEQ ID NO: 610044 - RNA, 64 nt, hsa; identical to SEQ ID NO: 147220

SEQ ID NO: 610045 - RNA, 64 nt, hsa; identical to SEQ ID NO: 147221

SEQ ID NO: 610046 - RNA, 64 nt, hsa; identical to SEQ ID NO: 147222

SEQ ID NO: 610047 - RNA, 64 nt, hsa; identical to SEQ ID NO: 147223

SEQ ID NO: 610048 - RNA, 64 nt, hsa; identical to SEQ ID NO: 147224

SEQ ID NO: 610049 - RNA, 64 nt, hsa; identical to SEQ ID NO: 147225

SEQ ID NO: 610050 - RNA, 64 nt, hsa; identical to SEQ ID NO: 147226

SEQ ID NO: 610051 - RNA, 64 nt, hsa; identical to SEQ ID NO: 147227

SEQ ID NO: 610052 - RNA, 64 nt, hsa; identical to SEQ ID NO: 147228

SEQ ID NO: 610053 - RNA, 64 nt, hsa; identical to SEQ ID NO: 147229

SEQ ID NO: 610054 - RNA, 64 nt, hsa; identical to SEQ ID NO: 147230

SEQ ID NO: 610055 - RNA, 64 nt, hsa; identical to SEQ ID NO: 147231

SEQ ID NO: 610056 - RNA, 64 nt, hsa; identical to SEQ ID NO: 147232

SEQ ID NO: 610057 - RNA, 64 nt, hsa; identical to SEQ ID NO: 147233

SEQ ID NO: 610058 - RNA, 64 nt, hsa; identical to SEQ ID NO: 147234

SEQ ID NO: 610059 - RNA, 64 nt, hsa; identical to SEQ ID NO: 147235

SEQ ID NO: 610060 - RNA, 64 nt, hsa; identical to SEQ ID NO: 147236

SEQ ID NO: 610061 - RNA, 64 nt, hsa; identical to SEQ ID NO: 147237

SEQ ID NO: 610062 - RNA, 64 nt, hsa; identical to SEQ ID NO: 147238

SEQ ID NO: 610063 - RNA, 64 nt, hsa; identical to SEQ ID NO: 147239

SEQ ID NO: 610064 - RNA, 64 nt, hsa; identical to SEQ ID NO: 147240

SEQ ID NO: 610065 - RNA, 64 nt, hsa; identical to SEQ ID NO: 147241

SEQ ID NO: 610066 - RNA, 64 nt, hsa; identical to SEQ ID NO: 147242

SEQ ID NO: 610067 - RNA, 64 nt, hsa; identical to SEQ ID NO: 147243

SEQ ID NO: 610068 - RNA, 64 nt, hsa; identical to SEQ ID NO: 147244

SEQ ID NO: 610069 - RNA, 64 nt, hsa; identical to SEQ ID NO: 147245

SEQ ID NO: 610070 - RNA, 64 nt, hsa; identical to SEQ ID NO: 147246

SEQ ID NO: 610071 - RNA, 64 nt, hsa; identical to SEQ ID NO: 147247

SEQ ID NO: 610072 - RNA, 64 nt, hsa; identical to SEQ ID NO: 147248

SEQ ID NO: 610073 - RNA, 64 nt, hsa; identical to SEQ ID NO: 147249

SEQ ID NO: 610074 - RNA, 64 nt, hsa; identical to SEQ ID NO: 147250

SEQ ID NO: 610075 - RNA, 64 nt, hsa; identical to SEQ ID NO: 147251

SEQ ID NO: 610076 - RNA, 64 nt, hsa; identical to SEQ ID NO: 147252

SEQ ID NO: 610077 - RNA, 64 nt, hsa; identical to SEQ ID NO: 147253

SEQ ID NO: 610078 - RNA, 64 nt, hsa; identical to SEQ ID NO: 147254

SEQ ID NO: 610079 - RNA, 64 nt, hsa; identical to SEQ ID NO: 147255

SEQ ID NO: 610080 - RNA, 64 nt, hsa; identical to SEQ ID NO: 147256

SEQ ID NO: 610081 - RNA, 64 nt, hsa; identical to SEQ ID NO: 147257

SEQ ID NO: 610082 - RNA, 64 nt, hsa; identical to SEQ ID NO: 147258

SEQ ID NO: 610083 - RNA, 64 nt, hsa; identical to SEQ ID NO: 147259

SEQ ID NO: 610084 - RNA, 64 nt, hsa; identical to SEQ ID NO: 147260

SEQ ID NO: 610085 - RNA, 64 nt, hsa; identical to SEQ ID NO: 147261

SEQ ID NO: 610086 - RNA, 64 nt, hsa; identical to SEQ ID NO: 147262

SEQ ID NO: 610087 - RNA, 64 nt, hsa; identical to SEQ ID NO: 147263

SEQ ID NO: 610088 - RNA, 64 nt, hsa; identical to SEQ ID NO: 147264

SEQ ID NO: 610089 - RNA, 64 nt, hsa; identical to SEQ ID NO: 147265

SEQ ID NO: 610090 - RNA, 64 nt, hsa; identical to SEQ ID NO: 147266

SEQ ID NO: 610091 - RNA, 64 nt, hsa
aacccagagggcugcauuuuggguugaguaauauggacaccauggaaguacaggaucugagucc

SEQ ID NO: 610092 - RNA, 64 nt, hsa
caauagaaaccauucacacacuccguucaugcauggacaccagaagacgauucagaacacaaga

SEQ ID NO: 610093 - RNA, 64 nt, hsa
ccaggccucuaaccaucugacagagacucggccuggacaccaugcgaugcacucuggcaccaag

SEQ ID NO: 610094 - RNA, 64 nt, hsa
acucccgugacucaucgaggagcuccagcuguugggacaccaaggagccugggagcacgcagag

SEQ ID NO: 610095 - RNA, 64 nt, hsa
aggcucaccggacccuggggcagagcugagcuugggacaccagcgggaacagggcaccccuucu

SEQ ID NO: 610096 - RNA, 64 nt, hsa
gacuuccagaucaugguucucccuuccucccugaggacaccaaauuggaugagagcaaguuuga

SEQ ID NO: 610097 - RNA, 64 nt, hsa
gcugugaucuuugccccacccgaauaaugcauauggacaccacaccuugccugccguguccagg

SEQ ID NO: 610098 - RNA, 64 nt, hsa
ggaagagggaaauucagacacagaugcauagggaggacaccaugccgugacagaggcagagggu

SEQ ID NO: 610099 - RNA, 64 nt, hsa
cccaccaaguacgcagagacccccuugucguccuggacaccacaggggcaccugcaggcuggga

SEQ ID NO: 610100 - RNA, 64 nt, hsa
gccugggccauggagcacucugagaucucaucgcggacaccacugcccacaccuccaucccguc

SEQ ID NO: 610101 - RNA, 64 nt, hsa
auaauuugggaaggaauggaagauggacaccaccggacaccaccagacacuaggaugggaugga

SEQ ID NO: 610102 - RNA, 64 nt, hsa
ccuuacuuccauaauuugggaaggaauggaagauggacaccaccggacaccaccagacacuagg

SEQ ID NO: 610103 - RNA, 64 nt, hsa
ucaaaggugggaagagagccuggaaaagaaccaggccuggaaaagaaccagaaggaggcugggc
